United States Patent 10,766,935 (PLANT TRAITS CONFERRED BY ISOLATED POLYNUCLEOTIDES AND POLYPEPTIDES) - sequence listing, part 4

SEQ ID NO: 4620 - DNA, 1809 bp, Amorphophallus konjac
gactgggagaggagtgagaagggagggagggaggtgtgggtttgtggtggttctccgcccatggcgtcgttgccgctggggcctcgccatccgccggagcagcagccgcatccgcacccgcaggcggtgcagcagcagcaccctcaggaggcgatggcgaagatcccgcaccgccggccggagatgggcgacgagaaggaagcatcagttgttgaggggaacgatccacttactggtcacatcatctcgacaaccattggaggaaaaaatggggagcccaaacgaacaattagctatatggctgagcgagttgtaggaactgggtcttttggaattgtctttcaggcaaagtgcttggagactggggaaactatagccataaagaaggtattgcaagacagacgatacaagaaccgtgagctgcaactgatgcgctcaatggagcatccaaacgtgatatgtttgaagcactgtttcttttcaacaacaagtagagatgagctttttctcaatttggtcatggagtatgttcctgaaaccgtataccgggttttgaagcattatagcaatgtgaaccagaggatgccacttatttatgttaaactctacacttaccagatttttaggggattggcatatatccacactgtccaaggcatttgccatcgtgatgtaaaaccgcaaaatctcttggttgatcctcttacccatcaagtgaagctttgtgactttggtagtgccaaaatattggttaagggagaagcaaacatatcatacatatgctctcgttattatcgtgctcctgagcttatatttggtgcgacagaatacacaacatcaattgatatatggtcagctggttgtgttcttgcagagttacttcttggccagccattgtttcctggagaaagtgctgtagaccagcttgttgagataatcaaggttcttggtacaccaacacgagaagaaattcgatgtatgaatcctaactacacggagtttaagtttccacagataaaagctcatccttggcacaaggttttccacaaacggatgcctccagaagcaatagatcttacatcaagacttcttcaatactcaccaagtctgcgttgcacagcactagaggcatgtgcccatccattctttgatgagctaagggaacccaatgctcgtttgccaaatggtcgccctctgcctccacttttcaacttcaaacaggaactagtgggaacttcacctgagctgattaacaagttgattcctgaacatgtgaggcgtcaagctggtctgaatttcttgcaccctgctggcacgtgagatagctgcctggcggccaatagtttctctctctacttctagtctcctatgtgccaatcataaccaactaaagattggccatcttagcccctcatgcactaaaagcgggcgatgtgggtggatgtgacgatgaagctgaaaaccaacggggagacgttggcgcaacctctcttccatattgccgttgttcctggcatgtgtatattatctctttaggataaatcttttgagaagcaatctttttagtaataggtagttcaatggatgggatggggataaatggctggggagagggtgtgtgttcatgatgccgtttgtatcggggggctggagggcgagagtgctgttttccatttttgttttgcagttattttaggttcttgcagccccatatgtcagcgttgttgttagaagtcactgtttttttaatgtacatgtttggaatctgcaaaatggaaatttcatggttatgttctattcgatcgcagg

SEQ ID NO: 4621 - DNA, 2145 bp, Aristolochia fimbriata
cctctttgatgttttgatggttggagtggatagcgatctgtaagtttttcgatcttcttttctggcgatctgggaggaaacctgtttctccttgttctctgattgtctgggaatctcttctcctctggccatggcgactatcccggaaataacaacctccgttgtcgagggaaacgacccagttacaggtcacatcatctcaaccacaattggagggaaaaatggtgaagccaagaggaccatcagttacatggcagagcgtgtcgtgggaactggttcatttggaattgttttccaggcaaaatgtttggaaactggagagacagtggccataaaaaaagttttacaggatagacgatataaaaaccgtgagctacaattaatgcgctctatggaccatcctaatgtcatatctctgaaacactgtttcttctctactacaagcaaaaatgagctgtttctaaacttagtcatggagtatgttccagaaactgtttaccgggtcctgaaacattacagcaatgtgaatcagagaatgccgttgatttatgtgaaactgtacacataccaaatatttagagggctggcttatattcatacagttcccggtgtttgtcatagggatgtgaagcctcaaaatcttctggttgatcctcttacgcaccaagtcaaactttgtgattttggaagcgccaagattctggtcaaaggtgaagcgaacatatcatatatttgttcacgttactaccgtgctcctgagctcatttttggtgcaactgaatatacgacatcaatagatatatggtcagccggttgtgtccttgcagagctgctacttggtcagccattgtttcctggagaaagtgcagtggaccaacttgttgagataatcaaggttcttggtactcctactcgtgaggagattagatgtatgaatcctaattacactgagttcaggtttccacagataaaagctcacccttggcacaaggttttccacaaaaggatgcctccagaagctatagatcttgcttcaagacttctccaatactccccgagtcttcgttgcacagcgctagaggcatgtgctcatccattctttgatgaacttcgagagcctaatgctcgacttccaaatggacgtccatttccccctttgttcaactttaagcaagagttgtcaggtgcatgccctgagctgataaacaagttaataccagagcacgtgagacgccaatctggtctcagtttcttgcacctagctgggacgtgaaagcttgctgtgcagtgatgatggacataagtaatggtatagtcgccaagggaattggggatgtccagcgcaggcaaaattacatagaagcaggcatacggaaggggtcttgaaattgcttgcatgtttcaattttgccggcaattcagcattatgtatatcgtaaaaagatttggatcaggtggatcagaaggcctgttgtgagtatatgagaagatggggaaaaatggaagtggttagggaatggcaatggaagggggaggcagttctgtttttacatggtgtttggcttgtgttcgtggtggctacgagctgctcaaaatgtgtcaaaggttggttagtttcgtttccacttcttttttttcttttaatttctttttcttttctgggtaatgtagggggcctctagtttaaatccggacggtcggacgtgggttttaaactttttttattgatttcctgtacatgtttcctttaatctggatctcaatgctgccaatgaaaatttctgttctcttatgaaaaggccaacactgcgctttataaaaatctggcactgtttcattctgttgaatatgaatttatggctgatgtctttatttattatcttctgcaataccgacgggtcacagctcagcttggtttgttcagtgaatttgcctacactacttgtacctgcttcttgtaaacctaataaatgtatgggaatgttactattcatctctggccacactttactggctatcaatactgtatggctagtggtttcgatatttatttcggtgagagacgacgttcgaaaatagccacgaagcgagcccaagtgtgggagtgaagaagtcctctttctgtaattgttctcagaaattgtt

SEQ ID NO: 4622 - DNA, 1618 bp, Cenchrus ciliaris
cgaggagagagaaaccagccgcagatcagccaccgccccacatggccaccgcgcccggtggtgggcccctccccgccgccgccgacgccatggaggtcgacccgccgcgcgcctccgccgacgagaagcatgttgccactgttatggggggaaatgatgctgtcactggccatataatctcgaccacgattggtggaaagaatggtgaaccaaaaaggaccattagctatatggctgagcgagttgttggaactggatcgtttggggttgtcttccaggcaaaatgcattgagacaggcgaaactgttgccattaagaaggttctacaggacaaaagatacaagaatagggagttgcagataatgcgatcgattgaccattgcaatgtcatttccctgaagcattgtttcttctctaccacaagtagagatgaacttttccttaacttggtcatggagtttgttccagagtcactctatcgtgttctgaaacattacaaagatatgaagcagaggatgccccttatatatgttaaactgtacatgtaccagatattccggggattagcttatattcataatgcaccaggagtttgtcaccgggatattaagcctcagaatattttggtggatcctctttcccaccaagtcaaggtttgtgacttcgggagtgctaaaatcttggttaaaggtgaagcaaatatctcgtacatatgctcgcgttactatcgtgctcctgagctcatatttggtgcaactgaatacacaacatctattgatatatggtctgctggatgtgttcttgctgagcttcttcttggtcaacctttgtttcctggtgaaagtgctgtggaccagcttgttgagattatcaaggttttgggtactccaacacgagaggaaatccggtgcatgaatcccaattacacagaattcaagtttcctcagataaaagcgtgtccatggcacaagattttccacaagcgaatgcctccagaagcaatagatcttgtttcccgccttcttcagtattcaccaaatctgcggtgtagcgctcttgaggcgtgtgctcattcattctttgacgagttacgagaaccacatgcaaggctcccaaatggacgaccattccctccactgttcaactttaagcaggaactagcaaacgcatcaccggagcttatcagcaagctgttaccagagcacgctcgaaggcattcaggatttaattctttatttgggactggaccataggaaggattgaaatgtcgctgctggtactgccaaagggcaatctgcatttcccgcatttaagttttagaacctgaccatcttgtcgaagttgagccagctttaaaaaaagaaactaatgttgaaacccgaggtggctattgtgtccatgttctgctaggaacggcacatatttgctagagggtaacggttggtgtattgttaagcatgggggtaacttaattagcttatgtgttttttcatgtttcatgtctctagcgcacctgtacctgttacctgaacattgtactattcgcaactgatgtaaccatgtaaatgtgtcttgccctgtcgtgttatgatggtcaagtcgcatcttgttctggctc

SEQ ID NO: 4623 - DNA, 1644 bp, Fagopyrum esculentum
aaagtacagagatagagagaggggaaaccacatgagctcgctgcccttgggaccgcagtcacacaatccgccaccggagcgccaccacattgattctacagcaaggcctcctcaccgtcctcctgaatcaatggctgacgataaggaaatgtctgcagctgtaatagaggggaatgatcaagttacaggtcacattatttcaacaaccataggtggtaaaaatggcgaacccaaaagaacgattagctacatggcagagcgtgttgttggcactggctcgtttggtgtggtatttcaggcaaaatgcttagaaactggcgagactgtggctataaagaaagttttgcaagataggcgttacaaaaatcgtgagctgcaattaatgagattgatggatcacccaaatgttatctcgctgaagcactgtttcttttcaaccacaagtagagatgaactttttctcaatcttgttatggaatacatgccagaatccttataccgcgttcttaagcattacagcagtgtaaaccaaaggatgccgcttatttacgtcaaactttatacttatcagatctttcgtggactggcatatatgcatactgttcctggtgtctgccatagagatgtgaagcctcagaatcttttggtggatccactgacacatcagctgaaaatatgcgatttcggaagtgcaaaagtcttggtcaagggggagccaaatatctcttacatttgttctcgatactacagggcaccagagttaatttttggtgccactgaatatacaacttcaattgatatttggtcagtaggctgtgttcttgcagaacttcttctaggccagccactatttccaggtgaaaatgcagttgaccaacttgtagagattatcaaggttctcggcactccaactagggaggaaattcggtgcatgaatccgaactatacggattttaggtttccgcagattaaggctcacccttggcacaaggttttccataagcggatgccacctgaagccattgatcttgcttcgaggcttcttcaatattcacctagtcttcgctgcacagcactggaagcatgtgcacatcctttctttgatgagttaagggatccaaatgctcgtcttcccaatggacgtccgttaccaccacttttcaatttcaagcaagagttggctggagcaccacctgagcttatcaccaaactgattccagaacatgtgagacggcaaatgggcttcccgatttcgggatcaacatagaagttcaccaagagacaaaaactcactgcagcaagcaaatgatacaatgatcgtgaagcaatgggaagctaatcaaatatcagtattttatatggcaacaatcgcctggcctaaatgatcatcttagagatatctgggctagaatcggagattacattctctttgttgcctgttaccttatctttgtatatgatctttagtaaaggttagccaatacccagaaaagcagaaccaatctgggatagataggcctataattagggcggatgctgcactttatgagatctaaatatgccctgactattttaggtttatgcatcagtaagttgaatatcttatgttctgaaatgtttttatttgccaaaatagatatattt

SEQ ID NO: 4624 - DNA, 1838 bp, Citrus clementina
agacagaagagagagaaagtaaagcaaagcgaaaaagaaagaaaagaggggagagagagggagagagagagtgagtgtatgtgtattgaattgagagtttgaagctgtagcagctgtaacccacatggcttcaatgcccttggggcctcagcctcagccaccgccgccaccacaagcacaagccccaccatcgcagcaaccgcacttcgacaatgacctgctgaaacgacaccgtccggatatggactccgacaaggaaatgtcagctgcagttattcaggggaatgatgctgtcaccggccacatcatttctaccacaattggaggcaaaaatggcgaacccaagcagacgatcagttacatggcagagcgtgttgttggtactggatcattcggtatcgtttttcaggcaaaatgcttggaaactggagagacagtggctataaaaaaggtcttgcaagacaggcggtataaaaatcgtgaactgcagttaatgcgtttgatggatcacccgaatgtgatttcccttaagcattgtttcttctccacaacaagtaaagatgagctttttttgaatttggttatggaatatgttcctgagactatgtaccgggtgctgaagcattacagcagtatgaaccagaggatgcccctcatctatgtaaaactgtatacatatcaaatctttaggggcttggcatatactcatacagttcctggggtctgccatagggatgtgaagcctcaaaacctcttggttgatccactcacccaccaggttaagctttgtgattttgggagcgcaaaagttctggtcaagggcgaagctaatatatcgtacatatgctctcgatattaccgagctccagaactgatttttggtgcaacagagtatactacatcgattgatatttggtcagctggttgtgttcttgccgagctgcttctaggccagccattatttccaggggaaaatgcagttgaccaactagtagagattattaaggttcttggtactcctactcgggaagaaattcgatgcatgaatccaaattatacggattttagatttcctcagattaaggctcatccttggcacaaggttttccacaagcgaatgcctccggaagcaattgaccttgcatcaaggcttcttcaatattcacctagtctccgctgtactgcgcttgaggcatgtgcacatcctttctttgatgagcttcgtgaacctaatgcccgccttccaaatggtcgcccctttcctccgctttttaactttaaacaggaattagctggagcttcacctgaactgatcaacaggctgataccagagcatgtgaggcggcaaacaggtcttagcatgccacattcagctggcacgtaaatatggtgacatgaaacaagtatcaagaatgccattggtggagggaagtgaatgaaagaaccttcctggtcaacatatattcaacattttggcctagttggtggatcttcgcaccgtgcaaagatgtatgcatatactggcttttgtgcaaagatgtatgcatatactggctttttggcttaaccttgaagttgatgattctgtctactatgtcgatcatgctatttccctacttttttgtacattgttttgagtgcaaggattctgaaaagctaggagtataagaaaaggtgactgtatttatgtctagctaggtaggagttgcaaatcccagcaagagctcaagggctcagtactgtagtagtttggcttgctttcttgcttgaacttggtgttattttcacattatgtccatgctgatctcaaatggaaactagatttcgctattgatccc

SEQ ID NO: 4625 - DNA, 2730 bp, Zea mays
cccatttccatctccggtggaaagccgttttgcaaggggagattcaagtgccacccggactgacacattgaccatgtccacctccggcctcctccactgccaaatctcattcttccataccatactcctcaaattacagatacagacatatagggacccatgtgtaaaactcttgcagcgctaacgacaccggtacggtattctcgaaattctcctgtccttgcctacaaaattcctcattctcgtagcagcgtagtgggtggcggtctggcggaggacaggaaggaaaaacaaggcgaaaaaggaggttcggggcgggttccatggcgctgccttcctagcccagccgcctcaccaacctccctcctcaccgaggagagaccgaggcgccaagagagaacaggacactacgagaagaggaggttcatttccgcgtcgtctccgccagcagccccacccaccacatggcagccatgccgggtggggcccacgccgccggcgccgcggaccagatgcaggtggaccagccgctccccgctgcggccgcacacggccccgcggacgccaagcatgctggttctatgattgaagggaatgatccagtcacgggtcatataatctcaacaaccattggagggaagaatggagagcctaaaaagactatcagctacatggcagagagagttgtgggaactggatcattcggaatcgtcttccaggcaaaatgtctggagactggtgagactgttgctatcaagaaggttttgcaggacaagcgctacaagaacagggagctgcaaatcatgcgatccatggatcactgcaatgctgtttccttgaagcattgtttcttctccaccacaagcagagatgaactttttcttaacttagtgatggagtttgttcctgagtcactatatcgtgtgctgaagcactacagcaatatgaaccagaggatgccgcttatttatgttaaattatatacctaccagatatttcgaggtttagcctatattcacacagtacctggtgtttgccacagggatgtgaaaccacagaatcttttggttgatccattgactcaccaagtgaagatatgtgattttgggagtgccaaaatgttggtcaaaggtgaagcaaacatttcatatatatgctcacgttattaccgtgctccagagctcatatttggggcaaccgagtacacaacatcaattgatatttggtcagctggatgtgttcttgctgagctgcttcttggccagcctctcttccctggcgaaagtgctgtggatcaacttgttgagataataaaggttcttggtactccaacacgtgaggaaatccgttgtatgaatccaaactacaccgagtttagatttcctcagatcaaagctcacccatggcacaagattttccacaagcggatgcctccagaagctatagatctcgcttcacgtttgctccagtactcaccaaatctaagatgcactgctcttgaagcgtgtgcacatccattctttgatgagttgcgagagccacatgcgaggttgccaaatggacggccatttcctccactgttcaactttaaacaggaactagcaaatgcctccccggagctcatcaacaggctgatcccagaccatgctaggcggcatcttgggctcactttattgcccaccgctggaccataggcgaaggctctatggtgtttaaaccttgctctttctgattcttcgttgtgccataggcaattcaaggtgtagaatctgaccattattggaaagccaaacacgagctggcgccaatgtgttgcataaggagaggcggtatgttcgtgcagccagccttttgccgcctgttttaatgcaaaatctgattttacttaagcagtgtgaggggaagtgggttggtgtattgttaagctattgaaggaattcaatccctggtattgtattactttctccaacgttaaatgttgtagttcgcctgtaagtgttccacatcgcctgttatcagtccgcaatccttcgtgtaaatgttattaatgaaaaaaatacatcttgctatgttaccgatcgactcattccaatcacattccgtcctgttgcaaacaaattcttgttttcattgtcagtcgtgctgatcgggaattgtttccagcatcttcctgcaaggaagtgttaattctgaatggttgtaccacttccgttgctatgagttcttaacttctttgttatgatctaatcctgagtgaattgtcatcttagatttctgaatggttgttgtaccacttccgttgctatgagttctttaacttttttgttatgatctaatcctgagtgaattgtcatcttagatttctgaatggttgttgtaccacttccgttgctatgagttccttaacttctttgttatgatctaatcctgagtgaattgtcatcttagatttttcatcggatggcatgcatctagtgcaaaggcagaagagccaacaaaggtatatataattgggggaataaaagaccggtgagggcgaatggattctgtgggctacagcctactggcagtggcgtggtccattggcgattgattctgttcgttagtaggccgccatttattcgctttatttttttcgcgacgccgacaccgtgatacgctcagttttctgtctcaacgacattttatagtgccgttgttttgttccttgtaaaggtttcttgggttcac

SEQ ID NO: 4626 - DNA, 1700 bp, Tripterygium wilfordii
aatagtaagagagagaaagcaaagttgaaacttgaaagctgttgagcacatggagtgaggggtctgaccgaaccatcatcaaccaccacgaccacagcaatactgaagccgacgccatgtcccactcttcctgagccaccggcaccactacttgcgtcggcgctccgattatggactccgataaggaaatgtcatctgctgttattgaggggaatgatgcagttactggtcagataatatgcacgaccatcggaggcaaaaatggggaacctaaacggactgtcagttatatggcagagcgtgttgtaggtactggatcatttggaattgttttccagtcgaaatgccttgaaacgggagagacagtggctattaagaaggtcttgcaggaccggcgatataaaaatcgtgaactgcagttaatgcgcttgatggatcacccaaatgttatttccttgaagcactgttttttctctacgactagtaaagacgagctttttctcaatttggttatggaatatgtccctgagaccatgtatcgggttctgaagcattacagcagtatgaaccagaggatgccacttatctacatacaactttatacgtatcagatcttcagagggctggcatatattcattctgttcctggagtttgccatagagatgtgaagcctcaaaatttgttggttgatcctctcacgcaccaggttaagctatgtgactttggaagtgcaaaagttttggtcaagggagaagcaaacatctcatacatatgctctcgttattaccgagctccagaactcatcttcggtgctacggagtatacaacgtcaattgatatttggtcagctggttgtgtccttgctgagcttcttctgggccagccgttgtttccaggagaaaatgcagtggatcaacttgtagagatcatcaaggttcttggtactcctactcgagaagaaatccgctgcatgaatcctaattatacagacttcaggttccctcagattaaagcttatccttggcacaaggttttccacaagcggatgcctcctgaagcaattgacctcgcttcaaggcttctccagtattcaccaagtcttcgttgcactgcacttgaagcatgtgcacatcctttttttgatgagcttcgtgagcccaattcccgccttcctaatggtcgccttttacctcctcttttcaacttcaaacaggaattagctggggcctcttctgaactgattaataggctcatacccgagcatataaggcgacaggctagtcttagcttaccacatcctgcaggcacgtaaaagggaaggcatatgaataagaaatcaattcttggagtcaatgcttatgaaacagaggatgaccttggtaagatcaatacaatcattttgttatcagtggattctcttggcccgtgatggatgtctagcggtgtagctaaatcatagtgtttctgtgcctttgtatatattgttttgataaaaaagagtggaaaagctaagggagtaaaaggaggtattacaatctgtctagctagttagggggacacaataaaatcccagctgttgcttgagctcgttagtggtttggcttgcttttatgtaagaggaagacattgtattgtctgttgttggccgtgttctgcagacacaaaacgaaatttcacaatttatggttactacaaaatc

SEQ ID NO: 4627 - DNA, 1932 bp, Eucalyptus grandis
gtcgagccagaagagagagaaaatcgtatttagagagagagagagagagagagagtgagggaaagagtgtgaaagtctagagagagagagagagagagggcgtgcttgtgctgcgttgttgctcacatggcctccatgccctcggggcctcaccaccaccacctcctccaccaccaccaaccgccgccgccgccgcggccggagaacgacccgccgaagctcgccccgcggcagcatgatccaatggacaccgataaggaagcgtcaccctctattattgagaataatgaggctgtcactggtcagattatttcaaccacaatcggtgggaaaaatggcgaacccaagcagaccatcagctataaggcggaacgtgttgttggcaccggatcttttggagtagttttccaggcaaagtgcttggaaactggggaaatggttgccataaagaaggttttgcaggacagacgctataaaaatcgagagctgcagctaatgcgtctaatggatcacccaaatgtggtttctttgaaacattgcttcttctctactactagtagagatgagttgtttctgaatttggtcatggagtacgtacccgaaaatatgtatcgggttctgaagcattacagcagtatgaaccagaggatgccccttctttatgtgaaactctatacatatcaaatatttcgagggctagcatacattcataacgttccagcggtttgtcacagggatgtgaagccacaaaaccttctggttgataatgtgacccaccaagtcaaactctgtgattttgggagcgcaaaagttcttgttaagggcgaaactaatatatcatacatatgctctcgctactatcgggctccagagcttatatttggcgcgacagaatacacgacatcaattgacatttggtcagcgggttgtgttcttgctgagcttctccttggtcagccattatttcctggggaaaatgcagtagaccaacttgtagagattatcaaggttctcggtacacccactcgagaagaaattcgatgcatgaatccgaactacacagacttcagatttccccaaatcaaggctcatccttggcacaaggtatttcacaagaggatgcctcctgaagcgattgaccttgcatcacgactgcttcagtattcaccaagtcttcgctgcactgcgctggaggcatgtgcccatcctttctttgatgagttgcgtgagccaaatgcacggcttcctaatggtcggccttttccgcctctattcaactttaaacaagaattggctggggcatcacctgaattgattaacaggctgattccagagcatgtgaggaagcagaatattctcaatttccctcatctggctagtacataagcgtagaatgcaaaacgaggagtcaatcatctagtacttgatggaagtgaacataactgaggacaatctgtgtgttctgcagtttcagccctgcaatcggcttttctcgccctgcaagatgtggaaatggtgatatctcagcttttaacatggaaagcggttgactgtcttctcatgtcgttctagcgaagaaagatagtatttccttggatgtacatcgttttgatcctaaactctagaaaccttaggagtataaaaatgtgatgctatttatgtctagttatgtaggggcattacagacccaaaaaggagcttaagaagctcatttaagttagtatggcttccttctttttatatgttgaagaagaatgtggtgtttgtttccagcctgtgactgggtgccatcattaacctactgtggggcatcgagatctcggtccaagtttgttccattttgtcttctttcatggaattcgatgactctttcgctaccaaaaaaaaaaaaaaagatcgcctgtctatccaccccatagcggctagatgcat

SEQ ID NO: 4628 - DNA, 1852 bp, Fragaria vesca
agagagagagggggtggtggtgtgtgtgagagagagactcagcatctctcacatcacatggggtctttgggtttggggccaaagcatcatcaccaagcagaggcacaaccacagcgacaagcagacctcaatgagccactgaaccacgtgccccgccgcccctccgatatggactcccacaaggaaatgtcggctcctgttattgagggaaatgatgcagtcactggtcacatcatttccacaaccattggtgggaaaaatggtgaacccaaacggacgataagttatatggcagagcgtgctgtaggtactggatcatttggaattgtatttcaggctaagtgcttggaaactggagaaacggtggccataaagaaggtgttgcaggacaggaggtataaaaatcgagagttgcagctgatgcgtttaatggatcacccaaatgttgtttccctaaagcattgtttcttctctacaacgactaaagatgagcttttcctgaatttggtcatggaatatgtacccgagactatgtacagagtactgaagcactatagttctatgaaccagaggatgccactcatctatgtgaaactttatacatatcaaatttttaggggccttgcttacatccacgctgttcctggggtatgccatagagatgtgaaacctcaaaatcttttggttgatcccctcacccaccaggttaagatttgtgattttggaagtgcaaaagtattggtcaagggtgaagcaaacatttcctacatatgttctcgctactatcgagctcctgagctcatctttggtgcaacggagtatacaacatccattgatatctggtcagctggttgtgttcttgctgagctccttctaggccagccgttgtttccaggagagaatgcagtggatcaacttgtagagattatcaaggttcttggtactccaaccagagaagaaattagatgcatgaatccaaactataccgattttaggttccctcagatcaaagctcatccttggcataaggttttccacaaacgaatgcctccagaagcaattgaccttgcttcacggctccttcagtattcaccaagtctacgctgcacggcgcttgaagcatgcacacatccgttttttgacgaacttcgtgagcctaatgcacgtcttccaaatggccgccctttgccgcctcttttcaacttcaaacaagaattaaatggagcatcacctgaactgatcagcaggctcataccagagcatatgcgacagcagattggtcttggattccctcacccagcaggtacttaaatgtaaagtcatgaagcaaggaatcatctcttcttctagtggatggagcaaagcaaaatcaggcatgtttgtggtccatataacattgagcattttggcctaatctgctgttgtccccctttcgaagatgtatacatatactctctcaggcttaatgtggaaatcagtaatcctgtctatgtcaattttagcctaaacatattgtcttactgcatctgtacatcgttttgattgtaaggattccagaaagctaagtgtaaaagaaggtgatgttattcgaatgacgctagtaggggttgtgaaagtcttgcaggacccggagggtatttatagtagtgcggcttgttcttctcttttaattattgtgttgtttctattgttgcctcagttacgtttttacaattgatgattattgtgtccacactagggcattgtttcagttctccgctgagtaacattgtggagtgcctgctgtgtttggaatgtcttgctgttcaggaaccttgactggtgggagttgattaagattgatgttcatatc

SEQ ID NO: 4629 - DNA, 1485 bp, Allium cepa
gttgctttttcgccccctttccttctccttcatccccttccatggcggaagacaaggaacactctatgatggagacaagtgatcctgtaacaggacatatcatctcaacgaccattggtggcaaaaatggtgaaccaaagagaacaattagttatatggcagagcgtgttgtggggactggatcatttggaatagtgtttcaggccaaatgcttagaaacaggggagacagttgcaataaagaaagtgctacaggataagagatacaagaacagagagctacagctgatgcgaacaatggatcatcctaacgtagtttctttgaaacattgctttttctcaaccacaagcagagatgaactcttccttaatttggtcatggagtatgtgccagaatctttatatcgggttttgaagcattataacaatgcaggccagatgatgccacttatatttgtgaagctctacacatatcagatttttagagctctagcttatattcatgctgttcctggcgtttgtcatagagacgtaaagccacaaaacatactggttgacccgcttactcatcaagtgaaattgtgtgactttggaagcgctaaaattttggttaaaggtgaagaaaacatatcttacatttgctcccgctattatcgtgcaccagaacttatatttggtgcaacagaatacacaacgtcgattgacatatggtctgctggttgtgtacttgctgagttactccttgggcagccattatttccaggggagagtgctgttgatcaacttgttgagataatcaaggttctcggtactccaactcgagaggaaattcgatgcatgaatcccaactacactgatttcagatttccacagattaaagctcatccatggcataagatatttcacaagaggatgcctccagaagcaatagatctcacatcacgacttctccagtattcaccaagttttcgatgtactgcgttggaagcatgttctcatccattttttgatgagttgcgtcaacctaatgctaggctcccaactggtcgcccgttgcctccacttttcaacttcaaacaagagttgactggagcatcaccggatcttatcaatagactgattccagaacacgtgaagaagcagtctggtctcaatttattccatttggccgggacataattctgcatttatcataatatccgtgagttgaatgttactaagtaaagagaaaacttcatggtttatattttacttagatgaagttgttgcaaagtgaggtcacttgagtccagatcgggagataagagactcacaagtccatccatagtagttttaatctgttttctgtatattgtattatatatttatagtttattaggattcttgtgaggataaatatagttgtgagtagaggaatgaatgaatgaattctggccgaagcaaaaggagagattctcccggttttcgatgttgtatccagttcacg

SEQ ID NO: 4630 - DNA, 1652 bp, Phalaenopsis aphrodite
tgagccagacatcacccattcaacctgaaatatgaccagggaaaggaccggatgacgtggcatcatgttgatctcatgttacagatgtggggtccactgtagggttcagtttttatcgatgtgggtgtaaattgaaacgaagggagaggagagagagagaggttaggtgggagagcttcacattgtcgtcgcatcctgctcaggagggtgagatggcgctgagggttgaagatcatcggccggagatggcggaggagaaggaaacctctgttgtggaagggaatggccctgtcactggacatatcatctcaaccaccattggaggaaagaatggagaagctaaacagactgtaagctacatggccgaacgtgttgtcggaaccggatctttcgggattgtcttccaggcgaaatgtttggagacaggggagactgtagccataaagaaggtcttgcaggatagaagatacaaaaatcgcgagcttcagttgatgcgatcgatggaccacccaaatgtgatatccctgaagcactgcttcttctccactaccaataaagacgaactttttctcaatctggtaatggaatacgtccctgaatccctttaccgtgttctgaaacactacagcagcgcgaatcaacgaatgcctcttatctatgtgaagctttatatgtatcagatttttagggggttagcatacattcatactgttccaggagtctgccatagggatgtgaagccccaaaaccttttggttgatcctcttactcaccaagttaagctctgtgattttgggagcgctaaggtgctggtaaaaggagaagctaacatatcttacatttgctctcgatattaccgagctcctgagctcatatttggtgcagtggaatatacctcatcaatcgatatatggtctgcaggatgtgttcttgctgagttgttactcggtcagccgctctttccgggtgaaagtgctgttgatcaactggttgagataattaaggttcttggcactccaactcgagaagaaattcgatgcatgaatccaaactacactgaatttcggtttcctcagataaaagctcatccttggcataaggtttttcataaacgaatgcctccagaagctatagatcttgcatcaaggcttcttcaatattctccaagtcttcgttgcactgctcttgaagcatgcgcccaccctttctttgatgagctacgagagcccaacgctcgattaccaaatggcaggccattccccccgctttttaactttaaacaagaattagcaggcgcatcactagagcttgtcagcaagctgatacctgaacatgtgagaaggcaggctggtctcactattcttcatccttcaggtacctgaaattctattttttagtctttttgatgtgggattatgttaagatccaaagggcaaatatataaccctttgattttttcataaaccttagttgtatagtagatgaattccaagtttttgtgcttcattcttccccacactcttgtatatttgcccagtaaaaataggatgcattttatttttaaaaaaattattttagatgatttggggagtggactatggtggtggaacctgtaatgttgtattattatttaagacaacaaattgtatttg

SEQ ID NO: 4631 - DNA, 1641 bp, Fagus grandifolia
agagagagtctagtctagtctgtctctcacatggcatccatgcccttggggctaaaccatcaacaaccacaagcagtgattaatgagccacaaaagctagtgcctcgccgctcctctcaaatggactctgataaggaaatgtcagctgcagtaattgaggggaatgatgcagtcactggacacatcatttccaccaccattggaggcaaaaatggcgaacctaaacagactatcagctacatggcagagcgtgttgtaggtactggatcatttggaattgtttttcaggcaaaatgcttggaaactggggagacagtggccataaagaaggtattgcaggacaggcgatataaaaatcgtgagttacagttaatgcgcttgatggatcacccaaatgtggtttccctgaagcattgtttcttctctacaacgagtaaagatgagctctttcttaatctagtcatggaatatgttcctgagactatgtaccgggttctgaagcattacagcagtatgaaccagaggatgccccttatctatgttaaactctacacgtatcaaatttttagggggctggcatatatccactctgttcctggagtgtgccatagggatgtgaagcctcaaaatcttttggttgatcctctcacccaccaggttaagctttgtgactttggaagtgcaaaagtcctggttaagggcgaagcaaatatatcgtatatatgctctcgttactatcgggctcctgaactaatatttggtgcaacagaatatacaacatcaattgatatttggtcagctggctgtgtcctcgctgagcttcttctgggccagccattgtttccaggagaaaatgcagtggaccaacttgtagaaattatcaaggttcttggtactccaacaagagaagaaattcgttgcatgaatccaaattatacagattttaggttccctcagattaaagctcatccttggcacaaggttttccacaaacgaatgcctcctgaagcaattgaccttgcttctcggcttcttcaatattcaccaagtcttcgctgcactgcgttagaagcatgtgtgcatcctttctttgatgagctacgtgagcccaatgcccgccttccaaatggccgcccattgcccactctttttaactttaaacaggaattacaaggagtgtcacccgatttgatcaacaggctcataccagagcatgtgcggcggcaaactggtctcagcttcccacatccagctggtacgtaaatgtaaagcctgatgtgatgaggaaatcaactctggtagtgatgaatgtagaaaccaaggatggcttcttttgcggtctatgtaaccgagcattctggattaatgagctagttttttcttgccccctgtgaagatgtatacatatatactggctgttcagcttaacctggaaattggtgattctgtctactatgtcattttagctaaaatatactatttccctacttctgtacattgttttgatcgtaaagattccagagctaggagtataaaaggtgatgctattcatgtttatttgtctagctaggtaggggctgcagaagcttaagaggctcagtagtaatttggcttgcttttgtgctttttctttcataccta

SEQ ID NO: 4632 - DNA, 1691 bp, Panax ginseng
accactcacccgtatattcccagtcctctaacaaaatctagagagagagagagagaaacacacacagtcaagtattattgtatagagagagaaagacgggcacatggcctcgttgccgctgggacctcagcatccgccagacaaccatgacccttgaagctcgccgctcctcaccggacggagatggactccgataaggagatgtcagctgctgttattgaggggaatgatcaagttactggtcacatcatttctacaacaataggtggcaaaaatggcgaaccaaaaaggactattagttacatggcagagcgtgtcgtgggtactggatcattcggaatcgtttttcaggcaaagtgcttggaaactggagaaaccattgctataaagaaggttttgcaggacaggcggtacaaaaatcgtgagctacaattaatgcgcttaatggatcaccccaatgtggtttgtctgaagcattgttttttttccacaactactaaagatgaacttttcctcaatctggtaatggaatatgtccctgagactatgtaccgggttctcaagcactacagcaatgtaaatcaaagaatgccgcttatttatgtcaaactttacacctaccagatatttagggggctggcttatatccatactgttccaggtgtttgccatagggatgtgaagcctcaaaatcttctagttgatcctctcacccaccaagttaagctttgtgactttggaagtgcaaaaaatttggtcaagggtgaggctaatatatcgtacatatgctctcgttattaccgagccccagaactaatatttggtgcaacggaatatactacctcgattgatatttggtctgctggttgtgtccttgctgagcttcttttggggcagccattgtttcctggcgaaaatgcagtggaccaacttgtagagattatcaaggttcttggtactccaactcgagaagaaatacgatgtatgaatccaagttacactgattttagattccctcagataaaagctcatccttggcacaaggttttccacaaaaggatgcctcctgaagcaattgatcttgcttcacgcctcctacagtactcaccaagtcttcgctgtacagctctagaagcgtgtgcccattcattctttgatgagctaagggatcccaatgcccgccttcccaatggtcgccctttaccccctcttttcaacttcaagcaggaattaactggggcttcgcctgagctgatcaacaggcttattccagaacacatccggaggcagagtggtctaagcttcccacatccagctgggacgtaatcaagttgatcaactgttgtgctagttgatggaaggtgaacataaggggtctctttgtttgtttatatcaccagtctttttgccctaaccagtgattttctcaagagagatgtatgcgtgaactggttgttttggcttagctgaaggtgaaagaacatcccctacttctgtaaaattgtttttgatcgcaaaagatttcagaacgctagaggcatacaaaatctggcaattctagtcaaggctagctaggcagatgctctaaagaaacaggaagaacgctaggggcttgtagtttcccttgtttatttatatggtgttattcctagtgctgcactcaaaattttcattattgatgaaaattactg

SEQ ID NO: 4633 - DNA, 1710 bp, Euonymus alatus
gaaaatattgagagagagaaagcaaaggtgaaagctgtagagcacatggagtgaggggtctgaccaaaccatcatcaaccaccatcaccacaatactgaagcccacactatgtcccactcttcctgagccaccgccgccgccatcaccacggccaccagcctcggcgctccgattatggactccgataaggaaatgtcatctgctgttattcaggggaatgatgcagttactggtcacataatatccaccaccatccgaggcataaatggggaacctaaacagacaatcagttatatggcagagcgtcttgtaggtactggatcattcggaattgttttccaggctaaatgcctggaaactggagagacagtggctattaagaaggtcttacaggaccgacgatataagaatcgtgaactacagttgatgcgcttgatggatcacccaaatgttgtttccctgaagcactgtttcttttctacaacgagtaaagacgaactttttctcaatttggttatggaatatgtccctgagaccatgtatcgggttgtgacacattacagcagtatgaaccagaggataccacttatctatgtgaaactttatgcatatcagatctttagagggctggcatatattcattctgttcctggggtttgccatagagatgttaagcctcagaatttgttggttgatcctctcacacatcaggttaagctatgtgactttggaagtgcgaaagtattggtcaagggagaaacaaacatctcatacatatgctctcgttattaccgagctccagaactcatattcggtgcaacagagtatacgacgtcaattgatatttggtcagctggttgtgtcattgctgagcttcttctaggtcagcccttgtttccaggagaaaatgcagtggatcaactagtagagatcatcaaggttcttggtactcccactcgagaagaaattcgctgcatgaatcctaattatacagacttcaggttccctcagattaaagctcatccttggcacaaagttttccataagcgaatgcctcctgaagcaattgacctggcttctaggcttctccaatattccccaagtcttcgctgcactgcgcttgaagcatgtacacatcctttttttgatgagctccgtgagcccaatgcccgccttcctaatggtcgccctctaccccctcttttcaacttcaaacaggaattagttggagcctctcctgaactgatcaacaggctcatacccgagcatgtcaagagacaggctggtcttagcttaccacatccagcaggtacataaaaggggaggtatgcaataaggaatcaattattggagtggatgtttatgaaacgaggattaccttcgtgtggtcaatgtaaacgatgccttatcagtgaattatctcgcccggtgaagatgtacacatactggcgtttcagcttggaaattggtgatcgtctacggggcctttgtacattgtttttgatcgaaaagagtccataaaagcagggagtaggagttattcaatctgtctagctagttggggggttcaaaaaacatcccaactggcgttccagagcttagtcattagtttgtcttgctctttcctaagttgttttattctgtgttatttctcatgttttgaacacaaccaaatttcacgatttatggtttactgaaatctttccctt

SEQ ID NO: 4634 - DNA, 1709 bp, Tropaeolum majus
aggaaaagagaaggggaggaagtaagcaagcaagtagctgtaaagcacatggcctcaatgccctcggggcctcaacatcaaccacctccacaacagcaacaacttcctcctgacaatgactccttgaaacgccgtccaaatatggactccgataaagaaatgtctgcgtctgtcattgagggtaatgatgcagtcactgggcacatcatttccaccaccatcggaggaaaaaatggtgaaccaaaacagactatcagttacatggccgagagagttgttggcactggatcctttggaattgtatttcaggcaaaatgcttggaaactggagagacaatggctataaagaaggttttgcaagacaggcggtacaagaatcgtgagctgcaactaatgcgattaatggatcacccgaatgtggtctccttaaagcactgtttcttctcaacgacaagtaaagatgagcttttcttgaatttggttatggaatatgttcctgagactatgtaccgagttctgaggcactacagcactatgaatcagaggatgcccctcatctatgtgaaactttacacatatcaaatctttcgggggcttgcatatatacatacagtccctggggtttgccacagagatgtgaagccacagaatcttttggttgatcctctcacccaccaagctaagctttgtgattttggaagtgcaaaagttctgatcaagggcgaagctaacatatcatatatatgttctcgttactatcgagctccagaactgatatttggtgctacagagtacacaacatcaattgatatatggtccgctggttgtgtccttgccgagcttctacttggacagccattgtttccaggagaaaatgcagtggaccaacttgtagagattattaaggttcttgggactccaactcgagaagaaattcgatgcatgaatccaaattatacagattttagattccctcagatcaaagcacatccatggcacaaggttttccaaaagcgaatgcctcctgaagcaattgaccttgcttcacgacttcttcagtattcaccaagtcttcgatgcactgcgctggaagcatgtacgcatcctttctttgatgaacttcgagagccgaatgcccgccttcccaatggtcgaccattaccccctctgttcaactttaaacaagaattagcaggagcttcacctgagcttatcaataggctgataccagagcatgtgaggcggcaaacaggtctaagcttggcgcatcctcctaatacgtgagcttagagactccagagaagcattcaactctaaatatagtgttatgcagcaaaggaatggaaccatccggttgttggaaccaatctgctagggatcaaatagtggatattctctcccctgcaaaggtgtacacatatactggcttttcagcttaaacttggaagctagtgactgtttactatgttgtttttagccaaaacatactgtgttgctgcttttgtacattgttttggtcgtaaagatttcagaaagctaggagtataaagaggtgatgcaaacgtctgtttagataaagtagactcttgaaaagttaattggtagtatggtctgtctttattacttgagaatattgtgctcgtaattatgttgtggcggtgtatggacgataatcaaactttaaaactacaaggtcgctgcctgctctt

SEQ ID NO: 4635 - DNA, 1373 bp, Elaeis guineensis
ccccccgagcctgaggcgatgaggaccgaccctggccggccggagatggccgaagacaaggaagcgtctgttattgaggggaatggtccagtaactggtcacattatctcaactacgattggaggaaagaatggcgaagccaaacggaccattagttacatggcagagcgtgttgtgggtactgggtcatttggaattgtctttcaggctaaatgcttggaaactggggagattgttgctataaaaaaggtcttgcaggacaggcgatacaaaaaccgtgagctacaactgatgcgctcgatggatcatccaaatgtgatttctctgaagcactgtttcttctccaccactaacagagatgaactgtttctgaacctggtcatggagtatgtccctgaaactgtattccgtgtcctgaagcattacagcaatgtaaagcagaggatgccgcttatctatgtgaaactttatatgtatcaggtatttagggggttagcatacattcatactgttccaggaatttgccatagagatgtgaagccacagaatatcctggtcgatcctcttactcatcaagtcaagctctgtgactttggaagtgccaaaattctggttaagggtgaagcaaacatatcatacatttgctctcgctattaccgtgctccagagctcatatttggtgcgacagaatatacaacatcaattgatatatggtcagcaggatgtgtacttgctgagttgcttcttggccagccattatttcctggagaaagtgctgtcgatcagcttgttgagataatcaaggttcttggtactccgactcgagaagaaattcgatgcatgaatcctaactatacagaatttaggtttcctcagataaaagctcatccttggcacaaggtttttcacaagcgaatgcctccggaagctatagatcttgcatcccgtcttcttcaatactcaccaagcctccgttgcactgcacttgaggcttgtgcccatcctttttttgatgagctacgagagcccaatgcacggttgccaaatggtcgcccttttcctcctctcttcaacttcaaacaggaactagcagttgcttcgccagagctcatcaacaagctaatacctgagcatgtgaggcgacaatatggtcctactttcccgcttccaactgggacgtgaggcagtaactagggtacttcttgaggaattgcaatcaaaagcacggaggccttcagggtttgaacggaaaatgatgaatgctgagccagtgagctgccggtttgttaagtggttcatgtcttaaccctaccaatattgcagccttgtatattgcctgattgttgggattaaaaatgattgtgagggaatcc

SEQ ID NO: 4636 - DNA, 1707 bp, Allium cepa
ataaatagattagaaagtggaggtgcttgtattcacatggcttcgctgtcacatttgtccctcttttcttccttttctctcaactactcttctcttcattcttctctttcgctggctaattaaagttgctttttcgccccctttccttctccttcatccccttccatggcggaagacaaggaacactctatgatggagacaagtgatcctgtaacaggacatatcatctcaacgaccattggtggcaaaaatggtgaaccaaagagaacaattagttatatggcagagcgtgttgtggggactggatcatttggaatagtctttcaggccaagtgcttagaaacaggtgagactgttgcaataaagaaagtgctacaggataagagatacaaaaacagggagctacagctgatgcgaacaatggatcatcctaatgtagtttctttaaagcattgctttttctcaaccacaagcagagatgaacttttccttaatttggtcatggagtatgttccagaatctttatatcgggttttgaagcattataacaatgcaggccagatgatgccgctaatatttgtgaagctctacacatatcagatttttagagctctagcttatattcatgctgttcctggagtttgtcacagagatgtaaagccacaaaacatactggttgatccgcttactcatcaagtgaaattgtgtgactttggaagcgctaaaattctggttaaaggtgaagaaaacatatcttacatttgctcccgctattatcgtgcaccagaacttatatttggtgcaacagaatacacaacatcgattgacatatggtcagctggttgtgtgcttgctgagttactccttggacagccgttatttccaggggagagtgccgttgatcaacttgttgagataatcaaggttcttggtactccaactcgagaggaaattcgatgcatgaatcccaactacacggatttcagatttcctcagataaaagctcatccatggcataagatatttcacaagaggatgcctccagaagcaatagatctgacatcacgacttctccagtattcgccaagttttcgatgcacagcgttggaagcatgttctcatccattttttgatgagttgcgtcaacctaatgctaggctcccaactggtcgcccattgcctccacttttcaacttcaaacaagagttgactggagcatcaccggatcttgtcaatagactgattccagaacatgtgaagaaacagtctggtctcaatttattccatttggctgggacgtagctctgcatttaccgtaatatccgtgagttgaacgttaccaagtaaagagaaaaacttcatggtttatatattttcctaggagaagttgttacaaagtgaaatcccctgagtctagatcgagagataagagactcaggagtccatccatcagtagttgttctaatccgtttgctgtatattgtattatatgtttatgtttagtaggatcttgtgaggataagtatagttgtgagtagaggaatgaatgaatgacttctagctgaaacaaagggagagaatcttaggggttttctacgttgtatccagtttatgttgctttttctttgttgtatactactgcatttcctgtttgatctgtagatttgtattattaatgtgaagttctaaaagcttttcaactttaat

SEQ ID NO: 4637 - DNA, 2214 bp, Lupinus angustifolius
gaatagaaatggcataaaggaaataaacgagtgagtcaaacatccacattcgtatttgactcgctctcattatcagctggcaaatggaatctcttctcatgcacctaaccgcacctgaccggatattcccgtcatcaacatttccatgcaaaccaaccaacagctctgatctagcgcgtgtcttcactctccatctctctcattgattaaaaaaatcaacgcagagtacatgggggagagaagaaacaaaacaaaggaaataattgagactgtttctctttctaacatcacatggcttctatacctttggggccgcaccaccgaccaccggcgccaccgcaacatcctcaacctgatgtggctcgccggagctctgacatggacagcgataaggatatgtcagctactgtcattgaagggaatgatgcagtcactggccacattatctccaccacagttggaggcaaaaatggtgaacctaaacagaccatcagttacatggcagaacgtgttgttggcactggatcatttggagttgttttccaggcaaagtgcttggagaccggggaggcagtagctataaagaaggtcttgcaggacaggcggtacaaaaatcgtgagcttcagctaatgcgcttgatggatcacccaaatgtaatttctctgaagcactgtttcttctctacgacaagtaaagatgaactttttctgaacttggtaatggaatatgtccctgagacgatgtaccgggttctaaagcactacaataatatgaaccagagaatgcccctcatctatgtgaaactatatacttatcagatctttaggggactagcatatatccataccgtaccaggagtttgtcatagggatgtgaagcctcaaaatcttttggttcatcctcttactcatcaagttaagctttgtgatttcgggagtgcaaaaattctggtcaagggcgaagcaaacatttcgtacatttgttcacgttactacagggctccagaactaatatttggtgcaacagaatacacaacttctattgatatctggtctgctggctgtgtccttgctgaacttcttctaggccagccattatttccaggagaaaatcaggtggaccaactcgtggaaataattaaggttcttggtactccgactcgagaagaaattcgttgcatgaacccaaattatacagattttagattccctcaggttaaagctcatccttggcacaaggtttttcacaagcgaatgccccctgaagcaattgaccttgcatcaaggcttctccaatattcaccaagtcttcgctgcactgcgctggaagcatgtgcacatcctttctttgatgagctccgtgagccgaatgctcgactacctaatagccgtccattgcccccacttttcaactttaaacatgaattagctggagcatcacctgaactgatcaacaggctcatcccagagcacattaggcgtcagaccagtctcagcttccctaatcctaatccggctgatacatagatgttaagagataatgaaacaatcgagtgaactgatctagtgatcagcgacacaaacgatcggctcttggtggtcaatatagctgagggttccagcttaatatgtagatccccccctgtgaaatgtatacacgtgctagctgtttgggatgacaaggaaatatgtgtactatctagtatttcattttagtcaaagcatatacttatcttctgcatctgtacattgttttggtcagatttcagaaagctaggagtattaaatgatagcaatcttgtctacataggtaggggaggccaccagaaattggagggtctccttagtaatttgtcttcctttttatatgaacatactcatggtcacggtgttctttgtaatgttatgacaatctcttcatgtaaaaccagattttcattagtgttcaatactcaatttcctctgtttctaccccaaaaagtcgataacgggagaaaaatatgaattcgtttgttgataacagagagatgcaatgctgacagcacagtccttacaaatgaggagtacagccaaatataatactgtagtgatcttcaatatgcaaggtaaaaccctgaagagtatcactatcagacaacaatttattaggctcatgaataagacaacctctgatgtattttatttatccctaggatacaattttgctttcttgcc

SEQ ID NO: 4638 - DNA, 1624 bp, Silene vulgaris
ttccttgaagtgaatgcaacaataagagacagcagaaaatgtgattagagagagaaagagaaaaagcaagcagcagcagctggaaaagcacatggctcacaataatcatacacataatccacctttacttcctcttaatcctcttcttaacaaccatcttaatcctcttattaatactaataatccctcttctctccccaaactccctccttccaacatcaccatgtctgaagataaggaaatgactccagcggtaatacaaggaaatgatcaggttacgggacacattatatcgacaaccattggcggcaagaatggtgaaccaaaaaggactataagctatatggcggagcgagttgtcggtactggatcatttgggattgtgttccaggcaaaatgcttggagactggggagacaatggcaattaagaaagtcttgcaagataggcgttataagaaccgtgagcttcaattgatgcgattactagatcaccctaatgtggtttcactcaagcactgtttcttttcgacaaccagtaaggatgagctgtttctcaacttagtgatggaatatgtgccagaatctttgtatcgtgttctcaagcactacagcagtatgaaccagaggatgccgcttatatatgtcaaactctacacatatcagattttccgtggattggcgtacatccatactgtccctggcgttgctcacagagatataaaacctcaaaacctcctggttgatcctcttactcaccagctcaagatttgtgattttggaagtgcaaaagttctggtcaagggagaaccaaacatatcgtatatatgttcaagatattaccgtgcaccagaactaatatttggcgctacagaatatacaacctccattgacatctggtcagttggttgtgtcctagctgaacttcttctcggccagccattgtttcctggagaaaatgcagtagaccaacttgtggagattatcaaggttcttggtactcctactagagaagaaattcgatgcatgaatcctaactatacggatttcagattcccgcaaataaaggctcatccctggcacaaggttttccacaagagaatgccaccagaagccattgatctcgcttcacggctgcttcagtattctcccagtcttcgctgcactgctctggaagcatgtgcgcatcctttctttgatgaactccgtgaacctaatgcacgtcttcccaatggtcgaccattgccacctctattcaactttaaacaagaattggctggagtttcgcctgaactacttatccgtttgataccagaacatctgcgtcgccaaaccagttttcctcatcccggataaagcatcatatgctcaaactgtatgtaagctcaaagccagctaggctgaccagaatatttgtcgacgtaaatgtgttctagtcatgtggtgaaaaggtccacattatatgttgctagaaatttccatactcagtgagtcctgaccaccaaattatttttctggcttacccaagcttcttattgtatttatatgcatgcctcttttccatccttctcttaagtgtaaaattttctgaaaggattcaacattatatgttttacatactctcct

SEQ ID NO: 4639 - DNA, 2364 bp, Oryza sativa
ggaagaagggaataaaaaaacaaagaggaaaaaaaaggaaggtctcatctcatggtcgcctagccaagccaagccaagccaacctcctcgccgaggagagagaagagaggagaggagacgagaggagagagaagccgaggaggaggagagagagagagaggaggccgctccatttgcccccccccccatggccacgctgccgggcgggccccaccccaccggaggcggcgccgcggcggacccgatgcaggtcgaccagccgcgctccgccgcggccgccgcagcggtcgcccccgccggtgaaaagcacggtgcttctcttatggaagggagtgatcctgtcaccggccacataatctccacaacgattggagggaagaatggagaacctaaaaggacgattagctacatggcagaacgagttgtgggaactggatcatttggaatcgtctttcaggcaaaatgtttggagactggtgagactgtcgccattaagaaggttttacaggacaagcgttacaagaacagggagttgcagattatgcgatcaatggatcattgcaatgttgtttctttgaagcattgcttcttctctacaacaagcagagatgaacttttccttaacctggtcatggaatttgttcctgagtcactgtatcgtgtgttgaagcattatagcaacatgaaccaaaggatgccacttatatatgtcaaattgtatgtttaccagatattccgtggtttggcttacattcatactgtacctggagtttgccacagggatgtgaagcctcagaatcttttggtcgatcctcttactcaccaagtcaaaatatgtgattttgggagcgcaaaaatgttggttaaaggtgaagcaaacatatcgtatatatgttcacgttattaccgtgctccagaactgatatttggggcaaccgaatacacgacatcaattgatatatggtcagctgggtgtgttcttgctgagttgctccttggccagcctctctttcctggtgaaagtgcagtggatcagcttgtcgagattataaaggttcttggtactccaacacgtgaggaaatccgctgcatgaatcccaactacacagaattcagatttcctcagattaaagctcacccatggcacaagattttccacaagcggatgcctccagaagcaattgaccttgcatcacgtcttctccagtatgcaccaaatctacgatgcactgccctcgaagcatgtgcacattcattctttgatgaattgcgagaaccccacgcaaggttgccaaatggacgtccattccccccactgttcaactttaagcaagaactagcgaatttatcgccagagctcatcaacaggttgataccagagcatgctcggtgacattgtgggttcaatttcttgcctgctgccggaccataggacagctggatggtatttttactttgcgaagccgatgcttgtttgtgccaaagggcaacttgcatgttctcacatttaaggtgtagaatctgaccattattgggaagctgaacatgagctggcgccaatgtgttatatgaggtgggtgtgctaggcacagccaacccatgttaatttaatgcttctcctccattattaggaggccatggtggtcaggattagccaagtactgtggggatagctggagggaatggggatggtgtattgttaagctattgaaagggatcagatcccaagtactgtactactttctcccacgattaatgttgtagtgcccctgtaagtgtttctcatgccctattgtcgatgtaattgtgtaaatgttcctaatggaaaaatctcttgttatgataccccatgcccaaacttgtttaccccccccccccctactggtttcctctaccatatggttcagagaactttcctcatctgttggctgcaaagatgaatgttgtgattatcattgtcactggaatactaggataaaattgttgataaatgagtaatatatttgaggtctgcatttgtgagttgtgtaaggatttaaggcaggtgtctgcaccaatcctatattgagagaataaaagcaacagttgagaaccaattggttgtgtcggctggtcctttcatcaatagagatgctgtctgtttagtgtggttgagcagaacactatttatttgctttattatcatcatgctgacacacctgctctattaatcttttatagctattttttttccagttgctgttgactatgggaaggctacaaacttatagaagtctgtaaacaaagcatatacatacagtgttgttttatttttgctgctttgatgacttcttcatttcacaccgtccccagatttcattgtct

SEQ ID NO: 4640 - DNA, 1465 bp, Vaccinium corymbosum
gcacatggcctcgttgccactgggacctcatcatcctccagacaacaaccaccaacaccaccaccatcacgctcctcctcctcgccggccgccggaaatggactccgacaaggaaatgacatctgctgttatcgagggaaacgatcaagtcacaggtcatattatttccactactattgggggaaaaaatggtgaacctaagcagaccattagttacatggcggagcgagtagtgggtactgggtcatttggaattgtttttcaggctaaatgcttggaaaccggagagactgtcgccataaaaaaggttttacaagacaggcggtacaaaaatcgggagctgcagttaatgcgcttgatggatcacccaaatgttgtgtcactgaagcactgtttcttttctacgacgactaaagatgagcttttcttaaatttggttatggaatatgtccctgagactatgtaccgagttcttaagcattacagtaatgcaaatcagaggatgccgctcatctacgtcaaactctatacataccagatatttagggggctggcttatattcatactgttcctggggtttgccacagagacgttaaacctcaaaatctgctggttgatcctctcacccatcaggttaagctttgtgactttggaagtgcaaaagttctggtcaagggtgaagcaaacatatcatacatttgctctcgttactaccgcgctccagaactcatatttggagcaacagaatattcatcttcaattgatatatggtcagctggttgtgtacttgctgagcttctactggggcagccgttgtttccgggagaaaatgcagtggaccagcttgtggagattatcaaggttctgggtactccaactcgtgaagaaattcgatgcatgaatccaaattatacagattttaggtttcctcagattaaagctcacccttggcacaaggttttccaaaagcggatgcctcctgaagcaattgatcttgcttcaaggctgcttcaatactcaccaagtctgcgttgcactgcgttggaagcatgtgctcatcccttctttgatgagcttcgggagccaaatgctcgtcttcctaatggccgccctttgcccactcttttcaacttcaaacaggaactggctggagcttcaccggagttgatcaacaggctaataccagagcatgtccgacggcaaatgggtctcaccttcccacatccggctggcacgtgaagaaactgatgtaaggtggaaaatcgactcctttgttggttgactgaaggcatagtctctgtggattatcggttttggcctaaccaccggttttcttgcccgaatacaaagatgtgtatgtattcatatagcgtggctgtttccctgaaattcggccaatctgtttactatgtctcctcttagctaaaaaatactcttcgccccacttctgtacattttttcttt

SEQ ID NO: 4641 - DNA, 2687 bp, Cannabis sativa
aggatatgtcagcgtcatctactgttattgagggcaatgatcaggtaactggtcatatcatttcaacaaccattggcggcaagaatggtgaacccaaacggacaattagttacatggctgaacgtgttgttggtacgggatcatttggaattgttttccaggcaaaatgtctggaaactggagaaacagtggccataaagaaagttttgcaggacagacgatacaaaaatcgtgaactgcagttaatgcgtttgatggatcatccaaatgtggtttcactgaagcattgtttcttctccacaacaagtaaagatgagctttttctgaatttagtcatggaatacgtaccagaaaccatgtatagggttctgaagcactatagcagtatgaaccagaggatgccactcatatatgtgaaactttatacatatcaaattttcagaggcctggcttacatccatactgttcctggagtttgccatagggatgtgaaaccacagaaccttttggttgatcctcttactcaccaagttaagctttgtgattttggaagtgcaaaagttttggtgaggggtgaagcaaatatatcatacatatgctctcgttactatcgagctccagaactgatcttcggtgcaacagaatacacaacatctattgatatttggtcagctgggtgtgtccttgctgagctccttctaggccagcctctgtttccaggagagaataaagtggaccaacttgtagagataatcaaggttcttggcactccaactcgagaagaaattcgatgcatgaatcctagctacacagattttaggttccctcagattaaagctcatccttggcacaaggtcttccacaaacggatgcctcctgaagcaattgaccttgcatcgcgacttttgcaatattctccgagtcttcgctgtactgctttagaagcatgttctcatccgttctttgatgaacttcgtgaacccaatgctcgtctgccaaatggtcgcccattgccacctctattcaacttcaagcatgaattgtcagcagcttcgcctgaactcattaacaggcttatacccgaacatatacggcggcaggctagtcagaacttcccacacttggtaggtacttaaaaaaaatgtgatgatacaaaacatggaaatcatcactgtccttttctggtggtagatatatatatatgtgtatgggaagccaaaagggcctctgtgtggtctgtatatccgaaccaagagcattttgatcgatcagcagctgtttctcctcttcctctaaagatgtacacaaatacttgctgttgttcggcttaactttgggaaactgtcgacaaaatgtcatttagtattaaacatagtattttccttcatctgtaaattgttttgatcttaagaattcctgaagaaccctaccccccaaaaaatggcagagtataagaaggtgattctgttcattgtctatctatctaggtaagcaaatactgtttcgtcattgttttttttttaaatttatttccttcaagcttttaatttctttgctgtttgttgcaattcctttcaagaactataaattggtattgttttaaattcagctgtgtttctctcttgctcttctttaatttaatttggtctaatttttcgttctttaagcctctgcctcggcaaaaaattgtacattcctagagaaaaggaaaagaaattggaattagaatttcctcgcattctaggcgtggagatcacatttctgattaataaaatttgattaaaaatgggaatgttatgactgaaattataatatttaaatgcaccattttattttccaataagtaatgttgcgctcttcatagtttggtatgaagtgcaattctgaataacactacaaaatcccccaacggaaaatggaggaagaacagttgatgtgaccaagaaattatattgttttccttttttttcaaaaggaaaaaaataatatttattgctatccctttaacaattagagggaattatagccaagaaattaacaaaaatgtagagacatttgcaaccttgcaacctctcaattagccctacttggtcacttcgtgtatagcattagccagatatccaacatttccagtcgtaacacccgccatgctgtataccaagagaaaagttcaattttagatataaatatatgaattcatttctccagtaataaaaataattaaaaacaacacaaatttaccttatacggccattgcgagtcatatagatatgatattcattggtcaaacggtccacctgttcaggtgtcatcccactgtagcagaacatgccaatctgtttgccaccatcaaaataattcttaattgcgtcaagagacaaatacaattacaaacatattatttccctacaacaatccatcatacctgattggttatatgctcccacgataaaggcgagcccaacttctcaaggttttctcttaaagcagttcgcattccaatgatgcggtcggccattaccttgacttctttgagccacaatttcttcaagtctggatcatcaagaatgattgagactacgagtgctccatgcacaggcgggttactatacatgggtctagcaagctgctgcaattggctttttacagccacggcttgcttttcatcgtcacatagtaaactacaa

SEQ ID NO: 4642 - DNA, 1836 bp, Festuca arundinacea
ggcacgaggtccatttcggcgtcccgtccggccccctcccccaccccacatggcgacgctgccgggcggggcccaccccgccggcggcgccgcggctgacctcatgcaggtcgacgagccgcacgccgccggcggcgccgcggctcctgtggtcaagaagcatggtgcttctattatccaagggagcgatccagtcactggtcacataatctccacaaccattggagggaagaatggagagcctaaacggactattagctacatggcagagcgtgttgtcggaactggatcttttggaattgtcttccaggcaaaatgtctggagacaggtgagactgttgccatcaagaaggttttacaggacaagcgttacaagaacagggagctgcaaataatgcgatcaatggaacattgcaatgttgtctgtctgaagcactgcttcttctctaccacaagcagagatgaacttttcctcaacctggttatggagtttgttcccgagtcattgtatcgtgttctgaagcattatagcaatatgaaccagaggatgccacttatatatgtcaagctgtacgtgtaccagatattccgaggtttagcttacattcacagtgtgcctggagtttgccacagggatatcaagcctcagaatcttttggtggatcccctgactcacacagtcaaaatatgtgattttgggagcgccaaaatgttggttaaaggagaagcgaacatatcgtacatatgctcacgttattaccgtgctcctgagctgatatttggggcaacagagtatacaacatcaattgatatatggtcagctggatgtgttcttgctgagttgcttcttggccagcctctatttcctggtgaaagtgcagtggaccaacttgttgagataattaaggttcttggtactccaacacgtgaggaaatccgctgtatgaatcccaactacactgaatttagatttcctcagataaaagctcatccgtggcacaagattttccacaaacgaatgccaccagaagcaatagacttagcatcacgtcttcttcagtattcacccaatctacgatgcactgctctcgaagcatgtacacatccattctttgatgaattacgggagccccatgcaaagttgccaaatggacgcccattccctccactcttcaacttcaaacaggaactagcaaatgcttcaccagacctcatcggcaggttgataccagagcatgcaaggcgacattgtgggttcaatttctcgccttccaccggacagtagggaaggctgtacgatattattttacctggcacactgccaaggcttgtctatgccaaagggcaacctgcgtgttatcacaaatttagaatctgacaaccaattattggaaagccgaagacaagccggtgccattgcgtttgtacgaggggggtatgtatttgcctagccagcccctgatgtaacattcaatgcttgagctcctttatgtggaggcaatggttgcaagatcaggattagccaagaactgtgcgcatgggtggagagaactgggatggtgtattgttaagcagttgatgggactagaggaaaaccatgtattgtaacttctccatgttcagtggtgtagtgagcctgtaagtgtttcacatgttcctaccgtgaatgtagctgtgtaaatgctcctgacgggatgtctcagtcatgatggtcttgctcaaaaccttgtatccttcctcaattaaaaaatgtaggcttaagtagccatgaaatcttgaatcatgtgcttaatattcattgttagtactgtatttgtctcaaaaaaaaaaaaaaaa

SEQ ID NO: 4643 - DNA, 1438 bp, Festuca arundinacea
acggcgagccgaagcggacaattagctacatggctgagcgagtagtgggaactggttccttcgggatcgtcttccaggctaagtgcttggagactggagagaccgtggccatcaagaaggttctgcaggaccggcgttacaagaaccgcgagctgcagctcatgcgctccatggaccaccccaacgtcgtctctctcaagcactgcttcttctccaccacgagcagggacgagctgttcctcaaccttgtcatggagtatgtccccgagactctgtaccgggtgctcaaacactacagcaacgccaaccagcggatgccgcttatctatgtgaagctctacatgtatcagctttttagaggtctagcttacattcatactgttcctggagtctgccacagggatgtgaaaccacaaaatgttttggttgatcctctaacccaccaagtcaaaatctgtgactttggaagtgcaaaagttctggtacctggtgaacccaatatatcatacatatgctctcgctactatcgtgctcctgagctcatatttggtgcaactgaatatacaacttcaatagacatatggtcagctggatgtgttcttgcagagttacttctgggtcagcctctgtttccaggagagactgcagttgatcagctagtggagattataaaggttcttggtactccaacccgtgaggaaattcgatgcatgaaccccaactatactgagttcagatttcctcagataaaggctcatccttggcacaagattttccacaagagaatgcctgctgaagctatagatcttgcctcccgtcttctccaatattcaccaagtctgcggtgcactgctcttgatgcatgtgcacattccttcttcgatgagctacgcgagccgaatgcacgcttgccgaatggccgcccgttcccccctctgttcaactttaagcctgaactagcgaacgcttctccggatctcatcaacaggctgatcccagaacatgttcgacggcaaaatagcctcaacttcgcgcatgctgggagctagaagggcgtggtaccacatcgctcattctttttgtttgtccgacttctgcaagctgcaaatacgcaagctcagacctcaccatcttggaagataactctcctaaaaacttgtggagagactggttcggtgcacgagaaagaggtacaactatgtaaattatctgaccgtaagttgttgatgctgccagtgtttaagtacatggcagcgcatgttggttgagttattacttattattagtaggtaaggcaatgatgtaggtggtggagacatgttaatgctagggggctgtgacctgtttcgttctcgccatttttgtaatgcttagtagtacctgtcatgcagcagccgtatagctgctccctgttttgtccgttctccctgatgtaaaa

SEQ ID NO: 4644 - DNA, 1617 bp, Panax ginseng
attattgtatagagagagaaagacgggcacatggcctcgttgccgctgggacctcagcatccgccagacaatcataaccctttgaagctcgccgctcctcacaggacggagatggactccgataaggagatgtcagctgctgttattgaggggaatgatcaagttactggtcacatcatttctacaacaataggtggcaaaaatggagaaccgaaaaggactattagttacatggcagagcgtgtcgtgggtactggatcattcggaatcgtttttcaggcaaagtgcttggaaaccggagaaaccattgctataaagaaggttttgcaggacaggcggtacaaaaatcgtgagctacaattaatgcgcttaatggatcaccccaatgtggtttgtctgaagcattgttttttttccacaactactaaagatgaacttttcctcaatctggtaatggaatatgtccctgagactatgtaccgggttctgaagcactacagcaatgtaaatcaaagaatgccgcttatttatgtcaaactttacacctaccagatatttagggggctggcttatatccatactgttccaggtgtttgccatagggatgtgaagcctcaaaatcttctagttgatcctctcacccaccaagttaagctttgtgactttggaagtgcaaaaaatttggtcaagggtgaggctaatatatcatacatatgctctcgttattaccgagccccagaactaatatttggtgcaacggaatatactacctcgattgatatttggtctgctggttgtgtccttgctgagcttcttttggggcagccattgtttcctggcgaaaatgcagtggaccaacttgtagagattatcaaggttcttggtactccaactcgagaagaagtacgatgtatgaatccaagttacactgattttagattccctcagataaaagctcatccttggcacaaggttttccacaaaaggatgcctcctgaagcaattgatcttgcttcacgcctcctacagtactcaccaagtcttcgctgtactgctctagaagcgtgtgcccattctttctttgatgaactaagggatcccaatgcccgccttcccaatggtcgccctttaccccctcttttcaacttcaagcaggaattaactggggcttcgcctgagctgatcaacaggcttattccagaacacatccggaggcagagtggtctaagcttcccacatccagctgggacgtaatcaagttgatcaactgttgtgctagttgatggaaggtgaacataaggggtctctttgtttgtttatatcgccagtctttttgccctaaccagtgattttctcaagagagatgtatgcgtgaactggttgttttggcttagctgaaggtgaaagaacatcccctacttctgtaaaattgtttttgatcgcaaaagatttcagaacgctagaggcatacaaaatctggcaattctagtcaaggctagctaggcagatgctctaaagaaacaggaagaacgctaggggcttgtagtttcccttgtttatttatatggtgttattcctagtgctgcactcaaaattttcattattgatgaaaattac

SEQ ID NO: 4645 - DNA, 1800 bp, Panax ginseng
acagaacagaacattgaattgtcgcgtgcccgtacactttctcttctcgcgtgggtctaacttccccccacacctcttgtccgtcaatctagttcctcgccaacagtaacttgatacaccactcacccctatattcccactcctataacaaaatctagagtaacacacgcagtcaagtattattgtatagagagagaagacgggcacatggcctcgttgccgctgggacctcagcatccgccagacaatcataaccctttgaagctcgccgctcctcacaggacggagatggactccgataaggagatgtcagctgctgttattgaggggaatgatcaagttactggtcacatcatttctacaacaataggtggcaaaaatggcgaaccgaaaaggactattagttacatggcagagcgggtcgtgggtactggatcattcggaatcgtttttcaggcaaagtgcttggaaaccggagaaaccattgctataaagaaggttttgcaggacaggcggtacaaaaatcgtgagctacaattaatgcgcttaatggatcaccccaatgtggtttgtctgaagcattgttttttttccacaactactaaagatgaacttttcctcaatctggtaatggaatatgtccctgagactatgtaccgggttctgaagcactacagcaatgtaaatcaaagaatgccgcttatttatgtcaaactttacacctaccagatatttagggggctggcttatatccatactgttccaggtgtttgccatagggatgtgaagcctcaaaatcttctagttgatcctctcacccaccaagttaagctttgtgactttggaagtgcaaaaaatttggtcaagggtgaggctaatatatcatacatatgctctcgttattaccgagccccagaactaatatttggtgcaacggaatatactacctcgattgatatttggtctgctggttgtgtccttgctgagcttcttttggggcagccattgtttcctggcgaaaatgcagtggaccaacttgtagagattatcaaggttcttggtactccaactcgagaagaagtacgatgtatgaatccaagttacactgattttagattccctcagataaaagctcatccttggcacaaggttttccacaaaaggatgcctcctgaagcaattgatcttgcttcacgcctcctacagtactcaccaagtcttcgctgtactgctctagaagcgtgtgcccattctttctttgatgaactaagggatcccaatgcccgccttcccaatggtcgccctttaccccctcttttcaacttcaagcaggaattaactggggcttcgcctgagctgatcaacaggcttattccagaacacatccggaggcagagtggtctaagcttcccacatccagctggtacgtaatcaagttgatcaactgttgtgctagttgatggatggtgaacataaggggtctctttgtttgtttatatcgccagtctttttgccctaaccagtgattttctttctcaagagagatgtatgcgtgaactggttgttttggcttagcagaagctgaaagaacttcccctacttgtgtaaattgtttttgatcgcaaaagatttcagaacgctaggcatacaaaatctggcaattctagtcaaggctagctaggcagatgctctaaagaaacaggaagaacgctaggggcttgtagtttcccttgtttatttatatggtgttattcctagtgttgcactcaaatttttcattattgatgaaaattactgttt

SEQ ID NO: 4646 - DNA, 1630 bp, Avena sativa
tccatttcggcgtcccgtccggtcccctcccccacatggcgacgctgccgggcggggcccaccctgccggcgcggcagctgacccgatgcaggtcgacgagccgcacgccgccgccgcggctcccgtggtcgagaagcatggagcttctattatccaagggagcgatccagtcactggtcacataatctccacaacgatcggagggaagaatggagagcctaaaaggactattagctacatggcagagcgagttgtcgggactggatcatttggaattgtcttccaggcaaaatgtctggagacaggtgagactgttgccattaagaaggttttacaggacaagcgttacaagaacagagagctgcaaataatgcgatcaatggaccattgcaatgtcgtttgtttgaagcattgcttcttctctacaacaagcagagatgaacttttcctcaacttggttatggagttcgttcccgagtcgttgtatcgtgttctgaagcattatagcaatatgaaccaaagaatgccacttatatatgtcaaactgtatgtgtaccagatattccggggtttagcttacatacatagtgtgcccggagtttgccacagggatatcaagcctcagaatcttttggtggatcctctgactcacacagtcaaaatatgtgattttgggagtgccaaaatgttggttaaaggcgaagcgaacatatcgtacatatgctcacggtattaccgtgctcctgagctgatatttggtgcaaccgagtacacaacatcaattgatatatggtcagctggatgtgttcttgccgagttgcttcttggccagcctctatttcctggtgaaagtgcagtggaccaacttgttgagataattaaggttcttggtactccaacacgtgaggaaatccgctgtatgaatcccaactacactgagtttagatttcctcagataaaagctcatccatggcacaagattttccacaaacgaatgccaccagaagcaatagacctagcgtcacgtcttcttcagtattcaccaaatctacgatgcactgctctcgaagcgtgtacacatccattctttgatgaactacgagagccccatgcaaagttgccaaatggtcgcccattccctccactgttcaacttcaaacaggaagtagcaaatgcttcaccagagctcatcagcaggttgataccagaacatgctaggcgccattctgggttgaatttcttgccttcgacggggcagtagggaaggctgtacgatattatcttgttcatgccaaagggcaacctgcacgttctcacaaatttagaatctgacaaccattattggaagctgaagacgagctggtgccattacgtttgtatgagggggtctgtatttgtcaagccagcccctgatgtaacctttaatgctccaactccattatgaggaggcaatggatgccagcagctgaagattagccaagaaccgtgcgcatggctggagagaattgggatggtgtattgttaagcaattggtgggaccagaggaaaaccatgtattgtaactttctccatgtttaatggtgtagcgcgcctgtaagtgtttcacatgttctaccgtgaatgtagttg

SEQ ID NO: 4647 - DNA, 1933 bp, Prunus mume
gagaaaaatacaactaagccaagagctaaatgatgtgagagagtagagagcgaaaaagagagaaggtgggtgtgtgagagagtcgcaatctcactatcacatggggtctttggctttggggccaaagcatcaacaagcagaggcacagccacagcgacagccagaccacaatgagccactgaaccacgtgactcgccgagcccccgatatggactccgacaaggaaatgtcagctcctgttattgagggaaatgatgcagtcaccggtcacatcatttcaacaaccattggtggcaaaaatggtgaacccaaacggacgatcagttacatggcagagcgtgttgtaggtactggatcatttggaatcgtttttcaggctaaatgcattgaaactggagaaacggtggccataaagaaggtcttgcaggacaggaggtataaaaatcgcgagttgcagttgatgcgcttgatggatcacccaaatgttgtttccctgaagcattgtttcttctctacaacgagtaaagatgagcttttcttgaatcttgttatggaatatgtacccgagactatgtacagggttctgaagcactacagtagtatgaaccaaaggatgccactaatctatgtgaaactttatacatatcaaatttttaggggcctggcttatattcatgctgttcctggtgtttgccatagagatgtgaagcctcaaaatcttttggttgatcccctcacccatcaggttaagctttgtgacttcggaagtgcaaaggttctggtcaagggggaagcaaatatatcatacatatgttctcgttactatcgggctcctgaactcatctttggtgcaacagaatatacaacatccattgatatctggtcagctggttgtgtccttgctgagctccttctaggccagccattgtttccaggagagaatgcagtggaccaacttgtagagattatcaaggttcttggcactccaactagagaagaaattcgatgcatgaatccgaactacacagattttaggttccctcagattaaagctcatccttggcataaggttttccacaagcgaatgccgcctgaagcaattgaccttgcctcacgacttcttcaatattcgccgagtctacgttgcactgcgctagaagcatgcacacatcctttctttgatgaacttcgggagcccaatgctcgccttccaaatggtcgcccactgccaccgcttttcaacttcaaacaagaattaagtggagcatcacccgaactgatcaacaggctcataccagagtatatgcggcagcagactggtcttggattcccacacccagttggtacttgaatgtaaagtcatgaaacaaggaattatctcttctactagtggatggatgtgaagcaaaagagggcctctttgtggtctatataacactcagcattctggcctaatctgctgttctcgccctcccctccgatggtgtatacatatagtggctctccagcttaacctggaaattgttgatcctgtcttctatgtcattttagcccaaacatactgtcttcctgcatctgtacatcgttttgattgtaatgattccagaaagccaagtgtataagtttattcaaatctagctagggtaggggctgtaaaagtccggtgccccgaggggcataatagtagtgcggcttgtcgtttaccttttaattatggtgttgtttctgctgtctgttgctgtcttgtctcgaattatattttgctattgttgatttctgtatttttttaatttcttcaatactgccttcttctggataatttcaaatctctgctgtttaatggggcaggggtttgagcttcataatttaatagaacattcttgctcagtgtttgaagttggtatctatggggttggcagtaacagaaaattac

SEQ ID NO: 4648 - DNA, 1873 bp, Prunus persica
gtgtgagagagtagagagcgaaaaagagagaaggtgggtgtgtgagagagtcgcaatctcactatcacatggggtctttggctttggggccaaagcatcaacaagcagaggcacagccacagcgacagcaagaccacaatgagccactgaaccacgtgactcgccgagcccccgatatggactccgacaaggaaatgtcagctcctgttattgagggaaatgatgcagtcaccggtcacatcatttcaacaaccattggtggcaaaaatggtgaacccaaacggacgatcagttacatggcagagcgtgttgtaggtactggatcatttggaatcgtttttcaggctaaatgcattgaaactggagaaacggtggccataaagaaggtcttgcaggacaggaggtataaaaatcgtgagttgcagttgatgcgcttgatggatcacccaaatgttgtttccctgaagcattgtttcttctctacaacaagtaaagatgagcttttcttgaatcttgttatggaatatgtacccgagactatgtacagggttctgaagcactacagtagtatgaaccaaaggatgccactaatctatgtgaaactttatacatatcaaatttttaggggcctggcttatattcatgctgtacctggtgtttgccatagagatgtgaagcctcaaaatcttttggttgatcccctcacccatcaggttaagctttgcgacttcggaagtgcaaaagttctggtcaagggggaagcaaatatatcgtacatatgttctcgttactatcgggctcctgaactcatctttggtgcaacagaatatacaacatccattgatatctggtcagctggttgtgtccttgctgagctccttctaggccagccattgtttccaggagagaatgcagtggaccaacttgtagagattatcaaggttcttggtactccaaccagagaagaaattcgatgcatgaatccgaactacacagattttaggttccctcagattaaagctcatccttggcataaggttttccacaagcgaatgccgcctgaagcaattgaccttgcctcacgacttcttcaatattcgccgagtctacgttgcactgcgctagaagcgtgcacacatcctttctttgacgaacttcgggagcccaatgctcgccttccaaatggtcgcccactgccaccacttttcaacttcaaacaagaattaagtggagcgtcacccgaactgatcaacaagctcataccagagcatatgcggcagcagactggtcttggattcccacacccagttggtacttgaatataaagtcgtgaaacaaggaattatctgttctactagtggatggatgtgaagcaaaagagggcctctttgtggtctatataacactcagcattctggcctaatatgctgttctcgccctcccctccgatgatgtatacatatagtggctctccagcttaacctggaaattgttgatcctgtcttctatgtcattttagcccaaacatactgtcttcctgcatctgtatatcgttttgattgtaatgattccagaaagccaagtgtataagtttattcaaatctagctagggtaggggctgtaaaagtccggtgccccgaggggcataatagtagtgcggcttgtcgtttaccttttaattatggtgttgtttctgctgtctgttgctgtcttgtctcgaattatattttgctattgttgatttctgtatttttttaatttcttcaatactgccttcttctggataatttcaaatctctgctgtttaatggggcagaggtttgagcttcataatttaatagaacattcttgctcagtgtgtttgaagttggta

SEQ ID NO: 4649 - DNA, 1821 bp, Nicotiana benthamiana
agtggggttaagggggaaataataaagcaattagagaatatagaaagaagaaaagaaagaagcagcagaagaggaagagcacatggcctcgttaccgctggtacctcagcagcaccataatccaccggaaaatcatcagcatcagcagaatgctcatcgtgaccaaggagcagcagctgccgttaggcacgccggcgccggcgcacggccggaaacggattccgacaaggaaatgtcagctgccgttgttgagggtaatggtgctgtcactggtcacataatttccaccacaattggaggcaagaatggggaaccaaaaaggacaatcagttacatggcagaacgagttgtcggtacaggatcatttggaatagtgtttcaggcaaaatgcttggaaactggagagactgtggccataaagaaggttttgcaggacaaacggtataaaaatcgtgaactacagctgatgcgcttgatggatcacccaaatgtcatttgtctaaagcactgcttcttttccacgacaagtagagacgagcttttccttaatttggtcatggattacgtccctgaaagcttatacaaggttttaaggcactatagcaattcaaaccaaaggatgccactcatctatgtcaaactttatatgtatcagatattcagggggctggcttacattcataatgttccaagaatttgccatagagatgtgaaaccacaaaatcttttggttgatcctctgacccatcaagtcaagctttgtgactttggaagtgcaaaagtcctggtgaatggtgaagcaaatatttcgtacatttgctctcgctactacagagctccggaactcatatttggtgccacagagtatacaacatcaattgatatttggtcagcgggatgtgttctttctgagcttcttctggggcagccgctctttcccggtgaaaatgctgtagaccaacttgtagagattatcaaggtccttggtactcctactcgagaagaaattcgatatatgaacccaaattacacggatttcagattcccacagatcaaagctcatccttggcacaaggtattccacaaaagaatgccccctgaagcaattgatcttgcttcacggcttctccaatattcaccaagtcttcgctgtactgcgctagaagcgtgtgctcattcattctttgatgagcttcgtgagcccaatgctcgtctcccgaatggacgtccattaccacctcttttcaacttcaaacaggaattaactggagcttcacctgatttggtaagcaaactgatccctgagcatgtgtggaggcaaactggtttgaattttccctatcctggtgcgacgtaattgtcctaatgaaattaaagctagtgtatcaaggtagagggaggctttgttgatttagtgtaacctggcattttggcttaaccagcagctacgtacgcctgtaagttgtatgtgtatagtcgctgcttggcttacaaggaagtgatcctgctactatgtcatcttaatagcagacttgttgccgcttctgtatattgttttgataagaaaatttcagataggagtataaaatgataaatattgtaatgtctagttaggcagatttcattgagaagacattaggatttgtagctttcagttgtggttatttatatttacatgcagttcctttttgctcttttttctgttctcctgagcctggagcaaatgttatccaaggactctccaagctttggcttctttttttttctgccttagaaggaccaatttgattgttttttcttaaactgatgattgttgaattt

SEQ ID NO: 4650 - DNA, 1923 bp, Silene vulgaris
aaacacaaaagaaagagaagaataaactagtgtggtctctagatagagaaagagagattagcattagctgctagctggaagtaaaaaaaggcacatggctctcaataaccatacacttaatccctcacttaatcaacctcaacctcctcctcctcttaatcctcttcttcctgatcttaataagcatcctattcctcctccttcagttccttcttccatccctaaaatgtctgaagataaggaaatgacaccggctgtaattgaaggcaatgaccaagttactggccacattatatcgacaactattggtggcaaaaatggtgaaccaaaaaggactataagctatatggcagagcgtgttgttggtactggatcatttgggattgtgtttcaggcaagatgcttggagactggtgagaccgttgcaattaagaaggtgttacaagataggcggtacaagaaccgggagctgcaattgatgcgtttactagaccaccccaatgtaatatcgctcaagcattgtttcttttcaacaaccagtagagatgagctgttcctcaacctagtgatggaatacgtaccagaatccttgtaccgcgttttgaagcactacagtagcatgagccaaaggatgccacttatatatgtcaagttatacacgtatcagattttccgtggattggcatacatacattctgttcctggtgtttgtcatagagatatcaaacctcaaaatctccttgtggatcctcttactcaccaacttaagatttgcgattttggaagtgctaaagttctggtgaagggagaacccaacatttcatatatatgttccagatactaccgtgcacccgagctaatatttggtgcaacagaatatacaacatccatcgacatctggtcagttggttgtgtccttgccgaactgcttcttggtcagccattattccctggagaaaatgcggtagatcagcttgtggagattatcaaggttcttggtactccaactagagaggagatccgatgcatgaatcccaactatactgattttcgattcccccagataaaagctcacccctggcacaaggttttccacaaaagaatgccacctgaagccattgatcttgcctctcggctactccagtattctcccagtcttcgctgcactgctctggaagcatgttctcatcaattcttcgatgagctccgtgaacctaatgcacgccttccgaatggtcgacctctgccgccgcttttcaactttaagcaggaattagcaggagtttcacaagaactgatcaatcgtctggtaccagaacatgtgcgacgccaagctggtttcccacatcccggataagacaggaggctcaatcggtggaagcgtagctggaatcttgatggatggtgacagcctggtggatgagttgctagtttttgtaatttgtatttgtgggccttatcatcgagccttcaagctggctttttgctcacctgcaaagatgtatacataatagtcgagctgcaaaataacagggtcctgtgtactggtgtaaccgttagggctgtacatcgttttgatcgtaaatgtctcaggttagggaagttttaactaagactcaaggctaagtctagctagattggatgcttaaatactgctagcataacttgaaattttgtcgtcgtctattatgtgttcttgtcgtatgtgttttaacctctaggtgcattgttattctcattctactcgtcttcctattgctggtagatttgcttatggagtgacaaatgctatgcagctcatctgcataaaagaggggacaaacatgtaaatttggcgcgtgaacttgtttgaacctgttgttccgtatttttctgtcgcctattgaaatctgatcctctatcccaggcatcccacggtaacct

SEQ ID NO: 4651 - DNA, 1390 bp, Chelidonium majus
aagaggctaagagctgtattcacatggcattgttgcatttgggtcctcctaatctgccagaaaatgaaggagtgaaggttaatcgccggacagaaatgggagacgataaggaaatatctgctactgttattgaggggaatgatccagtcactggtcacatcatttccactacaatcggaggcaaaaatggcgagcccaagcagaccatcagttacatggccgagcgtgttgtagggactgggtcatttggaatcgtctttcaggcaaaatgcttggaaactggagagcctgtggctataaagaaggtcttgcaggacaggcggtataaaaatcgtgagctgcagctaatgcgctcaatggatcacccaaatgtgatttctctgaagcactgtttcttttccaccacaagcagaaatgagctttttctaaacttggtcatggaatacgtccctgagaccgtgtatcgggttctaaagcactacagcaatgtgaaccagaggatgccactcatctatgttaaactttatatgtaccaaatttttagggggttagcgtatattcacactgttcctggagtttgccacagggacgtgaagcctcaaaatattctggttgatcctctaacccatcaggtcaagctatgtgattttggaagtgcaaaagttctggtcaagggtgaagcaaacatatcctacatatgttctcgctactatagggccccagaactcatatttggtgctacagaatatacaacatcgatcgatatctggtcaggtggttgtgttcttgctgaacttcttctaggccagccattgtttcctggagaaagtgcggttgaccagcttgttgagataataaagattcttggtactccaacacgggaggaaattcgttgtatgaatccaaactatactgattttaggtttccgcagataaaagctcacccttggcacaaggtttttcataaacggatgcctccagaagcaattgatcttgcttcacggctacttcaatattcaccaagtcttcgatgcactgcgttagaagcatgtgctcatcctttctttgacgagatccgagaacccaatgctcgcctgccaaatggacgtcctttaccccctctcttcaactttaaaccggaattatctggagcctctgtggagctgattaacaagctagtacctgagcatgtgaggcggcaatcaggtctgagtttcttgtatccgggcacataaaggcagaaaagagcctgctatcagtttctgcaacttaatggatgctatactagagctctgtctttgtggtttactacctatcatgcaatacaacccccaactactgattgtttctagcgttgggaaggcaataaatatatatatatatatataca

SEQ ID NO: 4652 - DNA, 1776 bp, Cocos nucifera
tggagcataaatgtggtaattaacaatgcttggtggttaagattgtggatattttgggaacgggagttgggggagtaagggaaagagagggaccgaggaggtggtgttgttccacatggcttcgctgccgctggggcctcatcatccccctgagcctgaggcgatgaggaccgatcctcgccggccggagatggccgaagacaaggaagcctctgttatcgaggggaatggtccagtaactggtcacattatctcaactacgattggaggaaagaatggcgaagccaaacggaccattagttacatggcagagcgtgttgtgggtactgggtcatttggaattgtctttcaggctaaatgcttggaaactggggagattgttgctataaaaaaggtcttgcaagacaggcgatacaaaaaccgtgagctgcaactgatgcgttcgatggatcatccaaatgtgatttctctgaagcactgtttcttctctaccactaacagagatgaactgtttctcaacctggtcatggaatatgtccctgaaactgtattccgtgtcctgaagcattacagcaatgtaaagcagaggatgcctcttatctatgtgaaactctatatgtatcaggtatttagggggttagcatacattcatactgttccaggaatttgccatagagatgtgaagccacagaatatcctggtcgatcctcttactcatcaagtcaagctctgtgactttggaagtgccaaaattctggtcaagggtgaagcaaacatatcatacatttgctctcgctattaccgtgctccggagctcatatttggtgcaacagaatatacaacatcgattgatatatggtcagcaggatgtgtacttgctgagttgcttcttggccagccattatttcctggagaaagtgctgttgatcagcttgttgagataatcaaggttcttggtactccgactcgagaagaaattcgatgcatgaatcctaactatacagaatttaggtttcctcagataaaagctcatccttggcacaaggttttccacaagcgaatgcctccagaagctatagatcttgcatcccgtcttcttcaatattcaccaagcctccgttgcactgcacttgaggcttgtgcccatcctttctttgatgagctacgagagcccaacgcacggttgccaaatggtcgcccttttcctcctctcttcaacttcaaacaggaactagcagttgcttcgcctgagctcatcaacaagctaatacctgagaatgtgaggcgacaatatggtcttactttcccgcttccagctgggacgtgaggcagtaactagggcactttttgatgaattgtaatcaaaagcacggaggccttcagggtttgaacggaaaatgatgaatgctgaaccattgagctgccggtttatttagtggttcatgtcttaaccctaccaatattgcagctagccttgtatattgcctgattgttgggattgaaaatgattgtaagggaatgctgatgctgagcgttcggcaaagggcaagaaagtgttgctggaggaattcgactgtgttagaaacagatataggctgagacctcgtttctttcttgtttttcaaaacttcccccccccccccccccccccagttgggtgctcttgaagttttgatggtttgtgtaaattgttctcgctcaggactgcttctctaggaagctggaaatagaattttggctgtgttgctagttctgacccttggaattctgagttgt

SEQ ID NO: 4653 - DNA, 1624 bp, Eschscholzia californica
tattgaatagctgtaaccacatggcttcgttgcctctggggcctcctcatccaccagaaaatgagggagtaaagaattctgcttctgctgctgcacctcgtcggacggaaatgggagacgaaaaggatatatcagctgccgttgttgagggaaatgatcaagttactggtcacatcatttccaccacgattgggggaaaaaatggtgaacccaagcagaccattagttacatggccgagcgtgttgtggggactgggtccttcgggattgtctttcaggcaaaatgcttggaaactggagagactgtggctataaagaaggttttgcaagatagacggtacaaaaatcgtgagctacagttaatgcgttcgatggatcatccaaatgtgatatctttgaagcactgtttcttttccaccactagtagaaatgagctttttcttaatttggtaatggaatatgtcccggaaactttgtaccgggttttggagcactacagcaatgtgaaccagaggatgcctctcatttatgtgaaactttacacataccaaatttttaggggtttagcttatattcacacggtccatggagtttcccacagggatttgaagccgcaaaatcttctggttgatcctcttacccaccaattgaagctttgtgattttggaagtgcaaaagtgctggtaagaagtgaggcaaacatatcgtatatttgctctcgttactaccgtgctccagaactcatatttggtgcaacagaatatacaacatctattgatatttggtcggctggttgtgtgctagccgagcttctcttaggccagcccttgtttcctggagaaagtgctgttgatcagcttgttgagatcattaaggtccttggtactccaactcgcgaggaaattcgctgtatgaatccaaattacacagaatttaggtttccgcagattaaagcacatccttggcacaaggttttccacaagcgaatgcccccagaagccatcgatcttgcttcacgacttcttcaatattcaccgagtcttcgatgcacagcgcttgaagcatgttctcatcctttctttgatgaactccgtgaacccaatgctcgtttaccaaatggtcgccctttgcctacactcttcaattttaaacaagaattatctggggcatctcccgagctcatcaacaggctaatacctgagcacataaggcgacagtctggtctgaatttcttgcacccaaccacataaaatgaagacagaagcttcgttgtaatatttggactacttggtcaaggtgcaaatcagaggactccctctcattgtggtcaatgcatcctcgtgtatcgaggtcttccgaccagcgatttctagctctcatgcagatacaaacaagggtagctagatcccatagtctcctggggtttaattgcttttgttttcttattgtcttcctaaaatgtttcttttgccttttgtatatttgtctgatcatcaaagataataacaattgtatcgatcggaactgtgttggaatagcttatattgcagccaacctttgtctagttatataggaagttgtggatgtaaaagacccgcaggagataaactgggttagttagttt

SEQ ID NO: 4654 - DNA, 1504 bp, Eschscholzia californica
cgactcaccaaaaaacgttaaagagagagagagagagtagctgtagctgtggtggtggtggtatatacatggcttctgtgccgctagggcttcatccgccggaaaatgaacaagtaaaggttgctgctgtacctcgtaggtcagagatgggagacgataaggaaatgtcagcctcagttgttgaggggaatgatcaagtcactggtcacattatttccaccacaattggaggaaaaaatggggaacccaagcagacaattagttacatggcagagcgtgttgtggggactgggtcattcggaattgtctttcaggcaaaatgcttggaaactggagagcctgttgctataaagaaggtcttacaggatagacgatataaaagtcgtgagctgcaattaatgcgtttaatggatcatccaaatgcaatatctttgaagcactgtttcttttcaaccactagtagaaatgaacttttcctcaatttggtcatggaatatgtcccggaaactctgtaccgggttttgagacactacagcaatgtgaaccagaggatgccactcatttatgtgaaactttatacatatcaaatttttaggggtctagcttatattcacaccgtccatggaatttcccacagggatgtgaagcctcaaaatcttctggttgatcctcttacccaccaagtcaagctttgcgattttggaagtgcgaaagtgctggtgaagggcgaggcaaacatatcatacatttgttctcgttattaccgtgctccagaactcatatttggtgcaacagaatatacaacatctattgatatttggtctgctggttgtgtgctggctgagcttcttctaggccagcccttgtttcctggagaaagtgcagtagaccagcttgtggagatcatcaaggtccttggtactccaactcgtgaggaaattcgctgtatgaatccaaattacacggaatttgggtttccacagagaaaagctcacccttggcacaaggttttccacaaaagaatgcctccagaagccattgatcttgcttcacgacttcttcagtattcaccaagtcttcgatgcactgctctagaagcatgctcacatcctttctttgatgagctccgagaacccaatactcgtctaccaaatggccgtcctttacctccactcttcaactttaaacaagaattatcgggggcttccgttgaactcattaataggttgataccggagcatgtgagacggcaacaatttggtctgaatttcatgcacctggcaggcacctaaatgaaaactggaatttggtatctgctgaactacttggacaagatgcaaatcagagagaacttcctctgattgtggttaaaaatccttgagcttaaggcgctatcagtaatttgtagctcgggcagctagagagatattataggctgactagccgagcttggctgaatatgtgtaggtcttctaagattttatgcttttatatatgctaatgg

SEQ ID NO: 4655 - DNA, 1501 bp, Trifolium pratense
agtttgagagtgttttgttttgtgtgttactttctgaaatggccgccatgccgttggggccgcaccaccatcaaccaccgcaacaaccaccgttaccgctaccgttaccgttaccacagcaacagttacagcaaccacaaacactgaatgagccgatgaaaacgaccgcggctaatggcgtctccgatatgaacaccgataaggaaatgtcggctactgtcgttgacagtaatgatgcagtcactggtcacataatctcaactaccattggaggcaaaaatggtgaacctaaacggacaatcagttacatggctgaacgtgttgttgggacgggatcatttgggattgtttttcaggcaaagtgcttggagactggtgaggcggtggctataaagaaggttttgcaagacaagcggtacaaaaatcgtgaactgcagttaatgcgtgtattggatcacccaaatgtaatttccttgaagcactgtttcttctctacaacaagcagagacgaactttttcttaacttggtcatggaatatgtccccgagacgatgtaccgagttctaaagcactacaataatatcaaccaaagaatgcccctaatctatgtgaaattatatacataccaaatattcagaggactagcatatatccatactgttccaggagtttgccatagggatgtgaagcctcaaaatctattggttgatcctctcactcaccaagttaagctttgcgattttgggagtgcaaaagttctggtcaagggtgaagcaaacatttcatacatatgttcacggtactatcgggccccagaactaatattcggtgcgacagaatacacaacttctattgatatctggtcagctggttgtgtccttgcagaacttcttctaggccagccactattcccaggagagaatcaggtggaccaacttgtggaaattattaaggttcttggtactccaactcgagaagaaattcgttgtatgaaccctaattattccgattttagattcccccagattaaagctcatccttggcacaaggtttttcacaagcgcatgcctcctgaagcaattgaccttgcatcaaggcttcttcaatattcaccaagtcttcgttgcagtgcactggaagcatgtgcacatcccttctttgatgagcttcgagagcccaatgctcggcttcctaatggtcgtcctctgcctcctcttttcaactttaaacaggaattatctggagcatcccctgaactgatcaataaactgatcccagagcatgtcaggcggcaaactggtctcggcttttcccatatcccggctagcacataaatgtaaagagatcattaatgaaacaatgagtcaaccctggtagttattaatgttaaacacaggtccccccgttatggtcaatagattaggattcaggccttatatatgaagttttcctccaaaccccaatcacccctctccccaaagatgtaggtatacatgtactg

SEQ ID NO: 4656 - DNA, 1702 bp, Saccharum officinarum
tagcagcagcgaccccgaagcagcctcccccatcaccggggagagagagaggcctgccgccgcgcgaccgccccacatggccaccgcgctcggtgggggggcccaccccaccgccgacgccatggaggtcgacccgccgcgcgcctccgccgacgagaagcacgtcgtcactattatggggggaagtgatgcagtgacaggccatataatatcgaccacaattgggggaaagaatggtgaaccaaaaaggactattagctatatggccgagcgagttgttggaactggatcatttggggttgtcttccaggcaaaatgcattgagactggtgaaactgttgcaattaagaaggttctacaggacaaaagatacaagaatagggagttacaaataatgcggtcgattgaccattgcaatgtcattaccctgaagcattgtttcttctctaccacaagtagggatgaacttttccttaacttagtcatggagtttgttccagagtcactttatcgtgttctgaaacactacaaagacatgaagcagaggatgcccctgatatatgttaaattgtacatgtaccagatactccggggattagcttatattcatagtgtcccaggagtttgtcaccgagatattaagcctcagaatattttggtggatcctctttcccaccaagtcaaggtttgcgacttcgggagtgctaaaatcttgattaaaggtgaagctaatatatcatatatatgctcacgttattatcgtgctcctgagctcatatttggtgcaactgaatacacaacatctattgatatatggtcagctggatgtgttcttgctgagcttcttcttggtcaacctttatttcctggtgaaaatgctgtggaccagcttgttgagattatcaaggttttgggcactccaactcgagaggaaattcgttgtatgaatcccaattatacagaattcaagtttcctcagataaaagcatgtccatggcacaagatcttccacaagagaatgcctccagaagcaatagatcttgtttcccgtcttcttcagtattcgccaaatctgcgatgtagtgcacttgaggcgtgtgctcattcattctttgacgagctacgagaaccacatgcaagactcccaaatggccgcccatttcctccactattcaactttaagcaggaactagcaaacgcacgaccggagcttatcagcaggctgttaccagagcatgctcagcgacattcaggatttggttccttatttgggagtggacagtaggagagggatgtatggaaatctcgtttttaatgttgggctgctgtacgctgccaaagggcaatctgcatatcccgcatttaagttttagaacctgaccatcttgttgaaaagttgccagccgtaaaaatctaatgctgaaaccagtggtggcccttgtgtccatgttctgccaagagcggcacataatgctggggggaatggttggtgtattgttaagcatggagggtaactgcaggagctaatgtattttcacgtttcatgtttgtagcgaacttgtacctgtactatcgcaactgatgtaatcatgtcaatgcttctgaactgttttaagttatccggtcaatcatttcattccttcttcctcttagggtgtttggacacaatgaggaacgaaatgattctatctctgtttttggg

SEQ ID NO: 4657 - DNA, 1538 bp, Cyclamen graecum
agagagagggagggctgagctgtagtgcacatggcttcgctgccggtgggaccacttgacaaccaccacttagctccgccgccgcaccgcccgccggagacggacgccgataaggaaatgactccggctattattgagggaaatgatcaagtcacaggtcacataatttctacgactattgggggcaaaaatggtgaacctaaacggaccatcagttacatggccgagcgtgtagtgggtactggatcgtttggcatcgttttccaggcaaagtgtttggaaactggagagacagtcgccataaagaaggtgttgcaggacaggcgttataaaaaccgtgagctgcagttgatgcgtttgatggatcatccaaatgtcgtttctctgaagcattgtttcttttctacaacaactagagacgagcttttcctgaatttggtgatggagtatgtccccgagacaatgtaccgtgtactgaagcactataccaatgccaatcagagaatgccactcatatatgtcaaactttacacttatcagatactcaggggccttgcgtatatccataccggtcctggagtttgccatagggatgtgaaacctcaaaatcttctggttgatcctctcacccaccaagtgaagctatgtgacttcggaagtgccaaaattttgatcaagggtgaagcaaacatatcctacatatgttctcgttattaccgagctccagagctcatttttggtgctacagaatatacatcagcaattgatgtttggtctgccggttgcgttcttgctgagcttctacttgggcagcccttgtttcctggagaaaatgcagttgaccaacttgtggagattatcaaggttcttggtactccaactcgagaggaaatcagatgcatgaatccaaattatactgattttaggtttcctcagatcaaagctcatccttggcataaggttttccataaacggatgcctccggaagcaattgatcttgcttcaagactccttcaatactccccaagtcttcgatgcactgctctggaagcatgtactcatccattctttgatgagcttcgtgagcctaatgcccgtcttccaaatggccgtcctttgccgcctctgttcaacttcaagcaggaattggctggagcgtcatctgagttgatcagcaggctaatacccgagcatgtgcaaagacaaattggtctcttccctcatcctgctggcacttgagcgaacaatttaaggtgggacgaagcttttctgctattctgtggatatatcaagtaaaagagagcctattatcggtctaatttatacaaccccagtgtttgcttaagtccgagtttccttacccatggaaaatgtatgattgtatcgaagattctatttttgtgttcatcgtagctaaaagaacttgcctgcttctgtacattgtgtttatcccaacaactcggggaaaattagctagtagtgtccaaaaaatattgtatgtttgtgtttacctagatatttctattcaaaacaccagt

SEQ ID NO: 4658 - DNA, 1426 bp, Echinochloa colona
gctttgcccaacgggcggaaggaagaagacccaaggccaagggcagggaataaaaaagcggcgtggtggtgggcagtgtgcagacagggacagtgcccacaccccccatggccccctcctcacggtcacgctagcaggcagcggcagcctctcccctccccctccatcaccgaggagagagaagccagccaccgccccacatgaccaccgtgccaggtggcgggccccaccccgccgccgacgcgatggaggtcgacccgccgcgcgcctccgccgacgagaagcatgtcgccactgttatggggggaaatgatgctgttacaggacatataatctcaaccactatcgggggcaagaatggtgaaccaaaaaggaccattagctacatggctgaacgagttgtgggaactggatcatttggggttgtcttccaggcaaaatgcattgagactggcgaaactgttgccatcaagaaggttttacaggataaaagatacaagaacagggagctgcagataatgcgatcaattgaccattgcaatgtcatttccctaaagcattgtttcttctctaccacaaatagagatgaacttttccttaacttagtcatggagtttgttccagagtcactttatcgtgttctgaaacactacaaagatatgaagcagaggatgccccttatatatgttaagctgtacatgtatcagatattccggggattagcttatattcataatgcaccaggagtttgtcaccgagatattaagcctcagaatattttggtggatcctctttcccaccaagtcaaggtttgtgacttcgggagtgctaaaatcttggttaaaggtgaagcgaatatatcgtatatatgctcacgttactatcgtgctcctgagcttatatttggagcaactgaatacacaacatctattgatatatggtctgctggatgtgttcttgctgagctgcttcttggtcaaccgttgtttcccggtgaaagtgctgtggaccagcttgttgagattatcaaggttttgggtactccaacacgagaggaaatcaggtgtatgaaccccaattacacagaattcaagtttcctcagataaaagcatgtccatggcacaagatcttccacaagcgaatgcctccggaagcaattgatcttgtttcccgccttcttcagtattcaccaaatctgcgatgcagtgctcttgaggcatgtgctcattcattctttgatgagttacgagagccaaatgcaagactcccgaatggccgtccatttcctccactgttcaactttaagcaggaactagcaaatgcaccaccggagctcatcagcaagctgttaccagagcatgctcgacggcattcaggatttagttctttatttggaaccggaccataggagaaggatgtatggaa

SEQ ID NO: 4659 - DNA, 2252 bp, Setaria italica
cccaaatccactgcatcgcgaaaccgaaaagagagcagagctcccctgctctcggctgctctgctttgcccaacgggcggaaggaagaagaccggaagcgaataaaaaagcggcgtggtggtgggcagacagggacagtgcccacaccccccatggccccctcctcacggtcacgctagccccgaagcagcagcctccccctccccccccatcaccgaggagagagaagccattcgcagagccaccgccccacatggccaccgcgcccggtggtgggcccctccccgccgccgacgccatggaggtcgacccgccgcgcgcctccgccgacgagaagcacgtcgccactgttatggggggaaatgatgccgttactggccatataatctcgaccacaattggtggaaagaatggtgaaccaaaaaggaccattagctatatggctgagcgagttgttggaactggatcatttggggttgtcttccaggcaaaatgcattgagacgggcgaaactgttgccattaagaaggttctacaggacaaaagatacaagaatagggagttgcagataatgcgatcgattgaccattgcaatgtcatttccctgaagcattgtttcttctctaccacaagtagagatgaacttttccttaacttagtcatggagtttgttccagagtcactttatcgtgttctgaaacactacaaagatatgaagcagaggatgccccttatatatgttaaactgtacatgtatcagatattccggggattagcttatattcataatgcaccgggagtttgtcaccgggatattaagcctcagaatattttggtggatcctctttcccaccaagtcaaggtttgtgacttcgggagtgctaaaatcttggttaaaggcgaagcaaatatctcgtacatatgctcgcgttactatcgcgctcctgagctcatatttggtgcaactgaatacacgacatctattgatatatggtctgctggatgtgttcttgctgagcttcttcttggtcaacctttgtttcctggtgaaagcgctgtggaccagcttgttgagattatcaaggttttgggtactccaacacgagaggaaatccggtgtatgaatcccaattacacagaattcaagtttcctcagataaaagcgtgtccatggcacaagattttccacaagcgaatgcctccagaagcaatagatctcgtttcccgccttcttcagtattcaccaaatctgcggtgtagcgctcttgaggcgtgcgctcattcattatttgacgagttacgagaaccacatgcaaggctcccaaatggacgcccattccctccactgttcaactttaagcaggaactagcaaacgcaccaccggagcttatcagcaagctgttaccagagcatgctcgaaggcattcaggatttaattctttatttgggagtggaccttaggaaggattgaaacgtcgctgctggtactgccaaagggcaatctgcattccccgcatttaagttttagaacctgaccatcttgtcgaaaagttgagccagcctttttaaaaaaattctagtattgaaacccgaggtggctattgtgtccatgttctctgctaggaacggcacatattgttctgctagtgggtaacggttggtgtattgttaagcatggagggtaacttaattagcttatgttttttttttcatgtttcatgtctgtagcgcacctttgtacctgttacctttaccctgtactattcgcaactgatgtaaccatgtaaatgtgtcttgcccctttcgtgttatgatggtcaagtcacatcttgttctgcctcaaccaagatctggcgacaatgtttgcaggtacaccaaccattggtgaaatgaaagctttgtgtgatggatcaagcaatacgtatttgcaagcgaatgcccttcgctgtttgatgcattgggtcgttgcaatatcctaccttaggtgtagaattggattgagagaccaagagtaatgcaaatcttgcgcagctttatgaaggctccttccaatttgtcctaaatttgtcagtctctgactcggtattccaatgttgcacgtgatgacactgccaatgttccagcttaaattgttcgattgtcttcttttggagccagataattcaaatttgttaggcttacatgctcactaaccacgttacgcaaaccgaaattggttttcaactttcaaagctcgctgagatgacaaaag

SEQ ID NO: 4660 - DNA, 1509 bp, Eutrema parvulum
acatgacctcaataccattggggcctcagcctccggctacagctccgccgccgcagcttcgagacggagatgcttcaaaacatcgtcccgatatgaatacagacaaggaaatgtctgctgctgttacagagggcaatgatgctgttactggtcatatcatttccactaccattgggggaaaaaacggtgaacccaaacagaccattagttacatggctgagcgggttgttggaacaggatcattcggaattgttttccaggcgaaatgcttggaaactggagaatcagttgccattaaaaaggtcttgcaagatcgacgctataaaaatcgtgagttgcaactaatgagactaatggatcacccaaatgtcatctccttgaagcattgtttcttctctacaacgagtagagatgagcttttccttaacctcgttatggagtatgtacctgagactttgtaccgggttttgaggcactatactagctcaaatcagagaatgcccattttctatgtcaaactttacacataccaaatcttcagagggttggcttatatccataccgctcctggtgtctgccacagagacgtgaaaccacaaaatcttttggttgatcccctcacccatcagtgtaagctgtgtgattttggaagtgcaaaagtattggtgaaaggcgaagcaaacatatcatatatctgctctcggtattaccgagctccagaactcatttttggggcgacagagtatacatcctccatagatatatggtctgctggttgtgttttggcagagctccttcttggccagccattgttcccgggagaaaattctgtggaccagctagtggagatcatcaaggttcttggtactccaactcgagaagaaatccgatgcatgaatccaaactacacagacttcagattcccacaaatcaaagctcacccgtggcataaggttttccataagaggatgcctccagaagccattgaccttgcttctcggcttcttcaatattcaccgagcctacgttgcactgcgctcgaagcatgtgctcacccatttttcaatgaacttcgtgagcccaatgctcgtcttccaaacggccgacctctaccaccattgttcaacttcaaacaagagttatctggggcttcaccagagcttataaacaggctaataccggagcacgttaggcgacagatgagtggagggtttccatttcaagctggtcattagaaacctattcgaaactgagatgcttttgctgaggaaatgcctgatggaaaagacaagtgaggattttactttctgatttcgaaagagtcaccagatttaactaaatatatcagcttctgagtagagatgataatctcctccttatggccaattcagctttttgagaaatcaggaggtgatgatgattgtgtctatcatatgtattctctctctcttttctcgttcttatatctgttgttgttcactttgacttgtagagatactttttctcgtg

SEQ ID NO: 4661 - DNA, 2035 bp, Aquilegia formosa
cttacttcttcttcttcttcttcttcttcattttcttcaaaacaacaaacaataatgatggattaataaacaaactcttctcaactttccgactttagtaagatgggtgacgcgaaggaattgaattcagcttttgtcgatgggaatgatcacgtcactgggcatatcatttctaccactattggtggaaaaaatggcgaacccaagcagaccattagctacatggcagagcgggttgtgggcagtggatcttttggaatagtttttcaggcaaaatgcttggaaactggagaaactgtggccattaaaaaggtcttacaagacaggcggtataagaatcgagagctgcagttgatgcgctcgatggatcacccaaacgtggtctgtttgaagcattgttttttttccacgacagcaaaaaacgagcttttccttaatttagttatggaatatgtccccgaaactctatatcgggttctgaggcactacagcaatgtgaatcagaggatgccccttatctacgtgaagctttatacataccaaattttcagggggttagcgtatattcatactgttcatggagtttctcaccgggatgtgaaacctcaaaatcttctggttgatcctcttactcaccaggtcaagctttgtgattttggaagtgcaaaagttctggtaagtggtgaagcaaacatatcttacatatgctctcgttattatcgtgctcctgagctcatatttggtgcgacggagtatacaacatcaattgatatttggtcagccggctgtgtacttgctgagcttcttctaggccagccgttgtttcctggggaaagtgcagtggatcagcttgttgagataatcaaggttctcggtaccccaactagggaagaaattcgctgtatgaatccaaattatacagagttcagattcccacagataaaagcacacccttggcacaaggttttccagaaaaggatgcctccagaagccattgatcttgcttcacgacttcttcagtattcaccaagtcttcgctgcaatgcgttggaagcatgtgcacatcctttctttgatgagctccgagaacctaatgctcgtcttccaaatggccgtcctttgcctccacttttcaacttcaagcaggaattttctggagcttcacaggagcttattaacaagttggtacctgatcacatcaggcggcaacctggatcagtatttttgcatctttcaggaacataaatgtaaacagctgggaggccagggttttgtcgctaaatcaccgagcattcagcttcaagcaacggtacttctagcctcgcagaattacgtattagacaaggcaatggggttcctgggccttctagaatttggtacttttcttgactacattttgcggaatgcttttgtaaattctctgatcacgatgaaagtctctgcgggactgatcaagaagttgtagaagaaatatgactggctgactgtttgtctagttagaagggtactagaagaacagctacagcagaaagggttagttttgttgtgtttgtttacttacctggtgtgttccactcctttttgtaccccttgtggttattgacaacttcaaaaggttacctgtcccccgctccttacatattgctgttaatacaggccttctagctactagctttattgctgtcaataacgttttacagagccatttgttgaaacattatattcaggaaaaaaacttaaatgttgttctttatacctactttacttctgtactaccctaaccaaaatgtgcacttccagttacatgttagttaatagaaattacttcaatgtttgtgtgcaagtgggaacatacttttggactttgtgttaatacatgagtaatacttggggtttgatgtcactgggacttgtatattatttcagtgaaaggggaatatgtaatccaaacaggataatggttcattcagtttggttgtgaatctttttttgtagtctgacttcaatgttgttgcatatgaaatcttaatactga

SEQ ID NO: 4662 - DNA, 1605 bp, Cleome gynandra
cgcgtggatccttctttgtctttaatcgatttcagaaattgagacttgaggagagagagtgagaagaaaaatagtctttacacttgcagtgtagggcaagagggagctgtaaaacacatggcctcaatgccatcggggcctcagccccagcttctggctccgctgccgcagcctcacgacggagatgctctgaaacgtcgccccgaaatggattccgacaaggaaatgtctgctgctgttatcgagggaaatgatgctgttactggtcacatcatttccactaccattggaggaaaaaatggtgaacctaagcagaccattagttacatggcggaacgtgtcgtcggtacaggatcctttggaattgttttccaggcaaaatgcttggaaactggagaatcggtagccattaagaaggtcttgcaagaccggcgctataaaaaccgcgagttgcaattaatgcgattaatggatcacccaaatgtggtctcactgaagcattgtttcttctctacaacgagtagagatgaactcttcctcaatcttgttatggagtatgttcctgagactttgtaccgggttctgaggcactatactagttcaaatcagagaatgcccattttctatgtcaaactttacacataccaaatcttcagaggtttggcctatatccatactgttccgggtgtttgtcacagagatgtgaaaccacaaaatcttctggttgatccacttacccaccaggtgaagctatgcgattttggaagtgcaaaagttttggtaaaaggtgatgcaaacatatcatatatctgctctcggtattaccgagctccagaactcatctttggggctacagagtacacatcatccatagatatgtggtctgctggttgtgttttggcagaacttcttcttggccagccgttgtttccaggagaaaattcagtggaccagcttgtagagatcataaaggttctcggtacacctactcgggaagaaatccgatgcatgaacccaaattacacagattttaggttcccacaaattaaggctcatccatggcacaaggttttccataaacgaatgccgccggaagcaatagatctcacatctcggcttcttcaatattcaccaagtctacgttgcactgcgctcgaagcatgtgctcatcctttcttcaatgaactccgggagccaaatgcccgccttccaaacggtcgaccattgccacctctgttcaacttcaaacaagagttagctggagcttcaccggagctgatcagcaggctaataccggagcacgcaaaacggcagatgagtggtggctttccgtttcatacgggtccttagaaatcgaagacagtcagagaaatgaaaaaggaagctgccgagaaaatgagagaggtcacctccacactgatgaacgaagaagaagatgaaatcattttcgttttcttttttgtttcctcttgcattttgtatatgttttttattttattttgttgcaaacagtttctcttcggacaaaacatagaaacaatggagacatggtgaaatcatttgattatatgtctaaatgcatcaaacattttaacacttccgaat

SEQ ID NO: 4663 - DNA, 1667 bp, Fagopyrum esculentum
gggagagtgtgaaagtacagagaaagagagagaggggaaaccacatgagctcgttgcccttgggaccgcaatcacacaatccgccaccggagcgccaccacattgattctacagcaaggcctcttcaccgtcctcctgaatccatggctgacgataaggaaatgtctgcagctgtgatagaggggaatgatcaagttacaggccacattatttcaacaaccataggtggtaaaaatggtgaacccaaaagaacaattagctacatggcagagcgtgttgtcggcactggctcatttggtgttgtatttcaggcaaaatgcttagaaactgacgagactgtggctataaagaaggttttgcaagataggcgttacaaaaaccgtgaactgcaattaatgagattgatggatcacccaaatgttatctcactgaagcactgtttcttttcaacaacaagtagagatgaactttttctcaatcttgttatggaatacatgccagaatccttataccgtgttcttaagcattacagcagtgtaaaccaaagaatgccgcttatttatgtcaaactttatacttatcagatctttcgtggactggcatatatgcatactgttcctggtgtctgccatagagatgtgaaacctcagaatcttttggtggatccactgacacatcagctgaaaatatgcgacttcggaagtgcaaaagtcttggtcaagggggagccaaatatctcttacatctgttctcgatactacagggcaccagagttaatttttggtgccactgaatatacaacttcaattgatatttggtcagtaggttgtgttcttgcagagcttcttctaggccagccactatttccaggtgaaaatgcagttgaccaacttgtagagattatcaaggttctcggcactccaactagggaggaaattcgatgcatgaatccgaactatacggattttaggtttccgcagattaaggctcacccttggcacaaggttttccataagcggatgccacctgaagccattgatcttgcttcgaggcttcttcaatattcacctagccttcgctgcacagcactggaagcatgtgcacatcctttctttgatgagttacgggatccaaatgctcgtcttcccaatggacgcccgttaccactacttttcaatttcaagcaagagttggctggagcaccacctgaactgatcaccaaactgattccagaacatgtgagacggcaaatgggcttcccaatttcaggatcaacatagaattcaccaagagacaaaaactctcttcagcaagcaaatggtacaatgatcgtgaagcaatgagaagctaatcaaatatcagtattttatatggcaacaatcgccttggcctaaatgatcatcttagagatatctgggctagaaattggagattacattctctttgttgcctgttaccttatctttgtatatgatctttagtaaaggttagccaatacccagaaaatgaaaaaccaatctgggatagataggccttataattagggtggatgttgcactttatgagatctaaatttgcccagactattttaggtttatgcatcagtaagttggatatcttatgttccaaaatgtttttatttgccaaaatagatatatttgctctct

SEQ ID NO: 4664 - DNA, 1310 bp, Platanus occidentalis
ctcgttgccgctggggcctcctcatctaccagacagtgagggagtgaagatcgctcctcgcccgccggagatggctgacgataaggaaatgtcggctgctgttgttgaggggaatgatcccgttactggtcatatcatttccaccaccattggaggcaaaaatggtgaagccaagcggaccatcagttacatggcagagcgtgttgtggggactgggtcatttggaattgtctttcaggcaaaatgcttggagactggagagagtgttgctataaagaaagttttgcaggataggcggtataagaaccgtgagctgcagttaatgcgctctatggatcacccaaatgtgattgctctgaagcactgttttttttcctacaacgagtaacaatgagctctttctcaacctagtcatggaatatgtccctgagactctgtaccgtgtcctgaagcactacagcaatgtgaaccagaggatgcccctcatctatgtgaaactctacatatttttaggggactggcttatattcacaccgttcctggagtttgccatagggatgtgaagcctcaaaatcttctggttgatcctcttacacaccaagtcaggctttgtgattttggaagcgcaaaagttctggtcaagggtgaagcaaacatagcatacatttgctctcgttactacagagctcccgaacttatatttggggcaactgaatatacaacgtcgattgatatctggtcagccggttgtgttcttgctgagcttcttctaggccagccattgtttcctggagacagcacagtggatcagcttgtagagatcattaaggttcttggaactccaactcgagaagaaattcgctgtatgaatccgagttataccgagtttcggtttccacaataaaagctcacccttggcacaaggtattccacaaacggatgcctgcagaagcaattgacctcgcttcaaggcttcttcaatattcaccaagtcttcgctgcactgctctagaagcatgcactcatcctttctttgatgagctccgggtacccaatgtccgcctgccaaacggtcgtccactgcctcctcttttcaactttaaacaggaactttctggagcttcaccagagttgattaacagactgataccagagcatgtgagacggcaatttggtctgaatttcttgcacccatcgggcacataagcaaaggcaggaacctggaatctacttcgtctactttatggttgcaaagagaagggatgccctttctggctatatcatcatatattcagctctgcaagtgggag

SEQ ID NO: 4665 - DNA, 1609 bp, Panax ginseng
acacacagtcaagtattattgtatagagagagaaagacgggcacatggcctcgttgccgctgggacctcagcatccgccagacaaccatgacccgttgaagctcgccgctcctcaccggacggagatggactccgataaggagatgtcagctgctgttattgaggggaatgatcaagttactggtcacatcatttctacaacaataggtggcaaaaatggcgaaccaaaaaggactattagttacatggcagagcgtgtcgtgggtactggatcattcggaatcgtttttcaggcaaagtgcttggaaaccggagaaaccattgctataaagaaggttttgcaggacaggcggtacaaaaatcgtgagctacaattaatgcgcttaatggatcaccccaatgtggtttgtctgaagcattgtttttttccacaactactaaagatgaacttttcctcaatctggtaatggaatatgtccctgagactatgtaccgggttctgaagcactacagcaatgtaaatacaaagaaatgctgcttatttatgtcaaactttactacctaccagatatttagggggtcgtggcgttatatccatactgttcctaggtgtttgtccatagggatgtgaagcctcaaaatcttctagttgatcctctcacccaccaagttaagctttgtgactttggaagtagcaaaaaattaggtcaaggtgaggctaatatatcatacatatgctctcgttattaccgagccccagaactaatatttggtgcaacggaatatactacctcgattgatatttggtctgctggttgtgtccttgctgagcttcttttggggcagccattgtttcctggcgaaaatgcagtggaccaacttgtagagattatcaaggttcttggtactccaactcgagaagaaatacgatgtatgaatccaagttacactgattttagattccctcagataaaagctcatccttggcacaaggttttccacaaaaggatgcctcctgaagcaattgatcttgcttcacgcctcctacagtactcaccaagtcttcgctgtacagctctagaagcgtgtgcccattcattctttgatgagctaagggatcccaatgcccgccttcccaatggtcgccctttaccccctcttttcaacttcaagcaggaattaactggggcttcgcctgagctgatcaacaggcttattccagaacacatccggaggcagagtggtctaagcttcccacatccagctgggacgtaatcaagttgatcaactgttgtgctagttgatggaaggtgaacataaggggtctctttgtttgtttatatcgccagtctttttgccctaaccagtgattttctttctcaagagagatgtatgcgtgaactggttgttttggcttagctgaaggtgaagaacttcccctacttctgtaaaattgtttttgatcgcaaaagatttcagaacgctaggcatacaaaatctggcaattctagtcaaggctagctaggcagatgctctaaagaaacaggaagaacgctaggggctcgtagtttcccttgtttatttatatggtgttattcctagtgctgca

SEQ ID NO: 4666 - DNA, 1934 bp, Eutrema halophilum
aaacggaaagtagagagagagagagagaaataaaagaagagatagagcgagaaagagagctggattcacatgggcttgttctttctctctcctttttctcatcttgcggcctctctctttctctctctctccaccatgatcattaccaaccaaactgattgaaacccatttgttctctcaatctctctctctctctctctctctctctcttttcttttcattctcttctgtgcgtctctaacgccatggctgacgataaggagatgccagctgctgtagttgatggacatgatcaagtcactggtcacataatctccaccacaatcggaggaaaaaatggagaaccaaaacagactattagttacatggcggagcgagttgtcggtacaggctcgttcggaatagtattccaggcaaagtgtttggagactggagaaactgtggcgattaagaaggttttgcaagacaggagatacaagaaccgagaacttcagttaatgcgtgtgatggatcatccgaatgtggtttgtttgaagcattgcttcttttcaaccacaagcaaagacgagcttttcctcaatttggttatggagtatgtccctgagagcttgtatcgagttctgaaacattatagcagtgcaaaccaaagaatgccgcttgtctatgttaaactctatatgtaccagatcttccgcggacttgcctacattcacaatgttgctggagtttgtcacagagatctaaagcctcaaaatcttctggttgatcctcttactcatcaagtcaagatctgtgactttggcagtgcgaaacagctcgttagaggtgaagctaacatttcttacatatgttcacgattctaccgtgcacctgaactcatatttggtgccacggagtacacaacttctattgatatctggtctgctggttgtgttcttgctgagcttcttcttggtcagcccttatttcctggagaaaatgctgtggatcagctcgttgagattatcaaagttcttggtacaccaactcgagaagaaatccgttgtatgaatccacattacacagattttaggtttccacagataaaggcacatccttggcacaagatcttccacaaaaggatgcctccagaagcgattgattttgcctcgaggcttcttcaatactcaccaagtcttagatgcacagcgctcgaagcttgtgcacatccgttctttgatgaactcagagaaccaaatgcacgtttaccaaatggacggcctttcccgcctctcttcaacttcaaacaagaggtagctgcagcatcaccagagctggtcaacaagttgattccagaccatatcaagagacagttgggtctcagtttcttgaatcaatccggaacataaaggatcaaaaagacaagaactttatatatataatgtaccattactcgagccagaaggtagttgaagacaatttggaggacacaattcgaagtttaccctcctcaaactcgttccagaagtgttctattcagacaagtttgatggtcaaagccaagcttctacaaccgacttccccaaatctgcaagaaaatctattccgttgtatcttcttcttttttccttttttatgtttggtaaaaaacacaaatctcctctttgcttattttcttctgtcttttctgcatctgtaaatgagtttagtcagagatttttatatagtaaagtttgagcagaaggtgaagaatctagtcaaagcgatacaatcggtctaccccgaagaggaaggctggagtttctgcagtttaaggggggttgctttgttttttttttcctccttttgaatgtttgtcttcttctattttgttgttattgccaaattttatgagatggtttgtttatcactctcttctcttccttataaagtcaaatctcaagactttttttgtc

SEQ ID NO: 4667 - DNA, 1569 bp, Musa acuminata
gggtacctccggaatgcagctgcggagaaaggacgagtggaagagagagagagagagaggggagggggagagcagcgagaggtgtcgttggctatcaacatggcgtcgttgccgacgggacctcctcatgcgcccgcgagcgaggcgttggtgatggatcctccccggccggagatggtggacgcggataagcaagaagcatccgtcatccaggggaatcagccaatgactggccacattatctcaaccaccattggaggaaagaatggtgaacccaagcagaccatcagctacatggcagaacgtgtcgtcggcactgggtcatttggaatcgtcttccaggccaaatgcctggagacaggggagaccgtggccataaagaaggtcttgcaggatataagatacaaaaaccgtgagcttcagttgatgcgcttgatgggtcatcccaatgtgatatcccttaagcactgttttttctccacgacgaacaaagatgaactgtttcttaacctggtcatggactttgtccctgaaacgctataccgtgtctcgaagcattatagcaatgtgaaccgggggatgccactaatctatgtgaagctttacatgtatcagatatttagagggctagcatacatccataatgttctgagagtttgtcatagagatgtgaagccacagaatgtactggtcgatcctcttacccaccaagtaaagctttgtgattttggaagtgccaaagttttggtcaagggtgaagcaaatatatcatacatctgttctcgctattatcgtgctccggagctcatatttggtgctacagaatatacaacatcgattgacatttggtcagcaggatgtgttcttgcggaattacttcttggtcatccactatttcctggagagagtgctgttgatcagctagttgagataatcaaggttcttggtactccaacccgagaggaaattcgatgcatgaatcctaactacactgaattcaggtttccgcagataaaagcacatccttggcacaaggtttttaacaaacgaatgcctctcgaagcagtagatcttgcatcacgtcttcttcagtattcgccaaatcttcgctgcagtgctctcgaggcatgcgcacatccattatttgatgagttacgtgaacgtaatgcacgactgccaaatggccggccatttcctctccttttcgacttcaataaacaagaacttttgggtgcttcacctgcgcttatcaacaagctggtacccgagcatgcgaggcgacaatgtggccttgactttgttcaagtggcggggacgtaggcggagtacaagtgcttcatctacatacatctggataaatggaagcatgatcacgagctcatctcccaatcctgccgcctcgtatcatatcagaccctttcgggacgcgaggcctgggctgctgctgctgctgcttgcagtgcagggccgatagagaggacgtatcatctcttcttgtttgtttgttttggtcttatcaggagcggtggtttgtgcgtctgttgaatgaatccccagtgatatatgtga

SEQ ID NO: 4668 - DNA, 1842 bp, Chelidonium majus
ttagagagagaaagtagagactgagttttagtattagctgtatatcacatggcctcggtgccgctggggtctcatccacctgagaatgagggagtaaaggttgctgttgctgctgctgctgctcaacctcgtcggtcggagatgggagacgaaaaggatatatcagccgcagttgttgagggaaatgatcaagtcactggtcacatcatttccaccactattggaggcaaaaatggcgaaccaaagcagaccattagttacatggcagagcgcgttgtcggaactgggtcgtttggaattgtctttcaggcaaaatgcttggaaacaggagagactgtggccataaagaaggttttacaggatagacggtataaaaatcgtgagctgcagttaatgcgttccatggatcacccaaacgcgatatctctgaagcactgcttcttttccaccacaagtagaaatgaactttttctcaacttggttatggagtatgtccccgaaactgtgtatcgggttttgaagcactacagcaatgtgaaccagaggatgccactaatatatgtgaaactttatacataccaaatttttagaggtctagcttatattcacaatgtccatggagtttcacatagggatgtaaagcctcaaaatctcctggtagaccctcttacccaccaggtcaagctgtgtgattttggaagtgcaaaagtgctggtcaagggtgaagcgaacatatcatacatatgctctcgttactacagggctccagaactcatatttggtgcaacagaatatacaacatctatcgatatttggtcggctggttgcgtacttgctgagcttcttctaggccagcccttgtttcctggagaaagtgcagtagatcagcttgttgagatcataaaggtccttggtactccaactcgcgaggaaattcgctgtatgaatccaaattacacagagtttagatttccgcaaataaaaacacacccttggcacaaggttttccacaaaaggatgcctgcagaagcaattgatcttgcttcccgacttcttcaatattcaccaagtctccgatgcactgcgctagaagcatgttcccatcccttctttgacgagcttagagaacccaatgcccgtttgccaaatggtcgccctttgccttcgctcttcaattttaaacaagaatcatctggggcttccccggagctcattaacaggctgatacctgaacatgtgaggcggcagtctggattgaatttcttgcaccctgcaggcacgtaaagttggagacacaaacttggtatctaccgaggctactaagaaaagatgaaaagcagaaggctccctgctgttggggttagatcatgatggactgaggcctggccagcattttctagctcagcacagttagatacagacaagggtagctggatacgtgggtctctctccctattcagggccttttgtttttactacttttttgtccaaaatgtttctttgccttttgtatatttgtctgatcagaaagataatctcagttgtaatgatcagaaagctgcgattagaaaagataatgtgaagcccttatctagctaggaagggggatagaagaatggcaggagtaaaaaggggttagttggttgtcgggtttctttacttagctggtgttgtttctactgacgtctatgtggcggctcgtggattacgagttcctatggttagttgtgttcgtttttctgcagttattaatatagggctttctagtttatccaagatgtgtgtttgaatcttgttttgtatttttaaatgcttttgaatcctgtcgcaaatgttagatcc

SEQ ID NO: 4669 - DNA, 1988 bp, Avena sativa
ctacaagcggaaaaaatcaaggaggctgctgactcacggttcccttccctagccaagcccctcaccgaggagaggagagagaacacaagccaaggcaggagagagaaagccagagcagaagcaaggagagggagggaggagctccatttcggcgtcccgtccggtcccctcccccacatggcgacgctgccgggcggggcccaccccgccggcgcggcagctgacctgatgcaggtcgacgagccgcacgccgccgccgcggctcccgtggtcgagaagcatggagcttctattatccaagggagcgatccagtcactggtcacataatctccacaacgattggagggaagaatggagagcctaaaaggactattagctacatggcagagcgagttgtcgggactggatcatttggaattgtcttccaggcaaaatgtctggagacaggtgagactgttgctattaagaaggttttacaggacaagcgttacaagaacagagagctgcaaataatgcgatcaatggaccattgcaatgtcgtttgtttgaagcattgcttcttctctacaacaagcagagatgaacttttcctcaacttggttatggagtttgttcccgagtcgttgtatcgtgttctgaagcattatagcaatatgaaccaaagaatgccacttatatatgtcaaactgtatgtgtaccagatattccgtggtttagcttacatacacagtgtgcccggagtttgccacagggatatcaagcctcagaatcttttggtggatcctctgactcacacagtcaaaatatgtgattttgggagtgccaaaatgttggttaaaggcgaagcgaacatatcgtatatatgctcacgctattaccgggctcctgagctgatatttggcgcaaccgagtacacaacatcaattgatatatggtcagctggatgtgttcttgccgagttgcttcttggccagcctctatttcctggtgaaagtgcagtggaccaacttgttgagataattaaggttcttggtactccaacacgtgaggaaatccgctgtatgaatcccaactacactgagtttagatttcctcagataaaagctcatccatggcacaagattttccacaaacgaatgccgccagaagcaatagacctagcgtcacgtcttcttcagtattcaccaaatctacgatgcactgctctcgaagcgtgtacacatccattctttgatgaactacgagagccccatgcaaagttgccaaatggtcgcccattccctccactgttcaacttcaaacaggaagtagcaaatgcttcaccagagctcatcggcaggttgataccagaacatgctaggcgccattctgggttgaatttcttgcctttgacggggcagtagggaaggctgtacgatattatcttgttcatgccaaagggcaacctgcacgttctcacaaatttagaatctgacaaccattattggaagctgaagacgagctggtgccattacgtttgtatgagggggtctgtatttgtcaagccagcccctgatgtaacctttaatgctccaactccattatgaggaagcaatgaatgccagcagctgaagattagccaagaactgtgcgcatggctggagagaattgggatggtgtattgttaagcaattggtgggaccagaggaaaaccatgtattgtaagtgtttcacatgttctaccgtgaatgtagttgtgtaaatgttccagatgggatgtctcggtcatgatggtcttgctcaaaactttttagcctccctcttaattaaatatgtaggcttaagtagccatttaaatctggagccatgtactcgtatcattatgagtatgcgtctccctgagcattgaacatggcggtgtgacttctgaaatctgtattactccccctgatccgatccataataagtctgaattggtacgacaacacctcttatccaaattagttgt

SEQ ID NO: 4670 - DNA, 1802 bp, Solanum phureja
agaatagtagtggggttaagaggaaaataaagcaattatattatttttagtagagaagtaagaaaaagagtgagagtatagcagagtagaagagagcacatggcctcgataccgctgggacctcagcaccataatccgccggaaaatcaccatcaccaccaccttcagccgccgcagctgcagcagcagcagcttgtgaatcgtgaacaaggaggaggaggagctgcagtaaggaacaccgtcgccggagcacgaccggaaatggaatccgaaaaggaaatgtcagctgctgttgttgagggtaatggtgccgtcactggtcacataatttccaccactattggaggcaagaatggagaaccaaaaaggaccatcagttatatggcagagcgagttgtcggtacagggtcctttgggatagtgtttcaggcaaaatgcttggaaactggagagactgtggccataaagaaggttttacaggacaagcggtataaaaaccgtgaactacaactgatgcgcttgatggatcacccaaatgtcattactctaaagcactgcttcttttccacgactagtagagatgagctttttcttaatttggtcatggattatgtccctgaaagtttatacaaggttttaaagcactatagcaattcaaatcaaaggatgccactcatatatgtcaaactttacatgtatcagatattcagagggctggcttacattcataatgttccaagaatttgccatagagatgtgaaacctcaaaatcttttggttgatcctctgacccatcaagtcaagctatgtgattttggaagtgcaaaagtcctggtgaatggtgaagcaaatatttcgtacatttgctctcgctactacagagctccagaactcatatttggtgccacagaatatacaacatcaattgatatttggtcagcaggctgtgtccttgctgagcttcttctggggcagccgctctttcctggcgaaaatgcggtagaccaactggtggagatcatcaaggtccttggtactcctactcgggaagaaattcgatgtatgaacccaaactacacagatttcagattcccacagataaaagctcatccttggcacaaggtattccataaaagaatgcctcctgaagcaattgatcttgcctcacggcttcttcaatattcaccaagtcttcgctgtactgcactagaagcatgtgcacattcattctttgatgagcttcgtgagcccaatgcccgtctccctaatggacgtccatttccacctcttttcaactttaaacaagagttaactggagcttcacctgatttggtcaacaagctgatccctgagcatgtgtggaggcaacttggtttgaatttcccatttcctggtgcgacgtagttgtactaatgcaatatagagttggtgtatcagaaaaaatatatagggagtccttgtggattaatgtaaccatgcattttggcttaaccagtggctatgtatgcacgtaaaagttgtatgtgtatagtcgctgtttgtcttacaaggaagtgatcctgcctcaacttatgtcctcttttagctaatagcagacctgttgcctcttttgtacattgttttttataagaagatttcagatagaagtataaaatgataaatattgtaatgcctagttaagcaaatttccttgagagagaccttctgaagcactaggacttgtagcttttggttgtagctatatttatatgcaagttgtttttagctctttttatttttgaatgcaaggcatatatgatttt

SEQ ID NO: 4671 - DNA, 1907 bp, Mimulus guttatus
taatgcaagaaaacatagtattattatatgaaacaatacaaaaatacacaactgttgaataaaacataaaaaaaaaaataaagtattaaatacagagaggagagagaaagaagagagaggagagagaaacagaagaaaagcacatggcgtcgttgccgctgggacctcagcagcatcaccataatccaccacccgaccatcttcatcatcttcatcatcataatgctcttgaccaagctccacatccttcagctgccgtgaagccccccgccgccgccgccgccgcagcaccgcacagtatggacactgataaggagatggcagcatctgtggttgagggaaacgatccactcactggtcatattatatccactactattggcggcaaaaacggagagcccaaacggacgattagttacatggcagagcgtgttgtgggtacaggatcatttggaatagtttttcaggcaaaatgcttggaaacaggagagacagtggctataaagaaggttttgcaggacaggcggtataaaaaccgtgagctgcagttaatgcgtttgatggatcatccgaatgtgatttctctgaagcactgcttcttctctacaacaacaagagacgagcttttccttaatttggttatggactatgtacccgagactatgtacaaggtccttaagcattataccaattcaaatcaaaggatgccactcatatatgtcaaactttacacctatcagttatttagggggcttgcatatatgcacacggttgctggagtgtcccatagggatataaaacctcaaaatattttggttgatcctcttacacatcaggtcaagatttgtgattttggaagtgctaaagttcttgtaaagggtgaagctaatatatcctacatttgctctcgttactatcgtgctccagaacttatattcggtgcaactgaatatacaacctcaattgatatttggtcagctggttgtgtccttgccgagctacttcttggacagcctctcttcccaggagaaaatgcagttgatcaacttgtagagattatcaaggttttgggtaccccgactagagaagaaatccggtgcatgaatccaaattatagtgatttcagatttccccagattaaagcccatccatggcataaggtttttcataagaggatgcctccagaggccattgatcttgcgtcacggttacttcactactcaccaaatcttcgctgcacagctctagaagcatgcgcacatcctttctttgatgagcttcgcgagccgaatgcgcgccttccaaatggccgccctttccctcctcttttcaactttaagcaggaattgaacggaagttatccagagctgatgaacaagttgatacccgaacatatccgaaggcaagctggtctcacttttccttttccccatcctgctgccgggacttgatttatcactttatcgaatatcgaatttgtgtagccaattaaaaaaggctataacaaagatgtgtatgcacatagtggcttggcttgttcccccctccccccttttttctttcggttgttgttaacagcaaaagttggcgtgtgtgtacatctatttcatcgtacctgaacaaagtttcatcgcttctgtacatctgtttttggttgaaacgcgcaaaaaaaagaaaaggattccgatatgtgtaggtacgtgctaatgtcatggtgaacctcttaaacagcatagcagcaggatttcagtttttcttttcactttcctttttgtgtttttgtatcactacttgtttctatgttatctagtactgtatttggaataccatccattcaagttgtaatgtgtatcctattattattattattattattattattattattattattattattatttcaa

SEQ ID NO: 4672 - DNA, 1889 bp, Cocos nucifera
taacgaacgaagttttatggctaagatcgtgggtattttgggaatggcccgaatggcgagtggtagggagaggagagtggggaaagagagaagccgagtaggtggtgctgttccccatggctttgctgccgctggggcctcatcgtgctcccgagcctgaggctatgacaatcgctcctcgccgggcagatatggctgaagacaaggaagccgctattgttgaggggaatggtccaaccactggtcacattatctctactaccattggaggaaagaatggcgaatccaagagaaccattagttacatggcagagcgtattgtgggtactgggtcatttggaattgtctttcaggctaaatgcttagaaacaggggagactgttgctataaaaaaggtcttgcaggacaggcgatacaaaaaccgtgagctacaactgatgcgctcgatggatcatccaaatgtgatttctctgaagcattgtttcttttccaccactaacagagatgaactgtttctcaacctggtcatggaatacgtccatgaaactctatttcgtgcccttaagcattatagtaatgtgaaccagaggatgccactcatctatgtgaaactttatatgtatcagatatttagggggttagcatacattcatactgttccaggagcttgtcatagagatgtgaagccacagaatcttctggttgatcctcttactcatcaagtcaagctctgtgattttggaagtgccaaaattctggttaagggtgaagcaaacatatcatacatctgctctcgctattaccgtgctccagagctcatatttggtgcaacagaatatacaacatctattgatatatggtcagcaggatgtgtactcgccgagttgcttcttggccagccattatttcctggagaaagttctgttgatcagcttgttgagataatcaaggttcttggtactccgactcgggaggaaattcgatgcatgaatcctaactatacagaatttaggtttccacagataaaagctcatccttggcacaaggttttcgacaagcgaatgcctccagaagctatagatcttgcatcacgtcttcttcaatattcaccaagtcttcgttgcactgcacttgaggcttgtgcccatcctttctttgatgagttacgggagcccaatgcacggttgccaaatggtcgcccttttcctcctctcttcaacttcaaacaagaactggtaggtgcttcgccagagttgatcaacaagctgatacctgagcatgtgaggcgacaatatggtcttaattttacacacccagctgggacataaggagcaactagttactacactttctgatgaattgcaaccaaaagcgtgggggccttcagggtttgaatgaaaacgatgaatgctgaaagagtgagctgctggtctgttaactgatgcatgcctcaaccctaccaatattgcagccttatgaattgtgcgactgttgagattaacacgactgaggaaatgctgatgccgagtgttcagcaaagagctagtagtgttgctggaggaattctgcttgtgttaccgaagcagatgttccgtgagccccgttccctttgtctttcccccccccccccccccccccccccccccccccccccccccccccccccccccccccccccccccccccccccccccccccccccccccccccccccccccccccccccccccccccccccccccccccccccccctggtcgagagtgtctctgtgaagctggaaaataaaatttaggtcgtgtcgctagttctgatccaatggatgtcttaacccagttttttctctcgggttgcgttacatattggtgggaggttgtatataggttatcg

SEQ ID NO: 4673 - DNA, 1617 bp, Elaeis guineensis
aggaggaaagtggggaaagagagaaggccgagtaggtggtgctgttccacatggctttgctgccgctggggcctcatcgcgcccccgaacctaagcctatgacaatcgctcctcgccggccagagatggctgaagacaaggaagcctctgttgttgaggggaatggtccagccaccggtcacattatctctactaccattggaggaaaaaatggcgaatccaagagaaccatcagttatatggcagagcgtgttgtgggtactgggtcatttggagttgtctttcaggctaaatgcttagaaacaggggagactgttgctataaaaaaggtcttgcaggacaggcgatacaaaaaccgtgagctacaactgatgcgctcgatggatcatccaaatgtgatttctctgaagcattgtttcttttccaccacaaacagagatgaactgtttctcaacctggtcatggaatacgtccctgaaactctatttcgtgtcctgaagcattatagcaatgtgaaccagaggatgccactcatctatgtgaaactttatatgtaccagatatttagggggttagcatatattcatactgttccaggagtttgtcatagagatgtgaagccacagaatcttctggttgatcctcttactcatcaagtcaagctctgtgattttggaagtgccaaagttctggttaagggtgaaggaaacatatcatacatctgctctcgctattaccgtgctccagagctcatatttggtgcaacagaatatacagcatctattgatatatggtcagcaggatgtgtacttgcggagttgcttcttggccagccattatttcctggagaaagttctgttgatcagcttgttgagataatcaaggttcttggtactccgactcgggaggagattcgatgcatgaatcctaactatacagaatttaggtttccacagataaaagctcatccttggcacaaggttttccacaagcgaatgcctccagaagctatagatcttgcatcacgtcttcttcaatattcaccaaaccttcgttgcactgcacttgaggcttgtgcccatcctttctttgatgagctacgggagcccaatgcgcggttgccaagtggtcgcccttttcctcctctcttcaactttaaacaagaattagtagatgcttcgccagagctcatcaacaagctgatacctgagcatgtgaagcgacaatacggtcttaattttacacgtccagctgggacataaggcagcaactagttactacactttctgatgaagggcaaccaaaagcgtgggggccttcagggtttgaacgaaaatgatgaatgctgaaagagtgagctgctggtctgttaactgatgcatgcctcaaccctaccaatattgcagccttgtgaattgtccgaccgttgagattaacatgactgaggaaatgctgatgccgagtgttcatcaaagagcaagaagtgttgctggaggaattctacttgtgctaccgaagcagttgttcgtgagccccgttcccgttccctttgtcttttcttgttttttggatattagtagtttaagttggacgcccttgaagctttattagtttttg

SEQ ID NO: 4674 - DNA, 1710 bp, Papaver somniferum
ttttgttttggagtgctgtaataccacatggcttcgttgccgctggggcctaatcatctaccagaaaatgatgaaggagaaggaggaacagtaaagatcgttcctcctcatccttctaaaatggaaaccgaaaaggaaatatcagccgcagttgttgagggaaatgatcaagtcactggtcacatcatttctaccaccattgggggtaaaaatggtgaacccaagcagaccatcagctacatggctgagcgggttgtggggactgggtcctttggaatcgtgttccaggcaaaatgcttggaaactggagagactgtggctataaagaaggtcttgcaagatagacggtacaaaaatcgtgagttgcagttaatgcgttcgatggatcacccaaatgtggtcaccctgaagcactgcttcttttccacaacaagtagaaatgaactgtttctcaacctggttatggaatatgtccctgaaactgtgtatcgagttttgaagcactacagcaatgtgaaccagaggatgcctctcatctatgtgaaactctatacctatcaaatttttagaggcctagcttatattcacagtgtccacggagtttcacatagagatgtgaagcctcaaaatcttctggttgaccctcttacgcaccaagtcaagctttgtgattttggaagcgctaaagtgttggttaaaggtgaagcaaatatatcatatatatgctctcgctattaccgggccccagaactcatatttggtgccactgaatatacaacatccatcgatatttggtcagctggttgtgtgcttgctgagcttcttctaggccagcccttgtttcctggagaaagcgcggtagatcaacttgttgagatcatcaaggtccttggtactccaactcgtgaggaaattcgctgtatgaatccaaattacacagaatttaggtttccacagattaaagcacacccgtggcacaaggttttccacaaaaggatgcccccagaagcaattgatcttgcttcccgactactacagtattcaccaagtctccgatgcactgcgctagaagcatgttctcatcctttctttgatgagctccgtgaacccaatgcccgtctgccaaatggccgacctttgcctcctctcttcaactttaaacaagaattatctggggcctcccctgagctaattaacaggttgatacctgagcatgtgaggaggcagttgggtctgagtttcgtgcacccaaccggcacataagtggagacagagacctggtatttatatatatagtctactctggtaaagatgctaagcagagaggcaggcccggccttggtgctgagcaagctgggcagttgtccagggcttacggttgcggtttaatctctggggttgctcctctgagccttgcaagcagcagtcaacaattgcggttgcttctccaagccttaaaaatcacttttcttatagggtaactcgccaagttgggaactcaccatagggtttgttgcacgtatcaagtgtagtgtaattcttgcagaactgaagtagaatttcaatattttgatgtttgtaaaataattttgtttcgttttggtggatggccagcaaattataagcttgatgaatgtgtaactgcttgtgttgccaccttttggctatttttcaatcaccttggcgacaagctgaataattttatccaaa

SEQ ID NO: 4675 - DNA, 1819 bp, Avena sativa
acaagccaaggcaggagagagaaagccagagcggaagcaaggagagggagggaggagctccatttcggcgtcccgtccggtcccctcccccacatggcgacgctgccgggcggggcccaccccgccggcgcggcagctgacccgatgcaggtcgacgagccgcacgccgcggcggcggctcccgtggtcgagaagcatggagcttctattatccaagggagcgatccagtcactggtcacataatctccacaacaatcggagggaagaatggagagcctaaaaggactattagctacatggcagagcgagttgtcgggactggatcatttggaattgtcttccaggcaaaatgtctggagacaggtgagactgttgctattaagaaggttttacaggacaagcgttacaagaatagagagctgcaaataatgcgatcaatggaccattgcaatgtcgtttgtttgaagcattgcttcttctctacaacgagcagagatgaacttttcctcaacttggttatggagttcgttcccgagtcgttgtatcgtgttctgaagcattatagcaatatgaaccaaagaatgccacttatatatgtcaaactgtatgtgtaccagatattccgggtttagcttacatacacagtgtgcccggagtttgccacagggatatcaagcctcagaatcttttggtggatcctctgactcacacagtcaaaatatgtgattttgggagtgccaaaatgttggttaaaggcgaagcgaacatatcgtacatatgctcgcgctattaccgtgctcctgagctgatatttggcgcaaccgagtacacaacatcaattgatatatggtcagctggatgtgttcttgccgagttgcttcttggccagcctctatttcctggtgaaagtgcagtggaccaacttgttgagataattaaggttcttggtactccaacacgtgaggaaatccgctgtatgaatcccaactacaccgagtttagatttcctcagataaaagctcatccatggcacaagattttccacaaacgaatgccgccagaagcaatagacctagcgtcacgtcttcttcagtattcaccaaatctacgatgcactgctctcgaagcgtgtacacatccattctttgatgaattacgagagccccatgcaaagttgccaaatggtcgcccattccctccactgttcaacttcaaacaggaagtagcaaatgcttcaccagagctcatcagcaggttgataccagaacatgctaggcgccattctgggttgaatttcttgcctttgacggggcagtagggaaggctgtacgatattatcttgttcatgccaaagggcaacctgcacgttctcacaaatttagaatctgacaaccattattggaagctgaagacgagctggtgccattacgtttgtatgagggggtctgtatttgtcaagccagcccctgatgtaacctttaatgctccaactccattatgaggaggcaatggatgccagcagctgaagattagccaagaactgtgcgcatggctggagagaattgggatggtgtattgttaagcaattggtgggaccagaggaaaaccatgtattgtaagtgtttcacatgttctaccgtgaatgtagttgtgtaaatgttccagatgggatgtctcggtcatgatggtcttgctcaaaactttttagcctccctcttaattaaatatgtaggcttaagtagccatgaaatctggagccatgtatcattatcagtacagtatttgtctctccgatccattatcattatcagtagcagt

SEQ ID NO: 4676 - DNA, 1719 bp, Arabidopsis lyrata
agaaagagaaggagacgagctggattcacatggtcttgttctttctctctctctcttctttctttttctcatcttgcggcttctctctctctctctctctctctctctttccacaatgatcattaccaaccaaactgattgaaactcatttgttctctctctctcaaatccactttctctctctctctttctcttctcctctctgtgtctctatcgccatggctgatgataaggagatgcctgctgctgtagttgatggacatgatcaagtcactggtcacataatttccaccacaatcggtggcaaaaatggtgaaccaaaacagacaattagttacatggcggagcgagttgttggtacaggctcgttcggaatcgttttccaagcgaagtgtttggaaactggagaaaccgttgcgataaagaaggttttgcaagacagaagatacaagaacagagaacttcagttgatgcgtgtgatggatcatccgaatgtggtttgtttgaagcattgcttcttttcgacaacaagtaaagacgagcttttcctcaatttggttatggagtatgtccctgagagcttgtatcgagttctgaaacattatagcagtgctaaccaaagaatgcctcttgtctatgttaaactttacatgtaccagatcttccgggggcttgcttacattcacaatgttgctggagtttgtcacagagatctaaagcctcaaaatcttctggttgatcctcttactcaccaagtcaagatctgtgactttggcagtgcgaaacagctcgttaaaggtgaagccaacatttcttacatctgttcacgattctaccgtgcacccgaactcatatttggtgccactgagtacacaacttctattgatatctggtctgctggttgtgttcttgccgagcttcttctcggtcagccattatttcccggagaaaatgctgtggatcagctcgttgaaattataaaagttcttggtacaccaactcgagaagaaatccgttgtatgaatccacattacacagattttaggtttccacagataaaggcacatccgtggcacaagatcttccacaaaaggatgcctccagaagcgattgatttcgcatcgaggctgcttcaatactctccaagtcttagatgcacagcgctcgaagcttgtgcacatccgttctttgatgaactcagagaaccaaacgctcgtttaccaaatggacggccattcccgcctctcttcaacttcaaacaagaagtagctggagcatcacctgaactggtcaacaagttgattccagaccatatcaagagacaattgggtctaagtttcttgaatcaatctggaacataaaaggattctgcaaaagacaacaactttttatatataaatgtaccattacacgagccacaaggtcgtagtagttgaaggcaacgtggaggacgcaattcgaagtttttcctccgcaaactcgttcagacatgccagctgctagcaaaccaacttccccaaatctgcaaaaacaaaaactctccagttgtatctgtttatttctctcttcttttataagtttggtgaagaacacaatctactctttgcttcttttcttctttctttccccatatgtaaatgagtttagtcagaagtttttatatagtaaagtttgagcagaaggtgaagaatctagtcaaagtgataccaaagtgtttca

SEQ ID NO: 4677 - DNA, 1865 bp, Brassica rapa
gaaagaagatggcgaagaaaacggaaagtgtagagagagaaataaaagagagatagagctggattcacatggccttgttcttcttctcatctctctctctccaacatttgatcattaccaaccaaactaattgaaatccatttgtttctctcaaccccattctttctttctctctctctctctctctctctctctcttctcttctctgtgcgtcatggctgacgatagggagatgccggctgctgtagttgatggacatgaccaagtcactggccacataatctccaccaccatcggtggtaaaaacggagaacctaaacagacaataagttacatggcggagcgagttgtcggaacaggctccttcgggatagtgttccaggcgaagtgtctggagactggagaaaccgtggcgataaaaaaggttttgcaagacaggaggtacaagaaccgggagcttcagctgatgcgtgtgatggaccatcctaatgttgtttgtttgaagcattgcttcttctcgaccacgagtaaagacgagctgttccttaatctggttatggagtatgtccctgagagcttgtaccgagttctgaaacattacagcactgctaaccagaggatgccgcttgtttatgttaaactctatatgtaccagatcttcagaggacttgcttacattcacaatgttgctggagtttgtcacagagatctaaagcctcagaatcttctggttgatcctcttactcatcaagtcaagatctgtgattttggcagtgctaaacagcttgttaaaggtgaagctaacatctcttacatatgctcgcggttctaccgtgcacctgaactcatatttggtgccactgagtacaccacttccattgatatctggtctgctggttgtgttctcgctgagcttcttcttggtcagccactcttccctggagaaaatgctgtggaccagctcgttgaaataatcaaagttcttggtacaccaactcgagaagagatccgttgtatgaatccacactacacagacttcaggttcccgcagataaaggcacatccttggcacaagattttccacaaaaggatgcctccagaagcaattgattttgcatcaaggctgcttcagtactctccaagtcttagatgcacagcgcttgaagcttgtgcacatccgttctttgatgagctgagagaaccaaatgctcgtttaccaaacggacggccattcccacctctcttcaacttcaaacaagaggtagctggagcttcacctgagctggtcaacaagttgattccagaccatatcaagaggcagttgggtctaagtttcttgaatcagtctggaacttaaaaacgatcaacagacgaagaactttttatatataattgtaccattactcagagccagaagaaggttagttgaaggcaacgtggaggacacagttagaagttttgcctcctcaaaactcggtcaaaaagacaagcttctctacaacctgacttcccccaaacccgcaagaaaagctattcagttgtatcttcttcttcttctttgtccttttttaaaaaagtttggttaaaacaaagaacaaaatcttctctttttgctttattcttactgcatctgtaaatgagtttagtcagagatttttatatagtaaaagtttgagcagaaggttaaagaatctttttactcaaaagagatccccaaagtcaaccagaagaggaaggctgtagtttctgtagttcaaggggttgttgctctttttttttgtttgtttcctttctccttttgaatgttgtcttctgctttgttgttattaccaaattttatgaaatgatgatttgcttctgtctca

SEQ ID NO: 4678 - DNA, 2922 bp, Theobroma cacao
aaccaacagaaagagagagtagctgtaaagcacatggcctcaaaccccttggggactcagcttcaacaacaacaaccaccaccagctgacaatgactctctgaaactacgccgttccgatatggactccgataaggttttcttttttccttcgtaactatatttatatttgtaaaaatagattggcatttcctttttttttttgcttagatcttctttgatctagctctctctctctctctcttttcactcaaattaaatcgatttaagtgtttttttagtttctttatcttttaaaactatttttctctttttttaatatgaattaaaggttataattctattctgattaattttcattttttagtgataccgtttatatgatttttttttttgtcttgaaaagtttagtcggtgaagatcttgatcttgaaactaagtttgtttttcgggttcagttacttcatttctgagaaaatctaagcaaaaataaaaggtaaaataagaattgaggtttttctttacttttttatttattggttgtttcatttttatagttgcatttgcttagttcaagtgttataatgcaaaaaaagttaaaatgagcttagatttaggatcttcattatcttttactgttttctgctttttgtccctgctgccaaacagagaattagggttctttttttcttattttgtgtttagtctataaactctgttgttagctaaatttctctatgttttaaattaattttttgtatgattttgggttttttttttttttgtaatactttagtgaaatttgttgttatatctttgattctttaccaaaattgagtgatttaatttttacgagtttcctgtgtgttgcaaacaactgctgtggttcctgaaagctttttatggcacctcttttttctttgggtagattgttgttcaatctcttgtagtttgcttctggaagtgaatgtcctctgattctcttataacagtctcttttttgcaatggatttctttatttattttggggcatgtgattctttcttgtgagttatggtcattgtgtattatgcttcgcctatacataactgctgagatctttgtgctttgctcttcttccagttttgcactcttgagatgccttttagttctatgcaatacccatatgcttgtagtagttgattgtttttcttctttgtaggtatttatttattatagttgatttaaagttcatgtgtttaattgatgtcccctatctgagatatctttccatccatagattgtctttttcacaaacgcctaatgataacctggttccagaaatggcaacctaccggaaatttgcaatcaggatcaaggaaatgtctgctcctgttgttgagggcaacaatcaagtcactggccacatcatttccaccaccattggaggcaaaaatggtgaaccaaaacagaccataagttacatggcagaacgggttgttggcactggctcatttggaattgtttttcaggcaaaatgcttggaaaccagtgagactgtggcaataaagaaagtcttgcaggacaggcggtataaaaaccgtgagctgcaattgatgcgcttaatggatcatccaaatgtggtgtctctgaagcactgttttttctccactacaagtaaagatgagctttttctaaatttggttatggagtatgttcctgagactatgtatcgggttctcaagcactacaacaatatgaaccagaggatgcccctcatttatgtgaaactctatacgtatcaaattttcagagggctggcatatatccatgctgttcaaggggtttgccatagagatgtgaagccacaaaatcttttggttgatcctcttacccaccaggttaagctttgcgattttgggagtgcaaaagtcctggtaaagggtgaagtaaacatatcgtatatatgttctcgttactatcgggctccagaactcatatttggtgctacagaatatacgacatcaattgatatttggtctgcaggttgtgtgcttgccgagcttcttttgggccagcctttgtttccaggagaaaatgcagttgaccaacttgtagagattatcaaggttcttggtactccaactcgagaggaaattcgctgcatgaatcccaactatacagatttcagattccctcaagtcaaagcccacccatggcataaggttttccacaagcgtatgcctcctgaagcaattgaccttgcctcacgccttcttcagtattcaccaagtctccgatgtactgcgctggaagcattagcgcatcctttctttgatgaactacgtgaacccaatgctcgccttccaaattgccgtcctttacccccacttttcaactttaaacaagaattagctggagcttcccctgagctaatcaacaggctgataccagagcatgtgaggcggcagatgggtcttggctttccacatccagctggtacgtaaatgtggaaaaagcaatacaaggaatcaagtctttctgttagtggacgggttcaacgcaaaggaaggacggacggagctcctggtcactaaaccaagctttctagcctattcagtggatttattgccccgcaaagatgtatgcatatactggcttcttctggcttaacatggaagttggcgatatctgtctaccatgtcattctagctacaacatagtgttcccctgtttttgtacattgttttgatcagagctaggagtataaaaaaggtgatgcaatccatgtgtagctaggagaaatagcccagccgaagctgaaggagttgtacgtactagtttggcttgcttcttaaatgttgcgctagttttacatatgtttgttgcagcatgtggacataaaccgaatttcatcaatttaagttccaccctttttctcttc

SEQ ID NO: 4679 - DNA, 1668 bp, Rosa hybrid cultivar
aaaaaagaaagagactttggcaaaatcaactccagcctcaccatggctgatgataaggaaatggctgcctctgttgtagatggtagcgatccaactggtcacataatttctacgaccataggaggcaaaaatggagagcccaaacagaccattagttatatggcagagcgtgttgtgggaaatgggtcatttggaattgttttccaggcgaaatgcttggaaactggcgagactgtggctataaagaaggttttgcaagacagaagatataagaacagggaacttcaattgatgcgtgtgatggatcatcccaatgtgatttgtttgaagcattgcttcttctctacaacaagcaaaaatgagctttttctcaatttggtcatggaatatgttccggagaccatgtatcgggtcttgaagcattacagcaatgcaaaccagagaatgccccttgtctatgtcaagctttacatgtaccagattttcagaggactggcttacatacacaccgttcctggagtttgccatagagatttgaagcctcaaaatttattggtcgatcctctaactcaccaggtcaagctctgtgattttggaagtgccaaaatgctggtgaaaggtgaatcaaacatagcatacatatgttcacgtttctatcgggctccagaactaatatttggtgccacggattatacaacttcaattgatatctggtcagctggctgtgtcctagcagagcttcttttgggccagcctttgtttcctggggaaaatgcagtggaccaacttgtagagatcatcaaggttctgggaacaccaacacgtgaagaaattcgctgtatgaatccaaattatacagatttcaggtttccacagataaaagcacacccttggcacaaggttttccacaagcgcatgcctccagaagcaattgatctggcttcaagactgctacaatactctccaagtcttcgttgcacagctctagaagcatgtgcacatcctttctttgacgaactccgtgagtccaatgcccgcctaccaaatggtcgcccattgcctccgctttttaattttaagcaagagttgtccggcgcttctccagagcttatcaacaagttgattcctgatcatgtgaaacgccaaatgggtctccctttcttgcatgcggctggcacataaatgtgaaaagattatatgcagttgctatcttccagttgaactgtgacacaaaggcttcctatctttgtggttaaatcgccacttagttagaatcctgaggatcatcatattttgctctgcctgtaagactaccaaccggggcggatggatggcatcttgtaatgtgttctcttctacggtttcttcccctatccctcttcatccttgtctcccgaaattcctttttgttgctgtaaatgtttgatagtaaagatagaccgagactcctgagaaatctgctagaggaaaagctagaaaaagtgtatctatatagctaggaagagaatccctaatagaatgttatgttggtggttgctgggcgggtttgctttcacttcaatgttgtttcttaaggtggtttgtggtggctgacttgtaattgcggtcaaatattcactttactgtttgtgcaagcttaaaagtaatgcattgttctcttgtcaaaaa

SEQ ID NO: 4680 - DNA, 1570 bp, Cleome spinosa
aggagctgtaaagcacatggcctctatgccattggggcctcagccccagcttcttgctccaccgccgcagcctcacgacggagacgttctgaagcgtcgctccgacatggattccgacaaggaaatgtcatctgctgttatcgagggaaatgatgctgttactggtcatatcatttccactaccattggaggcaaaaatggtgaacctaagcggaccattagttacatggctgaacgggttgttggtacaggatcatttggaattgttttccaggcaaaatgcttggaaaccggggaatcggtcgccattaagaaggtcttgcaagaccggcgctataaaaaccgtgagttgcagttaatgcgactaatggatcatccaaatgtggtctcgctgaagcattgttttttctccacgacaagtagagatgaactcttcctcaatcttgttatggagtatgttcctgagactttgtaccgggttctgaggcactatactggttcaaatcagagaatgccaattttctatgtcaaactttacacataccaaatcttcagaggtttggcctatatccatactgttcctggtgtttgccacagagatgtgaagccacaaaatcttctggttgatcctcttacccaccaggttaagctatgcgattttggcagtgcaaaagttttggtcaaaggtgaagcaaacatatcatatatctgctctcgatattaccgagctccggaactaatctttggggcgacagagtacacatcctccatagatatgtggtctgctggctgtgttctggcagaacttcttcttggtcagccattgtttccgggagaaaattcagtggaccagctggtagagatcataaaggttcttggtactcctactcgggaagaaatcagatgcatgaatccaaactacacagattttagattcccgcaaattaaagctcacccatggcacaaggttttccataaacgaatgcctccggaagcaatagatctaacgtctcggcttcttcaatattcaccaagtctacgctgcactgcgctcgaagcatgcgctcatccattcttcgacgagctccgggagccaaatgcccgacttccaaacggtcgtccattgccatctctgttcaacttcagacaagagttggggggagcatcgacggagctgataagcaggctaataccagagcacgtgaggcggcagatgaacggtgcctttccatttcaggcaacagctccttagacggcaaacgtatcgaaagagagagatagaaaggacgatgatgaatgatgaatgatgaatgatgaatgatgaatgatgatgatgctctcccttgcgcgtggcattcagcacacgagagaatcgggagagttcgattattttctttctattattacctctttttgttcccccttgatcatatgtaagacactcaaaaagtttctcgttgcattttctttttcttgtatattattatgttttggtcgccaacatttgaagacaatctctctcccttcggagcagacgatacaatggtgaaattgaatcattattatgtct

SEQ ID NO: 4681 - DNA, 1581 bp, Vaccinium corymbosum
gctgtacttagcacatggattcgctgccgctgggacctcaacatcttgacccattgaatcaccagcctcctcctcgttctcaccggccaccggagatggactccgacaaggaaatgacatcagcagttgtcgagggcaatgatcaagtaacaggtcacattatttccaccacaattgggggtaaaaatggagaacctaagcgcaccatcacttacatggccgagcgtgtagtgggtacaggatcatttggaattgtctttcaggcaaaatgcttggaaacgggggaaatggtagcaataaagaaggtcttgcaggacaggcggtacaaaaatcgtgaacttcagttaatgcggttgatggatcacccgaatgtggtttctctgaagcactgtttcttttcaacgacaagtaaagatgaactattcttgaatttggtcatggaatatgtccccgagactatgtaccgcgttctaaagcattacaccaatgcaaatcaaaggatgccactcatctatgtcaaactttatacgtatcagatatttagagggctggtttatattcatactgttcctggggtttgccatagggatgtgaaacctcaaaatcttctggttgatcctcttacccaccaggttaagctttgtgactttggaagtgcaaaagttctggtaaagggcgaagcaaacatatcatacatatgttctcgttactaccgtgcccctgaactcatatttggggcaacagaatacacatcatcaattgacatttggtcagctggttgtgtccttgctgagcttcttttggggcagcccttgtttcctggagaaagtgcagtggaccaacttgtagagattatcaaggttcttggtactccaactcgagaagaaatccgatgcatgaacccaaattatacggattttaggtttcctcagattaaagcacatccttggcacaaggttttccacaaacgaatgcctcctgaagcaattgatcttgcttcacggctccttcaatactcaccaagtcttcgttgcactgctttggaagcatgtactcattcattttttgatgagcttcgggagcccaatgcccgtctaccaaatggtcgccctttgccgcctcttttcaactttaaacaggagctaactggagcttcccctgagttgatcaaccgactgataccagagcatgtccgacggcaaagcggtttcaacttgccgcatccagctgggacgtgaacaaaaattcggtacgaagttgaatcaactcttctgctagttgatgcatatcgattgaaagggagcctatatgcgttatatcactgggttttggcataaccagcactttctcgcccaccaaaagggtacatgtgtttttggaatatccaggaatcgggcaattcttcttgtctatttatgatgtcatattagctgaaaaggaactcgttccccacttctgtaaattgttttgatcgcaaagatttctgaaagctagtgagcaccaatgtctagtagctaggcagttgtctgaaggaacaacagcagaactaagggctcttttgtagtattgcattttttcaac

SEQ ID NO: 4682 - DNA, 1366 bp, Manihot esculenta
gaaaagaaaatgcaaaaaatgatgtgtgtttgtgtgcgtgtgaagtgagagtgagcgaaaggagaggaaaggcaaagggaatttgcagagagcagtgccctctctccatgcctttggcttttgggagctaatcaatcatcttcaacatcatcatcaagcccagcaatcacacttagctccatcgtacgatgacccactgaagctccaccctctccgctgatatatggattccgataaggaaatgacatctgctgaagttgaggggaatggtgcaattacaggtcatatcatatccactaccattggaggcaagaatggggagcccaaacagaccatcagttacatggctgagcgagttgtaggtactggatcatttggaatagtttttcaggcaaaatgcttggaaactggagagccggtggctataaagaaagtcttgcaggacaaacgatacaaaaatcgtgagctgcagctgatgcggttgatggatcacccaaatgtggttcccctgaggcattgtttcttctccacgacaagtaaagatgagcttttcctgaatttggttatggaatatgttcctgaaacaatgtacagggttttgaagcactataccagtataaaccaacggatgccgctcatctatgtgaaactttatacataccaaatattcaggggattggcatatatccatactgttcctggagtttgtcacagagatgtaaagcctcaaaatcttctggttgatcccctcactcaccaggttaagctttgtgactttggaagtgctaaagtcttggtccagggtgaagcaaacatatcatatatatgctctcgctattatcgggctccagagctcatatttggtgcaacagaatatacaacttcaattgatatttggtcagctggttgtgtattggctgagcttcttctgggtcagccattgtttcctggggaaaatgcagtagatcaacttgttgagatcatcaaggttctgggtactccaacgcgagaagaaattcgatgcatgaatccaaattacacggattttagattcccacagattaaagcacacccttggcacaagattttccacaaacgaatgcctcctgaagcaattgaccttgcttcacggcttcttcaatattcacctagtcttcgttgcactgcacttgaagcttgttcacatcctttctttgatgagctacgtgagcctaatgcccgtcttccaaatggtcggccactgccacctcttttcaactttaaacaggaactgtcagaagcttcacctgaattgatcaacaggctcatacctgaacatgtgagacggcagggtggtcttagcttcctgcatccagctggttcttaa

SEQ ID NO: 4683 - DNA, 1797 bp, Avena sativa
acggttcccttccctagccaagcccctcaccgaggagaggagagagaacacaagccaaggcaggagagagaaagccagagcagaagcaaggagagggagggaggagctccatttcggcgtcccgtccggtcccctcccccacatggcgacgctgccgggcggggcccaccctgccggcgcggcagctgacccgatgcaggtcgacgagccgcacgccgccgccgcggctcccgtggtcgagaagcatggagcttctattatccaagggagcgatccagtcactggtcacataatctccacaacgatcggagggaagaatggagagcctaaaaggactattagctacatggcagagcgagttgtcgggactggatcatttggaattgtcttccaggcaaaatgtctggagacaggtgagactgttgccattaagaaggttttacaggacaagcgttacaagaacagagagctgcaaataatgcgatcaatggaccattgcaatgttgtttgtttgaagcattgcttcttctctaccacaagcagagatgaacttttcctcaacttggttatggagttcgttcccgagtcgttgtatcgcgttctgaagcattatagcaatatgaaccaaaggatgccacttatatatgtcaaactgtatgtgtaccagatattccggggtttagcttacacccacagtgtgcctggagtttgccacagggatatcaagcctcagaatcttttggtggatcctctgactcacacagtcaaaatatgtgattttgggagtgccaaaatgttggttaaaggcgaggcgaacatatcgtacatatgctcacgctattaccgtgctcctgagctgatatttggcgcaaccgagtacacaacatcaattgatatatggtcagctggatgtgttcttgccgagttgcttcttggccagcctctatttcctggtgaaagtgcagtggaccaacttgttgagataattaaggttcttggtactccaacgcgtgaggaaatccgctgtatgaatcccaactacactgagtttagatttcctcagataaaagctcatccatggcacaagattttccacaaacgaatgccaccagaagcaatagacctagcgtcacgtcttcttcagtattcaccaaatctacgatgcactgctcttgaagcatgtacacatccattctttgatgaactacgagagccccatgcaaagttgccaaatggtcgcccattccctccactgttcaacttcaaacaggaagtagcaaatgcttcaccagagctcatcggcaggttgataccagaacatgctaagcgccattctgggttgaatttcttgcctttgacggggcagtagggaaggctgtactatattatcttgttcatgccaaagggcaacctgcacgttctcacaaatttagaatctgacaaccattattggaagctgaagacgagctggtgccattacgtttgtatgagggggtctgtatttgtcaagccagcccctgatgtaacctttaatgctccaactccattatgaggaagcaatgaatgccagcagctgaagattagccaagaactgtgcgcatggctggagagaattgggatggtgtattgttaagcaattggtgggaccagaggaaaaccatgtattgtaagtgtttcacatgttctaccgtggatgtagttgtgtaaatgttcctgatgggatgtctcagtcatgatggtcttgctcaaaacttattatcctccctcttaattaatcatgtaggcttaagtagccat

SEQ ID NO: 4684 - DNA, 2453 bp, Prunus mume
cgtaattggaggcaaagagtaggaaaggggcccaccccattggggaagagagagagagagagagagagagagagagagagagagagaagaagcaaaaactgaaaaagaagagctggaatcacatgggggttgttgtttgtctaattgtctgtggcagtgacatctaattcttctccattctccattctccgttctccattcttcattcttcttcttcctcatccaccaccgctccaactccatctccaccatgaccttctccttcttcctccccccagcacttgcagtctgattcgcgtttgtcttccgctgtccgtcttcctcctgctctttctttcccatctcaacatggctgacgataaggaaatttctgcacctgttgtagacggtagtgatccaactggccacatcatctccacaaccatcggagggaaaaatggagaaccaaaacagaccattagttacatggcagagcgtgttgtgggaactggctcttttggaattgttttccaggcaaaatgcttggaaagtggtgagactgtggctataaagaaggttttgcaggacagaagatataagaacagggaacttcaattgatgcgtgtgatggaccatccaaatgtggtttctttgaaacattgtttcttttccacaacgagtagaaatgagctctttctcaacctggttatggaatatgtcccagagactatgtaccgggttttgaaacattacagcaatgcaaaccagagaatgccactaatctatgtcaaactttacatgtaccagatttttagagggctggcctatatacacaccgttcctggagtttgccatagagatttgaagcctcaaaatcttttggttgatcctcttactcaccaggttaagctttgtgattttggaagtgcaaaagtgctggtgaaaggtgaagcaaacatatcttacatatgttcacgtttctatcgggctccagaacttatatttggtgccacggattatacaacctcaattgatatctggtcagctggttgtgtcctagcagagcttcttttgggccagccgctgtttcctggagaaaatgctgtggaccagcttgttgagatcatcaaggttcttggcacgccaacacgtgaagaaattcgttgtatgaatccaaactatactgattttaggtttccacagataaaagcacacccttggcacaaggttttccacaaaaggatgcctccagaagcaattgatttggcttcacgacttctgcaatactcaccaagtcttcgttgcacagctctagacgcatgtgcacatcctttctttgatgaacttcgtgagcccaatgctcgcctaccgaatggtcgtccgtttccacctctgtttaatttcaaacaggatttgtccggagcctctccagagctaatcaataggttgatacctgagcatgtgaaacgccagatgggtctaaatttcttgcatccagccggcacataaatgtggagaagttaatatgcagaatctatcttccagttgatgtgtgacacaaaggtttagtatctttgtggttaaatcaccgtgtattgaggcctaacgatcatcttttgttgctctaccaagaagagtgcaaattggggcggatggatggcttcccgtaatgtgttatcttctgtgatttcctcccttatccctcacttcttccctcctttttcccgaaattccattttgttcctgtaaatgtttgatagtaatgatagtctgaggtggaccggtaagaaagctgctagagaggaaaagctaggaaactggaaaagtgtatttatatagctaggaaagagggctcctaatagaatgttgttggttgctggatggttttcgttttacttaaatgttgtttcttattagtcctgggggtgttttgtggtggctggctgactcgaaattacggatgaatgccgttactttgatgtttgtgcaaacttgaaagtgtaatgcattgttctgtggtttaatgtactgctctctacacctttcccccatccctacctttagtggtttctgccattcgtctcgctgcattgtaggttcactgtccctgtgtttggaagaattatttgcactgcatgctcaaatgaacttggtgtttttctctcaccctcgtccattttgaggactgttatcattttccagcaatttcctcccgcttgttgcgccgcatgagtttatggaggaaaatattaaaattgataaagaaacgaagtcgtactttgcgcgcagaaaagtccaaaataccggcagcgttaaagttggcgccataaatttttacattatttgtctgctccaaaaggaacattgaggtaatgagtaaagagagattcgaaacgataaggtctgtaaaagcatctctaagggagatgtcaaatatcaaacatcaaatttaattttgatgattgatgtagtaa

SEQ ID NO: 4685 - DNA, 1670 bp, Trigonella foenum-graecum
cttcttctctcactcctttatctttcgctgaacccaaaacactattcagagagaaagagatagagatactagagagcgaaagaaagtgtttttttagagagagaaagaaagtgtttttttagagagagaaagaaaaagagtgagagtttcgtgcgtagctttctgaaatggccaccatgccgttggggccacatcaccaccatcaaccaccgcaaccagcaccgttaccgttaccattaccaccgtcacagttacaacaaccgcaaacggtgaatgaaccggtgaaaacgacggcggcgagtggaggctccggtatggacaccgataaggaaatgtcagctactgtagttgacagtaatgatgcagtcactggtcacataatctcaactaccattggaggcaaaaatggtgaacctaaacggacaatcagttacatggctgagcgtgttgttggcacgggatcatttggaatcgttttccaggcaaagtgcttggagactggtgaggcagtggctataaagaaggttttgcaagacaagcggtacaaaaatcgtgaacttcagttaatgcgtgtgatggatcacccaaatgtaatttccttgaagcactgtttcttctctacaacaagcagagacgaactttttctgaacctggtcatggaatatgtccctgagacgatgtatcgagttctaaagcactacaataatatcaaccagagaatgcccctaatctatgtgaaattatatacataccaaatcttcaggggactagcatatatccatactgtaccaggagtttgccatagggatgtgaagccccaaaatctattggttgatcctctcactcaccaagttaagctttgcgattttgggagtgcaaaagttctggtcaagggtgaagcgaacatttcatacatatgttcaaggtactatcgggccccagaactaatatttggtgcgacagaatatacaacttctattgatatctggtcagctggttgtgtccttgcagaacttcttttaggccagccattgttcccaggagaaaatcaggtggaccaacttgtggaaattattaaggttcttggtactccaactcgagaagaaattcgttgtatgaaccctaattataccgattttagattccctcagattaaagctcatccttggcataaggtctttcgcaagcgaatgcctcctgaagcaattgaccttgcatcaaggcttcttcaatattcaccaagtcttcgttgcagtgcgctggaagcatgtgcacatcctttctttgatgagcttcgagagcccaatgcaaggcttccaagtggtcgtcctctacccccgcttttcaactttaaacaagaattatctggagcatcccctgaactgatcaacaaactaatcccagagcatgtcaggcggcaaactggttttggcttcccatatcccgctagcacataatgtaaagagataatgaaacaatgagtcaacccttctagtgattaatgttaaacacaggtcccctttatggtcaatagattaggattcaggccttatatatgaatgaagttttcctccaatcccgtcccccaaagatgtatgtatacatgtactggctgctcaatgtaacatgaaaaatcttgaatctgtctaaatatctcgttctagtttaca

SEQ ID NO: 4686 - DNA, 1878 bp, Brassica rapa
gaaaacggaaagtagagagagagagaaataaaagagagaagtaagagctggattcacatggacttgttctctctctctctctccttcctttattctcatcttgcgacttctctctctctctctctctccaccaacaaaactgattgaaaccaattttgttctctctcactcttctttctcttcccttctctgcctctaacgccatggctgacgataaggaggtgccgggtgctgtagttaacggacacgatcaagtcactggccacataatctccacaactatcggaggcaaaaacggagaaccaaaacagacgataagttacatggcggagcgtgtcgtcggaacaggctccttcgggatagttttccaggcgaagtgtctcgagaccggagaaaccgtggcgataaagaaggttctgcaagacaggaggtacaagaaccgagagcttcagctgatgcgtgttatggaccatcctaatgtggtttgtttgaagcattgcttcttctccaccactagtaaagacgagctgttcctcaacttggttatggagtatgtacccgagagcttgtaccgtgttctgaaacattacagcactgctaaccagagaatgcctcttgtctatgttaaactctacatgtaccagatcttcaggggacttgcgtacatgcacaatgttgctggagtttgtcacagagatctaaagcctcaaaatcttctggttgatcctctgactcatcaagtcaagatctgtgactttggcagtgccaaacagcttgttaaaggtgaagccaacatctcttacatatgttcaagattctaccgtgcaccagagctcatatttggtgccactgagtacacaacttccattgatatctggtctgctggttgtgttcttgctgagcttctccttggtcagccattattccctggagaaaatgctgtggatcagctcgttgaaatcatcaaagttcttggtacaccaactcgagaagagatccgttgtatgaatccacattacacggactttaggttcccacagataaaggcacacccttggcacaagattttccataaaaggatgcctccagaagcgattgatttcgcatcaaggctgcttcagtactctccaagtcttagatgcacagctcttgaagcttgtgcacatccgttctttgatgaactgagagaaccaaatgctcgtttaccaaacggacggcctttcccgccaatcttcaacttcaaacaagaggtagctggagcatcaccagagctggtcaacaagttgattccggaccatatcaagagacagttgggtctaagtttcttgaatcagtctggaacttaaaacgatcagaagatgagggactttatatgtataatgtaccattactcagaggcagaagaaggtagttgaacgcaatgtggaggataacaaatcagaagttttgtctcctcaaactcagttccaggaatgtttcctttgggagacaagtttgatggtcaaagacagcttctacaaacctgacttccccaaatctgcaagaatagctattcagatgtatctttttctttttctttttcctttttaagttttgtgagaaaacaaaatcttcccttgtacttcattctttctgcatctgtatatgagtttagtagttagagtttctttatatagtaaagtttgagcagaagttgaaggaatctttagtcaaagagatccaaagtctaccaaaagaggaaggcttgagttcttctgcagtttaaggggtttctgttcttttttggttcttttctcctttggaatgttttgtcttctaatgaaatggtttgtttcacttaaccttcttacaaaggcaaatctcaagactatcttatcc

SEQ ID NO: 4687 - DNA, 1623 bp, Arabidopsis lyrata
gaaaaatagtctttactcaattgttcagtggttgagagagaaaagagtaaaaaagcacatggcctcattaccattggggcatcagcctcatgctcttgctccacctccgccgcagccgcagcttcacgacggcgacgctttgaaacgccgtcctgaaatggattctgataaggaaatgtctgctgctgttattgagggaaatgatgctgttaccggtcatatcatttccactaccattgggggcaaaaatggtgaaccgaagcagaccattagttacatggctgagcgggttgttggaacaggttcattcggaattgttttccaggcgaaatgcttggaaactggagaatcagtagccattaaaaaggtcttgcaagatcgacgctacaaaaaccgtgagttgcaactaatgcggccaatggatcacccaaatgtcatctccttgaagcattgtttcttctctacaacaagtagagatgagctcttcctcaaccttgttatggagtatgtacctgagactttgtaccgggttttgaggcactatactagttcaaatcagaggatgccaattttctatgtcaaactttacacatatcaaatctttagaggtttggcttacatccatactgttcccggtgtttgccacagagatgtgaaaccacaaaatctattggttgatcccttgacccatcaggttaagctgtgtgattttggaagtgcaaaagtattggtcaaaggtgaagcaaacatatcatatatctgctcccgttattatcgagctccagaactcatctttggcgccacagagtatacagcatccatagatatatggtccgctggttgtgttctggcagagcttcttcttggccagccgttatttccaggagaaaattcagttgatcagcttgtggagatcataaaggttcttggtactccaactcgtgaagaaattcgatgtatgaacccaaactacacagactttaggttcccacaaatcaaagctcacccttggcacaaggtttttcataagcggatgcctccagaagccattgaccttgcatctcggcttcttcaatattcaccaagcctacgatgcactgcgctcgaagcatgtgcccatccgtttttcaatgaactccgagagccaaacgcccgtcttccaaatggtcgtccattaccgccattgttcaatttcaaacaagagttaggtggagcttcagtggagctagtaaacaggctaatacctgagcatgtgagacgacagatgggcacaggattacaaaacagttaaaaactgtgcatgtctgaagaaaaagaggagaaagcagatttactacttctatttgatagttgacaggttcaacaatatattaaccacaactattatcagcttctatacccgtagtaaagtcattttcagcttttgagaaatcagatgctgataattgcttctattttttttttattccttagcttggagagtggagagagagacactgttcctcgtgtattttctgtatatgtttttgtccgtaaaacaattctgacagatccgtagagaaaagaaaaaaaaaacgaggtgataatattgaaccatgtcatgtccaaaagttaatctacaga

SEQ ID NO: 4688 - DNA, 1584 bp, Eutrema halophilum
agtctttactcttttgtttgttttgagcgggtgagagagaaagtgtaaagagcacatggcctcatttccgttggggcctcagcctcatgttcttgctcctcctccgccgccgcagcagcttcacgacggagacgctttgaaacgccgtcctgaattggattctgataaggaaatgtctgctgctgttacagagggcaatgatgctgttactggtcatatcatttccactaccattgggggaaaaaacggtgaacccaaacagaccattagttacatggctgagcgggttgttggaacaggatcattcggaattgttttccaggcgaaatgcttggaaactggagaatcagttgccattaaaaaggtcttgcaagatcgacgctataaaaatcgtgagttgcaactaatgagactaatggatcacccaaatgtcatctccttgaagcattgtttcttctctacaacgagtagagatgagcttttccttaacctcgttatggagtatgtacctgagactttgtaccgggttttgaggcactatactagctcaaatcagagaatgcccattttctatgtcaaactttacacatatcaaatcttcagaggtttggcttacatccacgccgttcctggtgtttgccacagagatgtgaaaccacaaaatcttttggttgatcccttaacacatcaagttaagctgtgtgactttggaagtgcaaaagtactggtcaaaggtgaagcaaatatatcatacatctgctctcgttattatcgagctccagaactcatctttggagccacagaatatacagcatccatagatatatggtctgctggttgtgttctggcagagcttcttcttggccagccgttatttccaggagaaaattcagttgaccagcttgtggagatcataaaggttcttggtactccaacccgagaagaaattcgatgtatgaacccaaactacacagactttagattcccacaaatcaaagctcatccttggcacaaggtttttcataagcggatgcctccagaagccattgacctcgcttcccggcttcttcaatattcaccaagtctacgctgcactgcgctcgaagcatgcgcacatccatttttcaatgaactccgggagccaaacgcccgtcttccaaatggtcgtccattaccgccattattcaacttcaaacaagagttaactggagtttcattggagctgatcaataggctaatacctgagcatgtgagacgacagatgagcacaggattacaaaacacttgaaaactgtggatgtctgagaaaagtggagaaagaagatttacttcttctatctgatattagacaggatctacatcaatattaaccacgattgttatcagcttcttctatatacccgtaaagtcatattcagctcttttgagaaatcagaagctgacaactgcgtctttttttgtatttttaaattcttgacctggaaaatggaggaagactctgttcctcgtgtatttctgtatatgtttttgtccgtaaaacaattctgacagatccgtagagagagaagaaaaacgaggttatgg

SEQ ID NO: 4689 - DNA, 1612 bp, Valeriana officinalis
gagaagctgtcatcgcacatggccgcgttgccgccggtacctaaccaccttcctccagaccctctcatgctcgccgcagctcaccggaccgaaatggactccgataaggaaatgtcggctactagtacagttgttgagggaaatgatcaagttacaggtcacattatatcaactacgattgggggcaaaaatggtgaaccgaaaaggaccattagttatatggcagagcgcgtcgtaggtacgggatcttttggaattgtttttcaggctaaatgcttggaaactggagaaacagtggcgataaaaaaggttttgcaagacagacggtataaaaatcgtgaattgcagttgatgcgaatgatggatcatccaaatgtggtttctctaaagcattgttttttctctacaacaagtagagatgaacttttcttgaatttggtaatggagtttgtccctgaaactatgtaccgagttttaaagcactacagtaatgtcaatcaaagaatgccgctcatctatgttaaactctacacatatcagatatttagagggctggcttatatccattctgttcctggggtttgccatagggatgtgaaacctcaaaatcttctggttgatcccctcacgcaccaggttaagctttgtgactttggaagtgctaaagtattggtgagaggtgaagcaaacatagcttacatatgctcacgttattaccgtgcaccagaacttatatttggtgccactgagtatacatcctctatcgatatttggtcagctggctgtgttcttgccgagcttcttttagggcagccgttatttcccggagaaaatgcagtcgatcaacttgtagaaattatcaaagttcttggtactccaactcgtgaagaaattcgatgcatgaatcccaattacactgatttcaggtttcctcagattaaagctcatccgtggcacaaggttttccacaaacggatgccaccagaggcgattgaccttgcttctcgacttctgcaatactcaccaagtctccgttgcactgcgcttgaagcatgtgcacattcattctttgacgagttaagggatcccaatgttcgcctaccaaatggccgtcctgtacccccacttttcaactttaaacaggagttggccggagcttcgtcggagttggtgaacaggctgataccggaacacattcagcgccaaatgggtctaaatttgccttctcatccaccagggacttgatcaactgctgaaaaaatttggaaactgaaatggaaaaatcttgatggtcttgtaagcataaccaaaacaggaaagtgaaagttatgcgtatattcagcttttaatgcaaacaaattctagtagtaagggaaaaagagagaatagtttttggggcgtatgtgtaaattgttttgattcgagaagtaatgttaggttatggagtatgatactactagtatttgtgtttatatagctactagttacaactgccagtcgccctactttgttctgcgttttctagttttttcatgttcaagctgccagattctatttaagattactataggtctcctattcagtctttagcgattaataatcatttctttta

SEQ ID NO: 4690 - DNA, 2045 bp, Cajanus cajan
accttttttatttattaatttggtttaagttaagcacacctaatgattgtgattaacagcgaggtcttcctaacctgcaaagttagtcaagaaaaatgggaaaagtccaaaaaaataaataaaaaagaaaagaaaaagaagacagaggaaagaaaggagagctggaatcacatggacttgtctttctcttgctgggtcctccattttcttcacatcttctctctattctaaccattctcttcttcttccttagattcctctcccttctgccatggctcaggataaggagatgtctacctctgttatcaatggcaatgattccctcactggtcacatcatttctacaactattggagggaaaaatggggaacccaaacagactattagttacatggcagaacgagttgtaggaactggatcatttggaattgttttccaggcaaaatgcttggaaactggggaagcagtggcaattaagaaggttttacaagacagaagatacaagaatcgtgaactgcagttaatgcgtgttatggatcatccaaatgtgatctctctaaagcattgtttcttttctactacaagtacagatgaactttttcttaatttggtgatggagtatgttccagagtccatgtatagagtcttaaagcactatagcaatgctaatcaaagaatgccaatcatctatgtaaaactttatatgtaccagattttcagggggttggcttatatccacactgttcccaaagtttgccacagagatttgaagcctcaaaatatactggtggatcctcttacacatcaagtgaagctatgtgattttggaagtgcaaaagttctagttaaaggcgaagctaatatatcatacatatgttcacgattctatcgagctccggaacttatatttggtgccactgagtatacaagttcaattgatatttggtcagctggctgtgtccttgctgaacttcttttgggccagccattattccctggtgaaaatgcagtagaccagctcgttcatattataaaggtgcttggcacacccacacgagaggaagtacgctgtatgaatcccaattacaatgactttaggtttccacagataaaggcacacccatggcacaagatattccacaaaaagatgcccccagaagctattgatcttgcatcccgacttttgcaatactccccaagtctccggtgcactgcgcttgaagcatgtgcacatcctttctttgatgaacttcgagaacccaatgctcgcctgccaaatggtcgtccatttccccctctatttaacttcaagcaggaattagctggagcatctcctgagctcgttaacaagttgatacctgaccacgtgaagcggcaaatagggctacaatttgctcattcagcaggatcgtgatgatatacttagggaaggcatggtgtatactaattgataagttaaacgaaagtggcaccatttttttttgtctaaattaccttgtgctgtggcctggccaatgtagtttcaagctgaacctggactgagacttgaggtgcgggatggctgcagttgatccgtcagtgtatgtataccttttggttctctgtttctactggtggatctttattttcccaggcaaacatagccttgtttattgtaaacgtctacatgtcatatagtagtatactttggcctgaaatggtcagatcagaactcaatgcttctgtaaggggaaaactaaagccttggctggaaggaagggagggtcaagacttgttttgatgatggggctgttggttggctttggtttcctcatgttgatatgtgcctcatttgtaatgttgcacaccagttccttttcttgtgaaatgtaatgtgttatctacctgtttttttttcaatgcggcgttctattcttccacatttcattttttttttaatcttgaattttaattcccaagttttagctcctttggaactgacagggctcgtaattttctatgttgacacaaaacaaaaatgttgggagactagaacatgttctctt

SEQ ID NO: 4691 - DNA, 2106 bp, Brassica oleracea
ccgacaacaacattgatgtctttgatcacgaaatttccacaaagagaatagtcctttgtctgcgtaattagacagcaaacttgagggtgtttatgtaactttaccaaataaacaaattttttaaacgaaagaagatggcgaagaaaacggaaagtgtagagagagaaaataaaaagagagatagagctggattcacatggccttgttcttcttctctctctctccaaatttgatcattaccaaccaaactaattgaaatccatttgttctctcaaccctgttctctctctctctctctctctctctctctctcctcttctctgctcttctctgcgcctctaacgtcatggctgacgatagggagatgccgccggctgctgtagttgatggacatgaccaagtcactggccacataatctccaccaccatcggtggtaaaaacggagaaccaaaacagacaataagttacatggcggagcgagttgtcggtacaggctccttcgggatagtgttccaggcgaagtgtctggagactggagaaaccgtggcgataaagaaggttttgcaagacaggaggtacaagaaccgagagcttcagctgatgcgtgtgatggaccatccgaatgttgtttgtttgaagcattgcttcttctcgaccacgagcaaagacgagctgtttctgaacttggttatggagtatgtccctgagagcttgtaccgagttctgaaacattacagcactgctaaccagaggatgccgcttgtttatgttaaactctatatgtaccagatcttcagaggacttgcttacattcacaatgttgctggagtttgtcacagagatctaaagcctcaaaatcttctggttgatcctctgactcatcaagtgaagatctgtgattttggcagtgcgaaacagcttgttaaaggtgaagccaacatctcttacatatgttcaagattctaccgtgcacctgaacttatattcggtgccactgagtacacaacttccattgatatctggtctgctggttgtgttctcgctgagcttcttcttggtcagccactattccctggagaaaatgctgtggatcagctcgttgaaatcatcaaagttcttggtacaccaactcgagaagagatccgttgtatgaatccacactacacagactttaggttcccgcagataaaggcacatccttggcacaagattttccacaaaaggatgcctccagaagcaattgattttgcatcaaggctgcttcagtactctccaagtcttagatgcacagcgcttgaagcttgtgcacatccgttctttgatgagctgagagaaccaaatgctcgtttaccaaacggacggcctttcccacctctcttcaacttcaaacaagaggtagctggagcttcacctgagctggtcaacaagttgattccagaccatatcaagaggcagttgggtctaagtttcttgaatcagtctggaacttaaaaaacgatcaaaaagacaagaacttttttatatataattgtaccattactcagagccagaagaaggttagttgaaggcaacgtggaggacacagttagaagttttgcctcctcaaaactcgttccaggaatgaaggtcaaaaaagacaagcttctctacaacctgacttcccccaagcctgcaagaaaagctactcagttgtatcttcttcttcttcttttgtccttttttaaaaatgtttggttaaaacaaagaacaaaatcttctctttttgctttattcttactgcatctgtaaatgagtttagtcagagatttttatatagtaaagtttgagcagaaggtgaaagaatctttactcaaaagagatccccaaagtctgccagaagaggaaggctggagtttctgtagtttaagtggttgtggctcttttttctttttgtttcctttctcctttttaatgcttctgctttgttgttgttaccaaattttatgaaatggtttgcttatgtctcattttcttacaaagacatctctagaaatgttctctttctgcattagggaggtatgtattcattttaacatttgatgtgatttgatttttaatggggtttt

SEQ ID NO: 4692 - DNA, 1638 bp, Musa acuminata
gtggcaaaatgtgtcattcacatttgttcctgtatggaactataatggcttgagagaatcgttggaattttctcgtagtctgctgcctacgttggaccgtcttaagtggcaaccaacccagggagggagagcgagagagaaagagagagagagaggtgcagatcataagatcgccgattccggtctgcatcataaaagcgtcccacatggcttcgctgccgctgggacctcaccatcccccaccaccgcccggccacgccgccgccgccgccgcccttaacctcgcgccacctccccgtacggaattggccgacaacaagcaagcatctgttgtcgaggggaatgaaccagtaactggtcatatcatctccaccaccatcggaggcaagaatggcgaaccaaagcagacccttagttatatggcagagcgtgttgtggggacgggctcattcggaattgtcttccaggccaaatgtttggaaacgagagaaacagttgcaataaagaaggttttacaggacaaaagatacaaaaatcgtgaacttcaattgatgcgcacaatggctcatccaaatgttatctctctaaagcattgtttcttctcatccacaagtagagatgagcttttccttaacctagttatggaatatgtgcctgaatctctttatggtgtcctaaggcattatagcaatgtgaatcagaggatgccactcatctttgtgaagttgtatacatatcagatatttagaggtctggcttatatccatactgttccaggagtttgtcatagagatttgaagccacaaaatattctcgtagatcccctcactcaccaagtcaagctatgtgattttggaagtgcaaaagttctggttaagggtgaagcaaacatatcttacatttgttctcgctattaccgtgctccagagcttatttttggcgcaacagaatatacaacatccatagatatatggtcagcaggttgtgttcttgctgagttactacttggccagccattatttcctggagacagtgctgtcaatcagcttgttgagataatcaaggttcttggaactccaacccgtgaggaaattcggtgcatgaatcctggctacacagagttcagatttccacagataaaagctcatccatggcataagattttccacaagcgaatgccgccagaagcgatagatcttacgtcacgcctcctccaatactccccaagttttcgttgcactgcattggaagcatgcacccatcccttctttgatgaactgcgagaacccaatgcacgattgccaaatggtcgccctcttcctcctctttataactttaaacaagaattagctggagcatcaccagatctcatcaacaagctgattccagaacatgccaggcgtcaatctggtttcagttgcttgcatatggctggaacatgagttggaaacactgttgcggtgttttttttttttcagtaatgaaaatctggggaaaagatgaatcagcatagtgggaactgatgaaaggtagcttatctattcagtctcgggaacatggatgtaatttgatggtgctgggtgttgagatgtatgaccggtcacaaaggtgtggttcaagatttctctgcggtgtttg

SEQ ID NO: 4693 - DNA, 1739 bp, Brassica oleracea
cattgcctacgtaaacttgagggtgtttatgtaactttctcttaataagcgaaaattaattattaaaaaacacgaaagaggatggcgaagaaaacggaaactatagagagaaataaaaaggagctggattcacatggcctttgttctctctctctccaccatgatcattaccaacaaaactgattgaaacccacctgctctactctctctatcactcttctctgcctctaacgccatggctgacgataaggagatgccagctgctgtagttgctgggcatgatcaagtcactggtcacataatctccaccacaatcggaggaaaaaacggagaacctaaacagacaataagttacatggcggagcgagtcgtcggcacaggttccttcgggatagtgttccaagcaaagtgtttggagacaggagaaaccgtagcgataaagaaagttctgcaagacaggagatacaagaaccgagagcttcagctgatgcgcgtgatggaccatccgaacgtggttcgtttgaagcattgcttcttctcgaccacgagtaaagacgagcttttccttaacttggttatggagtatgtccccgagagcttgtaccgtgttctcaaacattacagcactgcgaaccagagaatgcctcttgtctacgttaaactctacatgtaccagatctttaggggacttgcttacgttcacaatgttgctggagtttgccatagagatctaaagccgcagaatcttctggttgatcctcttactcatcaagtcaagatctgtgactttggcagtgcgaaacagcttgttaaaggtgaagccaacatttcttacatatgttcaagattctaccgtgcacctgaactcatattcggtgccaccgagtacacaacttcaattgatatctggtctgctggttgtgttctcgctgagcttcttcttggtcagccattattccctggagagaatgctgttgatcagctagttgaaatcatcaaagttcttggtacaccaactcgagaagagatccgttgtatgaatccacactacacagactttaggttcccacagattaaagcacatccttggcacaagattttccataaaaggatgcctccggaggctattgattttgcgtcaaggctgcttcagtactctcctagtcttagatgcacagcgctggaagcttgtgcacatcctttctttgatgaactgagagaaccaaatgctcgtttaccaaacggacggcctttcccgcctctcttcaacttcaaacaggaggtagctggagcatcacctgagctggtcaacaagttgattccagaccatatcaagagacaattgggtctaagtttcttgaatcagtctggaacttaaaaggaacaatagacaagaagttttttttatataaatgtagttgaaggcaaagtggaggacacacagttcgaagttttgatggtgaaagaaagcttgtacacagcctgacttccccaaatctgcaagaaaagccattcgcagtttatcttattctttctccttttgcttcattctttctgcatctgtaaatctcttagagcaacattatccatagcaccccatttggggtgcttaatcacttttttattattaaatatgtgttaagcattttattaagaaacttgtatattttgatcctccaatgcaaggtggttaatatggggtgtttaagaaaataaaatattaaacattgtttttttta

SEQ ID NO: 4694 - DNA, 1690 bp, Brassica rapa
ggaaactatgagagaaataaaaggagctggattcacatggcctttgttctttctctctcatatctctctctcaccaccatgatcattaccaacaaaactgattgaaacccacctgttctctctctctctctctctatcactcttctctgcctccaacaccatggctgacgataaggagatgccggctgctgtagttgatggacatgaccaagtcactggtcacataatctccaccacaataggaggtaaaaacggagaacctaaacagactataagttacatggcggagcgagtcgtcggcacaggctccttcgggatagtgttccaagcaaagtgtttggagacaggagaaaccgtggcgataaagaaggtttttcaagacaggagatacaagaaccgagagcttcagctgatgcgtgtgatggaccatccgaacgtggttcgtttgaaacattgcttcttctcgaccacgagtaaagacgagcttttccttaatctggttatggagtatgtccctgagagcttgtaccgtgttctgaaacattacagcactgcgaaccagagaatgcctcttgtctacgttaaactctacatgtaccagatctttaggggacttgcttacgttcacaatgttgctggagtttgccatagagatctaaagccgcagaatcttctggttgatcctcttacacatcaagtcaagatatgtgactttggtagtgcgaaacagcttgttaaaggtgaagccaacatatcttacatatgttcaagattctaccgtgcacctgaacttatattcggtgctaccgagtacacaacttcaattgatatctggtctgctggttgtgtccttgctgagcttcttcttggtcagccattattccctggagagaatgctgttgatcagctagttgaaatcatcaaagttcttggtacaccaactcgagaagagatccgttgtatgaatccacactacacagactttaggttcccacagattaaagcacatccttggcacaagattttccataaacggatgcctccagaagctattgattttgcgtcaaggctgcttcagtactctcctagtcttagatgcacagcgctggaagcttgtgcacatccgttctttgatgaactgagagaaccaaatgctcgtttaccaaacggacggcctttcccgcctctcttcaacttcaaacaggaggtagctggagcatcacctgagctggtcaacaagttgattccagaccatatcaagagacagttgggtctaagtttcttgaatcagtctggaacttaaaaggaacaatagacaaggagtttttaaatgttgaaggcaaagtggaggacacatagttcgaagttttgatggtgaaagaaagcttgtacagcctgacttccccaaatctgcaagaaaagccaattcagttgtatcttcttatttctcctttattttgcttcattctttctgcgtctgtaaatgagcttagtcaagagttttcttatatagtaaagtttgagcagaatgtgaaagtagcttagtcaaagagatgcaaagtcttaccacaagaggaaggctttctctgtttttttttttgttttgtttcttcctcctcttgaatgttttgtcgtcttctgtattgttgctattacggtattaacaaattttgtgaaacggtttgtttat

SEQ ID NO: 4695 - DNA, 1749 bp, Brassica napus
ttgttctctctctctctctctctctctcacactctcttctctgctcttctctgcgcctctaacgtcatggctgacgatagggagatgccgccggctgctgtagttgatggacatgaccaagtcactggccacataatctccaccaccatcggtggtaaaaacggagaaccaaaacagacaataagttacatggcggagcgagttgtcggtacaggctccttcgggatagtgttccaggcgaagtgtctggagactggagaaaccgtggcgataaagaaggttttgcaagacaggaggtacaagaaccgagagcttcagctgatgcgtgtgatggaccatccgaatgttgtttgtttgaagcattgcttcttctcgaccacgagcaaagacgagctgtttctgaacttggttatggagtatgtccctgagagcttgtaccgagttctgaaacattacagcactgctaaccagaggatgccgcttgtttatgttaaactctatatgtaccagatcttcagaggacttgcttacattcacaatgttgctggagtttgtcacagagatctaaagcctcaaaatcttctggttgatcctctgactcatcaagtgaagatctgtgattttggcagtgcgaaacagcttgttaaaggtgaagccaacatctcttacatatgttcaagattctaccgtgcacctgaacttatattcggtgccactgagtacacaacttccattgatatttggtctgctggttgtgttctcgctgagcttcttcttggtcagccactattccctggagaaaatgctgtgggtcagctcgttgaaatcatcaaagttcttggtacaccaactcgagaagagatccgttgtatgaatccacactacacagactttaggttcccgcagataaaggcacatccttggcacaagattttccacaaaaggatgcctccagaagccattgattttgcatcaaggctgcttcagtactctccaagtcttagatgcacagcgcttgaagcttgtgcacatccgttctttgatgagcttagagaaccaaatgctcgtttaccaaacggacggcctttcccgccgctcttcaacttcaaacaagaggtagctggagcttcacctgagctggtcaacaagttgattccagaccatatcaagacgcagttgggtctaagcttcttgaatcagtctggaacttaaacaaacgatcaaaaagacaagaacttttttatatataattgtaccattactcagagccagaagaaggttagttgaaggcacgtggaggacacagttagaggttttgcctcctcaaaactcgttccaggaatgaaggtcaaaaaagacaagcttctctacaacctgacttcccccaagcctgcaagaaaagctactcagttgtatcttcttcttcttcttttgtccttttttaaaaatgtttggttaaagcaaagaacaaaatcttctctttttgctttattcttactgcatctgtaaatgagtttagtcagagatttttatatagtaaagtttgagcagaaggtgaaagaatctttactcaaaagagatccccaaagtctgccagaagaggaaggctggagtttctgtagttcaaggggttgttgctcttttttttcttttgtttgttcttctcttgtatgttgtctctgtcgtttgttagttacttaactaatttatagaatgctgtattcgtcttacgtaaacgtagagtactcg

SEQ ID NO: 4696 - DNA, 1471 bp, Brassica napus
accaccatgatcattaccaacaaaactgattgaaacccacctgttctctctctctctctctctctctctctctctatcactcttctctgcctccaacaccatggctgacgataaggagatgccggctgctgtagttgatggacatgaccaagtcactggtcacataatctccaccaccatcggtggcaaaaacggagaacctaaacagacaataagttacatggcggagcgagtcgtgggcacaggctccttcgggatagtgttccaagcaaagtgtttggagacaggagagaccgtggcgatcaagaaggttctgcaagacaggagatacaagaaccgagagcttcagctgatgcgtgtgatggaccatccgaacgtggttcgtttgaaacattgcttcttctcgaccacgagtaaagacgagcttttccttaatctggttatggagtatgtccctgagagcttgtaccgtgttctgaaacattacagcactgcgaaccagagaatgcctcttgtctacgttaaactctacatgtaccagatctttaggggacttgcttacgttcacaatgttgctggagtttgccatagagatctaaagccgcagaatcttctggttgatcctcttacacatcaagtcaagatatgtgactttggtagtgcgaaacagcttgttaaaggtgaagccaacatatcttacatatgttcaagattctaccgtgcacctgaacttatattcggtgctaccgagtacacaacttcaattgatatctggtctgctggttgtgtccttgctgagcttcttcttggtcagccattattccctggagagaatgctgttgatcagctagttgaaatcatcaaagttcttggtacaccaactcgagaagagatccgttgtatgaatccacactacacagactttaggttcccacagattaaagcacatccttggcacaagattttccataaacggatgcctccagaagctattgattttgcgtcaaggctgcttcagtactctcctagtcttagatgcacagcgctggaagcttgtgcacatccgtctttgatgaactgagagaaccaaatgctcgtttaccaaacggacggcctttcccgcctctcttcaacttcaaacaggaggtagctggagcatcacctgagctggtcaacaagttgattccagaccatatcaagagacagttgggtctaagtttcttgaatcagtctggaacttaaaaggaacaatagacaagaagttttttaatataaatgtacacatagttgaaggcaaagtggaggacacatagttcgaagttttgatggtgaaagaaagcttgtacacagcctgacttccccaaatctgcaagagaagccgattcagttgtatcttcttctttctcctctattttgcttcattctttctgcatctgtaaatgagtttagtcaagagttttcttatatagta

SEQ ID NO: 4697 - DNA, 2019 bp, Citrus sinensis
gaaaagaggaaaaatcaaaaagcgaatagaacggaaagtagacagaggggaagggggaaaaaaaaaaggggaaaaaggaaaaggaaaacaaaaacaaaaacaagagaggaaaaagaagagctggaatcacatgggcttgttgtgtgtccttgggtcctcctttctctcattctccatcgccacaccatgatcatcatcttctccctcatccaccgttgaaatttctccatttctcttccatcgctctctctctctctctctctctctccctctctttcttcaccccaatttctctccaaatctccccatggccgacgataaggagatgtctgctgctgttgttgatgggagtgaccatgtcactggtcacatcatttccaccaccattggaggcaaaaatggagagccaaaacagactattagctacatggcggagcgtgttgtgggaactgggtcatttggtattgtcttccaggctaaatgcttggaaactggagagactgtggctatcaagaaggttttgcaggacagaagatataagaatcgtgaactgcagttaatgcgggtgatggatcatccaaatgtgatttctttgaagcattgtttcttttcaactaccagtaaaaacgaacttttcctcaacttggttatggaatacgtaccagagagcatgtatagggttttgaagcattacagcagtgcaaatcagagaatgcccctcatatatgtgaaactttatacgtaccagattttcaggggcctggcttacatccacactgttcctcgagtttgccatagggatttgaagcctcaaaaccttttggttgatcctcttactcaccaggttaagatttgtgattttggaagtgcaaaacagctgattgctggagaagcaaacatatcatacatatgttcacgtttctatcgggctccagaacttatatttggagctacagaatatacaacctcaattgatatatggtcagctggttgtgtgcttgccgagcttcttttgggccagccattatttcctggagaaaatgcagtggaccagcttgtagagattatcaaggttctcggtacacccactcgtgaagaaattcgctgtatgaatccaaattataccgattttaggtttccacagattaaagcacatccttggcacaaggttttccacaaacggatgcctcctgaggctattgatcttgcttcacgcctgttgcagtattcaccaagtctccgatgtacagcgctagaagcatgtgcacatcctttctttgatgaactgcgtgagccaaatgctcgcctaccaaatggccgcccactgccacctctcttcaactttaaacaggaattatcaggggcttcaccagagcttgttaataagttgataccagaccatgtgaaacggcaattaggtctgaatttcttgcatccagccgggacataggtctagacaagtaatatagaagtgaaatctacttggtgatgtgtagcacaaagggaattatatccttgttcgtaactgccatgcattgaggcttaatcagcatcagttgttgctcgatcagcaagcctacattctcaggctgctatgcttttcttggtgccttctttttctgcttttccatcctcctgtgtctcctccccacttcgtcccacctcccctcctctgttaaagttcccatttgtttatgtacatgtttgatagtaaagataggttaagttgataaggtggactgatcagactgctgttagtagaggaaaaactgaggaaaaatgtatttgtacctaggaagaaagccccaaagagaatggcccagaagatggggtgggcatgatgttgtcaggtttggtcctgtttttcttttccctctttgcaagtctttcaatttctctattttgatggtctgtggtgactgacttcaaattgcagacaattgttgtcacttgctgtttgtgcaaagtaatgttattgcaattctcctcttggaaatgcttgcttgccccctatttgtt

SEQ ID NO: 4698 - DNA, 1865 bp, Raphanus sativus
ggagagagagagagagagaaataaaaagagagatagagctggattcacatggccttgttcttctcttctctcatctcatctccctctctctctccaccatgatcatcaccaaccaaactaattgaaatccatttgttctctcaaaccctattctctctctctcacactctctcttctcttctcttctcttctcttctctgtgcctctaacgacatggctgacgatagggagatgccggctgctgtagttgacggaggacacgatcaagtcaccggtcacataatctccaccaccatcggcggcaaaaacggagaaccaaaacagacgataagttacatggcggagcgagtcgtcggcacgggctccttcgggatagttttccaggccaagtgtctggagacaggagagaccgtggcgataaagaaggttctgcaagacaggaggtacaagaaccgagagcttcagctgatgcgcgtgatggaccaccccaacgtcgtctgtttgaagcattgcttcttttccaccacgagtaaagacgagctgttcctcaatctggtcatggagtatgtccccgagagcttgtaccgtgttcttaaacattacagcactgctaaccagaggatgcctcttgtctacgttaaactctatatgtaccagatcttccgaggactagcttacgttcacaatgttgctggagtctgtcacagagatctaaagcctcaaaatcttctggttgatcctcttactcatcaagtcaagatctgtgactttggcagtgctaaacagcttgttaaaggtgaagccaacatttcttacatatgttcgcgattttaccgtgcacctgaactcatattcggtgccacggagtacacaacttccatcgatatctggtctgctggttgtgttcttgctgagcttcttcttggtcagccactgttccctggagaaaatgctgtggatcagctcgttgaaatcatcaaagttcttggtacaccaactagagaagagatccgttgtatgaatccacattacacagactttaggtttccgcagataaaggcacatccttggcacaagattttccacaaaaggatgcctccagaagccattgattttgcatcaaggctgcttcagtactctccaagtcttagatgcacagcgcttgaagcttgtgcacatcccttctttgatgaactcagagaaccaaatgctcgtttaccaaatggacggcctttcccaccactcttcaacttcaaacaagaggtagctggtgcttcacctgagctggtcaacaagctgattccagaccatatcaagagacagttgggtctaagtttcgtgaatcagtctggaacttaaaaaacgatcaaaagaactagaaccttattttaaatatataaatgtaccattactcagagccagaaggtagttgaaggcaaacgtggaggacacagttagaagttatcagactcggttccaaagaacgttccttcttaaagacgagtttgatggtcaaaacagacagagcttctatgtaaacattgttccccaaaatctgcaaggaaagctattcagttgtatttttctcactacttttttttttcaagttaaaaaacaaaaatctcctcttttgtttgcattctttctgcatctgtaaatgagtttagtcagagatttttatatagtaaagtttgagcagaaggtgaaaagaatgttttactcaaagagatccccaaaagtctaccagaagaggaagactggagtttctgtagttgctctgtatttttttctttttggtttactgtatccttttgaatgttttgtcttcttctatgttgttgttgttgttattaccaaattttatg

SEQ ID NO: 4699 - DNA, 1711 bp, Brassica napus
aaagttagagaaagagagagaagaatagcacatgacatcactatcattgggccctcagcctccggctactgctcagccgccgcagcttcgcgacggagatgcttccaggcgtcgttccgatatggatacagacaaggatatgtctgctgctgtgatagagggaaacgatgctgttacaggccacatcatttctactacaattggaggcaaaaacggtgaacctaaacagaccatcagttacatggccgaacgggttgttggacaaggatcattcggaatcgtgttccaggccaagtgcttggaaactggagaatcagtcgccattaagaaggttttgcaagaccggcgctacaagaatcgtgagctgcagttgatgcgactaatggaccacccaaatgtggtttccttgaagcattgtttcttctctacaacgagtagagatgagctcttcctcaatctcgttatggagtatgtacccgagactttgtaccgggttttgaagcactatactaattcaagccagagaatgcctattttctatgtcaaactctacacataccaaatcttcagaggcttggcttatatccatactgttcctggtgtctgtcacagagatgtgaaaccacaaaatcttttggttgatcctctcactcatcagtgtaagctgtgtgattttggaagtgcaaaagtattggtgaaaggtgaagcaaacatatcatacatttgctctcggtattaccgagctccagagctcatctttggggccacagagtatacatcctccatagacatatggtctgctggttgtgttttggcagagctccttcttggccagccgttgttcccgggagaaaattctgtggaccagctggtagagatcatcaaggttcttggtactccaactcgagaagaaatccgatgcatgaatccaaactacacagacttcagattccctcaaatcaaagctcacccgtggcataaggttttccataagaggatgcctccagaagccattgacctcgcatctcggcttcttcaatactcaccgagcctgcgttacactgcgcttgaagcatgtgcacatccatttttcaatgaactccgtgagccgaatgctcgtcttcctaacggccgacctctaccagccttgttcaacttcaaacaagagttagctggggcttcaccagagctgataaacaggctcataccggagcacataaggcgacagatgagtggaggcttcccatcacagcctggtcattagaaaaggaatatggaaactgggatgcttttgcggagcaaatgccttatggaaaagaggagagaagatctctgatttttcagagggtttaactaaaatatcagcttatgagtagagagatgattggccaattaagctttttgagaaatcaggaggtggtgatgattgtgtctaatatacaattctctcttttctctttttatgttataattcgcttttgacttgtagagataccttttctcgttgtattatttgtatatgtttttgtccgtaagacagcaaaccgcgatgatggaagaatggaatgaatgaatgatgtctaaaacttaagccctgtgtagtttggattcatgcatcggatttcttctcgagttggagtaccaagaaccttgatgatctctaccagctggtccacagaattttctcccgggaacaacggctggccaagaa

SEQ ID NO: 4700 - DNA, 1609 bp, Allium cepa
aagtaaatagattagaaagtggaggtgcttgtattcacatggcttcgctgtcacatttgtccctcttttcttccttttctctcaactactcgcctcttcgttcttcttctctttcgctgactaattaaattagccttttcgccccttcccttctccttcatctccatacatggcggacgacaaggaacactctatgatggagacaagtgatcctgtaactggacatatcatttcaacgaccattggtggcaagaatggtgaaccaaagagaacaattagttacatggcagagcgtgttgtggggactggatcatttggaattgtctttcaggccaagtgcttagaaacaggagagactgttgccataaagaaagtgctacaggataagagatacaaaaacagagagctacagctgatgcgaacaatggatcatcctaacgtagtttctttgaaacattgctttttctcaaccacaagcagagatgaactcttccttaatttggtcatggagtatgtgccagaatctttatatcgggttttgaagcattataacaatgcaggccagatgatgccacttatatttgtgaagctctacacatatcagatttttagagctctagcttatattcatgctgttcctggcgtttgtcatagagacgtaaagccacaaaacatactggttgacccgcttactcatcaagtgaaattgtgtgactttggaagcgctaaaattttggttaaaggtgaagaaaacatatcttacatttgctcccgctattatcgtgcaccagaacttatatttggtgcaacagaatacacaacgtcgattgacatatggtctgctggttgtgtacttgctgagttactccttgggcagccattatttccaggggagagtgctgttgatcaacttgttgagataatcaaggttctcggtactccaactcgagaggaaattcgatgcatgaatcccaactacactgatttcagatttccacagattaaagctcatccatggcataagatatttcacaagaggatgcctccagaagcaatagatctcacatcacgacttctccagtattcaccaagttttcgttgtactgcgttggaagcatgttctcatccattttttgatgagttgcgtcaacctaatgctaggctcccaactggtcgcccgttgcctccacttttcaacttcaaacaagagttgactggagcatcaccggatcttatcaatagactgattccagaacacgtgaagaagcagtctggtctcaatttattccatttggccgggacataattctgcatttatcataatatccgtgagttgaatgttactaagtaaagagaaaacttcatggtttatattttacttagatgaagttgttgcaaagtgaggtcacttgagtccagatcgggagataagagactcacaagtccatccatagtagttttaatctgttttctgtatattgtattatatatttatatttattaggattcttgtgaggataaatatagttgtgagtagaggaatgaatgaatgaattctggccgaagcaaaaggagagattcttcccggttttcgatgttgtatccagtt

SEQ ID NO: 4701 - DNA, 1523 bp, Allium cepa
ctctttcgctgactaattaaattagccttttcgccccttcccttctccttcatctccatccatggcggacgacaaggaacactctatgatggagacaagtgatcctgtaactggacatatcatttcaacgaccattggtggcaagaatggtgaaccaaagagaacaattagttacatggcagagcgtgttgtggggactggatcatttggaattgtctttcaggccaagtgcttagaaacaggagagaccgttgccataaagaaagtgctacaggataagagatacaaaaacagagagctacagctgatgcgaacaatggatcatcctaacgtagtttctttgaaacattgctttttctcaaccacaagcagagatgaactcttccttaatttggtcatggagtatgtgccagaatctttatatcgggttttgaagcattataacaatgcaggccagatgatgccacttatatttgtgaagctctacacatatcaaatttttagagctctagcttatattcatgctgttcctggcgtttgtcatagagacgtaaagccacaaaacatactggttgacccgcttactcatcaagtgaaattgtgtgactttggaagcgctaaaattttggttaaaggtgaagaaaacatatcttacatttgctcccgctattatcgtgcaccagaacttatatttggtgcaacagaatacactacgtcgattgacatatggtctgctggttgtgtacttgctgagttactccttgggcagccattatttccaggggagagtgctgttgatcaacttgttgagataatcaaggttctcggtactccaactcgagaggaaattcgatgcatgaatcccaactacactgatttcagatttccacagattaaagctcatccatggcataagatatttcacaagaggatgcctccagaagcaatagatctcacatcacgacttctccagtattcaccaagttttcgttgtactgcgttggaagcatgttctcatccattttttgatgagttgcgtcaacctaatgctaggctcccaactggtcgcccgttgcctccacttttcaacttcaaacaagagttgactggagcatcaccggatcttatcaatagactgattccagaacacgtgaagaagcagtctggtctcaatttattccatttggccgggacataattctgcatttatcataatatccgtgagttgaatgttactaagtaaagagaaaacttcatggtttatattttacttagatgaagttgttgcaaagtgaggtcacttgagtccagatcgggagataagagactcacaagtccatccatcagtagtagttttaatctgttttctgtatattgtattatatatttatatttattaggattcttgtgaggataaatatagttgtgagtagaggaatgaatgaatgaattctggccgaagcaaaaggagagattcttcccggttttcgatgttgtatccagttcatgttgtttttcctttg

SEQ ID NO: 4702 - DNA, 1597 bp, Arabidopsis lyrata
aacacaggtgagagagagagagagaaaaaatagtctttactcttcttcagtgagagagagagagaagttagagctgtaaaagcacatgacttcaataccattggggcatcctcagcctccgtctttagctcctcagccgccgcatcttcacggcggagatgctttgaaacgtcgtcccgatatggataccgacaaggaaatgtctgctgctgttatagaaggaaatgatgctgttactggtcacatcatttctactacaattggaggcaaaaatggtgaacctaaacagaccattagttacatggccgaacgggttgttggaacaggatcattcggaattgtattccaggcaaaatgcttggaaactggagaatcagtagccattaagaaggttttgcaagatcgccgctataaaaaccgagagctgcaactaatgcggctaatggaccacccaaatgtggtttccttgaagcattgtttcttctctacaaccactagagatgaactctttctcaatctggttatggagtatgtaccagagacgctgtatcgagttctgaagcactatactagttcaaaccagcggatgcctattttctatgtcaaactttacacataccaaatcttcagaggcttggcttatatccatactgctcctggtgtctgccacagagatgtgaaaccacagaatcttttggttgatcccctcacccatcagtgtaagctctgtgattttggaagtgcaaaagtactggtgaaaggtgaagcaaacatatcatatatctgctctcggtattaccgagctccagaactcatttttggggccacagagtatacatcatccattgatatatggtctgctggttgtgttctggcagagctacttcttggccagccgttattcccgggagaaaattctgtggaccagctagtggagatcataaaggttcttggtactccaactcgcgaagaaatccggtgcatgaacccaaactacacagacttcagattcccacaaatcaaagctcacccttggcataaggttttccacaagcggatgcctccagaagccattgaccttgcatctcggcttcttcaatactcaccaagtctacgttgcactgcgctcgaagcatgcgcacatccttttttcaatgaactccgtgaggcaaatgctcgtcttccaaatggccgacctctaccaccgttgttcaacttcaaacaagagttatctggggcgtcaccggagcttatcaacaggctaataccagagcatgtgaggcgacagatgaatggtggctttccatttcaagctggtccctagaaaaacgatttcgaaatgcttttcgatagcaaactgccttccggaaaggaggagaaggggatttacttctttctgattaaccacgtatcagcttctgagaagagatgatgctcctccttagacgtggccaattcagccttttgagaaatcaggaggtgatgattgtgtctattatattctttttgttcactgacttgtagagatactttttctcgtgtatcagtatttgtatatgtttttgttcttaaaaatgaaacaaaaaccattccaaac

SEQ ID NO: 4703 - DNA, 1702 bp, Arabidopsis thaliana
gtgggtttcctctttatctttaaaaattttctcaagtttagacagaacaccaggtaatagagagagaacaaaatagtctttactctttcagtgagagagagaagttagagctgtaaaagcacatgacttcgataccattggggcctcctcagcctccgtctttagctcctcagccgccgcatcttcacggcggagattctttgaaacgtcgtcccgatatagacaacgacaaggaaatgtctgctgctgttatagaaggaaatgatgctgttaccggtcacataatttctactacaattggaggcaaaaatggtgaacctaaacagaccattagttacatggccgaacgtgttgttggaacaggatcattcggaattgtattccaggcaaaatgcttggaaactggagaatcagtagccattaagaaggttttgcaagatcgccgttataaaaaccgagagttgcaattaatgcgactaatggaccatccaaatgtggtttccttgaagcattgtttcttctctacaacgactagagatgagctcttcctcaatctcgttatggagtatgtaccagagacattgtaccgggttttgaagcactatactagttcaaaccagcggatgcctatcttctatgtcaaactttacacataccaaatcttcagaggcttggcttatatccatactgctcctggtgtctgccacagagatgtgaaaccacaaaatcttttggttgatcccctcacccatcagtgtaagctctgtgattttggaagtgcaaaagtactggtgaaaggtgaagcaaacatatcatatatctgctctcggtattaccgagctccagaactcatctttggtgccacagagtatacatcatccattgatatatggtctgctggttgtgttctggcagagctacttcttgggcagccgttattcccgggagaaaattctgtggaccagctagtggagatcataaaggttcttggtactccaactcgcgaagaaatccggtgcatgaacccaaactacacagacttcagattcccacaaatcaaagcccacccttggcataaggttttccacaagcggatgcctccggaagccattgaccttgcatctcggcttcttcaatactcaccaagtctacgttgcactgcgctcgaggcatgtgcgcatccgtttttcaatgaactccgtgagccaaatgctcgtcttccaaatggccgacctctaccaccgttgttcaacttcaaacaagagttgtctggggcttcaccggagcttatcaacaggctaataccagagcatgtgaggcgacagatgaatggtggctttccatttcaagctggaccctagaaaagcgatctcgagatgcttttccagagcaaaatgccgccttatggaatgaaggagagggagatttacttctctctgattaactaagtatcagcttctgagaagagatgatgtctcctccttagacgtggccaattcagctttttgagaaatcaggaggcgatgattgtgtcctattatattctttttgttcactgacttgtagagagatacttttctcctgtatcagtatttgtatatgtttttgtccttgaaatgaaacaaaatcgattccaaactgcaagtcaaataaccgaaatgatgaaatgaaatcatgataatctaaagttgcctacggtaaa

SEQ ID NO: 4704 - DNA, 2120 bp, Cicer arietinum
atacgtatttccatgtgatccttgtccccttccgattcttcacgtaagcctacgtatcaccattttcccctacaccctaccacacctgatcacacatccccatcgtcggttacaaccatcaaaccgttatgattaaaacgtcattctcagactccatcaaacgcgcgtgagagagagcacaatcagacacactctatgttcctcactcactcttctttatctatccaaagcatcacgctaaacccaaacactattccctcgagacacagttagatagagaaacaagagagagaaagagtgtgtttgtgttagagagagaaactagagagagaaagaaaaagagtgttgaagttctgaaatggcctccatgccgttggggccgcactaccatcaaccaccgcaaccggcgcctctaccactaccgctaccaccacaagccgtgaatgagccgattaaaacgacggcggttagtggcgtctccgacatggacaccgataaggaaatgtcatctactgttgttgacagtaatgatgcagtcactggtcacataatctcaactaccattggaggcaaaaatggtgaaccaaaacggacaatcagttacatggccgaacgtgttgttggcacaggatcattcggaattgttttccaggcgaagtgcttggagactagtgaggcagtggctataaagaaggttttgcaagacaagcggtacaaaaatcgtgaactgcagttaatgcgtgtgatggatcacccaaatgtaatttccttgaagcactgtttcttctctacaacaagcagagacgaactttttctgaacttggtgatggaatatgtccctgagacgatgtaccgagttctaaagcactacaataatatcaaccagagaatgcccctaatctatgtgaaattatatacataccaaatctttaggggactagcatatatccataccgttccaggagtttgccatagggatgtgaagccccaaaatctattggttgatcctctcactcaccaagttaaactttgcgattttgggagtgctaaagttctggtcaagggtgaagcgaacatttcatacatatgttcacgatactatcgggccccagaactaatattcggtgcgacagaatatacaacgtcgattgatatctggtcagctggttgtgtccttgcagaacttcttctaggccagcccttgttcccaggagaaaatcaggtggaccaacttgtggaaattatcaaggttcttggtactccaactcgagaagaaattcgttgtatgaaccctaattattctgattttagattccctcagattaaagcccatccttggcataaggtttttcacaagcgaatgcctcctgaagcaattgaccttgcatcaaggcttcttcaatattcaccaagtcttcgttgcagcgcactggaagcatgtgcacatcctttctttgatgagcttcgagagcccaatgctcggcttcctaatggtcgtcctctgcctccgcttttcaactttaaacaggaattatctggagcctcccctgaactgatcaataaactcatcccagagcacgtcaggcggcaaacgggtcttggctttccatatcccggctagcacataaatgtaaagagataatgaaacgagtcaacccttctagtggttaatgttaaacacaggtcctttttatggtcaatagattaggattcaggccttatatatgaagttttcctccaaccccctcctaagatgtatgtatacatgtaccggctgctcaatgtaacctgaaaagtgttgattctgtctaatatttcattctagtttaagcatgcttacaccttgcatttatacattgttttctgtagatttccaaaagcttggagcagtcaaaattattgtgttgtccgcgttgttacgagtactgctaactgtagttcataaaagtgaagggtcttggtagcattttgatttgaagctatatttagccatcaatgctctacacttacatagtttctccattctgcaaatccttaaaaatcctaattcatgcacagtggaaaaagaatggaatccttaaaaatcctaatcaaggtttaacattcaagttataattcta

SEQ ID NO: 4705 - DNA, 2040 bp, Vitis vinifera
ttctttgtttttatatttatttatttatttgttagttatctttgcgtagtagagactacaaagcgagagccatggagtccaaatcacattcctagcgtggcataacaaaaaaatttagagaaacgacgtctccataatccattcagggagagagagagaaagagagagggggaaaggaaagaaaaaggagtagagggagggaggtggaagcacatgggcttgttgtggctggggcctccatttcccatacaatgagaaagtgaaagattctctctcgtcgccgccggaaaatctcatcctcatgtccgacgacaaggaaatctctgcccctgttgttgatgggaatgatcctgtcacaggtcacatcatttccaccacaattggagggaaaaatggggagcccaaacagaccatcagttacatggcagagcgtgttgtgggtaccgggtcatttggaattgtttttcaggcaaaatgcttggaaactggagagactgtggccataaagaaggttttgcaggacagaagatataagaatcgtgagctgcagttaatgcgcacgatggatcatccaaatgtcatttccctaaaacattgtttcttttctactacaagtagagatgaacttttcctcaacttggtaatggaatatgtccctgagactatgtatcgggtcttgaagcactacagcaacgcaaaacagcgaatgcctcttatatatgtgaaactttacacttaccaaattttcaggggcctggcatatatccacagtgttcctggagtttgccatagggatttgaagcctcaaaatcttctagttgatccacttactcaccaagttaagctttgtgactttggaagtgcaaaagtgctagttaaaggtgaagcaaacatatcatacatatgttctcgtttctaccgagcacctgaactcatatttggggccacagagtatacaacctcaattgatatatggtcagctggttgtgtcctagctgagcttcttctaggccagccattgtttcctggagagaatgcagtggaccagcttgttgagattatcaaggttcttggtacaccaacgcgggaagaaattcgctgtatgaatccgagttatactgattttaggtttccacagataaaagcacacccttggcacaaggtctttcacaaacgaatgcctcctgaagcaatcgatcttgcttctcgacttctgcaatactcaccaagtcttcgctgcacagctctagaagcatgtgcacatcctttctttgatgagctccgagaacccaatgcccgcctgccaaatggtcgtccattaccacctctcttcaattttaagcaggaattatctggggcttctcctgagcttgttaataagttgataccggagcatgtgaggaggcaaataggcctaagttttttccacccagcaggcacataaatttatttgtgatgttgaattgatttctgctaattgatgaatgagccaccaagggatgtgccatctgtgttctgaatcccccatgcagtgaggcctgaccagcagcatttcttgctctacaagaatttacgtaaagactccagtgggtggatggctgcaacttattgacttggatgcttctcttttatgatgtctttcctcccttatcccccaaatgctttttcttacctgtatatgtttgatagtatatatagtttgagtttgaactgatcaaaagctgttagcagaatgaaaagatgaggtgaattgtataatgcctacgagaggagggctctgaaaggaaatggccgttgcaaaggggtagtgagtttcttgttgggtttgtttacttccttgtttctacttttatcttcatggttgttttggtacaaaccgaattgtattaaagataagtggtttcaatttgtggagagaccagcctcctagcttaattttaaagaattgatgattgtgttcctctttttctttccccattgctactacccatacagaaatgagaatatgaaaagccttaaaaatactctcataagaattgg

SEQ ID NO: 4706 - DNA, 1581 bp, Avena sativa
caaggaggctgctgactcacggttcccttccctagccaagcccctcaccgaggagaggagagagaacacaagccaaggcaggagagagaaagccagagcagaagcaaggagagggagggaggagctccatttcggcgtcccgtccggtcccctcccccacatggcgacgctgccgggcggggcccaccccgccggcgcggcagctgacctgatgcaggtcgatgagccgcacgccgccgccgcggctcccgtggtcgagaagcatggagcttctattatccaagggagcgatccagtcactggtcacataatctccacaacgatcggagggaagaatggagagcctaaaaggactattagctacatggctgagcgagttgtcgggactggatcatttggaattgtcttccaggcaaaatgtctggagacaggtgagactgttgccattaagaaggttttacaggacaagcgttacaagaacagagagctgcaaataatgcgatcaatggaccattgcaatgttgtttgtttgaagcattgcttcttctctaccacaagcagagatgaacttttcctcaacttggttatggagttcgttcccgagtcgttgtatcgcgttctgaagcattatagcaatatgaaccaaagaatgccacttatatatgtcaaactgtatgtgtaccagatattccggggtttagcttacacccacagtgtgcctggagtttgccacagggatatcaagcctcagaatcttttggtggatcctttgactcacacggtcaaaatatgtgattttgggagtgccaaaatgttggttaaaggcgaggcgaacatatcgtacatatgctcacgctattaccgtgctcctgagctgatatttggtgcaaccgagtacacaacatcaattgatatttggtcagctggatgtgttcttgctgagttgcttcttggccagcctctatttcctggtgaaagtgcagtggaccaacttgttgagataattaaggttcttggtactccaacgcgtgaggaaatccgctgtatgaatcccaactacactgagtttagatttcctcagataaaagctcatccatggcacaagattttccacaaacgaatgccgccagaagcaatagacctagcgtcacgtcttcttcagtattcaccaaatctacgatgcactgctcttgaagcatgtacacatccattctttgatgaattacgagagccccatgcaaagttgccaaatggtcgcccattccctccactgttcaacttcaaacaggaagttgcaaatgcttcaccagagctcatcggcaggttgataccagaacatgctaagcgccattctgggttgaatttcttgcctttgacggggcagtagggaaggctgtacgatattatcttgttcatgccaaagggcaacctgcacgttctcacaaatttagaatctgacaaccattattggaagctgaagacgagctggtgccattacgtttgtatgagggggtcgtgtatttgtcaagccagcccctgatgtaacctttaatgctccaactccattatgaggaggcaatg

SEQ ID NO: 4707 - DNA, 1917 bp, Arabidopsis thaliana
aaaacggaaagtagtagatagataaagaaagagaaagagaagagctggattcacatggtcttgttctttctctctccttcttttctcatcttgcggcttccctttctctctctatcgccacaatgatcattaccaaccaaactgattgaaactcatttgttctctctctctcaaatccactctctctctttcttttctcttctcctctctgtgtctctatcgccatggctgatgataaggagatgcctgctgctgtagttgatggacatgatcaagtcactggtcatattatttccaccacaatcggtggcaaaaatggtgaaccaaaacagacaattagttacatggcggagcgagttgttggtacaggctcgttcgggatcgttttccaagcaaaatgtttggagactggagaaaccgtggcgataaagaaggttttgcaagatagaagatacaagaaccgagaacttcagttgatgcgtgtgatggatcatccgaatgtggtttgtttgaagcattgcttcttttcgactacaagtaaagacgagcttttcttgaacttggttatggagtatgtccctgagagcttgtatcgagttctgaaacattatagtagtgcaaaccaaagaatgcctcttgtctatgttaaactttacatgtatcagatcttccggggacttgcttacattcacaatgttgctggagtttgtcacagagatctaaagcctcaaaatcttctggttgatcctcttactcatcaagtcaaaatctgtgactttggcagtgcgaaacagctcgttaaaggtgaagccaacatttcttacatctgctcacgattctaccgtgcacccgagctcatatttggtgccactgagtacacaacttctattgatatctggtctgctggttgtgttcttgctgagcttcttcttggtcagccattatttcccggagaaaatgctgtggatcagctcgttgaaattataaaagttcttggtacaccaactcgagaagaaatccgttgtatgaatccacattacacagatttcaggtttccacagataaaggcacatccctggcacaagatcttccacaaaaggatgcccccagaagcgattgattttgcatcaaggctgcttcaatactctccaagtctaagatgcacagcgctcgaagcttgtgcacatccgttctttgatgaactcagagaaccaaacgctcgtttaccaaatggacggcctttcccgcctctcttcaacttcaaacaagaagtagctggatcatcacctgaactggtcaacaagttgattccagaccatatcaagagacaattgggtctaagcttcttgaatcaatctggaacttaaaagggatcctgcaaaagacaactacttttttatatataatgtaccattacacgagccacaaggtcgtagttgaaggcaaacgtggaggacacaattcaaagtttttcctcctcaaactcgttcagacaaagccagctgctagcaaaaccaactcccccaaatctgcgaaaacaaaaactctccagtgttgtatctgcttatttctcttctcttttcaagtttggtgaaaaacacagtctcctctttgcttcatttcttctttctttcccccttatgtaaatgagtttagtcagaagtttttttatatagtaaagtttgggcagaaggtgaagaatgtaatcaaagtgatactctttcaacgaggagcttctttcaaacactttttttttttttcaaacacttcatgaatggatacatggttttgctttaagcataagtatatttgtattaaattttcactcaatttaattgcacgaatcattacaaaaataatatctcgctactcatataaataccctataaataaataagtgaattttttttatctctc

SEQ ID NO: 4708 - DNA, 1740 bp, Fagus grandifolia
gagagagaaaagaaagtgtggaatcaatcacatggtcttgttgttgttgttgtttttctctttctctttctcattctcttcctacacactatgatcttcttcttcttcttcgttaccgactgacccaataatattcagttactttccacttcaaaggacatggctgacgataaggaaatttctggtcctgttgttgatggaaatgatccaacgggtcacatcatatccacgacgattggaggaaaaaatggagaacctaagcagaccattagttacatggcagagcgtgttgtggggactggctcatttggaattgttttccaggcaaaatgcttggaaactggtgaaactgtggctataaagaaggttttacaggacaaaagatataaaaatcgtgaactgcagttaatgcgtgtgatggatcatccaaatgtgatttctttaaagcattgtttcttttccacgactagtaaaaatgaacttttcctcaacctggttatggaatatgtcccggagaccatgtatcgggtcttgaagcattacagcaatgcaaatcagagaatgccactaatctatgtgaaactttacatgtaccagatttttagggggctggcttatgtacacactgttcctggggtttgccatagggatttgaagcctcaaaatattttggttgatcctctcactcaccaggttaagctttgtgattttggaagtgcaaaaatgctagtcaaaggtgaagctaacatatcatacatatgttcccgattctatcgggctccagaacttatatttggtgccacagaatatacaacctcaatagatatctggtcagctggttgtgtccttgctgagcttcttctggggcagccactgtttcctggagaaaatgcggtggaccagctagtagaaattatcaaggttcttggtacaccaactcgcgaagaaattcgttgtatgaatccaaattataccgattttaggtttccgcagataaaagcacacccttggcacaaggttttccacaaaagaatgcctccggaagcaattgatctggcttcacgactgctgcaatattctcctagtcttcgctgcacagctcttgaagcatgtacacaccctttctttgatgaactccgagaacccaatgctcgcctaccaaataatcgcccattgccaccgctcttcaactttaaacaagagttgtcaggggcttctccagagcttgttaacaggttgataccagagcacgtgaaacgccaaataggtctaaatttcttgcatccggcaggcacataagtgtggaaagtcatatggggatagttatcattccagttgatatgtgacacaatgaggtactatctgtgttcaaaatcacaatgcatggaggcctgaccagtatcatttcttgctctaccaggacgcatagagactcaagtggctggatagctgcacttacatgttgagttcatttctacgtttttctcccttgtccctcctccagtcattctccgtctttccaacccccctctttcttaagataccgttttgttctgtacatgtttgatagtaaaggtagctcgagatggactgatcagaaagctgctagcagaggaaaagctaggggaaagtgtatctatagctaggaagaaagccccaaatagaatggctgaaacaaaagggggcggtcttgttgttggttgttgggtatggtttacttgcatgttgttttcattagtt

SEQ ID NO: 4709 - DNA, 1804 bp, Musa acuminata
gagagagagagagagagagagagaagagagaggggcatccgttcctatctggagcgccgcccaacatgacttcgctgccgctgggacctcaccagcccccgcccccgccgggccacgacgccgccgccgcagcgaaccttaccctcgcggtccctccccgggcggagatggccgacaacaagcaaacatctgttgttggcaagagtgaacaagtaactggtcatgtcatctccaccaccatcgggggcaagaatggtgaacctaagaagaccattagctacatggcagagcgtgttgtagggactggatcgtttggaattgtctttcaggccaaatgcttggaaacaggagaagcggttgccataaagaaggttttacaggacaaaagatacaaaaatcgtgagctccaattgatgcgctcaatggatcatccaaatgtgatacctcttaagcattgtttcttctccactacaagcagagatgagcttttccttaatctggtcatggaatatgtgcctgagactctgtatggtgtcctaaggcatttcagcaatgggaatcaaaggatgccacttatctatgtgaagttgtatacatatcagatatttagagggctggcttatatccatactgttccaggagtttgtcatagagatgtgaaaccacaaaatattttggtagaccctcttactcatcaagtcaaattatgtgattttggaagtgcaaaagttctggtgaagggtgaagcaaacatatcttacatctgttctcgctattaccgtgcgccagagcttatttttggtgcaacagaatatacaacgtcaattgatatatggtcagcaggttgtgttcttgctgagttactacttggccagccgttgtttcctggagcaagtgctgttgatcagcttgtccagattatcaaggttcttggaaccccaacccgtgaagaaattcggtgcatgaatcctagctatacagagttcaggtttcctcagataaaagctcatccatggcacaagattttccacaagcgaatgcctccagaagctattgatcttacatcacgccttcttcaatactctccttgtttccgttgctctgcactggaagcatgtgcccatccattcttcgatgagctacgagaacctaatgtgcgattgccaaacggtcgccctctgcctcccctttttaactttaagcaagaattagctggagcatcaccagagctcgtcactaagctgattccagaacatgtgaggcaacgatccgttctcagcttcttgcatccagttggaacataaacagaaaacacttcccaaccattctcagaaggcagacagagccttaaaataggttttcatgcctgtgagaaagtttaggataaaacatggaagctgacgaaggtgtagcttctggactgtttggcggatcgttacccgagctttgtttcgggtgctgtacaagtgtgattactcaggatcatgctaatgtaaaatgatgattctgagctaagatcaatggctagaggcatggtgcaggttttttcttttgcagtgttgtctggctgttattttcctgctactgggctggttatcttttcttggtttctatttcatagcaccaaggaatgatagctttaaggtgaatgaattctgtagcctgttgtgtaaatgaaatacctaatccatgggtgtttggtggtgtggagctggaatttagatatccatgtattgccccagtcgatacatttcttgtacttgagactgctagaggtcttctttttttatctgcaagtggaagg

SEQ ID NO: 4710 - DNA, 1337 bp, Brassica napus
ggagatgccggctgctgtagttgatggacatgaccaagtcactggccacataatctccaccaccatcggtggtaaaaacggagaacctaaacagacaataagttacatggcggagcgagttgtcggaacaggctccttcgggatagtgttccaggcgaagtgtctggagactggagaaaccgtggcgataaagaaggtgttgcaagacaggaggtacaagaaccgggagcttcagctgatgcgtgtgatggaccatcctaatgtggtttgtttgaagcattgcttcttctcgaccacaagtaaagacgagctgttccttaatctggttatggagtatgtccctgagagtttgtaccgagttctgaaacattacagcactgctaaccagaggatgccgcttgtctacgttaaactctatatgtaccagatcttcagaggacttgcttacattcacaatgttgctggagtttgtcacagagatctaaagcctcagaatcttctggttgatcctcttactcatcaagtcaagatctgtgactttggcagtgcgaaacagcttgttaaaggtgaagctaacatctcttacatatgctcacggttctaccgtgcacctgaactcatatttggtgccacggagtacacaacttccattgatatctggtctgctggttgtgttctcgctgagcttcttcttggtcagccactattccctggagaaaatgctgtggaccagctcgttgaaatcatcaaagttcttggtacaccaactcgagaggagatacgttgtatgaatccacactacacagactttaggttcccacagataaaggcacatccttggcacaagattttccacaaaaggatgcctccagaagcaattgattttgcatcaaggctgcttcagtactctccaagtcttagatgcacagcgcttgaagcttgtgcacatccgttctttgatgagctgagagaaccaaatgctcgtttaccaaacggacggcctttcccacctctcttcaacttcaaacaagaggtagctggagcttcacctgagctggtcaacaagttgattccagaccatatcaagaggcagttgggtctaagtttcttgaatcagtctggaacttaaaaacgatcaacagacgaagaactttttatatataattgtaccattactcagagccagaagaaggttagttgaaggcaacgtggaggacacagttagaagttttgcctcctcaaaactcggtcaaaaagacaagcttctctacaacctgacttcccccaaacccgcaagaaaagctattcagttgtatcttcttcttcttcttctttgt

SEQ ID NO: 4711 - DNA, 1469 bp, Raphanus sativus
aggagatgccggctgctgtagttgatggaggacatgatcaagtcactggtcacataatctccaccactatcggtggtaaaaacggagaacctaaacagacgataagttacatggcggagcgagttgtcggcacaggctccttcgggatagttttccaagccaaatgtttggagacgggagaaaccgtggctatcaagaaagtattgcaagacaggagatacaagaaccgagagcttcagctgatgcgcgtgatggaccatcccaacgtggttcgtttgaagcattgcttcttctcgaccacgagcaaagacgagcttttcctcaatcttgttatggagtatgtccccgagagcttgtaccgtgttctgaaacattacagcaccgcaaaccagaggatgcctcttgtctacgttaaactctacatgtaccagatcttccggggacttgcctacattcacaatgttgctggagtttgccatagagatcttaagcctcaaaatcttctggttgatcctcttacacatcaagtcaagatctgtgactttggcagtgctaaacagctcgttaaaggtgaagccaacatatcttacatatgctcaagattttaccgtgcacctgaactcatatttggtgccaccgagtacacaacttccattgatatctggtctgctggttgtgtccttgctgagcttcttcttggtcagccattattccctggagagaatgctgttgatcagctcgttgaaatcatcaaagttcttggtacaccaactcgagaagagatccgttgtatgaatccacactacacagactttaggttcccacagataaaagcacatccttggcacaagattttccacaaaagaatgcctccagaagcgattgattttgcatcgaggctgcttcagtactctcctagtcttagatgcactgcgcttgaagcttgtgcacatcctttctttgatgaactgagagaaccaaatgctcgtttaccaaatggacggcctttcccgcctctcttcaacttcaagcaagaggtagctggagcatcacctgagctggtcaacaagttgattccagaccatattaagagacaattgggtctaagtttcttgagtcagtctggaacttgaaaaggaacaatagagaagaagtttttatatatgaatgaatgtaccatttactcagagccagaaggtagttgaaggcaaagtggaggaaacaattcgaagttttgatggtgaaaagaaaagcttgtacagccttgacttccccaaatctgcaagaaaagccaactccgttgtatcttcttcattatcctattatgcttcattctttctgcgcctgtaaatgagtttagttcagagttttcttatatagtaaagtttgagcagaaggtgaaaagaatcttagtctaagagatccaaagtcttaccagaagaggaaggctttctctgttttttgtttct

SEQ ID NO: 4712 - DNA, 1773 bp, Eutrema parvulum
ttctcagacaagcattatgcttttgcttttgatgatggtttttaaagtggaatcagtggttacttgcgttattgctgaccttaaaagcttgtctcttacaggagatgccagctgctgtagttgatggacatgatcaagtcactggtcacataatctccaccacaatcggaggaaaaaatggagaaccaaaacagactattagttacatggcggagcgagttgtcggtacaggctcgttcggaatagtattccaggcaaagtgtttggagactggagaaactgtggcgattaagaaggttttgcaagacaggagatacaagaaccgagaacttcagttaatgcgtgtgatggatcatccgaatgtggtttgtttgaagcattgcttcttttcaaccacaagcaaagacgagcttttcctcaatttggttatggagtatgtccctgagagcttgtatcgagttctgaaacattatagcagtgcaaaccaaagaatgccgcttgtctatgttaaactctatatgtaccagatcttccgcggacttgcctacattcacaatgttgctggagtttgtcacagagatctaaagcctcaaaatcttctggttgatcctcttactcatcaagtcaagatctgtgactttggcagtgcgaaacagcttgttaaaggtgaagccaacatttcttacatatgttcacgattttaccgtgcacccgaactcatatttggtgccacggagtacacaacttccattgatatctggtctgctggttgtgttcttgctgagcttcttcttggccagccattatttcctggagaaaatgctgtggatcagctcgttgaaattataaaagttcttggtacaccaactcgagaagaaatccgttgtatgaatccacattacacagattttaggtttccgcagataaaggcacatccttggcacaagattttccacaaaaggatgcctccagaagcgattgattttgcctcgaggcttcttcaatactcaccaagtcttagatgcacagcgctcgaagcttgtgcacatccgttctttgatgaactcagagaaccaaatgcacgtttaccaaatggacggcctttcccgcctctcttcaacttcaaacaagaggtagctgcagcatcaccagagctggtcaacaagttgattccagaccatatcaagagacagttgggtctcagtttcttgaatcaatccggaacataaaggatcaaaaagacaagaactttatatatataatgtaccattactcgagccagaaggtagttgaagacaatttggaggacacaattcgaagtttaccctcctcaaactcgttccagaagtgttctattcagacaagtttgatggtcaaagccaagcttctacaaccgacttccccaaatctgcaagaaaatctattccgttgtatcttcttcttttttccttttttatgtttggtaaaaaacacaaatctcctctttgcttattttcttctgtcttttctgcatctgtaaatgagtttagtcagagatttttatatagtaaagtttgagcagaaggtgaagaatctagtcaaagcgatacaatcggtctaccccgaagaggaaggctggagtttctgcagtttaaggggggttgctttgtttttttttcctccttttgaatgtttgtcttcttctattttgttgttattgccaaattttatgagatggtttgtttatcactctcttctcttccttataaagtcaaatctcaagattttttttgt

SEQ ID NO: 4713 - DNA, 1909 bp, Lotus japonicus
aagaaagaaagcagagagagaaagaaacggagagagaaacgaagaagagtgcttgtgcaggttctcacacatcacatggcctccgtgcccttggggcaccaccactaccaggcgccaccaccggccgcgcctccgcaaccgtcacaaccgctgcagtttcaggctcaagctgaagtgcctcgccggagctccgatatggagactgataaggcaatgtcaactactgtcattgaagggaatgatgcagtcactggccacattatctccaccacaattggaggcaaaaatggtgaacctaaacagaccattagttatatggcagagcgtgttgttggcactggatcttttggagttgttttccaggcaaagtgcttggagactggagaggcagtagcaataaaaaaggtcttgcaagataggcggtacaaaaatcgtgagctccaattaatgcgcttgatggatcacccaaatgtaatttccttgaagcattgtttcttctccacaacaagcagagatgaactttttttgaacttggtaatggattatgtccctgagacattgtaccgagttctaaagcactacaattctatgaatcagagaatgcctctcatctatgtgaaattatatacatatcaaatctttcggggattagcatatatccataccgtgccaggagtttcccatagggatgtgaaacctcagaatcttttggttcatcctcttactcatcaagttaagctttgtgatttcgggagtgccaaagttctggtcaagggtgaatcaaacatcgcatacatctgttcacgttactatcgggctccagaactaatatttggtgcaacagaatacacaacttctatcgatatctggtcagctggttgtgtccttgccgaacttcttctaggccagccattatttccaggagaaaatcaggttgaccaacttgtggaaattattaaggttcttggtactccaactcgagaagaaattcgctgcatgaacccgaattatacagattttagattccctcagattaaagctcatccttggcacaaggttttccacaagcgaatgcctcctgaagcaattgaccttgcatcaaggcttctacaatattcacctagtcttcgctgcactgcgctggaagcattgacacatcctttctttgatgagcttcgtgagccaaatgcccgactgccaaatggccgcccattgcccccactttttgactttaaacaggaattagctggagcatcatctgagctggtaaataggctcatcccagagcacattaggcggcaggctggtatcggcttccctcatccggccggtacatagatgtaaagagatggaacattaagtcaacatatttagtgatcaacgtgaagcaatgaacgggctgtttatggtcactagaaccgggggtggttccggtcttatctccagtttttcctacccctgtgaagatgtacgtatacatgtgctggctgctcggcatgacaaggaaattggtggttgtctaatatttcattctagttaaagcatacttatccctgcatctgtacatggttttggtcagattttaaaaaagctaggagtataaattgataggaatcatgtctgtctacataggtagaggaccccaccaaaattgaggggccccaatagtagtttggcttgctctttacatgatcatattatatgcagttgttctaatgggcttatgacaatatctattcaataccagttatttttcctcattatttaatcctctagtgaccccaacactaccattttacaaagtttctgattgtcactgctttaggctagatccatgagtgtggacaaagtaatcaatccaaaagttgatcacggaattttaaaataatgaattatttctttcgttctg

SEQ ID NO: 4714 - DNA, 2324 bp, Saccharum officinarum
cgaaaccgggtcccatcccaagcctagggtttggtctgcccgtcgggcgcgagcccccggccgccgctacgcttttgcctccatcgcccactcctcttcggagcctctctttcggcggcggcgcaagaagagatggcggagcggctgacccgtatcgccatcgtcagcgaggacaagtgcaagcccaagaagtgccgccaggagtgcaagaagagctgccccgtcgtcaagaccgggaagctttgcattgaagtgactccggcgtcgaaactcgctttcatttccgaagagctgtgcataggttgtggtatctgtgtaaagaaatgcccatttgatgccattgaaatcatcaaccttccaaaggacttggaaaaggataccactcatcgatatgggcctaataccttcaagttgcacaggttgcctgtcccgaggcctggtcaggttttgggccttgttggaacaaacggaattggaaagtcgacagctcttaaagtgttggctggcaagctgaaacctaacttggggcgcttcaaaaacccgcctgattggcaggaaattcttacatacttccgtgggtctgaacttcagaactacttcacacgcatattggaagataacctgaaggcaatcatcaaacctcagtatgttgaccacatcccaaaagctgttcaagggaatgtaggacaagtacttgaacagaaggacgagagggatatgaaagctgaactgtgtgttgatcttgaattaaaccaagttattgaccgaaatgtaggagatctttctggtggtgagctccagagatttgcaatagcagttgttgctgtgcaaaatgcggaaatctacatgttcgatgagccatcaagttaccttgatgtgaagcagaggctgaaagctgcacaagtcattaggtccttgcttaggcccaacagctatgtcatcgttgtggaacatgacttgagtgtcttggattacttgtccgacttcatttgctgtttatatggcaagccaggtgcttatggtgtggttaccttgccattctcagtccgagagggtatcaatattttcttggctggatttgttccaacagaaaatcttcggttccgagacgaatctcttacatttaagattgcagagactcaagaaagtgctgaggagattgagacgtatcagcggtataagtaccctactatgagcaaaacacagggaaatttcaagcttactgttgttgagggtgaatttactgattcccagattgtggttatgcttggtgaaaacgggacagggaaaactacattcattagaatgctggctgggttgttgaagccagacacagtggaaggaactgatattgaaattcctgaattcaatgtgtcttacaagccccaaaagattagcccgaaattccagaataccgtgaggcatttgctgcatcagaaaattcgggattcctatatgcaccctcagtttgtgtctgatgtaatgaaaccactgcaaattgaacaacttatggaccaggaggttgttaatttatcaggtggagaactccaaagagttgctatatgcctctgccttggaaagcctgcagatatctatctgattgatgaaccaagtgcatatcttgattcggagcagcgtattgttgcctcaaaggttatcaagagattcattcttcacgcaaagaaaactgcatttattgttgagcatgatttcatcatggcaacatacttggctgacaaggtcattgtttatgaggggcgaccttctattgactgtactgccaatgcaccacagtctttagtatctgggatgaataaattcttatcgcatcttgacattacttttagaagagaccctaccaactataggccacgtataaacaagttggactctacaaaggacagggaacagaagtcagccgggtcctactactacctcgatgactaatgaggaagtacagaatcttcttgaagagctatatggcgcataatctttccagggcgtggaaatgagaagctactttgaagctaccactacatcatggcatgagacttgttaaataattggttgcagtagtgtgcgccggttataacttataaagcagagcatgctgtgttgatactgagtttttgttggcttgacctatatgaggagaaggatcggtgttaaaatgggctttgggagggaagaaagagtttctgtttttaagcaatactgtactgtcgatttgcccttgagtatatttgatcctcaattttatagatcacattaaagttttgagcaacaatgtgaaatcttatgataaattgctgtgattgttggtt

SEQ ID NO: 4715 - DNA, 2357 bp, Setaria italica
gcgcacgtgtccgccacactcccaaagggataccccctccctctctcccaccgccgccgctcgctttcggctccatcatcacccctcttcctcctcggagccctcctcccggcggcggcggaagaagaaagagatggcggagcggctgacccgtatcgcgatcgtcagcgaggacaagtgcaagcccaagaagtgccgtcaggagtgcaagaagagctgccccgtcgtcaagaccgggaagctttgcattgaggtgacttcggcgtcgaaacttgctttcatttctgaagagctgtgcattggttgtggtatttgcgttaagaaatgcccatttgatgccattgaaatcatcaaccttccaaaggatttggaaaaggataccactcaccgatatgggcccaataccttcaagttgcacaggttgcctgtcccgaggcctggtcaagttttgggccttgttggaacaaatggaattggaaagtcgactgcgcttaaagttttggctggcaagctgaaacctaatttgggacgcttcaaaaacccacctgattggcaggaaatccttacatacttccgtgggtctgaacttcagaactacttcacacgcatattggaagataacctgaaggcaatcatcaaacctcagtatgtcgaccacattccaaaagctgttcaaggaaatgtaggacaagtacttgaacagaaggatgagagggatatgaaagctgagctgtgtgttgaccttgaattaaaccaagttattgaccgaaatgtaggggatctgtctggtggtgagctccagagatttgcaatagcagttgttgctgtacaaaatgcggaaatttacatgtttgatgagccatcaagttaccttgatgttaagcagaggcttaaagctgcacaagtcattagatctttgcttaggcccaacagctatgtcatcgttgttgaacacgacttgagtgtcttggattacttgtccgacttcatttgctgcttatatggaaagccaggtgcttatggtgtggttaccttgccattctcggttcgagaaggcatcaatattttcttggctggatttgttccaacagagaatcttcggttccgagatgagtctcttacatttaagattgcagagactcaagaaagtgctgaggagattgagacatatcaacgatacaagtaccctaccatgagcaaaacacagggaaatttcaagctaactgttgttgagggtgaatttactgattcccagattgttgtgatgcttggtgaaaatggtacagggaaaactacattcatcagaatgctggctgggttgttgaagcccgacacagtggaaggaactgacattgaaattcctgaattcaatgtgtcgtacaagccccaaaagattagcccgaaattccagaataccgtgaggcatttgcttcatcagaaaatacgcgattcttatatgcaccctcagtttgtgtctgatgtcatgaaaccactacaaattgagcaactcatggaccaggaggttattaatttgtcaggtggagagctccaaagagttgctatatgcctctgccttggaaagcctgcagatatctatttgattgatgagccaagtgcgtatcttgattcagagcagcgtattgttgcctcaaaggttatcaaaagattcattcttcatgcgaagaaaactgcatttattgttgagcacgatttcatcatggcaacctacttggctgacaaggtcattgtttatgaggggagaccttctattgactgtatcgccaatgcaccacagtctttggtatctggaatgaataagttcttatcgcatcttgacattacctttagaagagacccgaccaactacaggccccgtataaacaagctggactccacgaaggacagggagcagaagtcggctggatcctactactacctcgatgactaatcagcacgtacaggatcttctcggagagctttccgctcatgatctttccaggccgtggaaaagcttaggctaggttgaagctgccaccacatcacggcatgagacttgttgaataattggctgcaaggagtaaagcgcaccgattaacttataaagcagagcatgctgtgttgatagtttgataccgagttttttgttggctcgatctatctattatgacaaaggaagatgagatcggtgttaaagtcgggcttctccagtggagaattatggctagtttctgtttatttgttactctgtaccttcgagtccatttgccgtcgagtaacttccatccttgattttagagatgacactaaagttttcgagcaacaatgtgaaagaaaatcttatccgtcttcgatgagcc

SEQ ID NO: 4716 - DNA, 2290 bp, Zea mays
gggtttcgtctgtctcccgacgccgccgctaggctttgcgcctttgcctgcatcactcgctcattcggagcccctctcttcgccggcgtcgtaagaagagatggcagagcgtttgacccgtatcgccatagttagcgaggacaagtgcaagcccaagaagtgccgccaggagtgcaagaagagctgccccgtcgtcaagactgggaagctttgcattgaagtgacttcggcgtcgaaactcgctttcatttctgaggaactgtgcatcggttgtggtatctgtgtaaagaaatgcccatttgatgccattgaaatcatcaaccttccaaaagacttggaaaaggataccactcaccggtatgggcctaataccttcaagctgcacaggttgcctgtcccgagacctggtcaggttttgggccttgttggaacaaatggaattggaaagtcgacagctcttaaagtgttggctggcaagctgaaacctaacttggggcgcttcaaaaacccgcctgattggcaggaaattcttacatacttccgtgggtctgaacttcagaactacttcacacgcatattggaagataacttgaaggcaatcatcaaaccgcagtatgttgaccacatcccaaaggctgttcaagggaatgtaggacaagtgcttgaacagaaggacgagagggatatgaaagctgaactgtgtgttgatcttgaattaaaccaagttattgaccgaaatgtaggagatctttctggcggtgagctccagagatttgcaatagcagttgttgcagtgcaaaatgcggaaatctacatgttcgatgagccatcaagttaccttgatgtgaagcagaggctgaaagctgcacaagtcatcaggtccttgcttaggcccaacagctatgtcatcgttgtggaacatgacttgagtgtcttggattacttgtccgacttcatttgttgtttatatggcaagccaggtgcttatggtgtggttaccttgccattctcggtccgagagggtatcaatattttcttggctggatttgttccaacagaaaatcttcggttccgagacgaatctcttacatttaagattgcagagactcaagaaagtgctgaggagattgagacatatcagcggtataagtaccctactatgagcaaaacacaggggaatttcaagcttactgttgttgagggtgaatttaccgattctcagattgttgttatgcttggtgaaaacgggacagggaaaactaccttcattagaatgctggctgggttgttgaagccagacacagtggaaggaactgatattgaaattcctgaattcaatgtgtcttacaagccccaaaagattagcccgaaattcaagaacaccgtgaggcatttgctacaccagaaaattcgggattcctatatgcaccctcagtttgtgtctgatgtaatgaagccactgcaaattgaacaactcatggaccaggaggttgttaatttatctggtggagagctccaaagagttgctatatgcctctgccttggaaagcctgcagatatctatctgattgatgaaccaagtgcttatcttgattcggagcagcgtattgtggcctcaaaggttatcaagagattcattcttcacgctaagaaaactgcatttattgttgagcatgatttcatcatggcaacatacttggctgacaaggtcattgtttatgaggggcgaccttctattgactgttctgccaatgcaccacagtctttagtatccgggatgaataaattcttatcgcatcttgacattacttttagaagagacccgaccaactataggccacgtataaacaagttggactctacaaaggacagggaacagaagtcggccgggtcctactactacctcgatgactaatgaggaagcacagattcttcttggagagccatatggcgcatagtctttcgagggcgcggagagtgcggaaacgagaagctactatgaagctaccacactacatggcatgagacttggttgcaggagtagagtgcgccggttataacttataaagcagagcatgctgtgttgatactggttttttttccctttttggcttgacctatatgaagaaaaggatcggcgttaaaatggtattgtgaagggagaggtttttaagcaaaatgttgtaccgtcgttttgccatcgagtatatttgaccctcgattatatagatcacattaaatttttggagcaacaatatgaaatctcgtgacaagtcgttgtgctttttgg

SEQ ID NO: 4717 - DNA, 2341 bp, Zea mays
aaggacccgagcctagggttcggtctgcctcccacagccgccgctacgctttggctgcatcactcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgggaagctttgcattgaagtaacttcggcatcaaaactagctttcatttctgaggagctgtgcatcggttgtggtatctgtgtaaagaaatgtccatttgatgccattgaaatcatcaaccttccaaaagacttggaaaaggataccactcaccgatatgggcctaataccttcaagttgcacaggttgcctgtcccaaggcctggtcaggttttgggccttgttggaacaaacgggattggaaagtcgacagctcttaaagtgttggctggcaagctgaaacctaacttggggcgcttcaaaaacccacctgattggcaggaaattcttacatactttcgtgggtctgaacttcagaactacttcacacgcatattggaagataacctgaaggcaatcatcaaacctcagtatgttgaccacattccaaaagctgttcaagggaatgtaggacaagtacttgaacagaaggacgagagggatatgaaatctgaactgtgtgttgatcttgaattaaaccaagttattgaccgaaatgtaggagatctttctggtggtgagcttcagagatttgcaatagcagttgttgctgtgcaaaatgcagaaatctatatgttcgatgagccatcaagctaccttgatgtgaagcagaggctaaaagctgcacaagtcgttaggtccttgcttaggcctaacagctatgtcatcgttgtggaacatgatttgagtgtcttggattacttgtccgacttcatttgctgtttatatggcaagccaggtgcttatggtgtggttaccttgccattctctgtccgagagggtatcaatattttcttggctggatttgttccaacagaaaatcttcggttccgagatgaatctcttacatttaagattgcagagactcaagaaaatgctgaggagattgagacgtatcagcggtataagtaccctactatgagcaaaacacagggaaatttcaagcttactgttgttgagggtgaatttactgattcccagattgttgttatgcttggtgaaaacgggacagggaaaactacattcatcagaatgctggctgggttgttgaagccagacacggtggaaggaactgatattgaaattcctgaattcaatgtgtcgtacaagccccaaaagattagcccgaaattccagaataccgtgaggcatttgctgcatcagaaaattcgggattcctatatgcatccgcagtttgtgtctgatgtgatgaaaccactgcaaattgaacaactcatggaccaagaggttgttaatttatcaggtggagagctccaaagagttgctatatgcctctgccttggaaagcctgcagatatctatctgattgatgaaccaagtgcttatcttgattcggagcagcgtattgttgcctcaaaagttatcaagagattcattcttcacgcgaagaaaactgcatttattgttgagcatgatttcatcatggcaacatacttggctgacaaggtcattgtttatgaggggcgaccttctattgactgtactgccaacgcaccacagtctttagtatctgggatgaataaattcttatcgcatctcgacatcacttttagaagagacccaaccaactataggccacgtataaacaagttggaatcgacaaaggacagggaacagaagtcagccgggtcctactactacctcgatgactaatgaggaagtgcagattcttcttggagagccatatgtcgcataatctttccagagcgtggaaaggagaagctactttgaagctaccactgcatcatggcatgtgacttgttgaataattggttgcaggagtagagtgcgccggttataacttataaagcagagcatgccgtgttgatactgagttttttgttggcttgacctatatgaagagaaggatcggtgttaaaatgagatttgcgagggggaactaatttctgtttttaagcaatactgtactgtcgttttgctatcaagtatatttgaccctcgattatatagattacattgaagtttttgggcaacaatgtgaaatcttgtgataaatctctgtgcttattggttatctgattgtaactcgtcctttgtaaactttgtttga

SEQ ID NO: 4718 - DNA, 2241 bp, Echinochloa colona
tcccaccgccgccgctctacgctttcggctccatcacccctttctcctctcggcggcggcggaaggcgagatggcggatcggctgacccgtatcgccatcgtcagcgaggacaagtgcaagcccaagaagtgccgccaggagtgcaagaagagctgccccgtcgtcaagaccgggaagctttgcattgaggtgacttcggcgtcgaaggttgctttcatttctgaggagctgtgcatcggttgtggtatttgtgttaagaaatgcccatttgatgccatcgacatcatcaaccttccaaaagatttggaaaaggataccactcaccgatatgggcccaataccttcaagttgcacaggttgcctgtcccaaggcctggtcaggttcttggccttgttggaacaaatggaattggaaagtcaacagcgcttaaagttttggctggcaagctgaaacctaacttgggacgcttcaaaaacccacctgattggcaggaaatccttacatacttccgtgggtctgaacttcagaactacttcacacgcatattggaagataacctgaaggcaatcattaaacctcagtatgttgaccacattccaaaagctgttcaaggaaatgttgggcaagtacttgaacagaaggatgagagggatatgaaagctgagctgtgtgttgaccttgaattaaaccaagttattgatcgaaacgtaggagatctttctggtggtgagctccagagatttgcaatagcagttgttgctgtacaaaatgcggaaatttacatgtttgatgagccgtctagttaccttgatgttaagcagaggcttaaagctgcacaagtcgttaggtccttgcttaggcccaacagctatgtcatcgttgttgaacacgacttgagtgtattggattacttgtccgacttcatttgctgcttatatggaaagccaggtgcttatggtgtggttaccttgccattctcggttcgagaaggcatcaatattttcttggctggatttgttccaacagaaaatcttcggttccgagatgaatctcttacatttaagattgcagagactcaagaaagtgctgaggagattgagacatatcaacggtacaagtaccctaccatgagcaaaacacagggaaatttcaagctcactgttgttgagggtgaatttactgattcccagattgttgtgatgcttggtgaaaatggtacggggaaaactacattcatcagaatgctggctgggttgttgaagcctgacacggtggaaggaactgatattgaaattcctgaattcaatgtatcgtacaagccccagaagattagtccaaaattccagcataccgtgaggcatttgcttcatcagaaaatacgtgattcatatatgcaccctcagtttgtgtctgatgtcatgaagccactccaaattgagcaactcatggaccaggaggttattaatttatcaggtggagagctccaaagagttgctatatgcctctgccttggaaagcctgcagatatctatttgattgatgaaccgagtgcgtatcttgattcagagcagcgtattgttgcctcaaaggttatcaaaagattcattcttcacgcgaagaaaactgcatttattgttgagcacgatttcatcatggcaacgtacttagctgacaaggtcattgtttatgaggggcgaccttctattgactgtactgccaatgcaccacagtctttggtgtctgggatgaataagttcctgtcgcatcttgacattaccttcagaagagaccccacgaactatagaccacgcataaacaagctggactctacgaaggacagggagcagaagttggcgggatcctattactaccttgacgactaatgagctcgaacagaatcttcttggagagctttccgcgcatgatcttcccaagccgtggaaatgcgaggctagattgaagctgccactacatcatggcatgaaacttgttgaataatttgctgccaggagtacagcgcaccggttaaaagtataaaagcagagagcatgctgtgttgatagtttgatactgagttttttgttggcttgatctatctgtatgacaaaggaagatgagatcggtgttaaagtgggctttgcgaggggagaattatggttagtttctgtttatttgctatgctggaccgtcgatttgccatcgaataactttaatcctcgattttatatatagacgacat

SEQ ID NO: 4719 - DNA, 2191 bp, Echinochloa colona
ggcggaagacgagatggcggatcggctgacccgtatcgccatcgtcagcgaggacaagtgcaagcccaagaagtgccgccaggagtgcaagaagagctgccccgtcgtcaagaccgggaagctttgcattgaggtgacttcggcgtcgaaggttgctttcatttctgaggagctgtgcatcggttgtggtatttgtgttaagaaatgcccatttgatgccatcgacatcatcaaccttccaaaagatttggaaaaggataccactcaccgatatgggcccaataccttcaagttgcacaggttgcctgtcccaaggcctggtcaggttcttggccttgttggaacaaatggaattggaaagtcaacagcgcttaaagttttggctggcaagctgaaacctaatttgggacgtttcaaaaacccacctgattggcaggaaatccttacatacttccgtgggtctgaacttcagaactacttcacacgcatattggaagataacctgaaggcaatcataaaacctcagtatgttgaccacattccaaaagctgttcaaggaaatgttgggcaagtacttgaacagaaggatgagagggatatgaaagctgagctgtgtgttgaccttgaattaaaccaagttattgaccgaaacgtaggagatctttctggtggtgagctccagagatttgcaatagcagttgttgctgtacaaaatgcggaaatttacatgtttgatgagccgtctagttaccttgatgttaagcagaggcttaaagctgcacaagtcattaggtccttgcttaggcccaacagctatgtcatcgttgttgaacacgacttgagtgtattggattacttgtccgacttcatttgctgcttatatggaaagccaggtgcttatggtgtggttaccttgccattctcggttcgagaaggcatcaatattttcttggctggatttgttccaacagaaaatcttcggttccgagatgaatctcttacatttaagattgcagagactcaagaaagtgctgaggagattgagacatatcaacggtacaagtaccctaccatgagcaaaacacagggaaatttcaagctatctgttgttgagggtgaatttactgattcccagattgttgtgatgcttggtgaaaatggtacggggaaaactacattcatcagaatgctggctgggttgttgaagcctgacacggtggaaggaactgatattgaaattcctgaattcaatgtgtcgtacaagccccagaagattagtccaaaattccagcataccgtgaggcatttgcttcatcagaaaatacgcgattcatatatgcaccctcagtttgtgtctgatgtcatgaagccactccaaattgagcaactcatggaccaggaggttattaatttatcaggtggagagctccaaagagttgctatatgcctctgccttggaaagcctgcagatatctatttgattgatgaaccgagtgcgtatcttgattcagagcagcgtattgttgcctcaaaggttatcaaaagattcattcttcacgcgaagaaaactgcatttattgttgagcacgatttcatcatggcaacttacttagctgacaaggtcattgtttatgaggggcgaccttccattgactgtactgccaatgcaccacagtctttggtgtctgggatgaataagttcctgtcgcatcttgacattactttcagaagagaccccaccaactatagaccacgcataaacaagctggagtctacgaaggacagggagcagaagttggcgggatcctattactacctcgacgactaatgagtgcgaacagaatcttcttggacagctttccgcgcatgatctcttcccaggctgtggaaatgcgaggctagtttgaagctgccactaccatcatggcatgagacttgttgaataattggttgccaggagtaaagtgcaccagttaaacgtataaagcagagagcatgctgtgttgatagtttgatactgagttttttgttggcttgatctatctgtatgacaaaggaagatgagatcggtgttaaagtgggctttgcgaggggagaattatggttagtttctgtttatttgctatgctggaccgtcgatttgccatcgaataactttaatcctcgattttatatatagacgacattaaag

SEQ ID NO: 4720 - DNA, 2384 bp, Oryza sativa
accccctccctcccttctcttcctctcctcctcaccgcagctatcggggagcgccgccgccgccgccaccgccgccaccgctaggctttccttccccttcccccaccagaagcttctcgccggagaaggaaaggaggaggagagatggcggagcggctgacgcgtatcgcgatcgtcagcgaggacaagtgcaagcccaagaagtgccgccaggagtgcaagaagagctgccccgtcgtcaagaccgggaagctttgcatcgaagtaactccggcgtcgaagcttgcgttcatttctgaagagctgtgtattggttgtggtatttgcgttaagaaatgcccgtttgatgccattgagattatcaaccttcctaaggatttggaaaaagatactactcatcgctatggtccaaacaccttcaaattgcacaggttgcccgttccaagacctggtcaagttttaggccttgttgggacaaatggaattggaaagtcgacagcactcaaagtgttagctggcaagctcaagcctaatttgggacgatttaaaaatccaccagactggcaggaaattctgacatacttccgtgggtctgaactccaaaactattttacacgcatattggaggataaccttaaggcaatcatcaagcctcagtatgtggatcacattccaaaagctgtccagggaaatgttgggcaagtacttgaccagaaagacgagagaggcgtgaaagctgagctttgtgtcgaccttgaattgaaccaagttattgatcgaaatgtaggagatctttctggtggtgagctccagagatttgcgatagcagttgttgctgtgcagaatgcggaaattttcatgtttgatgagccatcaagttaccttgatgttaagcagaggcttaaggctgcacaagtcgttcggtctttgcttagacccaacagctatgtgattgttgtggagcatgatttgagtgtcctggattacttgtccgactttatttgctgcttgtatgggaagccaggtgcttatggtgtagttactttgccgttttcggtccgagaaggtatcaatattttcttggccggatttgttccaacagaaaatctacggtttcgagatgaatctcttacttttaagattgcggagactcaggaaagtgctgaggagattgagacataccagcgatataagtaccctactatgagtaaaacacagggcaatttcaagctcactgttgttgagggtgagttcactgattcacagattgttgtgatgcttggtgagaatgggacagggaaaactacattcatcagaatgctggctgggttgttgaagccagacactgtggaaggaactgagattgaaattcctgaatttaatgtgtcctacaagcctcagaagattagcccgaaattccagcattctgtgaggcacttgcttcatcagaaaatacgggattcatatactcatcctcagtttgtgtctgatgtcatgaagccactgcaaatagagcaactcatggaccaggaagttatcaatttatcaggtggtgagctacaaagggtggcaatatgcctttgccttggaaagcctgcagatatctatctgattgatgaaccaagtgcctatcttgattcggagcagcgcattgttgcttcgaaggttatcaaaagattcatccttcatgcaaagaaaactgcatttattgtggagcatgatttcatcatggctacctacttagctgacaaggtcattgtttatgaggggcggccttctatcgactgtactgccaatgcaccacagtctttggtatctgggatgaataagttcttatcgcatcttgacattacttttagaagagacccaaccaactataggccaagaataaacaaactggactccacaaaagacagggaacaaaagtctgcaggatcctactactaccttgatgactaatttgaaggcgtacagaatcttcttgtggagcttcccgcccataatttgcccaggccttcgatgtcctacgcattacttgttcagaaggttactttgaagctaccacagcttgaagcatgctaaataacttggctgcaggagtgaagtggtatcatcatcagttataaggctgagcatgtgatgctgacacttgagttcttttgctggtttgatatatatgatgatgggaaagagagatgttactgttaaactgagcaactttgtcaggatcggaagattgtgaatttttgtgtatttttgcattattgtatcgtggatttaccaactggcacccttaaatcgttggttttataggcataaagtttttgagctgttactcatgttaccaatgttatcaaagttctctgagttattactgttaattc

SEQ ID NO: 4721 - DNA, 2418 bp, Oryza sativa
ctcccaaagccaaaggagataccccctccctcccttctcttcctctcctcctcaccgcagctatcggggagcgccgccgccgccgccaccgccgccaccgctaggctttccttccccttcccccaccagaagcttctcgccggagaaggaaaggaggaggagagatggcggagcggctgacgcgtatcgcgatcgtcagcgaggacaagtgcaagcccaagaagtgccgccaggagtgcaagaagagctgccccgtcgtcaagaccgggaagctttgcatcgaagtaactccggcgtcgaagcttgcgttcatttctgaagagctgtgtattggttgtggtatttgcgttaagaaatgcccgtttgatgccattgagattatcaaccttcctaaggatttggaaaaagatactactcatcgctatggtccaaacaccttcaaattgcacaggttgcccgttccaagacctggtcaagttttaggccttgttgggacaaatggaattggaaagtcgacagcactcaaagtgttagctggcaagctcaagcctaatttgggacgatttaaaaatccaccagactggcaggaaattctgacttacttccgtgggtctgaactccaaaactattttacacgcatattggaggataaccttaaggcaatcatcaagcctcagtatgtggatcacattccaaaagctgtccagggaaatgttgggcaagtacttgaccagaaagacgagagaggcgtgaaagctgagctttgtgtcgaccttgaattgaaccaagttattgatcgaaatgtaggagatctttctggtggtgagctccagagatttgcgatagcagttgttgctgtgcagaatgcggaaattttcatgtttgatgagccatcaagttaccttgatgttaagcagaggcttaaggctgcacaagtcgttcggtctttgcttagacccaacagctatgtgattgttgtggagcatgatttgagtgtcctggattacttgtccgactttatttgctgcttgtatgggaagccaggtgcttatggtgtagttactttgccgttttcggtccgagaaggtatcaatattttcttggccggatttgttccaacagaaaatctacggtttcgagatgaatctcttacttttaagattgcggagactcaggaaagtgctgaggagattgagacataccagcgatataagtaccctactatgagtaaaacacagggcaatttcaagctcactgttgttgagggtgagttcactgattcacagattgttgtgatgcttggtgagaatgggacagggaaaactacattcatcagaatgctggctgggttgttgaagccagacactgtggaaggaactgagattgaaattcctgaatttaatgtgtcctacaagcctcagaagattagcccgaaattccagcattctgtgaggcacttgcttcatcagaaaatacgggattcatatactcatcctcagtttgtgtctgatgtcatgaagccactgcaaatagagcaactcatggaccaggaagttatcaatttatcaggtggtgagctacaaagggtggcaatatgcctttgccttggaaagcctgcagatatctatctgattgatgaaccaagtgcctatcttgattcggagcagcgcattgttgcttcgaaggttatcaaaagattcatccttcatgcaaagaaaactgcatttattgtggagcatgatttcatcatggctacctacttagctgacaaggtcattgtttatgaggggcggccttctatcgactgtactgccaatgcaccacagtctttggtatctgggatgaataagttcttatcgcatcttgacattacttttagaagagacccaaccaactataggccaagaataaacaaactggactccacaaaagacagggaacaaaagtctgcaggatcctactactaccttgatgactaatttgaaggcgtacagaatcttcttgtggagcttcccgcccataatttgcccaggccttcgatgtcctacgcattacttattcagaaggttactttgaagcttccacagcttgaagcatgctaaataacttggctgcaggagtgaagtggtatcatcatcagttataaggctgagcatgtgatgctgacacttgagttcttttgctggtttgatatatatgatgatgggaaagagagatgttactgttaaactgagcaactttgtcaggatcggaagattgtgaatttttgtgtatttttgcattattgtatcgtggatttaccaactggcacccttaaatcgttggttttataggcataaagtttttgagctgttactcatgttaccaatgttatcaaagttctctgagttattactgttaattcactttatcgagata

SEQ ID NO: 4722 - DNA, 2324 bp, Brachypodium distachyon
cccaaagccaaaagccagccaaagcgataccctccttctcctcctcaccgcagctctagcgccgccgccagggctctacgctttcccccacatcggagaccccttcgcggcggcggcggctaagtgagtcgccgcagatggcggaccggctgacgcgtatcgcgatcgtgagcgaggacaagtgcaaacccaagaagtgccgccaggagtgcaagaagagctgccccgtcgtcaagaccgggaagctttgcattgaagttagtccagcggcgaaacttgcattcatttctgaagagctgtgtattggttgcggtatctgtgttaagaaatgcccatttgatgccattgaaattatcaatcttccgaaagatttggaaaaagataccactcatcgctatggtccgaataccttcaaattgcacaggttgcctgttccaagacctggtcaagttttgggccttgttggaaccaatggaattgggaagtcaactgcacttaaagtgttagctggcaagctgaagcctaatttgggacgattcaaaaacccacctgattggcaagaaattcttacatacttccgcgggtccgaacttcagaattactttacgcgtatattggaagataacctgaaggctatcatcaagcctcagtatgttgaccacattccaaaagctgttcaaggaaatgtagggcaagtacttgagcagaaagatgagcgggatatgaagaatgagctgtgtgttgaccttgaattgaaccaggttattgacagaaatgtaggagatttgtctggtggtgagcttcagagatttgcaatagcagttgttgctgtgcaaagtgcagaaatttacatgtttgatgagccatcaagttatcttgatgtcaagcagaggcttaaggctgcacaagtcattaggtccttgcttagatccaacagctatgtcattgtcgtggaacatgacttgagtgtcttagattacttgtccgactttatttgctgcttatatgggaagccaggtgcttatggtgttgttacactgccattttcggtccgagaaggtatcaatattttcctggctggatttgttccaacagagaaccttcggtttcgtgatgaatctcttacatttaagattgcggagacccaggaaaatgcagaggaagtagcgtcataccagcggtacaagtacccttccatgagcaaaacacagggaaatttcaagctttctgttgctgagggtgaattcactgattctcagattgttgtgatgcttggtgagaacgggacagggaaaactacattcatcagaatgctggctgggttgttgaagccagataccatagaaggaactgaggttgaaattcctgaatttaatgtgtcatacaagcctcaaaagatcagcccaaaattccagcatccagtgaggcacttgcttcatcagaaaataagggattcatatactcatcctcagtttgtgtctgatgtcatgaaaccactgcaaattgagcaactcatggaccaggaagttgttaatttatcaggtggagagctccaaagagtggcattatgtctgtgccttggaaagcctgcagatatttatttaattgatgagccaagtgcatatctcgattcagaacagcgaattgttgcctcgaaggttatcaaaagattcatccttcatgcaaagaaaactgcatttatcgtagagcatgatttcatcatggcaacgtacttagcggacaaggttattgtttatgaaggacgtgcttctattgactgcactgccaatgcacctcagtctttggtatctgggatgaataaattcttatcgcatcttgacattacgtttagaagagacccgaccaactataggccacgaataaacaaactggaatctacaaaagacagagagcagaagaatgctggatcttactactaccttgatgactaatgaggaattacagtgacttctcggagagcttcacgttgataatgctccgagtctgttggatgcaccagactagctggaagctgctgccactacatgagatcattagatgagacatacaaaaataataggctacaggagggaagcccatcgagtgaagttcttcgattataaagcagcgcatgtggtgttgatactgtatttttgtttatttttctctgtacgatgggaaggaaactaattgactctgaggggagaacgattatcagttttcgtgtatctgcattgttgtatcatggctttaccatctggtatccttcaatccttgaattcatacaacttataattttctttgacttgtatatttgttacagt

SEQ ID NO: 4723 - DNA, 2287 bp, Secale cereale
gccgccagtggtagcgctctgccccctccagcggaaatctctttggacggggcgacggatacggagaatcgcagcagatggcggaccgtttgacccgtatcgcgatcgtgagcgaggacaagtgcaagcccaagaagtgccgccaggagtgcaagaagagttgccccgtcgtcaagaccggaaaactttgcattgaagttagtccagcggccaaacttgcattcatttctgaagagctgtgtattggttgtggtatttgtgttaagaaatgcccatttgatgccattgaaatcatcaatcttccaaaagatttggagaaagatactacccatcgctatggaccgaataccttcaaattgcacaggttgcctgttccaagacctggtcaagttctgggtcttgttggaacaaatggaattgggaagtcaacagcacttaaagtcttagctggcaagctgaagcccaatctgggacggttcaaaaatccacctgattggcaagagatccttacatatttccgtgggtctgaacttcagaactattttacgcgcatattggaggataacctgaaggcaatcatcaagcctcagtatgttgaccatattccaaaagctgttcaaggaaatgtagggcaagtacttgagcagaaagatgagcgggatatgaaaaatgagctgtgcgttgaccttgaattgaaccaagttattgacagaaatgtaggagatctgtctggtggcgagcttcagagatttgcaatagcagttgttgctgtacaaagtgcggaaatttacatgtttgatgagccatcaagttatttggatgttaaacagaggcttaaggctgcacgagtcattaggtctttgctcagatcaaacagctatgtcatcgttgtcgaacatgacttgagtgtcttagattacttgtccgactttatttgctgcttatatgggaagccaggtgcttacggtgtggttacattaccattttcggtccgagaaggtatcaatattttcctggcaggatttgttccaacagaaaaccttcggtttcgagatgaatctcttacatttaagattgcggagacccaggaaaacgcagaggaagttgctacgtaccagaggtacaagtaccctaccatgagcaaaacacagggaaatttcaagctctctgttgttgagggtgaattcaccgattctcagattgttgtaatgcttggtgagaacggcacagggaaaactacattcatcagaatgctggccgggttgttgaagccagataccatggaaggaactgaggttgaaattcctgaattcaatgtgtcctacaagcctcaaaagatcagcccaaaattccagcatccagtgaggcacttgcttcattcgaaaatacgcgattcatatactcatcctcagtttgtatctgatgttatgaaaccactacaaatcgagcaactcatggaccaagaagttataaatttatcaggcggagagctccagagagtagcattatgtttgtgccttggaaagcctgcagatatttatttaattgatgagccaagtgcatatctcgattcagagcagcgtattgttgcctcgaaggttatcaaaagattcatccttcatgcaaagaaaactgcatttattgtggagcatgatttcatcatggcaacctacttagcggacaaggttattgtttatgagggacttgcttctattgactgtactgccaatgcaccacagtctttggtatctgggatgaataaattcttatcgcatcttgacattacatttagaagagacccgaccaactataggccacgaatcaacaaactggaatctacgaaggacagagaacaaaagaatgcagggtcctactattaccttgatgactaatgagaggggattcttactggacgtcaataatgttacgaatcctgctggatcatgcgcaaggctaacgagaagttgccatgacgtgtgtccatgaggcatgggaattggctacaggagtgaagcacatcgaatgtggtgcttgcggtacaaagaagcgcatgtgttgaaagtgtattttttgttggtttgagctgtgggtagaacgatcatcagttttcttgtattttgcattgctgtatcatggctttaccatctcatatttttctatcgtgaaatcttataatgcatattcttttggagcttattatagtcctcacaagtttatccatattgtattttatgtcctctcactagttggttctgtgtcagaaccttagtacttgcattaggactag

SEQ ID NO: 4724 - DNA, 2396 bp, Triticum aestivum
cttccacgcctaactctagtgtcgccgccagtggtagcgctcttccccttccagcggaaatctctttggacggggcggcgtatacggagagtcgccgcagatggcggaccgtttgacccgtatcgcgatcgtgagcgaggacaagtgcaagccgaagaagtgccgccaggagtgcaagaagagttgccccgttgtcaagaccggaaagctttgcattgaagttagtccagcggccaaacttgcattcatttctgaagagctgtgtattggttgtggtatttgtgttaagaaatgcccatttgatgccattgaaatcatcaatcttccaaaagatttggagaaagatactacccatcgctatggaccgaataccttcaaattgcacaggttgcctgttccaagacctggtcaagttttgggtcttgttggaaccaatggaattgggaagtcaacagcacttaaagtcttagctggcaagctgaagcccaatctgggacgattcaaaaatccacctgactggcaagagatccttacatatttccgtgggtctgaacttcagaactattttacgcgcatattggaggataacctgaaggcaatcatcaagccgcagtatgttgaccatattccaaaagctgttcaaggaaatgtagggcaagtacttgagcagaaagatgagcgggatatgaaaaatgagctgtgcgttgaccttgaattgaaccaagttattgacagaaatgtaggagatctgtctggtggcgagcttcagagatttgcaatagcagttgttgctgtacaaagtgcggaaatttacatgtttgatgagccatcaagttatttggacgttaaacagaggcttaaggctgcccgagtcattaggtctttgcttagatcaaacagctatgtcatcgttgtcgaacatgacttgagtgtcttagattacttgtccgactttatttgctgcttatatgggaagccaggtgcttacggtgtagttacgttaccattttcggtccgagaaggtatcaatattttcctggctggatttgttccaacagaaaaccttcggtttcgagatgaatctcttacatttaagattgcggagacccaggaaaacgcagaggaagttgctacgtaccagcggtacaagtaccctaccatgagcaaaacacagggaaatttcaagctctctgtcgttgagggtgaattcactgattctcagattgttgtgatgcttggtgagaacggcacagggaaaactacattcatcagaatgctggccgggttgttgaagccagataccatggaaggaactgaggttgaaattcctgaattcaatgtgtcctacaagcctcaaaagatcagcccaaaattccagcatccagtgaggcacttgcttcattcgaaaatacgcgattcatatactcatcctcagtttgtatctgatgttatgaaaccactacaaattgagcaactcatggaccaggaagttattaatttatcaggtggagagctccagagagtagcattatgtttgtgccttggaaagcctgcagatatttatttaattgatgagccaagtgcatatcttgattcagagcagcgtattgttgcctcgaaggttatcaaaagattcatccttcatgcaaagaaaactgcatttattgtggagcatgatttcatcatggcaacctacttagcggacaaggttattgtttatgagggacttgcttctattgactgtactgccaatgcaccacagtctttggtatctgggatgaataaattcttatcgcatcttgacattacatttagaagagacccgaccaactataggccacgaatcaacaaactcgaatcaacgaaggacagagaacaaaagaatgcagggtcctactactacctagatgactaatgagaggggccagcgcagattcttgttggacgtcaataatgttccgaatcctttctggatcatgcgcaaggctaacgagaagttgccatgacgtgcgtccatgagacatgcgaattggccacaggagtgaagcgcatcgagtgtggtgcttgggtttcaaagaagcgcatgtgttgaaactgtactttttgttggtttgagctgtggggagaacgattatcaattttcttgtatttgcattgctgtatcatggctttaccatctcatattgttctatcgtgaaatcttataatgcatattctcctggagcttattatagtcctctcactagtttgtcctcatattatattttatatcctctcactagttggttccgttccttttgaactagtcttatgaatgatgaagtgtggtgggcagtacacgctatacattttattttttgttcatctcgttcgttttgaactagtcttatgaatga

SEQ ID NO: 4725 - DNA, 2288 bp, Avena sativa
ccaaagccaaagccaaagcgataccctcctcctcaccgcagcctcctgctaaatcctacgccgccgccagaccgaagctcctcttcctcccctccatcggatacctcttcgcgtcggcggcggccaaagagagtcgccgcagatggccgaccgtctgacccgtatcgcgattgtgagcgaggacaagtgcaagcctaagaagtgccgccaggagtgcaagaagagctgccctgtcgtcaagaccgggaagctttgcatcgaagttagtccagcagtgaaacttgcattcatttcggaagagctgtgtattggttgtggtatttgcgttaagaaatgcccattcgatgctattgaaatcatcaatcttccaaaagatttggaaaaagatactactcatcgctatggaccaaataccttcaagttgcataggttgcctgttccaagacctgggcaagtcttgggtcttgttggaaccaatggaattggaaagtcaacagcccttaaagtgttggctggcaagctgaagcctaatttgggacgtttcaaaaatccacctgattggcaagagatccttacatacttccgtgggtctgaacttcagaattattttacacgtatattggaagataacctgaaggctatcatcaagcctcaatatgttgaccacatcccgaaagctgtccaaggaaatgtagggcaagtacttgagcaaaaagatgagcgggatatgaaaaatgagctatgtgttgatcttgaattaaaccaagttattgatagaaatgtaggagatctgtccggtggcgagcttcagagatttgcaatagcagttgttgctgtacaaagtgcagaaatttacatgtttgatgagccatcaagttatcttgatgttaagcagcggcttaaggctgcacgagtcattaggtccttgcttagatccaacagctatgtcattgttgtggaacatgacttgagtgtcctagattacttgtccgactttatttgctgcttatatgggaagccaggtgcttacggtgtagttacattgccattttcggtccgagaaggtatcaatatattcctggctggatttgttccaacagaaaaccttcggtttcgagatgaatctcttactttcaagatcgcggagacccaggaaaatgcggaggaagtagcttcgtaccagcggtacaagtaccctaccatgaccaaaacacagggaaacttcaagctctgtgtagctgagggtgaatttactgattctcagattgttgtgatgcttggtgagaatggcacagggaaaactacattcatcagaatgctggctgggctattgaagccagataccgtggaaggaactgagattgaaatccctgagttcaatgtgtcctacaagcctcaaaagattagcccaaagttccagcatccagtgaggcacttgcttcattctaagatacgggattcttatactcatcctcagtttgtgtctgatgtcatgaaaccactacaaattgaggcactcatggaccaggaagttattaatttatcaggtggagagctccaaagggtggcattgtgtctgtgccttggaaagcctgcagatatttatttgattgatgagccaagtgcatatctcgattcagagcagcgcattgttgcttccaaggttatcaaacgattcatccttcatgcaaagaaaactgcatttattgttgagcacgatttcattatggcaacctacttagcagacaaggttattgtttatgagggccgtgcttctattgattgtactgccaatgcaccacagtctttggtatctgggatgaataaattcttatcgcatcttgacattacgtttagaagagacccgaccaactataggccccgaattaacaaactggaatctacaaaagacagagaacaaaagaatgcaggatcctactactaccttgatgactaatgagattcttctgggagaacttcatgcccgtaatgtttgaatccgttggacttatatacacaaggctaactggaagctggcactacatgagacgctcggaaataattgctagacaaaatgaaagaagcacatttagtgaagtgcttgggttataaagcagtgcacgtgatcctgttactgtatttttgttttgacctctatgattcgacggaagttgaggtcttgaggggagaacgattatcagtttttgtgtatttgcattgttgtatcatggctttaccatctggtattcttcaatccttgaattatatgacgcatgtgttctttggtc

SEQ ID NO: 4726 - DNA, 2376 bp, Triticum aestivum
aagtgatataccctcctccccgccgccgcttccacgcctaactctagtgccgccgccagtggttgtgctctgccccctccagcggaaatctctttggacggggcggcgaatacggggagtcgccgcagatggcggaccgtttgacccgtatcgcgatcgtgagcgaggacaagtgcaagcccaagaagtgccgccaggagtgcaagaagagctgccccgttgtcaagaccggaaagctttgcattgaagttagtccagcggccaaacttgcattcatttctgaagagctgtgtattggttgtggtatttgtgttaagaaatgcccatttgatgccattgaaatcatcaatcttccaaaagatttggagaaagatactacccatcgctatggaccgaataccttcaaattgcacaggttgcctgttccaagacctggtcaagttttgggtcttgttggaaccaatggaattgggaagtcaacagcacttaaagtcttagctggcaagctgaagcccaatctgggacgattcaaaaatccacctgactggcaagagatccttacatatttccgtgggtctgaacttcagaactattttacgcgcatattggaggataacctgaaggcaatcatcaagccgcagtatgttgaccatattccaaaagctgttcaaggaaatgtagggcaagtacttgagcagaaagatgagcgggatatgaaaaatgagctgtgcgttgaccttgaattgaaccaagttattgacagaaatgtaggagatctgtctggtggcgagcttcagagatttgcaatagcagttgttgctgtacaaagtgcggaaatttacatgtttgatgagccatcaagttatttggacgttaaacagaggcttaaggctgcccgagtcattaggtctttgcttagatcaaacagctatgtcatcgttgtcgaacatgacttgagtgtcttagattacttgtccgactttatttgctgcttatatgggaagccaggtgcttacggtgtagttacgttaccattttcggtccgagaaggtatcaatattttcctggctggatttgttccaacagaaaaccttcggtttcgagatgaatctcttacatttaagattgcggagacccaggaaaacgcagaggaagttgctacgtaccagcggtacaagtaccctaccatgagcaaaacacagggaaatttcaagctctctgtcgttgagggtgaattcactgattctcagattgttgtgatgcttggtgagaacggcacagggaaaactacattcatcagaatgctggccgggttgttgaagccagataccatggaaggaagtgaggttgaaattcctgaattcaatgtgtcctacaagcctcaaaagatcagcccaaaattccagcatccagtgaggcacttgctgcattcgaaaatacgcgattcatatactcatcctcagtttgtatctgatgttatgaaaccactacaaattgagcaactcatggaccaggaagtcattaatttatcaggtggagagctccagagagtagcattatgtttgtgccttggaaagcctgcagatatttatttaattgatgagccaagtgcatatctcgattcagagcagcgtattgttgcctcgaaggttatcaaaagattcatccttcatgcaaagaaaactgcatttattgtggagcatgatttcatcatggcaacctacttagcggacaaggttattgtttatgagggacttgcttctattgactgtactgccaatgcaccacagtctttggtatctgggatgaataaattcttatcgcatcttgacattacatttagaagagacccgaccaactataggccacgaatcaacaaactggaatcaacgaaggacagagaacaaaagaatgcagggtcctactactacctagatgattaatgagaggggccagcgcagattcttgttggacgtcaataatgttccgaacccttctggatcatgcgcaaggctaacgagaagttgccatgacgtgtgtccatgggacatgcgaattggccacaggagtgaagcgcatcgagtgtggtgcctgggtttcaaagaagcgcatgtgttgaaactgtactttttgttggtttgagctgtggggagaacgatcgtcagttttcttgtatttgcattgctgtatcatggctttaccatctcatatttttctatcgtgaaatcttataatgcatattctcttggagcttattatagtcctctcactagtatatcctcatataatatattttatgtcctcttactagttggttccgttccttttgaactagtcttatgaatgatgaagtgtggtgggcagtacacgctatac

SEQ ID NO: 4727 - DNA, 2390 bp, Triticum aestivum
ctccccgccgccacttccacgcctaactctagtgccgccgcctgtggtagcgctctgccccctccagcggaaatctctttggacggggcggcgaatacggagagtcgccgcagatggcggaccgtttgacccgtatcgcgatcgtgagcgaggataagtgcaagcccaagaagtgccgccaggagtgcaagaagagctgccccgttgtcaagaccggaaagctttgcattgaagttagtccagtggccaaacttgcattcatttctgaagagctgtgtattggttgtggtatttgtgttaagaaatgcccttttgatgccattgaaatcatcaatcttccaaaagatttggagaaagatactacccatcgctatggaccgaataccttcaaattgcacaggttgcctgttccaagacctggtcaagttttgggtcttgttggaaccaatggaattgggaagtcaacagcacttaaagtcttagctggcaagctgaagcccaatctgggacgattcaaaaatccacctgactggcaagagatccttacatatttccgtgggtctgaacttcagaactattttacgcgcatattggaggataacctgaaggcaatcatcaagccacagtatgtcgaccatattccaaaagctgttcaaggaaatgtagggcaagtacttgagcagaaagatgagcgggatatgaaaaatgagctgtgcgttgaccttgaattgaaccaagttattgacagaaatgtaggagatctgtctggtggcgagcttcagagatttgcaatagcagttgttgctgtacaaagtgcggaaatttacatgtttgatgagccatcaagttatttggacgttaaacagaggcttaaggctgcccgagtcattaggtctttgcttagatcaaacagctatgtcatcgttgtcgaacatgacttgagtgtcttagattacttgtccgactttatttgctgcttatatgggaagccaggtgcttacggtgtagttacgttaccattttctgtccgagaaggtatcaatattttcctggctggatttgttccaacagaaaaccttcggtttcgagatgaatctcttacatttaagattgcggagacccaggaaaacgcagaggaagttgctacgtaccagcggtacaagtaccctaccatgagcaaaacacagggaaatttcaagctctctgtcgttgagggtgaattcactgattctcagattgttgtgatgcttggtgagaacggcacagggaaaactacattcatcagaatgctggccgggttgttgaagccagataccatggaaggaactgaggttgaaattcctgaattcaatgtgtcctacaagcctcaaaagatcagcccaaaattccagcatccagtgaggcacttgcttcattcgaaaatacgcgattcatatactcatcctcagtttgtatctgatgttatgaaaccactacaaattgagcaactcatggaccaggaagttattaatttatcaggtggagagctccagagagtagcattatgtttgtgccttggaaagcctgcagatatttatttaattgatgagccaagtgcatatctcgattcagagcagcgtattgttgcctcgaaggttatcaaaagattcatccttcatgcaaagaaaactgcatttattgtggagcatgatttcattatggcaacctacttagcggacaaggttattgtttatgagggacttgcttctattgactgtactgccaatgcaccacagtctttggtatctgggatgaataaattcttatcgcatcttgacattacatttagaagagacccgaccaactacaggccacgaatcaacaaactggaatctactaaggacagagaacaaaagaatgcagggtcctactactacctagatgactagtgagagggggcacacagattcttgttggacgtcaataatgttttgaacccttccggatcatgcgcgaggctaacgagaacttgccatgacgtgtgtccatgagacatgtgaattggccacaggagtgaagtgcatcgagtgtggtgcttgggtttcaaagaagtgcatgtgttgaaactgtattttttgttggtttgagctgtggggagaacgattatcagttttcttgtatttgcattgctgtatcatggctttaccatctcatattgttttatcgtgaaatcttataatgcatattcttttggagcttattatagtcctctcagtagtttatcctcatattgtattttatgtcctctcactagttggttccgttccttttgaactagtcttatgaaagacgaagtgtggtgggcagtacacgctatacattttattttttgttcatctcgttcgttttga

SEQ ID NO: 4728 - DNA, 2176 bp, Avena sativa
aaagcgataccctcctcctcaccgcagccccctgctcaatcctacgccgccgccagacccaagctccccttcctcccctccatcggatacctcttcgcgtcggcggcggccaaggagagtcgccgcagatggccgaccgtttgacccgtatcgcgattgtgagcgaggacaagtgcaagcctaagaagtgccgccaggagtgcaagaagagctgccctgtcgtcaagaccgggaagctttgcatcgaagttagtccagcagtgaaacttgcattcatttcggaagagctgtgtattggttgtggtatttgcgttaagaatgcccattcgatgctattgaaatcatcaatctaccaaaagatttagaaaaagatactactcatcgctatggaccaaataccttcaagttgcataggttgcctgttccaagacctgggcaagtcttgggtcttgttggaaccaatggaattggaaagtcaacagcccttaaagtgttggctggcaagctgaagcctaatttgggacgtttcaaaaatccacctgattggcaagagatccttacatacttccgcgggtctgaacttcagaactattttacacgtatattggaagataatctgaaggctatcatcaagcctcagtatgttgaccacatcccaaaagctgtccaaggaaatgtagggcaagtacttgagcaaaaagatgagcgggatatgaaaaatgagctatgtgttgatcttgaattgaaccaagttattgacagaaatgtaggagatctgtctggtggtgagcttcagagattcgcaatagcagttgttgctgtacaaagtgcagaaatttacatgtttgatgagccatcaagttatcttgatgttaagcagcggcttaaggctgcacgagtcattaggtccttgcttagatccaacagctatgtcattgttgtggaacatgacttgagtgtcctagattacttgtccgactttatttgctgcttatatgggaagccaggagcttacggtgtagtgaccttgccattttcggtccgagaaggtatcaatattttcctcgctggatttgttccaacagaaaaccttcggtttcgagatgaatctcttactttcaagatcgcggagacccaggaaaatgcggaggaagtagcttcgtaccagcggtacaagtaccctaccatgaccaaaacacagggaaacttcaagctctgtgtagctgagggtgaatttactgattctcagattgttgtgatgcttggtgagaatggcacagggaaaactacattcatcagaatgctggctgggctattgaagccagataccgtggaaggaactgagattgaaatccctgagttcaatgtgtcctacaagcctcaaaagattagcccaaagttccagcatccagtgaggcacttgcttcattctaagatacgggattcttatactcatcctcagtttgtgtctgatgtcatgaaaccactacaaattgaggcactcatggaccaggaagttattaatttatcaggtggagagctccaaagggtggcattgtgtctgtgccttggaaagcctgcagatatttatttgattgatgagccaagtgcgtatctcgattcagagcagcgcattgttgcttcgaaggttatcaaacgattcatccttcatgcaaagaaaactgcatttattgttgagcacgatttcattatggcaacctacttagcagacaaggttattgtttatgagggccgtgcttctattgattgtactgccaatgcaccacagtctttggtatctgggatgaataaattcttatcgcatcttgacattacgtttagaagagacccgaccaactataggccccgaattaacaaactggaatctacaaaagacagagaacaaaagaatgcaggatcctactactaccttgatgactaatgagattcttctgggagaacttcatgcccgtaatgtttgaatccgttggacttatatacacaaggctaactggaagctggcactacatgagacgcgtggaaataattgctagacaaaatgaaagaagcacatttagtgaaagtgcttgggttataaagctgtgcatgtgatgttgatactgtatttttgttttgatctctatgatatgaaggaagctgagtgacttgaggggag

SEQ ID NO: 4729 - DNA, 2034 bp, Panicum virgatum
cgggcatgtgaaccaggacggggcccgagcctagggtttggtccaatcccctccgccgcgcgcacgtgtccgccacacttccaaaggaataccccctcccccctctctctttcccaccgccgccgctacgctttcggctccaccaccccttcctcctcggagccctcccctcggcggcggcggaagaagagatggcggagcggctgacccgtatcgcgatcgtcagcgaggacaagtgcaagcccaagaagtgccgccaggagtgcaagaagagctgccccgtcgtcaagaccgggaagctttgcattgaagtgactccggcttcgaaactcgctttcatttccgaggagctgtgcatcggttgtggtatttgtgttaagaaatgtccatttgatgccattgaaatcattaacctcccaaaagatttggaaaaggataccactcaccgatatggacccaacaccttcaagttgcacaggttacctgtcccgaggcctggtcaggttttgggccttgttggcacgaatggaattggaaagtcaacagcacttaaagttttggctggcaagctgaaacctaatttgggacgcttcaaaaacccacctgattggcaggaaatccttacatacttccgtgggtctgaacttcagaactacttcacacgcatattggaagataacctcaaggcaatcattaaacctcagtatgtcgaccacattccaaaagctgttcaaggaaatgttgggcaagtacttgaacagaaggatgagagggatatgaaagctgagctgtgtgttgaccttgaattgaaccaagttattgaccgaaatgttggagatctgtctggtggtgagctccagagatttgcaatagcagttgttgctgtacaaaatgcagaaatttacatgtttgatgagccatcaagttaccttgatgttaagcagaggcttaaagctgcacaagtcattaggtccttgcttaggcccaacagctatgtcatcgttgttgaacatgacttgagtgtcttggattacttgtccgacttcatttgctgcttatatggaaagccaggtgcttatggtgtggttaccttgccattctcggttcgagaaggcatcaatattttcttggctggatttgttccaacagaaaatcttcggttccgagatgaatctcttacgtttaagattgcagagactcaagaaagtgctgaggagattgagacataccagcggtataagtaccctaccatgagcaaaacacagggaaatttcaagctaactgttgttgagggtgaatttactgattcccagattgttgtgatgcttggagaaaatggtacagggaaaactacgtttatcagaatgctggctgggttgttgaagcctgacacagtggaaggaactgatattgaaattcctgaattcaacgtgtcgtacaagccccaaaagatcagtccaaaattccagaataccgtgaggcatttgcttcaccagaaaatacgcgattcttatatgcatcctcagtttgtatctgatgtcatgaaaccactacaaattgagcaactcatggaccaggaggttattaatttatcaggtggagaactccaaagagttgctatatgcctctgccttgggaagcctgcagatatctatttgatcgatgaaccaagtgcatatcttgattcagagcagcgtattgttgcctcaaaggttatcaaaagattcattcttcatgccaagaaaactgcatttattgttgagcatgatttcatcatggcaacctacttggctgacaaggtcattgtttatgaggggcgtccttctattgactgtactgccaatgcgccacaatctttggtatctggaatgaataagttcttgtcgcatcttggtgttactttcaaaagagacccagccaactataggccttgttttcctacctcttccatgattaggatccagtaattttagatttgcacatgcgtgtttggtttagatcccaaatgcgtccaagcttgccatgccaaatttt

SEQ ID NO: 4730 - DNA, 2283 bp, Festuca arundinacea
ccaaagccaaagtgataccctccttcctcaccgcagcctcctgctcgaatcctacgccgccaccagaccgaagaatccccccttcttccatcggacaccacttcgcgtcggcggcggccaaggagagtcgccgcagatggcggagcgtttgacccgtatcgcgatcgtgagcgaggacaagtgcaagcccaagaagtgccgccaggagtgcaaaaagagttgccctgtcgtcaagaccgggaagctttgcatcgaagttagtccagcagcgaaaattgctttcatttctgaagagctgtgtattggttgtggtatttgcgttaagaaatgcccatttgatgccattgagatcatcaaccttccaaaagatttggaaaaagatactacccatcgctatggaccaaatacctttaaattgcacaggttgcctgttccaagacctggtcaagttttgggccttgttggtaccaatggaattgggaagtcaactgcacttaaagtgttggctggcaagctgaagcctaatttgggacgcttcaaaaatccacctgattggcaagagattcttacatacttccgtgggtctgaacttcagaattattttacacgtatattggaagataacctgaaggctatcatcaagccccagtatgtcgaccacattccaaaagcggtccagggaaatgtagggcaagtacttgagcaaaaagatgagcgggatatgaaaaatgagctatgtgttgatcttgaattaaaccaagtcattgacagaaatgtaggagatctgtccggtggcgagcttcagagatttgcaatagcagttgttgctgtacaaagtgcagaaatttacatgtttgatgagccatcaagttatcttgatgttaagcagaggcttaaggctgcacgagtcattaggtctttgcttagatccaacagctatgtcattgttgtggaacatgacttgagtgtcctagattacctgtccgactttatttgctgcctatatgggaagccaggtgcttatggtgtagttacgttgccattttcggtccgagaaggtatcaatattttcctggctggatttgttccaacagaaaaccttcgatttcgagaggaatctcttacatttaagatcgcggagacccaggaaaatgcggaggaagttgcttcgtaccagcggtacaagtaccctaccatgaccaaaacacagggaaatttcaagctctgtgtagctgagggtgaattcactgattctcagattgttgtgatgcttggtgagaacggcacagggaaaactacattcatcagaatgctggccgggttgttgaagccagatactgtggaaggaactgaggttgaaatccctgaatttaatgtgtcctacaagcctcagaagattagcccaaagttccagcatccagtgaggcacttgcttcactcgaagatacgggattcatatactcatcctcagtttgtgtctgatgtcatgaaaccactacaaattgaggcactcatggaccaggaggttattaatttatcaggtggagagctccaaagagtggcattgtgtctgtgccttggaaagcctgcagatatttatttgattgatgaaccaagtgcatatctcgattcagagcagcgcattgttgcttcgaaggttatcaaacgattcatcctacatgcaaagaaaactgcatttattgttgagcacgatttcatcatggcaacctacttagcggacaaggttattgtttatgagggacgtgcctctattgactgtactgccaatgcaccacagtctttggtatctgggatgaataaattcttatcgcatcttgacattacattcagaagagacccgacaaactataggccccggattaacaaactggaatctacaaaagacagagaacagaagaatgcaggatcctactactaccttgatgactaatgagattcttcttggagagcttctcatgccgataatgtttgaatccggtggatctatatgcacaaggctaactggaagctggcactacataagacagaggcatgcaaaaataactgggtttcggttataaagcaacgcatgtgatgttgatgctgtatttttgttagtttgatctgtatgacttgaaggaagctgagtggctcttgaggggagaatgattatcagtttttgtgtatctgcattgctgtatcatggctttaccatctggcattctctaatccttgaattataggacacaaagatattttgagtcaaaaaaaaaaaaaaaaaaa

SEQ ID NO: 4731 - DNA, 2348 bp, Musa acuminata
gtcgagcaccggcaacgagtggtggtcttatttttgtggcggcgctagggcctcgtcctctccatcatggccgatcggttgacccgtatcgctatcgttagctctgatcgatgcaaaccaaagaagtgccgacaggagtgcaagaagagttgccccgtcgtgaaaacaggaaaactttgcatagaagtaactccagcctcaaagattgctttcatatctgaggagttatgcattggatgtggtatctgtgttaagaaatgcccttttgaggccattcagattatcaatctaccaaaggacttagacaaagacacgacccaccgttatggaccaaatacatttaaattgcacaggttgccagttccaagacctggacaagttctgggcttggttgggacaaatggtattggaaagtctactgcacttaaagtgttggctgggaagttgaagcccaacttgggtagattcaataatcctcctgattggcaggaaattttaacatatttccgtggctctgagcttcagaattattttactcgtatactggaggacaatctaaaggcaatcatcaagccgcagtatgttgatcacattccaaaagctgttcaaggtaatgttggacaggtgcttgaccaaaaagatgagagagagatgaaagcagaactttgtaatggcctagaattgaatcaagttattgatcgaaatgtgggggacttatctggtggagagttgcaaagatttgctattgctgtggttgccatacaaaatgcagagatttatatgtttgatgagccatcaagttatcttgatgtgaagcagaggcttaaagcagctcaagttatccgttccctacttagacctaacagctatgtgattgttgtggagcatgatctcagtgtattggactacttgtccgatttcatttgttgtctctatggaaagccaggagcttatggagttgttacactacccttctctgtacgagaaggaatcaacatttttttggctggttttgttcctacagaaaatcttcggtttcgagacgaatcacttacatttaaggttgctgagactcctcaagaaagtgctgaggagattcagacataccaacgatataaatatcctaccatgagtaaaacccaagggaatttcaagcttaaagtgatcgagggtgaatttacagattctcagatcattgtaatgctgggtgagaacgggactgggaagacaacatttattcggatgctggctggattgctgaagccggatactgtggaagattcagatgttgagatgcctgaatttaatgtttcatataagcctcagaaaattagtcctaagtttccatctacagtgagacacttgctgcatcaaaaaattcgtgattcatatatgcatccgcaatttgtgtctgatgttatgaaaccattgcaaattgagcaattgatggaccaagaagttgtgaacctttctggtggagaattgcaaagagtagcattgtgtttgtgtcttgggaagccagcagatatttatctgatagatgaaccaagtgcttatcttgattcggagcagcgcattgtcgcctcaaaggtgataaagagatttatccttcatgccaagaaaactgccttcatcgttgagcatgatttcatcatggcaacctacctggctgataaggtcattgtgtatgagggaaggccctctatagattgcactgcaaatgcacctcagtctttggtatccgggatgaacttgttcttatctcatcttgatatcactttcagacgagatccaactaattacaggcccaggataaacaagttggactctaccaaagaccgagaacagaaagctgcaggatcttattattacctcgatgattgatcatcattcttgtgcacgatggccattgtctgtttgcttttgtgaacattggtgggcatttctttggcaagtaaccaagtgtgtgcaaagcatgaatcctggtgtctatgcacaaacttctgttgccgtgctaacgtttccctgatgcactctaccgctggctcttcatcttccccctttgtttggatcctgaagatagaaaatgtggcataagcagcgtattcaataaggcaacagtggttttctttcgtgatttatgttcatagtttgtaactcgagacatcaccggtgctgcgagcatctggtcgagttctttctccaaccaacatgatcatatgacatggctaaactcctggttttctgtaatgagcaatattttgccttggttgtaccaaagaagatatcttttgagcggccactttggtgctataaattaaatggaggctgtaattttgttggggcac

SEQ ID NO: 4732 - DNA, 2852 bp, Ananas comosus
cctcttcggttgatctctcttctctccttctctacccccataaattcgcctctttttcctctttttcggagtgctctgattcgaatctcccgctctagggtttcctgcgcttgatccgatcatctagcgaggcgaagagatggcggatcgattgacccgtattgcgatcgtgagctccgaccggtgcaagcccaagaagtgtcgccaagaatgcaagaagagttgccccgtcgtcaaaaccggaaaactctgtattgaagtcaccccggcctcaaaaattgcttttatttccgaggagttatgtattggatgtggtatttgtgtgaagaaatgcccgtttgaggccattcaaatcatcaatttaccaaaggacctggacaaagacactactcatcgctatggaccaaacacattcaagttgcacaggttgccagttccaagacctgggcaagttctaggcctggtaggaacaaatggtattgggaaatccactgcacttaaagtgttggctgggaagttgaagcctaacttgggccgattcaataatcctcctgattggcaagaaattttgacatatttccgtggttctgaacttcagaattatttcactcgtatactagaggataatctgaaggcaattatcaagccacagtacgttgaccacattccaaaagctgttcaagggaatgttgggcaggtgctcgatcagaaggatgagagagatatgaaggctgaattatgtgttgatctcgagttgaaccaggtcattgaccgaaatgtgggcgatttgtctggtggagagctgcaaagatttgcgattgctgtagttgctgtgcaaaatgcagaaatctatatgtttgatgagccatcaagttatcttgacgtgaagcagaggcttaaagctgcacaagtagtccggtccttgcttagacctaacagctatgtgattgttgtggagcatgacctcagtgtcctggattacttatcagacttcatttgttgcttatacggaaagccaggagcttacggagttgttactttgcccttttctgtgcgagaagggatcaacatattcttggctggttttgttcctacagaaaacctccggtttcgtgaagaatcacttacatttaaggtcgctgagactcctcaggaaagtgctgaggagatccaaacataccaacgttacaagtatcctacaatgactaaaacccagggtaacttcaggctttcggtcattgagggtgaatttactgattctcagattattgtgatgcttggtgagaatggtactggaaaaacaaccttcatacggatgttggctggattgttgaagccggatactgtagaaggtacagatgttgaaatacctgagttccatgtttcgtataaacctcagaaaatcagtcctaagtttcaatctactgtgagacacttgctgcatcagaaaataagggattcttatatgcatgctcagtttgtgtcggatgttatgaaaccgttgcaaattgagcaactcatggaccaggaagtggtaaatctctctggtggagagcttcaaagagtagccttgtgcctatgtcttggaaagccagcagacatctatttgatagatgaaccaagtgcctatctagattcagagcagcgtattgttgcctcaaaggtcataaaaagattcatccttcacgcgaagaaaactgcatttgtcgttgagcatgatttcatcatggcaacctaccttgctgataaagttatcgtctatgaggggataccttctgtagattgtactgccaacgcaccgcagtcattggtatctgggatgaaccgttttctctcacatcttgatattacttttaggcgagatccgaccaattacaggccccgcataaacaagttggattcaacaaaggatagggaacaaaaatctgcaggatcttattactaccttgacgattaatgtaaaggagcatatgcaggattatttaactgccctgccttgtccggtgatacagagcccctttgccaccacgaatgatcgcaactagagttatattttctagaaggttgagggttatttttcgcgtcttgatgctttctaatcttttacttgcttgatcctccaacatgttgagtctattatgacttactacagaaatcagaaagagcttctgccgcccctgctgccgcttatggtttgctatttcctatttgatcctctacccttacagactggctcgtgcaccaaattcgcctgcgtaagaatctgtcagctgaatagaggttcctaggtttcgagctgtagtcgcatgcggttactgaaattttttgtcggcagttaatactctggttattttactgtaataagtcatcttggtctgagtgttgtacgggtttatttatcgccttaacttgagattcattttaaactcagttcggatgcaccagttttttctatatatagaggttgggattgtaatttatgcgtgcttgtttggttgatgactttgcatcgatatttctccggtgcatgatactctccttcgacgacgcaatgaacctgacctctcctgagcctgttgtttgtgcgcgtgcttgtgtgggattgtgttctaccaggttctgtcggcttccctttggaaacagctattccttcataattgttattttgtatgaagatttataaaatttgataaaaattattatttttataatggagcaaatttttatatcgtttgaatataaagttactaaaaaatgttactgttttgttgttacactgaaaaaggttactgtttgatttgtagaatgatgaaaatatatatttataacttcttatgtgtagatcttttgga

SEQ ID NO: 4733 - DNA, 2233 bp, Festuca arundinacea
cgaagaatccccccttcctccatcggacaccacttcgcgtcggcggcggccaaggagagtcgccgcagatggcggaccgtttgacccgtatcgcgatcgtgagcgaggacaagtgcaagcccaagaagtgccgccaggaatgcaaaaagagttgccctgtcgtcaagaccgggaagctttgcatcgaagttagtccagcagtgaaacttgcgttcatttctgaagagctgtgtattggttgtggtatttgcgttaagaaatgcccatttgatgccattgagatcatcaaccttccaaaagatttggaaaaagatactacccatcgctatggaccaaatacctttaaattgcataggttgcctgttccaagacctggtcaagttttgggccttgttggtaccaatggaattgggaagtcaactgcacttaaagtgttggctggcaagctgaagcctaatttgggacgcttcaaaaatccacctgattggcaagagattcttacatacttccgtgggtctgaacttcagaattattttacacgtatattggaagataacctgaaggctatcatcaagccccagtatgttgaccacattccaaaagcggtccagggaaatgtagggcaagtgcttgagcaaaaagatgagcgggatatgaaaaatgagctatgtgttgatcttgaattaaaccaagttattgacagaaatgtaggagatctgtccggtggcgagcttcagagatttgcaatagcagttgttgctgtacaaagtgcagaaatttacatgtttgatgagccatcaagttatcttgatgttaagcagaggcttaaggctgcacgagtcattaggtctttgcttagatccaacagctatgtcattgttgtggaacatgacttgagtgtcctagattacttgtccgactttatttgctgcctatatgggaagccaggtgcttacggtgtagttacgttgccattttcggtccgagaaggtatcaatattttcctggctggatttgttccaacagaaaaccttcgatttcgagaggaatctcttacatttaagatcgcggagacccaggaaaatgcggaggaagttgcttcgtatcagcggtacaagtaccctaccatgaccaaaacacagggaaatttcaagctctgtgtagctgagggcgaattcactgattctcagattgttgtgatgcttggtgagaatggcacaggaaaactacattcatcagaatgctggctgggttgttgaagccagatactgttgaaggaactgaggttgaaatccctgaatttaatgtgtcctacaagcctcaaaagattagcccaaagttccagcatccagtgaggcacttgcttcattcgaagatacgggattcatatactcatcctcagtttgtgtctgatgtcatgaaaccactacaaattgaggcactcatggaccaggaggttattaatttatcaggtggagagctccaaagagtggcattgtgtctgtgccttggaaagcctgcagatatttatttgattgatgaaccaagtgcatatctcgattcagagcagcgcattgtagcttcgaaggttatcaaacgattcatcctacatgcaaagaaaactgcatttattgttgagcacgatttcatcatggcaacctacttagcggacaaggttattgtttatgagggacgtgcctctattgactgtactgccaatgcaccacagtctttggtatctgggatgaataaattcttatcgcatcttgacattacattcagaagagacccgacaaactataggccccggattaacaaactggaatctacaaaagacagagaacaaaagaatgcaggatcctactactaccttgatgactaagattcttcttgaagagcttcacgccgataatgtttgaatccgttggatttatatgcacaaggctaacaagttggcactacattagactgaggcgtgcaaaaatacagctaggctacatgaaaggagcgcatgagtgaagtgtttcggttataaagcagcgcatgtaatttgatatgtattttgttagtttgatctgtatgatgtgaggacgctgaatgactcttgagggtagaacgattatcagtttttgtgtacctgcattgttgtatcatggctttaccatctggtattcttcaatccttgattatataggaagaacaaaaaaaaaagaaaaaaacaaaagtaactact

SEQ ID NO: 4734 - DNA, 2565 bp, Brachypodium distachyon
gttccacctcacagttcttcttcgtctcctcatccagctgctcggggagatgcggccgccgcccaggaggagctcacccggcggcgacagtgtccgccgccgtccgcttgccgcgacggcgagcgcgcgcggccgtacgtgccggcccgtgtccgaaaggcacacccgtcccgtctgctatatccgggcggcaagtaatgtcgactttctgttagcacttcctccataaatcccaaaacggaattgcgggggaatcgggaaataatccgtggctggagctaaaaaccaaggacccgagagtccgagactagggtttcggctggttcgttccccttcgcgaaccacattccattcccctgcactgccgccgcctccggcctctcgaggctacacactccccaccggctcgcggcggcggcggcattgatggcggatcggctgacgcgtatcgcgatcgtgaacgaggacaggtgcaagcccaagaagtgccgccaggagtgcaagaagagctgccccgtcgtcaagactgggaagctttgcattgaagttagttctgcgtcgaaggtagcattcatctctgaagagctgtgcattggttgcggaatttgcgttaagaaatgcccttttgacgccatcgagatcatcaaccttccaaaagatttggagaaagataccacccatcgctatgggccaaataccttcaaattgcacaggttgcctgttccaagacctggtcaagttttgggccttgtcgggaccaatggaattggcaagtccacagcacttaaagtcttagctggcaagctgaaacccaatttggggcgattcaaaaatccacctgattggcaggagatccttacatacttccgtgggtctgagcttcagaattactttacgcgtatattggaggataacctgaaggcaatcatcaagcctcagtatgttgaccacattccaaaagctgtccaaggaaatgtgggacaagtacttgaccagaaagatgagaggggtatcaaagctgagctttgtgttgatcttgaattgaaccaagttattgaccgaaatgtaggagatctttctggtggtgaacttcagagatttgcgatagcagtcgttgctgtgcaaagtgcggaaatttacatgtttgatgaaccatcaagttatcttgatgttaaacagagacttaaggctgcacaagtcattaggtccttgcttagagcaaacagctatgtcatcgttgtggaacatgacctgagtgtcttagattacttgtccgactttatttgctgcttatatggaaagccaggagcttatggtgtagttacacttccattttcggtccgagaaggtatcaatattttcctggctggatttgttccaaccgaaaatcttcggtttcgagatgaatctcttacatttaagattgtggagagccaggaaagtgctgaggagattgagacgtaccagcggtacaagtaccctaccatgagcaaaacgctgggaaatttcaagctcactgtcatggaaggtgaattcactgattcccagattgttgtgatgcttggcgagaacgggacagggaaaactaccttcatcagactgctggctgggcacttgaagccagatactgtggagggtactgacattgaaattccagaatttaatgtgtcctacaagcctcaaaagttgagcccaaaattccagggttcggtgaggcaactgcttcataagaaaatacgggactcgtatactcatcctcagtttacgtctgatgttattaagccactacaaattgagcagctcatggaccaggaagttattaacctatcaggtggagaactccaaagaatggccttgtgtctttgccttggacagcctgcagatatttatttgattgatgaaccaagtgcatatcttgattcagagcagcgtattgttgcatcaaaggttatcaaaagatttatccttcatgcaaagaaaactgcatttattgtcgagcatgatttcatcatggcaacctacttagctgacaaggttgtcgtttatgagggacgtccttctattgattgtactgccaatgcaccacagtctttggtatctgggatgaataaattcttatcgcatcttgacattacatttagaagagacccgaccaactataggccgcggataaacaaactggaatccacaaaagacagggaacaaaagtctgcaggatcctactactaccttgatgactaatcctgagggagtacagaatcctctctaagggctttccagaattatgaattatgcagaagatcagctggatgctgtcaagtggatgtggcatgttaaataattaactagtgtgatctgcatcggttgtacaccagaggatgtgttgttcatagtgagtttttgtcggttcggcatttgtagggacaatggtcatctcttctgtaatttgcattagtgtatcatttacattattattttgtcggtttctgccgagaaatgactcatggagtgatccatatccttaatggtgatgataattcagagaatatcaatagtgccctttat

SEQ ID NO: 4735 - DNA, 2207 bp, Avena sativa
cacccaactcgcgccgccgcctccacgcttccagcgcctcgccgcggccgtccgatcgccgccgccgccggagatggcggaccggttaacgcgcatagctatcctcaacgaggacaggtgcaaaccaaaaaagtgccggcaggagtgccggaagagctgccccgtcgtgaaaacggggaagctctgcatcgaagtcagtccggccacgaaggttgcgttcatctctgaagatctctgcattggttgtggtatttgcgttaagaaatgcccgttcagcgcgatagaaattatcaatcttcctaaagatctggagaaggacacgacacatcgctacgggccaaataccttcaaattgcataggttgcctgttccaagacctgggcaagtcttgggccttgttggaaccaatggaattggaaagtcaacagcccttaaagtgttggctggcaagctgaagcctaatttgggacgtttcaaaaatccacctgattggcaagagatccttacatacttccgtgggtctgaacttcagaattattttacacgtatattggaagataatctgaaggctatcatcaagcctcagtatgttgaccacatcccaaaagctgtccaaggaaatgtagggcaagtacttgagcaaaaagatgagcgggatatgaaaaatgagctatgtgttgatcttgaattaaaccaagttattgatagaaatgtaggagatctgtccggtggcgagcttcagagatttgcaatagcagttgttgctgtacaaagtgcagaaatttacatgtttgatgagccatcaagttatcttgatgttaagcagcggcttaaggctgcacgagtcattaggtccttgcttagatccaacagctatgtcattgttgtggaacatgacttgagtgtcctagattacttgtccgactttatttgctgcttatatgggaagccaggtgcttacggtgtagttacattgccattttcggtccgagaaggtatcaatatattcctggctggatttgttccaacagaaaaccttcggtttcgagatgaatctcttactttcaagatcgcggagacccaggaaaatgcggaggaagtagcttcgtaccagcggtacaagtaccctaccatgaccaaaacacagggaaacttcaagctctgtgtagctgagggtgaatttactgattctcagattgttgtgatgcttggtgagaacggcacagggaaaactacattcatcagaatgctggctgggctattgaagccagatactgtggaaggaactgagattgaaatccctgagttcaatgtgtcctacaagcctcaaaagattagcccaaagttccagcatccagtgaggcacttgcttcattctaagatacgggattcttatactcatcctcagtttgtgtctgatgtcatgaaaccactacaaattgaggcactcatggaccaggaagttattaatttatcaggtggagagctccaaagggtggcattgtgtctgtgccttggaaagcctgcagatatttatttgattgatgagccaagtgcatatctcgattcagagcagcgcattgttgcttccaaggttatcaaacgattcatccttcatgcaaagaaaactgcatttattgttgagcacgatttcatcatggcaacgtacttagcggacaaggttattgtttacgagggacgtgcctctattgactgtactgccaatgcaccacagtctttggtatctgggatgaataaattcttatcgcatcttgacattacgtttagaagagacccgaccaactataggccccgaattaacaaactggaatctacaaaagacagagaacaaaagaatgcaggatcctactactaccttgatgactaatgagattcttctgggagaacttcatgcccgtaatgtttgaatccgttggacttatatacacaaggctaactggaagctggcactacatgagacgctcggaaataattgctagacaaaatgaaagaagcacatttagtgaaagtgcttgggttataaagctgtgcatgtgatgttgatactgtatttttgttttgatctctatgatatgaaggaagctgagtgacttgaggggagaacgattatcagtttttgtgtatttgcattgttgtatcatggctttaccatctggtattcttcaatccttgaattatatgacgcg

SEQ ID NO: 4736 - DNA, 2403 bp, Manihot esculenta
gtcgtttaataaaaaacaggttctctcttctatttcacggttcctcctacaaaccctaagccctttagttgccgctgccgcacagctccgctttgattcccccaacgcaattgtcgttcacctttgccgctctaggcaactgtcgcggtagctgtcgttcaccatttcgggccatcgcctgcccgttgatattgaactcgaggaggcaagttgcccgaaatagctctctacccctctgcctaactgccttatccgcgtctccgttgctgttgtgtggttgagtggttgtgtacgtgaatacattcggcaggttaaagaaagaaggggatggcggacaggttgacgcgtatagcaattgtgagctcagacagatgcaagcccaagaagtgccgtcaagaatgcaaaaagagttgccctgtcgtcaaaactgggaaattatgtattgaggttactcctgcatctaagatagcttttatctctgaggagttgtgcattgggtgtggtatttgtgttaagaaatgcccatttgaagcaattcagatcatcaacttgccaaaggatttggataaagatacaacgcaccgttatgggcctaacacctttaaattgcacaggttaccagtccctaggcctgggcaagttcttggattagttggaacaaatggcattggaaagtccactgccctcaaagttttggctggaaaactgaaaccaaatttgggtcgcttcaataatcctccagattggcaggaaatcttgacctattttcgaggatctgaattgcagaactactttacccgtatcctggaagataatttgaaggccatcataaagcctcagtatgttgaccatattccaaaagcagtccaaggcaatgtagggcaggtgcttgaccaaaaagatgagagagagatgaaagcagaactttgtcatgatcttgagctgaaccaggttatagatcgtaatgtgggggatctgtctggtggggagctccagcgttttgctattgctgttgttgcaatacagaatgcagagatatatatgtttgacgaaccttcgagttatcttgacgtcaaacagaggcttaaagctgcccaagttatcagatctttgctcaggcctaatagctatgttattgtggtggagcatgaccttagtgtcctcgattatttatcagactttatttgctgcttatatgggaaacctggtgcatatggagttgtaactcttcccttctctgttagagaaggaattaatatattcttggctggatttgttcctacagaaaatcttcgattccgggatgagtcattaaccttcaaggttgctgagactccacaagagagtgctgaggagatagaaacatatgcacgttacaaatatccaaccatgactaaaactcagggcaacttcaggcttcgtgtgattgagggtgaatttacagattctcagataattgttatgctgggcgagaatgggacggggaagacaacatttattcgtatgctggctggcctattgaaacctgatactgtagaagattctgatgtggagatacctgagtttaatgtttcttacaagccccagaagatcagtcctaagttccaatctactgttagacacttgctacatcaaaaaattcgtgattcttatacacatcctcagtttgtgtcagatgtcatgaaaccactgcttatagaacaactaatggatcaagaagtagtgaatctatctggtggagagttgcaaagagttgctttatgcctctgtcttgggaagcctgcagacatttatctgatagatgaaccaagtgcttatctagattctgagcagcgtattgttgcttcaaaagtcataaagaggtttatccttcacgcgaagaaaactgcattcgtggtagagcatgattttataatggcaacttacctggctgatagagttattgtatatgagggaaggccatctatagattgtacagcaaattcgcctcagtccttgttgactggaatgaatctcttcttatcacatctagatatcacttttaggcgggacccaaccaattatcgaccaagaatcaacaagttagactctaccaaggatagagagcagaagtctgctgggtcatattattacctggatgattgatgtaattattggcagttttacatagttttgactctggccaaaatgcacgccctctcaggtagtatcctgagatatgcttacgtttttgctaaccagagacgttggcaaaggttttcatttgatttgctgtttttagatatgcagaatttgatggcatcattctgattagttttgcatctaggccgagttgttctaatagttgacaaatgaatggatgtcttccggctgttgaagaaataaacgtctatttattttgcc

SEQ ID NO: 4737 - DNA, 2355 bp, Ricinus communis
ctctttcgtcagatcaacagcttaaaatcttagttaaggaggcgaggtattcatctcctacatcacagaccagtctttgatcgtagagaccatattcagcacctccttctcatctcttctccatttcctgaagctactcaggctgtgctttgtgtttgggtaggtagaaaggtgtggtagagatggcagacaggttgacacgtatagcgattgtgagctctgacagatgcaagccgaagaagtgccgtcaagagtgcaagaagagctgccctgttgtcaaaactgggaaattatgtattgaggttactgttgcatctaagatagctttcatctctgaggagttgtgcattggatgtggtatttgtgttaagaaatgcccatttgaagcactacagatcatcaacttgcccaaagatcttgataaagatacaacccaccgttatgggcccaacacctttaaattgcacaggctgccagtcccaaggcctgggcaagttcttggcttggttggaacaaatggcattgggaagtccacagccctcaaagttttggctggaaaactgaaaccaaatttgggtcgtttcaataatcctccagattggcaggaaatcttgacctactttcgaggatctgagttgcagaattattttacccgtatcctggaagataatctgaaggccatcataaagcctcagtatgttgatcacattccaaaagcagtccaaggcaatgtagggcaggtgcttgaccaaaaagatgaaagagagatgaaagctgaactttgtcatgatcttgagctgaaccaggttatagatcgtaatgtgggggacttgtctggtggggagctccaacggtttgctattgctgttgttgccatacagaatgctgaaatatatatgtttgatgaaccatcaagttatcttgatgtgaagcagaggcttaaagctgcccaagtcataagatctttgctcaggcccaacagctatgtaattgtggtggagcatgatcttagtgttctggattacttgtccgacttcatttgttgcttatatgggaaaccgggtgcatatggagttgtaactcttcccttctctgttagggaaggaatcaatattttcttggctggatttgtccccacagagaatctacgattccgggatgaatctttaaccttcaaggttgctgagactccacaagagagtgctgaggagattgaaacatatgcacgatataaatatcctactatgaccaaaactcagggcaactttaagcttcgtgtggttgagggtgaatttacagattctcagattattgtaatgctgggtgagaatgggacggggaagacaacctttattcgtatgctggctggtttactaaaacctgatagtgtggaaggttctgatgttgaaatacccgagtttaatgtttcttataagccccagaaaatcagtcctaagttccagtctactgttagacacttgctacatcaaaaaatccgtgattcatatatgcatcctcagtttgtatcagatgtcatgaagccactgcttatagagcagctaatggatcaagaagtggtgaatctctctggtggggagttgcaaagggttgctttgtgtctctgccttggaaagcctgcagacatttatctaatcgatgaaccgagtgcatatctggattctgaacagcgtattgttgcttctaaagtcattaagaggtttatccttcatgcgaagaaaactgctttcgtggtagagcatgattttataatggcaacttaccttgctgatagagttattgtatacgaggggaggccttctgtagattgtactgcaaattctcctcagtcattgctaactggaatgaatctgttcttatctcatctggacatcacatttaggcgggatccaactaattaccgaccaagaatcaataaattggactcaaccaaggacagagaacagaaagctgctgggtcatactattacctggatgattgatgcaattattggcagagtttacataattctccttgccagtctttctttgagaatttaagagcgccattctgaacaattttgcaactcagcaaattatcatacattggcaaatgactagttgcctcctgtccggtgaagaagtaacatttatcttttatgtaaatgagctgcagcagaccatttacaatgttgcttcaccatgttttctgatatatcatgttagttcatttttcttgataatgacatcagggccggtctttaaattttatttgaatgtgagtctgtatttaactagtgccgaaattagaggaagaaaggtattgagctgagttatcgaggtgcagttttgtctttt

SEQ ID NO: 4738 - DNA, 2277 bp, Citrullus lanatus
ctgtaattctgtgcagtgattagatggcggatcgattgacgcgtatagctatagtgagttcggataggtgcaagcctaaaaagtgccgtcaggaatgcaagaagagctgtcccgttgttaagactggtaaactgtgtattgaggttaccccagcctctaagatcgcttttatctcagaagaactctgtattggatgtggtatctgtgttaagaaatgcccatttgaagcaattcaaatcatcaatctgccaaaggatttggataaagatacaacacatcgatatggccccaataccttcaaattgcacaggctgccagttcctcggcctggacaagttcttggtttggttggaaccaatggtattgggaagtccactgcactgaaagttttggctggaaagctgaaaccaaatcttggtcgtttcaataaccctccagattggcaggagatattgacttactttcggggatctgagttgcagaattattttacacgtatccttgaagataatctaaaggcaatcataaagccccaatatgttgatcacattccgaaagcagttcaagggaatgttggccaggtgctagagcaaaaagatgagagggatatgaaacaagaactctgtcgtgatcttgaacttaaccaggttatagatcgtaatgttggtgatctgtctggtggagaacttcaaagatttgccattgctgttgttgccatacaaaatgcagagatatatatgttcgatgaaccctcaagttaccttgatgtgaaacagagacttaaagctgcgcaagttattcgatctttgctcaggcccaatagctatgtaattgttgtggagcacgatcttagtgtcttggattacttatctgacttcatttgctgtctttatgggaaaccgggtgcttatggagtcgtaacccttcccttctcggttagagaagggatcaatatcttcttggctggatttgttcccacagaaaatctacgatttagagatgaatctcttacattcaaggttgctgagactcctcaggaaagtgcggaggaaattgaaacatatgcgcgatataaatatccaaccatgagtaaaactcagggaaatttcaagctccgtgtgatagaaggtgaatttactgattcacagattattgtgatgctcggtgaaaatggaacagggaagacaacatttattcgtatgctggctggtttgttgaaaccagattctgtcgaaggctctgatattgagattcctgagtttaatgtttcctacaagccccagaagatcagtcccaagtttcaatccactgttaggcacttgttacaccagaaaataagggagtcctatatgcatccccaatttgtttccgacgtaatgaaacccttgcttattgaacaattaatggaccaggaagtcgtgaatctttctggaggagagttgcagagagttgcattgtgcctctgccttggaaagcctgcagatatttatctgatagatgaaccaagtgcttaccttgactctgagcagcgtattgttgcttcaaaagtcatcaagagatttattcttcatgcaaaaaagactgcctttgtggtcgaacacgattttattatggcaacttatctcgcagatcgggttattgtatacgagggtcagccatcagttgattgtactgctaattgtcctcagtcgctgttgactggaatgaatctcttcttatcccatctcgatattacgtttagaagagatccaacaaattacaggccaaggattaataaggtcgactcagcaaaggatagggagcaaaagtcagccggctcatactattacttggatgattaagaattttgtaggtagcagatgctggtggtttattaacctatagagagcacttctgaagcgaaatcgttgaatcttcatctttgaaagaggtgcaaaaggggaggatgttttcattttgtggaatctgtgtttttggcttattgctttaatttaaagaaagcagggcatgcacgttcttgattctgccatgtagaatatttctcttatgacctgctttagcaaaattcaacagttttctcagccatcataaggcaagtcgttgtctgaatgtcgttcgcttttttgtcctcctgctcctaaaaaattgtatttgattattagatttgcaaaacattttgaggaacaaatagtattttgcacattttagattttgtaatgcggcaatttctttcgctcaagttttagaggaatgagtagattttgttatattacaaga

SEQ ID NO: 4739 - DNA, 2276 bp, Musa acuminata
ggtcgacgctaggctctcgtcctctccaacatggcggatcggctgacccgtatcgctatcgttagctccgaccgatgcaagccgaagaagtgccgccaagagtgcaagaagagctgccccgtcgtgaaaacaggaaagctttgcatagaagtaacccctgcctcaaaacttgctttcatttctgaggagttatgcattggatgtggtatatgtgtcaagaaatgtccatttgaggccattcagatcatcaatctaccgaaggacttggacaaagatacaactcaccgttatggaccaaatacatttaaattgcacagattgccagttccaagacccggacaagttctgggcctggttggtacaaatggtattggaaagtccactgcgcttaaagtgttggccgggaagttaaagcccaacttgggtcgattcaataatcctcctgattggcaggagatcttgacatatttccgtggctctgagcttcagaattattttactcgtatactggaggacaatctaaaggcaatcatcaagccacagtatgttgatcacattccaaaagctgttcaagggaatgtgggacaggtgcttgaccaaaaggatgagagggagaagaaggcacaactatgtgctgacttagaattaaatcaagttattgatcgaaatgtgggggatttatctggtggagagttgcaaagatttgctattgctgtggttgctatacaaaatgcagagatttatatgttcgatgaaccgtcaagttatcttgatgtgaaacagcggctcaaagcagcacaagttgtccgttccctgctcagacctaacagctatgtgattgttgtggagcatgacctcagtgtactggactatttgtccgatttcatttgttgcttatatgggaagccaggagcttatggagttgttacattgcctttctctgtacgtgaaggaataaacatttttttggctggttttgttcctacagaaaatttgcggtttcgagatgagtcacttatgtttaaggttgctgagactcctcaagaaagtgctgaggagattcagacttatcaacgctatagatatccgactatgagtaaaacccaagggaatttcaagcttaaagtgatagagggtgaatttactgattctcaaatcattgtaatgctgggtgagaatgggaccgggaagacaacatttattagaatgctggcaggattgctgaagcctgatacggtggaagattctgatgttgagatgcctgaatttaatgtttcatataagcctcagaaaattagtccaaagtttcaatatacagtgagacacttgctgcatctaaaaattcgagattcatatatgcatccacaatttgtgactgatgttatgaaaccattgcaaattgagcaattaatggaccaagaagttgtgaatctttctggtggagaactgcaacgggtagcattgtgtttgtgtcttgggaagccggcagacatttatctgatagatgaaccaagtgcttatctagattcagagcagcgtattgttgcctcaaaggtgataaaaagatttatccttcatgcgaagaaaactgcctttgttgttgaacatgatttcatcatggcgacctacctggctgataaagtgattgtgtacgaggggaagccctctgtggattgcattgctaatgcacctcagtctttggtatccggcatgaacctgttcttatctcatcttgatatcactttcagacgagatccaactaattacaggcccaggataaacaagttggattctaccaaagatcgggaacagaaatctgcaggatcttattattatcttgatgattgatataaaattatgttgtgttatactcaggtttctacggccttgtgtgacgatggatgagtgttatttggcaagtagtaaagcttcttttcatgtttctttgttggatcccgaagatgaaaatgtggggcaaggagtcgaatccatgaaggcaacagaaattaccattcatggcccccttgtttcgacctgttagtccatgattgcttcttcagttgccacttatagaattactttagactttgcttcccttgtcactgggagcctatttttgaataacaaaaatcagttgtattttgatagtaatttacttttttgattgttgttgttggtatactgatgtcacccagtgatccttttcctcaaacatcatttggtgtatacgacatgttaaaggtatattttcttgtatcgagcaatatctgtcgggg

SEQ ID NO: 4740 - DNA, 2801 bp, Cocos nucifera
gttactccgacgccgtgtgggcatccccgtgcttttatactgcaattcccagggtttccatctcggcaaagcacgagcagcgagaggtatccacgcgcctcttcttccattcttctcacctcccattttagggttcgttcgtcgtagatttatctgacgccggatcctcatcttctttctgtgagcgtggttccgttgtggatcggcgcgagggcgatctgctcgtctagagtaggggagagcgatggcagatcgattgactcgtatcgccatagtcagctccgatcgctgcaagcccaagaagtgccgccaggagtgcaagaagagttgtcctgtcgtgaaaacaggaaaactttgtatagaagtcactcctgcatcaaaaattgctttcatttctgaggagttatgcattggatgcggtatctgtgtcaagaaatgcccttttgaggcaattcagattatcaacttaccaaaggatttagataaagatacaacccatcgctatggaccaaataccttcaagttgcacaggttacctgttccaagacccgggcaagtgttgggcctagttggaacaaatggtattgggaagtcgactgcccttaaggtgttggctgggaagttgaaacccaacctgggtcgatataataatcctcctgactggcaggaaattttgacttatttccgtggatctgagctccagaattactttacacgcattctggaggacaatctgaaggcaattattaagccccagtatgttgatcacattcccaaagctgtccaagggaatgtaggtcaggtgcttgaccaaaaagatgagagagatatgaaggctgaactgtgcattgatctcgagttaaatcaggttattgatcgtaatgtgggtgatttgtctggtggagagttgcagagatttgcgattgctgtagttgctatacaaaatgcagaaatttatatgtttgatgagccatcaagttatcttgatgtaaaacagaggcttaaagctgcacaagttgtacggtccttgctcaggcctaacagctatgtgattgtcgtggagcatgacctcagtgtcctagattacttatcagatttcatttgttgcttgtacgggaaaccgggagcttatggagttgttactctacctttttctgtccgagagggaattaacattttcttggctggttttgttcctacagaaaatctccgttttcgagatgaatctctcacattcaaggttgctgagactcctcaagagagtggtgaggatatccagacctaccaacgatacagataccctaccatgagtaaaacacagggtaatttcaagttatccgtgattgagggtgaatttactgattctcagatcattgtcatgctgggtgaaaatggaaccgggaagacaacatttatacggatgctggctggattgttaaagcctgatgtggtggaagatacagatgttgaaatacctgaattcaatgtttcatataagcctcaaaagatcagtccaaaatttcaatctactgtgagacacttgctgcatcaaaaaattcgagattcatacatgcatcctcagttcacaactgatgtcatgaaacctttgcaaattgagcaattaatggaccaagaagttgtaaatctttctggtggagagctgcaaagggtggcgttgtgtctctgtcttgggaagcctgcagacatttatctgatagatgaaccaagtgcttatcttgattcagagcagcgtattgttgccgcaaaggtgataaaaagatttatcctgcatgcaaagaaaactgctttcgttgttgagcatgatttcatcatggcgacttacttggccgacaaagttattgtatatgaggggagaccctctgtggattgtattgccaatgcacctcagtcattggtatctgggatgaaccgcttcttatctcatcttgatattacttttaggcgggatccaactaactacagacctcggataaacaagttggactccacgaaagatagggagcagaaagccgctggatcttattattaccttgatgattgacgtgacaatagattatacacaggctattttttcatcttcccactttctgtcagtgatgaagatgaatcggttgagaaagcattttgcagtgatacatgaagatccaccgtgacacgtgaagatctgccatgatgcgtgaaggccatcgaagtcatagtttctatctgatttgaaagctttaggttggagttctttcttcccctttttgcagttttttaatgttttatttcaatgttccacccaaaggaaaacactggatatcgctttagttcctacaatgaggctgttgagttttagaattgaggcagcttcgtataggttgcaatggccctgtttgatgccggagttccgccatcgtgttccctttgaagatcttgctggtggttaaacagttatctgcataaatattgattgatgcatgtggattcagagattatcgtggtatggtataaagcttttcatcaccttcagcaccgattgttctagtagcaagctttatcctggtttcatcatgttacctggattcttctttcgtactctgaattcttgttggtactggggtaaaaccatcaagttattgttggtttctgtgctctttgggtttcgaaatgatgaagtgagccattacatatgaatattttggttttttaaaaattccccccccccccccccccccccccccccccccccccccccccccccccccccccccccccccccccccccccccccccaagtc

SEQ ID NO: 4741 - DNA, 2300 bp, Cocos nucifera
tccttgacgccggagattcctttctttttatcacccaaccaagggttaggtcgtcgtggatttccttgacgccggagattcctttctttttgttctgtgaacagggttttgttttggatcggcacgtgggcgatctgctcttctacataggggtgagcgatggcggatcgattgactcgtatcgccatcgtcagctccgaccgctgcaagccaaagaagtgccgccaggagtgcaagaagagctgccctgtcgtgaaaacaggaaaactttgtatagaagtcacccctgcatcaaaaattgctttcatttctgaggagttatgcatcggatgtggtatctgtgtcaagaaatgtccttttgaggcaattcagattatcaacttaccaaaggatttagacaaagatacaacccatcgctatggaccaaataccttcaagttgcataggttacccgttccaagacctgggcaagtgttgggcctagttggaacaaatggtattgggaagtcgactgcccttaaggtgttggctgggaagttgaaacccaacttgggtcgatacaataatcctcctgattggcaggaaattttgacatatttccgaggatctgagctccagaattactttacacgcattctggaggacaatctgaaggcaattattaagccccagtatgttgatcacattcccaaagctgtccaagggaatgtaggtcaggtgcttgaccaaaaagatgagagagatatgaaggctgaactgtgcattgatctcgagttaaatcaggttattgatcgtaatgtgggtgatttgtctggtggagagttgcagagatttgcgattgctgtagttgctatacaaaatgcagaaatttatatgtttgatgagccatcaagttatcttgatgtaaaacagaggcttaaagcggcccaggtcattcgatctttgctcagacctaacagttatgtgattgttgtggagcatgacctaagtgtccttgattatttatcagattttatttgttgtttatatgggaagcctggagcttatggagttgtcaccttacctttctctgttagagaaggaatcaatattttcttggctggttttgttcctactgaaaatctaagattccgagatgaatcacttacatttaaggttgctgaggctcctcaagaaagtgctgaggaaattcaaacttaccagcgatataggtaccctaccatgagtaaaacccagggtggttttaaactttctgtgattgagggtgagttcactgattctcagattattgtgatgttgggagaaaatggaacagggaagacaacatttatccgcatgctggctggattgctgaagcctgattctgttgaagattcagatattgaaataccagagtttaatgtttcatataagccccagaagatcagtcctaaatttcaatctacagtgagacacttgctgcatcaaaaaattcgggattcatatatgcatcctcagttcacttctgatgtgatgaaacccttacaaattgaacaattaatggaccaagaagttgtaaacctctctggtggagagttgcaaagagtggcattatgtctatgtcttggaaagcctgccgatatttatctgattgatgaacctagtgcttacctcgactcagagcagcgtatcattgcctcaaaagtgataaagagatttattcttcatgcaaaaaagactgcctttattgtcgagcatgatttcatcatggcaacttacttggctgacaaagttattgtgtacgaggggaaaccatctgttaattgtactgccaatgctcctcagtcattggtatctgggatgaattgcttcttatcgcatcttgatattacttttagaagggatccaactaatttcaggccccggataaataagttgaactccaccaaagatagggaacagaaggctgctggatcctattactaccttgatgattgatgcaatatgtcagcaagtcctgctacttccaaagaatctgatacttgcgggtcctctccacctccgtttgcttgttgcatttgctgtctttttcttctccttcacaatcttaccccttcttggcaacgtctcgctgtagggtcttgcgtccctcatttgtctaatcatggaaacatgcgagtgcgggtagcaccacactaaagccttaaatactttattccatcacatcaaatagttacatccggcattgtggagcttgaaaaggttaaaagatctgctttgtgctttgtgctttgttcgaggaagttgagttcaaaaatagc

SEQ ID NO: 4742 - DNA, 2707 bp, Cocos nucifera
ccaagggttaggtcgtcgtggatttccttgacgccggagattcctttctttttgttctgtgaacagggttttgttttggatcggcacgtgggcgatctgctcttctacataggggtgagcgatggcggatcgattgactcgtatcgccatcgtcagctccgaccgctgcaagccaaagaagtgccgccaggagtgcaagaagagttgtcctgtcgtgaaaacaggaaaactttgtatagaagtcactcctgcatcaaaaattgctttcatttctgaggagttatgcatcggatgtggtatctgtgtcaagaaatgtccttttgaggcaattcagattatcaacttaccaaaggatttagataaagatacaacccatcgctatggaccaaataccttcaagttgcacaggttacctgttccaagacccgggcaagtgttgggcctagttggaacaaatggtattgggaagtcgactgcccttaaggtgttggctgggaagttgaaacccaacctgggtcgatataataatcctcctgactggcaggaaattttgacttatttccgtggatctgagctccagaattactttacacgcattctggaggacaatctgaaggcaattattaagccccagtatgttgatcacattcccaaagctgttcaagggaatgtcggccaggtgcttgaccagaaagatgagagagatatgaaggccaaactatgcattgatcttgagttgaatcaggttattgatcgtaatgtgggtgatttatctggtggagagttgcagcgatttgcaattgctgtggttgctatacaaaatgcggaaatttatatgtttgatgagccatcaagttatctggatgtaagacagaggcttaaagctgcacaagttattcggtccttgctcagagctaacagctatgtgattgttgtggagcatgaccttagtgtcctagattacttatcagatttcatttgttgcttgtacgggaagccaggagcttatggagttgttactctacctttctctgtccgagaaggaattaacattttcttggctggttttgttccaacagaaaatctccgttttcgagatgaatctctcacatttaaggttgctgagactcctcaagagagtgctgaggagatccagacataccaacgatacaaataccctaccatgagtaaaacccagggtaatttcaagttatctgtgattgagggtgaatttactgattctcagatcattgtcatgctgggtgaaaatggaacagggaagacaacatttattcggatgctggctggattattaaggcctgatgtggtggaaggtactgatgttgaaatacctgaattccatgtttcatataagcctcaaaagatcagtcccaaatttgaatctaccgtaagacacttgctgcatcaaaaaattcgagattcatacatgcatcctcagttcacaacggatgttatgaagcctctgcaaattgagcaattaatggaccaagaagttgtaaatctttctggtggagagctgcaaagggtggcattgtgtctctgtcttgggaagcctgcagacatatatctgatagatgaaccaagtgcttatctcgattcagagcagcgtattgtcgcctcaaaggtgataaaaaggtttatccttcatgcaaagaaaactgctttcgttgttgagcatgatttcatcatggctacctacttggctgacaaagttattgtgtatgaggggcaaccctctgtggactgtactgccaatgcacctcagtcattagtatctggcatgaatcgcttcttatctcaccttgatattacttttaggcgagatccaactaactacagacctcggataaataagttggattccacaaaagatagggagcagaaagctgctggatcttattattaccttgatgattaatgtgacaatagatgatatacaggctatttctctcagtgataaagatgggccgaatgagcaatctgccatgataatgaagatccaccgccatacatgaagacctggcatgatagatgaagatctgccttgatacaggaagatctgccatggtacatgaagaccaccagtgtcatttttctattttgattaagagctttaggtttcaggtttttcttcccctttctgctgtttatttatgttgccggactctgcaccccaaaggaaacattgggtattgctttagttcttctaatgacgctgagtttttagaaacagagcagcagctgcatataggttgcaatgatcctgcttgatggaggagtcatgccatgtctcagacatcatctaccctgtgaagatcttgctggtgtttaaacagttatccatgcaaatgttgatcattgcccgtggattcaagggttattttttgtagaatatctagatttccatctttctcaacagtgcttgttactggttaacatggacagcaagctttctcctggtttgatcatgttacatgggttcttgtttcttgtcctgaattcttgttggtgatggggaaaaattatttacttgtctattttgattttgaagaggttaccataactactagttatggtgctgggcaaactgcaccatgtttggaatattttcatcgtctgagctatactcactctttagtcatgattttggctgttaatacttgcaaaactcgtgagccaatcagcc

SEQ ID NO: 4743 - DNA, 2333 bp, Gossypium hirsutum
cgaagcacacgcctcctccctctttttctcctcctttttccataagctaaacaaacgcagctcgatcttcaaatccctacacctaataaatccatcggttttcgttttgtaaatccgacggagagatggcggatcgcttgacgcgtatcgcgattgtcagctccgaccgctgcaagcccaagaagtgccgtcaggaatgcaagaagagctgtcctgttgttaaaactgggaaactttgcattgaggttacccctgcctcaaagattgctttcatctctgaggagttgtgcattggttgtggtatctgtgtcaagaaatgcccatttgaagcaattcaaatcatcaacttaccaagggatttggataaagatacaacccatagatatggccccaatacttttaaactacacaggttaccagttccaaggcctgggcaagttcttggtctggttggaaccaatggcattggaaaatcaactgctcttaaagttttggctgggaagctaaagccaaacttgggtcgtttcaataatcctccagattggcaggaaatcttgacctactttcgaggatctgagttgcagaactattttacccgcatcttggaggataatctcaaggccatcatcaagccacagtatgttgatcatattccaaaggcagtccaaggcaatgtgggacaggtgcttgaccaaaaagatgagagagagatgaaggccgaactctgtgctgatcttgaactaaaccaggtcatagatcgtaatgttggggatttatcaggtggggagctccagagatttgctattgctgttgtcgccatacagaatgctgagatatatatgtttgatgagccttcaagttaccttgatgttaaacagagactgaaagcagcacaggtcattcgatctctgctcaggcctaatagctatgttattgtggtcgagcatgatcttagtgtcctggattacttgtcggatttcatttgctgcttgtatggaaaaccgggtgcatatggagtcgtaacccttcccttctctgtaagagagggaatcaatatcttcttggctggatttgtacctactgaaaatctaaggtttcgagatgaatctttgaccttcaaggtagctgagaccccacaggaaagtgctgaagaaattgaaacctatgcacgatacaaatacccaaccatgactaaaactcagggcaattttaaacttaaagttatggagggtgaatttactgattctcagattattgtaatgctgggtgagaatggtactgggaagaccacatttattcgtatgctggctggtttgttgaaacctgataacgtagaaggttcagatgtggagatacctgagtttaatgtttcatacaaacctcaaaagatcagtcccaaatttcaatctactgtccggcacttgctgcatcaaaagatacgtgattcatacatgcacccccagtttgtttcagatgtgatgaagcctcttctcattgagcaattaatggatcaggaagtggttaatctctctggaggagagctgcaaagagttgcattatgcttatgtcttggaaagccagcagatatttatctgatagatgaaccaagtgcttatctggactccgagcagcgtattgttgcttctaaagtcataaagaggtttatcctccatgcaaagaaaactgcgtttgtggtcgagcatgattttataatggcgacttacctcgcagatagagttattgtgtatgaggggaagccttcagtggattgtattgcaaactctcctcagtccttgttaactggcatgaatctgttcctatctcatctggacatcacttttaggcgggacccaaccaattaccgaccgagaatcaacaaactggactcaaccaaggatagagagcaaaagtctgctgggtcatattattacctagatgattgatcgacacatctactggcagttgtcaattgtgatgagatgaacaacaagacgtgaatgttgggtattcccgggatctctgagtggagcagtgatggtatgttgataagctgagaagaggtccgttgatggtatccatgaggtggcatgccatttgttttagaaaaatatttcaattatcctacagtgtgcttttctttatgttttagcaattttggttgatattttatgagtcagaggaatactgatactcctgttttatttacttttaagagcaaaggtatgctgttgacatgagagagctttgaattatccatgtagctagagaattattattattattattattacccttttactttaacaaagctaattgcttagtttaggtttaaa

SEQ ID NO: 4744 - DNA, 2420 bp, Gossypium raimondii
actaaaacagaagagaaaaccctaaaagtccctccacgtgcgttgcgtgtgctctacgctcacctcatctccgtcccgatcgaagcacacgcctcctccctctttttctcctcctttttccataagctaaacaaacgcagcccgatcttcaaatccctacacctaataaatccatcggttttcgttttgtaaatccgacggagagatggcggatcgcttgacgcgtatcgcgattgtcagctccgaccgctgcaagcccaagaagtgccgtcaggaatgcaagaagagctgtcctgttgttaaaactgggaaactttgcattgaggttacccctgcctcaaagattgctttcatctctgaggagttgtgcattggttgtggtatctgtgtcaagaaatgcccatttgaagcaattcaaatcatcaacttaccaagggatttggataaagatacaacccatagatatggccccaatacttttaaactacacaggttaccagttccaaggcctgggcaagttcttggtctggttggaaccaatggcattggaaaatcaactgctcttaaagttttggctgggaagctaaagccaaacttgggtcgattcaataatcctccagattggcaggaaatcttgacctactttcgaggatctgagttgcagaactattttacccgcatcttggaggataatctcaaggccatcatcaagccacagtatgttgatcatattccaaaggcagtccaaggcaatgtgggacaggtgcttgaccaaaaagatgagagagagatgaaggctgaactctgtgctgatcttgaactaaaccaggtcatagatcgtaatgttggggatttatcaggtggggagctccagagatttgctattgctgttgtcgccatacagaatgctgagatatatatgtttgatgagccttcaagttaccttgatgttaaacagagactgaaagcagcacaggtcattcgatctctgctcaggcctaatagctatgttattgtggtcgagcatgatcttagtgtcctggattacttgtcggatttcatttgctgcttgtatggaaaaccgggtgcatatggagtcgtaacccttcccttctctgtaagagagggaatcaatatcttcttggctggatttgtacctactgaaaatctaaggtttcgagatgaatctttgaccttcaaggtagctgagaccccacaggaaagtgctgaagaaattgaaacctatgcacgatacaaatacccaaccatgactaaaactcagggcaattttaaacttaaagttatggagggtgaatttactgattctcagattattgtaatgctgggtgagaatggtactgggaagaccacatttattcgtatgctggctggtttgttgaaacctgataacgtagaaggttcagatgtggagatacctgagtttaatgtttcatacaaacctcaaaagatcagtcccaaatttcaatctactgtccggcacttgctgcatcaaaagatacgtgattcatacatgcacccccagtttgtttcagatgtgatgaagcctcttctcattgagcaattaatggatcaggaagtggttaatctctctggaggagagttgcaaagagttgcattatgcttatgtcttggaaagccagcagatatttatctgatagatgaaccaagtgcttatctggactccgagcagcgtattgttgcttctaaagtcataaagaggtttatcctccatgcaaagaaaactgcgtttgtggtcgagcatgattttataatggcgacttacctcgcagatagagttattgtgtatgaggggaagccttcagtggattgtattgcaaactctcctcagtccttgttaactggcatgaatctgttcctatctcatctggacatcacttttaggcgggacccaaccaattaccgaccgagaatcaacaaactggactcaaccaaggatagagagcaaaagtctgctgggtcatattattacctagatgattgatcgacacatctactggcagttgccaattgtgatgagttgaacaacaagacgtgaatgtggggaattcccgggatctctgagtggagttgtgatggtatgttgatgataagctgagaagaggtccgttgatggtatccatgaggtggcatgccatttgttttagaaaaatatttcaattatcctacagtgtgcttttctttatgttttagcaattttggttgatattttatgagtcagaggaatactgatactcctgttttatttacttttaagagcaaaggtatgctgttgacatgagagagctttgaattatccatgtagctagcgaattattattattattattattattattacccttttactttaacaaggctaattgcttagtttaggttta

SEQ ID NO: 4745 - DNA, 2503 bp, Elaeis guineensis
agcgatggcggatcgattgactcgtatcgccatcgtcagctccgatcgctgcaagccaaagaagtgccgccaggagtgcaagaagagctgccctgtcgtgaaaacaggaaaactttgtatagaagtcactcctgcatcaaaaattgctttcatttctgaggagttatgcatcggatgtggtatctgcgtcaagaaatgtccttttgaggcaattcagattatcaacttaccaaaggatttagacaaagatacaacccatcgctatggaccaaataccttcaagttgcataggttacctgttccaagacctgggcaagtgttgggcctggttggaacaaatggcattgggaagtcgactgcccttaaggtgttggctgggaagttgaaacccaacttgggtcgatataataatcctcctgactggcaggaaattttgacatatttccggggatctgagctccagaattactttacacgcattctggaggacaatctaaaggcaattattaagccccagtatgttgatcatattcccaaagctgttcaagggaatgtcggccaggtgcttgaccagaaagatgagagagatatgaaggctaaactatgcattgatctcgagttgaatcaggttattgatcgtaatgtgggtgatttatctggtggagagttgcagcgatttgcaattgctgtggttgctatacaaaatgcagaaatttatatgtttgatgagccatcaagttatcttgatgtgaaacagaggcttaaagctgcacaggttgttcggtccttgctcagacctaacagctatgtgattgttgtggagcacgacctcagtgtcctagattacttatcagatttcatttgttgcttgtacgggaagccgggagcttatggagttgttactctacctttttctgtccgagaaggaatcaacattttcttggctggttttgttccaacagaaaatctccgatttcgagatgaatcgctcatatttaaggttgctgagactcctcaagagagtgctgaggagatccagacataccaacgatacaaataccctaccatgagtaaaacccagggtaacttcaagttatctgtgatcgagggtgaatttactgattctcagatcattgtcatgctgggtgaaaatggaacagggaagacaacatttattcggatgctggctggattattaaggcctgatgtggtggaagatacagatgttgaaatacctgaattcaatgtttcatacaagcctcaaaagatcagtccaaaatttcaatctactgtaagacacttgctgcatcaaaaaattcgggattcatacatgcatcctcagttcacaacggatgtcatgaagcctctgcaaattgagcaattaatggaccaagaagttgtaaatctttctggtggagagctgcaaagggtggcattgtgtctctgtcttgggaagcctgcagacatatatctgatagatgaaccaagtgcttatctcgattcagagcagcgtattgttgcctcaaaggtgataaaaaggtttatcctccatgcaaagaaaactgctttcgttgttgagcatgatttcatcatggctacctacttggctgacaaagttattgtgtatgaggggcaagcctctgtggactgtactgccaatgcacctcagtcattagtatctggcatgaaccgcttcttatctcaccttgatattacttttaggcgagatccaactaactacagacctcggataaataagttggattctacaaaagatagggagcagaaagctgctggatcttattattaccttgatgattaatgtgacaatagatgatatagaggctatttctctggtgataaagatgaatgggctgaatgagcaatctgccatgataacgaagatccaccgcgatacatgaagatctgccttgatacaggaagatctgccatggtacatgaagactaccagcgttatttttctattttgattaagagctttaggttttaggttttttcccccctttctgctgttcattgatgttgccccaccctccaccccaaaggaaacattggatattgctttagtccttctaatgaggcttgagtttttagaaacggagcagcagctgcatataggttgcaatgatcctgcttgatggtggggttatgccatgtctcagacatcatctaccctgtgaagatcttgctggtgtttaaatagttatctatgcaaatgttgatcattgcacatggattcaagagttatttttcgtagaatatctagaattccatctttctcaacagtgcttgttgctggttgacagcaagctttctcccggttcaattatgttacgtgggttcttgtttcttgccctgaattcgtgttggtcatggggtaaaattatttatttatctattttgattttgaagaggttaccataactactagttatggtgctgggcaaactgcaccatgttctcaatatttatatcatctgag

SEQ ID NO: 4746 - DNA, 2321 bp, Fagus grandifolia
agccaaaatcaaggcgatacgaggggaggcgacacacgccgagtcaccgctacgcacgatcggcagctcagaaaagccaggagagctctcaatttcactcctagttagagaagagaagagataaatagagatgtcggaacgattgacgcgtattgcgatagtgagctcagacaggtgcaagcccaagaagtgccgccaggaatgcaaaaaaagctgccctgttgtcaaaactggaaagctctgtattgaggttacccctgcatccaagattgctttcatctctgaggaattgtgtattggatgtggtatctgtgtcaagaaatgcccatttgaagctattcagatcatcaacttgccaaaagatttggacaaagatacaacccatcgctatggccctaacacttttaaattgcacaggttaccagtcccgagacctgggcaagttcttggcttggttggaactaatggcattgggaagtctactgccctcaaagttttggctggaaaactgaaaccaaacctgggtcgcttcaaaaatcctccagattggcaggaaatcttgacacacttccgaggatcagagctgcagaattattttactcgtattcttgaagataatttgaaggcgattataaagccccagtatgttgatcacatcccaaaagcagttcaaggaaatgtagggcaggtcttggaccaaaaggatgagagagacatgaagtcggaactttgcgctgatcttgagctgaaccaggttatagaccgtaatgtaggggatttatcaggaggagagcttcagagatttgctattgctgtcgttgctgtacagaatgcagagatatatatgtttgatgaaccttcaagttaccttgatgtaaaacagaggctaaaagctgctcaagttgtccgatctttgctcaggcctaatagctatgtaattgttgtggagcatgatcttagcgtcctggattacttgtcggacttcatttgttgtttatatgggaagccgggagcatatggagttgtaacacttcccttctcagtcagagaaggaatcaatatcttcttggctggatttgttccaacagaaaatttacgtttccgggatgaatctcttacctttaaggttgctgagactccacaggaaagcgcggaggaaattgagacatatgcacgatacaaatacccaactatgaccaaaactcaaggaaattttaggcttcgcgttgttgagggtgaatttactgattctcagattgtcgtgatgctgggtgagaatgggactggaaaaactacatttatccgtatgctggctggtttactgaaacctgatagtgtagaaggtactgatgtggagatacctgagtttaatgtttcttacaagccccagaagatcagtccaagatttcaatctactgtcaggagcttgctacatcaaaaaatacgtgattcatacatgcatcctcaatttatgtcggatgttatgaagcctcttcttattgaacaattaatggatcaagaagttgtgaatctttctggtggagagttgcaaagagttgcattatgtctatgccttgggaagcctgcagacatttatctgatagatgaaccaagtgcatatctggattctgagcagcgtatagtagcttcaaaagtcataaagagatttatccttcatgcaaagaaaactgctttcgtggttgaacatgattttataatggcaacttatttggcagatagagttatcgtgtatgaggggcagccatcaattgactgtagtgcaaattctccccagtcattgttgactgggatgaatctcttcttatctcatctggatatcacatttagaagggacccaactaatttccgcccgagaatcaacaaactggagtcaaccaaggacagggagcagaaatctgctgggtcctattattacctggatgactgacaattttaaatagttgattctatttcaaagtttaagggcattggtgtgagcaatgggatctcggcgagttatgttgacatatgacaagatgtccttcgcctattgaaggctacatgttgggcttcttgcttaaaatgagttttcaggccatgttatttattgatgccagtttagtatttcttctactatagtgtgcttgctgttcaccagttttggtacgacattaggtcagtgaatctttatacaacttggtctcttgcggcatcaacggttgtatttaactagttgaggaacaaccaaaacgatgtcaactgagttattgctttacgtgtttgacctttgtaatttctggggtaatatataacaattccac

SEQ ID NO: 4747 - DNA, 2231 bp, Panax ginseng
cgcagttcgcaccacacgccactctccctcttcaattttttccagagatggcggatcgattgacgcgaattgcaattgtgagttctgatcggtgtaagccgaaaaagtgtcggcaggaatgcaaaaagagttgccctgttgttaaaactggtaaactatgtattgaggtcactcctgcagccaaaattgctttcatctctgaggaattgtgcattggatgcggtatatgtgttaagaaatgcccatttgaagcaattcagataattaatctacccaaagatttggataaggataccactcaccgttatggccccaacaccttcaaattacacaggttaccagttccgaggccagggcaggttcttggcttggttgggacaaatggcattgggaagtcgactgcccttaaagttctggctggaaaattgaaacctaatctgggtcgtttcaataaccctcctgattggcaagaaattttgacatactttcgaggatctgagttgcagaattatttcacccgtattttggaagataatttgaaggcaatcatcaagccacaatatgttgaccacattccgaaagcagtccaaggaaatgttgggcaagtgctggaccaaaaagatgagagggacatgaaagcagaactttgttttgaccttgaactgaatcaggttatagatcgtaatgtgggagacttatctggcggggagcttcagaggtttgctattgctgttgtagccatacagaatgcagagatatatatgtttgacgaaccctcgagttatcttgatgtgaagcaaaggcttaaagcagcccaagttattcgatctttactcaggcctaatagctatgtaattgttgttgagcatgacctaagcgtcctggattacttatcagatttcatttgctgcctatatggaaagcctggtgcatatggagttgtaacacttccattttctgttagagaaggaattaatatattcttggctggttttgttccgacagaaaatcttcgttttcgggacgaatctcttacttttaaggttgctgagactccacaagaaagtgctgaggaaatagaaacatatgcacgatacagatatccaactatgagtaaaacccaaggtgggttcaagcttaaggtgatggaaggtgaatttactgattctcagatcgttgtaatgctgggtgagaatggaaccggaaagacgaccttcatccggacgctggctggtttattgaagccagatacggtagaaggctctgatgtggagatacctgagttcaatgtatcttacaagccccagaagatcagtccaaaatttcaaaatacagttcgtcacttattacattcaaaaattcgtgattcatatatgcatcctcagtttgtatcagatgtaatgaagcctcttctaattgagcaactgatggatcaagaagttgtgaatctttctggaggggagttgcaaagagttgcattatgtctatgccttggcaagcctgcggatatttatttgattgatgaaccaagtgcatatcttgactctgagcaacgtattgttgcgtctaaagtaataaagcggtttatactccatgcaaagaaaactgcatttgtggttgaacatgacttcataatggcaacatatctggcagacagagtcatagtgtatgaggggaagccatcaattgattgtattgcaaatgctcctcagtcattattgactggaatgaatcttttcttatctcatctgaacatcacatttaggcgcgaccctactaattttcggcctagaatcaacaaactggaatcagccaaggacagggagcagaaatcagctggatcctattattacctggatgattaaataaattatgtttattgactgttgcttgacatccaaactagcgctcctgctatatctccgatgatgtcaatgtctttatcatctccatgtctttttgacataatgatcacatcataaggccttcagcattgggaagaggtcagttttgcattgattgaatgagtgcatatttgagatggtagtttgaccataatgttaccttatctatgttgtaagctttctttcacagattttgaccttgttgggtgagcgaattcataggttttttctgcctgtagtttgatgttataaaattaatgaagtgaggtgtaactatatatttgatcacattgtcatcttcagcctcactccttgaaaaaaattccc

SEQ ID NO: 4748 - DNA, 2837 bp, Sesamum indicum
aaaagaaaaaggggaaaaagggtttgtttattctgtgtagttggaaccctagcacctcgcaccagtactctcttttgcgcgtatccaccgttacatcatcaccgcctccgccctctccgaatctctcatcccccagttgaattgagagagatggcggatcagaagctgacgcgtatcgctatagtgagctcagacaagtgcaagccgaaaaaatgtcgtcaggagtgcaaaaagagttgccctgttgtcaaaacaggtaaactttgcattgaggtgactcctgcatccaaaattgctttcatctcagaggaattgtgcattggatgtggtatctgtgtgaagaaatgcccatttgaagcaatccagattatcaatctaccaaaagacttggataaggatacgactcatcgttatggtcctaacaccttcaagttgcatagattacctgttcctcgacctggccaagttcttggcttggttggtactaatggaattggaaaatcgactgcgcttaaagtgttggctggaaaacttaaacctaacttgggacgctttaataatcctcctgactggcaggaaattttgacctacttccggggatcggagctgcaaaattacttcactcgtattcttgaagataacttgaaggcaatcatcaagccccagtacgttgatcacatcccaaaagctgttcaaggcaatgttgggcaagttcttgaacagaaagatgaaagagatatgaaaggggaacttggtgtcgatcttgagttgaatcaggttatggaccggaatgtgggagatttatctggtggagagcttcagagatttgctatagctgttgtagccgtacagaatgcagagatctatatgtttgatgagccttcgagttatcttgatgtgaaacagaggctcaaagctgctcaagttattagatccttgcttcggcctaatagctacgtgattgtcgtggagcatgatctgagtgtgcttgattatttatctgacttcatctgctgcctttatggaaaacctggtgtctatggggtggtaacccttccattctctgtcagagaaggaattaatatatttctggctggatttgtccccaccgagaatctaaggtttcgggatgaatctcttacgtttaaggttgctgagactccccaagaaagtgcggaggaaattgagacttatgcaagatacaaatatccaaccatgactaaaactcagggcaacttcaaacttaaggtcatggaaggtgaattcacagattcccaaataattgtgatgcttggtgaaaatgggacaggcaaaacgacatttataaggatgctggctggtcttttaaagcctgattcagtagaaggatctgatgtggaaatacctgagttcaacgtctcttacaagccacagaaaatcagtcctaaatttcagtctactgttcgaatgctgttacatcaaaaaattcgtgactcttatatgcatcctcagtttgtatcagacgtgatgaagcctctgctgattgagcaattaatggatcaagaggttgtgaatctttctggtggagaattgcaaagagttgccctgactctttgtcttggaaagcctgctgacatatatttaatagatgaacctagtgcatatctcgactctgagcagcgtattgttgcttcaaaagtcataaagagatttatacttcatgcaaaaaagactgcatttgttgttgagcatgactttataatggcaacataccttgcggatagggtgattgtgtacgaggggaagccatccatagattgtgtggccaactcacctcaatcattgctgactggaatgaatctgttcttatctcacctggatataacattcagaagagatccaacaaattaccgtcccagaatcaataaattggactcaaccaaggaccgggagcagaagtctgctgggtcttattattatttggatgactaatgtgattgttaacaggctacgaatgctcctcagttagtttcaccagcacctggaccttaagtgaaagctgctaccttgccgttggtgctgtctgtactgaagaaagtgtttctcattttggttgtcgaagttgagggttaatttgatgaatggggtctggtttacatggtgaaccaagtgtggttgctgacggcattatgaacattatcaccggctatggataagccttgctagttggcttcgagcaggatgtttttgttcaccagttttggccgttttagatgaattgtagctgaggatgtctttttggttcttcgttatgagcatatcaaccattataccttattttatcatttgttattggcggaaaaatattgtttacatttatcatatggaaaaggacgaggtgagttatgtaaatttctgtgtattgctttggcagtttgattgttggccgtccaactttattaagtgaggggagagttttatgcttatagccaatgataacaaaaacagctagtgtggcttcttgatgaacgggagaattgactgttcccccggtgaatacgattgggtgttacgaatgtgaagtcttagacatgaaaacagagatgcttttggtgaatattggtttccttcgtgtgcatgttgctgcgccactgtgatctttcaactggttttggagtatcatattgttcattgagaacaaacaagaattacataaaaagggttctggtgcaagatatgtatgatgtgatctttgtagtatttgaatttacagaatcaatgtctgtctttgcgcagttttaagtctatttaatttggtgaccatgacgagcggcccttaaaactgcgcaaagacagac

SEQ ID NO: 4749 - DNA, 2420 bp, Tabernaemontana elegans
agccatcagcccttgcgcgtgtccaacatacacggtgtccctttgcactttttggttgttctctcacgtctttgttgcgaagaacaccggtacgcactcaaagcacacgcctctctccggttcttcccaaatcaatcgtcctaggagagagatggcggatcagaggttgacgcgtatagcaattgtgagttcggacaagtgtaagccgaagaagtgccggcaggagtgtaagaagagttgtccggtcgtcaaaactgggaaactttgtattgaggtgactcctggatccaagattgcttttatctcagaagaattgtgcattggttgcggtatttgtgttaagaaatgcccatttgaagcaattcagattatcaatttacctaaagatttggacaaggatacaacccatcgttatggtccaaataccttcaaattgcataggttaccagtcccaagaccaggacaggttcttggcctggttggaacgaatggcattgggaagtcaactgccctcaaagttctggctggcaaattgaaacctaatttggggcgctttaataacccccctgattggcaagagatcttgacttatttccgtgggtcagaacttcagaactattttactcgtattctggaagataacttaaaggcaatcatcaagccacagtatgttgatcacatccccaaggctgtccaaggcaatgttggtcaggtgttggatcaaaaggatgagagagagatgaaacaagaactttgtgttgatcttgagctgaatcaggttttggaccgtaacgtaggggatttatctggtggagagctccagagatttgccatagcagttgtggcaatacaaaatgctgaaatctatatgtttgatgaaccctcaagttaccttgatgtgaaacagaggcttaaagctgctcaagttgtccgttcattgcttcgtcctaatagttatgtaatcgtggtggagcatgatctcagtgttctggattatttatcagacttcatttgctgtctatatgggaagcctggtgcatatggtgttgtaacccttccattctctgtcagagaaggaattaatatatttttggctggatttgtccctacagaaaatctgcgatttagggatgaatcacttacttttaaggttgcagagactccacaggagagtgctgaggaaattgaaacatatgcacgttataaatatccaaccatgacaaaaactcagggcaatttcaagcttaaagttatggagggtgaattcactgattctcagatagttgtaatgcttggtgagaatgggactggcaaaacaacattcatccggatgctggctggtttactaaaacctgatttggttgagggctctgatgtggagatccctgagtttaatgtctcgtacaaaccacagaagatcagtccaaaatttcagtctactgtgaggcacttgcttcatcaaaaaatacgtgattcatatactcaccctcagtttatatcagatgttatgaagcctctccagattgagcaattaatggatcaagaagttgtgaatctctctggtggagagttacaaagggttgccctagcactatgccttggaaagccagctgatatatatctgattgatgaaccaagtgcttatctggactcagagcagcgtattgtggcttcaaaggtcataaagagatttatacttcacgcaaagaagacagcatttgttgttgagcatgacttcataatggcaacatacctggctgatcgggttattgtatacgaggggaggccatctgtagattgtgtggcaaatgcacctcaatcattgttgactggaatgaacttattcttatctcatctggatattacgttcagaagggacccaactaattaccgtccaagaatcaacaagctggactcaaccaaggacagggagcaaaagtctgctggatcctattactacctggatgattaacttgttagttgacaaggttgtagctggcttccttgatcacacctctctctgtatccaacaaattatcaggagctgacctttccttaggcggtattttggtgagagggtgaatgatatttgctagtcgtgtccttgatgtgacgacatgacccaacagcaagttcttttttggcgtcaagatctttatttatgcagggcgacaaatactggcgcccttggcttggcggaatgatcctttttactgcttctcgagcacttttcccatggcttaatatggtttactttagtaaatgcctttcttagccagttttggccttgttggctgagtagctattgaggatttctttttgtctaatgacatcacggtatcttgtgttgtatctttgatttgacgtaagaaccctaaacgaaagataagtaatagaattgaggctattgtagtggaatt

SEQ ID NO: 4750 - DNA, 2347 bp, Olea europaea
cctgccacacgcctctctgattttctctccatttccttctctatacagtttacagttttccattaatcggaaaaaggcaacggagaaagatgtcggatcagaagttgacgcgtatcgctatagtgagctccgacaagtgcaagccgaaaaagtgccgtcaggagtgtaaaaagagctgccctgttgtcaaaactggtaagctttgcattgaggttactgctgcctccaaaatagcattcatctcggaggagttgtgcattggatgtggtatatgtgttaagaaatgtccatttgaagccatccagatcatcaatctaccgaaagacttggataaggatactacccatcgttatggtccaaatacctttaaattgcacaggttacctgtcccaagacctggacaagtacttggcttggttggaacgaatggcattggaaaatcaacggctcttaaagttttggctggaaaattgaaacctaatttggggcgtttcaataaccctcctgattggcaagagatcttgacttacttccgaggatctgagctgcagaattactttactcgcattctggaagataatttgaaggcaatcatcaagcctcagtacgttgatcacattccaaaagctgtccaaggcaatgttggccaagtgctagagcagaaagatgagagagatatgaaagcagaactttgttttgatcttgagctgaatcaggtcatggaacgtaatgtaggagatttatctggtggtgagcttcagaggtttgctattgctgttgtcgcaatacagaatgcagagatttatatgtttgatgagccttcaagttatcttgatgtgagacagaggcttaaagctgcccaggttatcagatctttgctccgggctaatagctatgtaattgtcgtagagcacgatctcagtgtgctggattacttatcagacttcatttgctgcctttatggcaagcctggtgcatacggggttgttactcttccgttctctgtcagagaaggaattaatattttttggctgggtttgtccccacagaaaatctaagatttcgggatgaatctcttactttcaaggttgctgagacaccacaagaaagtgctgaggaaattgaaacatatgcacgatataagtacccaacaatgactaaaacccagggcaatttcaaacttaaggttgtcgagggtgaatttactgattctcagatcattgttatgcttggtgagaatgggacaggaaagacaacatttatccgtatgctggctggtctattgagacctgatactgtagaagactctgatgtggagatacctgagttcaatgtctcttacaagccacagaaaatcagcccaaagtttcaaaatagtgtcaggcacctgctacatcaaaaaattcgtgattcatatatgcatcctcagtttgtgtctgatgttatgaagccactccaaattgagcagctaatggatcaagaggttgtgaatctctctggtggagagttgcagagagttgccttgaccctatgccttggaaagcctgccgacatatatttgatagatgagccaagtgcatatctcgactctgagcagcgtatagttgcttctaaagtcataaagaggttcatacttcatgcaaagaaaacagcatttgtggtcgagcatgacttcataatggcaacatacctggcagatagagtgatcgtgtatgaggggaagccatcaatagattgtactgccaattcaccccaatcattattgagtgggatgaacctattcttatctcaattggacattacatttagacgagacccaacaaattaccgcccaagaatcaacaaactggattcaaccaaggacagggagcagaagtctgctggatcttattattaccttgatgattaactcaattatcaacgtagttagcttgcgggattacccttttcaacctagatgtcgagacaagctgcacccgtcccataggtgccaattcttgaaaataaaagggcttcatactacacgtgacgtgatggattatgtcagtcaacaagagggcttttcgtaccgaagtagttattactgcgtttcaacaatagatccgtttgctcggtgaagtgacgatttttgttactgtattcatatatttactagctggctgtgattgggattcgtttctcatattttctttggactatttatgttgtgtgagtttcactagaaggattttgttctttatgatataattattttgactgggactatcgcttttgcttggattggatattatgcgaactaagaacagcgaggtagatttttgaataagaatgtttggctgttctttaa

SEQ ID NO: 4751 - DNA, 2681 bp, Cocos nucifera
atcatacttacgcgcgaaaggtacatcttccatctcggcgctagggtttcctttccgttctccaaagtaacggcggaggtatttgctttcctgcccgttctcacgctagccagtttggtcttcgaatctcttcccttcttctgtccgatcggtttgtagggttttgcttcgaagaggcggaagggtttaggctttgtcgatcgaagtctctgaaggaagagatggcggatcgattgactcgtatcgccatcgtcagctccgatcggtgcaagcccaagaagtgccgccaagagtgcaagaagagctgtcccgtcgtcaaaacaggaaaactttgtattgaggtcactcctgcatcaaagattgctttcatttcagaggagttatgcattggatgtggaatttgtgttaagaaatgccctttcgaggccattcagattatcaatttacccaaggatttgagtagagatacaactcatcgttatgggccaaataccttcaagctgcacaggttgccagttccaagacctgggcaagttcttggattggttggaacaaatggaattgggaagtcaactgcccttaaagtgttagctgggaggttgaaacccaacctgggtcgctacgataatccacctgattggcaggaaattttgacatacttccgcgggtctgagcttcagaattattttactcgcattctagaggacaatttgaaggcaatcatcaagccacaatatgttgaccatattccaaaagctgtccaagggaatgttggacaggtgcttgatcaaaaagatgagagagaaatgaaagctgaactctgtgctgatcttgagttgaatcaggttattgatagaaatgtaggagatttgtctggtggagagctgcaaagatttgcaattgctgtggtagctgtgcagaatgcagaaatatacatgtttgatgagccatcaagttatcttgatgtaaaacagaggcttaaagcggcccaggtcattcgatctttgctcagacctaacagttatgtgattgttgtggagcatgacctaagtgtccttgattatttatcagattttatttgttgtttatatgggaagcctggagcttatggagttgtcaccttacctttctctgttagagaaggaatcaatattttcttggctggttttgttcctactgaaaatctaagattccgagatgaatcacttacatttaaggttgctgaggctcctcaagaaagtgctgaggaaattcaaacttaccagcgatataggtaccctaccatgagtaaaacccagggtggttttaaactttctgtgattgagggtgagttcactgattctcagattattgtgatgttgggagaaaatggaacagggaagacaacatttatccgcatgctggctggattgctgaagcctgattctgttgaagattcagatattgaaataccagagtttaatgtttcatataagccccagaagatcagtcctaaatttcaatctacagtgagacacttgctgcatcaaaaaattcgggattcatatatgcatcctcagttcacttctgatgtgatgaaacccttacaaattgaacaattaatggaccaagaagttgtaaacctctctggtggagagttgcaaagagtggcattatgtctatgtcttggaaagcctgccgatatttatctgattgatgaacctagtgcttacctcgactcagagcagcgtatcattgcctcaaaagtgataaagagatttattcttcacgcaaaaaagactgcctttattgtcgagcatgatttcatcatggcaacttacttggctgacaaagttattgtgtacgaggggaaaccatctgttaattgtactgccaatgctcctcagtcattggtatctgggatgaattgcttcttatcgcatcttgatattacttttagaagggatccaactaatttcaggccccggataaataagttgaactccaccaaagatagggaacagaaggctgctggatcctattactaccttgatgattgatgcaatatgtcagcaagtcctgctacttccaaagaatttgatacttgcgggtcctctccacctccgtttgcttgttgcatttgctgtctttttcttctccttcacaatcttaccccttcttggcaacgtctcgctgtagggtcttgcgtccctcatttgtctaatcatggaaacatgcgagtgcgggtagcaccacactaaagccttaaatactttattccatcacatcaaatagttacatccggcattgtggagcttgaaaaggttaaaagatctgctttgtgctttgttcgaggaagttgagttcaaaaatagctacagaagcggcagctaacaggcgatcagttctcgtatttttctagcttaaaagcatatctggctagggtagagaaataattaaatatatgcacaaatatttatcattacatctaatttggctgatattttattgggatattgagtgtttggttttcaaagtgtttatttgaaatgatactacacataatcaagccttttcaaggctaagctagtgctgtaagggcctgtggtctgtgctgcagcagtggtttccgatcccagttttgacattacaatatgtaatatgagcataatttagttatttcagatatggcaccctttttt

SEQ ID NO: 4752 - DNA, 2098 bp, Euonymus alatus
gtcgaccagctgaaggcgggtcggatacgcatccggcatctctctgtcacagacagcgaaaccctaaatagctttttcctttttcatttgccagcttgtggtagctcaacgctgaaagccttccaagcacacgtctctctttccctacttcactccctttctcttctattcccaaacctcaacatcgttgttcagttttgcttcagaagagaggagggagatgtcggacaggttaacgcgtatagctatagtgagttcggacaggtgcaagcctaaaaagtgccgtcaggagtgcaagaagagctgccccgtcgttaaaaccggaaaactgtgtatcgaggtttcttctgcctctaagattgcttttatctcagaggagttgtgcattggatgtggtatctgtgttaagaaatgcccatttgaagcaatccagattatcaacttgccgaaagatttggataaagatacaactcatagatatggtcccaacacatttaaattgcacaggttgccagtccctaggcctgggcaagttcttggtttggttggaacaaatggcattgggaagtctacggctcttaaagttttggctggaaaactgaaaccaaatttgggtcgtttcaataatcccccagattggcaggaaatattgacatatttccgaggttcagagctgcagaattattttactcgtatcctggaagacaatttgaaggctattatcaagccccagtatgttgatcacattccaaaagcagttcaaggcaatgtggggcaggtgcttgaccaaaaagatgagagagatatgaaggcagaactttgtgctgatcttgagctgaaccaggtgatagatcggaatgttggggatttgtctggtggagagctccagaggtttgccattgccgttgtggcgatacagaatgcagagatatatatgtttgatgaaccctcaagttatcttgatgtgagacaaagactgaaagctgcacaagttgtcagatctttgctgaggcctaatagctatgtaattgttgtggagcatgatcttagtgtcttggattatctatcagatttcatttgctgcctgtatgggaaaccaggtgcatatggggttgtcactcttcccttctctgttagggaaggtattaacatcttcttggctggatttgtacccaccgaaaatttgcgtttccgagatgaatctctcacgttcaaggttgctgagacgcctcaagaaagtgccgaggagattgagacctatgcacgatataaatacccaaccatgactaaaactcaggggaattttaagcttcgcgtggtcgagggtgaatttacggattctcagattgttgtaatgctgggtgagaatggaacagggaagacaacgtttattcgtatgctggctggtttattgaagcctgatactgttgaaggtacggatgtggagattcctgagtttaatgtatcttacaagccccagaagattagtccaaaattccaatcaactgtccgacacttgctacatcaaaagatacgtgattcgtatactcatcctcagtttcactctgatgttatgaagccactgttaattgaacaactaatggatcaggaagttgtgaatctctctggtggggagttgcaaagagttgcattatgtctgtgccttgggaagcctgcagacatttatttgatagatgaaccaagtgcatatcttgattctgagcagcgcattgctgcttccaaagtcataaagaggtttattcttcatgcaaagaagactgcatttgtggtggagcatgactttataatggcaacttacctagcagacagagttattgtatatgagggaaagccgtctttggactgtactgcaaactccccacagtcattgttgactgggatgaatctattcctatcacatctggatatcacttttagacgggatccaacaaatttccggccaagaatcaacaagctggaatcgactaaggaccgggagcagaaagccgctgggtcttattattacctggatgattgaagtagtattgacaggtgatggtttatgcacaagttttttaggcattggcatgagcgaaac

SEQ ID NO: 4753 - DNA, 2606 bp, Aristolochia fimbriata
ttgttcttctgctcttcaagcggaacctagccgccgaggtgcggctggaaactttaagcagcttgatactagcctcgaagtacgatctgcggccgccggcgaacagcaacacactctagtaaggtagtctgtagctgggaggatggcagatcggttgactcgaattgccattgtgagttcagatagatgcaagccaaaaaaatgccgacaggagtgcaagaagagttgtcctgttgttaaaacaggaaaactgtgtattgaggtcacccctgcctcaaagattgctttcatttctgaagagctatgtattggatgtggtatttgtgtcaagaaatgcccatttgaggccattcagatcatcaatttgcctaaagatttgaataaggacacaacccaccgttatggtccaaacacattcaagttgcacaggttgccagttccaagacctggtcaagtgctaggtcttgtaggaacaaatggaattggaaaatcaactgctctgaaagtgttggctgggaaattgaaacctaatttgggccgattcaataatcctcctgattggcaggaaatactgacatactttcgtggttcggagcttcagaattatttcactcgcattttagaagataatctaaaggcaataattaagcctcaatatgttgatcatataccaaaagcagtgcaggggaatgttggccaggtgcttgaccaaaaggatgagagagatatgaaagctgaactttgtgatgatcttgaattgaatcaggttattgatcgaaatgttggagatttgtctggtggagagttgcaaaggtttgcaattgctgttgttgctatccaaaatgcagagatttatatgtttgatgagccatcaagttatcttgatgtgaagcagaggcttaaagctgcccaagttgtccgctctttgcttaggcctaacagttatgttattgtcgtggagcatgacctcagtgtcctggattacctatcagatttcatttgctgcttatatgggaaacctggagcatatggtgtagtaacccttcctttctctgtgagggaagggataaatatttttttggcaggctttgtccctactgagaatctgaggttccgggaagagtcacttacttttaaggtagcagagactcctcaggaaagtgcggaagagattcagacttatgcacgttacagatatcctacgatgagtaaaactcagggcaatttcaagcttaaagtcatcgaaggtgaatttactgattcacagatcattgttatgcttggagagaatggaacggggaagacaactttcatacgtatgctggctggattgctgaagcctgatgtggtggaaagttctgaggctgaaattcctgagttcaatgtgtcttacaaacctcaaaaaattagtccaaaatttccgtccactgtcaggcacttactccatcaaaaaattcgcgattcatacatgcatccgcagtttgtgtccgatgttatgaaacccctgcaaattgaacaattgatggatcaagaagtagtgaatctctctggtggagagctgcagagagttgctttgtgtctctgtctgggaaagcctgcagatatttatctgatagatgagccaagtgcttatcttgactctgagcaacgtatagttgcttcaaaggtcatcaagaggtttatcctgcatgcgaagaaaactgctttcgtagttgagcatgacttcatcatggctacttatctggcagaccgagttatagtttatgaagggaaaccatctgtggactgtattgcgaactgtccacaatccctattaactggaatgaatctctttttatctcatctggatataacattcaggcgtgatccaacaaattatcggccacggattaataaattggactccacgaaagacagagaacagaaatctgctggttcctactattaccttgatgattgagctatttgttacattgagatggagtgattaatgcaccggcttgagtttttgttttgctcttggtagaaaaatttgggttgagtttcagttaacatcagcttctggtttgtaccaacttgtgtgggtggcataatcatcacacccaaacattatcatgcattttatcaggaaccagtaatgtctataacgtatacgcctgtatcaatgaatctcacttcttaacacctttttgtatttgtaatggtggatacgtacatagagaggcctgacgaaaaggaggaagagagacaagaatgacacaagtttccgaaacggattgccgtccggcgttgattcaggcgagtggggatccggacgcctggactccctcttagttcttgtttgaatcttatatttccccggacttgcatattcccctctctcaccatccaaatacaaatctccagaagctccgaggctctcaaattatcactaaaggatgtcaagatttgcttggtcattttgattgggcccagcccaaagttctaaccgcccaaaccgacggctctaatcgcgcaacttgtctgttttttccatccactaatgtgatgcaaagtttttgtgtgtggaaatttacattataggatttttgaagaaattagattaa

SEQ ID NO: 4754 - DNA, 2414 bp, Theobroma cacao
atgacacggaagcagaagtgaaaaccctaacgttgtccactttagactacgtgcgtgtgctctacgctcatctcgtcgcaatccaagcacacgccctccctctctctctctctccaatttccgtcgtccgtcgctctttgattccggccggggacaggtgttcagaggagaggaatggcggatcgcttgacgcgtattgcgattgtcagctccgaccgctgcaagcccaagaagtgccgccaagagtgcaagaagagctgccctgttgttaaaactgggaagctatgtattgaggttactcctgcttctaagattgctttcatctctgaggagttgtgcattggttgtggtatctgtgtgaagaaatgcccatttgaagcaattcaaattatcaacttaccaagagatttggataaagatacaacccatcgatatggtcccaatactttcaaattacacaggttgccagttccaaggcctgggcaagttcttggtctggttggaaccaatggtattgggaagtcaactgcccttaaagttctggctggcaaactcaagccaaacttgggccgcttcaataaccctccagattggcaggaaatcttgacctattttcgaggatctgagttgcagaattattttactcgcatcttggaagataatctgaaggccatcatcaagccacagtatgttgatcatattccaaaggcagttcaagggaatgtggggcaggtgcttgaccaaaaagatgagagagagatgaagtcagaactctgtgttgatcttgaactgaaccaagtcatagaccgtaatgttggggatttatctggtggtgagctccagagatttgctattgctgttgttgccatacagaatgcagagatatatatgtttgatgaaccttcgagttatcttgatgtgaaacaaagactaaaagcagcacaagttgttcgatctcttctcaggcctaatagctatgtcattgtcgtcgagcatgatcttagtgtcctggattacttatcggacttcatttgctgcttgtatggaaaaccgggtgcatatggagttgtaacccttcccttttctgtaagagaaggaatcaatatcttcttggctggatttgtccctacagaaaatctaaggttccgagatgaatctttaaccttcaaggttgcagagaccccacaggaaagtgctgaggaaattgaaacctatgcacgatacaaatacccaaccatgacaaaaactcagggcaactttaaacttaaagtgattgagggcgaatttactgattctcagattattgtaatgctgggggagaatggtacagggaagaccacattcatccgtatgctggctggtttgttgaaatctgatagcatcgaaggttctgatgtggagatacccgaatttaatgtttcatacaagccccagaagatcagtcccaaatttcaatctacagtcaggcacttgctacatcaaaagatacgtgattcatacatgcatcctcagtttgtttcagatgtgatgaagcctcttctcattgaacaattgatggatcaggaagtggttaatctttctggaggagagttgcaaagagtggcattatgtctatgccttgggaagccagctgatatttatctgatagatgaaccaagtgcttatcttgactctgagcagcgtattgttgcatctaaagtcataaagaggtttatcctccatgcaaagaaaactgctttcgtggttgagcatgattttataatggcgacttaccttgcagatcgagttattgtgtatgaagggaagccctcagtggattgtattgcaaattctcctcagtccttgttgactggcatgaatctcttcttatctcatctggacattacgtttaggcgggacccaaccaattaccgaccaagaatcaacaaattggactcaactaaggacagagagcaaaagtctgctgggtcatattattatttagatgattgacatgtttcgtacagttgctaattgtgataaggtgaaagcacatcaatgttgggtaatcatgggatctcaaatgagttgttctgatatgttgacgagtggaaaataggtccttcgcctggtgaggagctcatatccatcttgctgctaaaggagctcacataacacttgtttagaaaaattttatcctatagtgtgcttttttgtttcaccaattttgattgatatttggtgagttagaatgcttggtacttttctgtcttgccatacctccgtggtatttttcactagatgttcgaatatttaagaggaaggatgttgaattgagatattgagcttcatctttgtttattgaattataatttaaggttctgtcattttacagttactccattactctaccttttaaggggctcttttttctt

SEQ ID NO: 4755 - DNA, 2165 bp, Chrysanthemum coronarium
ttttggggttttcattcattaatcatctgaaaccctaaaagtcatctatggctgatcgattaacgcgtatcgctatattgaaagaagaccgctgcaaacccaagaagtgccgtcaagagtgcaagaaatcatgccctgttgtcaaaactggtaagctatgtattgaggtcagttctgcatccaaagtggcatatatttctgaggagctttgcatagggtgtggtatatgtgttaagaaatgcccatttgatgcgattgagatcattaatttaccaaaagatttggaaaaagatacaactcaccgttacggggtcaacaccttcaagttacacaggttgcctgtcccgaggcctgggcaagttcttggcttagtcggaacaaatggaattgggaagtcgacagctctcaaagttttggctggaaaactgaaacccaatttgggtcgcttcaataaccctcctgactggcaagaaattttgacctacttccgaggatctgagttgcaaaactacttcacacgtattctggaagataatctaaaggctatcataaaaccgcagtatgttgaccatattccaaaagcagttcaaggaaatgttggacaagtccttgagcaaaaggatgagagagatgcaaaggcggagctttgtgctgatcttgagctgaatcaggttatagatcgtaatgttggagacttatccggtggagagcttcagaggtttgcgattgctgtcgttgccatacagatggcagagatatatatgtttgatgagccttcaagttatcttgatgtgaaacaacgtcttaaagctgcccaagttatccgatccttacttagacccaacagctatgtgattgttgttgagcacgatttaagtgtgcttgattacctatcagacttcatttgctgcctgtatgggaaacctggtgcatatggtgttgtgactctacctttctctgtcagagaaggaataaatatctttttagacggttttgtgcccactgaaaaccttcgtttccgcgatgagtcacttacttttagggtttccgagacaacacaggagagtgctgaggaaattgaaacatatgcacgctacaagtacccaactatgtctaaaacacagggtggtttcaaattaaaggtggttgagggtgaattcacagactcgcagattattgtaatgcttggtgaaaatggaaccgggaagacaacatttatccgaatgctggcaggtttactaaagcctgatacagtggaaggcactgatgtggagatacctgagtttaacgtctcttacaagccccaaaagatcagtcccaagttccctcattcagttaggcatctgctacattcaaagattcgtgattcgtatatgcatcctcagtttgtttccgatgtcatgaagcctcttcaaatcgagcagctaatggatcaagaggttgtgaatctttctggtggtgaattgcaaagagttgctttgtgcctgtgcctaggaaagcctgctgatatctacctgatagatgaaccaagtgcgtatcttgattctgagcagcgtattgtcgcttcaaaggttataaagagattcatactgcacgccaaaaagactgcattcgtggttgaacacgacttcataatggccacttatctagcagatagggtgattgtttatgaagggcagccgtctgttgattgtgttgctaattgtcctcagtcgttattgagcggaatgaatctctttctatcgcatttgaccatcacgtttagacgggatccaactaattatcgcccaagaatcaacaagcttaattcaacaaaggacagggagcagaaacttgctggatcttattattatctggatgactaattttgtcagttcgagttgtaagctatatagtgatcacttttgtccagtgagtggcggcgagttcatctccagtgagtgttgctacaccatgataaatcttgtttgaaagagtttttgatagcatgcagttatgtgttacagatccttgtacttaagagtgcaccagtttttatttgttggtaccccttttgttttctatttgtaactttcggcttatgatcacttttgtcagttactgatattcgagcggatggttatttttggtgattttgaggaatgtgtttaatgtgctatgatgtt

SEQ ID NO: 4756 - DNA, 2473 bp, Echinacea purpurea
cggccgggggattggtgcaaaattccaaagtaacagcaatcctccatagaaccctagctcttgtacgtctgcttgcgaagggttctaatcatcgtgttccaaccacacgccgcatcaatcatcctttgaactgcaaggtttcgatcaatggcggatcgattgactcgtatcgccatcctcaaagaagaccgttgcaagccgaagaagtgtcgtcaggaatgcaagaaaagctgtcctgttgttaaaactggtaagctatgtattgaggtcacttctcaatctaaggtggcgtatatctctgaggagctttgcatagggtgtggtatatgtattaagaaatgcccctttgatgcaattgagatcattaatttaccaaaagatttggataaagatacaactcatcgttatggggtcaataccttcaaattacacaggttgcctgtcccaagacccgggcaagttcttggtttggttggaacaaatggaattgggaagtctacagctctcaaagttttggctggaaaattgaaacccaatttgggccgttttaataaccctccagattggcaagaaatattaacttactttcgaggatctgagttgcaaaactactttacgcgcattcttgaagataatctaaaggcaatcataaaaccacagtatgttgatcatattccaaaagcagttcaagggaatgttggacaagtacttgaccagaaagatgagagagatgtgaaggcggagctttgtgctgatcttgagctgaatcaggttattgatcgtaatgttggagatttatctggtggagagcttcagaggtttgcaattgctgttgttgccatacagaatgctgagatttatatgtttgacgagccctcaagttatcttgatgtcaaacaaaggcttaaggctgcccaagttatcagatctttgcttagacctaacagctatgtgattgttgtggaacacgatttaagtgtgcttgattatctatcagacttcatttgctgcctctatgggaagcctggtgcatatggtgttgtgacactacccttttctgtcagagaaggaattaatatctttttggaagggtttgtgcccacagaaaaccttcgttttcgtgacgagtctcttacgtttaaggtagctgagacaccccaggagagtgctgaagaaattgaaacatatgcacgctataaatatcccactatgagtaaaacgcaaggtggctttaaacttaaagtggttgagggtgaattcaccgactctcagatcgtagtaatgcttggtgaaaatggaaccgggaagacaacgtttattcgtatgctggctgggttgctgaagcctgatactgtggaagactctgagacggagatacctgagtttaatgtttcttacaaaccccagaagatcagtcccaaatttcaaaatacagtcaggcttttacttcatcaaaaaattcgtgactcatatatgcatcctcagtttgtttccgatgtgatgaagcctcttcaaatagagcagctaatggatcaagaagttgtcaatctttctggtggagaattgcaaagagttgcattgtgcttgtgtcttggcaagcctgctgatatatacctgattgatgaaccaagcgcgtaccttgattctgagcagcgtatagtcgcatcaaaagttataaagagatttatactacatgctaagaagactgcatttgtggttgaacatgattttataatggcaacttatctagcagatagggtgattgtttatgaagggaaaccatcgattgattgtgttgcaaattcacctcagtctttattaactggaatgaatctcttcttatcgcatctcaacattacatttaggcgggacccgactaattttcgaccaagaatcaacaagcttaattcaacaaaggacagggaacagaaacttgctggatcttattactatctggatgactaattttttctctgagtcgctctcttttcgctactgccggttaattcgccactaaagccagcggtctgttgtagtcttcatcctcagtcaatgctgctacaccatacttgctagttatcatgtttgaaagagtttaggtaacaatgcttgtacttagaaatgctcccattttcgttttgaggtacctcttgttcttgtattttcgggctcttgattactgatagactagagcttgttttttggcgatgatttgttttcaacattgtgttttctatgcgatgacatgattcagcgatggggtttttggttttaattttgggaaacttcatagaatagtaaccaagtttctaaattgattcaattaagtcactcaaaataatatgccctaactaaatcacttgaattttaaatgatgtgctaatcctagattttatacatgttcaataggttaccatgcttatgatgcttatgtgtaatttcctttttctaaatatatgttgaatgattttaa

SEQ ID NO: 4757 - DNA, 2674 bp, Vitis vinifera
gcgtgcgcagaacggcacgcgccaaacgcctttctttcttcctagttcctgctttgtttccctgaatttaagagggaagtgaaggagaagccgcagaagaagaagagagggaagagcgatggcggatcgattgaccagaatcgccatagtcagttctgaccgctgcaagcccaagaagtgccgtcaggaatgcaaaaaaagctgtccagttgtcaaaactggtaaactgtgtattgaggtaacgcctgcatcgaagattgccttcatatcggaggaattgtgcattggatgtggtatctgcgtcaagaaatgcccatttgaagcaattcagatcatcaatcttccaaaagatttggataaagataccactcatcgttatgggccaaacacttttaaattgcatagactgccagtgcccaggccaggccaagttctgggtttggttggaactaatggcattggaaaatctactgccctcaaagttttggctggcaaattgaagcccaacttgggtcgattcaataaccctcctgattggcaggaaatattgacatatttccgaggatctgagctgcagaattatttcacccgaatccttgaagataatctcaaggcaatcatcaagcctcagtatgttgatcatattccaaaagcagtccaaggaaatgttggtcaagtgcttgaccaaaaggatgagagggatatgaaggaagaactttgttttgatcttgatcttaatcaggttattgaccgtaacgtgggagatttatcgggtggagagctccagaggtttgctattgctgttgttgcaatacagaatgcagagatatatatgtttgatgaaccttcaagttatcttgatgtgaaacagaggcttaaagctgcccaagttgttcgatctctgctcaggcctaatagctatgtaatcgtcgtggaacatgatcttagcgtcctagattatttgtcagatttcatttgctgcctttatgggaagccgggtgcatatggagttgttacccttcccttctctgttagagaaggaatcaatatatttttagctggatttgttcccacagagaatctacgattccgggaggaatctctcactttcaaggttgctgagactccacaggagagtgctgaggaaattgagacatatgcacgatataaatacccaaccatgacaaaaactcagggcaatttcaaacttcgtgtggttgagggagaatttacagattctcagattattgtaatgctgggtgagaatgggacagggaagacaacatttatccggatgctggctggtttactgaaacctgattctgtagaagactctgacgtggagatacctgagtttaatgtttcttacaagccccagaagatcagcccaaaatttcaatctacagttagacacttgttgcatcaaaagatacgtgattcatatatgcatcctcagtttgtctcagatgtcatgaaacctcttctgattgagcaattgatggatcaagaagttgtgaacctctctggtggagagttgcaacgagtcgcactatgtctatgccttggaaagcctgcagatatttatttgatagatgaaccaagtgcatatcttgactcagaacagcgtatagttgcatcaaaagtcattaagaggtttatcctccacgcaaagaagactgcatttgtggttgagcatgatttcataatggcaacttatcttgcagacagagttatagtgtatgaggggcaaccatcagtggattgtactgccaatactcctcagtcattgttgactgggatgaatcttttcttatctcatctagatatcacatttaggcgggatccaacaaatttccgcccaagaatcaacaaattggagtcaaccaaggacagggagcaaaaatctgctggatcatattattacctggatgactgacctgatttttgacagttgctgaatatgcaagctttgaaaggcgtctttgtcagatatcagagcttgagtgaatcattttgatggattgacaaatggagagtggccctttgcttttggagaagtattgttttcgggatggttaaatgagtagtcttacaagtaatctgttaatgccacttcaggatagtttccccttctcttgttttggtcgtgatatcagttgagtgaatttgaggatgaattgtgctttttcttctccttcaccacatctagtgtgtttcaaactagagtgaggagaagaacaaaagataatgatgtcacagatttggaaccttagggaagaacccatctcacacttggcctttccttttggggcaaaggaaatcaactataaatttggggaattttctgtggaaaatctgttgtggtataagtttatttatcaaatgaaggaactaccatggacaaatgtttttctgattttagtccctctgaaattgaaggaatgttttgatgtgtgttgaagtccaggtgcccggtcataaatcaaggatgtgatgctgtattctcccttttctgttgttgtttcctgacggaggcttcgttcttttacagcgaatgtccttatgaatgttacagcaagtgacttagaaatatgaaaaaactgtaaccaagaaccatgaacaccataaactcctatagaatttgggatttaattgaatatgaggaattatttta

SEQ ID NO: 4758 - DNA, 2161 bp, Phalaenopsis aphrodite
ttgtgggtcggttgatttgggcggggcttgatggcggatagattgactcggattgcgatcgtcagctccgatcggtgtaaaccgaagaaatgccgccaggagtgcaagaagagttgccctgtggtgaaaaccggaaaactttgcatagaggtcatatcttcctcaagaattgctttcatttccgaagaactatgcattggatgtggtatatgtgtcaagaaatgtccttttgaggcaattcaaattattaatttaccaaaggatcttgacaaagatacaacacatcgttatgggcccaacacattcaagctgcataggctaccagtacctagacccgggcaagttctgggtcttgttggaacaaatggaattgggaagtctactgccctgaaagtgctagctggaaagttaaagcccaatttgggaagatttaataatcctcctgattggcaggaaatattgacatacttccgtggatccgagcttcagaattatttcacacgaattttggaggataaccttaaggcgattatcaaaccgcaatatgttgatcatattcccaaagccgtccaaggaaatgtcgggcaggtgcttgaccagaaggatgagaaagataagaaggtggagctatgtaatgatcttgagttgaatcaagtaatcgaccgcaatgtcggggatttatccggcggagagctgcagaggttcgctattgctgtggttgctgtgcaaaatgctgagatatatatgtttgatgagccttccagctaccttgatgtgcggcaaaggcttaaggccgcacaagttgttcgatctttgctcagaccaaacagctatgtgattgtcgtggagcatgatctaagcgtcctggattatttgtcggatttcatttgttgcttatatgggaagccgggagcttacggggttgttactttacccttttccgtacgggaaggtatcaatattttcttggctggtttcgttcctaccgagaatctgcgctttagggacgaatcacttacttttaaggttgctgagactcctcaggagagtgctgaggagattcagacatatcaacgttaccggtatcccacaatgattaaattgcagggtaattttaaactttgtgtaatggagggtgaatttaccgactcccagatcattgtgatgctcggggagaatggaaccgggaagacgacatttattcgcatgctggccggtttgctgaagcctgactctgttgaaggttcagatgttgaaatacctgaattcaatgtctcatataagcctcaaaagatcagtcccaagtttcaatcaactgtgaggcacttactgcatcaaaaaattcgcgactcatacatgcatcctcaatttgtttctgatgtcatgaaaccattacaaattgagcaactgatggaccaagaagttattaatctctctggtggagagctgcaaagggttgcattgtgcctatgccttgggaagcctgcagacatatatctgattgatgagcctagtgcttatcttgactcagaacagcgtattgttgcatccaaggtgataaagaggttcattctacatgcaaagaaaacagcctttgttgtggagcatgattttataatggcaacttatcttgctgacaaagtgattgtctatgagggaaaaccgtcggtggattgtactgctaatactcctcagacattggtatctgggatgaatcgcttcttatcccatctcgatattacttttcgacgggatccaactaattatcgacctcgcataaacaagttggattctaccaaagatcgggaacagaaatccgctgggtcttattactacttggatgattgagaagttcacaaatcgattaatataaagttttatatgctgcccacaatgaaactgaaaggagctcaatataaaaagcttctgaaatgtggtccagcagtaatatcggaagttttcattctctccaacaattttataatttatgagaagagtaattaagccaaaggtgtctgtatgctgagtgctgatgaggtcttacacaggtaaacttttgctcatccttaatctgctccggtgcctgtttaaggtttttcccactgcttgtcttgagtttcgagagcttaatcttatactattcaggttggtagatttttca

SEQ ID NO: 4759 - DNA, 1935 bp, Tripterygium wilfordii
ttctctgttagcgttcccagcgcacgtctttcgtttccgacttctctccctttctcctctgttcccaaatctcaacgtcgttgttccgttttgcttcagaagagagagggagatggccgacaggttgacgcgtatagctatagtgagttcggacaggtgcaagcctaaaaagtgccgtcaagagtgcaagaagagctgccccgtcgtcaagactgggaaactgtgtattgaggttacttctgcctctaagattgcttttatctcagaggagttgtgcattggatgtggaatctgtgttaagaaatgcccatttgaagcaatccagatcatcaacttgccgaaagatttggataaagatacaactcatagatatggccccaacacatttaaattgcacagattgccagtcccaaggcctgggcaagttcttgggttggttggaacaaatggcattgggaagtctacagctcttaaagttttggctggaaaactgaaaccaaatttgggtcgtttcaataaccccccagattggcaggaaatattgacatatttccgaggttcagagctgcagaattattttactcgtatcctggaagacaatttgaaggctattatcaagccacagtatgttgatcacattccaaaagcagttcaaggcaatgtggggcaggtgcttgaccaaaaagatgagcgagatgtaaaggcagaactttgtgctgatcttgagctgaaccaagtgatagatcgcaatgtgggggatttgtctggtggagaactccagaggtttgccattgccgttgtggccatacagaatgcagagatatatatgtttgatgaaccctcaagttatcttgatgtgaaacaaaggctgaaagctgcccgagttgtcagatctttgctgaggcctaatagctatgtaattgtcgtggagcatgaccttagtgtcttggattatctatcggatttcatttgctgcctgtatgggaaaccaggtgcatatggggttgtcactcttcccttttctgttagggaaggcattaacatattcttagctggatttgtacctaccgaaaatttgcgtttccgggatgaatctctcaccttcaaggtcgctgagacacctcaagagagtgccgaggagattgagacatatgcacgatataaatacccaaccatggctaaaactcaggggaattttaagcttcgcgtgatcgagggtgaatttactgattctcagattgttgtaatgctgggtgagaatggaacagggaagacaacgtttattcgtatgctggctggtttattgaagcctgatactgttgaaggtactgatgtggagattcctgagtttaatgtatcttacaagccccagaagattagtccaagattccagtcaactgtccgacacttgctacatcaaaagatacgtgattcgtatactcatcctcagtttatgtcagatgttatgaagccactgttaattgaacaactaatggatcaggaagtggtgaatctctctggtggggagttgcaaagagttgcattatgtctctgcctagggaagcctgcagacatttatttgatagatgaaccaagtgcgtatcttgattctgagcagcgcattgttgcttccaaagtcataaagaggtttattcttcatgcaaagaagactgcatttgtggtggagcatgactttataatggcgacttacctggcagacagagttattgtatatgagggaaagccgtctttggactgtgttgcgaactctccacagtcattgttgactgggatgaatctattcctatcacatctggatatcacatttagacgggatccaacaaatttccggccaagaatcaacaagctggaatcaaccaaggaccgggagcagaaagccgctggatcttattattacctggatgattaaagtag

SEQ ID NO: 4760 - DNA, 2222 bp, Euonymus alatus
ggtcgcagacaagcgaaaccctaaatagcttttgcctttttgcctgcttgcggaagctcaacgcttattctttgaaagcgttccaagcacacgtctctctttcccgacttctctccctttcagttttgctttagagaggagggagatgtcggacaggttaacgcgtatagctatagtgagttcggacaggtgcaagcctaaaaagtgccgtcaggagtgcaagaagagctgccccgtcgttaaaaccggaaactgtgtatcgaggtttcttctgcctctaagattgcttttatctcagaggagttgtgcattggatgtggtatctgtgttaagaaatgcccatttgaagcaatccagataatcaacttgccgaaagatttggataaagatacaactcatagatatggccccaatacatttaaattgcacaggttgccagtccctaggcctgggcaagttcttggtttggttggaacaaatggcattgggaagtctacggctcttaaagttttggctggaaaactgaaaccaaatttgggtcgtttcaataaccccccagattggcaggaaatattgacatatttccgaggttcagagctgcaaaattattttactcgcatcctggaagacaatttgaaggctattatcaagccccagtatgttgatcacattccaaaagctgttcaaggcaatgtgggacaggtgcttgaccaaaaagatgagagagatatgaaggcagaactttgttgctgatcttgagctgaaccaggtgatagttcggaatgttggagatttgtctggtggagagctccagaggtttgccattgccgttgtggccatacagaatgcagagatatacatgtttgatgaaccctcaagttatcttgatgtgagacaaagactgaaagctgctcaagttgtcagatctttgctgaggcctaatagctatgtaattgttgtggagcatgaccttagtgtcttggattatctatcagatttcatttgctgcctgtatgggaaaccaggtgcatatggggttgtcactcttcccttttctgttagggaaggcattaacatcttcttggctggatttgtaccgaccgaaaatttgcgtttccgggatgaatctctcaccttcaaggttgctgagacacctcaagagagtgccgaggagattgagacctatgcacgatataaatacccaaccatgactaaaactcaggggaattttaagcttcgcgtggtcgagggtgaatttacggattctcagattgttgtaatgctgggtgagaatggaacagggaagacaacgtttattcgtatgctggctggtttattgaagcctgatactgttgaaggtacggatgtggagattcctgagtttaatgtatcttacaagccccagaagattagtccaaaattccaatcaactgtccgacacttgctacatcaaaagatacgtgattcgtatactcatcctcagtttcactcagatgttatgaagccactgttaattgaacaactaatggatcaggaagtcgtgaatctctctggtggggagttgcaaagagttgcgttatgtctgtgccttgggaagcctgcagacatttatttgatagatgaaccaagtgcatatcttgattctgagcagcgcattgttgcttccaaagtcataaagaggtttattcttcatgcaaagaagactgcatttgtggtggagcatgactttataatggcaacttacctggcagacagagttattgtatatgagggaaagccgtctttggactgtactgcaaactccccacagtcattgttgactgggatgaatctattcctatcacatctggatatcacttttagacgggatccaacaaatttccggccaagaatcaacaagctggaatcgactaaggaccgggagcagaaagccgctgggtcttattattacctggatgattgaagtagtattgacaggtgatggtttatgcacaagttctcgaggcattggcatgatcaatacaaaacaaaacaaaagagagctggggtgtgggattattgcaaaaacgaaattgactaaagatggttgtcatgccttagtgaaagggcccatgcttcgtctctgtgtagatgaatttcagggcctttattggtatcagtgtaatttcttgtaacgtgttatttctccagttttggctaatgtgttgcatatgattagccaa

SEQ ID NO: 4761 - DNA, 2014 bp, Liriodendron tulipifera
gtcaccgcctctatatttggggtttgcttttctccttcgttccagttccaaaagcagggctagggcttgggcttttctcggccgtccgatctgccttatccctaaaaaacaatggcggatcggctgacacgtatcgccatcgtcagctccgatcgatgcaagccgaagaaatgcaaacaggaatgcaagaagagctgccctgtagtcaaaacaggaaaattgtgtattgaggtcactcctgcctctaagattgctttcatctccgaggaattatgcattggatgtggtatttgtgttaagaaatgcccatttgaggccatacaaatcattaatctgccaaaagatttggataaagatacaacccatcgctatgggcccaatactttcaagttgcacaggttgccagttccaagacctggtcaagtattaggtctcgttggaacaaatggcattgggaagtcgactgccctcaaggtgttggcagggaagttgaaacctaacctgggtcgcttcaagaatcctcctgattggcaagaaatattgacatacttcagaggatccgagcttcagaattattttactcgcattcttgaagacaatttgaaggccatcatcaagcctcagtatgtcgatcacattccaagagcagtccaagggaatgttgggcaagtgctggaccagaaagatgagagagaaatgaaggctcaactctgtcatgatcttgagttgaatcaagttatagatagaaatgtgggggatctatcaggtggagagctgcaaaggtttgctattgctgtggttgcagcacagaatgctgagatttatatgttcgatgagccatcgagctatcttgatgtaaaacagaggcttaaagctgcgcaagtcgttcgctctttgctcaggcctaacagctatgtgattgttgtggagcatgaccttagtgttctagattacttatcagacttcatttgctgcttatatgggaagccgggagcatatggagttgtaacccttcccttttctgttagagaaggaattaatatctttttggctggttttgtccctacagagaatctacgattcagagacgagtccctcacgtttaaggttgcagagactccgcaggaaagtgccgaggaaattcaaacttatgcacgttataaatacccaaccatgattaaaactcagggtaatttcaagcttaaagtgatcgagggtgaattcaccgactctcaaattatcgtaatgctcggtgagaatgggacagggaagaaacattcattcgcatgctggctggattgttgaaacctgatgtggtggaaggttcagatgtggaaatacctgagttcaatgtttcttacaagccccagaagatcagccccaaatttcagtctactgttagacacttgctgcaccaaaaaatccgtgattcatatatgcatccgcagtttgtgtcagatgtcatgaagcccttacagattgagcagttaatggaccaagaagtcgtgaatctctctggtggagagttgcaaagagtcgcattgtgtctctgtcttggaaagcctgcagatatttatctgatagatgaaccaagtgcttatcttgactcggagcagcgtatagttgcttcgaaggttatcaagaggtacatccttcatgccaagaagacagctttcgttgtggagcatgactttatcatggcaacctaccttgctgatagagttattgtttatgagggaacgccgtctctggactgtactgctaatgctcctcaatccttggtcaccggaatgaacctctttttatcacatctgaatattacattcagacgggacccaactaattataggcctcgaattaacaagttggaatccaccaaggacagggagcagaaatctgctggctcttattactacctggatgattgatgtaatctcggcaggtatttaccctcccatggatgttcggctgtttgtgaaggctgcctgagctgcctgcttccaattcaaacgca

SEQ ID NO: 4762 - DNA, 2168 bp, Brachypodium distachyon
ctcaactccaactccaagaccctctaggcggcggcggcggcggcatccgcgatcgtcggagagtcaagtcgccggccgcagatggcggcggagcggctgacgcgcatagcgatcgtgaacgaggacaggtgcaagcccaaaaaatgccgccaggagtgcaagaagagctgccccgtcgtcaaaacagggaggctttgcattgaagttagtcccgcatcgaaggttgcatttatttctgaagagctgtgcattggttgtggaatttgtgttaagaaatgcccctttgatgccatcgagatcatcaaccttccaaaagatttggaaaaggacacaacccatcgctatgggccaaataccttcaaattgcacaggttgcctgttccaagacctggtcaagttttgggccttgtcggaaccaatggaattggaaagtccacagcgcttaaagtcttagctggcaaggtgaaacctaatttggggcgattcaaaaatccacctgattggcaggagatccttacatacttccgtgggtcggaacttcagaattattttacgcgtatattggaggataacctgaaggcaattatcaagcctcaatatgttgaccacattccaaaagctgtgcaaggaaatgtggggcaagtacttgaccagaaagatgagaggggtatgaaagctgagctgtgcgtcgaccttgaattgaaccaagttattgaccgaaatgtagcagatctttctggtggtgagctccagaggtttgcaatagcagtcgttgctgtgcaaagcgcagaaatttacatgtttgatgaaccatcaagttaccttgatgttaagcagaggcttaaggctgcacgagtcattagatccttgcttagaacgaacagctatgtcattgttgtcgaacatgacttgagcgtcttagattacttgtccgactttatttgctgcttatatggaaagccaggagcttacggtgtagttacccttccattttccgtccgagaaggtatcaatattttcctggctggatttgttccaaccgaaaatcttcggtttcgagacgaatctcttacatttaagattgtggagacccaggaagctgaggagattacgtcataccagagatacaagtaccctaccatgagtaaaacactggcagatttcaagctcactgtcatggaaggtgaattcactgattcacagattattgtgatgcttggtgagaatgggacagggaaaactacattcattagaatgctggctgggcatttgaagccagatactgtggaaggaactgagattgaaattcctgaattcaatgtgtcctataagcctcagaagctcagcccaaaattccagggttcagtgaggcaattgctacataaaaaaatccgggattcatatacccacccccagtttacatctgatgtcatgaagccactgcaaattgagcagctcatggaccaggaagttatgaatttatcaggcggggaactccaaagagtggcattatgcctttgtctaggaaagcctgcagatatttatttgattgatgaaccaagtgcatatcttgattcagagcaacgtattgttgcctcgaaggttataaaaagattcatccttcatgcgaagaaaactgcgtttattgtggagcatgatttcattatggcaacctacttagctgacaaggttgtcgtttatgagggacggccttctgttgactgtactgccaatgcgccagagtctttggtatctggaatgaacaagttcttgtcgcatcttgacattacatttagaagagatccgaccaactataggccgcggataaacaaattggagtctacaaaagacagggagcaaaagtctgtaggatcctactactaccttgatgattaatatacgagggaacacaggttgctgatgaggagtaaagttgtgcatctgttgcaaactggccggagcatgtcatgctgatgatagttagtcttgttgttcgacgtttgactgataaggatgatcatctatcgtatgtaacacgtattataattgttagataacgatctacatgcctcctgtaggcaaaactgatttgtgtaaacttggcatttcattttgaatgttgggttgcagaattgttcaagtgtgtctttgtaccccctggatcgagc

SEQ ID NO: 4763 - DNA, 2346 bp, Catharanthus roseus
tccaggtcttcctaaatcagtcttcctaagagagagatggcggatcagaggttgacgcgtattgcgattgtgagttcggacaagtgcaagccgaaaaagtgccggcaggagtgcaagaagagttgtcccgtcgttaaaactgggaaactttgtattgaagtgactcctcagtctaggattgctttcatctcagaagaattatgcattggttgtggtatttgtgttaagaaatgcccgtttgaagctattcagattatcaatttacccaaagatttggacaaggatacaacccaccgttacggcccaaataccttcaaattgcataggttaccagttccaagaccaggacaggtccttggcctggttggaacaaatggaattgggaaatcaacggccctaaaagttttggctggaaaactgaaacctaatttggggcgctttaataaccctcctgattggcaagagatcttgacttatttccgcggatcagaacttcagaattattttactcgtatactggaagataacttgaaggcaatcatcaagccccaatatgttgaccacatccccaaggctgtccaaggcaacgtgggtcaggtgctggatcaaaaagatgagagagacatgaaaaaagaactgtgtgttgatcttgagctgaatcaggttttggaccgtggtgtgggagatttatctggtggtgaactccagaggtttgctattgcagttgtagctatacagaatgctgaaatctttatgttcgatgaaccctcgagttaccttgatgtgaaacagaggcttaaagctgctcaagttatccgctcattgctccgtcctaatagttacgtcattgtggtggagcatgatctcagtgtactggactatttatcagacttcatttgctgtctatatgggaaacctggtgcatatggtgttgtaacccttccattctctgtcagagaaggaatcaatatatttttggctggatttgtccctacagagaatctgcgatttagggatgaatcacttacttttaaggttgctgagactccacaggagactggtgaggaaattgaaacatatgcacgttataagtatccgacaatgacaaaaactcaaggcaatttcaagctgaaggttattgaaggcgaattcactgattctcagatagttgtaatgcttggtgagaatgggactggaaaaacaacattcatacgtatgctggctggtttactaaaacctgatttagttgagggctctgatgtggagatccccgagttcaatgtctcctacaaaccacagaagatcagtccaaagtttcagtctactgtcaggcacttgcttcatcaaaaaatacgggattcatatactcaccctcagtttatgtcagatgttatgaaacctctccagatcgagcaattaatggatcaagaagttgtgaatctctctggtggagagttgcaaagagttgccctagcactatgccttggaaagcctgcggatatatatctgattgatgaaccaagtgcatatctggactccgagcagcgtattgttgcttcaaaggtcataaagagatttatacttcacgcaaagaagactgcgtttgttgtggagcatgacttcattatggcaacttacttggcagatcgggtcattgtatatgaggggaggccatctgtagattgtgtggcaaatgcacctcaatcattgttgactgggatgaacttattcttatcgcacctggatattacgttcagacgggatccaaccaattatcgtccaagaatcaacaagttggactccactaaggacagggagcagaagtctgctggatcctattattacctggatgattaacttgttaatcaacaaggttatagctctataaacttggccacacatctctccacatccaagataattcagaagtcccctgacccttcattgggtggcaaaggccattgattttgcttgggatgtgatgcggtgacccaatagcgagttctcttcaggcagtgcgatctttatttctgcagattgatgaatacccttatgtcttagcgggatgatcctttcttcttcatcttgagtactttcctcattcatggttttctatacttgccatgcgccttattttaaccagttttgaccttgttgtctgagtagcattcgaggacttacttttgactaatgatatatctgtccgtattatgcatttgttgtattcttgatttgatgtaagagaaacctgaagaaaagagaagcaatagaaataggaggggtggataatgggtaatgtagtggattttggatattttcgtcctccctccttctctcctgtaaaaa

SEQ ID NO: 4764 - DNA, 3714 bp, Centaurea maculosa
tttcatcaatggcggatagattaacgcgtatcgccatcctaaaagaagaccgttgcaagccgaagaagtgtcgtcaagaatgtaaaaagagctgcccggttgtcaaaactggtaagctgtgtattgaggtcacttctgcatccaagattgcacaaatctctgaggagctgtgcatagggtgtgggatatgtgttaagaaatgcccatttgatgcaattgagatcattaatttgccaaaggatttggataaagatacaactcaccgttatggagtcaataccttcaaattacacaggttgcctgtcccaagaccaggacaagttcttggtttggttgggacaaatggaattggaaagtctacagccctcaaagttttggctggaaaactgaaacccaatttggggcgttttaataaccctccagactggcaagagattttgacatactttcgtggatctgagttgcaaaactacttcacgcgtattcttgaagataatctaaaggctatcataaaaccccagtatgttgaccatatcccaaaagcagttcaagggaatgtcggacaagtgctcgaacaaaaggacgagagagatgtgaaggcagagctttgtgccgatcttgagctgaatcaggtcatagatcgtaacgttggagatttatctggtggagagctacagaggtttgcgattgctgttgttgccatacagaatgcagagatatatatgttcgatgagccctccagttatcttgatgtgaaacaaaggcttaaagctgctcaagttatcagatccttgcttagacctaatagctatgtgatcgttgttgaacacgatctaagtgtgcttgattacttatcagacttcatttgctgcctttatgggaagcctggtgcatatggagttgtgacactacccttttctgtcagagaaggaattaacatatttttggaagggtatgtgcctacagaaaaccttcgttttcgtgatgaatctcttactttcaaggtagctgagacaccacaggagaccgctgaggaaattgaaacatatgcacgttacagataccccacaatgtctaaaactcaaggtgggttcaaacttaaggtgcttgaaggtgaattcacagactcgcagattattgtaatgcttggtgagaatggaacagggaagacaacatttatccgtatgctggctggtttgctgaagcctgatactgtggaagacactgatgtagagatacccgagtttaacgtctcttacaagccccaaaagatcagtcccaagttcccgcactcggtcaggcatttgctgcatcaaaagattcgcgactcgtatatgcatcctcagtttgtatcggatgtcatgaaaccgcttcaaattgagcagctgatggatcaagaagttgtgaatctttctggtggtgaattgcaaagagttgcattcgtgtttgtgccttggcaagcctgctgatatttacctgatagatgaaccaagtgcatacctcgattccgagcagcgtattgttgcttcgaaagttataaagagatttatactgcacgctaagaagaccgcctttgtggttgaacatgacttcataatggcaacttatctagcagacagggtgattgtttacgaagggacaccatccgttgactgtactgcaaatgcacctcagtcgttattgactggaatgaatctcttcttatctcatctgaacattacgtttaggcgggacccaactaatttccgaccaagaatcaacaagcttaattcaacaaaggacagggagcagaaatttgctggatcgtattattacctggatgactaatttgtcgaagactgctggttaatccgtcaccaaaaccatctatagatggagctgagtttatcatcttctggtcaatatgactacagccagttgttagcagcatttaatttgtttgaaaagagctttctttagatagcatcatggtgttacatatgcttgtactactaaagtgcatccattttcatttggagtccccctcttgttttccagttcagtgattttgatttgagcacatgtctttaactggtgattttgagcaagtgatttttgtggagctttttcagtgattttgatgagcacatgattttaagtggtgattttggcaagtgatttttgtggagctttttggtgcatttccttctcacaaatatcacaatagaaatcttcaggatgatcttcgattggaggatatgtcaatgggatttcatgtcctctgcaatacctatgagtaaggaaatgtggagaacatactgcacaaaacatgtctaatcggaagttacaagcctcgcaagcaaagcttataccatcaaacaacttaaaacatgccctacaacgacgagtgtcgggatcaataccttggataagaggatgtttgtgagatttatgtttgatggtgttaggtaaaaatgcacaatttacatctagatagaacttgcaagtttcacatgtgtacgcaaatctgttgccgttgctaaaacaaccattacatagatagtagtcctcatcttcataggtgtctaacaagtcaagtgaatgatccgggtgaagttgatgttctaatgtaagtggtaactcagcacaatatttatggagagtaaataaacatccatctttgcaactataatatggaagggaaaggggtcgtacacacccataacatacctcaattggatccctacaaccaatgttgtgtatgctaccatggggttcaatgttcaagatcaatggatgatcatggctccaatggttaatctctgttgcactatcatcatctacacccatcttctccaaatgaagtaattttagtggatctcttaatgcatatgacataggaaattgcagaaaatcatttgcacattcttcagcaacagatgtacctagttcatcacttgaaatagaaggttgcattgcattcaaggcacacttaatatgggcaaaatatctacaatttgcgcaatgatacatccaaccatttcggtggatgtatctgtcacaaaattcgcaaaaaaaatcgaatttataaaaattgtccggaagtgaatagacgagcacgagaggatgtttatggtgatggtgtagattgatagtgggtgccaaggaagtacaactcttgtggatccagaaatcacactcttcacattggtaaaacaagtcttcatccttagaatgacaagcatcacaaatgaatgatgcagatcttgactggagaattaaagtgtgttgtgagtgaccttcatgttgaaatctgatcaatgattcctccttgcgtgcaacaacaacaccacactttgtacatgcatcaaagttacactgaacacaatggtagctgaaaccttctactcggccatccttaccacacacatcacaagtccaatctatatcaccatggttaactagtgtaagagggtgtggaggatggatatggtgattgatagtaggtcttagttctatgcatttcttatgcagaaagaattggcacgtgatacaaccatatgcagagccagccaacatgggttcttgacatacatggcaatggacggaccctttcttctgatcattatcatcacaaattcctacaacaacctccaagttttcgatgaacttcaatgaatgttcttgatgtataaaatgatgatctcacccatctctcacccttcaatccccgcg

SEQ ID NO: 4765 - DNA, 1834 bp, Cirsium arvense
tttcatcaatggccgatagattaacgcgtattgccatcctaaaagaagaccgttgcaagccgaagaagtgtcgtcaagaatgtaaaaagagctgtccggttgtcaaaactggtaagctgtgtattgaggtcacttctgcatccaagattgcacaaatctctgaggagctgtgcatagggtgtgggatatgtgttaagaaatgcccatttgatgcaattgagatcattaatttaccaaaggatttggataaagatacaactcaccgttatggagtcaataccttcaaattacacaggttgcctgtcccaagaccaggacaagttcttggtttggttgggacaaatggaattggaaagtctacagccctcaaagttttggctggaaaactgaaacccaatttggggcgttttaataaccctccagactggcaagagattttgacatacttccgtggatctgagttgcaaaactacttcacgcgtattcttgaagataatctaaaggctatcataaaaccccagtatgttgaccatatcccaaaagcagttcaagggaatgttggacaagtgctcgaacaaaaggacgagagagatgtgaaggcagagctttgtgccgatcttgagctgaatcaggtcatagatcgtaacgttggagatttatctggtggagagcttcagaggtttgcgattgctgttgttgccatacagaatgcagagatatatatgttcgatgagccctccagttatcttgatgtgaaacaaaggcttaaagctgctcaagttatcagatccttgcttagacctaatagctatgtgatcgttgttgaacacgatctaagtgtgcttgattacttatcagacttcatttgctgcctttatgggaagcctggtgcatatggagttgtgacactacccttttccgtcagagaaggaattaacatatttttggaagggtatgtgcctacagaaaaccttcgttttcgtgatgaatctcttactttcaaggtagctgagacaccacaggagaccgctgaggaaattgaaacatatgcacgttacagataccccacaatgtctaaaactcagggtgggttcaaacttaaggtgcttgaaggtgaattcacagactcgcagattattgtaatgcttggtgagaatggaacagggaagacaacatttatccgtatgctggctggtttgctgaagcctgatactgtggaagacactgatgtagagatacccgagtttaacgtctcttacaagccccaaaagatcagtcccaagttcccgcactcggtcaggcatttgctgcatcaaaagattcgtgactcgtatatgcatcctcagtttgtatcggatgtcatgaaaccgacttcaaattgagcagctgatggatcaagaagttgtgaatctttctggtggtgaattgcaaagagttgcattgtgtttgtgccttggcaagcctgctgatatttacctgatagatgaaccaagtgcatacctcgattccgagcagcgtattgttgcttcaaaagttataaagagatttatactgcacgctaagaagaccgccttcgtggttgaacatgacttcataatggcaacttatctagcagacagggtgattgtttacgaagggacaccatctgttgactgtactgcaaatgcacctcagtcgttattgactggaatgaatctcttcttatctcatctgaacattacgtttaggcgggacccaactaatttccgaccaagaatcaataagcttaattcaacaaaggacagggagcagaaatttgctggatcttattattatttggatgactaatttgtcg

SEQ ID NO: 4766 - DNA, 2813 bp, Amborella trichopoda
gtttcaaagttcaagcacattttccacgtaaacaaacgcggcctcttttttttttccgcttaggctgccctatattttcacccatgcaccaggggagagttaaaggaggctggataaccaggggagagttgaagaaggcttgatcgtttttttctctcttctcatcgcaccatcgcagttccagtatatatttgatcgaggagtgtgatagtgggaagagaaaatggcagatcagcgactgactcgtattgctatcgtaaattctgatcgctgcaagcccaagaaatgccgccaagagtgtaaaaagagctgccctgttgttaaaacgggtaaactttgtatcgaggtttcgcctgcctcaaagattgcttatatttcagaagagttgtgcattggatgtggtatttgtgtgaagaaatgcccatttgatgctatccagataatcaatctgcccaaagatttggataaagatacaactcatcgatatggcccaaacacgttcaagttgcacaggttgccagttccaagacctgggcaagtccttggacttgttgggacaaatggcatagggaagtcaactgctctcaaagttttggctgggaaattgaaacctaatttgggtcggtataataatcctcctgattggcaggaaatattgacatatttccggggatcggagcttcaaaattatttcactcgtatattggaagacaatttaaaggctatcataaagcctcagtatgttgatcacatacctaaggcagtgcaagggaatgttggtcaggtgcttgatcaaaaagatgagagggagatgaaggctgaactctgccatgatctagagttgaatcaggttatagatcgaaatgttggggacctatcaggtggagaactgcagaggtttgctattgctgttgttgcagttcagaatgctgaaatatacatgtttgatgagccatcaagttatcttgacgtaaagcaaaggctaaaagccgcacaagtagttcgatctttactccgtccgaacagctatgtgatcgttgttgaacatgacctgagcgtccttgattacttatctgacttcatttgctgcctttatgggaagcctggaatttatggagttgtgacacttccattttctgtccgagaaggaatcaatatctttttagcgggatttgttcctactgagaatcttcgtttccgggacgagtacctgacattcaaggttgcagagaatccacaggaaagtgctgaggaaattcagacctatgcacgatatagatacccaaccatgagtaaaactcagggaaatttcaagcttacagtggttgagggtgaatttaccgattctcagattattgtaatgttgggtgagaacgggactgggaagacaacatttatccgcatgcttgctggtctactgaaacctgatgtgatcgaaggttcagatgtggaaattcccgaatttaatgtttcttacaagccccagaagattagccctaaattccagcacactgtcagacatttactgcatcagaaaattcgggattcatatatgcatcctcagttcatgtcagatgtcatgaaaccccttcaaattgagcaactgatggatcaggaagttataaatctatcgggtggagagttgcagagggtagcactttgcctctgtctcggcaagcctgctgacatctatctaattgatgagccaagtgcatatctggactccgagcagcgtattgtggcttcaaaggtcatcaagaggttcatccttcatgccaagaagactgcttttgttgtggagcatgactttataatggcgacttacctggcagacagagttattgtgtatgagggaaagccatcagtggattgcactgcaaatgctcctcagtccctgttgactggaatgaacttattcttgtcgcatctggatattacattcaggagagatccgaccaattataggcctcgaatcaacaaattggactctacaaaggacagggaacagaagtctgctgggtcctattactatctagatgattgacagtttttttcacagctgtttgtgcaggtccttgaggtttcaacttccatccaagctgtggaacatctcagtactgagaggaacttctatttattttttgcatgctgtgtttgtgtgttcttcttgagctcatcttcagtggcgtgaattaggaattaaaataggatttttttttgaatgggctgtctaatagttagttacaatcaactttcaaggattttggaaattagtgctacctctcattttgtgtgtagtcgaccccagtgtattatgcccagttcatccaggatgcagaccttagacccatccctggcctttgaagaggttggttatatactgtatggccccagaggtttggggttgcagaagaggatggtttttgggggttgcagaagaggatggttttgaagtgctctcttttttctattcgttatatttatctatagaaagtttagacaaattgatttgaaaatttgatcaaactgctgtgtaagttaatagtttgggaaagagttcttaatcttccaattgagtattctaataaggattgaaattactgaatcgtagatttcaagagtttccctgggcttctctgattcgaaaaactgtgggatgcactgggtgtcaattcattgttgttcacttcttgacccacttcctatggttggttttcatgtttaggtgctaaggtgatttagtgctgtaaaaagtggtggcggatatcttcttatgaaatcttcatatcatcttttattgagcttacgtacaa

SEQ ID NO: 4767 - DNA, 1968 bp, Cucumis sativus
taatcatctcttacctctgattcccttttttctgtgtttagatggcggatcgattgacgcgtatagctatagtgagttcggataggtgcaagcctaaaaagtgccgtcaggaatgcaagaagagctgtccggttgttaagactggtaaactgtgtattgaggttaccccagctgctaagattgcttttatctcagaagaactctgtattggatgcggtatatgtgtcaagaaatgcccatttgaagcaattcaaatcatcaatttgccgaaggatttagataaagatacaacacatcgatatggcccaaacaccttcaaactgcacaggctgccagttcctcggcccgggcaagttcttggtttggttggaacaaatggtatcgggaagtccacagcactgaaagttttggctggaaagctgaaaccaaatcttggtcgtttcaatgagatattgacttactttcgaggatccgagttgcaaaattattttacacgtatccttgaagacaatctaaaggcaatcataaagccccaatatgttgatcacattccaaaagctgttcaagggaatgttggccaggtgctagagcaaaaagatgagagggatatgaagcaagaactttgtcatgatcttgagcttaaccaggttatagatcgcaatgttggtgatctgtctggtggagaacttcaaagatttgccattgctgttgttgccatacagaatgcagagatatatatgttcgatgaaccctcaagttaccttgatgtgaaacagagacttaaagctgcccaagttattcgatctttgcttaggcccaatagctatgtaattgttgtggagcacgatcttagtgtcttggattacttatctgacttcatttgctgtctctatgggaaaccgggtgcttatggagttgtgacccttcccttctcggttagggaagggatcaacatcttcttggctggatttgttcccacagaaaatctacgatttagagatgaatctcttacattcaaggttgctgagactcctcaggaaagtgcagaggaaattgaaacatatgcacgatataagtacccaaccatgagtaaaactcaaggaaatttcaagcttcgtgtgatagaaggtgaatttactgattcacagattattgtgatgcttggtgaaaatggaacagggaagacaacatttattcgtatgctggctggtttgttgaaacctgattctgtcgaaggctctgatattgagattcctgagttcaacgtttcttacaagccccagaagatcagtcctaagttccaatccactgtccggcacttgctacatcagaaaataagagagtcctatatgcatccgcaatttgtttcagacgtaatgaaacccttacttatcgaacaattaatggaccaggaagtcgtgaatctttctggaggagagttgcagagagtcgctttgtgcctctgccttggaaagcctgcagatatctatctgatagatgaaccaagtgcttaccttgattctgagcagcgtattgttgcttcaaaagtcatcaagagatttattcttcacgcaaaaaagactgcctttgtggtcgaacacgattttattatggcaacttatctcgcagatcgcgttattgtttatgagggtcagccatcagttgattgtactgctaattgtcctcagtccctgttgactggaatgaatctcttcttatctcatcttgatattacgtttagaagagatccaacaaattacaggccacgaattaacaaggttgactcggcaaaggatcgtgaacagaagtcagctggctcatactattacttggacgattaagaattttgcaggtgaggaggctggttttttaacctatagagagcagcatgtccgaagctgaatggtcgaatgttcatcttcatctttgaaagaggtgcaaaagagggggagaggacattgtttcatt

SEQ ID NO: 4768 - DNA, 2219 bp, Flaveria ramosissima
cgtattacgtctgctgctgaggtttctaattctaccctttcactcatcatcgtgttccaaccacacgccgcaccttcatcctctgaaccctaagcttttcatcaatggcggatcgattgactcgtatcgccatcctcaaagaagaccgctgcaagcccaagaagtgtcgccaggagtgcaagaagagctgccccgttgttaaaactggtaagctatgcatcgaggtcacttctcaatcgaaaatggcctatatctctgaggagctttgcatagggtgtggtatatgtgttaagaaatgcccatttgatgcaattgagatcatcaatttaccaaaagatttggataaagatacaactcatcgttatggggccaacacctttaaattgcacaggttgcctgtcccaagacctgggcaagttcttggtttggttggaacaaatggaattgggaagtctacagctctaaaagttctggctggaaaattgaaacctaatttggggcgttttaataaccctccagattggcaagaaattttaacttactttcgaggatccgagttgcaaaactacttcactcgtattcttgaagataatttaaaggcaatcataaagccacagtatgttgaccatattccaaaagcagttcaagggaacgttggacaagtacttgaacagaaaaatgagagagatgtgaaggaagaactttgtgcggatcttgagctgaatcaggttattgatcgtaatgttggagatttatctggtggagagcttcagaggtttgcaattgctgttgttgccatacagaatgctgagatttatatgtttgatgagccctcaagttatcttgatgtcaaacaaaggcttaaagctgctcaagttatcagatctttgcttagacctaacagctatgtgattgttgtggagcacgatttaagtgtccttgattacctatcagacttcatttgctgcctctatgggaagcctggtgcatatggtgttgtgacactacccttctctgtcagagaaggaattaatattttcctggaagggtatgtgcccacagaaaaccttcgttttcgtgatgaatctcttacatttaaggtagctgagacaccacaggagagtgctgaagaaatcgaaacatatgcacgctataggtaccccactatgagtaaaacgcaaggtggtttcaaacttaaagtggttgagggtgaattcacagactctcagatcattgtaatgcttggtgaaaacggaacagggaagacaacatttattcgtatgctggctggtttactgaagcctgatactgtagaaggctctgagtcggagatacctgagtttaatgtttcttacaaaccccaaaagatcagtcccaagttccctaattcagtcaggcatttgttacatcaaaagattcgtgactcatatatgcaccctcagtttgtttctgatgtcatgaagcctcttcaaatcgagcagttaatggatcaggaagttgtcaatctttctggtggtgaattgcaaagagttgcattgtgcttgtgtcttggcaagcctgctgatatttacctgatagatgaaccaagtgcataccttgattctgagcagcgtattgttgcttcaaaagttataaagagatttatacttcatgctaaaaagactgcatttgtggttgaacatgattttataatggcaacttatctagcagatcgtgtgattgtttatgaagggacgccatctgttgattgtgttgcaaatgcacctcagtctttattaactggaatgaatctcttcttatcgcatctcaccattacatttaggcgggacccaactaattatcgaccaagaatcaacaagcttaattcaacaaaggacagggagcagaaacttgctggatcttattattacctggatgactaatttaccaattccagtttcatgctaccctacatgactgttgggtatcacttagcaactgtataagcagagtcactctcttctagacacttttggtgaatccactgccaggaccagcggtgcgtggtggtgttcatcctcggtcagtgtttgctacttgttatgtttgaaagagttttaggtaacatgcagttaaatgttacaaatgcttgtacttagtgctgcttttttcatctggaggcacctcttgttttctagttgttatttttccggctcatgattacttatatacgagcgctt

SEQ ID NO: 4769 - DNA, 2392 bp, Quercus alba
aggaaaggaaaagcagaaaactctctgttcttcgtagcgtgatttgcatcattctctcctataaaacccaaacaaggagagaatagaagataagagaagaagaaaagagaagcagaaatgtcggaacgattgacgcgtatagcgattgtgagctccgataggtgcaagcccaagaagtgccgccaggaatgcaaaaaaagctgccctgttgtcaaaaccggaaaactctgtattgaggttactcctgcatcgaagattgctttcatctctgaggaattgtgtattggatgtggtatctgtgtcaagaaatgcccgtttgaagctattcagatcatcaacttgccaaaagatctggacaaagatacaacccatcgctacggccctaacacttttaaattgcacaggttaccagtcccgagacctgggcaagttcttggcctggttggaactaatggcattgggaagtccactgccctcaaagttttggctggaaaactgaaaccaaacctcggtcgcttcaataatcctccagattggcaggaaatcttgacatacttccgaggatctgagctgcagaattattttacacgtattcttgaagataatttgaaggccattataaagccccagtatgttgatcacattccaaaagctgttcaaggtaatgtagggcaggtgctggaccaaaaggatgagagagacatgaagtcagaactctgcgctgatcttcagctgaaccaggttatagaccgtaatgtaggggatttgtcaggaggagagcttcaaagatttgctattgctgttgttgctgtacagaatgcagaaatatatatgtttgatgaaccttcaagttaccttgatgtaaaacagaggcttaaagctgctcaagttgtccgttctttgctcaggcctaatagctatgtaattgttgtggagcatgatcttagcgtcctggattacttgtcggacttcatttgctgtttatatgggaaaccgggagcatatggagttgtaacccttcccttctcagtcagagaaggaatcaatatcttcttggctggatttgttccaacagaaaatttacgttttcgggatgaatcccttacctttaaggttgctgagactccacaagaaagtgcggaggaaattgagacatatgcacgttacaaatacccaaccatgaccaaaactcaaggaaatttcaggcttcgtgttgttgagggtgaatttactgattctcagattattgtgatgctgggtgagaatgggactggcaaaacaacatttatccgtatgctggctggtttactgaaacctgattctgtagaaggttctgatgtggagattcctgagtttaatgtttcttacaagccccagaagatcagtccgaaatttccatccactgtgcggaacttgctacattcaaaaatacgtgattcatacatgcatgctcagtttgtgtcggatgttatgaagcctcttcttattgaacaattaatggatcaagaagttgtgaatctttctggtggagagttgcaaagagttgcattatgcctatgccttgggaagcctgcagacatttatctgatagatgaaccaagtgcatatcttgattctgagcagcgtatagttgcttcaaaagtcattaagaggtttatccttcatgcaaagaaaactgctttcgtggttgaacatgattttataatggcaacttatctggcagatagagttatcgtgtatgaggggaggccatcacttgattgtattgcgaattctccacagtcattgttgactgggatgaatctcttcttatctcatttggatatcacatttagaagggacccaactaatttccgccctagaatcaacaaattggaatcaaccaaggacagggagcagaaatctgctgggtcctattattacctggatgactgacaattttaaatagttgcttctatttcaaagttttagtgcattggtctgagcagtgggttctcaatgagctatttagatatgcgggcatcggtttgagcagtgggatctcaatatgttgacaaacgacaagatatcctcgcctgttgaaggcaaaatgttgtacttctggcttaaaatgagttttcaggccatgttatttattgatgtcagtttactatattttctcctatagtgtgttcaccaattttggtatgacattaggtcagtgaatctgtatgcctatttttcttttaccgcatcaacggttgtatttaactagttgaggaacggcgaaaatgatgtcaattgagttattgcttcacatgttttgacttttgtaatttctggggtaatatttaaaacaattccaccatagtttttctcttggaaaaatttactggaattgctgaatatttac

SEQ ID NO: 4770 - DNA, 2272 bp, Allium cepa
cttcattgccatctagggtttctattgcgtatcctagcaacaaattagttggatcgatctgctgctcaaattagatggcagatcgattgacgaggatcgctattgtcagctcggatcgatgcaaacctaaaaaatgcaggcaggagtgtaaaaagagctgtcccgtcgtcaaaacaggtaagctttgtattgaagttacttcagctgctaagcttgcttacatctccgaggagctatgcatcggatgtggtatatgtgtaaagaaatgcccatttgaggccatacaaattatcaatcttcccaaaaatttggataaagataccacacatcgttatggaccgaatacctttaaattgcacaggctacctgttccaaggcctggacaagttcttggtcttgtaggaacaaatggtattgggaagtccactgcacttaaagtgttagctgggaagctgaaaccaaatttgggccgttttaataatccaccagattggcaggaaattttgacgcatttcagaggatctgagctccaaaactatttcacccgtatactggaggacaatctcaaggctcttattaagccacaatatgttgatcacatacccaaagccgtacaagggaacgtgggtcaggtgcttgatcaaaaagatgagactgatagaaaggctgaactttgtgttgatcttgaattgaatcaagttattgaaagaaatgttggagatctgtcaggtggtgagttacagaggtttgcaattgctgtggttgctgtacaaaatgcagagatatatatgtttgatgaaccatcaagttatcttgatgtaaaacagagactgaaagcagctaaggttattcgttcattactcaaatcacaaagttatgtaattgttgtggagcatgatcttagcgtcctagattacttatcagattttatttgctgtttatatggcaaaccgggagcttatggagtggttacattacctttctcggttagggaaggaatcaacatttttttggctggttttgtgccaactgaaaatctgaggttccgggaagagtcgcttacatttaaggtatccgagacacctcaagaaagtgctgaagaaattgaaacataccagcgttacaaatatcctggcatgagtaaaactcaagggaattttaagctaactgtttgtgaaggggaatttactgattctcagattattgtgatgttgggagagaatggaactgggaagaccacatttattcgtatgctggctggattgttgaaacctgatgtggtggaaggcgcagcagatgttgagatacctgagtttaatgtttcatacaaaccacagaagataagccctaaatttcaatctacggttaggcacttgctgcatcaaaaaattagagagtcctatatgcatccacagtttgtctctgatgtcatgaagcccttacaaatcgaacaactaatggaccaagaagttgtcaatctctctggtggagagttgcaaagagttgctttatgcctttgccttggaaagcctgcagatatatatcttattgatgaaccgagtgcttaccttgattcggagcagcgtattgttgcttcaaaggttattaagaggttcatacttcacgcaaagaaaactgcttttgtggttgaacacgattttataatggcaacatatttggctgataaagttattgtctatgaggggaaaccatctattgattgtatagcgaacgctcctcaatcgttggtgtctgggatgaaccttttcttatctcatcttgacattacattcagaagagatccaacgaactacaggcctcgcataaacaagcttgaatctgccaaagatagggaacaaaagaacgctggatcctattactatctcgatgattgattttggctatcagcacatatttaactggaaaaatgagacctggagcttctggtttttgaacctaaaactatttccgttaggtccatatgcagttacataatctgtctacgttgagtttcaaactagtgaacatttagtattttcttcactgaggtggggtatcaagctatcagcggtaaacagcttgtttggtttcttcataattttttgtttaaatgctattactttgcagtgtttctatataattccataagcatttttgtttgtcgttcctgaccttttatttaacctgatatgtttttcaatgtatctctagtgtggattgaacgtttgaaattttgcctctgttggagttatttgttttgctcattgttctg

SEQ ID NO: 4771 - DNA, 2107 bp, Helianthus annuus
acgacacgcctgcctcttctgaactccgatcgatcaatggcggatcgattgactcgtatcgccatcctcaaagaagatcgttgcaagcccaagaagtgccgacaggaatgcaagaaaagctgtcctgttgttaaaactggtaagctatgtattgaggtcacttctcaatcaaaggtggcgtatatctccgaggagctttgcatagggtgtggtatatgtgttaagaaatgcccgtttgatgcaattgagatcatcaatttaccaaaagatttggataaagatacaactcatcgttatggggccaacaccttcaaattgcacaggttgcctgtcccgaggcctgggcaagttctcggtttggttggaacaaatggaatcggaaagtctacagctctcaaagttttggctggaaagttgaaacccaatttgggccgttttaataaccctccagattggcaagaaattttaacttactttcgaggttctgagttgcaaaactactttactcgtattcttgaagataatttgaaggcaatcataaagccacagtatgttgatcatattccaaaagcagttcaagggaatgttggacaggtacttgaccagaaagatgagagagatgttaaggcagagctttgtgtagaccttgagctgaatcaggttattgatcgtaatgttggcgatttgtctggaggggagcttcaaaggtttgcaattgctgttgttgccatacagaatgctgagatttatatgtttgatgagccctcaagttatcttgatgtcaaacaaaggcttaaagctgctcaagttatcagatctttgcttagagccaacagctacgtgattgttgtggagcacgatttgagtgtgcttgattacctatcagacttcatttgctgtctctatgggaagcctggtgcatatggtgttgtgacactacccttctctgtcagagaaggaattaatatctttttggaagggtatgtgcccacagaaaaccttcgttttcgtgacgaatctcttacgtttaaggtagctgagacaccacaggagagtgctgaagaaattgaaacatatgcacgctataaatacccaactatgtctaaaacacaaggtggtttcaaacttaaagtggttgagggtgagttcacggactctcagatcatagtaatgcttggtgaaaatggaacaggaaagaccacgtttattcgtatgctggctggtatacttaagcctgataccatagaaggctctgagacggagatacctgagtttaatgtctcgtacaaacctcaaaagatcagtcccaagttccctcattcagtcaggcatttgttacatcaaaagatccgtgactcgtatatgcaccctcagtttgtttctgatgtcatgaagcctcttcaaatcgagcagttaatggatcaagaagtcgtcaatctttctggtggtgaattgcaaagagttgctttgtgcttgtgtcttggcaagcctgctgatatttacctgatagatgaaccaagtgcataccttgattccgagcagcgtattgttgcttccaaagttataaagagatttatactacacgctaaaaagactgcatttgtggttgaacacgattttataatggcaacttatctagcagatcgggtgattgtttatgaagggacaccgtctattgattgtgttgcaaatgcacctcagtctttgttaaccggaatgaatctctttttatcgcatctgaccattacatttaggcgggacccaactaattatcgaccaagaattaacaagcttaattcaacaaaggacagggagcagaaacttgctggatcctactattacctggatgactaagataatcgattcagtttcatgcatgacatttgggtattatactgtataagccgtcacttgtagacacttttggttaatccgccaacaagaccagcagagggtggcttctttgctacttgttaaatgtttacattgcttgtactcttttcattaccttttgttttctagttgtaatgtaatttccggctcatgatcactgataattttgaggtgtttgtttgtttgtttgttacgcttgccatgacttaaagat

SEQ ID NO: 4772 - DNA, 1958 bp, Ambrosia trifida
acaaccactgccacaccaccttctactcatcatcgtcttccaacaacacgcctcaatctgttcatcaatggctgatcgattgacacgtatcgccatcctcaaagaagaccgttgcaagcccaaaaagtgtcgtcaggaatgcaagaaaagctgccctgttgttaaaactggtaagttatgtattgaggtcagttctcaatctaaggtggcgtatatctctgaggagctttgcatagggtgtggtatatgtgtcaagaaatgcccatttgatgcaattgagatcattaatttaccaaaagatttggacaaggatacaactcatcgttatggggccaataccttcaaattacacaggttgcctgtcccaagacccggacaagttcttggtttggttggaacaaatggaattgggaagtctacagctctcaaagttttggctggaaagttgaaacccaatttgggccgctttaataatcctccagattggcaagaaattttaacttacttccgaggatctgagttgcaaaactactttacacgcattcttgaagataatctaaaggcaatcataaaaccacagtatgttgatcatattccaaaagcagttcaagggaatgttggacaagtacttgaccagaaagatgagagagatgtgaaggcagagctttgtgctgatcttgagcttaatcaggttattgaccgtaatgttggagatttatctggtggagagcttcagaggtttgcaattgctgttgttgccatacagaatgctgagatttatatgtttgatgagccctcaagttatcttgacgtcaaacaaaggcttaaggctgcccaagttatcagatctttgcttaggcctaacagctatgtgattgttgtggaacacgatttaagtgtgctcgattatctctcagacttcatttgctgcctctatgggaagcctggtgcatatggtgttgtgaccctacccttttctgtcagagaaggaattaacatctttttggaagggtatgtgcccacagaaaacctgcgttttcgtgatgagtctcttacttttaaggttgctgagacaccacaggagactgctgaagaaattgaaacgtatgcacgctataaatatcccactatgtctaaaacgcaaggtggttttaaacttaaagtggttgagggtgagtttactgattctcagatcgtagtaatgcttggtgaaaatggaaccgggaagacaacgttcatccgtatgctggctggtttactgaagcctgatactgtggaaggcggctctgagacggagatacctgaatttaatgtttcttacaaacctcagaagatcagtcctaaatttcctcattcagtcaggcatttgctacatcaaaagattcgtgactcgtatatgcatcctcagtttgtttccgatgtgatgaagcctcttcaaatagagcagctaatggatcaagaagttgttaatctttctggtggagaattgcaaagagttgcattgtgcttgtgtcttggcaagcctgctgatatatacctgattgatgaaccaagcgcataccttgattccgagcagcgtatagtcgcatcaaaagttataaagagatttatactacatgctaagaagactgcatttgtggttgaacatgattttataatggcaacttatctagcagatagggtgattgtttatgaagggaagccatcggttgattgtgttgcaaatgcacctcagtctttattaaccggaatgaatctcttcttatcgcatctcaccattacatttaggcgggacccaactaattatcgaccaagaatcaacaagcttaattcaacaaaggacagggaacagaaacttgctggatcttattactatctggatgactaattttttggttccgtgttgcatgtaccagagtcactctcttctagctactgctggttaatccgccaccaaa

SEQ ID NO: 4773 - DNA, 2163 bp, Daucus carota
gcttaagccccatctgcttttctgcacaccaagctcttctaatcaaacccctctcaagatgtcagatcgattgactcgtatcgctatcgtgagttcggatcggtgcaagccgaagaagtgcaggcaggagtgcaagaagagctgtcctgttgtcaagaccggtaaactttgtattgaagtaacgtccgcagctaaaattgctttcatctctgaggagttatgcattggatgcggaatatgtgttaagaaatgtccttttgaggcaattcagattattaatcttcctaaagatttggacaaagacacaactcaccgttatggtcccaacactttcaagctccataggttgccagttccaagaccggggcaagttcttggtttggttgggacaaatggcattggaaagtctactgctcttaaagttttagcggggaaattgaaacccaatcttggtcgttttaataaccctcctgactggcaggaaattttgacgtactttagggggtctgagttgcaaaattatttcactcgtattctggaagataacctaaaggcaatcatcaagccacaatatgttgaccatattccaaaagcagttcaaggaaatgttgggcaagtgctggagcaaaaggacgagagggacatgaaagaagaactctgtattgacttggaactaaatcaggtcatagaccgtaatgtgggagatttatctggtggggagcttcagaggtttgcaatagctgtagttgctatacaaaatgctgaaatatacatgtttgatgaaccctcaagttaccttgatgtgaaacaaaggctcaaggctgctcaagtcattcgatctttactcaggcctaatagttatgtgattgtcgtggagcatgaccttagtgttctggattatttgtcggatttcatttgctgcctatatggaaagcctggtgcatatggtgttgttactcttccattttctgtcagagaaggaatcaacatattcttggctggttttgtacctacagaaaatctacgatttagagaggaatcccttacttttaaggtttctgagacaccacaggaaagtgctgaggaaatagaaacatatgcacgatataaatatccaaccatgagcaaaacccagggtggtttcaagctcaaagtgacagagggtgaatttactgattctcagattattgtgatgctgggagagaatggaacgggaaagacaacctttattaggatgttggctggtttattgaagcctgacacagtggaaggctctgatattgagatacccgagttcaatgtatcttacaagccccaaaaaattagtccaaaattccaacactcagtccgacatctgttacactcgaaaattcgtgagtcatatatgcatcctcagtttgtgtcagatgtaatgaagccacttttgattgagcagctgatggatcaagaagttgtgaatctttccggaggggagttgcaaagggttgcattatgtctgtgccttgggaagcctgcggatatctatctgatcgatgaacctagtgcatatcttgactccgagcagcgtattgttgcatccaaagtcattaagaggtttattcttcatgccaaaaagacagcatttgtggttgaacacgactttataatggcaacatacttggccgacagagtcatagtgtatgaaggacagccatcaattgactgtgttgcaaattcaccccaatcgcttttgactggaatgaatcttttcttatctcaattggacatcacctttagacgggacccaaccaatttccggcccagaatcaacaaattgaactccgccaaggacagggagcagaaaaatgccgggtcttactattatctggacgactaagcaggttattgttgttcgatatcttaatgactgatcagctgtgtcttgggtcatattatcctatccatatcattctgattacagttaaagatttttgaggttttcgtagggataaccatggatggcgaaggaactagtctatacacctaaacccagaccagaatgctctagtcagaattggtccactagttgggcaattttctgttatttactctttactacttaatacctgaccatccttttgttccctccttactgaagtggtgtacaatgttttttgtttggtg

SEQ ID NO: 4774 - DNA, 2235 bp, Cichorium intybus
gccgcactctttcttcaatcaactgcaactgatcgatcttttccgcgatggctgatcgattgactcgtattgctatcctcaaagaagaccgttgcaagccaaagaagtgtcgtcaagaatgtaaaaagagctgtcctgttgtcaaaactggtaagttatgtatcgaggtcacttctgcatccaagatggcatatatctccgaggagctttgcatagggtgtggtatttgtgttaagaaatgtccatttgatgcaattgaaatcataaatctaccaaaagatttagacaaagatacaacccatcgttatggggtcaacaccttcaaattacacaggttgcctgttcctagacctggacaagttcttggtttggttggcacaaatggaattggaaagtctacagcccttaaagttttagctggaaaattgaaacccaatttggggcgttttaataaccctccagattggcaagaaatcttgacctactttcgtggatccgagttgcaaaactactttacacgtattcttgaagacaatctaaaggctattataaaaccccagtatgttgaccatattccaaaagcagttcaagggaatgttggacaggttcttgatcagaaggatgagagagatgtgaaagcagaactttgtgctgatctggaacttaatcaagttatagaccgtaatgttggagatttatcaggtggagagcttcagaggtttgctattgctgttgttgccatacaaaatgcagagatttatatgtttgatgagccttccagttatcttgatgtcaaacaaaggcttaaagctgctcaagtcatcagatccttacttagacccaacagctatgtgattgtcgttgagcatgatttaagtgtgctggattacctatcagacttcatttgctgtctttatgggaagcctggtgcgtatggtgttgttacactgcccttctctgtccgagaaggaatcaacatatttctggaaggttatgtgcctaccgaaaaccttcgctttcgtgacgaatccctcacttttaaggtggcagagacaccacaagagacagctgaagagatagaaacatacgcgcgctatagatacccgactatggccaaaactcagggtggttttaaactcaaagtggttgaaggcgaattcacagactcccagatcattgtcatgcttggtgagaatggaacagggaagacaacgtttatccgtatgctggctggtttactgaagcctgatacggtggaggagtctgatgtagagatacctgagtttaatgtttcttataagcctcaaaagatcagtcccaagtttcctcattcagtgaggcatttgttgcatcaaaagatccgtgactcgtatatgcatccacagtttgtttctgatgtgatgaagcctcttcagattgagcaactgatggatcaagaggttgtcaatctttctggtggtgaattgcaacgtgttgctttgtgcctctgccttggcaagcctgctgacatttacctgatagatgagccgagtgcttacctggactcagagcagcgtattgttgcctcaaaagttataaaaagattcatcctacacgccaaaaagactgcatttgtggttgaacatgacttcataatggcaacctacttagcagatagggtcattgtttatgaagggaaaccatctgttgattgtgttgcaaatgcacctcagtccttgttaaccggaatgaatctcttcttatctcatctcaacattacgtttaggcgggacccaaccaattacaggccaagaatcaacaagcttaattcaacaaaggacagggagcagaaatttgctggatcttattattatctggatgactaatttctctcttgtacctgccagctaagctaccctaccctaccctacatgactcctgttgtgttagctgtcacatacccactgtataagcagatgcactgctacaccaaaaagaccatgggcacatcttcagttgatgttggttagtgtttgttttgttttgttttaaaaaagagagttgtttttagatgatagcatggatgcacttgtgttacaaatgcttgttttatagttgtaatttccggcccccatgaccatcattacttcgagcacatgttttttagccggtgatttttgagatgtctctgtcatgttttacaacattttttgctatgtttggaacctctttggatatgtttctttattattatta

SEQ ID NO: 4775 - DNA, 2347 bp, Cichorium intybus
tcccaagtaaaagcaatcctactccagaaccctagcccaaggaaattgtgcgtgcgtgcgtactacgtctgctggggtttctacccttcactcatcatcgtgttccaagcacacgccgcactctttctccaatcaactgcaactgatcgatcttttccgcgatggctgatcgattgactcgtattgctatcctcaaagaagaccgttgcaagccaaagaagtgtcgtcaagaatgtaaaaagagctgtcctgttgtcaaaactggtaagttatgtatcgaggtcacttctgcatccaagatggcatatatctccgaggagctttgcatagggtgtggtatttgtgttaagaaatgtccatttgatgcaattgaaatcataaatctaccaaaagatttagacaaagatacaacccatcgttatggggtcaacaccttcaaattacacaggttgcctgttcctagacctggacaagttcttggtttggttggcacaaatggaattggaaagtctacagcccttaaagttttagctggaaaattgaaacccaatttggggcgttttaataaccctccagattggcaagaaatcttgacctactttcgtggatccgagttgcaaaactactttacacgtattcttgaagacaatctaaaggctattataaaaccccagtatgttgaccatattccaaaagcagttcaagggaatgttggacaggttcttgatcagaaggatgagagagatgtgaaagcagaactttgtgctgatctggaacttaatcaagttatagaccgtaatgttggagatttatcaggtggagagcttcagaggtttgctattgctgttgttgccatacaaaatgcagagatttatatgtttgatgagccttccagttatcttgatgtcaaacaaaggcttaaagctgctcaagttatcagatccttacttagacccaacagctatgtgattgtcgttgagcatgatttaagtgtgctggattacctatcagacttcatttgctgcctttatgggaagcctggtgcatatggtgttgtcacactacccttctctgtccgagaaggaatcaacatatttctagaaggctatgtgcctactgaaaaccttcgctttcgtgacgaatccctcacttttaaggtggcggagacaccacaagagacagctgaagagatagaaacatacgcgcgctatagatacccgactatggccaaaactcagggtggttttaaactcaaagtggttgaaggcgaattcacagactcccagatcattgtcatgctcggtgagaatggaacagggaagacaacgtttatccgtatgctggctggtttactgaagcctgatacggtggaggagtctgatgtagagatacctgagtttaatgtttcttataagcctcaaaagatcagtcccaagtttcctcattcagtgaggcatttgttgcatcaaaagatccgtgactcgtatatgcatccacagtttgtttctgatgtgatgaagcctcttcagattgagcaactgatggatcaagaggttgtcaatctttctggtggtgaattgcaacgtgttgctctgtgcctctgccttggcaagcctgctgatatttacctgatagatgagccgagtgcttacttggactcagagcagcgtattgttgcctcaaaagtaataaaaagattcatcctacatgccaaaaagacagcatttgtggttgaacatgacttcataatggcaacctacttagcagatagggtcattgtttatgaagggaaaccatctgttgattgtgttgcaaatgcacctcagtccttattaaccggaatgaatctcttcttatctcatctcaacattacgtttaggcgggacccaaccaattacaggccaagaatcaacaagcttaattcaacaaaggacagggagcagaaatttgctggatcttattattatctggatgactaattttctcacttggagtcgccagctaagctactctacatcactcctgttgtgttggctgtcacatacccactgtataagcagaagcactgctacaccaaaaaaaaacccatgggcacatcttcagttgatgttggttagtgtttgttatgttttgtttgaaaaaagagagttgtttttagatgatagcatgcatggatgcagttgtgttacaaatgcttgttttatagttgtaatttccggcccccatgaccatcattacttcgagcacatgttttttagccggtgatttttgagatgtctctgtcatgttttacaacattttttgctatgtttggaacctctttggatatgtttctttattattatta

SEQ ID NO: 4776 - DNA, 2134 bp, Cichorium intybus
gatggctgatcgattgacgcgtattgctatcctcaaagaagaccgttgcaagccaaagaagtgtcgtcaagaatgtaaaaagagctgtcctgttgtcaaaactggtaagttatgtatcgaggtcacttctgcatccaagatggcatatatctccgaggagctttgcatagggtgtggtatttgtgttaagaaatgtccatttgatgcaattgaaatcataaatctaccaaaagatttagacaaagatacaacccatcgttatggggtcaacaccttcaaattacacaggttgcctgtcccaaggcctggacaagttcttggtttggttggcacaaatggaattggaaagtctacagcccttaaagttttagctggaaaattgaaacccaatttggggcgttttaataaccctccagattggcaagaaatcttgacctactttcgtggatccgagttgcaaaactactttacacgtattcttgaagacaatctaaaggctattataaaaccccagtatgttgaccatattccaaaagcagttcaagggaatgttggacaggttcttgatcagaaggacgagagagatgtgaaggcagagctttgtgctgatctggaacttaatcaagttatagaccgtaatgttggagatttatcaggtggagagcttcagaggtttgctattgctgttgttgccatacaaaatgcagagatttatatgtttgatgagccttccagttatcttgatgtcaaacaaaggcttaaagctgctcaagttatcagatccttacttagacccaacagctatgtgattgtcgttgagcatgatttaagtgtgctggattacctatcagacttcatttgctgtctttatgggaagcctggtgcgtatggtgttgttacactgcccttctctgtccgagaaggaatcaacatatttctggaaggttatgtgcctaccgaaaaccttcgctttcgtgacgaatccctcacttttaaggtggcggagacaccacaagagacagctgaagagatagaaacatacgcgcgctatagatacccgactatggccaaaactcagggtggttttaaactcaaagttgttgaaggcgaattcacagactcccagatcattgtcatgctcggtgagaatggaacagggaagacaacgtttatccgtatgctggctggtttactgaagcctgatacggtggaggagtctgatgttgagatacctgagtttaatgtttcttataaacctcaaaagatcagtcctaagtttcctcattcagtgaggcatttgttgcatcaaaagattcgtgactcgtatatgcatccacagtttgtttctgatgtgatgaagcctcttcagattgagcaactcatggatcaagaggttgtcaatctttctggtggtgaattgcaacgtgttgccctgtgcctctgccttggcaagcctgctgatatatacctgattgatgagccgagtgcttacctggactcagagcagcgtattgttgcctcaaaagttataaaaagattcatcctacacgccaaaaagactgcatttgtggttgaacatgacttcataatggcaacctacttagcagatagggtcattgtttatgaagggaaaccatctgttgattgtgttgcaaatgcacctcagtccttattaaccggaatgaatctcttcttatctcatctcaacattacgtttaggagggacccaaccaattacaggccaagaatcaacaagcttaattcaacaaaggacagggagcagaaatttgctggatcttattattatctggatgactaattttctcacttggagtcgccagctaagctactctacatcactcctgttgtgttggctgtcacatacccactgtataagcagatgcactgctacaccaaaaaaaaaaagaccatgggcccatcttcgttagtgtttgtttgaaaaaagagagttgtttttagatgatagcatggatgcacttgttacaaatgcttgttttatagttgtaatttccggcccccatgaccatcattacttcgagcacatgttttttagccggtgatttttgagatgtctccgtcatgttttacaacattttttgctatgtttggaacc

SEQ ID NO: 4777 - DNA, 2293 bp, Cichorium intybus
attgtgcgtgcgtgcgtactacgtctgctggggtttctacccttcactcatcatcgtgttccaagcacacgccgcactctttcttcaatcaactgcaactgatcgatcttttccgcgatggctgatcgattgactcgtattgctatcctcaaagaagaccgttgcaagccaaagaagtgtcgtcaagaatgtaaaaagagctgtcctgttgtcaaaactggtaagttatgtatcgaggtcacttctgcatccaagatggcatatatctccgaggagctttgcatagggtgtggtatttgtgttaagaaatgtccatttgatgcaattgaaatcataaatctaccaaaagatttagacaaagatacaacccatcgttatggggtcaacaccttcaaattacacaggttgcctgttcctagacctggacaagttcttggtttggttggcacaaatggaattggaaagtctacagcccttaaagttttagctggaaaattgaaacccaatttggggcgttttaataaccctccagattggcaagaaatcttgacctactttcgtggatccgagttgcaaaactactttacacgtattcttgaagacaatctaaaggctattataaaaccccagtatgttgaccatattccaaaagcagttcaagggaatgttggacaggttcttgatcagaaggatgagagagatgtgaaggcagagctttgtgctgatctggaacttaatcaagttatagaccgtaatgttggagatttatcaggtggagagcttcagaggtttgctattgctgttgttgccatacaaaatgcagagatttatatgtttgatgagccttccagttatcttgatgtcaaacaaaggcttaaagcagctcaagttatcagatctttgcttagacccaacagctatgtgattgtcgttgagcatgatttaagtgtgctggattacctatcagacttcatttgctgcctttatgggaagcctggtgcatatggtgttgtcacactacccttctctgtccgagaaggaatcaacatatttctagaaggctatgtgcctactgaaaaccttcgctttcgtgacgaatccctcacttttaaggtggcggagacaccacaagagacagctgaagagatagaaacatatgcgcgctatagatacccgactatggccaaaactcagggtggttttaaactcaaagtggttgaaggcgaattcacagactcccagatcattgtcatgcttggtgagaatggaacagggaagacaacgtttatccgtatgctggctggtttactgaagcctgatacagtggaggactctgatgttgagatacctgagtttaacgtttcttataagcctcaaaagatcagtcccaagtttcctcattcagtgaggcatttgctgcatcaaaagattcgtgactcgtatatgcatccacagtttgtttctgatgtgatgaagcctcttcagattgagcaactgatggatcaagaggttgtcaatctttctggtggtgaattgcaacgtgttgctctgtgcctctgccttggcaagcctgctgatatttacctgatagatgagccgagtgcttacctggactcagagcagcgtattgttgcctcaaaagttataaaaagattcatcctacatgccaaaaagactgcatttgtggttgaacatgacttcataatggcaacctacttggcagatagggtcattgtttatgaagggaaaccatctgttgattgtgttgcaaatgcacctcagtccttgttaaccggaatgaatctcttcttatctcatctcaacattacgtttaggcgggacccaaccaattacaggccaagaatcaacaagcttaattcaacaaaggacagggagcagaaatttgctggatcttattattatctggatgactaatttctctcttgtacctgccagctaagctaccctaccctaccctacatgactcctgttgtgttagctgtcacatacccactgtataagcagatgcactgctacaccaaaaagaccatgggcacatcttcagttgatgttggttagtgtttgttttgttttgttttaaaaaagagagttgtttttagatgatagcatggatgcacttgtgttacaaatgcttgttttatagttgtaatttccggccccccatgaccatcattacttcgagcacatgttttctagccggtgatttttgagatgtctttgtgtcatgttttacaacattttttttgctatggttggacatgtttctttttta

SEQ ID NO: 4778 - DNA, 2279 bp, Cichorium intybus
tcccaagtaaaagcaatcctactccagaaccctagcccaaggaaattgtgcgtgcgtgcgtactacgtctgctggggtttctacccttcactcatcatcgtgttccaagcacacgccgcactctttctccaatcaactgcaactgatcgatcttttccgcgatggctgatcgattgactcgtattgctatcctcaaagaagaccgttgcaagccaaagaagtgtcgtcaagaatgtaaaaagagctgtcctgttgtcaaaactggtaagttatgtatcgaggtcacttctgcatccaagatggcatatatctccgaggagctttgcatagggtgtggtatttgtgttaagaaatgtccatttgatgcaattgaaatcataaatctaccaaaagatttagacaaagatacaacccatcgttatggggtcaacaccttcaaattacacaggttgcctgttcctagacctggacaagttcttggtttggttggcacaaatggaattggaaagtctacagcccttaaagttttagctggaaaattgaaacccaatttggggcgttttaataaccctccagattggcaagaaatcttgacctactttcgtggatccgagttgcaaaactactttacacgtattcttgaagacaatctaaaggctattataaaaccccagtatgttgaccatattccaaaagcagttcaagggaatgttggacaggttcttgatcagaaggatgagagagatgtgaaagcagaactttgtgctgatctggaacttaatcaagttatagaccgtaatgttggagatttatcaggtggagagcttcagaggtttgctattgctgttgttgccatacaaaatgcagagatttatatgtttgatgagccttccagttatcttgatgtcaaacaaaggcttaaagctgctcaagtcatcagatccttacttagacccaacagctatgtgattgtcgttgagcatgatttaagtgtgctggattacctatcagacttcatttgctgcctttatgggaagcctggtgcatatggtgttgtcacactacccttctctgtccgagaaggaatcaacatatttctagaaggctatgtgcctactgaaaaccttcgctttcgtgacgaatccctcacttttaaggtggcggagacaccacaagagacagctgaagagatagaaacatatgcgcgctatagatacccgactatggccaaaactcagggtggttttaaactcaaagtggttgaaggcgaattcacagactcccagatcattgtcatgcttggtgagaatggaacagggaagacaacgtttatccgtatgctggctggtttactgaagcctgatacggtggaggagtctgatgtagagatacctgagtttaatgtttcttataagcctcaaaagatcagtcccaagtttcctcattcagtgaggcatttgttgcatcaaaagatccgtgactcgtatatgcatccacagtttgtttctgatgtgatgaagcctcttcagattgagcaactgatggatcaagaggttgtcaatctttctggtggtgaattgcaacgtgttgctttgtgcctctgccttggcaagcctgctgacatttacctgatagatgagccgagtgcttacctggactcagagcagcgtattgttgcctcaaaagttataaaaagattcatcctacacgccaaaaagactgcatttgtggttgaacatgacttcataatggcaacctacttagcagatagggtcattgtttatgaagggaaaccatctgttgattgtgttgcaaatgcacctcagtccttattaaccggaatgaatctcttcttatctcatctcaacattacgtttaggcgggacccaaccaattacaggccaagaatcaacaagcttaattcaacaaaggacagggagcagaaatttgctggatcttattattatctggatgactaatttctctcttgtacctgccagctaagctaccctaccctaccctacatgactcctgttgtgttagctgtcacatacccactgtataagcagatgcactgctacaccaaaaagaccatgggcacatcttcagttgatgttggttagtgtttgttttgttttgttttaaaaaagagagttgtttttagatgatagcatggatgcacttgtgttacaaatgcttgttttatagttgtaatttccggcccccatgaccatcattacttcgagcacatgttttctagccggtgatttttgagatgt

SEQ ID NO: 4779 - DNA, 2250 bp, Mimulus guttatus
ctctctctctctctctctcatccgcagttgaatcgagagagatgtcggagaagttgacgcgtatcgctatagtgagttccgacaagtgcaagcccaaaaaatgtcgtcaggagtgcaaaaagagttgtcctgttgtcagaacaggtaaactttgcattgaggtgactcctttgtccaagattgctttcatctcagaggaattgtgtattggatgtggtatctgtgtgaagaaatgcccatttgaagcaatccagattatcaatctgcctaaggacttggaaaaggatacaacccatcgttatggtcctaacacctttaagttgcatagattacctgttccaagacctggacaagttcttggcttggttggaactaatggcattggaaaatcgactgcacttaaagtcttggccgggaaattgaaacctaacttgggaaaatttaagagtcctcctgattggcaggaaattttgaccaactttcgaggatctgagctgcaaaattactttacccgtatacttgaagataatttgaaagcaatcatcaaaccccagtatgttgatcacattcccaaagccgtgcaaggcaatgtcgggcaagttctttctcagaaagatgagagagatataaaagaagaaatttgctttgatcttgagttgaatcaggtcatggaccgtaatgtgggtgatttatctggtggagagctgcagagatttgctatagctgttgttgctgtccagaatgcagagatctatatgtttgacgagccctctagttatcttgatgtgcgacagaggctcaaggctgctcaagtcatcagatccttgcttcggcctactagttacgtgatcgttgtagagcatgatcttagtgtgcttgattatttatcggacttcatctgctgcctttatgggaaaccgggggtatatggggtggtaacccttccattctccgtcagagaaggaattaatatatttctggctggatttgtcccaactgagaatctaagatttcgggatgaatctcttacattcaaagttgcggaaacacctcaagaaagtgccgaggaaattgaaacttatgcaagatatcgttatcctaccatgactaaaactcaaggcaatttcaagcttaaggtcatggagggtgagtttactgattcacaaatagttgtgatgctcggtgaaaatgggacggggaagacaacatttatacgtatgctggctggtcttttgaagcctgattcagtagaaggatctgatattgaaatacctgaattcaatgtgtcttacaagccgcagaaaatcagtcctaaatttcagcacacagttagaatgctattgcatcaaaaaatccgtgattcgtatatgcatcctcagttcgtgtcggatgtgatgaagcctctcttaattgagcaactgatggatcaagaagttgtcaatctttctggtggtgaattgcaaagagttgcccttaccctctgtcttggaaagcctgcggacatatatttaatagacgaaccgagtgcatatctggactcggagcagaggattgtggcctcaaaagtcataaagagatttatacttcatgcaaaaaagactgctttcattgtcgagcatgatttcatcatggcaacataccttgctgatcgagtgattgtttacgaggggaagccatcaattgattgtacagcgaatgcacctcaatcccttttgaccggaatgaatctcttcttatctcatctggatatcacattcagaagggaccccacgaatttccgtccgcgaatcaacaagctggactcgaccaaggatcgggagcagaagaatgctggatcgtattattatttggatgactaaacgtgactatcataaatgctactccttggtcaatcgaaagacgctaatactacccttgccttagttgcaatttgttaatgatgaaaaaagtgtttcgacttgttcgagggttttgaatttggtgaaatgtgggagtgggtttacatgatcgagtaatcacctgcggcatatcgattttttttctttttttttagtagctaagcttgctggttagctcctctctgaattattttatttttctttcaccagttttgaccatttaagatgatgttttttggttttttactatgagcattttaaccttttagcattatttggaacaatttgatttatatgaatatttttatacaactgtatttcactttttggtccgaatgcaaattgtatgcaa

SEQ ID NO: 4780 - DNA, 2159 bp, Petroselinum crispum
gattcgtgtgtgcaacacgcaaaaacacaaaggtgcggaaaccctaggcagctacagagctgtttggttagaagaagcctaaagccccctgctgtgtaatcccctgctctcttctaatcaaatccctctcaagatgtcggatcgattgactcgaattgcaatcgtgagttcggatcgatgtaagccgaaaaagtgcaggcaggaatgcaagaagagctgtcctgttgttaagactggcaaactttgtattgaagtaacgtccgcagccaaaattgcttttatatctgaggagttgtgcattgggtgcggaatatgcgttaagaaatgcccttttgaggcaattcagattattaatcttcctaaagatttggacaaggacacaactcaccgttatggtcccaacactttcaagctacataggctacccgttccaaggccggggcaagttcttggcttggttgggactaatggtatcggaaagtcgactgccctcaaagttttagcagggaaattgaagcccaatcttggccgtttcaataaccctcctgattggcaggaaattttgacgtactttagagggtctgagctgcaaaattactttactcgtatcctggaagataacttgaaggcgatcatcaagccacaatatgtggaccatattccaaaagcagttcaaggaaatgttgggcaagtgctggagcaaaaagatgagagagacatgaaagaagtactttgtcgtgacctggaactaaatcaggttatagaccgtaacgtgggagatttatctggtggggagcttcagaggtttgccattgctgtagttgccatacagaatgctgaaatatacatgtttgatgaaccctcaagttatcttgatgtgaaacaaaggctcaaggctgctcaagttattcgatctttacttaggcccaacagttatgtgattgttgtggagcatgaccttagcgttctggattatttgtcggattttatttgctgcctctatggaaagcccggtgcatacggcgttgttacccttccattttctgtcagagaaggaatcaacatattcttggctggttttgtacccaccgaaaatctacggtttagagaggagtctcttacttttaaggtttctgagacgccacaggaaagtgctgaggaaatagaaacatatgcacgatacaaatatccaaccatgagcaaaacccaggggggtttcaagcttaaagtcacggagggcgaatttactgattctcagattattgtaatgctgggtgagaatggaacggggaagactacctttattcggatgctggctggtctattgaagcctgacacagtggaaggctccgatattgagatacccgagtttaatgtatcttacaagcctcagaaaattagtccgaaattccaacactcagtccgacatctgctgcactcgaaaattcgtgagtcatatatgcatcctcagttcgtgtcagatgtaatgaagccactgttaattgagcagctgatggatcaagaggttgtgaatctttctggaggagagttgcaaagggttgcgttatgtctgtgccttgggaagcctgcggatatctatttgattgatgaacctagtgcatatcttgactccgagcaacgtattgttgcatctaaagtcattaagaggtttatacttcacgccaaaaagacagcatttgtggttgaacacgactttataatggcaacatatttggcagacagagtcatagtgtacgagggacagccatcgattgattgtgttgcgaattcaccccaatcgctgttgactggaatgaatcttttcttatctcaattggacatcacctttagacgggacccgaccaatttccggcccagaatcaacaaactgaactctgccaaggacagggagcagaaatcagctgggtcttactattacctggatgactaatatggttattgttgttctctatctaaattagagggaccagctgtgtcttgggtcatattttttcccccccccccccaggtttgtttgctctgtaattaatttgtatttggtttggtgtgtataacttcagttaagttgaagctaatcatccgcttttcttttgcagttgttctctatctaaattagagggaccagctgtgtcttgggt

SEQ ID NO: 4781 - DNA, 2824 bp, Cycas rumphii
caaacgctcactatcgtacattatgtgcgtcgcgagatgtcagccctaattctcctcggtttgtaaataatatgcgatgacctttttggtacacagagggaggcatcgtttaccccagcttcgccttcttagggattttgtttcgcattgatcttctcactccatccatccagaaaacaaattcagggagctcgtctattccactgccgaaggattggaggtgacttgacaaaatgacagatcggctaactagaattgctattgttagctcggatcgctgcaagcccaagaaatgcaggcaggagtgtaaaaagagctgccccgttgtaaaaacaggaaagctatgcatcgaagtctcctctgcctcaaaaattgcatttatatcagaggaattgtgcattggttgtggtatctgtgttaagaaatgtccatttgaagccatccaaatcatcaacctacccaaggatttagataaagacacaacacatcggtatgggccaaacacattcaagttgcacaggttgcctgtcccaagaccaggacaggttttgggactagttggaacaaatggtattggaaagtctactgcacttaaagtgttggctggaaaactgaagcccaaccttggcagattcaataatcctcctgattggcaggaaattcttacatatttccgaggatcagagcttcagaattatttcactcgtattttggaagataacctgaaggctataatcaagcctcagtatgttgatcacataccaaaagcagtgcaagggaatgttggtcaggtgctttctcagaaggatgaaagagaaatgaaatccgagctttgcaacgatcttgaattgaatcaggttattgaccggaatgttggtgatttatctggtggagaattgcaacggtttgctattgcagtagttgcaattcagaatgctgagatatatatgtttgatgagccatcgagttatcttgatgtaaagcagaggcttaaagctgcacaagtagttcggtccctgctcagacccaacagctatgttattgttgtcgagcatgaccttagtgtccttgattatttatcggactttatttgctgtctgtatggaaagcctggggcttatggtgtggtgacactcccattttcagtgagagaaggcatcaatatatttttggctggctttgttcccactgagaatcttcggtttcgggatgaatcacttacctttaaggttgcagagacaccacaggaaagtgcagaagagattcaaacctatgcgcgatacagatatccaactatgtccaaaactcagggtaatttcaagcttaatgtgaatgagggtgagtttaccgattctcagattgttgtaatgttgggagaaaatggaacgggaaagaccaccttcatacgcatgctggcaggtttattgaaaccagatacagttgaagattcagaggtggagatacctgaatttaatgtgtcatacaagccacaaaagataagccccaagttccagtcaactgtcaggcatttactacaccaaaagattcgagattcctacacacaccctcagttcacatctgatgtcatgaaacccctccaaattgagcaactgatggatcaagaagttataaatctttctggcggagaactgcagagagttgcactgtgcttgtgtcttggcaagccagcagatatttatctcattgatgaaccaagtgcatatttggattctgagcagcgtattgttgcagcaaaagtcataaaacgattcattcttcatgcaaagaagactgcttttgttgttgagcatgattttatcatggcaacctatttagcagacagggttatagtatatgagggaaagccttctgtggaatgtattgcaaatgccccccagagtctacaaacaggaatgaacctctttctatcacacttggatattacattcagacgagatccaactaattaccggcctcgcataaataaattggattccactaaggacagagagcagaagaatgcagggtcatattactatctagatgattgaagaaggcctaagtatgaggtagagtcaccaaaagaatctcatacttgcttgagagttaaacgagtttgtgtggctaaagctgttgcgatcttggattttttttcttgattactgtcatttgaatcggtacttggaaagctgcggttaaagagtgaatattcataggggcagaggatttttctttacttcctcatttgtttggttctaacgacaaagtgacctttttagaactggcagtgaattgaagtcactttttccctaaagcaaaatttcaggttctctttccttgtggggtggggggaaatgctggagtttagcgcaggtttaggtttatacctctatttcttgtatgctgttgagatccatacatatgtttttggtgaaaaagtgtatgctatgaaataaaagtgtggcttgctgaacctgtgctatttgtccttgctacaaactgctctgtagtatgtgctattttttcatgtgtcacagtatcatgaaggcattgttgtgctttgacttggtttctgaaacactagcccatgggaaacatggaaatgtgagaaaagaggtttagcttcacattaagatttccactagccatcccagttcatatcatggtctcagactgaatcaaattccagctccccttggctatctgctttttgttccattatgcatacatctgaagaacacgtgagcaactcacagcagttcactactattcttgggatcgaagggatacatttctttcattattccctagtagctaggggcct

SEQ ID NO: 4782 - DNA, 2350 bp, Ambrosia trifida
caacaaaaaatagaggggtaaaaaatgtgttacagtatgtattttatttgggaagcgttgatgcaaattatctatccccatagagtaaaacaaatcatcctgagaaccctagctagctgtgcgtgcgttgtacgtctgctgctgctgctgctgaggtttctaccatcatcatcatcatcatcatcatcatcgtgttccaaccacacgcctcttcctctcaactcttaactttccgatcacttgatcgatggctgatcggttgactcgtatcgccatccttaaagaagaccgttgcaaacccaagaagtgtcgtcaggaatgcaaaaaaagctgccccgttgttaaaactggtaagctatgtattgaggtcacttctcaatcaaaggtggcatatatctccgaggagctttgcatagggtgtggtatatgtgttaagaaatgcccgtttgatgcaattgagatcattaatttaccaaaagatttggataaagacacaactcatcgttatggggccaacaccttcaaactgcacaggttgcctgtcccaaggcctgggcaagttcttggtttggttggaacaaatggaattgggaagtctacagctctcaaagtcttggctggaaagttgaaacccaatttgggccgttttaataaccctccagattggcaagaaattttaacctacttccgaggttctgagttgcaaaactactttacccgtattcttgaagataatttaaaggcaatcataaagccacagtatgttgatcatattccaaaagcagttcaagggaatgttggacaagtacttgaacagaaagatgagagagatgtgaaggccgagctttgtgtggatcttgagctgaatcaggttattgatcgtaatgttggcgatttgtctggtggagagcttcaaaggtttgcgattgctgttgttgccatacagaatgctgagatttatatgtttgatgagccctcaagttatctcgatgtcaaacaaaggctcaaagctgctcaagttattagatctttgcttagacctaacagctacgtgattgttgtggagcatgatttaagtgtgttggattatctatcagacttcatttgctgtctctatgggaagcctggtgcatatggtgttgtgacactacccttctccgtcagagaaggaattaatatctttttggaagggtatgtgcccacagaaaatcttcgttttcgtgacgaatctcttacatttaaggtagctgagacaccacaggagagtgctgaagaagttgaaacatatgcacgctatagatacccaactatgactaaaacgcaaggtggtttcaaacttaaagtggctgagggtgaattcacagactctcaaattatagtaatgctgggtgaaaatggaacaggaaagaccacgtttatccgtatgctggctggtatacagaagcctgataccgtagaaggctctgagacggagatacccgagttcaatgtgtcgtacaaacctcaaaagatcagtcccaagttccctaattcagtcaggcatttgctacatcaaaagattcgtgactcgtatatgcaccctcagtttgtttctgatgtcatgaagcctcttcaaatcgagcagttaatggatcaagaagtcgtcaatctttctggtggtgaattgcaaagagttgcattgtgcttgtgtcttggcaagcctgctgatatttacctgatagatgaaccaagtgcataccttgattctgaacagcgtattgttgcttcgaaagttataaagagatttatactacacgctaaaaagactgcatttgtggttgaacatgatttcattatggctacttatctagcagatcgggtgattgtttatgaagggaagccgtctgttgattgtgttgcaaatgcacctcagtctttgctaaccggaatgaatctctttttatcacacctgaccattacgtttaggcgggacccaactaattatcgaccaagaatcaacaagcttaattcaacaaaagacagggagcagaaacttgctggatcctattattacctggatgactaaataaactaccctacatgacttttgggtatactgtataagcagagacttttggtgaatccgctgccaagaccagcagagggtgttggtgttcagctcgtttttgtgtttgctacttgttaaatgtttaaattgcttctacttttttcatttggaggtggtacatcttgttttttacttgtattttccggctcatgattactgactgatatatgagagcatgcttgtaactttgcaatggttttgaggtgtgcacttgttatgctatgtcatgaaatctaagatgaa

SEQ ID NO: 4783 - DNA, 2295 bp, Amsonia hubrichtii
atcagctcttgcgtgtgaacaacgtacacgcgttcattggcacttttggattgttcactcttatttctctgctgcccagaagaacataagcacccaaagcacacgcctctctccagttctgctcgaatcaatcttcctaagagagagatggcggatcagaggttgactcgtattgcaattgtgagttcggacaagtgcaagccgaagaagtgccgacaggagtgtaaaaagagttgtcccgtcgtcaaaactgggaaactttgtattgaggtgactcctcaatccaggattgctttcatctcagaagaattgtgcattggttgcggtatttgtgtgaagaaatgcccatttgaagctattcagattatcaatttacctaaagatttggacaaggatacaacacatcgttacggtccaaataccttcaaattgcataggttaccagtcccaagaccaggacaggttcttgggctggttggaacaaacggcattgggaaatcaactgccctaaaagttctggctggcaaattgaaacctaacttggggcgctttaataacccgcctgattggcaagagatcttgacttatttccgtggatcagaacttcagaattattttactcgtattctggaagataacctgaaggcaatcatcaagccacagtatgttgaccacatccccaaggctgtccaaggcaacgttggtcaggtgctggatcaaaaagatgagagagagatgaaagaagaactttgttttgatcttgagctgaatcaggttttggaccgtaatgtgggggatttatctggtggagagctccagaggtttgccatagctgttgtggcaatacagaatgctgaaatctatatgtttgatgaaccctcgagttaccttgatgtgaaacagaggctgaaagctgctcaagttgtccgctcattgctccgtcctaatagttatgtaatcgtggtggagcatgatctcagtgttctggattatttatcagacttcatttgctgtctatatgggaagcctggtgcatatggtgtcgtaacccttccattttctgttagagagggaattaatatatttttggctggatttgtccctacagaaaatctgcgatttagggatgaatcacttacctttaaggttgcagagactccacaagaaagtgctgaggaaatcgaaacatatgcacgatataagtatccaaccatgacaaaaactcagggcggtttcaagcttaaggttatggagggtgaatttactgattctcagatagttgtaatgcttggtgagaatgggactggaaaaacaacattcatccggatgctggctggtttactgaaacctgatttagttgagggctctaatgtggagatccctgagttcaatgtctcatacaaaccacagaagatcagtccaaaatttcagtctaccgtgagacacttgcttcatcaaaaaatacgtgattcatatactcaccctcagtttatgtcagatgttatgaagcctctccagattgagcaattaatggatcaagaagttgtgaatctctctggtggagagttgcaaagagttgccctagcgctatgcctcggaaagcctgctgatatatatctgattgatgaaccaagtgcatatttggactcggagcagcgtatcgttgccgcaaaggtcataaagagatttatacttcatgcaaagaaaacggcatttgttgttgagcacgatttcataatggcaacatacctggcagatcgggttattgtatatgaggggaggccatctgtagattgtgttgcaaatgcacctcaatcattattgactggaatgaacttattcttatctcatctggatattacattcagaagggatccaactaattaccgtccaagaatcaacaagctggaatcaaccaaagacagggagcaaaaatctgctggatcctattattacctggatgattaactcgttaatcaacaaggtgatgattaactcgttaatcaacaaggttatagccatattccatgatctatcatttctctctgcatccaagatattagcagaagctctgacctttccttaggtggcgtttttctgtgagagggcaattcatctttgcaaatcattccttgatgtgatgatgggatccaacaagaagttcttttctggcatcgagatcttcatctatggagaccgataaatacatatatatgtcccttggcttcgcggaatcatcctctttactatagagtacttttcccataattttgtatggttttactctagtgtatg

SEQ ID NO: 4784 - DNA, 2101 bp, Malus domestica
atgaggccttcgctcacttcagtgtccgctactcttcctcaacatctcaacccctcaattggaacctccacttctaggatcagctctagaaccaaatcgttgagagaggacaaagagacagctctcccctcccctggtacgccacacgccacaccacctccccgaccctccctatacttagcagtcagtctgccttccgtcgccaccgccgtcatctgcttcgttttcttcaataagattaggagaggagatggcagaccggttgacccgtattgcaatcgtgagctccgacagatgcaagccaaagaagtgccgccaggaatgcaagaagagctgccctgttgtcaagactggtaaactatgtattgaggttacccctgcagccaagattgcttttatctcggaagaattgtgcattgggtgcggtatctgtgttaagaaatgcccatttgaagcaattcaaatcatcaacttaccgaaggatttaaacaaagatacgacccatcgttatggtcctaacactttcaaactacacaggttaccagtcccaaggccaggtcaagttctaggtttggttggaactaatggcattgggaagtcgactgccctcaaagttttggctggaaagttgaaaccaaatttaggccgtttcaagaatcctccagattggcaggaaatcttgacctacttccggggatctgagctgcagaattattttacccgtattctggaagataatttgaaggccattataaagccccagtatgttgatcacattccaaaagcagttcaaggaaatgttggggaggtgctcaaccagaaagatgagagggatatgaaggaagaactgtgtgctgaccttgagctgaaccaggttatagaacgtaatgtaggggatttatcaggtggggagcttcaaagatttgccattgctgtcgtcgccatacagaatgcagagatatatatgtttgacgaaccttcaagttatcttgatgtgaaacaaaggcttaaagctgcccaagttgtccgatctttactcaggcctaatagctatgtaattgttgtggagcatgatcttagtgtcttggattacttgtcagacttcatttgctgtttatatgggaaacctggtgcatatggagttgtgactcttccattctcagttagagaaggaatcaacatcttcctggccggatttgttcctacagaaaatcttaggttccgagatgaatctctgacatttaaggttgctgagacaccacaggaaagtgctgaggaaattgagacatatgcacgatatagatacccatcaatgagtaaaactcagggaaatttcaggcttcgtgtggttgagggtgaatttacagattctcaaattattgtgatgctgggtgagaacggaacagggaagactacatttattcgtatgctggcgggtctattgaaacctgatattgtagaaaattcagatgtggagatacctgaattcaatgtttcttacaagcctcagaaaatcagtccaaagtttcaatccactgtcagacacttgttacattcaaaaatccgtgattcatatactcatccacaatttatgtcggatgtgatgaagcctcttctaattgaacaattaatggatcaagaagttgtgaatctctctggcggtgagttgcagagggttgcattatgcctatgcctcgggaagccagcagatatttatctgatagatgaaccaagtgcttatcttgattctgagcagcgtattgttgcttctaaggtcataaagaggtttatccttcatgctaagaaaactgctttcgtggttgaacatgattttattatggctacctacttggctgatagagttatagtctatgaggggaagccgtcaattgattgtactgcaaattgtccccagtcattgttgactgggatgaatctgttcttatcgcatcttgatatcacatttagacgtgaccccactaactatcgcccaagaatcaacaaattggagtcaactaaggatagggaacaaaaagctgctgggtcctactattacctggatgattgataaggccttgatggtatgtttcattcttattcc

SEQ ID NO: 4785 - DNA, 1884 bp, Cannabis sativa
taatttttgtttatgtgattagagagccatgtcggatcggttgacgcgtatagctatagtaagctcggacagatgcaaacccaaaaagtgtcgtcaggaatgcaagaaaagttgtcccgtcgtcaagactggcaaattgtgtattgaggttacaaccgcatccaaaattgctttcatatctgaagagctttgcattggttgtggtatatgtgttaagaaatgcccatttgaagcaattcagattattaacttgcccaaggatttggacaaagatacaacccatcgttatggccccaatacatttaaactccacaggttaccagttccaaggccaggtcaagttctaggtttggttggaactaatggcattggcaagtctactgctcttaaagttttggctggaaaactcaaaccgaatttggggcgtttcactaatcctccggattggcaggaaatcttgacctactttcgaggttctgagctgcaaaattattttactcgtatactggaagataatttgaaggctattataaagcctcagtatgttgatcacattcccaaagctgttcaaggaaacgtaggtcaagtgcttgatcaaaaagatgagagagacaggaaggccgaactctgcaaagatcttgatctaaaccaggttatagaccgtaatgttggagatctatctggtggagagcttcagagatttgctattgctgttgttgccatacaaagggccgagatatatatgttcgacgaaccttccagttatcttgatgtgaaacaaagactcaaagcagctcaagttatccgatccttgctcagggccgacagctatgtaattgttgtggagcacgacctgagcgtcttagattacttgtcagacttcatttgctgtttatacgggaaaccgggtgcatatggagttgttactcttcccttctcagtcagagaaggaatcaacattttcttggctggatttgtgcctacagaaaatcttcgtttccgagatgagtctctgacattcaaggttgctgagactccacaggagagtgctgaagaaattgaaacatatgcacgatacaaatacccaaccatgactaaaactcagggcaatttcagacttcatgtaatggagggtgaatttactgattctcagattgttgtgatgttgggagagaatggtacaggaaagacaacatttattcgtatgctggctggtttgttgaagcctgatgttattggagatactgatgtggagatacctgagtttaatgtttcttacaagccccagaaaatcagtccgaagtttcagtctactgtcaggcacctgctacatcaaaagatacgtgattcgtacactcatccccaatttatgtcagatgtgatgaaacctcttcttatagaacaattgatggatcaagaagttgtaaatctttctggaggagagcttcagagagttgcactttgtctatgccttggaaagccagctgacatttatctaatcgatgaacccagtgcttatcttgattctgagcagcgtattgttgcttcaaaggtcataaagaggtttatcctccatgcgaagaaaactgcttttgtggttgagcatgatttcattatggcaacttatctggcagatagagtcattgtgtacgaggggaatccttcgattgactgtactgctaatgctccccaatcattgttgactgggatgaatctattcttatctcatctggatatcacatttagacgcgacccaaccaatttccgcccaagaatcaacaagctggactcaactaaggatagagagcagaagcatgccgggtcctactattacttggatgactagaagatactcttgggacgggtgtgtataattaattattc

SEQ ID NO: 4786 - DNA, 2499 bp, Cajanus cajan
gcacggtgaagcaagtaaccctaatgctattatgctatatgcttttcttcacgttctcaccacacgcctctctccttcttcttcgatcacgctcgcctctctcttccttccaaaagggaaaacacaatctcactctcactgcttgaggcgccatggcggatcgattgacgcgtatcgccatcgtcagcaacgacaggtgcaagcccaaaaagtgccgccaggagtgcaagaagagttgccccgttgtcagaacaggtagattgtgtattgaggtcacttccgcgtccaagatagctttcatatctgaggaattgtgcattggatgcggtatttgtgttaagaaatgtccttttgaagctattcagattattaacttgcctaaagacttggacaaggatactactcatagatatggtcctaatacttttaagctgcataggttgcctgtgccgaggccggggcaagtgctcggattggttgggacaaatggaattgggaagtccactgctctgaaagttttggctgggaaattgaaaccgaacttggggagattcactaatccccctgattggcaggaaattttaacctatttccgaggatctgaattgcagaattacttcactcggattctagaggatgatttgaaggctatcatcaaacctcagtatgttgaccatattccaaaagctgtgcaagggaatgtggggcaggtgctggaccagaaagatgagagagatatgaagcaggagctttgtgctgatcttgagcttaatcaagttatagatcgtaatgttggtgatctttcaggtggcgagctccaaaggtttgccattgcggttgtagccatccagaatgctgagatatacatgtttgatgaaccttctagttatcttgatgtgaaacagaggctgaaagctgcccaagttattcgatcattgctcaggcctaatagctatgtaattgttgtagagcatgatcttagtgtcttggactacttatcagactttatttgctgtctatatggaaaacctggtgcatatggagtggtcacacttcccttctcagtcagagaaggaataaacattttcttggctggatttgttccaacagaaaatcttaggttccgggatgactcacttaccttcaaggttgctgagactccacaggaaagtgctgaggaagctcagacatatgctcgatacaaatacccaaccatgaccaaaactcaaggcaattttaaacttcgtgtagttgaaggagaatttactgattctcagattgttgtgatgctgggtgagaatgggacaggaaagacaacatttattcgtatgctggctggtttattgaaacctgactctgtagaaggtggatctgatgctgagatgcctgaatttaatgtttcatacaagcctcagaagattagcccgaagttccaatcaactgttaggcatttgctacatcaaaaaatacgtgatgcgtatactcatccccagtttgtgtcagacgtgatgaagccacttcttattgaacagttaatggaccaagaagttgtgaatctttctggtggagagttgcaaagagttgcactgtgtctctgtcttggaaagcctgcagacatctatctgatagatgagccaagtgcatatctagattctgaacagcgaattcatgctgccaaagtcattaagagatttattcttcatgcaaagaaaacagcttttgttgttgagcatgatttcatcatggcaacatatcttgcggacagagttattgtttatgaaggtcaaccatcaattgattgtattgctaatgctccacaatcattgttgactgggatgaaccttttcttatctcatcttgatatcacatttagaagggacccgactaacttccgcccaaggataaacaaactcgattcaactaaggatagagaacaaaagtctgctgggtcttattactaccttgatgactgagttcatacttaggggctgttcattctccaacgcaacaatgcatctgtttgagcttttaatgggatctcaaatttagttcatttgatgccttgaaatgttagattgccatttttcctgttgaaggcatctttctcaatgaatagaagaccagaaaaaaaaaaaagagcctgcatgcaggacaaatgttggttggtgcatttgtatattttccctaatatctagtgcagttactcaccaccagttttgctgcgacttgggtgggtgaatctgaatattacctgagtttatattgacatggttttcattacatgtcccgaatcgagaggaacattcatgatgtcagatcgggtttatcgtcattttggctcataatttcagttgaatattcagcgaagtttatgttcatttacatgttacttggtttagatggatgtctcctgtttggaatatattgccgttgagagggttgatacattggtggataatatcattcatatatgaaattgcggttggttgtgactatttg

SEQ ID NO: 4787 - DNA, 2119 bp, Allium cepa
agcaacaaattagttggatcgatcagctgctcaaattagatggcagatcgattgacgaggatcgctattgtcagttcggatcgatgcaaacctaaaaatgcaggcaggagtgtaaaaagagctgtcccgccgtcaaaacaggtaagctttgtattgaagttacttcagctgctaagcttgcttacatctccgaggagctatgcatcggatgtggtatatgtgtaaagaaatgcccatttgaggccatacaaattatcaatcttcccaaaaatttggataaagataccacgcatcgttatggaccgaatacctttaaattgcacaggctacctgttccaaggcctggacaagttcttggtcttgtaggaacaaatggtattgggaagtccactgcacttaaagtgttagctgggaagctgaaaccaaatttgggccgttttaataatccaccagattggcaggaaattttgacgcatttcagaggatctgagctccaaaactatttcacccgtatactggaggacaatctcaaggctcttattaagccacaatatgttgatcacatacccaaagccgtacaagggaacgtgggtcaggtgcttgatcaaaaagatgagactgatagaaaggctgaactttgtgttgatcttgaattgaatcaagttattgaaagaaatgttggagatctgtcaggtggtgagttacagaggtttgcaattgctgtggttgctgtacaaaatgcagagatatatatgtttgatgaaccatcaagttatcttgatgtaaaacagagactgaaagcagctaaggttatccgttcattactcaaatcacaaagttatgtaattgttgtggagcatgatcttagcgtcctagattacttatcagattttatttgctgtttatatggcaaaccgggagcttatggagtggttacattacctttctcggttagggaaggaatcaacatttttttggctggttttgtgccaactgaaaatctgaggttccgggaagagtcgcttacatttaaggtatccgagacacctcaagaaagtgctgaagaaattgaaacataccagcgttacaaatatcctagcatgagtaaaactcaagggaattttaagctaactgtttgtgaaggggaatttactgattctcagattattgtgatgttgggagagaatggaactgggaagaccacatttattcgtatgctggctggattgttgaaacctgatgtggttgaaggtgcagcagatgttgagatacctgaatttaatgtttcatacaaaccgcagaagataagccctaaatttcaatcaacggttagacacttgttgcatcaaaaaatcagggagtcctatatgcatccacagtttgtctctgatgtcatgaagcctttacaaatcgaacaactaatggaccaagaagttgtcaatctctctggtggagagttgcaaagagttgctttatgcctttgcctgggaaagcctgcagatatatatcttattgatgaaccgagcgcttaccttgattcggagcagcgtattgttgcttcaaaggtcattaagaggttcatacttcacgcaaagaaaactgcttttgtggttgagcacgattttataatggcaacatatttggctgataaagttattgtctacgagggtaaaccatctattgattgtatagcgaatgctcctcaatcgttggtatctgggatgaaccttttcttatctcatcttgacattacattcagaagagacccaacaaactacaggcctcgcataaacaagcttgaatctgccaaagacagggaacagaagaatgctggatcctattactaccttgatgattgattttgggtatcagaaaatattaaaaaaccaaacaagctattaccgctgatagcttgatacctcacttcagtgtagaaaatactaaatgttctctggaactcaaatgtaaacatactatgtatttagattcaaagcagaagctccatgtctcgtttttgcagcaaaccatttactgatacccaaaatcaatcatcaaggtagtaataggatccagcattcttctgttccctgtctttggcagattcaagcttgtttatgcg

SEQ ID NO: 4788 - DNA, 2251 bp, Aquilegia formosa
atgtcggatcgattgactcgtattgctattgttagttctgatagatgtaaacctaaaaaatgtcgtcaagaatgcaagaagagctgccctgttgtcaagacaggtaaactgtgtattgaagtatctcctgcagctaagattgcatacatctcagaggagttatgtattggatgtggtatatgtgtcaagaaatgcccatttgaagcgattcaaatcatcaatttgccgaaagatttggataaagacacaacccatcgctatggtgcaaacaccttcaaattgcacaggttaccagttccaaggcctggacaagttttaggcttagtcggaacaaatgggattgggaaatctactgccctcaaagttttggctggaaagttgaagcctaacttgggtcgcttcaaaaatcctcctgattggcaagaaatattgacatactttcggggatctgagcttcagaattatttcactcgtatattggaggacaacctgaaggcaatcattaagcctcaatatgttgaccacattccaaaggcagtgcaaggaaatgtggggcaggttctagaccaaaaagatgagagagacatgaaggctgaactttgtaaggatcttgatttaaatcaggtcattgatcgaaatgtgggtgacttatcaggaggggagctgcagagatttgctattgctgtagttgctatacagaatgcagagatatatatgtttgatgagccttcaagttatcttgatgttaagcaaaggcttaaagctgcccaggttgttcgatccttgcttagacctaacagctatgtgattgttgtggagcatgacctgagcgtcctagattacttatcagactttatatgctgcttatatggaaagcccggagcgtatggagttgttactcttcctttctctgttagagaaggaatcaacatcttcttggctggttttgtccctactgagaatttacgattccgagaggaatcacttacatttaaggttgcagagactcctcaagaaagtgctgaagaaattcagacatatgcacgatatagatacccaacaatgactaaaactcagggtaattttaggcttcgtgtcagtgaaggtgaatttactgattctcaaataattgtcatgcttggtgagaatggaaccggaaagacaaccttcattcgtatgctggctgggttattgaagcctgatcttgtggagggtgatgcggaaataccagagtttaatgtttcttacaagccacagaaaatcagtccaaaatttcaatcgactgtccgtcacctactgcatcaaaagatccgtgatatgtacatgcatcctcaattcatgtcagatgtcatgaaaccacttcaaattgaacaattaatggatcaggaagtggtaaatctctctggtggagaattgcaaagagtagcattgtgcctatgcttgggaaagccagctgacatttatctaatagatgaaccaagtgcttatcttgactcggagcagcgtattgttgcttcaaaagtcataaagaggtttatcctccatgccaagaagaccgcctttgttgttgagcatgatttcataatggcaacttaccttgccgacagagtgattgtatatgagggcaatccatctatcgattgtactgcgaatgctccacagtccttgttgactggaatgaacctattcttatctcatctggatattacattcaggcgggatcctactaattatcggccgcggattaacaaattagagtctactaaagatagagaacaaaagaatgccgggtcttattattaccttgatgattaaaggaatttcaacacaggtatatgtcctgctttgcaatttggatattctgtgataatcatattgacccagctgaaacatctgaggcttcctagagtccagggcagtttgtggagggatgttcctcaaccccagcaacagaaacagaagtggttcgtctagtaacattgccttaatttattctcctctggatttcaaagttttcgtcgggttttgtttaagattagctgaggaatctcaattataatgttgactgtggtcttttctctcccaacatacatgacatgcccaaaagttgtatgaaaacagagagattacactgtttcagaacactcctaactttgagctgttgtgttattatgatcccatatggggtaagattttgacgtttgtgagatgcttttgataggatgtgtaatattttgatattattttcgca

SEQ ID NO: 4789 - DNA, 2369 bp, Citrus clementina
agaaattaaaaacaaaatgaaaagaaaaagaaaccctaacacttaactaaagagaaattctgtgttgctattgctctgcgtgtgcccaacgctttcacaatccacagagagcgttctcagcacacgtctctcgtccgtttcaaagagagaagatgtcggaccgattgacgcgtatagctattgttagttctgatagatgcaagcccaagaagtgtcgtcaggagtgtaagaagagttgtcccgttgtcaaaaccgggaagttgtgtattgaggttactcctgcagctaagattgcctttatctctgaggagttgtgcattggatgtggtatctgtgttaagaaatgtccatttgaagcaattcagatcatcaacttgccaaaggatttggataaggatacaactcatcgatatggccccaatactttcaaattacataggttgcctgtaccgaggcctgggcaagttcttggcttagttggaacaaatggtattgggaaatcaactgcacttaagattttggctgggaagctgaaaccaaatttgggtcgtttcaataaccctcctgattggcaggaaattttgacctactttcgtggatctgagctgcaaaattattttactcgtattctggaagataatttgaaggctattataaagcctcagtatgttgatcacattccaaaagcagttcaaggcaatgtggggcaggtgcttgaccaaaaagacgaaagagatatgaaggcggatctttgcgcggatcttgacctgaatcaagtcatagaccgtaatgttggggatttatctggtggagagcttcagagatttgccattgctgttgttgctgtacagaatgcagagatatatatgtttgatgaaccttcaagttatcttgatgttaaacagaggctgaaagcggcccaagttgtccgatctttactcaggcctaatagctatgtgattgttgtggagcatgatcttagcgtccttgattacctgtcagatttcatttgctgcttatatgggaagcctggtgcttatggcgttgttactcttcctttctctgttcgagaaggaatcaatattttcttggctggatttgtaccaaccgaaaacctacgttttcgtgatgaatctttaacattcagggtcgctgagactccacaagaaagtgctgaggagattgagacatatgcacgatacaagtaccccaccatggttaagacgcagggaaattttaagcttaaggtggttgagggtgaatttaccgactcccagataattgtgatgttgggagagaatgggacagggaagacaaccttcatcagaatgctggctggtctattgaaacctgattctgtggaagattctgacgtggagatacctgagtttaatgtctcgtacaaacctcagaagatcagtcccaaatttcagtctacagtcagacacttgcttcaccaaaaaatacgtgattcatatactcatccgcagtttgtgtcagatgtgatgaagcctcttctcattgaacaattgatggatcaagaagttgtgaatctttctggtggagaattgcagagagttgcgctatgcctctgccttggcaagccagcggacatttatttaattgatgaacctagtgcatatctcgattctgagcagcgtattgttgctgcaaaagtcattaagaggtttatccttcatgcgaagaaaacagcatttgtcgtcgagcatgattttataatggctacttatctggcggatagagttattgtgtatgagggacagccgtcagtggattgtgttgcaaatgctcctcaatcattgttgactggaatgaatcttttcttatcccatctagatataacatttaggcgggatccaacaaatttccgaccgagaatcaacaaattggactccactaaggacagggatcaaaaagctgctgggtcatactattacctggatgattaaaataataatttccagttggtggttctgcaaaagttgatggcatcgatgcaggcatagaatgaggcgatggcatccaaggtccttttgcccaaaaaatgtttgaaatgagtttttgtgccatatactaatgaagctctagttaaatttttgctttattaggcttttgtgttttcaccattttttttattatggtattaggcgagcgaatctggaaaagtcattttagagttaaagaggtacgacaacactgggacactagggttaatgagcaggggagcttgtctttgtaatttttgaattgaaatatctgacagtttcacccgttttacttttacctaaataattctaagtgatattttttttccaaaaaagaaaagaaaattaaaaaaaattattgcc

SEQ ID NO: 4790 - DNA, 2597 bp, Eucalyptus grandis
cgcggctcatctcttttacttctgctctccagctttggcaccacgccagaggaacgttcccagcacacgcacgtctccttcctcgatcgccgcttctccctcgcagtctcgctgatagcgcctcaggagggagggagggggggactgccgtgcgagagatggcggatcggctcacgcgtatcgctatagtgagctccgacaggtgcaagcccaagaagtgccgccaggagtgcaagaagagctgccccgtcgtcaaaactggtaaactgtgtattgaggttactactcagtcaaggattgcattcatttctgaagaattgtgcataggatgtggtatatgtgtcaagaaatgcccctttgaggcaattcagatcataaacttgccaaaagatttggataaagatactactcatcgatatggaccaaacacatttaagttgcacaggttgccagtccccaggccaggtcaggttctcggtttggttggaacaaatggaattggaaagtctactgccctcaaaatcttggctggaaaactgaagccaaacttgggtcgttttgataatcctcccgattggcaggaaatcttgacatactttcgtgggtctgagttgcaaaattatttcacccggattttggaggataatttgaaggctattataaagccccaatatgttgatcatattccaaaggctgttcaaggcaatgtgggacaggtgcttgagcaaaaagatgaaagggatatgaaagaggaactctgtgttgaccttgaattgaatcaggttaaagatcgaaatgttggtgatttatcaggtggagagctccagagatttgccatcgctgttgttgcaatacaaaatgctgaaatatatatgttcgatgaaccttcaagttatctcgatgtgaaacagaggctcaaagcggcccaagttgtgagatccttgcttaggcctaacagctatgtaattgtcgtggagcatgaccttagcgtcctcgattacttatcagactttatttgctgcctgtatgggaaacctggtgcatatggagttgtaacccttcccttctctgttagagaaggaataaatatcttcttagctggatttgtccccactgagaatctgcggtttcgtgacgagtctcttactttcaaggttgctgagactccacaggaagtcactgaggatgttgagacttatgcacggtacaaataccccactatgacgaaaactcagggaaacttcaggctaaaggtcgtggagggtgaatttactgattcacagattatagtaatgctgggggagaacggtactggaaagaccacatttattagaatgctggctggtttgctgaaacctgatatcgttgaaggcgatgatgtggagatacctgaatttaatgtctcttacaagcctcagaagatcagtcccaaatttccagcttctgttagacatttgctgcaccagaaaatacgggattcttatatgcatcctcaatttgtatcagatgtaatgaagcctcttctcattgaacaactgatggatcaagaagttgtgaatctgtctggtggagagttgcaaagagttgcattatgtctctgtcttggaaagccggcagacatttacctaattgatgagccaagtgcatatcttgactctgagcagcgtattgttgcttcgaaagttatcaagagattcatcctccatgcaaagaagactgcttttgtggttgagcacgattttattatggcaacttatttggctgatagagtgatagtgtacgaggggaggccttcggtggattgtattgccaattctcctcagtcattgttgacagggatgaatcttttcttatcacatttggatatcactttcaggcgggacccgactaattatcgtccaaggatcaataaagtagactctaccaaggatagggagcagaaatcagcgggatcctactattatttggatgattaagatccttgttggcagttctgggttgtttgaagcttttgaagggcacatgaaggcgatgtggcagacagtgccatccaagagttgatgctctttttctcgaacagcttgcgggccccttcaaggacgctgcttcaatacagttgacccttcaatatgccttctccgtccgccatttttgtttctgttgtctgatgatatagtataaaaaaaaatgcaacttggttttatcactagttgcattaaattatttgcttggtgtttgaaatttgtagaggaacagggaaagatgtgaatctgagtatagagggtacgtgccttttgttttgcaagtgctcctactttgcagtacttggctgacacccaagagcgcccattctcgctagagaaataaagcgcacctatatgaattttttggtctcgtagcttctgaagaagtcatttttcttatatactagcaagattgcttgccggtatgcatgagttggtaacgttatgagattttgcatttttgaatgttggactctggtttcgtttttcttttgttttggtgagtgtggctcagggtttagctttgaaaagatgttagggatatcgtttgggatgatgacacaacaaattgag

SEQ ID NO: 4791 - DNA, 2182 bp, Gnetum gnemon
gcatctgtggcatataacttcttcaccgagagagggctttgatcatttgaggtgtcgagacagtcagacagagagagaccgacgtagtctgtatctgcaacgatcgcatttgtttctcggcgcccaggttgagtagtgtgcgcggaaacaatggcggatcgattaacaaggattgccattgtaagctcggatcgatgtaaaccaaagaaatgcagacaggaatgcaagaagagttgtccggttgtcaaaacaggtaaattgtgtatagaggttacttctgcttcaaaacttgcattcatatctgaggaactgtgcatcggttgcggtatatgtgtgaagaagtgtccttttgaggctattcaaattatcaacctgccaaaggacttggataaagataccactcatcgttatggtccaaatacttttaagcttcacaggttgcctgtaccacgccctgggcaagttttaggacttgttggaaccaatggtatcgggaaatctactgccttgaaagttcttgctggcaaattaaaaccaaatctaggaagattcaaaaatcctccagactggcaagagattcttacatatttccggggatcagaacttcagaattattttacccgaattttggaagataatctaaaggctataatcaagcctcagtatgttgatcacattccaaaggcagttcagggaaatgtgggccaggtattatctcaaaaggatgaaagagaaatgaaggctgagctttgcagtgatctagatttgaaccaagtgattgacagaaatgttggtgacctatctggcggagaacttcaacgttttgctatagcagtcgttgcaatccaaaatgcggaaatttatatgtttgatgagccttctagttatcttgatgtcaggcaaagacttaaagcagcacaagtgatacgttctcttctacgtccaaatagctatgtgattgttgttgaacatgaccttagtgtccttgattatctttcggattttatatgctgcctctatggaaagcctggggcgtatggagtagtgacacttcccttttcagttagagaagggatcaatatattcttggcaggttttgtaccaacagaaaatctgcgctttagagatgaatcactgacatttaaggtggcagagacccaggagagtgctgaagaaattaaaagttacgcacgttacaggtttccaagtatgtctaaaactcagggtagcttcaagcttcacgtaaaagagggagaattcactgattctcagataattgtaatgctgggagaaaatggaacagggaagacaacatttattcgaatgttggctggtttactaaagccagatacagtggagaattcagaggttgaaatacctgaattcaatgtttcatacaaaccacagaagatcagccccaaatttcaatcaactgttaggcatttgctgcatcaaaagatccgcgattcatatactcaccctcaatttatgacagatgtcatgaaaccacttcagattgaacagttgatggatcaagaagttataaacctttctggtggagagctacagagagtggcattggcattatgtcttggcaagccagcagatatctatctaatcgatgagccaagtgcgtatttggattcagaacaacgtattgttgcagcaaaggttatcaaacgtttcattttgcatgccaagaagactgcttttgtagttgagcatgattttatcatggcaacgtacttggcagatagagttattgtatatgaagggcaaccctctgtagaatgtactgctaatacacctcagagtcttcagtctggaatgaacctattcttatctcatttggatattaccttcaggcgtgatcctacaaactacagacctaggatcaataagttagattcaacaaaggacagagaacagaaaaatgcaggctcgtattactacctggatgattgatgattcgatgacaaactctgctggcaaccttcatactattatctgttttcccttgttgctgttttgttaattctagataaaagaggcatgatcttaacaacttttgtcttgtgttgaaagggagtaatcattttgattttttaagtagctgaaatgcaatattggagatgtaatagtgaagaggcttttcctttggattttccatgacggtctgaac

SEQ ID NO: 4792 - DNA, 2054 bp, Allium cepa
tcttcattgccatctagggtttctattgcgtatcatagcaataaattacttggatcgatctgctactcaaattagatggcagatcgattgacgaggatcgctattgtcagtggggatcgatgcaaaccgaaaaagtgcaggcaggagtgtaagaaaagctgtcctgtcgtcaaaacaggtaagctttgtattgaggttacttcagctgctaaggttgcttacatctccgaggagctatgcattggatgtggtatatgtgtaaagaaatgcccatttgaggccatccagattatcaatcttcccaaaaatttggataaagataccacacatcgttatggaccgaatacctttaagttgcacaggctaccttctccaaggcctggacaagttcttggtcttgtaggaacaaatggtattgggaaatccactgcactgaaagtgttagctgggaagttgaaaccaaatttgggccgttttaacaatccaccggattggcaggaaattttgacgcatttcagaggatctgagctccaaaactatttcactcgtatactggaggacaatctcaaggctcttatcaagccacaatatgttgatcacatccccaaagcagtacaagggaatgtgggccaggtgcttgatcaaaaagatgagactgagagaaaggcagaactttgtgttgatcttgaattgaatcaggttattgaaagaaatgttggagatctgtcaggtggtgagttgcagagatttgcaattgctgtggttgctgtacaaaatgcagagatatatatgtttgatgaaccatcaagttaccttgatgtaaaacagagactgaaagcagcaaaggttattcgttcattactcagatcacaaagttatgtaattgttgtggagcacgatcttagcgtcctggattacttatcagattttatttgctgtttatatggcaaaccgggggcttatggagtggttacgttacctttctcggttagggaaggaattaacatttttttggctggttttgtgccaactgaaaatctgaggttccgagaagaatcactcacatttaaggtatctgagacacctcaagaaagcgctgaagaagttgaaacataccagcggtacaaatatcctagcatgagtaaaacccaaggaaattttaagctaactgtttgtgaaggagaatttaccgattctcagattattgtgatgttgggagagaatggaactgggaagaccacatttattcgtatgctggctggattgttgaaacctgatgtggttgaaggtgcagcagatgttgagatacctgaatttaatgtttcgtacaaaccgcagaagataagccctaaatttcaatcaacggttagacacttgttgcatcaaaaaatcagggagtcctatatgcatccacagtttgtctctgatgtcatgaagcctttacaaatcgaacaactaatggaccaagaagttgtcaatctctctggtggagagttgcaaagagttgctttatgcctttgcctgggaaagcctgcagatatatatcttattgatgaaccgagtgcttaccttgattcggagcagcgtattgttgcttcaaaggtcattaagaggttcatacttcacgcaaagaaaactgcttttgtggttgagcacgattttataatggcaacatatttggctgataaagttattgtctacgagggtaaaccatctattgattgtatagcgaacgctcctcaatcgttggtgtctgggatgaaccttttcttatctcatcttgacattacattcagaagagacccaacaaactacaggcctcgcataaacaagcttgaatctgccaaagatagggaacaaaagaatgctggatcctattactatctcgatgattgattttggctatcagcacatatttaactggaaaaatgagacctggagcttctggtttttgaacctaaaactatttccgttaggtccatatgcagttacataatctgtctacgttgagtttcaaactagtgaacatttagtattttcttcactgaggtggg

SEQ ID NO: 4793 - DNA, 2364 bp, Citrus sinensis
ttaaaaacaaaatgaaaagaaaaagaaaccctaacacttaactaaagagaaattctgtgttgctattgctctgcgtgtgcccaacgctttcacaatccacagagagcgttctcagcacacgtctctcgttcgtttcaaagagagaagatgtcggaccgattgacgcgtatagctattgttagttctgatagatgcaagcccaagaagtgtcgtcaggagtgtaagaagagttgtcccgttgtcaaaaccgggaagttgtgtattgaggttactcctgcagctaagattgcctttatctctgaggagttgtgcattggatgtggtatctgtgttaagaaatgtccatttgaagcaattcagatcatcaacttgccaaaggatttggataaggatacaactcatcgatatggccccaatactttcaaattacataggttgcctgtaccgaggcctgggcaagttcttggcttagttggaacaaatggtattgggaaatcaactgcacttaagattttggctgggaagctgaaaccaaatttgggtcgtttcaataaccctcctgattggcaggaaattttgacctactttcgtggatctgagctgcaaaattattttactcgtattctggaagataatttgaaggctattataaagcctcagtatgttgatcacattccaaaagcagttcaaggcaatgtggggcaggtgcttgaccaaaaagacgaaagagatatgaaggcggatctttgcacggatcttgacctgaatcaagtcatagaccgtaatgttggggatttatctggtggagagcttcagagatttgccattgctgttgttgctgtacagaatgcagagatatatatgtttgatgaaccttcaagttatcttgatgttaaacagaggctgaaagcggcccaagttgtccgatctttactcaggcctaatagctatgtgattgttgtggagcatgatcttagcgtccttgattacctgtcagatttcatttgctgcttatatgggaagcctggtgcttatggcgttgttactcttcctttctctgttcgagaaggaatcaatattttcttggctggatttgtaccaaccgaaaacctacgttttcgtgatgaatctttaacattcagggtcgctgagactccacaagaaagtgctgaggagattgagacatatgcacgatacaagtaccccaccatggttaagacgcagggaaattttaagcttaaggtggttgagggtgaatttaccgactcccagataattgtgatgttgggagagaatgggacagggaagacaaccttcatcagaatgctggctggtctattgaaacctgattctgtggaagattctgacgtggagatacctgagtttaatgtctcgtacaaacctcagaagatcagtcccaaatttcagtctacagtcagacacttgcttcaccaaaaaatacgtgattcatatactcatccgcagtttgtgtcagatgtgatgaagcctcttctcattgaacaattgatggatcaagaagttgtgaatctttctggtggagaattgcagagagttgcgctatgcctctgccttggcaagccagcggacatttatttaattgatgaacctagtgcatatctcgattctgagcagcgtattgttgctgcaaaagtcattaagaggtttatccttcatgcgaagaaaacagcatttgtcgtcgagcatgattttataatggctacttatctggcggatagagttattgtgtatgagggacagccgtcagtggattgtgttgcaaatgctcctcaatcattgttgactggaatgaatcttttcttatcccatctagatataacatttaggcgggatccaacaaatttccgaccgagaatcaacaaattggactccactaaggacagggatcaaaaagctgctgggtcatactattacctggatgattaaaataataatttccagttggtggttctgcaaaagttgatggcatcgatgcagacatagaatgaggcgatggcatccgaggtccttttgcccaaaaaatgtttgaaatgagtttttgtgccatgtactaatgaagctctagttaaattttcgctttattaggcttttgtgttttcaccattttttttattatggtattaggcgagcgaatctggaaaagtcattttagagttaaagaggtacgacaacactgggacactagagttaatgagcaggggagcttgtctttgtaatttttgaattgaaatatctgacagtttcacccgttttacttttacctaaataattctaagtgatatttttttccaaaaaagaaaagaaaattaaaaaaaaattattgcc

SEQ ID NO: 4794 - DNA, 2630 bp, Populus trichocarpa
ggaaaaccctagtagacatttcattttcatatttatttttttggtggggtttgtcaccggaatacaactccacagagagggaagcgttcccagcacgcgtatctctccccttgtctctttcgaacccctctctctctcctgtcttcttcttgatatctctttagaatcaaaatcaaataaagaaaaaaacagagagagagatgtcagatcgattgacgcgtatagctatagtaacctccgacagatgcaaacctaagaagtgccgtcaagaatgcaagaaaagttgccctgtcgtcaaaactgggaagctgtgtatcgaggtaactccagcttcgaagatagcttttatctcggaggagctgtgcattggatgtggtatctgtgttaagaaatgcccgtttgaagcaattcagatcattaacttgcccaaggatttggataaagacacgacccatcgttatggtcccaatacctttaaattgcacaggttaccagtcccgaggcctgggcaagttcttggcttggttggaacaaatggtattggcaagtccactgctctcaaagttctggctggaaaactcaaacctaatttgggtcgattcaataaccctcctgattggcaggaaatcttgacttactttcgaggatctgagcttcagaattactttacccgtatcctagaggataatttgaaggccatcataaagcctcagtatgttgaccatattccaagagcagttcaaggcaatgttggacaggtgcttgaccaaaaagatgagagggacaagaaggcggaactttgtcgtgatcttgaactgaaccaggttatagatcgtaatgttggggatttatctggtggagagctccaaagatttgccattgctgttgttgcaatacagaatgcagagatatatatgtttgatgaaccttcaagttatcttgatgtcaaacagaggctcaaagctgcccaagttatcagatctttgctcaggcccaacagctatgtaattgtggtggagcatgatctcagtgtcctggattatttatctgacttcatttgctgcttgtacgggaaaccgggtgcatatggagtggtaactcttcccttctctgtgagagaaggtatcaatatattcttgtctgggtttgttcctacagaaaatctacgattccgggatgaatctttaaccttcaaggttgctgagactccacaggagaatgctgaggagattcaaacatatgcacgatacaaatacccaaccatgagtaaaactcagggaaattttaaacttcgtgtcgttgagggtgaatttactgactctcagattgttgtaatgctaggtgagaatgggacagggaagacaacatttatccgtatgctggctggtttattgaaacctgatactgtagagggttccgaagccgagatacctgagttcaatgtttcttacaagcctcagaagatcagtcccaaatttcaattcagtgtcaggcagttactgcattctaaaatacgtgattcgtatatgcatcctcagtttgtttcagatgtcatgaaaccacttcttattgagcaactgatggatcaagaagtagtaaatctgtctggtggagagttgcaaagagttgctttatgtctatgccttggaaagccagctgacatttatctgatagatgaaccgagtgcatatcttgattctgagcagcgtatcgttgcttcgaaagtcatcaagaggtttatcctacatgcaaagaagactgcatttgtggtcgagcatgattttataatggcatcatacctggctgatagagttattgtgtatgagggacagccttctgtggattgcacagcaaattctccccagtcattgttgactgggatgaatctcttcttatctcacctggatatcacatttaggcgagaccccagtaattaccggccaagaatcaacaaattggagtccaccaaggatagggagcagaaggctgctgggtcatattattacctggacgattgatgtaactgttgacacagagtttaacggcatcaatctgaaaaatcatgtaacctggtcaagtcagcatggatatggttaatttttccatcccagtcaagtgaattcagtatgctgacaaatgactggattacctctgcctgcgaagaagccatggcatatctttctgcctaaatgagtttggtggtgctttatgatatttctcctgtagcgagttttgtgttcgccatttttgctcaggacattaggtgagtgaatcatagtgttacccgttttgggcatttgttgcttcaagttgctgtactttgactaggattgctatttaactagagcaaagaacaaaaaatggcaaagtgagctactggggtccttgcctgtgttttttgtatctgttttatttattttaactattctagcagcagggcaagtaaactgaactggtctaggctccctttttattttgcctaagatacggttgatttttttcaagtcagacttatgcggaatgagaggatggttaatctgtcaatcaaattaataaataataataaaaaagatctccaattaatccttgattcatgctattcatgtgtggatacagcagcgagcaacgag

SEQ ID NO: 4795 - DNA, 2450 bp, Solanum lycopersicum
aagtacagaaatcggcggctatccccagcgttgttagggctgaagtgtctattacagccgtgtcacccacactcctttctctctcctagggtatagtttactttctctctctaacaaatctgcaatttttccattcaatttcagtttttcccccatatttttgggtgaaatttagggatttgggattcagatcggtgaaattgagacatcatgtcggacagattgacacgtatcgccatcgttagcgacgacaagtgcaagccgaagaagtgccgccaagaatgcaagaagagctgcccagttgttaaaactggtaagttatgtatagaggtcactgtaggctcgaagattgctttcatctcagaggagctgtgtattggatgtggtatttgtgtaaagaaatgcccatttgaagcaattcagatcatcaatctgccaaaagatctagacaaggatacaacccatcgttatggtcccaacactttcaaattgcacaggttacctgtccctaggccaggacaggttcttggtctggttggcacaaatggtattggaaagtcaactgccctgaaagttttggctggaaaattgaaaccaaacttgggacgcttcactaaccctcctgattggcaagagatcttgactcactttcgaggatccgaattgcagaactacttcactcgcattctggaagataacttgaaggcaattatcaagcctcagtatgttgaccatattccaaaggcagttcaaggaaatgttggacaagtgcttgaccaaaaagatgagagagacgtgaaggaaaaactctgtgttgatctagagctgaatcaggttttggatcgtaatgtaggtgatctatctggtggagagcttcagaggtttgctattgctgttgttgccatacaaaatgcagagatatacatgtttgatgagccttcgagttaccttgatgtgaagcaaaggcttaaagctgcccaagttgtcagatccttgcttcggccaaatagctatgtcattgttgtggagcatgatcttagtgtgcttgattatttgtcggatttcatttgctgcttatatggaaagcccggtgcatacggagttgtgaccctacccttctcagtcagggaaggaattaatatatttttggctgggtttgtgcctacagaaaatctacgttttcgtgacgagtctcttacttttaaggttgctgagaccccacaagaggctgctgaggaaattgaatcatatgcacgttacagatatcctaccatgactaagactcagggtaatttcaagcttaaggtttctgagggtgaatttactgattcacagattgttgtgatgcttggtgagaatgggactgggaagacaaccttcattcgtatgctggctggtctattaaagcctgacgtggtggaaggatctgatattgagatgccagagttcaatgtttcatacaagccccagaaaattagtccaaaatttcaatccaccgtgagacatttgctacatcaaaaaatacgtgattcttatcaacacccccagttttgttcagatgtgatgaagcctctccaaattgagcaattgatggaccaagaagttgtgaatctttctggtggtgagttgcaaagagttgccttagccctgtgccttggaaagcccgctgatatatatctgatcgatgagccaagtgcctatcttgattctgagcagcgtattgtagcttctaaagtcatcaagagattcattcttcacgcgaagaagactgcatttgttgtagagcatgactttataatggcaacttacctggcagatagagtcattgtatatgaggggacgccttccatagattgtgttgcaaatgcacctcaatcactgttgactggaatgaacttatttttatcacatctgaacattacgtttcgaagggacccaactaattaccgtccaaggatcaacaaactagaatcaaccaaggatagggagcagaagtcagctggatcttactattatttggatgattaaccagaacaggttgtgcatccatgatccttgctcacctcttttaattggcaccttgatgttaacagaagctccactcttccttaggtgctaattgatgatcacgagcagcctctgggcatttttataccatagacgtctgacgaggttgacgtctgagcacacagatgattggaatatcgccttttgtttcgtcgttgatttagtaattattactggtattatgtactcataaatgtagttttattcaccaattttgacagcagatggagtagttgatttccattttgtatgttttatctactggcacatgaatgaggtgtttgattgggttgatgaaaaactggattggcatttatgctgtaagccactgtttattttttaatctctcattgggctaagttattcaagcgtttggtggttgt

SEQ ID NO: 4796 - DNA, 2458 bp, Vinca minor
atttgcgtgtatccaaagtacacgcgttgcccttttcaatatttgggattctactttctctctcatatctctgctgctgagaacaacactggtagcgcacccaaaccacacgcctctctccaagttcttcccaaatcaatcttcctaagagagggagatgtcagaccagaggttgacgcgtattgctattgttagttcggataagtgtaagccgaaaaagtgtcgacaggaatgtaagaagagttgtcctgtggttaaaactgggaggctttgtattgaggtgactactttatccaagattgctttcatctcagaagaactatgcattggttgcggtatctgtgttaagaaatgtccatttgaagcgattcagattatcaatttacccaaagatttggacaaggatacaacccatcgttatggcccaaataccttcaaattgcacaggttacctgttccaagaccaggacaggtccttggccttgttggaaccaatggaatcgggaagtcaaccgcgctaaaagttcttgctggcaaattgaaacctaatttgggccgctttagtaatcctcctgattggcaagagatattgactcatttccgtggatcagaactccagaattattttactcgtattctggaagataacttaaaggcaatcatcaagccacagtatgttgaccatatccccaaggctgtccaaggcaatgttggtcaggtgctggatcaaaaagatgagagagatatgaaacaagaactttgcgttgatctcgagctgaatcaggttttggaccgtgctgtgggggatttatctggtggagagctccagaggtttgcaattgcagtggtggctatacagaatgctgaaatttatatgtttgacgagccctcaagttaccttgatgtgagacagaggcttaaagcggctcaagtggtccgctcattgctccgtcctaatagttatgtaatcgtggtggagcatgaccttagtgtactggactacttgtccgacttcatttgctgtctatacgggaaacctggagcttatggtgttgtcacccttccattctctgtcagagaaggaattaatatatttttggctggatttgtacctacagaaaatctgcggtttagggatgaatcacttacttttaaggtcgcagagacaccacaggagagtgctgaggaagttgaaacgtatgcacgatataagtatccaaccatgacaaaaactcagggaaatttcaagcttaaggttatggagggtgaattcactgattctcagatagttgtaatgcttggtgagaatgggactggaaaaacaacattcatccggatgctggctggtttactaaaacctgattcagttgaggactctgatgtggagatccctgagttcaatgtctcctacaaaccacaaaagatcagtccaaagtttcagtctaccgtgaggcatctgcttcatcaaaagataagagactcctatactcaccctcagtttaattcagatgttatgaagcctctccagatcgagcaattaatggatcaagaagttgtgaatctctctggtggagagttacaaagagttgcgctaacactatgccttggaaagcctgctgatatatatctgattgatgaaccgagtgcatatctggactcagagcagcgtattgttgcttcaaaggtcattaagagattcatacttcatgcgaagaagacagcatttgttgtcgagcatgacttcataatggcaacttacctggcagatcgggtcattgtatacgaggggaagccatccatagattgtgtggcaaatgcacctcaatcattgttgactggaatgaacttgttcttatctcatctggatattacattcagaagggatccaaccaattatcgtccaagaatcaacaagttggagtcaactaaggacagggaacagaagtctgctggatcctattattacctggatgattaacttgttaatgaatgagtttatagccgtattccttgaccagacatttctcccgcatccaagatatatcagaagctctggctttttcatgggtagcgtctttctgctagggaaattcgttttgctggtcatgtgatgacggcccaattgcgggtcctcttcctgcaatgtggcccttatttatacggattggcaaacacttgatttgaggcttggcaaaatgatccttttttactgcttaatcgagtacttttaccgtgataaattatggtttaatatgttgtgtctttctttgccagttttggccttgttggctgtgtagttcttgaggatttctttttgtcagatgatatccacttatcttgttcggtatgtttgatttgaagtacgaaagctaaacaaaagatgaggaaatagaattacgggggtaatgtactcgaatttgttgtaacccgatgttgagattttttctatagctcaccg

SEQ ID NO: 4797 - DNA, 2180 bp, Vinca minor
aaggtacacacgcctgctgagaacaacacaagtgcgcacccaaaccacacgcctctctccagttcttcccaaaatcaaccttcctaagagagagatggcggatcagaggttgacgcgtattgcaattgtgagttcggacaagtgtaagccgaaaaagtgtcgacaggagtgtaagaagagttgtcccgtggtaaaaactgggaaactttgtattgaggtgactcctttagccaagattgctttcatctcagaagaactatgcattggttgcggtatctgtgttaagaaatgcccatttgaagcgattcagattatcaatttacccaaagatttgaacaaggatacaactcatcgttatggcccaaataccttcaaattgcataggttaccagttccaagaccaggacaggtccttggcctggttgggaccaacggaattgggaagtcaactgccctaaaagttcttgctggaaaattgaaacctaatttggggcgcttcaataatcctcctgattggcaagagatattgactcatttccgtggatcagaactccagaattattttactcgtattctggaagataacttaaaggcaatcatcaagccacagtatgttgaccacatccccaaagctgtccaaggcaatgttggtcaggtgctggatcaaaaagatgagagagatatgaaacaagaactttgtgttgatctcgagctgaataaggttttggaccgtgctgtgggggatttatctggtggagagctccagaggtttgccattgcagtcgtagctatacagaatgccgaaatctatatgtttgacgaaccctcaagttaccttgatgtgaaacagaggcttaaagcagctcaagtggtccgctcattgctccgacctaatagctatgtaatcgtggtggagcatgacctcagtgtactggactacttgtccgacttcatttgctgtctatacgggaaacctggagcttatggtgtcgtcacccttccattctctgtcagagaaggaattaatatatttttggctggatttgtccctacagaaaacctgcggtttagggacgagtcacttacttttagggttgccgagacaccacaggagagtgctgaggaagttgaaacatatgcacgatacaagtatccaaccatgacaaaaactcaggggaatttcaagcttaaggttatggagggtgaattcactgattctcaaatagttgtaatgcttggtgagaatgggactggcaaaacaacattcatccggatgctggctggtttactaaaacctgattcagttgaagactctgatgtggagatcccagagttcaatgtctcctacaaaccacaaaagatcagtccaaagtttcagtctactgtgaggcatctgcttcatcaaaagataagggattcatatactcaccctcagtttaattcagatgttatgaagcctctccagatcgagcaattaatggatcaagaagttgtgaatctctctggtggagagttacaaagagttgccctaacactatgccttggaaagcctgctgatatctatcttattgacgaaccgagtgcatatctggactcagagcagcgtattgttgcttcaaaggtcattaagagattcatacttcatgcgaagaagacagcatttgttgttgagcatgacttcataatggcaacatacctggcagatcgagtcattgtatacgaggggatgccatctatagattgtgtggcaaatgcacctcaatcattgttgactggaatgaacttgttcttatctcatctggatattacattcagaagggatccaaccaattatcgtccaagaatcaacaagttggagtcgaccaaggacagagaacaaaagtctgctggatcttattattacctggatgattaacttgttaatgaatgagtttatagccgtattccttgatcagacatttctcccgcatccaagatatatcagaagctttggctcttgcttgggcggcgtctttctgcaggggcaattcgttttgctggtcatatgatgacgaccacaattgcagggggttctcttctagcgatgtgatatttatttatgcagattgggaaacacttgacccgaggcttggcgtaatgatcatttttcctacttaatcgagtacttttaatgtgataaa

SEQ ID NO: 4798 - DNA, 1871 bp, Cyclamen graecum
tgccgacacacgcctctctctcaagatttcagcttttctctgtgcagtggaagagagagatgtcagatcgattgacgcgaatcgcaattgtcagctccgacagatgcaagccgaaaaagtgtcgccaggagtgcaaaaagagctgccctgttgttaaaactggtaaactatgcattgaggttactcccgcaactaaaattgctttcatctctgaggaattgtgcattgggtgtggtatttgtgttaagaaatgcccttttgaagcaattcaaatcattaatctgcctaaagatttggataaagatactacccatcgttatggccccaatacattcaaattgcacaggttacctgtaccaaggcctgggcaagttcttggtttggttggaaccaatggtatcgggaagtcgactgctcttaaagttttggctgggaaactgaaacctaatttgggccgttttaataaccctcctgactggcaagaaatcttgacatactttcgtggttctgagctgcaaaattatttcactcgtattttggaagataatttgaaggcgatcatcaagccccaatatgttgatcacatcccaaaagcagtcgtaggaaatgttgggcaagtgcttgatcagaaagatgagagagatttaaaagaaagcctttgtgttgatcttgacctgaatcaggtccttgatcgtaatgttggtgatttatctggcggagagcttcagaggtttgctattgctgtcgtggcaattcaaaatgcagaaatatttatgtttgatgagccctcgagttatcttgatgtgaagcagagactaaaggctgcccaagtcatccggtctctattgagacctaacagttatgtgattgtcgtggagcatgatcttagcgtcctagattatttgtcagacttcatttgttgtctgtatgggaagcctggtgcctacggagttgttacacttcctttttccgtcagagaaggaattaacatatttttggcgggttttgtccctacagaaaatcttcgtttccgtgacgagtctcttaccttcaaggttgctgagaccccacaagaaagtgccgaggaaatcgagacctatgcacgttataagtacccaaccatgtgcaaaactatgggtaatttcaagattcgcgtggttgaaggagaattcactgattctcaaattgtggtcatgcttggtgagaatggtactgggaagacaacattcattcgcatgctggctggtttattgaaacctgatacagtagaaggttctgatatggatataccagagtataatgtctcttacaagccccaaaagatcagtccgaagttccagtctagtgttaggcatttactgcatcaaaaaatacgtgattcttatatgcatcctcagttcgtgtcggatgtaatgaagcctcttatgatcgagcaattaatggatcaagaagttgttaacctctctggtggggagttgcaaagagttgcattatgtctttgccttggaaagcctgcagatatttatctgatagacgaaccgagtgcttatctcgactctgagcagcgtattgttgcctcgaaagtcatcaagcgattcattcttcatgctaagaagactgcatttgtggtggaacatgactttataatggcaacttatttagctgatagggtcattgtctatgagggaaggccgtcagtggattgtactgcaaatgcacctcagtcgctattgaccgggatgaatctatttttatcccacctggacataacatttaggcgggacccgacaaattttcgtcctagaatcaacaagttggaatctacaaaggacagggagcagaaaaatgctggatcttattattaccttgat

SEQ ID NO: 4799 - DNA, 2343 bp, Amorphophallus konjac
gttaaagccacgcgcgcggcagctccccttcgcccctgggggagggaggattcgattccattcccacccgcgccttcgcgtgccctagcctcgtctgctttcctcctgctcctctctagggtttcgacaccgccgccgccgcccatcctccgctgctgcaagtaggatggcggatcggctcactcgtatcgccatcgtcagctccgatcggtgcaagcctaagaagtgccgccaggagtgcaagaagagctgccccgtcgtcaagaccgggaaactgtgcatcgaggtcagccctgcgtcgaagattgcttttatctcggaggaattgtgcatcgggtgtggtatctgtgtgaagaaatgcccttttgaagcgattcaaattatcaacttgcccaaggatttggataaggacactactcatcgttacggcccgaataccttcaagctgcacaggttgccagttccacgacctggtcaggttctgggcctggtcggaacaaacggcattgggaagtcgactgctctgaaagtgttggctgggaagctgaaaccaaacttgggtcgattcaataatcccccggactggcaggaaatattaacatactttcgaggatctgagcttcaaaattactttacacggattctggaggacaatctgaaggcactcattaagcctcagtatgttgaccacattccaaaagcagttcaagggaatgttggtcaagtgcttgaccagaaagatgagagaggactaaagggcatgctctgtgatgaccttgagctgaatcaggtcattgatcgtaatgtgggcgatttgtctggtggtgaactgcagaggtttgcaattgctgttgttgctatacagaatgcagaaatctatatgtttgatgaaccatcaagttatcttgatgtaaaacagaggctcaaagctgcacaagttgtccgatctttgctccggccagacagctatgtaattgttgtggagcatgaccttagtgttcttgattacctatcagacttcatttgctgtttatatgggaaaccaggagcatatggagttgttactctacctttttctgttagagaagggatcaacatctttttggctggttttgtgcctactgaaaacctacgatttcgagatgaatcacttacctttaaggttgctgagactcctcaggaaagtgctgaggaggttcagacatatgcacgatatagatacccaaccatgtccaaaacccagggtaacttcaaactttcagttatggagggcgaattcaccgattctcagattattgtgatgctgggcgaaaatggaacagggaagacaacttttatccgcatgctggctggtttgttgaagcctgatgtggttgaggattcagatactgacattcctgaatttaatgtgtcatacaagccccagaaaatcagtcctaaatttgagcataccgttcggcttttgctgcatcagaaaattcgagattcttatatgcatcctcagtttgtgtcagatgttatgaagcctttacagattgagcaattgatggaccaggaagtgaagaatctttctggcggagaactgcagagagttgcactttgtctgtgtctgggaaagcctgcagatatatatctgatagatgagccgagtgcttatcttgattcagaacaacgtattgttgcttcgaaagtcattaagaggtttattcttcatgcaaagaagactgcctttgttgtggagcatgattttatcatggcaacctatcttgctgacaaagttattgtgtacgaggggaaaccatctattgattgcatagccaatgctcctcaatcattagtatctggaatgaaccggttcttatctcatcttgacattacctttagacgagatccaactaactacagaccgcggattaacaaattagagtcattgaaggacagggagcagaaagctgcaggctcctactactaccttgatgattaattaatggagcctctccatctggtactttgttgcatacaagatggatgagaatttcttccctaacactctcagcaatatcgtggagtctcctgcttccacgttaagttccgcgtgctgttgctagaggtttgagctgtttggcctcgggagttcatctttgttgacatcagaagacatggtcgccggctggcttggatgggacatgttttgctacctgttccttgcatgaggatcgtatttgcatactggaaaagagcagatctaccctcaatagagcaaattatcgaggttcaaatcccccctacctctttcgtcccccccctctccgtgtctcctctctcttcgcgtgtctcgtatcg

SEQ ID NO: 4800 - DNA, 2163 bp, Arnica chamissonis
ttctatcgtgttctaagcacacgccgggcctttcctcctctgaactgcaaattttcgatcttttcatcaatggcggatcgattgacgcgtatcgccatcctcaaagaagaccgttgcaagccgaagaagtgtcggcaggaatgcaagaaaagctgtcctgttgttaaaactggtaagctatgtattgaggtcacttctcagtccaagatggcgtatatctctgaggagctttgcatagggtgtggtatatgtgttaagaaatgcccatttgatgcaattgagatcattaatttaccaaaagatttggataaagatacaactcaccgttatggggccaataccttcaaattacacaggttgccagtccccaggcccgggcaagttcttggtcttgttggaacaaatggaattgggaagtccacagctctcaaagttttggctggaaaatcgaaacccaatttggggcgttttaataaccctccagactggcaagaaattttaacttacttccgaggatctgagttgcaaaactactttacacgtattcttgaagataatctaaaggcaatcataaaaccacagtatgttgatcatattccaaaagcagttcaagggaatgttggacaagtacttgaacagaaagatgagagagatgtgaaagcacaactttgtgcggatcttgagctgaatcaggttattgatcgtaatgtcggagatttatctggtggagagcttcagaggtttgcaattgctgttgttgccatacagaatgctgagatttatatgtttgatgagccctcaagttatcttgatgtcaaacaaaggcttaaagctgcccaagttatcagatctttgcttagagctaacagctatgtgattgttgtggaacacgatttaagtgtgcttgattatctatcagacttcatttgctgcctatatgggaagcctggtgcatatggtgttgtgacactacccttctctgtcagagaaggaattaatatctttttggaagggtttgtgcctacagaaaaccttcgttttcgtgaagaatctcttacgtttaaggtagctgagacaccacaggagagtgctgaagaaattgaaacatatgcacgctataaataccccactatgtctaaaacacaaggtggttttaaacttaaagtggttgagggtgaattcaccgactctcagatcatagtgatgcttggtgaaaatggaaccgggaagacaacatttattcgtatgctggctggtatactgaagcctgatactgtggaaggctctgagtcggagttacccgagtttaatatctcttacaaacctcaaaagatcagtcccaaatttcctcattcagtcaggcatttgctacatcaaaagattcgtgactcgtatatgcatcctcagtttgtttctgatgtgatgaagcctcttcaaatagagcagctaatggatcaagaagttgtcaatctttctggtggtgaattgcaaagagttgcattatgcttgtgtcttggcaagcctgctgatatatacctgatcgatgaaccaagtgcataccttgattccgagcagcgtatagtcgcttccaaagttataaagagatttatactacatgctaagaagactgcatttgtagttgaacatgatttcataatggcaacttatctagcagatagggtgattgtttatgaagggacgccatcggttgattgtgttgcaaatgcgcctcagtctttattaactggaatgaatctctttttatcgcatctcaacattacgtttaggcgggacccgactaattttcgaccaagaatcaacaagcttaattcgacaaaggacagggaacagaaatttgctggatcttattattatctcgacgactaagtttttaattaatgtttcattacatgacttctgggctatcacatagcatctgtataagcagagtcactctcttttaggtactgctggttaatctgccaccaaaaccagcggttcgtggtggtgttcatccacagttcgatgttgctacatcgcaaatgctagttattatgtctgaaagagttttaggtaacatacttgtactttgagtgtttatgttttcatttggaggtacatctcttgttctcgaaatttcgagtctggcttttgattactggt

SEQ ID NO: 4801 - DNA, 2763 bp, Pinus taeda
acgtgcgaccttggctgtcactcaattaaatttcacaaacgcgtaccacatcagttgcaggaggggcaagatagcagcccagccctaattttgtgaaccctcgactcccattatttgtgcacgtttattagggttttggtggtctcttttgagctagaatcggaggatcggctcagtccacccaggtttcagtgaatatttacattattcaccttctctcattgccgagggcttcctttctcggagaccacccacacaataattatcgttttcactttcgaggcgaattcaaatcatgtcggatcggctgactaggattgcaatagtgagctcggatcgctgcaagcccaagaaatgcaggcaggagtgtaagaagagctgtcctgttgtcaaaacaggaaagctatgcatagaagtttcttctgccagtaaaattgcatttatatcggaggagttgtgcattggttgtggtatctgtgttaagaaatgcccatttgaagctatccagatcattaacctaccaaaggatttagataaagacacaacacatcgatatggaccaaacacattcaaactccacaggctgcctgtaccaaggccaggacaggtactgggacttgtcggaacaaatggtattggaaaatctactgcacttaaggttcttgctggaaaactgaaacccaacctcgggaggttcaataatcctcctgactggcaggaaattcttacatatttccggggatcagagttacaaaattatttcactcgtattctggaagataatctgaaggcaataatcaagcctcaatatgttgatcacataccaaaagcagtgcaagggaatgtgggtcaggtgctcgatcaaaaggatgaaagagacataaagtcagagctttgcactgatctggacttgaatcaggttatggatcgaaatgttggtgatttatctggaggggaattgcagcggtttgcaattgcagtagttgcaattcagaatgctgaaatatatatgtttgatgagccctctagttatcttgatgtaaagcaacggcttaaagctgcacaagtagtccggtccctgctcaggccaaacagctatgttattgttgtcgagcatgaccttagtgtgcttgattatttatcggactttatctgctgtctgtatgggaagcctggggcttatggtgtagtaacacttccattttcagttagagaagggatcaatatctttttggctggttttgttccaactgaaaatctccgttttagagatgaatcacttactttcaaggttgcagaaactccacaggaaagtgcagaagagataaaaagctatgcacgatacaagtatccaaatatgtgtaaaactcagggtaatttcaagcttaatgtgaaggagggagaatttactgattcacagataattgtaatgttgggagaaaatggaacagggaagacaacatttatacgcatgctggctggtttattgaaaccagatactgtagacaatacagatgtggagatacctgaattcaatgtgtcatacaaaccgcagaagatcagcccgaagttccagtcaactgtcaggcatttattgcaccaaaaaatccgtgattcatatactcaccctcaattcacatctgatgtcatgaaaccacttcagattgaacaactaatggatcaagatgtagtaaatctttctggtggagaattacagagagttgcattgtgcttatgccttgggaagcctgctgacatttatctgatagatgaaccaagtgcatacttggattcagagcagcgtattgttgcagcaaaggtcataaaacgatttattcttcatgcaaagaagactgcttttgttgtggagcatgatttcatcatggcaacttatttggcagatagggttattgtatatgaaggaagaccttctattgactgtgttgccaatactccacaaagtctacaaacaggaatgaatctgtttttatcgcaactcgatattacatttagacgagatccaacaaactacaggccacgtataaataaattggattcaacaaaggacagggaacagaagaatgcggggtcatattattatttggacgattaaaagatgttccaagtatgagggaagtatgatttatgtcattcacaggtcatcaccagttgctacttgcggcctttgcgggactgttactccacaaacctgctactaccgagagatgtgattttttcttgaacttgattgtattattctttcgatttggtgcaagaaaatgtggagactagcaatagaaggagagtaataatagagaagcagcggagattctggtaggctgcagtttgcgagcttaaatgacagaaaaggaaaagtgccctttaaagatttgcagtaaattgacgtgggtgaaatatttcgcattttttgcttttaatggagcagtgtttaaatttatgttggagttatatcccgcgtttttaaggtaaaatgaatattatgtgagtaaaaaagagtgattcattctaacatgacaatgatccattttagatttacaattgtccgtctagaagggatttgcatccatttgttttatttttattttacagagaagttcacttgtgcgcagagaattatttgaagaaatatctcatgaaaaccaagactgaagatatttccaactaactttcaaaaagaaggcttctttccctagttttgatcataactcttctaccttaatatttctaaacattaatgacgtt

SEQ ID NO: 4802 - DNA, 2219 bp, Papaver somniferum
actaccaatccaacagaagattctcttccttccttctctttggagagactagagagcagctgctgtgtgaatcttcatcttcttcttcttagaaatcaatccatcataaatcaccatgtctgaccgattgactcgtatcgccatcgtcagcggcgaccgctgcaaacctaaaaagtgccgtcaggaatgcaaaaagagttgccccgtcgtcaaaactgggaaactgtgtattgaggtaaccgtagctgcaaagattgcttacatctctgaggagttgtgtattggatgtggtatctgtgtcaagaaatgcccattcgaagccattcagattatcaacttgcctaaagatttggataaggatacaactcatcgttacggtcccaacactttcaagctgcacaggttgccagtgccaagaccaggacaagttcttggtttagtcgggactaatggaattgggaagtctaccgccctcaaagtcttggctgggaagctgaagcctaatctgggtcgattcaataacccacctgattggcaagaaatattgacatacttcagagggtctgagcttcagaactacttcacccgtatcttggaagataacttgaaggcgatcatcaagcctcaatatgtggatcacatcccaaaagcagtgcaagggaatgttgggcaagttctggaacagaaagatgagagaggtgtgaaagaggaactctgtcgtgatcttgagctcaatcaggttatagagcgaaacgtgggtgatctgtcgggtggagagctgcaaagatttgctattgccgtggttgccatacagaatgcagagatttatatgtttgatgagccttccagttatcttgatgtgagacagaggcttaaagctgcccaagttatccgatcattgctcaggccaaacagctatgtgattgtcgtggagcacgatcttagtgtcttagattacctgtctgacttcatttgctgcctatatgggaaacctggagcttatggagttgtaacccttcccttttctgttagagaaggaattaatattttcttggctggatttgtcccaactgagaatctaagattccgtgacgaatcacttactttcaaggttgctgagacaccacaggaaagtgcagaggaaattcagtcatacgcacgatacaagtacccaactatgagtaaaactcaaggaaatttcaagcttcgtgttctggagggagaattcaccgattcccaaattattgtcatgcttggtgagaacgggacagggaagacaacatttattcgcatgctggctggtctcttgaagccagatgaggtggagagttcagatgcagaaatacctgaattcaatgtttcttacaagccccagaagatcagtccaaagtttcaagcttctgtcagggccttgctgcatcaaaagatccgtgattcatacatgcaccctcagtttgtgtcagatgtcatgaaaccactccaaattgaacaactaatggatcaagaagttgtgaatctctcaggtggagagctgcaaagggttgcattatgtctttgccttggcaagcctgcggatatatatctgatagatgagccaagtgcttatcttgattcagagcagcgtattgttgcctcaaaagttattaagaggtttatcctccatgcgaagaagactgctttcgtcgttgagcatgattttataatggcaacttatcttgctgacagagtgattgtgtacgaggggcaaccatctatcgactgtactgccaatgctccccagtctttgttgacagggatgaaccttttcctatctcaattggacattacattcagacgggacccaaccaattttaggccgcgtatcaacaagatgaattccacgaaagacagggaacagaaaaatgctgggtcttactattacctcgacgactaaaacaccatatatactacagaggtgtttcttcggtggtgtaagattaaaagagcaccactctgttacaattgggaaggaccgctaactggatgtgcatctgtttgaggatgaggtttctggcttaggtagggtgaccagttattggagaggtcatgtatgttggaaggacaaagtaaagtagtgtcgcgttaccctaatttaagttgtgcaccccctgaatctgcttcctggttcatttttcttgttgcttccttggggtgtatgagcgagtaaagcagattttatt

SEQ ID NO: 4803 - DNA, 2292 bp, Solanum phureja
atcggcggctatccccagcgttgttagggctgaagtgtccattacagccgtgccacccacactcctctcctttctctctcttaggggatttgggattcagatcggtgaaatagagacatcatgtcggatagattgacgcgtatcgccatcgttagcgccgacaagtgcaaaccgaagaagtgccgccaagaatgcaagaagagctgcccagttgttaaaactggtaagttatgtatagaggtcactgtaggctcgaagattgctttcatctcagaagagctgtgtattggatgtggtatttgtgtaaagaaatgcccatttgaggcaattcagatcatcaatctgccaaaagatctagataaggatacaacccatcgttatggtcccaacactttcaaattgcacaggttacctgtccctaggccaggacaggttcttggtctggttggcacaaatggaattggaaagtcaactgccctaaaagttttggctggaaaattgaaaccaaacttggggcgcttcacgaaccctcctgattggcaagaaatcttgactcactttcgaggatccgaattgcagaactacttcactcgcattctggaagataacttaaaggcaattatcaagcctcagtatgttgaccatattccaaaggcagttcaaggaaacgtcggacaagtgcttgaccaaaaagatgagagagacgtgaaggaaaaactctgttttgatctagagctgaatcaggttttggatcgtaatgtaggtgatctatctggtggagagcttcagaggtttgctattgctgttgttgcaatacaaaatgcagagatatacatgtttgatgagccttcaagttaccttgatgtgaagcagaggcttaaagctgcccaagttgtcagatccttgcttcgaccaaatagctatgtcatcgttgtggagcatgatcttagcgtgcttgattatttgtcggatttcatttgctgcttatatgggaagcctggtgcatacggagttgtgaccctacccttctcagttagggaaggaattaatatatttttggctgggtttgtgcctacagaaaatctacgtttccgtgacgagtctcttacttttaaggttgctgagaccccacaagaggctgctgaggaaattgaatcatatgcacgttacagatatccaaccatgacaaagactcagggtaatttcaagcttaaggttgccgagggtgaatttactgattcacagattgttgtgatgcttggtgagaatgggactgggaagactaccttcattcgcatgctggctggtctattaaagcctgacgtggtggaaggatctgatattgacataccagagttcaatgtttcatacaagccccagaaaattagtccaaaatttcaatccaccgtgaggcatttgctacatcaaaaaatacgtgattcttatcaacacccccagttttgttcagatgtgatgaagcctctccaaattgagcaattgatggaccaagaagttgtgaatctttctggtggtgagttgcaaagagttgccttagccctgtgccttggaaagcccgctgatatatatctgatcgatgagccaagtgcctatcttgattctgagcaacgtattgtagcttctaaagtcatcaagagattcattcttcacgcaaagaagactgcatttgttgtagagcatgactttataatggcaacttacctggcagatagagtcattgtatatgaggggacgccttccatagattgtaatgcaaatgcacctcaatcactgttgactggaatgaacttatttttatcacatctgaacattacatttcgaagggacccaactaatttccgtccaaggatcaacaaactggaatcaaccaaggatagggagcagaagtcagctggatcttattattacttggatgattaaccagaacaggtgctaatcgatgatcacgagcagcctctgggcatttttataccatagacgtctgacaggttaacgtctgagcaaacagatgattggatatcagcagaatgccttttgtttcgtcgttgatttagtaattattactggtattatgtactcataaatgtagttttgttcaccaattttgacagcagatggagtagttgatttctcattttgtatgttttatctttggcacatgaatgagtcatttgattgggttgatgaaaactggagtgacatttatgcagtaagccacagtttattttttaatctctcattgggctaagttatttaagcgtttggtggttgctc

SEQ ID NO: 4804 - DNA, 1978 bp, Fagus grandifolia
cttaaaacagggataagagttccagtgtttgattgcgaagaagaagaattgtgcgtgtgtttggcacaaacacaagaaccctaaacacacagtgttagtgattccaaatcaaagcttgattttgttttgattattaacaataatttagagaagagaaacagagatgtcggatcgattgacgcgtattgcgatagtgagctccgacaggtgcaagccgaagaagtgccgccaggaatgcaaaaaaagctgccctgttgtcaaaaccggaaaactctgtattgaggtttcccctgcatccaagattgctttcatctctgaggaattgtgtattggatgtggtatctgtgtcaagaaatgcccgtttgaagctattcagatcatcaacttgccaaaagatctggacaaggatacaacccatcgctatggccctaacacttttaaattgcacaggttaccagtcccgagacctgggcaagttctggcttggttggaactaatggcattgggaagtccactgccctcaaagttttggctggaaaactgaaaccaaacctgggtcgcttcaaaaatcctccagattggcaggaaatcttgacacacttccgaggatctgagctgcagaattactttactcgtattcttgaagataatttgaaggtctattataaagccccaatatgttgatcacatcccaaaagcagttcaaggcaatgtaggacaggtgctggaccaaaaggatgagagagacatgaagtcacaactttgcgctgatcttgagctgaaccaggttatagaccgtaatgtaggtgatttatcaggaggagagcttcagagatttgctattgccgttgttgctgtacagcatgcagaaatatatatgtttgagaaccttcaagttatcttgatgtaaaacagaggctaaaagctgcccaagttgtccgatctttgctcagggctaatagctatgtaattgttgtggagcatgatcttagtgtcctggattacttgtcggacttcatttgctgtttatatgggaaaccgggagcatatggagttgtaaccccttcccttctcagtcagggaaggaatcaatatcttcttggctggattcgttccaacagaaaaattacgtttcgggatgaatctcttacttttaaggttgctgagactccacaggaaagcgcggaggaaattgagacatatgcgcgatacaaatacccaactatgaaccaaaactcaaggaaatttcaagcttcgtgttattgagggtgaatttactgattctcagattgttgtgatgctgggtgagaatgggactggaaaaacaacatttatccgtatgctggctggtttactgaaacctgatactacagaaggttctgatgtggagatacctgagtttaatgtttcttacaagccccagaaaatcagtccaaaatttcaatccacagtgaggaacttgctacatcaaaaaatacgtgattcatatatgcatcctcagtttgtgtctgatgttatgaagcctcttcttattgaacaattaatggatcaagaagttgtgaatctttctggtggagagttgcaaagagttgcattatgtctatgtcttgggaagcctgcagacatttatctgatagatgaaccgagtgcatatcttgattctgagcagcgtatagttgcttcaaaagtcataaagagatttatccttcatgcaaagaaaactgctttcgtggttgaacatgattttataatggcaacttatctggcagatagagttattgtgtatgaggggaagccatcaattgattgtattgcaaatactccccagtcattgttgagtgggatgaatctcttcttatctcatctggatatcacatttagaagggacccaactaatttccgccacgaatcaacaaattggactcaaccaaagacagggagcaaaaatgctgggtcctattattacctggacgactga

SEQ ID NO: 4805 - DNA, 2413 bp, Carpinus betulus
ccctagttgtttctgggcgtgtgcactacgctgaattcaagaacaccaagagcacgtctctctctcctcttctctctccaattttcggcaactcgaagaaaagaagaaggtattcatcagttaagaaaccctaaatctattcctcaaattgcccaaattttcttttttgcttttatttgagttttataactaacggtgaaaggaatagagataagagatagagagagatggcggagcggctgacgcgtatagcgatagtgagctcagaccgctgtaagcccaagaaatgccgccaggaatgcaagaagagttgccctgttgtcaaaaccggtaaactctgtattgaggttacaccagcatctaaaattgctttcatctctgaggaattgtgtattggatgtggtatatgtgttaagaaatgcccatttgaagctattcagatcatcaacttgaccaaaagatctggaacaaagataacaacacatcgttatggtcccaacacttttaaattgcacaggttaccagtcccaagacctgggcaagtacttggcttggttggaactaatggcattggaagtctactgccctgaaagtttttggctggaaaactggaaaccaaatctgggtcgtttcaataatcctccagattggcaggaaatcttgacatacttccgaggatctgagctgcagaattattctactcgtattcttgaagataatttgaaggctattataaagccccagtatgttgatcacattccaaaagcagttcaaggcaatgtagggcaggtgctggaccaaaaggatgagagagacgtgaagtcagaactttgtgctgatcttgagctgaaccaggttatagatcgtaatgtggggggattttatctggaggagagcttcaaagatttgcaattgctgttgttgctgtacagaatgctgagatatatatgtttgatgaaccttcaagctatcttgatgtgaaacagaggctaaaagctgctcaagttatccgatctttgctcaggcgtaatagctatgttaattgttgtggagcatgatcttagcgtcctggattactttatcggacttcatttgcttgtttatatgggaaaccgggagcatatggagttgtaactcttccttctcagtcagagaaggaatcaatatcttcttgtcaggtttcgttccaacagaaaatctaaggtttcgggatgaatcctttacctttaaggttgctgagactcctcaggaaagtgctgaggaaattgagacatatgcgcgatacagataccccactatgaccaaaactcaaggaaattttaagcttcgagttattgagggtgaatttactgattctcagattattgtgatgctgggtgagaatgggactgggaaaacaacatttatccgtatgctggctggtttactgaaaccagatactgtagaagattctgaggtggagatacccgagtttaatgtttcttacaagccccagaagatcagtccgagatttcaatccactgttaggcacctgctacatcaaaaaattcgtgattcatacatgcaccctcagtttatgtcagatgtgatgaagcctcttcttattgaacaattaatggatcaagaagttgtgaatctttctggtggggagctacaaagagttgcattatgtctatgccttgggaagcctgcagacatttatctgatagatgaaccaagtgcatatcttgattctgagcagcgtatagttgcttcaaaagtcatcaagaggtttatccttcatgcgaagaaaactgcttttgtggttgagcatgattttataatggctacatatctggcagatagagttattgtgtatgaggggaagccatcaattgactgtattgcaaattgtccccagtcattgttgaccgggatgaatctcttcttatctcatttggatatcacgtttagaagggacccaactaattttcgccctagaatcaacaaacaggagtcaaccaaggacagggagcagaaagcggctgggtcctattattacctggatgattgacataattttaaatagttgcttttgcaaaatttgagggcatcaatgagggcagtgggatctcagccgaatgatttggatatgttgacaatttgcaggaggtccttcgtctgtttaagggttcattgagattttgtcttaacatgagtttccaggcgatgttacttattgatgccagtttactctattttctccagttttggtatggcattaggtgagaatctatatgctacttggttttgtttgcatcaagtgttgttatttaactagttgaggaacaatgaacatgttgtcaaccgagttattgcggtgcatgtttgacttttgtaatttctgggttaatatataataatttcagcataa

SEQ ID NO: 4806 - DNA, 2153 bp, Ambrosia trifida
agaaccctagctctcatcatcttacaacacaacctctgttacaccaccttctactcatcatcgtcttccaaccacacgcctcaatctgttcatcaatggctgatcgattgacacgtatcgccatcctcaaagaagaccgttgcaagccgaagaagtgtcgccaggaatgcaagaaaagctgccctgttgttaaaactggtaagctatgcattgaggtcagttctcaatctaaggtggcgtatatctccgaggagctttgcatagggtgtggtatatgtgttaagaaatgcccatttgatgcaattgagatcattaatttaccaaaagatttggacaaggatacaactcatcgttatgggcccaataccttcaaattacacaggttgcctgtcccaagacccgggcaagttcttggtttggttggcacaaatggaattgggaagtctacagctctcaaagttttggctggaaagttgaaacccaatttgggccgctttaataatcctccagattggcaagaaattttaacttacttccgaggatctgagttgcaaaactactttacacgcattcttgaagataatctaaaggcaatcataaaaccacagtatgttgatcatattccaaaagcagttcaagggaatgttggacaagtacttgaccagaaagatgagagagatgtgaaggcagagctttgtgctgatcttgagcttaatcaggttattgaccgtaatgttggagatttatctggtggagagcttcagaggtttgcgattgctgttgttgccatacagaatgctgagatttatatgtttgatgagccctcaagttatcttgacgtcaaacaaaggcttaaagctgcccaagttatcagatctttgcttagacctaacagctatgtgattgtcgttgaacacgatttaagtgtgctggattatctctcagacttcatttgctgcctctatggaaagcctggtgcatatggtgttgtgaccctacccttttctgtcagagaaggaattaatatctttttggaagggtatgtgcccacagaaaacctgcgttttcgtgatgagtctcttactttaaggttgctgagacaccacaggagactgctgaagaaattgaaacatatgcgcgctataaatatcccactatgtctaaaacgcaaggtggtttaaacttaagtggttgaggtgagtttactgattctcagatcgtagtaatgcttggtgaaaatggaaccgggaagacaacgttcatccgtatgctggctggtttactgaagcctgatactgtggaaggctctgagacggagatacctgaatttaatgtttcttacaaacctcagaagatcagtcctaaatttcctcattcagtcaggcatttgctacatcaaaagattcgtgactcgtatatgcatcctcagtttgtttccgatgtgatgaagcctcttcaaatagagcagctaatggatcaagaagttgttaatctttctggtggagaattgcaaagagttgcattgtgcttgtgtcttggcaagcctgctgatatatacctgattgatgaaccaagcgcataccttgattccgagcagcgtatagtcgcatcaaaagttataaagagatttatactacatgctaagaagactgcatttgtggttgaacatgattttataatggcaacttatctagcggatagggtgattgtttatgaagggaagccatcggttgattgtgttgcaaatgcacctcagtctttattaactggaatgaatctcttcttatcgcatctcactattacatttaggcgggacccaactaatttccgaccaagaatcaacaagcttaattcaacaaaggacagggaacagaaacttgctggatcttattactatctggacgactaattttttggtcgtgttgcatatgctactggagtcgctctcttctagctactgccggttgatccaccaccaaagccagcagttcgtggtgatcttcgtttccagtcaatgttgctgcaccatggttgctagttatgtttgaatgagatttaggtaacattcagttgatgcttgtacctagaacgtttccattttcgttctgaggcacctcgcttgctttgtagtatttctgggctcttgattactt

SEQ ID NO: 4807 - DNA, 2825 bp, Pinus pinaster
attgggggtaataaaatttcacaaacgcgtaccacatcagttgcaggaggggcaagatagcagcccagccctaattttgtgaaccctcgactcccattatttgtgcacgtttattagggttttggtggtctcttttgagctagaatcggaggatcggctcagtccacccaggtttcagtgaatatttacattattcaccttctcttattgccgagggcttcctttctcggagaccacccacacaataattatcgttttcactttcgaggcgaattcaaatcatgtcggatcggctgactaggattgcaatagtgagctcggatcgctgcaagcccaagaaatgcaggcaggagtgtaagaagagctgtcctgttgtcaaaacaggaaagctctgcatagaagtttcttctgccagtaaaattgcatttatatcggaggagttgtgcattggttgtggtatctgtgttaagaaatgcccatttgaagctatccagatcattaacctaccaaaggatttagataaagacacaacacatcgatatggaccaaacacattcaaactccacaggctgcctgtaccaaggccaggacaggttctgggacttgtcggaacaaatggtattggaaaatctactgcacttaaggttcttgctggaaaactgaaacccaacctcggcaggttcaataatcctcctgactggcaggaaattcttacatatttccggggatcagagttacaaaattatttcactcgtattctggaagataatctgaaggcaataatcaagcctcaatatgttgatcacataccaaaagcagtgcaagggaatgtgggtcaggtgctcgatcaaaaggatgaaagagacataaagtcagagctttgcactgatctggacttgaatcaggttatggatcgaaatgttggtgatttatctggaggggaattgcagcggttcgcaattgcagtagttgcaattcagaatgctgaaatatatatgtttgatgagccctctagttatcttgatgtaaagcaacggcttaaagctgcacaagtagtccggtccctgctcaggccaaacagctatgttattgttgtcgagcatgaccttagtgtgcttgattatttatcggactttatctgctgtctgtatgggaagcctggggcttacggtgtagtaacacttccattttcagttagagaagggatcaatatctttttggctggttttgttccaactgaaaatctccgttttagagatgaatcacttactttcaaggttgcagaaactccacaggaaagtgcagaagagatacaaagctatgcacgatacaagtatccaaatatgtgtaaaactcagggtaatttcaagcttaatgtgaaggagggagaatttactgattcacagataattgtaatgttgggagaaaatgggacagggaagacaacatttatacgcatgctggctggtttattgaaaccagatactgtagacaatacagatgtggagatacctgaattcaatgtgtcatataaaccgcagaagatcagcccgaagttccagtcgactgtcaggcatttattgcaccaaaaatccgtgattcatatactcaccctcaattcacatctgatgtcatgaaaccacttcagattgaacaattaatggatcaagatgtagtaaatctttctggtggagaattacagagagttgcattgtgcttatgccttgggaagcctgctgacatttatctgatagatgaaccaagtgcatacttggattcagagcagcgtattgttgcagcaaaggtcataaaacgatttattcttcatgcaaagaagactgcttttgttgtggagcatgatttcatcatggcaacttatttggcagacagggttattgtatatgaaggaagaccttctattgactgtgtcgccaatactccacaaagtctacaaacaggaatgaatctgtttttatcgcaactcgatattacatttagacgagatccaacaaactacaggccacgtataaataaattggattcaacaaaggacagggaacagaagaatgcagggtcatattattatttggacgattaaaagatgttccaagtatgagagaagcataatttatgtcattcacaggtcatcaccagttgctacttgcagcctttgcgggactgttactccacaaacctgctactaccgagagatatggcggtgattttttcttgaacttgattgtattattctttcgatttggtgcaagaacatgtgaagactagcaatagaaggagagtaataatagagaagcagcggagattctggtaggctgcagtttgcgagcttaaatgacagaaaaggaaaagtaccctttaaagatttgcagtaaattgacgtgggtgaaatatttcgcattttttgcttttaatggagcagtgtttaattttatgttggagttatatcccgcgcttttaaggtaaaaggaatattatgtgagtaaaaagagtggttcattctaacatgacaatgatccattttagatttttaattgtccgtctagaagggatttgcatccatttgttttatttttattttacagaggagttcactagtgcgcagagaattatttgaagaaatatctcatgaaaccactgaagatatttccaactaactttaaaaaagaggcttctttccctagttttgatcagaactcttttaccttaatatttctaaacattaatgacgtttgggaatttggatatacaatagtattgatacagtgaaccatgaggaataatcctagaatatatgaagttgctttact

SEQ ID NO: 4808 - DNA, 2289 bp, Abies balsamea
gataacttgccaaaagttgacggtctaagagcataaatttcacaaatgcgcaccacatcaatcacaggggaggggaaagccagcaggccagccctaattttgtgagtgactcattgccttcagatcatctgtgcccgtatactagggttttggtggtttcttgagctgaaatcggaggatcggattcaaccgacaaaggtttcggtgaattgaaatcatgtcggatcggctgactaggattgcaatagtgagctcggatcgctgcaagcccaagaaatgcaggcaggagtgtaagaagagctgtcctgttgtcaaaacaggaaagctttgcatagaagtttcttctgcctctaaaattgcatttatatcagaggagttgtgcattggctgtggtatctgtgttaagaaatgtccatttgaagccatccagatcattaacctaccaaaggatttagataaagacacaacacatagatatggaccaaacacattcaaactccacaggctgcctgtaccaagaccaggacaggtgctgggacttgttggaacaaatggtattgggaagtctactgcacttaaagttcttgctggaaaactgaaacccaacctcggcaggttcaataatcctcctgattggcaggaaattcttacatatttccggggatcggagttacagaattatttcactcgtatcctagaggataatctaaaggcaattatcaagcctcagtatgttgatcacataccaaaagcagtccaagggaatgtgggtcaggtgcttgatcaaaaggatgaaagagatataaaggcagagctttgcactgatttggacttgaatcaggttatggatcgaaatgttggtgatttatctggaggggaattgcagcgatttgcaattgcagtagttgcaattcagaatgctgaaatatatatgtttgatgagccctctagttatcttgatgtaaagcaacggcttaaagctgcacaggtagtccggtccttgctcaggccaaacagctatgttattgttgttgagcatgaccttagtgtccttgattacttatcggactttatctgctgtctgtacgggaagcctggggcttatggtgtagtgacacttccattttcagtgagagaagggatcaatatctttttggctggttttgttcccactgaaaatcttcgatttcgagatgaatcacttactttcaaggttgcagaatctccacaggaaagtgcggaagagataaaaagctatgcacgttacaagtacccaactatggctaaaactcaggggaatttcaagcttaatgtgaaggagggagaatttactgattcacagataattgtaatgttgggagaaaatggaacagggaagaccacatttatacgcatgctggctggtttgttgaaaccagataccattgacaattcagatgtggagatacctgaatttaatgtgtcatacaaaccgcaaaagatcagcccaaagttccagtcaagtgtcaggcatttattgcaccaaaagattcgtgattcatacactcaccctcagttcacatctgacgttatgaaaccccttcagattgaacaattaatggatcaagaagtagtaaatctttctggtggagaattacagagagtggcattatgcttatgccttggcaagcccgcagacatttatctgattgatgagccaagtgcatacttagattcagagcagcgtattgttgcagcaaaggtcataaaacgatttattcttcatgcgaagaagactgcttttgttgttgagcatgattttattatggcgacttatttggcagatagggttattgtatatgaaggacgaccatctattgactgtgttgccaatactccacaaagtctacaaacaggaatgaacctgtttttatcgcaacttgatattacatttagacgagatccaacaaactacaggccacgtataaataaattagattcaacaaaggacagggaacagaagaatgcagggtcgtattattatctggatgattaaaaatgttcaagtatgagagatgcatgattttctcacaggttatcaacaatacactttactatgcaacttgcagcctatgcaggactgttactcaacaagcctgctaccaccaagagatatggtggtgggtttttcttgaacttaagtgtattgttctttggatttgatgcaagaacatgtggggactaggaattagaaggagagtaataatagagaagcagcggagattctggtatgccagggtttgcggtttt

SEQ ID NO: 4809 - DNA, 2406 bp, Nicotiana benthamiana
acgctcctctctctctcctagggtataattcttcccctttctctctctaataaatcttcaatttcttcatttaatttataattttttgtatgaatattagggtttagagaatcagatcggtgaagagagacagacatgtcggatcagagattgacccgtatcgctatcgttagcgccgacaagtgcaagcccaaaaagtgccgccaagaatgcaagaaaagttgtccggtggttaaaactggtaaattatgtatagaggtcactccagctgcgaagattgcttttatctcagaggagctgtgtattggatgtggtatatgtgttaagaaatgcccatttgaagcaattcagatcatcaatctgccaaaagatttagacaaggatacaacccatcgttatggtcctaacacttttaaattgcacaggttacccgtccctagaccagggcaggttcttggtctggttggaacaaatggtattggaaagtcaaccgcccttaaagttttggctggaaaattgaaaccaaacttgggacgcttcagtaacccacctgattggcaagagatcttgactcactttcgaggatctgaattgcagaactatttcactcgcattctggaagataacttgaaggcaattatcaagcctcagtatgtcgaccatattccaaaggcagttcaaggaaatgtgggtcaagtgcttgaccaaaaagatgagagagatgtgatgtcacaactttgtgttgatctagagctgaatcaggttttggatcgtaatgtaggtgatctatctggtggagagcttcagaggtttgctattgctgttgttgcaatacaaaatgcagagatatacatgtttgatgagccctcgagttatcttgatgtgaagcagaggcttaaagctgcccaagttgtcagatccttgcttcgaccaaatagctatgtcattgtggtggagcatgatcttagtgtgcttgattatttgtcggatttcatttgctgcttatatgggaagcctggtgcatatggagttgtcaccctacccttctcagtcagggaaggaattaatatatttttggctggatttgtgcctacagaaaatctacgtttccgtgaagaatctcttacttttaaggttgctgagaccccacaagaggccgctgaggaaattgaaacatatgcacgctacagatatcctaccatgaccaagactcagggtaatttcaagcttaaggttgccgagggtgaatttactgattcacaaattgttgtgatgcttggtgagaatggaaccgggaagacaaccttcattcgcatgctggctggtctattaaaacctgatgtggtggaaggatctgatacggatataccagagttcaatgtctcatacaagccccagaaaatcagtccaaaatttccatccaccgtgaggcatttgctacatcaaaagatacgtgattcttatatgcacccccagttctgttcggatgtgatgaagcctctccaaattgagcaattgatggatcaagaagttgtgaatctttctggtggagagttgcaaagagttgccttagccctgtgccttggaaagcctgctgatatatatctgatcgacgagccaagtgcctatcttgattctgagcaacgtattgtagcttcaaaagtcatcaagagattcattcttcatgcgaagaaaactgcatttattgtagagcatgactttataatggcaacttacctggcagatagagtcattgtgtacgaggggacgccttccatagattgtgttgcaaatgcaccccaatcattgttgacgggaatgaacctatttttatcacacctgaacattacatttagaagggacccaactaatttccgtccaagaatcaacaaactggaatcaaccaaggatagggagcagaagtcagctggatcctattattatttggatgattaaccagaacaggttgcgtcgatgatccttccttacctctttctattggcaccttgatgttaacagatgctccgctcttcctcctaggtgctaaatgatgatcacggaaacagcctctgggtcatttatctcattaacatctgacatgattattagaggttgatgtctcggtgaacagatgatagggtatcagcagaatgcctactgtttcgtcgatcgttttatatgatgatctagtatttatttctggtattatgtactcattatatgttattgttcaccaattttgactgcagagtgggtagttttctcctcggattttcattttgtatgttgatctttggcatatgaatgaggtatttgattgggttgatgaaattttgtgaggtgttatccaatcatcattgtatgttgacctttggcatatgaatgaggtatttgattgggttgatg

SEQ ID NO: 4810 - DNA, 2340 bp, Solanum tuberosum
attacagccgtgccacccacactcctctcctttctctctcttaggggatttgggattcagatcggtgaaatagagacatcatgtcggatagattgacgcgtatcgccatcgttagcgccgacaagtgcaagccgaagaagtgccgccaagaatgcaagaagagctgcccagttgttaaaactggtaagttatgtatagaggtcactgtaggctcgaagattgctttcatctcagaagagctgtgtattggatgtggtatttgtgtaaagaaatgcccatttgaagcaattcagatcatcaatctgccaaaagatctagacaaggatacaacccatcgttatggtcccaacactttcaaattgcacaggttacctgtccctaggccaggacaggttcttggtctggttggcacaaatggaattggaaagtcaactgccctaaaagttttggctggaaaattgaaaccaaacttggggcgcttcacgaaccctcctgattggcaagaaatcttgactcactttcgaggatccgaactgcagaactacttcactcgcattctggaagataacttaaaggcaattatcaagcctcagtatgtcgaccatattccaaaggcagttcaaggaaacgttggacaagtgcttgaccaaaaagatgagagagacgtgaaggaaaaactctgtgttgatctagagctgaatcaggttttggatcgtaatgtaggtgatctatctggtggagagcttcagaggtttgctattgctgttgttgcaatacaaaatgcagagatatacatgtttgatgagccttcaagttaccttgatgtgaagcaaaggcttaaagctgcccaagttgtcagatccttgcttcgaccaaatagctatgtcatcgttgtggagcatgatcttagtgtgcttgattatttgtcggatttcatttgctgcttatatgggaagcctggtgcatatggagttgtgaccctacccttctcagtcagggaaagaattaatatatttttggctgggtttgtgcctacagaaaatctacgtttccgtgacgagtctcttacttttaaggttgctgagaccccacaagaggctgctgaggaaattgaatcatatgcacgttacagatatccaaccatgacaaagactcagggtaatttcaagcttaaggttggcgagggtgaatttactgattcacagattgttgagatgcttggtgagaatgggactgggaagactaccttcattcgcatgctggctggtctattaaagcctgacgtggtggaaggatctgatattgacataccagagttcaatgtttcatacaagccccagaaaataagtccaaaatttcaatccaccgtgaggcatttgctacatcaaaaaatacgtgattcttatcaacacccccagttttgttcagatgtgatgaagcctctccaaattgagcaattgatggaccaagaagttgtgaatctttctggtggtgagttgcaaagagttgccttagccctgtgccttggaaagcccgctgatatatatctgatcgatgagccaagtgcctatcttgattctgagcaacgtattgtagcttctaaagtcatcaagagattcattcttcacgcaaagaagactgcatttgttgtagagcatgactttataatggcaacttacctggcagatagagtcattgtatatgaggggacgccttccatagattgtgttgcaaatgcccctcaatcattgttgactggaatgaacttatttttatcacatctgaacattacatttcgaagggacccaactaatttccgtccaaggatcaacaaactggaatcaaccaaggatagggagcagaagtcagctggatcttattattacttggatgattaaccagaacaggttgtgcatccgtgatccttgcttacctcttttaattgacaccttgatgttaacagaagctccactcttcccttaggtgctaatcgatgatcacgagcagcctctgggcatttttataccatagacctctgacgtgattattaagaggttaacgtctgagcaaacagatgattggatatcagcagaatgccttttgtttcgtcgttgatttagtaattattactggtattatgtactcataaatgtagttttgttcaccaattttgacagcagatggagtagttgatttctcattttgtatgttttatctttggcacatgaatgagtcatttgattgggttgatgaaaactggagtgacatttatgcagtaagccacagtttattttttaatctctcattgggctaagttatttaagcgtttggtggttgctc

SEQ ID NO: 4811 - DNA, 2462 bp, Pseudotsuga menziesii
agcccagccctaatttcatgagccctcgcctccacctcatttgtgcacgtatattagggtttttgtggttcccttgagccaagaacggaggatcggacccagtcaactaaggtttcagtaagtttttcattattcatcacaatttttattgccgagggtttcccttctcggagatcagccactcaaataattctcgtttttacattcgaggcgagttgcaatcatgtcggatcggctgactaggattgctatagtgagttcggatcgctgcaaacccaagaaatgcaggcaggagtgtaagaagagctgtcctgttgtcaaaacaggaaagctctgcatagaagtttcttctgcctctaaaattgcttttatatcggaggagttgtgcattggttgtggtatctgtgttaagaaatgtccatttgaagctatccagatcattaacctaccaaaggatctagataaagacacaacacatcgatatggtcccaacacattcaaactccacaggctgcctgtaccaagaccagggcaggtgctggggcttgttggaacaaatggtattggaaagtctactgcacttaaagttcttgccggaaaactgaaacccaacctcggcaggttcaataatcctcctgattggcaggaaattcttacatacttccggggatcagagttacagaattatttcactcgtattctggaagataatctaaaggcaataatcaagcctcagtatgttgatcacataccgaaagcagtgcaagggaatgtgggtcaggtgcttgatcaaaaggatgaaagagatataaaggcagagctttgcactgatctggacttgaatcaggtcatggatcgaaatgttggtgatttatccggaggagaattgcaacggtttgcaattgcggtagttgcaattcagaatgctgaaatatacatgtttgatgagccctctagttatcttgatgtaaagcaacgccttaaagctgcacaagtagtccggtccctgctcaggccaaacagctatgttatcgttgtcgagcatgaccttagtgtccttgattacttatcggactttatttgctgtctgtacgggaagcctggggcttatggtgtagtaacacttccattttcagttagagaagggatcaacatctttttggctggttttgttccaactgaaaatcttcgatttcgagatgaatcacttacttttaaggttgcagaaactccacaggaaagtgcagaagagatcaaaagctatgcacgatacaaatacccaactatgtctaaaactcagggtaatttcaagcttagagtaacagagggagaattcactgattcacagataattgtaatgttgggagaaaatggaacagggaagaccacatttatacgcatgctggctggtttgttgaaaccagatactattgaaaatgcagacatggagatacccgaatttaatgtatcatacaaaccgcaaaagatcagcccaaagttccagtcaactgtcaggcatttattgcaccaaaagattcgtgatacatacactcaccctcagttcatatctgatgtcatgaaaccccttcagattgaacaactaatggatcaagaagtagtaaatctttctggtggagaattacagagagtggcattgtgcttatgccttggcaagcctgctgacatttatctgattgatgagccaagtgcatacttagattcagagcagcgtattgttgcagcaaaggtcataaaacgatttattcttcatgcgaagaagactgcttttgttgtggagcatgattttattatggcaacttatttggcagatagggttattgtatatgaagggcaaccttctgttgattgtgttgcaaatactccacaaagtctacaaacaggaatgaacctgtttttatcgcaactggatattacatttagacgagatccaacaaactacaggccacgcataaataaattagattcaacaaaggacagggatcagaagaatgcagggtcatattactatctggatgattaagaaatgttccaagtatgagaagcatgatttgtgtcattcacaggtcgtcattgacagtacattttactcagcaatttgcagcctttgcaggattattactccacaagcctgctaccaccaagagatatggtggtggatttttcttgaattaagtgtattattctttggatttgatccaaggacatgtggagactagcgattaggagggtaataatggagaagcagcagagattctggtatgtcagggtttgcaggcatacatgatagaaagggaaaagtgccctctaaatatttgcagtaaattggggtggtaaaatatttggcactttttgcttttaatggagcagtgtttaattttacattggagttatatcctttgctattaaggtaaaatgaatattctattacgagtaaaaacgag

SEQ ID NO: 4812 - DNA, 2207 bp, Eutrema parvulum
tatttattttttagatctttgagagatggccgatcgattgacacgtatagctattgtgagttcagaccgttgcaagccaaagaaatgccggcaagagtgcaagaagagctgtcctgtggtcaagacaggaaaactttgtattgaggtgactgttggttccaaacttgcttttatctcggaggaattgtgcatcggttgcggtatttgtgtgaagaaatgcccgtttgaagctatccagattatcaatcttcccagagacttagaaaaagatacaacccatcgctatgggccaaacactttcaagttgcacaggctcccagttccaaggccagggcaagtcctagggttggttgggacaaatggtattggaaaatcaaccgctctgaaaattttggcgggaaagctcaaaccaaatttgggccgtttcactaatcctccagactggcaagaaatcttgactcactttcgtgggtcagaacttcaaaactactttacccgtattctagaagataatctaaaagccattataaagcctcaatatgtcgaccacatcccaaaagctgttcgaggcaatgttggggaggtccttgaccagaaggacgagagagataagaaggcagagctctgtgctgatctggagctgaaccaggtcattgatcgggatgttgagaatttatctggtggtgagctgcagaggtttgctatcgctgttgttgccatacaaaatgctgagatatacatgtttgatgagccatccagttaccttgatgttaagcaaagactcaaagctgctcaagttgttcgttctctcctgaggcctaatagctacgtcattgtggtggagcatgatctcagtgttcttgactacttgtcagatttcatttgctgtctgtatgggaaaccaggagcctatggtgtcgtgactctccccttctctgtcagagaaggaatcaacattttcttggctgggtttgttcccacagaaaatttacggtttagagatgaatcgctgacattcaaggttgctgagactccacaagaaagtgctgaagaaattcagtcgtacgctaggtacaaatacccgaccatgaccaaaactcaaggaaatttcaggttgaaagtgacggaaggtgaattcactgactctcagattattgtaatgcttggtgagaatggtacagggaagacaacatttatccggatgctggcgggtttgttgaaacctgacgatacagaaggatcagacatagagataccagaattcaatgtttcgtacaagccacaaaagatcagcccgaagtttcagaattcagttagacacttgctacatcaaaagattcgggattcttacatgcatcctcagtttgtgtcagacgtgatgaaaccgcttcagattgagcagttgatggatcaggaagttgtcaatctctccggaggagagctgcaaagggttgcattagctctctgcctaggaaagccagcggatatatacctgattgatgagccaagtgcatatcttgattcagagcaacgtattgtggcttctaaagtcatcaagcggttcattctacatgcaaagaaaactgcatttgtagtcgagcatgactttataatggcaacctatctggctgaccgagtcattgtctatgaaggacaaccatccattgattgtatcgcaaattgtcctcagtcactgcttagtgggatgaatctctttttatctcatctgaacatcaccttcagacgggatcctaccaatttcagaccacggatcaacaaattggagtcgactaaagacagggagcaaaagtctgctggctcatactactacttggacgattaagagaactaccatgagaatatagggcatgatctggataaaaaaatgtctgagttccaccagaaaggtctttttctctgaggaatttgatctacgagctcgggatattttgcgcaaccatctgttttccgagtttcttatgagatgtttctttctctctggtcaagcttctgattgtttgttcatcagttttgctcttccagccttttgctatatactgtgcaaaggttttttattaactgagcaataatatcttctgaatctttaacctttttgttttggtttttgtacttttgagttgtttatttcaacattgactgtaatgttattacttggttttaaaaggaatgcactgcctattattctt

SEQ ID NO: 4813 - DNA, 2008 bp, Triphysaria pusilla
tgattgagcgtgatgtcggatcaaaggttgactcgaatcgccattgtcagctccgataagtgtaagccgaaaaaatgccggcaggagtgcaaaaaaagctgccctgttgtcaaaacaggtaaactctgcattgaggtgacccctttgaccaagatagctttcatctcggaggaattgtgtattggatgtggtatttgtgtgaagaaatgcccttttgaagctatccagattatcaatctgccaaaggacctggacaaagatactacccatcgttatgggccaaacacatttaaattgcacagattaccagttccaaggcctgggcaggttcttggcttggttggaactaatggtattgggaaatcaactgcactaaaagttttggctgggaaactgaaacctaacttgggacgctttactaaccctccggattggcaagaaattttgacctactttcgaggatctgagctgcaaaattatttcactcgcattcttgaagataatctgaaggcaatcatcaagccccagtacgtcgaccacatcccaaaagcagttcaaggcaatgttgggcaggttcttacccagaaggatgagagagagatgaaagaaagtctcggtgttgatcttgagttaaatcaggttatggaccgcaatgttggagatttatccggtggggagcttcagcgatttgctatagctgttgttgctatacagaatgcagagatctatatgtttgatgagccctcgagttaccttgatgtgaaacagaggctcaaagctgccagagtcatccgatccttgcttcgccctaatagctatgttatcgttgtggagcatgatcttagtgttctggattacttatcggacttcatctgctgtctttacgggaaacctggtgtttatggggtggtaacccttccattctctgtcagagaaggaattaatatattcttggctggatttgtcccaactgagaatcttaggtttcgcgatgaatctcttacatttaaggttgctgagactccacaagaaagtgctgaggaaattcagtcttatgccagatacaaatacccaactatgactaaaactcaaggcaatttcagacttagggttgcagagggtgaatttactgactcacagattgttgtgatgcttggggaaaatggaaccggaaagactacgtttattcggatgctggctggcctcttgaagcctgattcagtggaaggttctgatgtggaaatacccgagttcaacgtctcgtacaaaccacaaaagatcagtccgaagtttcagaatactgttagaaacttgttgcattcaaaaatccgtgattcgtatatgcatcctcagtttatgtctgatgtgatgaagcctctcttaattgagcaactgatggatcaagaggttgtgaatctttctggtggagaattacagagagttgctctgactctttgtctcggaaagcctgctgatatatatctgatagatgagccaagtgcataccttgattcagagcagcgaattgtcgcttcaaaagtcataaagagattcatacttcacgccaaaaagaccgcatttgttgtcgagcacgatttcataatggcaacatatcttgcggatagggtgattgtgtatgaggggagaccatcgatagattgtacggcaaattcacctcaatcacttttgactggcatgaacctgttcttatctcatttggatatcacgttcagaagggacccgactaatttccgaccgagaatcaataagctggactcgactaaggaccgagagcaaaagaatgcgggatcgtactattatttggatgattagattaatgagtgtgatcttttttgttaggagactgagaatgttaagtacatgaaatctgagatgtaatatctttttttggggggagaatggggggttcggatatgatatttaccctcttttgaattgtagcaatttatatttcaatgtttgtctgttgaaagggttaatattctcg

SEQ ID NO: 4814 - DNA, 2055 bp, Brassica oleracea
tgtgctctccactggttcctcgaagctcaatcgaaatctctcaatcatctcagatatttttgagagatggcagatcgattgacacgtattgcaattgtgagttcggaccgttgcaagcctaagaaatgtcgccaagagtgcaagaagagctgtcccgtcgtcaagacaggaaaactttgtattgaggtgactgttggttccaagcttgcttttatctctgaggagttgtgcatcggttgcggtatttgtgtcaagaaatgcccatttgaagctattcagattatcaatcttcccagagacttggagaaagatacgacccatcgctatggggccaacactttcaagttgcacaggctgccagttccaaggccagggcaagtcctagggttggttggcaccaatggtattggaaaatcaaccgctctgaaaattttggcagggaagctcaaaccaaacttgggccgtttcactaatcctccagactggcaagaaatcttgactcacttccgtgggtcagaacttcaaaactacttcacccgtattctagaagataatctgaaggccattataaagcctcagtatgtggaccacatcccaaaggctgttcgaggcaatgttggagaggtccttgaccagaaggacgagagagacaagaaggcagagctctgtgctgatctggagctgaaccaggtcattgatcgtgctgttgagaatttgtctggtggtgagctgcagaggtttgccatcgctgttgttgccatacaaaacgctgagatttacatgtttgatgagccgtctagttaccttgatgttaagcaaagactcaaagctgctcaagttgttcgttctctcctcaggcctaatagctacgtcattgtggtggagcatgatctcagtgttcttgactacttgtcggatttcatttgctgtctgtatgggaaaccaggagcctatggtgtcgtgactctccctttctctgtcagagaaggaatcaacattttcttggctgggtttgtccccactgaaaatttacgttttagagatgaatcgctgaccttcaaggttgctgagactccacaagaaagtgctgaagaaatacagtcgtacgctaggtacaaataccctacgatgaccaaaactcaaggaaacttcaggttgaaagtgacggaaggtgaattcaccgactctcagattattgtaatgcttggggagaatggtacagggaagacaacatttatccgaatgctggcgggtttgttgaaacctgacgagacagaagagtcagacatagagataccagaattcaatgtttcttacaagccacaaaagatcagccccaagtttcagaattcagttagacacttgctacaccaaaagattcgagattcatacatgcatcctcaattcgtgtcggacgtgatgaaaccacttcagattgagcagttgatggatcaagaagttgtcaatctctctggaggagaattgcaaagggttgcattagctctgtgcctcggaaagcctgcggatatctacctgatcgatgagccgagtgcgtatctggattcagagcaacgtattgtggcttctaaagtcattaagcggttcattctccacgcaaagaaaactgcatttatagtcgagcatgactttataatggcaacatatctcgcagaccgagtcattgtctatgaaggacagccatccattgactgtattgcaaactgtcctcaatcactgctcagtggaatgaatctgtttctatctcatctgaacatcacattcagaagagatcccaccaatttcagaccaaggatcaacaaattagagtcgactaaagacagggagcaaaagtctgctggctcgtactattacttggatgattaagacgtctatcatgagaacataagaggcatggtctggataaaaacattgtctgaattccatgaaggtcttttgctctgaggaagttgatctatgagttcgggatgctctgtgttccttgcctgtttctcttctcaagcttttgattgtttgttcatcagttttgcttctcag

SEQ ID NO: 4815 - DNA, 2260 bp, Brassica oleracea
gtgtgctctctctctctctccgctggttccttaaaagaatcgacacacgcttcttcacctccatctccctcgaagctcagctcagctcagctcaatctgaatctctcaattatctcagtttggctcttgattgattcaccgttaaattttatatctgggattgtatcaaaagcttcgaactttcttcaaaatatcttctagttacgttaaaaaagatatttgagagatggcagatcggttgacacgtattgctattgtgagttcagaccgttgcaagccaaagaaatgtcgccaagagtgcaagaagagctgtcctgtggtcaagacgggaaaactttgcattgaggtgactgttggttccaagcttgctttcatctcagaggagttgtgcattggttgcggtatttgtgtgaagaaatgcccatttgaagctattcagatcatcaatcttcccagagacttagagaaagacacgacccatcgttatggtgcaaacactttcaagttgcacaggctcccggttccaaggccaggtcaggtcctagggttggttgggacaaatggtattggaaaatcaaccgctctgaaaattttggcggggaagctcaaaccaaatttgggccgtttcactaatcctccagactggcaagaaatcttgactcacttccgtgggtctgaacttcaaaactacttcacccgtattctagaagataatctaaaggccattataaagcctcagtatgtggaccacatcccaaaagctgtgcgaggcaacgttggagaggtccttgaccagaaggatgagagagacaagaaggcggagctctgtgctgatctggagctgaaccaggtcattgatcgtgacgttgagaatttatctggtggtgagctgcagagattcgccatcgctgttgtcgccatacaaaacgctgagatttacatgttcgatgagccgtctagttaccttgatgttaagcaaagactcaaagctgctcaagtcgtccgttccctccttaggcctaatagctatgtcattgtggtggagcatgatctcagtgttcttgactacttgtcggatttcatttgctgtctgtatgggaaaccaggagcctacggtgtcgtgactctccccttctctgttagagaaggaatcaacattttcttggctgggttcgttcccacagagaatctacgttttagagatgagtcgctgaccttcaaggttgctgagactccacaagagagtgctgaagaaatacagtcgtacgctaggtacaagtacccaaccatgaccaaaactcaaggaaactttaggttgaaagtgacggaaggtgaattcaccgactctcagattattgttatgcttggggagaatggtactgggaagacaacgtttatccggatgctggcgggtttgttgaaaccagacgagacagaagaatcagacatagagataccagaattcaatgtatcttacaagccacaaaagatcagccccaagtttcagaattcagttaggcacttgctacatcagaagattcgggattcttacatgcatcctcagtttgtgtcggacgtgatgaagccgcttcagatcgagcagttgatggatcaggaagttgtcaatctctctggaggagagctgcaaagggttgcattagctctgtgcctcggaaagcctgcggatatatacctgattgatgagccaagtgcatacctcgattcagagcaacgtattgtggcttctaaagtcattaagcgattcattctccatgcaaagaaaactgcatttatagtcgagcatgactttataatggctacctatttagcagaccgggtcattgtctatgaaggacagccatccattgattgtgttgcaaattgtcctcagtcactactcagtgggatgaatctcttcctatcccatctaaacatcaccttcagacgggatcccaccaatttcagaccaagaatcaacaaattagagtcgactaaagacagggagcaaaagtctgctggctcatactactacttggacgattaagacaactaccatgagaacatagggcatgatctggatatagaaacattgtctgaattccatgaaggtctttcgctctgaggaagttgatctatgagctcgcaaccatctttttccgaggtcctaaggagatgtttctcttctcaagcttttgattgtcagttcagttttgctactcagattttgctgtatacttggcaaggttttttattaactgag

SEQ ID NO: 4816 - DNA, 2551 bp, Phaseolus vulgaris
gatatccatagacccagtttgagttgcagggtgaagcaagtaaccctaatgctatatgcttttctgaaacgttctcaccacacgcctttctcttcgaaccgctttgctctcttccttctgtcaggggaaaacgaatctcatccttttcaactcttcgaaccgccatggccgatcgcttgacgcgtattgccatagtgagcaacgacaggtgcaagcccaagaagtgccgccaggagtgcaaaaagagttgtccagtggtcagaaccggtagattatgtattgaggttacttcagcctcgaagattgcttacatttctgaggaattgtgcattggatgcggtatatgtgttaagaaatgtccttttgaagctattcagattatcaacttgccaaaggacttggataaggatactactcatagatacggtcccaatacttttaagctgcataggttgcccgtgccaaggcccggccaggtgcttgggttggttgggacgaatgggattgggaagtccactgcccttaaagttttggctgggaagttgaagccgaatttgggtcgattcactaacccccctgattggcaggaaattttgacctactttcgaggatctgaattacagaattactttactcggattctcgaggatgatttgaaggctatcatcaagcctcagtatgttgaccatattccaaaggctgtgcaaggaaatgtggggcaggtgctagaccagaaagatgagagagatatgaaggcggagctttgtgctgatcttgagcttaatcaagttatagatcgtaatgttggggatctgtcaggtggtgagctccaaagatttgccattgcggttgttgcaatccagaatgctgagatatacatgtttgatgaaccgtctagttatcttgatgtgaaacagaggctgaaagctgcacaagttgttcgatcattgcttaggcctaatagttatgtaattgttgtagagcatgatctcagtgtcttggactacttatcagactttatttgctgtctatatggcaaacctggtgcatatggagttgtgacacttcctttctcggtcagagaaggaattaacattttcttggctggctttgtaccaacagaaaatcttaggtttcgggatgattcacttaccttcaaggttgctgagactccacaggaaagtgccgaggaagctcagacatatgctcgatataaatacccaaccatgaccaaaactcaaggcaattttaaacttcgtgtagttgaaggagaatttactgattctcagattattgtgatgttgggtgagaatgggacaggaaagacaacatttattcgtatgctggctggtttattgaaacctgacagcatagaagggggatctgaagcggagatgcctgaatttaatgtttcatacaagcctcagaagattagcccgaagttccagtcaactgttaggcacttgctacatcaaaaaatacgtgatgcatatactcatccccagtttgtttcagatgtgatgaagccacttcttatcgaacagttaatggaccaagaagttgtgaatctttctggaggagagttgcagagagttgctctatgtctctgtcttggcaagcctgcagatatctatctgatagacgagccaagtgcatatctagattctgaacagcgaattcatgctgccaaagtgatcaagaggtttattcttcatgcaaagaaaacggcttttgttgttgagcatgatttcatcatggcaacttatcttgcagacagagttattgtatatgcgggtcaaccatcaattgattgtattgcaaattctccacaatcattgttgtctgggatgaaccttttcttatcgcatcttgatatcacatttagaagggacccaactaattttcgtccaaggatcaacaaactcgattcaaccaaggacagagaacaaaagtctgctgggtcttattattaccttgatgactgattccatactcatactcagttgttctttcatcaatacaacattgcatcagtttgagctttcatgggatcgcagatttagttaatttgatgccttgaaatataagattgccgtttttaccgatgaaagcatcttttttcaatgaatagaagagcctgcatacattcttatgttggttggtgcatttgtatatttacccttaagttaatgcagttactcatcaccagttttgctacgacttgggtgggtgaatctgaatattacatgagtttaattggtcaaggttttcattgaatttcccaaatccattggaacatgatgacgtcagactgggtttatcgccacttttggcacataatttaagttgagtatgtaacgaagtttactttcatttccatgctacttgatttagttagatatgtcctgtttggaatatattgcggttgagaaagttgtcaatctcaataaatattgttttccttttatttgaagggttattagaatttggagagtattgtcgatttaattgttcaactgttagctagacaaaatacaagagaagtatattc

SEQ ID NO: 4817 - DNA, 1831 bp, Brassica napus
tttctgagagatggcagatcgattgacacgtattgcaattgtgagttcggaccgttgcaagcctaagaaatgtcgccaagagtgcaagaagagctgtcccgtcgtcaagacaggaaaactttgtattgaggtgactgttggttccaagcttgcttttatctctgaggagttgtgcatcggttgcggtatttgtgtcaagaaatgcccatttgaagctattcagattatcaatcttcccagagacttggagaaagatacgacccatcgctatggggccaacactttcaagttgcacaggctgccagttccaaggccagggcaagtcctagggttggttggcaccaatggtattggaaaatcaaccgctctgaaaattttggcagggaagctcaaaccaaacttgggccgtttcactaatcctccagactggcaagagatcttgactcacttccgtgggtcagaacttcaaaactacttcacccgtattctagaagataatctaaaggccattataaagcctcagtatgtggaccacatcccaaaagctgttcgaggcaatgttggagaggtccttgatcagaaagacgagagagacaagaaggcagagctctgtgctgatctggagctgaaccaggtcattgatcgtgctgttgagaatttgtctggtggtgagctgcagaggtttgccatcgctgttgttgccatacaaaacgccgagatttacatgtttgatgagccgtctagttaccttgatgttaagcaaagacttaaagctgctcaagttgttcgttctctcctgagacctaacagctacgtcattgtggtggagcatgatctcagtgttcttgactacttgtcggatttcatttgctgtctgtatgggaaaccaggagcctatggtgtcgtgactctccctttctctgtcagagaagggattaacatttttttggctgggtttgtccccactgaaaatttacgttttagagatgaatcgctgaccttcaaggttgcggagactccacaagaaagtgctgaagaaatacagtcgtacgctaggtacaagtacccaaccatgaccaaaactcaaggaaacttcaggttgaaagtgacggaaggtgaattcaccgactctcagattattgtaatgcttggggagaatggtacagggaagacaacatttatccgaatgctggcgggtttgttgaaacctgacgaaacagaagaatcagacatagagataccagagttcaatgtttcttacaagcctcagaagatcagccccaagtttcagaattcagttagacacttgctacaccaaaagattcgagattcatacatgcatcctcaattcgtgtcggacgtgatgaaaccacttcagattgagcagttgatggatcaagaagttgtcaatctctctggaggagagttgcaaagggttgcattagctctgtgcctcggaaagcctgcggatatctacctgatcgatgagccgagtgcgtatctggattcagagcaacgtattgtggcttctaaagtcattaagcggttcattctccacgcaaagaaaactgcatttatagtcgagcatgactttataatggcaacatatctcgcagatcgagtcattgtctatgaaggacaaccatccattgactgtattgcaaactgtcctcaatcactgctcagtggaatgaatttgtttctatctcatctgaacatcacattcagaagagatcccaccaatttcagaccaaggatcaacaaattagagtcgactaaagacagggagcaaaagtctgctggctcatactactacttggatgattaagac

SEQ ID NO: 4818 - DNA, 2396 bp, Sciadopitys verticillata
gtgatatatcatcagccctaacttcgtgtacactagcccaacacacgcttcttctatcacacccccaaattaagcctccctggattcgatctggggtttatgtttagtacgctattagggttttgagtggcgtttgttaaggcgggcgaaatatggcagatcggctaactaggattgctattgttagctctgatcgctgcaagcccaagaaatgcaggcaggagtgtaaaaagagctgtcctgttgtcaaaacaggaaagctctgcatagaagtttcttctgcctctaaaattgcgtttatatcagaggagttgtgcattggctgtggtatctgcgtgaagaaatgtccatttgaagctatccagatcattaacctcccaaaggatttagataaagatacaacacatcgatatggaccaaacacattcaagctccacaggttgcctgtgccaaggccaggacaggtgttgggactggttggaacaaatggtattgggaagtctactgcacttaaagtccttgctgggaaacttaagcccaatctcggcaggttcaataatcctcctgattggcaggaaattcttacgtatttccgtggatcagagttacagaactattttactcgcattttggaagataatctgaaggcaataatcaagcctcagtatgttgatcacataccgaaggcagtgcaagggaatgtgggccaggtgctttctcaaaaagatgaaagagagatgaagtctgagctttgcactgatctagacttgaatcaggttatagatcggaatgttggtgatttatctggaggggaattgcaacggtttgcaattgcagtagttgcaattcaaactgccgaaatatatatgtttgatgagccctcgagttatcttgatgtaaaacagcggcttaaagctgcacaggtagttcggtccctgctgaagcccaacagctatgttattgttgtcgagcatgaccttagtgtcctagattatttgtcggacttcatttgctgcctatatggaaagcctggagcttatggtgtagtaacacttccattttctgttagagaggggatcaacatatttttggctggttttattccgactgagaatcttcgatttcgagatgaatcactgacattcaaggttgcagagacaccacaggaaagtgcggaagaaataaaaagctatgcacggtacagatacccaagcatgtcaaaaactcagggtaatttcaagctatctgtaaaggagggagaattcacagattctcagattgttgtaatgttgggagaaaatggaactgggaagactactttcataaggatgctggctggtttgctgaagccagatatagttgaaaattcagaggtggagatacctgaatttaatgtgtcatataagccacagaagatcagcccgaagtttcagtcaactgtgaggcatttattacaccaaaagatacgcgattcatacacacaccctcagttcaacactgatgtcatgaagccccttcaaattgagcagctaatggatcaagaagtcgtaaatctttctggtggagaattacaaagggtggcactgtgcttatgtcttggcaagccagcagacatttatcttattgacgagccaagtgcatatttggactctgagcagcgtattgttgcagcaaaggttataaagagatttattcttcatgccaaaaagactgcttttgttgttgagcatgattttatcatggcaacatatttggcagacagggttatagtttatgagggacaaccatccgtagattgtattgcaaatgctccacagagtctacagacaggaatgaacctatttttgtcgcacctggatattacatttagacgagatccaacaaactacaggcctcgtataaataaattggattcaacaaaggacagggaacagaagaatgcagggtcatattattatctggatgattaatgaagtcttccaagcattaaagactttgtcttgatcacagtccatcaacagtaacagtatacaactcaaagtctttggaattatacttgagtccgcatatttaaagattgtatcaagagcctatgttattggaattttctccatggttgaatcttgaatggatattttgcttttagtgcaagaatgcctggagacttgcacaattgagctgaagtcagttataacaaaggagtggtttctattgcttctgtttgtgccagcttaattgaaagaaggaagagtgctcttcttaagaatttgaagtgaattggtgccatcaggctcactagtaggtttctatttacttcttgaattgtaacctcaattgaggcaaagggattttgttacagttaacaaacaattgaataagtttaacacggtggtaag

SEQ ID NO: 4819 - DNA, 2480 bp, Vigna unguiculata
tcctttcgaaagggtaaacgaatcttgtcttcttcaactcttccaccgccatggccgatcgcttgacgcgtattgccatagtcagcaacgacaggtgcaaacccaagaagtgccgccaagaatgcaagaagagttgtccagtggtcagaaccggtagattgtgtattgaggttacttcagcttccaagattgcttacatttctgaggaattgtgcattggatgcggtatttgtgtgaagaaatgtccttttgaagctattcagattatcaacttgccaaaggacttggataaggatactactcatagatacggtcccaatacttttaagctgcataggttgccggtgccaaggcccgggcaggtgcttgggttggtcgggacgaatgggattgggaagtccactgcccttaaagttttggctgggaagctgaagccgaatttgggtcgatttactaatccccctgactggcaggaaattgtgacatactttcgaggatctgaactgcagaattactttacccgtattctcgaggatgatttgaaggctatcatcaagcctcagtatgttgaccatattccaaaagctgtgcaaggaaatgtgggccaggtgctagaccagaaagatgagagagacatgaagaaggagctttgtgctgatcttgagcttaatcaagttatagatcgtaatgtgggggatctttcagtggtgagctccaaaggtttgccattgcggttgttgcaatccagaatgctgagatatacatgtttgacgaaccatctagttatcttgatgtgaaacagaggctgaaagctgcacaagttattcgatcattgcttaggcctaatagttatgtaattgttgtagagcacgatctcagtgtcttggactacttatcagactttatttgttgtctatacggcaaacctggtgcatatggagtggtgacacttcctttctctgtcagagaaggaattaacattttcttggctggctttgttccgacagaaaatctgaggttccgggatgattcactaacctttaaggttgctgagactccacaggaaagtgctgaggaagctcagacatatgctcgttataagtacccaacaatgaccaaaactcaaggcaattttaaacttcgtgtagttgaaggagaatttactgattctcagattattgtgatgctgggtgagaatgggacaggaaagacaacattcattcgaatgctggctggtttattgaaacctgacagcatagaaggtggatctgatgtggagatgcctgaatttaatgtttcatacaagcctcagaagattagtccgaagttccaatcaactgttaggcacttgctacatcaaaaaatacgtgatgcatatactcatccccagtttgtttcagatgtgatgaagccacttcttatcgaacagttaatggaccaagaagttgtgaatctttctggaggagagttgcagagagttgctctgtgtctctgtcttggcaagcctgcagatatctatctgatagatgagccaagtgcatatctagattctgaacagcgaattcatgctgctaaagtgatcaagaggtttattcttcatgcaaagaaaacggcttttgtcgttgagcatgatttcatcatggcaacttatctcgcagacagagttattgtttatgcgggtcaaccatcaattgattgtgttgcaaattctcctcaatcattgttgtctgggatgaaccttttcttatcgcatcttgatatcacatttagaagagacccaactaattttcgcccaaggatcaacaaacttgattcaaccaaggacagagaacaaaagtctgctgggtcttattactaccttgatgactgattccatactcaggctgttgttctttcaccattacaacattgcatcagtttgagcttttcatgggatctcagatttggttaatttgatgccttgaaatataagattgccatttttaccaatggcaactttctcagtgaatagaagagcctgcatacatgcttatgttggttggtgcatttgtacatttacccttatattactgcagttacttatcaccagttttgctacgacttgggtgggtgaatctgaatattacatgggtttaattggtcgagattttcattgaatgtcccaaatccattggaacatcatgacgtcagattgggtttatcgccacttcggcatataatttcagttgagtatgtatcgaagtttactttcattcccatgctacttgatttagatagatatctactgtctgtttggaatatgttgccgttgagaaagttgttaatcttgatgaatattgttttactcttgaaaaatggagattattgtcgatttaatgattcaactgttggctagacagatacaatagaagtatagtcgttgtgattttgtcctacaatttaaaatggtagtttcgaatgtctactttttcttgtggttc

SEQ ID NO: 4820 - DNA, 2291 bp, Brassica rapa
gggtcaattgggcaaagcgtaactctcaggcgcgtgtgctctccactggtttatcgatcatctcagacattttctgagagatggcagatcgattgacacgtattgcaattgtgagttcggaccgttgcaagcctaagaaatgtcgccaagagtgcaagaagagctgtcctgtcgtcaagacaggaaaactttgtattgaggtgactgttggttccaagcttgcttttatctctgaggagttgtgcatcggttgcggtatttgtgtcaagaaatgcccatttgaagctattcagattatcaatcttcccagagacttggagaaagatacgacccatcgctatggggccaacactttcaagttgcacaggctgccagttccaaggccagggcaagtcctagggttggttggcaccaatggtattggaaaatcaaccgctctgaaaattttggcagggaagctcaaaccaaacttaggccgtttcactaatcctccagactggcaagaaatcttgactcacttccgtgggtcagaacttcaaaactacttcacccgtattctagaagataatctgaaggccattataaagcctcagtatgtggaccacatcccaaaggctgttcgaggcaatgttggagaggtccttgaccagaaggacgagagagacaagaaggcagagctctgtgctgatctggagctgaaccaggtcattgatcgtgctgttgagaatttgtctggtggtgagctgcagaggtttgccatcgctgttgttgccatacaaaacgccgagatttacatgtttgatgagccgtctagttaccttgatgttaagcaaagacttaaagctgctcaagttgttcgttctctcctgaggcctaacagctacgtcattgtggaggagcatgatctcagtgttctggactacttgtcggatttcatttgctgtctgtatgggaaaccaggagcctatggtgtcgtgactctccctttctctgtcagagaagggatcaacattttcttggctgggtttgtccccactgaaaatttacgttttagagatgaatcgctgaccttcaaggttgctgagactccacaagaaagtgctgaagaaatacagtcgtacgctaggtacaaataccctacgatgaccaaaactcaaggaaactttaggttgaaagtgacggaaggtgaattcaccgactctcagattattgtaatgcttggggagaatggtacagggaagacaacctttatccgaatgctggcgggtttgttgaaacctgacgaaacagaagaatcagacatagagataccagagttcaatgtttcttacaagcctcagaagatcagccccaagtttcagaattcagttagacacttgctacaccaaaagattcgagattcttacatgcatcctcaattcgtgtcggacgtgatgaaaccacttcagattgagcagttgatggatcaagaagttgtcaatctctctggaggagagttgcaaagggttgcattagctctgtgcctcggaaagcctgcggatatctacctgatcgatgagccgagtgcgtatctggattcagagcaacgtattgtggcttctaaagtcattaagcggttcattctccacgcaaagaaaactgcatttatagtcgagcatgactttataatggcaacatatctcgcagatcgagtcattgtctatgaaggacaaccatccattgactgtattgcaaactgtcctcaatcactgctcagtggaatgaatttgtttctatctcatctgaacatcacattcagaagagatcccaccaatttcagaccaaggatcaacaaattagagtcgactaaagacagggagcaaaagtctgctggctcgtactattacttggatgattaagacgtctatcatgaggttcttaatctctaaaatccaatctttgtcttaacaatcacacagcattttatggagagccaatttctgaaatgtttgtttgtgtctcgttgatttcctttgtggattcacagaacataagaggcatggtctggataaaaacattgtaatgatatttgatctatgagttggggatgctctgtgttccttgcctgtttctcttctcaagcttttgattatttgttcatcagttttgcttctcaggtttttcattaactgagtaatagtagttcctaaattttcttaacctttattggcttttgtactttctgagttgtttgttttctgttgtaatgatatttactttggattttgcaaggaaggtactctgcctattgt

SEQ ID NO: 4821 - DNA, 2075 bp, Brassica napus
atcctttgagagatggcagatcgattgacacgtattgctatcgtgagttcagaccgttgcaagcctaagaaatgtcgccaagagtgtaagaagagctgtcctgtggtcaagacaggaaaactttgtattgaggtgactgttggttccaagcttgctttcatctcagaggagttgtgcattggttgcggtatttgcgttaagaaatgtccatttgaagctattcagattatcaatcttcccagagacttagagaaagacacgacccatcgttatggtgcaaacactttcaagttgcacaggcttccagttccaaggccagggcaggtcctagggttggttgggacaaatggtattggcaaatcaaccgctttgaaaattttggcaggaaagctcaaaccaaacttgggccgtttcactaatcctccagactggcaagaaatcttgactcacttccgtgggtctgaacttcaaaactacttcacccgtattctagaagataatctaaaggccattataaagcctcagtatgtcgaccacatcccaaaagctgtgcgaggcaacgttggagaggtccttgaccagaaggacgagagagacaagaaggcggaactctgtgctgatctggagctgaaccaggtcattgatcgtgacgttgagaatttatctggtggtgagctgcagaggtttgctatcgctgttgtcgccatacaaaacgctgagatatacatgtttgatgagccgtctagttaccttgacgttaagcaaagactcaaagctgctcaagtcgtccgctccctccttaggcctaatagctatgtcattgtggtggagcatgatctcagtgttcttgactacttgtcggatttcatttgctgtctgtatgggaaaccaggagcctacggtgttgtgactctccccttctctgttagagaaggaatcaacattttcttggctgggttcgttcccacagagaatctacgttttagagaagagtcgctgaccttcaaggttgctgagactccacaagaaagtgctgaagaaatacagtcgtacgctaggtacaagtacccaaccatgaccaaaactcaaggaaacttcaggttgaaagtgacggaaggtgaattcaccgactctcagattattgttatgcttggggagaatggtactgggaagacaacatttatccggatgctggcgggtttgttaaaaccagacgagacagaagaatcagacatagagataccagaattcaatgtttcttacaagccacaaaagatcagccccaagtttcagaattcagttaggcacttgctacatcagaagattcgagattcttacatgcatcctcagtttgtgtcggacgtgatgaagccgcttcagattgagcagttgatggatcaggaagttgtcaatctctcaggaggagagctgcaaagggttgcattagctctgtgcctcggaaagcctgcggatatatacctgattgatgagccaagtgcatacctcgattcagagcaacgtattgtggcttctaaagtcattaagcggttcattctccatgcaaagaaaactgcatttatagtcgagcatgactttataatggctacctatttagccgaccgggtcattgtctatgaaggacagccatccattgattgtgttgcaaattgtcctcagtcactactcagtggaatgaatctcttcctctctcatctaaacatcaccttcagacgggatcccaccaatttcagaccaagaataaacaaattagagtcgactaaagacagggagcaaaagtctgctggctcatactactacttggacgattaagacaactaccatgagaacataggggcatgatctggatacaacattgtctgaattccacaaaggtctttcgctctgaggaagttgatcttatgaggtcgggatagtgtttctcttatcaagcttttgattgtttgttcataagttttgcttctaagatttgccattgccgtcttcctcttcctggacacttagcaagtttttttattaacttacaataaaacacactgaatcctttttaacttttt

SEQ ID NO: 4822 - DNA, 2590 bp, Populus trichocarpa
aaacaagctagtagagcgtagtacctttttattattaatttttattgttttaggttttcggtaggcgttttcgctgggatacaatagaggggggagggcttaagtcgaaagggcgttcccaccacgcgtagcgtagcttctccttgtcttcttcggatccaccctctcttcaactgtttgcgtgtagtatcaacttaaataaaaaaaaaagagaagagggagagatggcagatcgattgacgcgtatagccatagtaacctctgatagatgcaagcctaagaagtgccgtcaagagtgcaagaagagctgccccgttgttaaaactgggaaactgtgtatagaggtgactcctatttcgaagatagcttttatttcggaggagttgtgcattggatgtggtatctgtgtcaagaaatgcccatttgaagcaattcagatcattaacttgcctaaggatttggataaagacaccacccatcgttatggccccaatacctttaagttgcacaggctaccagttccgaggcctgggcaagttcttggcttggttggaacaaacggcattggcaagtccactgctctcaaagttctagctggaaaactgaaacctaatttgggtcgtttcaataacccgcctgattggcaggaaattctgacttactttcgaggatctgagcttcagaattactttacccgtatcctagaggataatttgaaggccatcataaagcctcaatatgttgaccacattccaagagcagttcaaggcaatgtcgggcaagtgcttgaccaaaaagatgagagccacaggaaggcagaactttgtcgtgatcttgatctgaaccaggttatagatcgtaatgtgggggatttatcaggtggagagctccaaagatttgctattgctgttgttgcaatacagaatgcagagatatatatgtttgatgaaccttcaagttatcttgatgtcaagcagaggcttaaagctgcccaagttatccgatctttgctcagggccaacagctatgttattgtggtggagcatgatcttagtgtcctggactatttatctgacttcatttgctgcttgtacgggaaaccgggtgcgtatggagtagtaacccttcccttttctgtgagagaaggtatcaatatatttttgtctgggtttgttcctacagaaaacctacgattccgggatgaatctttaaccttcaaggttgctgagactccacaggataatgctgaggagattcaaacatatgcacgatacaaatacccaaccatgagtaaaactcagggcaatttcaagcttagtgtcgttgagggtgaatttactgactctcagattgtagtaatgcttggtgagaatgggacagggaagacaacatttatccgcatgctggctggtttgctgaaacctgatactatagaagattctgaatctgagatacctgagttcaatgtttcttacaaaccccagaagataagccccaagtttcaacacagtgtcagacagttactgcattcaaagatacgtgattcgtatatgcatcctcagtttgtttcagatgtcatgaaaccacttcttattgagcaactgatggatcaagaagttgtaaatctatctggtggagagttgcaaagagttgcattatgtctatgccttggaaagccagcagacatttatttgatagatgaaccaagtgcgtatcttgattctgagcagcgtattgttgcttcaaaagtcatcaagaggtttatcctacatgcaaagaagactgcatttgtggtggagcatgattttataatggcaacatacctggctgatagagttattgtgtacgagggacagccttctgtggattgtacagcaaattctcctcagtcattgttgactgggatgaatctcttcttatctcatctggatatcacatttagacgagaccccactaatttccggccaagaatcaacaaattggactcgaccaaggacagggagcagaaaactgccgggtcatattattacctggatgattgatgtaacaattgacacaggcatcgcacggattaatttataatcctggtcaaggtggcaccgatttgattaaattttctatcccagtcaagtcaatgtgctatgctgacaaatgactggatttcctctgcctgctaagaggccatggtttctcttttcgcctaaatgagtctggtggctgctcatgatgatgctttatgatattttctcctgtgtcgagttttttgttcgccagtttttgtttttatgacattaggtgagtgaatcataatgataaccgaatcctttttgggcatttgctgcttcaagttgtattttgaatagaattactattaatcagaagaaataacaaaaaaaaaggggcaaacactgagctaatagaggtccttgcctgtgttttgtatcttggctttggtattctagcaggataattaatcctccgagattttttagccctttttcactgaattttatatataattgtatttttaagtcttgattttatagaagtttaaataatttatatttttttattaataaaaacttttttt

SEQ ID NO: 4823 - DNA, 2299 bp, Cephalotaxus harringtonia
gtgtgcactcgcccagcacacgcttctcctttcattagagccgcaggttaagtccacagggattcgatccgtgaaaaaatgacggatcggctgacaaggattgctattgttagctcggaccgctgcaagcccaaaaaatgcaggcaggagtgtaaaaagagctgtcctgttgtcaaaacaggaaagctctgcatagaggtttcatctgcctctaagatcgcatttatatcagaggagttgtgcattggttgtggtatctgtgttaagaatgcccatttgaagctatccagattattaatctcccaaagatctagataaagacacaacacatcgatatgggccaaacacattcaagctccacaggttgccagtgccaaggccaggacaggtgttgggacttgttgggacaaatggtattgggaagtctactgcacttaaagtccttgctggaaaactcaagcccaatcttggcaggttcaataatcctcccgattggcaggaaattcttacatattttcgggggtcagagctacagaactatttcacccgtattttagaagataatctgaaggcaataatcaaacctcaatatgttgatcacataccaaaggcagtacaagggaatgtggggcaggtgctttctcagaaggatgaaagagatatgaaagctgagctttgcactgatctggatttgaatcaggttattgatcggaatgttggcgatttatctggaggagaattgcagcggtttgcaattgcagtagttgcaattcaaaatgctgaaatatatatgtttgatgagccctcgagttatctggatgtaaagcaacggcttaaagctgcacaagtagtccggtctttgctcaggcctaacagctatgttattgttgttgagcatgaccttagtgtccttgactacttatcggacttcatttgctgcctgtacggaaagcctggagcttatggtgtagtaacgcttccattttcagttagggaagggatcaatatctttttggctggttttattcccactgaaaatcttcgatttcgagatgaatcgctgacgttcaaggttgcagagacgccacaggaaagtgcagaagaaataaaaagctatgcacggtacagatacccaagcatgtcaaaaactcagggtaatttcaaacttagtgtaaaggagggagagttcacagattctcagattgttgtaatgttgggggaaaatggaacaggaaagaccactttcatacgcatgctggctggcttgttgaagccagatattgttgaaaactcagaggtggagatacctgaatttaatgtgtcatataagccacagaagataagtccaaaatttcagtcaactgtgagacatttattgcaccaaaagattcgtgattcatacacacatcctcagttcacaactgatgtcatgaagcctcttcaaattgagcaactaatggatcaagaagttgtaaatctttctggtggagaattacagagagtggcactgtgcttatgtcttggcaagccagcagacatttatcttattgatgagccaagtgcatacttggattccgagcagcgtattgttgcagcaaaggttataaagagatttattcttcatgcaaaaaagactgcttttgttgttgagcatgattttatcatggccacctatttggcagacagggttatagtttacgagggacaatcttctgtagattgtattgcaaatgctccacagagtctacagacaggaatgaacttgtttttgtcgcacctggatattacatttagacgagatccaacaaactacaggcctcggattaataaattggaatcaacaaaggacagggagcagaagaatgcaggatcatattattatctggatgattaaatatgccttcctggtattcgataattgtcttgattgcaggccgtcaacatcaagaatttacaattgcaggccatcaacatcaagaatttacaactcacagtacgtgaagattttcattcatgggcctgcatagcaaaaaattgtatcaagagcttatatgattggatttttcttgattggacattttggattgacttgtaattgagatgaggtaattatgacgagggagtggtttcaattgctctgtttgtgccggcttagctgaaaatatgaagagtgctcttttcaaggatttgcagtgatttggcgccatcaggctcactagtagattttaatttcctggttgaattgtaacctcagtttcctcctatttaattgaggcgaaattttttttatgagtaaaac

SEQ ID NO: 4824 - DNA, 2145 bp, Prunus persica
aggagatggcagatcggttaacccgtatagcaatagtgagctccgacagatgcaagcctaagaagtgccgccaggaatgcaagaagagctgtcctgtcgtcaagactggtaaactatgtatcgaggttacccctgcatccaagattgcttttatctcagaagaattgtgcattgggtgtggtatctgtgttaagaaatgcccatttgaagcaatccaaattatcaacttgccaaaggatttagacaaagatacaacacatcgttatgggcctaacactttcaaactacacaggttaccagtcccaaggccagggcaagtacttggtttggttggaactaatggcattgggaagtcaactgccctaaaagttttggctggaaagttgaaaccaaatttaggtcgtttcaataatcctccagactggcaggaaattttgacctactttcgaggatctgagttgcagaattattttactcgtatcctggaagacaatttgaaggccattataaagccccagtatgttgatcacattccgaaagcagttcaaggaaatgttggggaggtgctcagccagaaagatgaaagggatatgaaggaagaactatgtgctgatcttgagctgaaccaggttatagatcgtaatgtaggggatttatcaggtggggagcttcaaagatttgccattgctgtcgttgccatacagaatgcagagatatatatgtttgacgaaccttcaagttatcttgatgtgaaacagaggcttaaagcagcccaagttgtccgatctttgctcaggcctaatagctatgtaattgttgtggagcatgatcttagtgtcttggattacttatcagacttcatttgctgtttatacgggaaaccgggtgcatatggagttgtaactcttcctttctcagttagagaaggaattaacatcttcttggccggatttgttcctacagaaaatcttaggttccgggatgaatctctgacctttaaggcaagattataaattttgttgctgagactccacaggaaagtgctgaggaaattgagacatatgcacgatataaatacccatctatgactaaaactcagggaaactttaggcttcgtgttgttgagggagaatttacggattctcaaattattgttatgctgggtgagaatggaacagggaagacaacatttatccgtatgctggctggtctactgaaacctgatattgtagaagattccaatgtggagatacctgaattcaatgtttcttacaaaccccagaaaatcagtccaaaatttcaatccactgtcagacacttgttacattcaaaaattcgtgattcatatacccatccccagtttatgtcagatgtgatgaagcctcttcttattgaacaattgatggatcaagaagttgtgaatctctctggtggagagctgcaaagggttgcattatgcctatgcctcgggaagcctgcagatatctatcttatagatgaaccaagtgcctatcttgattctgagcagcgtattgttgcttcaaaagtcataaagaggtttatcctacatgctaagaaaactgcatttgtggttgaacatgactttattatggctacctacttggcagatagagttattgtctatgaggggaagccatcaattgattgtgttgcaaattctccacagtcattattgactgggatgaatctattcttatctcatcttgatattacatttcgacgtgaccccactaactaccgcccaagaatcaacaaattggagtcaacgaaggatagggaacaaaaagctgctggatcctattattacttggatgattgatataaccacgaagttttggcaaaatttagagggcttcaatgtgatctaataatggaatcccggctgagtcatgacatgctgacaaatgatgggaggtcctttgtctgtgaagaggtgatgtttgtttaccagtgagtttccgtgaatgagagtttccaggcccttccatattgttgctagttgagtacattatgccctatgtgtgcttgcacttatcccaattttgttaaaatttgtctctgggcgacggaatctaaatgtacaatggtctctcatagtatcaatttttctttctttttgatgaa

SEQ ID NO: 4825 - DNA, 2499 bp, Papaver somniferum
aaatcaccatgtctgaccgattgactcgtatcgccatcgtcagcggcgaccgctgcaaacctaaaaagtgccgccaggaatgcaaaagacttgccccgtcgtcaaaactgggaaactgtgtattgaggttacggtagctgcaaagattgcttacatctctgaggaattgtgtattggatgtggtatctgtgtcaagagatgcccattcgaagccattcagattatcaacttgcctaaagatttggataaggatacaactcatcgttacggtcccaacactttcaagctgcacaggttaccagtcccaagaccaggacaagttctaggtttggtcggaactaatggaattggaaagtctacggctctcaaagtcttggctgggaagctgaagcctaatctgggtcgattcaataacccacctgattggcaggaaatattgacatacttcagagggtctgagcttcagaactacttcacccgtatcttggaagataacttgaaggcgatcatcaagcctcaatatgtggatcacatcccaaaagcagtccaagggaatgttgggcaagtactggagcagaaagatgagagaggtgtgaaagaggaactctgtcgtgatcttgagctcaatcaggttatagagcgaaacgtgggtgatttgtcaggtggagagctgcaaagatttgctattgctgtcgttgccatacagaatgcagagatttatatgtttgacgagccttccagttatcttgatgtcagacagaggcttaaagctgcccaagttatccgatcattgctcaggccaaacagctatgtgattgtcgtggagcacgatcttagtgtcttagattacctgtctgacttcatttgctgcctatatgggaaacctggagcttatggagttgtaacccttcccttttctgttagagaaggaattaatattttcttggctggatttgtcccaactgagaatctaagattccgtgacgaatcacttacttttaaggttgctgagacaccacaggaaagtgcagaagaaattcagtcgtatgcacgatacaagtacccaactatgagtaaaactcaaggaaatttcaagcttcgtgttctggagggagaattcactgattcccaaattattgtcatgcttggtgagaacgggacagggaagacaacatttatccgcatgctggctggtctcttgaagccagatgaggtggagagttcagatgcagaaatacctgaattcaatgttcttacaagccccagaagatcagtccaaagtttcaagcttctgtcagggccttgctgcatcaaaagatccgtgattcatacatgcatcctcagtttgtgtcagatgtcatgaaaccactccagattgaacaattaatggatcaggaagttgtgaatctctcaggtggagagctgcaaagagttgcattatgtctttgccttggaaagcctgcggatatatatctgatagatgagccaagtgcttatcttgattcagagcagcgtattgttgcctcaaaagtcattaagaggtttatcctccatgcgaagaagactgcttttgtcgttgagcatgattttataatggcaacttatcttgctgacagagtgattgtgtacgaggggcaaccatctatcgactgtactgccaatgctcctcagtctttgttgacagggatgaaccttttcctatctcaattggacattacattcagacgggacccaaccaattttaggccgcgtatcaacaagatgaattccacgaaagacagggaacagaagaatgctgggtcttactattacctcgatgactaaagcaccatatatgctacaaaggcgtctcttcggtggtgtaagattaaaagagcaccactctgttgcaattgggaaggaccgctaactggatgtgcatctgttgaggatgaggtttctggcttaggtagggtggccagttattggagaggtcatgtatgttggaaggacaaagtaaagtagtgtcgcgttaccctaatttaagttgtgcaccccctgaatctgcttcctggttcattttttgttgttgcttccttggggtgtatgcgagtaaagcagattatattagtactactgcagtatttgatgttctctcagaatgagcttttgaagatcaacgagggcatgagaacagagagcagtttaagcaactgtacttaaaaggcctatcccatactttatatttttctttctatgatgatatttgacaagaattttggttgaggatattagatctctatgttttattgacctagctttctaaagtcttttaggtagttggtctccttctctttaatcatatttttctgagatgtttttttgttcttcggcatttgtgggttttgttaagaagaggtttcttttgtctgtctgtttcttatgaaaatatataaagaggatttctccttaagagcattacataaagatgtttttctgtcttgtgtatcaccaaaaaaa

SEQ ID NO: 4826 - DNA, 2287 bp, Arabidopsis lyrata
ttcattttgcgcaaagcataactatcaagtgcgtgtgctctccgctggttccttaaaagaatcggcacacgctttttcatttcaatcttcctctacgaatctctcaatcatctcaggtttattgagagatggcagatcgtttgacacgtattgctattgtgagttcagaccgttgtaagccaaagaaatgtcgccaagagtgcaaaaagagttgccccgtggtcaagacaggaaaactttgtattgaggtgactgttggttccaagcttgcttttatctcagaggagttgtgtattggttgcggtatttgtgtgaagaaatgcccatttgaagctattcagattatcaatcttccaagagacttggagaaagatacgacccatcgctatgggccaaacacgtttaagttgcacaggctcccagttccaagaccggggcaggtgctagggttggttggaaccaatggtattggaaaatcaactgctctgaaaattttggctggaaagctcaaaccaaatttgggccgtttcactagtcctccagactggcaagaaatcttgactcacttccgtggttcagaactgcaaaactacttcacacgtattctagaagataatcttaaggccattataaagcctcaatatgtcgaccacatcccaagagcggttaaaggtaatgttggagaggtccttgaccagaaggatgagagagataagaaggcagagctctgtgctgatctggagctgaaccaggtcattgaccgtgatgttgagaatttatctggtggtgagctgcagaggtttgccatcgctgttgttgccatacaaaatgcagagatttacatgtttgatgaaccatctagttacctcgatgttaagcaaagactcaaagctgcacaagttgttcgttctctcctgaggcctaatagttacgtcattgttgtggagcatgatctcagtgttcttgattacttgtcggatttcatttgctgtctgtatgggaaaccaggagcctatggtgtggtgactctccccttctctgtcagagaaggaatcaacattttcttggctgggtttgttcctacagaaaatttacgttttagagatgaatctttgaccttcaaggttgctgagactccacaagaaagtgctgaagagatacagtcgtacgctaggtacaaataccccacgatgaccaaaactcaaggaaacttcaggttgagagtgtcggaaggtgaattcaccgactctcagattattgtaatgcttggggagaatggtacagggaagacaacatttattcggatgctggcggggttgttgaagccagacgatgcagaaggagaagacagagagatcccagaattcaatgtttcgtacaagccacaaaagatcagccctaagtttcagaattcagttagacacctgctacatcaaaagattcgagattcttacatgcatccacaatttatgtcggatgtgatgaaaccacttcagattgagcagttgatggatcaagaagttgtcaatctctcaggaggagagttgcaaagggttgcattaactctgtgcctcggaaagcctgcggatatatacctgatcgatgagccaagcgcatatctcgattcagagcaacgtatcgtggcttcgaaagtcattaagcgatttattctccacgcaaagaaaactgcatttgtagtcgagcatgactttataatggcgacctatttggcagaccgagtcattgtgtatgaaggacaaccatccattgattgtactgcaaattgtcctcaatcactgctcagtggaatgaatctcttcttatctcatctgaacatcacattcagacgggatcccactaatttcagaccaagaatcaacaaattggagtcgaccaaagacagggagcaaaagtctgcaggctcatactactacttggatgattaggacaactaccacgagaatacaagggcatgagctggataaaacattgttcgaattccagaagggcttttgcttatagcaagatctatgaactcaggatattttacgcagccatctgttttccgagtgcatttagcagatgtttctttctggtcaagcttttgattgttgtttcatcagttttgcttcttcgtatttttttcccacatcttttattaactgagcaataaaagtttcagaatctgtaacttttttctttttggctttgtacttcccgagttgatgatttcaacatttactgtaatgttattactttggattttacaatgaatctattgcttctt

SEQ ID NO: 4827 - DNA, 2330 bp, Podocarpus macrophillus
accgccacaaaaaaagagaaaaacgattccgtagattaaacgcagccattgcaacatccattctttaccttgttggccaaggcttggctaagtctctctcatatctaccctaacttggtctctcttgctctgtcgctgctgctgctgctgttttcccagggattcgatctgtggtgagttgagatggccgatcggttgacaaggattgcgatagtgagctcggaccgatgcaagcccaagaaatgccggcaggagtgcaaaaagagctgccctgttgtcaaaacaggaaagctctgcatagaagtttcatctgcctctaaaattgcatttatatcagaggagttgtgtattggttgtggtatctgtgttaagaaatgtccatttgaagcaatccagatcattaatctcccaaaagatttagagaaagacacgacacacagatatgggccaaataccttcaagctccacagattgcctgtgccaagaccagggcaggttttgggacttgttggaacaaatggtattgggaagtctactgcccttaaagtccttgctggcaaacttaagcccaatttgggcaggttcaatagtcctcctgattggcaagaaattcttacttatttcaggggatcagagttacagaactattttacccgcattctggaagataatctgaaggcaataatcaaacctcagtatgttgatcacataccaaaggcagtacaagggaatgttggccaagtgctttctcagaaggatgaaagagataagaagtctgagctttgcagtgatctggatctgaatcaggttattgatcggaatgttggtgatctgtctggaggggaattgcaacggtttgcaattgcagtagtcgcaattcaaaatgctgaaatatatatgtttgatgagccctctagttatcttgatgtaaagcaacgtcttaaagctgctcaagttgtccgatccctgctcaggcccaacagctatgttattgttgtcgagcatgaccttagtgtccttgattacttgtcggacttcatttgttgtctgtatgggaaacctggagcgtatggagtggtaacacttcctttttcagtcagggaagggatcaatatatttttggctggttttattcccactgaaaatcttcgatttcgagatgagtctctgacattcaaggttgctgagactccacaagaaagtgcagaagaaatcaaaagctatgcacggtacaagtacccaagcatgacaaaaaatcagggtaatttcaagcttgctgtaaaagaaggagaatttacagattctcagatcgttgttatgctgggagaaaatggaacaggaaaaactactttcatacgtatgctggctggattattgaagccagatactgttgaaaattcagaggtggagatacctgagtttaatgtgtcatacaagccgcagaagatcagtccaaagtttcaatcatctgtgaggcatttattgcaccaaaggatccgtgattcatatacacatcctcagttcacaactgatgtcatgaaaccgcttcaaattgagcaactaatggatcaagaagttgtgaatctttctggtggagaattacagagagtggcattgtgtttatgtcttggcaagcctgcagacatttatcttattgatgagccaagtgcatacttagattctgagcaacgtattgttgcagcgaaagttattaagagattcattcttcatgctaaaaagaccgcttttgttgttgagcacgattttatcatggcaacctatttggcagacagggtcattgtgtacgagggacaggcatctgtagattgcgttgcaaatgctccacagagtctacagacaggaatgaacctgtttttatcgcacctggatatcacatttagacgggatccaacaaactacaggccacgtataaataaattagattcaacaaaggacagggatcagaagaatgcaggatcatactactatctggatgattgaagttgttccattttcgagtcctctcggtcaagatcatcaacagtaacaattcgcaacttatattatggatttatgctagagtttctgcggactagcgattgagatgaggtttattatgaagaggcagtaatatcttttgatcctctttgtgctggcttcactggaaaaaagtaagagtccttatgtgttttggattgtattggtgccctctggcttactactacatttttacttctgcttggattgtagcctcactttgtatttgaaattgaggtaaaaagtattttacaagtgaatatttgattcagtttagatggatatagttaatt

SEQ ID NO: 4828 - DNA, 1983 bp, Valeriana officinalis
gtttgctagccagagcttcgcgttctatcctccaaattttgcagccgtattcatcacaatcgggaggaaaagatgtcggatcgattaacgcgtatagctatcgtcagctctgatcggtgcaagccaaagaagtgccgtcaagagtgcaaaaagagctgtcctgttgttcgaactggtaaactgtgtattgaggtcacgtctgctgccaaaatcgcgtacatctctgaggagttgtgcattggatgtggtatttgtgttaagaaatgtccgtttgaagcaattcaaatcattaatctacccaaagatttggataaggatacaactcatcgttatggtgccaacactttcaaattacacaggttgcctgttccgaggcctggacaggtgcttggtttagttggcacaaacggtattggaaagtcaactgccctgaaagttttggctggaaaattgaaacctaatttgggccgattcaataaccctcccgattggcaagagatcttgacgtattttcgtggatctgagctgcaaaattatttcacccgcattcttgaagataatcttaaggccattattaagccacaatatgtggaccacattccaaaagcagtcaatggaaatgtgggtgaagtacttgaccaaaaagacgaaagaggcaagaaggaagaattgtgtcatgacctgcaactgaatcaagttattgaccgtaaggtcgaacaattatcaggtggagaacttcagagattcgcgattgcagttgtcgctatacaaaatgcagagatatatatgtttgatgaaccatcaagttatctcgatgttaaacagaggctcaaagctgctcaagttattcggtctttactaaggcctaatagctatgtgattgttgttgaacatgatctgagtgttctggattatctatcggatttcatttgctgtttatatggccggcctggtgcatatggtgttgttacccttcctttttctgtccgagaaggaattaatattttcttggccggatttgttcctactgaaaatcttcgctttcgtgatgaatctctcacttttaaggttgctgaaacaccgcaagaaagtgcagaggaaatagagacatacgcaagatacaaatatcctactatgactaaaactcaaggtggtttcacgcttaaagtcgccgaaggtgaatttactgattctcaaattattgtcatgcttggtgaaaacggtaccggaaaaacaaccttcatccgaatgcttgctggtttactgaaacctgattcggtagaagattctgacgtcgaaataccggaattcaacgtgtcttacaagccccaaaaaatcagtccgaaatttcagaattcagtgaggcacttattgcatcaaaaaataagagattcatatatgcatcctcagtttgtgtcagatgtgatgaagccactcttaatcgaacaacttatggatcaagaagttgttaatctttctggtggagaattacaacgagttgcgttatgtctttgcctcggaaagcctgcagatatatatttgatagacgagccgagtgcgtatctagattcagaacagcgtatagtagcatcaaaagtgataaagagattcatactgcatgccaagaagactgcatttattgttgagcatgattttataatggcaacttatttggctgatagagtcatcgtttatgagggaaatccttctattgattgtaccgctaatgcccctcagtctttgttgaccggcatgaatcttttcctatcgcatctggacatcacgttcaggcgggacccaactaactttcgaccaagaatcaacaaactggagtcgaccaaagacagggaacagaagaatgctggatcgtattactacctcgacgattaaattcattttcttttggtttacaaaaccaggtcgccgatacggattcaacagatcacacatgcatacatgtttatatatatatatatatatata

SEQ ID NO: 4829 - DNA, 2448 bp, Glycine max
acggtgaagcaagtaaccctaatgctatgctatatgattttctgaacgttctcacgacacgcctactcattgcactcttcgatcgcaactctctttttcttccaaaagggaaaacgaatctcaaacttcacaagtgtttgaggcgccatggcggatcggttgacgcgtattgccatcgtcagcaacgacaggtgcaagcccaaaaagtgccgccaggagtgcaagaagagttgccccgtcgtcagaaccgggaggttgtgtattgaggttacttcctcgtccaagattgctttcatttcggaggaattgtgtattggatgcggtatttgtgttaagaaatgtccttttgaagctattcagattatcaacttgccgaaggacttggacagggatactactcatagatatggtcctaatacttttaagctgcataggttgccggttccgaggcccgggcaggtgcttgggttggttgggactaatgggattgggaagtccaccgctcttaaagttttggccgggaaactgaagccgaacttgggtcgattcactaatccccctgattggcaggaaattttgacctattttcgaggatctgaactgcagaattattttactcggattctagaggatgatttgaaggctatcatcaagcctcagtatgttgaccatattccaaaagctgtgcaagggaatgtggggcaggtgctagaccagaaagatgagagagagaagaaggaggagctttgtgctgatcttgagcttaatcaagttatagatcgtaatgttggtgatctttcgggtggtgagctccaaaggtttgccattgcggttgttgcgatccagaatgctgagatatacatgtttgatgaaccttctagttatcttgatgtgaaacagaggctgaaagctgcccaagttattcgatcattgcttaggcctaatagctatgtaattgttgttgagcatgatcttagtgtcttggactacttatcggactttatttgctgtctatatggtaaacctggtgcatatggagtggtgacacttcctttctcggtcagagaaggaattaacattttcttggctggctttgttccaacagaaaatcttaggttccgtgatgactcactcaccttcaaggttgctgagactccacaggaaactgctgaggaagctcagacatatgctcgatacaaatacccaaccatgagcaaaactcaaggcaattttagacttcgtgtagctgaaggagaatttactgattctcagattattgtgatgctgggtgagaatgggacaggaaagacgacatttattcgaatgctggctggtttattgaaacctgacaccatagaaggtggatctgaggtggagatgcctgaatttaatgtttcatacaagcctcagaagattagcccgaagttccaatcaactgttaggcacttgctacatcaaaaaatacgtgatgcatatactcatccccagtttgtgtcagatgtgatgaagccacttcttattgaacagttaatggaccaagaagttgtgaatctttctggtggagagttgcagagagttgctctgtgtctctgtcttggaaagcctgcagacatctatctgatagatgagccaagtgcgtatctagattctgaacagcgaattattgctgccaaagtcattaagaggtttattcttcatgcaaagaaaacggcttttgtcgttgagcatgatttcatcatggcaacatatcttgcagacagagttattgtttatgagggccaaccatcaattgactgtattgcaaatactccgcaatcattgttgtctgggatgaaccttttcttatcacatcttgatatcacatttagaagggacccaactaattttcgcccaaggatcaacaaacttgattcaaccaaggacagagaacaaaagtctgccgggtcttattattaccttgatgactgagttcatactttggggctgttctttcaccaacacaaccttgcatctgtttgagcttttcatgggatctcagatttggttcagttcatgccttgaaatataagattgccatttttgccgatgaaagcatctttctcaatgaatagaggagcctgcatgcaattgcaagccctatgttggttggtgcattttgtatatttacccttatatttagtgcagttactcatcaccaggtttgctacgacttgggtgggtgaatctgaatattacatgagtttatattggtcatggttttcattcgatgtcctaagtccagaggaacattcataatgtcagactgagtttatcgccaatttcagttgagtatgtaacgaagtttacgttcattccatgttacttaatttagatagatgtcttctgtttggaatatgttgtcgttgaggctgatatcttcgtggatatatatcattacattttttagat

SEQ ID NO: 4830 - DNA, 2277 bp, Arabidopsis thaliana
cattctgagcaaagcagtaactctcaggtgcgtgtgctctccgctggttccttagaacaatcggcacacgctttttcatttcaatcttcttcttctactcttaagtatctcaggtctgttgagagatggcagatcgattgacacgtattgctattgtgagttcagaccgttgcaagccaaagaaatgtcgccaagagtgcaagaagagttgtcctgtggtcaagacaggaaaactttgtattgaggtgactgttggttccaagcttgcttttatctcagaggagttgtgtatcggttgcggtatttgtgtgaagaaatgcccgtttgaagctattcagattatcaatcttccaagagacttggagaaagatacgacccatcgttatggggcaaacacttttaagttacacaggctcccagttccaagaccagggcaggtgctagggttggttggaaccaatggtattggaaaatcaactgctctgaaaattttggctggaaagctcaaaccaaatttgggccgtttcactagtcctccagactggcaagaaatcttgactcacttccgtggttcagaacttcaaaactacttcacacgtattctagaagataatcttaaggccattataaagcctcaatatgtcgaccacatcccaagagcagttaaaggcaatgttggagaggtccttgaccagaaggatgagagagataagaaggcagagctctgtgctgatctggagctgaaccaggtcattgaccgtgatgttgagaatttatctggtggtgagctgcagaggtttgcaatcgctgttgttgccatacaaaatgcagagatttacatgtttgatgaaccatctagttacctcgatgttaagcaaagactcaaagctgctcaagttgttcgttctctcctgaggcctaatagctacgtcattgttgtggagcatgatctcagtgttcttgattacttgtcggatttcatttgctgtctgtatgggaaaccaggagcctatggtgtggtgactctccccttctctgtcagagaaggaatcaacattttcttggctggatttgttcctacagaaaatttacgttttagagatgaatctttgaccttcaaggttgctgagactccacaagaaagtgctgaagagatacagtcgtacgctaggtacaaataccccacgatgaccaaaactcaaggaaacttcaggttgagagtgtcggaaggtgaattcactgactctcagattattgtaatgcttggggagaatggtacagggaagacaacatttattcggatgctggccgggttgttgaaaccagacgacacagaaggaccagacagagagataccagaattcaatgtttcgtataagccacaaaagatcagcccaaagtttcagaattcagttaggcacctgctacatcaaaagattcgagattcttacatgcatccacaatttatgtcggatgtgatgaaaccacttcagattgagcagttgatggatcaagaagttgtcaatctctcaggaggagaattgcaaagggttgcattaactctgtgcctcggaaagcctgcggatatatacctgatcgatgagccaagtgcatatctcgattctgagcaacgtattgttgcttctaaagtcataaagcgatttattctccacgcaaagaaaactgcatttgtagtcgagcatgactttataatggcgacctatttggcagaccgggtcattgtgtatgaaggacaaccatccattgattgtactgcaaattgtcctcaatcactgctcagtggaatgaatctcttcttatctcatctgaacatcacattcagacgggatcccaccaatttcagaccaagaatcaacaaattggagtcgaccaaagacagggaacagaagtctgcaggctcatactactacttggatgattaggacaactaccaagagaatatagggcattgttcgaattccagaagggtcttttgctcagaggaagttgatctatgagctcggaatattttacgcagccatctgttttccgagtgcataagcacagatgtttctttctggtcaagcttttaattgttgtttcatcagttttacttctacattttctctctcacagcttttattaactgagcaataaaagtttaagaatctgtaacctttttttctttttggctttgtacttcctgagttgatgatttcaacatttactgtgatgttactactttggattttacaatctattgcctatttttacatt

SEQ ID NO: 4831 - DNA, 2241 bp, Brassica oleracea
agacaaaaagtgaaactctctcaaagtgcgtgtgctctccgctggttcctttaaaaagtaatcggcacacgcttctccactccgatcttcctcgtctctcaatcaatctcagatcgttgagagatggcagatcgattgacacgtattgctatcgtgagctcagaccgttgcaagcctaagaaatgtcgccaagagtgtaagaagagctgtcctgtggtcaagacaggaaaactttgtattgaggtgactgttggttccaaggttgcttttatctcagaggagttgtgcattggttgcggtatttgtgtcaagaaatgcccatttgaagctattcagatcatcaatcttccccgagacttagagaaagatacgacccatcgttatgggccaaacactttcaagctgcacaggctccctgttccaaggccagggcaggtcttagggttggttgggactaatggtattggaaagtcaactgctctgaagattttggctggaaagctcaaaccaaacttgggccggttcactaatcctccagactggcaagagatcttgactcacttccgtgggtcagaacttcaaaactacttcacccgtattctggaagataatctaaaggccatcattaagccacaatatgttgaccacatcccgaaagctgttcgaggcaatgttggagaggtcctagaccagaaggacgagagaaacatgaaggcggagctgtgtgctgatctggagctgaaccaggtcattgatcgtgacgttgtgaatctatctggtggtgagctccagaggtttgctatcgctgttgttgccatacagaacgctgagatatacatgtttgatgagccgtctagttaccttgatgttaagcaaagactcaaagctgctcaagttgttcgttctctcctcaggcctaatagctacgtcattgtggtggagcatgatctcagtgttcttgactacttgtcggatttcatttgctgtctgtatgggaaaccaggagcctatggtgtggtgactctccctttctctgtcagagaaggaatcaacattttcttggctggctttgttcccactgagaatctacgttttagagatgaatctctgaccttcaaggtttctgagactccacaagaaagtgctgaggagatacagtcgtacgctaggtacaagtaccccaccatgaccaaaacacaaggaaacttcaggttgaaagtctccgaaggtgaattcaccgactctcagattattgtaatgcttggggagaatggtacagggaagacaacgttcatccggatgctggcgggtttgttgaaacctgacgagactgaaggatcagacatagagattccagagttcaatgtttcttacaagccgcagaagatcagtcccaagtttgagaactcagttaggcacttgctgcatcagaagattcgggattcttacatgcatcctcagtttgtgtcagacgtgatgaagccgctgcagattgagcagctgatggatcaacaagttgttaatctctcaggaggagagttgcaaagggttgcattagctctgtgcctcggaaagcctgctgatatctacctgattgatgagccaagtgcatatctcgattcagagcagcgtattgtggcttctaaagtcatcaagcggttcattctccatgcgaagaaaaccgcatttgtagttgagcatgactttataatggcgacctatctggcagaccgagtcatcgtctatgaaggacaaccatccattgattgtactgcaaattgtcctcagtcactgctcactgggatgaatctcttcttatcccatctgaacatcaccttcagacgggatcccaccaatttcagaccaagaatcaacaaactagagtcgactaaagacagggagcaaaagtctgctggctcatactactacttggatgattaagacaactaccatgagagcatatggcatgatgtggacaaaacattgtgcgagttacatctttgctgtgaggaagttgatctaagtgagctcgagtattttgcgcaaccatctgtttttcggagttctttaggagatgttactcttcaaagcttttgttcatcagttttgagcaaataataagagtttctgaatcttttttaacctttgtttcttttggcttttgtattttctgagttgataatttactgttgtggtgttggtatttggatttcataaggaatgaactgcttctgtttttgc

SEQ ID NO: 4832 - DNA, 2261 bp, Brassica napus
aaaagtgaaactctctcaagtgcgtgtgctctccgctggttccttaaaaagcaatcggcacacgcttcttcactccgatcttcctcatctctcaatcaatctcagatcgttgagagatggcagatcgattgacacgtattgctatcgtgagcgcagaccgttgcaagccaaagaaatgtcgccaagagtgtaagaagagctgtcctgtggtcaagacaggaaaactttgtattgaggtcactgttggttccaaggttgcttttatctcagaggagttgtgcatcggttgcggtatctgtgtgaagaaatgcccatttgaagctatccagatcatcaatcttccccgagacttggagaaagatacgacccatcgttatgggccaaacactttcaagctgcacaggctccctgttccaaggccagggcaggtcttagggttggttgggactaatggtattggaaagtcaactgctctgaagattttggctggaaagctcaaaccaaacttgggccggttcactaatcctccagactggcaagagatcttgactcacttccgtgggtcagaacttcaaaactacttcacccgtattctagaagataatctaaaggccatcattaagccacaatatgttgaccacatcccgaaagctgttcgaggcaatgttggagaggtgctagaccagaaggacgagagaaacatgaaggcggagctgtgtgctgatctggagctgaaccaggtcattgatcgtgacgttgtgaatctatctggtggtgagctccagaggtttgctatcgctgttgttgccatacaaaacgctgagatctacatgtttgatgagccttctagttaccttgatgttaagcaaagactcaaagctgctcaagttgttcgttccctcctcaggcctaatagctacgtcattgtggtggagcatgatctcagtgttcttgactacttgtcggatttcatttgctgtctgtatgggaaaccaggagcctatggtgtggtgactctccctttctctgtcagagaaggaatcaacattttcttggctggctttgttccaacagagaatttacgttttagagatgaatcacttaccttcaaggtttctgagactccacaagaaagtgctgaggagatacagtcgtacgctaggtacaagtaccccaccatgaccaaaacacaaggaaacttccggttgaaagtctccgaaggtgaattcaccgactctcagattattgtaatgcttggggagaatggtacagggaagacaacgttcatccggatgctggcgggtttgttgaaacctgacgagacggaaggatcagacatagagattccagagttcaatgtttcttacaagccgcagaagatcagtcccaagtttgagaactcagttagacacttgctgcatcagaagattcgggattcttacatgcaccctcagtttgtgtcggacgtgatgaagccgctgcagattgagcagctgatggatcaacaagttgtcaatctctcaggaggagagttgcaaagagttgcattagccctgtgcctcggaaagcctgctgatatctacctgattgatgagccaagtgcatatctcgattcagagcagcgcattgtggcttctaaagtcatcaagcggttcattctccatgcgaagaaaaccgcatttgtagttgagcatgactttataatggcgacctatctggcagaccgagtcatcgtctatgaaggacaaccatccattgattgtactgcaaattgtcctcagtcactgctcactgggatgaatctcttcttatcccatctgaacatcaccttcagaagggatcccaccaacttcagaccaaggatcaacaaattagagtcgactaaagacagggagcaaaagtctgctggctcatactactacttggatgattaagacaactaccatgagagcatatggcatgatgtggacaaaacattgtgcgagttacatgaaggtctttgctgtgaggaagttgatctaagtgagctcgagtattttgcgctaccatctgtttttcggagttctttaggagatgttactcttcaaagcttttgttcatcagttttgagcaaataataagagtttctgaatctttttaacctttgttctttggctttggtatttctgagttgataatttactgttgtggtgttggtatttggatttcataaggaatcaaccggttctgctcgccatctcacaacgccgtcacggaaaagt

SEQ ID NO: 4833 - DNA, 2242 bp, Brassica napus
aactctctcaaagtgcgtgtgctctccgctggttcctttaaaaagtaatcggcacacgcttctccactccgatctcaatcaatctcagatcgttgagagatggcagatcgattgacacgtattgctatcgtgagctcagaccgttgcaagcctaagaaatgtcgccaagagtgtaagaagagctgtcctgtggtcaagacaggaaaactttgtattgaggtgactgttggttccaaggttgcttttatctcagaggagttgtgcattggttgcggtatttgtgtcaagaaatgcccatttgaagctattcagattatcaatctcccccgagacttagagaaagatacgacccatcgctatgggccaaacactttcaagctgcacaggctccctgttccaaggccagggcaggtcttaggattggttgggactaatggtattggaaagtcaactgctctgaagattttggctggaaagctcaaaccaaacttgggccggttcactaatcctccagactggcaagagatattgactcacttccgtgggtcagaacttcaaaactacttcacccgtattcttgaagataatctaaaggccattattaagccacaatatgttgaccacatcccgaaagcagttcgaggcaatgttggagaggtcctagaccagaaggacgagagaaacatgaaggcggagctgtgtgctgatctggagctgaaccaggtcattgatcgtgatgttgtgaatttatctggtggtgagctccagaggtttgctatcgctgttgttgccatacagaacgctgagatatacatgtttgatgagccgtctagttaccttgatgttaagcaaagactcaaagctgctcaagttgttcgttctctcctcaggcctaatagctacgtgattgtggtggagcatgatctcagtgttcttgactacttgtcggatttcatttgctgtctgtatgggaaaccaggagcctacggtgtggtgactctccctttctctgtcagagaaggaatcaacattttcttggctggctttgttcccactgagaatctacgttttagagatgaatctctgaccttcaaggtttctgagactccacaagaaagtgctgaggagatacagtcgtacgctaggtacaagtaccccaccatgaccaaaacacaaggaaacttcaggttgaaagtctccgaaggtgaattcaccgactctcagattattgtaatgcttggggagaatggtacaggaaagacaacgttcatccggatgctggcgggtttgttgaaacctgacgagactgaaggatcagacatagagattccagagttcaatgtttcttacaagccgcagaagatcagtcccaagtttgagaactcagttaggcacttgctgcatcagaagattcgggattcttacatgcatcctcagtttgtgtcagacgtgatgaagccgctgcagattgagcagctgatggatcaacaagttgttaatctctcaggaggagagttgcaaagggttgcattagctctgtgcctcggaaagcctgcggatatatacctgattgatgagccaagtgcatatctcgattcagagcagcgtattgtggcttctaaagtcatcaagcggttcattctccatgcgaagaaaaccgcatttgtagttgagcatgactttataatggcgacctatctggcagaccgagtcatcgtctatgaaggacaaccatccattgattgtactgcaaattgtcctcagtcactgctcactgggatgaatctcttcttatcccatctgaacatcaccttcagacgggatcccaccaatttcagaccaagaatcaacaaactagagtcgactaaagacagggagcaaaagtctgctggctcatactactacttggatgattaagacaactaccagagaacatatggcatgatgtggacaaaacattgtgtgagttacatgaaggtctttttgctgtgaggaagttgatctaaatgagctcgagtattttgcgcaaccatctgtttttccgagttccttgggagatgttactcttcaaagcttttgttcatcagttttgagcaaataataagagtttctgaatcttttttaacctttgtctcttttggcttttgtattttctgagttgataatttactgttgtggtgttggtatttggatttcattcggaaaaaaaaaaaaaaaactcgaggggggcccgtacccatcg

SEQ ID NO: 4834 - DNA, 2074 bp, Chrysanthemum coronarium
caatggctgatcgattaactcgtatcgctatattgagagaagaccgctgcaaacccaaaaagtgccgtcaagagtgcaagaaatcatgccctgttgtcaaaactggtaagctatgtatcgaggtcagttctgcatcaaaggtggctactatttccgaggagctttgcatagggtgtggtatatgcgttaagaaatgcccgtttgaagctattgatatcattaatttaccaaaagatttggaaaaagatacaactcaccgttacggggtcaacaccttcaagttgcacaggttgcctgtcccgaggcctgggcaagttcttggcttagttggaactaatggaattgggaagtcgacagctctcaaagttttggctggaaagttgaaacccaacttgggtcgcttcaataaccctcctgactggcaagaaattttgacctacttccgaggatctgagttgcaaaactacttcacacgtattctggaagataatctgaaggccatcataaaaccgcaatatgttgaccatattccgaaagcagttcaaggaaatgtcgggcaagttcttgatcaaaaggacgaaagaggtgcaaaggcggagctttgtgctgatcttgagctgaatcaggttatagatcgtaacgttggagacttatctggtggagagcttcagaggtttgcgattgctgttgttgcgatacaaatggcagaaatatatatgtttgacgaaccttcaagttatcttgatgtgaagcaaaggcttaaagctgcccaagttattcgatccctgcttagacctaacagctatgtgattgttgttgaacacgatttgagtgttcttgattacctatcagacttcatttgctgcctgtatgggaaacctggtgcatatggtgttgtgactctacccttctctgtcagagaaggaataaatatctttttagacggttttgttcccactgaaaaccttcgttttcgagaagtcgcacttacttttagggtttctgagacaacacaggagagtgctgaggaaattgaaacatatgcacaatataggtatccaactatgactaaaacacagggtggtttcaaactgaaggtggttgccggtgaattcacagactcacagattgttgtaatgcttggtgaaaatggaaccgggaagacgacatttatacgaatgctggcaggtttgctaaagcctgatacagtggaaggcactgatgtggagatacccgagtttaacgtctcttacaagccccaaaagatcagccccaagttccctcattcagttaggcatctgctacattcaaagattcgtgattcgtatatgcatccccagtttgtttcggatgtcatgaagcctcttcaaatcgagcagctaatggatcaagaggttgtgaatctttctggtggtgaattgcaaagagttgctttgtgcctatgccttggaaagcctgctgatatctacctgatagatgaaccaagcgcgtacctcgattctgagcagcgtattgttgcttcaaaggttataaagagattcatactacacgcgaaaaagactgcatttgtggttgaacatgacttcataatggccacttatctagcagatagggtaattgtttatgaagggcagccgtctgttgattgtgttgctaatagtcctcagtcgttattgaccggaatgaatctctttctatctcatttgaccatcacgtttagaagggatcctggtaattatcgcccaagaatcaacaagcttaattcaacaaaggatagggagcagaaacttgctggatcttattattatctggatgactaattttgtcaattcgagttgtatgctatacccttttggctgttgcagcgtccgtcctaaagtagcaaatgtataagccagcaaaacctgcaatgtgtggcggctagtttatcctcggtgagtgttgttgcaccgttaatcttgtttgaaagagttttagatagcatggagttatgtgttgcaaaaccttgtacttgagagtgtccgtttttatttgttggtacctccttttattttatatatgtaactttcggctg

SEQ ID NO: 4835 - DNA, 2284 bp, Distylium racemosum
gaggattcgatctgtggtgaggttagttgagaatggatcggttgacaaggattgcgattgtgagttcagaccgctgtaagcctaagaagtgcaggcaagagtgtaaaaagagctgtcctgttgtcaaaacaggaaagctctgcatagaagtgtcatctgcctctaaaattgcattcatatcagaggagttgtgcattgggtgtggtatctgcgttaagaaatgtccatttgaagctatccagatcattaacctcccaaaagatttagataaagacacaacacaccgatatgggccaaacacgtttaagcttcacaggttgcctgtcccaagaccaggacaggtgttgggacttgttgggaccaatggtatagggaagtctactgcacttaaagtccttgctggaaaacttaagcccaatcttggaaggttcaataatcctcctgattggcaggaaattcttacatatttccggggatccgaattacagaactatttcactcgcattttggaagataatctgaaggcaataatcaagcctcagtatgttgaccacataccaaaggctgtccaaggaaatgtgggccaggtgctgtctcagaaggacgaaagagatgtgaaggctgagctttgcactgatctggacttgaatcaggttattgatcggaatgttggcgatttgtcgggaggggaattacaacggtttgcgattgcagtggttgcaattcagaatgctgaaatatatatgtttgatgaaccctccagttatcttgatgtaaagcaacgacttaaagctgcacaagtagtccggtccctgctcaggcccaacagctatgttattgttgttgagcatgaccttagcgtccttgattacttgtccgatttcatttgctgtctatatggaaagcctggggcttatggggtggtaacactgccattttcggtcagagaagggattaacatatttttggctggttttattcccactgaaaatcttcgatttcgtgatgaatcactgacattcaaggttgcagaaacgccacaggaaagtgctgaagaaattaaaagttatgcaaggtacagatacccaagcatgtcaaaaactcagggtggttttaaacttcatgtaaaggagggtgaatttacagattcgcagattgttgtaatgttgggagaaaatggaacagggaagactactttcatacgcatgctggctggtttgttgaaaccagatacggctgaaaattcagaagtggatatacctgaatttaatgtgtcatacaagccacagaagatcagcccaaagtttcagtcaactgtgaggcatttattgcaccaaaagattcgtgattcatacacacaccctcagttcaacactgacgtgatgaagccccttcaaattgagcaattgatggatcaagaagtcataaatctttctggtggagaattacagagagtagcactgtgcttgtgtcttggcaagcctgcagatatttaccttattgatgagccaagtgcatacttggattccgagcagcgtattgttgcatcaaaagttataaagagatttattcttcatgctaaaaagactgcttttgttgttgagcatgactttatcatggcaacttatttggcagacagggttatagtatacgagggacaatcatctgtagagtgtactgcaaatcctccacagagtctacagacaggaatgaacctgtttttatcgcatctggatattacattcagacgagatccaacgaactacaggcctcgtattaataaattagattcaactaaggacagggaacagaagaatgcaggatcatattactatttggatgattaaagaagtcgtcctctcagttccaagcatagaaatttcaaggttatcaacggtagcaatttacaacacacaatctcagcatttctccatgagctctttatttaggaagttaaatcaatgagcctatattattggatttttctcaagttgtcttgaaatggatattttagatttgatgctataattgccagacttgcaattcagatgggattaatcataaagagggattggtttcaatttcttctgtttgttccggcttgactcaaggagagtgccattatgaagcatttgcagtgaattggttctgtgaggtccactagtaaattttattcccgttagaattgtaacctcaattttcctctttgcaatttaggtggagtatttattacaagtaacaattgaatcagtgcaaggcggacgtgattaatttcatattttaa

SEQ ID NO: 4836 - DNA, 2252 bp, Eschscholzia californica
ggtgagagaacaaaaaaagttctatctgtttctctcttgagattctgaagaaatcatgtcatctgatcggctaactaggattgccatagtcagctccgatcgatgcaagccaaagaagtgccgacaagaatgcaagaagagttgtccggtcgtcaaaactggtaaactctgtattgaagtttcttctctatctaagattgcattcatctctgaggagttatgtatcggatgtggtatttgtgtcaagaaatgcccattcgaagccattcagattatcaacttgccaaaagacttggataaagatacaacccatcgttatggtccaaacactttcaagttgcacaggttagcggttccaagacctgggcaagttctgggattagtcggaacaaatggtattggcaagtcaactgctctcaaaatcttggctgggaagctgaagcctaatttggggcgtttcaataatcctcctgattggcaggaaatattgacatacttcagagggtctgagcttcaaaactattttactcgtatcttggaagataatctgaaggcaatcattaagccccagtatgttgatcacatcccaaaagcagttcaagggaatgttgggcaagtgcttgaccagaaagatgaaagaggtgtgaaagcggagctttgtcatgatcttgagctgaaccaagttatagatcggaatgtaggtgacttatctggtggagagcttcagagatttgctattgctgtagttgctatacagaatgcagacatatttatgtttgatgagccatctagttatttggatgtaagacagaggcttaaagctgctcaagttatccgatctctgctcaggccaaacagctacgtaattgttgtggagcacgaccttagtgtcttggattatctatcagacttcatttgctgcttatatggaaaacctggagcttatggagttgtaaccctccccttttctgtaagagaaggaataaatatcttcttggctggttttgtccctacagagaatctgcggtttagggaagaatcacttacttttaaggttgcagagactccacaagaaagtgcagaagagcttcaatcatatgcacgatacaaatacccaaccatgagtaagacacagggaaattttaagcttcgcgtcactgagggtgaattcactgattctcagattattgtaatgctcggtgagaatgggacagggaaaaccacattcatccgcatgctggctggtcttttgaagcctgatgaagtggagagttctgatgctgaaatacccgagttcaatgtttcttacaagccccagaagatcagtccaaaatttcaagcttctgttaggcacttgcttcatcaaaaaattcgtgattcatatcagcatcctcagtttatatcagatgtcatgaaaccactccaaattgagcaattaatggaccaggaagttgtgaatctctccggtggagagctgcaaagagttgcactagctctttgccttgggaagcctgcagatatatatttgatagatgagccaagtgcttaccttgactcagagcagcgtattgttgcttcaaaagtcataaagaggtttattctccatgccaagaaaaccgcttttgttgtcgagcatgatttcataatggcaacttacctagcagacagagttattgtctacgacgggcaaccatctattgactgtactgccaatgcacctcaatctctgttgactgggatgaaccttttcctatctcatttggacataacatttaggcgggacccaaccaattatcgacctcgtatcaacaaattggaatccacaaaagacagggagcaaaaatccgctgggtcctactactatctggacgactaaacataattttgtaataacgtgtccgagtaagctaccatctaaagacagggaaatggatcttttgagacatcagttttttaactagatgaaaacttgataacagtattgacttgaggatttgttcttgacaaggtgagttatttgtgtttgacatgatttggtggatttttaagttatatctggaatgagatgaattcaaaaaatgtagttaagtagtagattcttcttgttttgattacaaagcagtttccgaaaaatagacttgtgtttttcttatggaattttactttatgactcttctagtggttacttctatctcattctggattgtgtatgttttgaatcttaatgattctaagttttagatcagttggtt

SEQ ID NO: 4837 - DNA, 2489 bp, Glycine max
tgcacggtgaagcaagtaaccctaatgctatgctatatgattttctgaacgttctcacgacacgcctactcattgcactcttcgatcgcaactctctttttcttccaaaagggaaaacgaatctcaaacttcacaagtgtttgaggcgccatggcggatcggttgacgcgtattgccatcgtcagcaacgacaggtgcaagcccaaaaagtgccgccaggagtgcaagaagagttgccccgtcgtcagaaccgggaggttgtgtattgaggttacttcctcgtccaagattgctttcatttcggaggaattgtgtattggatgcggtatttgtgttaagaaatgtccttttgaagctattcagattatcaacttgccgaaggacttggacagggatactactcatagatatggtcctaatacttttaagctgcataggttgccggttccgaggcccgggcaggtgcttgggttggttgggactaatgggattgggaagtccaccgctcttaaagttttggccgggaaactgaagccgaacttgggtcgattcactaatccccctgattggcaggaaattttgacctattttcgaggatctgaactgcagaattattttactcggattctagaggatgatttgaaggctatcatcaagcctcagtatgttgaccatattccaaaagctgtgcaagggaatgtggggcaggtgctagaccagaaagatgagagagagaagaaggaggagctttgtgctgatcttgagcttaatcaagttatagatcgtaatgttggtgatctttcgggtggtgagctccaaaggtttgccattgcggttgttgcgatccagaatgctgagatatacatgtttgatgaaccttctagttatcttgatgtgaaacagaggctgaaagctgcccaagttattcgatcattgcttaggcctaatagctatgtaattgttgttgagcatgatcttagtgtcttggactacttatcggactttatttgctgtctatatggtaaacctggtgcatatggagtggtgacacttcctttctcggtcagagaaggaattaacattttcttggctggctttgttccaacagaaaatcttaggttccgtgatgactcactcaccttcaaggttgctgagactccacaggaaactgctgaggaagctcagacatatgctcgatacaaatacccaaccatgagcaaaactcaaggcaattttagacttcgtgtagctgaaggagaatttactgattctcagattattgtgatgctgggtgagaatgggacaggaaagacgacatttattcgaatgctggctggtttattgaaacctgacaccatagaaggtggatctgaggtggagatgcctgaatttaatgtttcatacaagcctcagaagattagcccgaagttccaatcaactgttaggcacttgctacatcaaaaaatacgtgatgcatatactcatccccagtttgtgtcagatgtgatgaagccacttcttattgaacagttaatggaccaagaagttgtgaatctttctggtggagagttgcagagagttgctctgtgtctctgtcttggaaagcctgcagacatctatctgatagatgagccaagtgcgtatctagattctgaacagcgaattattgctgccaaagtcattaagaggtttattcttcatgcaaagaaaacggcttttgtcgttgagcatgatttcatcatggcaacatatcttgcagacagagttattgtttatgagggccaaccatcaattgactgtattgcaaatactccgcaatcattgttgtctgggatgaaccttttcttatcacatcttgatatcacatttagaagggacccaactaattttcgcccaaggatcaacaaacttgattcaaccaaggacagagaacaaaagtctgccgggtcttattattaccttgatgactgagttcatactttggggctgttctttcaccaacacaaccttgcatctgtttgagcttttcatgggatctcagatttggttcagttcatgccttgaaatataagattgccatttttgccgatgaaagcatctttctcaatgaatagaggagcctgcatgcaattgcaagccctatgttggttggtgcattttgtatatttacccttatatttagtgcagttactcatcaccaggtttgctacgacttgggtgggtgaatctgaatattacatgagtttatattggtcatggttttcattcgatgtcctaagtccagaggaacattcataatgtcagactgagtttatcgccaatttcagttgagtatgtaacgaagtttacgttcattccatgttacttaatttagatagatgtcttctgtttggaatatgttgtcgttgaggctgatatcttcgtggatatatatcattacattttttagatgaaattgcggctattatgtgattttatttgaagggtgg

SEQ ID NO: 4838 - DNA, 2329 bp, Eutrema halophilum
aattttgtcatttgcgcaaagcgtaactctccggtgcgtgtgctctcagctggttcctttaagaatcggcacacgcttcttcatttccgatcgtcctcgaagctcaatctgaatctctcagttatctcagatcttccgagagatggcagatcgattgacacgtatcgctattgtgagtcaagaccgttgcaagccaaagaaatgtcgccaagagtgtaagaagagttgtcctgtggttaagacaggaaaactttgtattgaggtgactgttggttccaagattgcttttatctcagaggagttgtgcatcggttgcggtatttgtgtgaagaaatgcccgtttgaagctatccagattattaatcttcccagagacttagagaaagatacaacccatcgctatgggccaaacactttcaagttgcacaggctcccagttccaaggccagggcaagtcctagggttggttgggacaaatggtattggaaaatcaaccgctctgaaaattttggcgggaaagctcaaaccaaatttgggccgtttcactaatcctccagactggcaagaaatcttgactcactttcgtgggtcagaacttcaaaactactttacccgtattctagaagataatttaaaggccattataaagcctcaatatgtcgaccacatcccaaaagctgttcgaggcaatgttggagaggtccttgaccaaaaggatgagagaaataaaaaagcagagctctgtgctgatctggagctgaaccaggtcattgatcgtgatgtcatgaatttatctggtggtgagttgcagaggttcgcaatcgctgttgttgccatacaaaatgcagagatatacatgtttgatgagccatctagttaccttgatgttaagcaaagactcaaagctgctcaagttgttcgttctctcctgaggcctaatagctacgtcattgttgtggagcatgatctcagtgttcttgattacttgtcggatttcatttgctgtctctatgggaaaccaggagcctatggtgtcgtgactcttcccttctctgtcagagaaggaatcaacattttcttggctggatttgttcccacagaaaatttacgttttagagatgaatctctgaccttcaaggttgctgagactccacaagaaagtgctgaagaaatacagtcgtacgctagatacaaatacccatccatgaccaaaactcaaggaaactttaggttgagagtgtcggaaggtgaattcacagactcgcagattattgtcatgcttggggagaatggtacagggaagacaacatttatccggatgctggcgggtttgttgaaacctgatgatacagaaggatcagacatagagataccagaattcaatgtttcttacaagccacaaaagatcagcccaaagtttcagcattcagttagacagttgctacatcaaaagattcgggattcgtacatgcatcctcagtttgtgtcggacgtgatgaaaccacttcagattgagcagttgatggatcaagaagttgtcaatctctcgggaggagagttgcaaagggttgcattaactctgtgcctcggaaagcccgcggatatatacctgattgatgagccaagtgcatatctcgattcagagcagcgtattgtggcttctaaagtcattaagcggttcattctgcatgcaaagaaaaccgcatttgtagtcgagcatgactttataatggctacctatttggcagatcgagtcattgtctacgaaggacaaccatccattgattgtactgcgaattgtcctcaatcactgctcagtggaatgaatctctttttatctcatctgaacatcaccttcagacgggatcccaccaatttcagaccaaggatcaacaaattagagtcgactaaagacagggagcagaagtctgctggctcatactactacttggatgattaagacaactaccgagagaatatagggcatgatctggataaaaaaatgtctgagttccaccagaaaggtctttttctctgaggaatttgatctacgagctcgggatattttgcgcaaccatctgttttccgagtttcttatgagatgtttctttctctctggtcaagcttctgattgtttgttcatcagttttgctcttccagccttttgctatatactgtgcaaaggttttttattaactgagcaataatatcttctgaatctttaacctttttgttttggtttttgtacttttgagttgtttatttcaacattgactgtaatgttattacttggttttaaaaggaatgtactgcctattattattattta

SEQ ID NO: 4839 - DNA, 2320 bp, Brassica rapa
ccctaacataatagcttttcgtgtcacttggacaaggcataactccaaggcgcgtgtgctctctctctccgctggttcctttaaaaaatcgacacacgcttcttcacctccatcatcctcgaagctcagctcaatctgaatctctcgattatctcagatctttgagagatggcagatcgattgacacgtattgctatcgtgagttcagaccgttgcaagccaaagaaatgtcgccaagagtgtaagaagagctgtcctgtggtcaagacaggaaaactttgtattgaggtgactgttggttccaagcttgctttcatctcagaggagttgtgcattggttgcggtatttgcgtgaagaaatgtccatttgaagctattcagattatcaatcttcccagagacttagagaaagacacgacccatcgttatggtgtaaacacattcaagttgcacaggcttccagttccaaggccagggcaggtcctagggttggttgggacaaatggtattggccaatcaaccgctttgaaaattttggcaggaaagctcaaaccaaacttgggccgtttcactaatcctccagactggcaagaaatcttgactcacttccgtggttctgaacttcaaaactacttcacccgtattcttgaagataatctaaaggccattataaagcctcaatatgtcgaccacatcccaaaagctgtgcgaggcaacgttggagaggtccttgaccagaaggacgagagagataagaaggcggagctctgtgctgatctggagctgaaccaggtcattgatcgtgacgttgagaatttatctggtggagagctgcagaggtttgctatcgctgttgttgccatacaaaacgctgagatatacatgtttgatgagccgtctagttaccttgatgttaagcaaagactcaaagctgctcaagtcgtccgttccctccttaggcctaatagctatgtcattgtggtggagcatgatctcagtgttcttgactacttgtcggatttcatttgctgtctgtatgggaaaccaggagcctacggtgttgtgactctccccttctctgtcagagaaggaatcaacattttcttggctggattcgttcccacagagaatctacgttttagagaagagtcgctgaccttcaaggttgctgagactccacaagaaagtgctgaagaaatacagtcgtacgctaggtacaagtacccaaccatgaccaaaactcaaggaaacttcaggttgaaagtgacggaatgtgaattcaccgactctcagattattgttatgcttggggagaatggtactgggaagacgacatttatccggatgctggcgggtttgttaaaaccagacgagacagaagaatcagacatagagataccagaattcaatgtttcttacaagccacaaaagatcagccccaagtttcagaattctgttaggcacttgctacatcaaaagattcgggattcttacatgcatcctcagtttgtgtcggacgtgatgaagccgcttcagattgagcagttgatggatcaggaagttgtcaatctctctggaggagagctgcaaagggttgcattagctctgtgcctcggaaagcctgcggatatatacctgattgatgagccaagtgcatacctcgattcagagcaacgtattgtggcttctaaagccattaagcggttcattctccatgcaaagaaaactgcatttatagtcgagcatgactttataatggctacctatttagccgaccgggtcattgtctatgaaggacagccatccattgattgtgttgcaaattgtcctcagtcactactcagtggaatgaatctcttcctctctcatctgaacatcaccttcagacgggatcccacaaatttcagaccaagaatcaacaaactagagtcgactaaagacagggagcaaaagtctgctggctcatactactacttggacgattaagacaactaccgtgagaactagggcatgatctggatatagaaacattgtctgaatcccatgaaggtctttcgctctgaggaaattgatctatgagctcgcaaccatctttttccgaggtcctaaggagatgtttctcttctcaagcttttgattgtcagttcagttttgctactcagattttgctgtatacttggcaaggttttttattacatgagcaataaaactctttgatctttttaactatatgtactttctttactgttgtaatgttattatttagattttacaaggaatctactgcctattactattttatctacttctcacaaagcct

SEQ ID NO: 4840 - DNA, 2250 bp, Chrysanthemum coronarium
ggagctttgcatagggtgtggtatatgcgcaggggttttcattcattaataattagggtatcagaaaaagcatctgaaaccctaaaaagaaaagtaatcatcatcaatggctgatcgattaacgcgtatcgctatattgagagaagaccgctgcaaacccaaaaagtgccgtcaggagtgcaagaaatcatgccctgttgtcaaaactggtaagctatgtatcgaggtcagttctgcatcaaaggtggctactatttccgaggagctttgcatagggtgtggtatatgcgttaagaaatgcccgtttgaagctattgatatcattaatttaccaaaagatttggaaaaagatacaactcaccgttacggggtcaacaccttcaagttgcacaggttgcctgtcccgaggcctgggcaagttcttggcttagttggaactaatggaattgggaagtcgacagctctcaaagttttggctggaaagttgaaacccaatttgggtcgcttcaataaccctcctgactggcaagaaattttgacctacttccgaggatctgagttgcaaaactacttcacacgtattctggaagataatctgaaggccatcataaaaccgcaatatgttgaccatattccgaaagcagttcaaggaaatgtcgggcaagttcttgatcaaaaggacgaaagaggtgcaaaggcggagctttgtgctgatcttgagctgaatcaggttatagatcgtaatgttggggacttatctggtggagagcttcagaggtttgcgattgctgttgttgcgatacagatggcagagatatatatgtttgatgagccttcaagttatcttgatgtgaagcaaaggcttaaagctgcccaagttatccgatccttacttagacctaacagctttgtgattgttgttgagcacgatttaagtgtgcttgattacctatcagacttcatttgctgcctgtatgggaaacctggtgcatatggtgttgtgactctacccttctctgtcagagaaggaataaatatctttttagacggttttgttcccactgaaaaccttcgttttcgagaagtcgcacttacttttagggtttctgagacaacacaggagagtgctgaggaaattgaaacatatgcacaatataggtatccaactatgactaaaacacagggtggtttcaaactgaaggtggttgccggtgaattcacagactcacagattgttgtaatgcttggtgaaaatggaaccgggaagacgacatttatacgaatgctggcaggtttgctaaagcctgatacagtggaaggcactgatgtggagatacccgagtttaacgtctcttacaagccccaaaagatcagccccaagttccctcattcagttaggcatctgctacattcaaagattcgtgattcgtatatgcatccccagtttgtttcggatgtcatgaagcctcttcaaatcgagcagctaatggatcaagaggttgtgaatctttctggtggtgaattgcaaagagttgctttgtgcctatgccttggaaagcctgctgatatctacctgatagatgaaccaagcgcgtacctcgattctgagcagcgtattgttgcttcaaaggttataaagagattcatactacacgcgaaaaagactgcatttgtggttgaacatgacttcataatggccacttatctagcagatagggtaattgtttatgaagggcagccgtctgttgattgtgttgctaatagtcctcagtcgttattgaccggaatgaatctctttctatctcatttgaccatcacgtttagaagggatcctggtaattatcgcccaagaatcaacaagcttaattcaacaaaggatagggagcagaaacttgctggatcttattattatctggatgactaattttgtcaattcgagttgtatgctatacccttttggctgttgcagcgtccgtcctaaagtagcaaatgtataagccagcaaaacctgcaatgtgtggtggctagtttatcctcagtgagtgttgttgcaccgttaatcttgtttgaaagagttttagatagcatggagttatgtgttgcaaaacttgtactcgagagtgtcagtttttattcgttggtacctccttttattttatatatgtaactttcggctgatcacttttttcagttactgatatacgaggtcatggttatttttggtgattttgaggaataatgttaatgtgc

SEQ ID NO: 4841 - DNA, 2344 bp, Fragaria vesca
aaaaataagagatgtcggaccggttaacgcgtatagctattgtcagctctgacagatgcaagcccaagaagtgccgccaggaatgcaagaagagttgtcctgtcgtcaagactgggaaactatgtattgaggttactactgcatccaaaatcgcttttatctcagaagagttgtgcatcgggtgtggtatttgtgttaagaaatgcccgtttgaggcaattcagattattaacttgccaaaggacttggacaaagataccacccatcgttatgggcctaacactttcaagttacacaggttaccagtcccaaggccaggtcaagttcttggtttggttggaactaatggaattgggaagtcaactgccctcaaagttttggctggaaagctgaaaccaaatttaggccgtttcaataatccaccagattggcaggaaatcttgacctactttcggggatctgagttgcagaattattttacccgtattttggaagacaatttgaaggccattataaagccccaatatgtggatcacattccaaaggccgttcatggaaatgtaggggaggtgctcaaccagaaaaatgagaggggtgtgaaggaagtactgtgtcatgaccttgagctgaaccaggttattgatcgtaatgtaggggatttatcaggtggggaacttcaaaggtttgccattgctgttgtttgcatacagaatgcagagatttatatgtttgatgagccttcaagttatcttgatgtgaaacaaaggctcaaagctgcccaagttattcgttcgttgctcaggcctaatagctatgtaattgttgtggagcacgatttgagtgtcctggattacttatcggacttcatttgctgtttatatgggaaaccgggtgcatatggtgttgtaacccttcctttctcagttagagaaggaatcaacatcttcttggctggatttgttcctactgaaaacctgaggtttcgagatgaatcactgacctttaaggtggctgagactccacaggaaactgctgaggaaattgagacatatgcacgatataaatacccaacaatgagtaaaacacagggaaacttcaggcttcgtgtgatggagggtgaatttactgattcacagattattgtcatgcttggtgagaatggaacagggaagaccacattcatccgtatgctggctggtctactgaaacctgatgaatcagattcagaagtggaaatacctgaatttaatgtctcgtacaagccgcagaagatcagtccaaagtttcaaaacactgtcagacacttgttacattcaaagatacgtgattcatatactcatccccaattcatgtcagatgtgatgaagcctcttcttattgagcaactaatggatcaagaagttgtaaatctctccggtggagagttgcaaagggttgcattatgtttgtgccttggaaagccagctgacatttacctaatcgatgagccaagtgcatatttggattctgagcagcgtattgttgcttcaaaagtcataaagaggtttatcctgcatgccaagaaaactgcatttgtggttgaacacgactttatcatggctacgtacttggcagatagagttattgtctatgaagggaagccgtcgattgattgtactgcaaattgtccgcagtcattgttgactgggatgaatctcttcttatctcatttggatatcacatttagacgagacccaacaaattttcgtccaagaatcaacaaaatgaactcaacgaaggacagagaacaaaagaatgctgggtcctactattacttggatgattgatataatcaataggtttagcgaatttcagagggcatctatacggactctaaacttctaaaggggatctcggctgaggctcaggcccccaacatgttgacagatgattagtgctttttctgctgaagaggtgatatttgctttcctacatggatcagtttaggccgttccatgttgctacttcagttatgccctgtagtgtgcttgcagttatccaattttggctattgtcatgaggcaagaatctgaatgtacaatgagttctcttaacatcaactctatttgactactatgttatctgcgggaatggagtttttctcctagaatgaagtcttttatatatcctttcaagttatgtgttttctgggtttatgcatcggttctgcctttatatgttaaatatacacatttctcttcaactgcattttttttctggtggattttcaagctaaatcaagaacgttttggttcatttccggattgtacaacagccctgacgctagaacttgatattttgaact

SEQ ID NO: 4842 - DNA, 2113 bp, Chrysanthemum coronarium
atcagaaaaagcatctgaaaccctaaaaagtaagaacttatcatcatcaatggctgatcgattaacgcgtatcgctatattgagagaagaccgctgcaaacccaaaaagtgccgtcaagagtgcaagaaatcatgccctgttgtcaaaactggtaagctatgtatcgaggtctcatccgcctccaaggtggcagtaatctccgaggagctttgcataggttgtggtatatgtgtgaagaaatgcccgttcgatgcaattgatatcattaatttaccaaaagatttggagaaagatacaactcaccgttatggagtcaacacattcaaattacacaggttgcctgtcccgaggcctgggcaagttcttggtttagtcggaacaaatggaattggcaagtctacagctcttaaagtcttggctggaaaattgaaacccaatttgggacgctttaacaaccctccagattggcaagaaatcctgacctacttccgagggtctgagttgcaaaactacttcacacgtattctagaagataatctaaaggctatcattaaacctcaatatgttgaccacattccaaaagcagttcaagggaatgttggacaagtacttgaacaaaagaatgagagagatgtgaaggccgagctgtgtgctgaacttgagctgaatcaggttatagatcgtaacgttggagacttatctggtggagagcttcagaggtttgcgattgctgttgttgcgatacagatggcagagatatatatgtttgatgagccttcaagttatcttgatgtgaagcaaaggcttaaagctgcccaagttatccgatccttacttagacctaacagctttgtgattgttgttgagcacgatttaagtgtgcttgattacctatcagacttcatttgctgcctgtatgggaaacctggtgcatatggtgttgtgactctacccttctctgtcagagaaggaataaatatctttttagacggttttgttcccactgaaaaccttcgttttcgagaagtcgcacttacttttagggtttctgagacaacacaggagagtgctgaggaaattgaaacatatgcacaatataggtatccaactatgactaaaacacagggtggtttcaaactgaaggtggtgccggtgaatcacggactcacagattgttgtaatgcttggtgaaaattggaaccgggaagacgacatttatacgaatgctggcaggtttgctaaagcctgatacagtggaaggcactgatgtggagatacctgagtttaacgtctcttacaagccccaaaagatcagtcccaagtttcctcattcagttaggcatctgctacattcaaaaattcgtgattcgtatatgcatccccagtttgtttcggatgtcatgaagcctcttcaaatcgagcagctaatggatcaagaggtcgtgaatctttctggtggtgaattgcaaagagttgctttgtgcctatgccttggaaagcctgctgatatctacctgatagatgaaccaagtgcgtacctcgattctgagcagcgtattgttgcttcaaaggttataaagagattcatactacacgccaaaaagactgcatttgtggttgaacatgacttcatcatggccacttatctagcagatagggtaattgtttatgaagggcagccgtctgttgattgtgttgctaatagtcctcagtcgttattgaccggaatgaatctctttttatctcatttgaccatcacatttagaagggatcccggtaattatcgcccgagaattaacaagctaaattcaacaaaggacagggagcagaaacttgctggatcttattattatctggacgactaattttgtcacttcaagttgtaagctatacccatttggctgttgcagcgccctaaaatagcaaatgtataagccagcaaaacctgcaatgataggcggctagtttatcctcggtgagtgttgcaccgttaatcttgtttgaatgagttttagatagcatggagttatgtgttgcaaaaccttgtacttgagagtgtgggtttttatttgttggtacctccttttattttatatatgtaacttttggctc

SEQ ID NO: 4843 - DNA, 2698 bp, Cicer arietinum
ctatattcctttccgcttgaacgttccaaccacacgcctctcacattctctctctctctctgaaccgatttccatctccgtaatcagagagtttgaggcaacatgtcagatcgattgacgcgtatcgccatcgtcagcaacgacagatgcaaaccaaaaaagtgccgtcaagagtgtaagaagagttgccctgtcgtcagaactggaagattgtgtattgaggttacttctgcatcgaagattgcttacatatctgaggaattatgcattggatgcggtatttgtgttaagaaatgtccttttgaagctattcagattatcaacttgccaaaggatttggacaaagacactactcatagatatggtcctaatacttttaagctacacaggttgccggttccgaggccggggcaagtgcttggtttggttgggacaaatggaattgggaagtccactgcccttaaagttttggctggaaaattgaagccaaacttgggtcgtttcactaacccccctgattggcaggaaattttgacctattttcgaggatctgaattgcagaattactttactcgcattctagaggatgatttgaaggctatcatcaagcctcagtatgttgaccacattccaaaagctgtgcaagggaatgtggggcaggtgctagaccaaaaaaatgaaagagatatgaaggaagagctttgtgctgatcttgagcttaatcaagttatagatcgtaatgttggtgatctttcagggggtgagctccaaaggtttgccattgcggttgttgccatccaaaatgctgagatatacatgttcgatgaaccctctagttatcttgatgtgaaacagaggctgaaagctgcccaggttgttcggtcattgctcaggcctaatagctacgtaattgttgttgagcacgatcttagtgtcttggactacttatcagactttatttgctgtttgtatggaaaacctggtgcatatggagtcgtaacacttcctttctcagttagagaaggaattaatatcttcttgtccggctttgttccaacagaaaatcttaggtttcgggaggactctcttacctttaaggttgcagagactccacaggaaagtgctgaggaagctcaaacatatgctcgatacaaatacccaaccatgaccaaaactcaaggcaatttcaggcttcatgtcgttgaaggagaatttacggattctcagattattgtgatgctgggtgagaatggaacaggaaagacaacattcattcgaatgctggctggtttattgaaacctgacactgtagaaggtggagctgatgtggatatgcccgagttcaatgtttcatataaacctcagaagattagtccgaagttccaatcaactgttagacacctgctacatcaaaaaattcgtgatgcttatactcatccccagtttatatcagatgtgatgaaaccactacttatagaacagttgatggaccaagaagttgtgaatctttctggtggagagttgcaaagagtcgccttatgcctttgtctcggaaagcctgcagacatctatctgatagatgaaccaagtgcatatcttgattcagaacagcgtattattgctgcaaaagtcatcaagaggtttattcttcatgcaaagaaaacagcctttatagttgagcatgatttcattatggcaacttatcttgccgacagagttattgtttatgagggtaaaccttcaattgattgtattgcaaattctccacaatcattgctgactgggatgaaccttttcttatcacatcttgatattacatttagaagagacccaactaattttcgcccaaggatcaacaaacttgattcaaccaaggacagagagcaaaagaatgctgggtcttattattacctcgacgactgagtttatactcgacagcctgctcttttgccaatgcaacagtgcgccaatttgtgcttttcgtcaaatcccagctttaattcatttgatgccttgatatataagatactcctttttgtgttgtaggcatctttctcaatggataaaagagtctgcatgcaggccatatgttggttggtgcatttgtatatgtttccataatatttagtgcagttgctcatgaccagttttggtatgactttggtgggtgaatctgattatacttgagtttgtatcggtcatggtttcacatttgatgttccttgagagattcatgatgccacagattaagtttatcaccattgcggctcgcataattatcagttgaatatgtaacgaagtatcccatgttacttaattttgatagatggtttctttttggaatatatctcttctgagagggttgatgttttaatggttatcatgcattttaggatcaaattgcatttggctctttaatgcggactattagaagaattattattttcagtctccttaagttagtcaaagaatttattttggtgaaaccatgtcattggtgtgatttatcccgttattttgatatggtcacaagaccaaatgaatagtgcttcatatgcacacaataagacatttttcaaacatcaacacagtaaaattcatttattattattaaaaatttccatttgaacttgtgatcaagatttaattgaattattatgtagttgtaattaaaatatccttccaatagtgattttcc

SEQ ID NO: 4844 - DNA, 2425 bp, Taxus baccata
cgcgcttcttccttcgtagagcttcctgtcaagcaaatctacaggaattcgatccgtggaaaaatgacggatcggctgacaaggatcgctattgttagctccgaccggtgcaagcccaagaaatgcaggcaggagtgtaaaaagagctgtcctgttgtcaaaacaggaaagctctgcatagaggtttcatctgcctctaaaattgcttatatatcagaggagttatgcattggttgtggtatctgtgttaagaaatgcccatttgacgctatccagatcattaacctcccaaaaagatttagacaaagacacaacacatcgatatgggccaaacacattcaagctccacaggttgcctgtgccgagaccaggacaggtattggggcttgttgggacaaatggtattggcaagtctactgcacttaaagtcctcgctggaaaactcaaacccaatcttggcaggttcaataatcctcctgattggcaggatattcttacatatttccggggatcagagctacagaactatttcactcgtattttagaagataatctgaaggcaataatcaaaccgcaatatgttgatcatataccaaaggcagtacaagggaacgtggggcaggttctttctcaaaaggatgaaagagatatgaaatctgagctttgcactgatctggacttgaatcaggttattgatcggaatgttggtgatttatctggaggggaattgcagcggtttgcaattgcagtagttgcaattcaaaatgctgaaatttatatgtttgatgagccctcgagttatcttgatgtaaagcaacggcttaaagctgcacaagttgtccggtctctgctcaggcctaacacctatgttattgttgttgagcatgaccttagtgtccttgattacttatcggacttcatttgctgcctgtatggaaagcctggagcttatggtgtagtaacgcttcctttttcagttagggaagggatcaatatctttctggctggttttattcccacagaaaatcttcgatttcgagatgaatcactgaccttcaaggttgcagagacgccacaggaaagtgcagaagaaataaaaagctatgcacggtacaaatacccaagcatgtcaaaaactcagggtaatttcaagcttagtgtaaaagagggagaatttacagattctcagattgttgtaatgttgggagaaaatggaacaggaaagactactttcatacgcttgctggccggcttgttgaagccagatgttttagaagattcagaggtggatatacctgaattcaatgtgtcatataagccacagaagatcagcccgaagtttcagtcgactgtgagacacttattgcaccaaaggattcgtgattcgtacacacaccctcagttcacatctgatgtcatgaaaccccttcaaattgagcaactaatggatcaagaagttgtaaatctttctggtggagaattacagagagtggcactgtgcttatgtcttggcaagcctgcagacatttatcttattgatgagccaagtgcatacttggattctgagcagcgtattgttgcagcaaaggtgataaagagatttattcttcacgcgaaaaagactgcatttgttgttgagcatgattttatcatggccacctatttggcagacagggttatagtttacgagggacaaccttcaataaattgcactgcaaatggtccgcagagtttacagacaggaatgaacttgttttatcgcacctggatatcacatttaggcgagatccaacaaactttaggcctaggatcaataaattggaatcaacaaaggacagggagcagaagaatgcaggatcatattattatctggatgactaaagatgccttcaggtattggataattgtcttgattgcaggccattgacatcaagaatttacaactcgcagtacgcgcacatttcattcatgggcctgcttagtaaaaattgtaccaaagctatgtgattggtaattttctcctcctgccaaccgataattcctccacgtgctgctgctttattacagtcaatctgaatcaagtcgtttttggtttagggtgtaagtcttgaaggttaattggagtatttttgatgttccttccccattctgtttcccttcctcttctacattgtcttgcctttcagctttaaatttctagctattcaataactctggtgtctccaatttgtctctcgaacaacattgcctctcttaaagttactcctctcatcagaggaaccttataaaccaacaggagtgaagattagtgaaaaacatgtgtcatgtagcacgattgggaaaatttgagccttatcaatatccctgctataatgtaggtcatcaagcaaatgtattcccggtatttgctgtgagattgaatccc

SEQ ID NO: 4845 - DNA, 2084 bp, Chrysanthemum coronarium
ggggtttcattttatcatcgtgtgtcgaccacgcgccgcatttctatcaagctgaaaccctaataacaatggctgatcgattaactcgtatcgcaatcttgaacgaagacagatgtaaacctaaaaagtgccgtcaagagtgcaagaaatcatgccctgttgtcaaaactggtaagctatgtattgaggtctcatccgcctccaaggtggcagtaatctccgaggagctttgcatagggtgtggtatatgtgtgaagaaatgcccgttcgatgcaattgatatcattaatttaccaaaagatttggagaaagatacaactcaccgttatggagtcaacaccttcaaattacacaggttgcctgtcccgaggcctgggcaagttcttggtttagtcggaacaaatggaattggcaagtctacagctcttaaagtcttggctggaaaattgaaacccaatttgggacgctttaacaaccctccagattggcaagaaatcctgacctacttccgagggtctgagttgcaaaactacttcacacgtattctagaagataatctaaaggctatcattaaacctcaatatgttgaccacattccaaaagcagttcaagggaatgttggacaagtacttgaacaaaagaatgagagagatgtgaaggccgagctgtgtgctgaacttgagctgaatcaggttatagatcgtaacgttggagacttatctggtggagagcttcagaggtttgccattgctgtcgttgccatacaaatggcagaaatatatatgtttgacgaaccttcgagttatcttgatgtgaaacaaaggcttaaagctgcccaagttattcgatccctgcttagacctaacagctatgtgattgttgttgaacacgatttgagtgttcttgattacctatcagacttcatttgctgcctctatgggaaacctggtgcatatggtgttgtgactctacccttctctgtcagagaaggaataaatatatttttagagggttttgtgcccactgagaaccttcgtttccgcgatgaaagacttacttttcgggttgctgagacagcacaggagaccgctgaggagattcaaacatatgcacagtataggtacccaactatgtctaaaacacagggtggttttaaactcaaggcggttgagggtgaattcacagactcgcagattatagtaatgcttggtgaaaatggaactgggaagacgacgtttattcggatgctggctggtttactaaagcctgataccgtggaaggatctgaggtggagatacctgagtttcacgtctcgtacaagccccaaaagatcagtcccaagttccctcattcagttaggcatttgctgcattcaaagattcgtgattcatatatgcatcctcagtttgtttccgatgtcatgaagcctcttcaaatcgagcagctaatggatcaagaggtggtgaatctttccggtggtgaattgcaaagagttgcattgaccctgtgccttgggaagcctgctgatatttacctgatagatgaaccaagtgcatacctcgattctgagcagcgtattattgcttcaaaagtgatcaagagatttatactacacgctaagaagactgcttttgtcgtagaacatgattttataatggcgacttatctagcagacagggtgattgtttatgaagggcagccgtctgttgattgtgttgctaatgcccctcagtcgttattgactggaatgaatctctttttatctcatttgaccatcacatttagaagggatccaggtaattatcgcccgagaattaacaagctaaattcaacaaaggacagggagcagaaacttgctggatcttactattatttggatgactaaatttatcagtctgagttgtaggctataccctctcttgttttctgattgtaacttccggctcatgacgacttttgtcagttaactgatatacgagaacatgattttgttgtttattttgaggaacgtgtttaaaatgcttagagattttgaacattttatggttctttattaatgcagctttcaatcttgattgcatag

SEQ ID NO: 4846 - DNA, 2371 bp, Picea glauca
agcaaaagtaaaagcatcgcaattccaaaggataagagggatcgagtaggttgagagtaaagtagtactgttcgttgaggagaagcggagaaaacccccttatacaaggacttcatttcaggtgacttgaaaaatggctgatcgcctaacaagaattgctatagtgagttcagatcgctgcaaaccaaagaaatgcagacaggagtgtaagaagagctgtccagttgttagaacaggaaagctctgcatagaagtttcttctgcctctaaaattgcgtatatatcagaagagttgtgcattggctgtggtatctgtgttaagaaatgtccatttgatgctatccagatcattaacctacccaaggatttagaaaaagatacaacacatcgatatgggccaaacacattcaagttacataggttacccgtaccaaaaccaggacaggtcttgggacttgttggaacaaatggtataggaaagtccactgcactcaaagtgcttgctggaaaactgaagcccaatcttggcaggttcaataacccacctgattggcaggaaattcttacacatttcaggggatcagagctacagaattatttcacacgtattttagaagataatctgaaggctataatcaagcctcaatatgttgatcatataccaaaagcagtgcaagggaatgttggtcaggtgctttctcaaaaggatgaaagagatatgaagtccaagctttgcactgatctcgaactgaatcaggttattgatcgaaatgttgatgagttatctggaggagaattgcagcggtttgctattgcagtagttgcagttcaacatgctgagatatatatgtttgatgaaccctcaagttatcttgatgtaaggcaacggcttaaagctgcactagtaatccggtccttgctcaggcccaacagctatgttattgttgtcgagcatgatcttagtgtccttgattatttatcggactttatttgctgtctgtacgggaagcctggggtctatggtgtagtaacgcttccattttcagtcagagaagggataaatatctttttggctggttttgtgcctactgagaatcttcgttttcgagaggaatcacttatgttcaaggttgcagagattccacaggaaagtgcagaagagataaaatcctatgcacgctacaaatacccaagtatgtctaaaacacagggcaatttcaaacttcatgtagaggaaggagaattcactgattcacagattgttgtaatgttgggagaaaatggaacaggaaagaccaccttcatacgcatgctggctggattattgaaaccagatacagtcgagaactcagaggtggagatacctgaatttaatgtatcatacaagccacagaagatcagcccaaagtttcagaatactgtaaggatattattacaccaaaagattcgtgattcatacactcatcctcaattcacatcggatgtcatgaaacccctccaaattgagcaattattggatcaggaagttgtaaatctttcaggtggagaattgcagagagtagctatatgcttatgtcttggcaagcctgcagacatttatctcattgatgagccaagtgcgtacttagattctgaacagcgtattgtggcagcaaaggtcataaagcgatttattcttcatgccaagaagacagcttttgttgtcgagcatgattttataatggcaacatatttggcagacagggttatagtatatgatgggaaaccttctgtggattgttctgcccatgctccgcagagtctacaaacaggaatgaacctcttcctatcacacctggatattacatttagacgagatccgacaaactacaggcctcgtataaataaattagattccacaaaggacagagaacaaaagaatgcagggacatattattatctggatgattaattcttgtcactcagtatgtgatacacatgaaaggtcatgagcaaacaaaattatgcctttctctgtggcggccagtctttgcaggacttattctatgagcccgcatattgtaaattgtatcaaaagctatggtgatggattttcttgagtaccgtagcttgaatgaaacattagattcgatagaggatgcttggagactagaaactacatagtgataatagtgaggcagtggattctgtttcttactgctgtttgtgcagggagagaaagagtgccctacaatgattttgcagtaaaatgcagtgtaaaatttgagggtctctttcttttagttaaatgcagatttagtttaccatggaaaattgtatgctctaattcttgtatgctaatgagctaaatatatattttattacatgagtg

SEQ ID NO: 4847 - DNA, 2356 bp, Pinus taeda
agcaaaagtaaaagcatcgcaatgccaagggataagagggatcgagtatgttcacagaaaaacagtcctgctcattgaggagaagccgaggaaacctcccttatacaagcacttcattccaggtgacttaaaaaaatggctgatcgcctaacaagaattgctatagtaagttcagatcgctgcaaacccaagaaatgcagacaagagtgtaagaagagctgtccagttgttagaacaggaaagctctgcatagaagtttcctcttcctccaaaattgcttttatatcagaagagttgtgcattggctgtggtatctgtgttaagaaatgtccatttgatgctatccagatcattaacctacccaaggatttagaaaaagatacaacacatcgatatgggccaaacacattcaagttacataggttacctgtaccaaaaccaggacaggtcttgggacttgttggaaccaatggtataggaaagtccactgcactcaaagtgcttgctggaaaactgaagcccaatcttggcaggttcaataatccacctgattggcaagaaattcttacatatttcaggggatcagagctacagaattatttcacacgtattttagaagataatttgaaggctataatcaagcctcaatatgttgatcatataccaaaggcagttcaagggaatgttggtcaggtgctttctcaaaaggatgaaagagatatgaagtccgagctttgcgctgatcttgaactgaatcaggttattgatcgaaatgttgacgagttatctggaggagaattgcagcggtttgctattgcagtagttgcagttcaacatgctgagatatatatgtttgatgaaccctcaagttatcttgatgtaaggcaacggcttaaagctgcattagtaatccggtccttgctccggcccaacagctatgttattgttgtcgagcatgatcttagtgtccttgattatttatcggactttatttgctgtctgtacgggaagcctggcgtctatggtgtagtaacgcttccattttcggtcagagaagggataaatatctttctgtctggtttcgtgcctactgagaatcttcgttttcgagatgaatcacttacgttcaaggttgcagagattccgcaggaaagtgcagaagagataaaatcctatgcacgctacaaatatccaagtatgtctaaaacacagggcaatttcaaacttgatgtagaggaaggagaattcactgattcacagattgttgtaatgttgggagaaaatggaacaggaaaaaccaccttcatacgcatgctggctggattattaaaaccagatacaatcgaaaactcagaggtggagatacctgaatttaatgtgtcatacaagccacagaagataagcccaaagtttcagcattctgtaaggactttattacaccaaaagattcgagattcatacactcatcctcaattcacatctgatgtcatgaaacccctccaaattgaacaattattggatcaggaagttgtaaatctttcaggtggagaattgcagagagtagcgatatgcttatgtcttggcaagcctgcagatatttatctcattgatgaaccaagtgcgtacttagattctgaacagcgtattgtggcagcaaaggtcataaagcgatttattcttcatgccaagaagacagcttttgttgttgagcatgattttataatggcaacatatttggcagacagggttatagtatatgatgggaaaccctctgtggagtgtactgcccatgctccccagagtctacaaacaggaatgaacctctttctatcacacctggatattacatttagacgagatccgacgaactacaggcctcgtataaataaatttgattcaacaaaggacagggaacagaagaatgcagggacatattattatctggatgattaattcttgtcactcagagtgtaatacacatgaatggtcacaagccaacaaaattatgtctctctgtggcggccattctttgcaggacttattctatgagcccgcagactgtaaatagtacaaaagctacagtgatgggttttatttgggaatcatagcttgaatggaacattggattcgatagaggatgcttggagactagcaactacccagtgataatagtgaggcagtggattctgcttcttactgctgtttgtgcaggaagagaaagagtgctcaacaacgattttgcagtaaaatggagttcaaaatttgagggtctctttgttttagttaaatatagatttagtttaccataggaaattgtatgctctaattcttgtatgctaaagagctaaatgcatgt

SEQ ID NO: 4848 - DNA, 2458 bp, Malus domestica
ggagaacagagaggcccttccctcccttgtctaactatcgcgcaatttccacacctgcccttccctactcttaacggtcgctcaccctctatcccctctctctctttcttagcttccatttttcagtctcagcctccaccgccacctcagtttgatacccttcgttgttctccgtaactgttcagtgtattttctactccttctctgcttgcagccgccagctgatccgactcaagtttctcctccattttctcatctattgccaaacagaagaagattaggagatgacagaccgtttgacccgtatagctatagtgagctcggacagatgcaaacccaagaagtgccgccaggaatgcaagaggagctgtcctgttgtcatcacaggtaaactatgtgtcgaggttacccctgcatccaagattgctttcatctcagaagaattgtgcattggatgtggtatttgtgttaagaaatgcccatttgaagcaatccaaatcattaacttgccaaaggatttagacaaagatacaacccatcgctatgggcctaacactttcaagctacacaggttaccagtcccaaggccaggtcaagttcttggtttggttggaacgaacggcattgggaagtcaactgccctcaaagttttgggtggaaagttgaaaccaaatttaggtcgtttcaaaaatcctccagattggcaggaaatcttgacctactttcgaggatctgagttgcagaatttttttacccgtatcctggaagataatttgaaggccattataaagcctcaatatgttgatcacattccaaaagcagttcaagggaatgttggggaggtgctcagtcagaaagatgagagggatatgaaggaaaaattatgtgctgaccttgagctgaaccaggttatagagcgtaaggtaggggatttatcaggtggggagcttcaaagattcgccattgctgtcgttgccatacagcatgcagagatatatatgtttgacgaaccttcaagttatcttgatgtcaaacaaaggcttaaagctgcccaagttgtccgatctttactcaggcctaatagctatgtaattgttgtggagcatgatcttagtgtcttggattacttatcagacttcatttgctgtttatatgggaaaccgggtgcatatggagttgtaactcttcctttctcagttagagaaggaatcaacatcttcttggctggatttgttcctacagaaaatcttaggttccgggatgaatctctgaccttcaaggttgctgagactccacaggaaagtgctgaggaaattgagacatatgcacgatataaatacccatcaatgactaaaactcaggggaacttcaggcttcgtgcggttgaaggtgaatttactgattctcagattattgtaatgctgggagagaatggaacagggaagacaacattcatccgtatgctggctggtctattgaaacctgattctgtagaagattccgatgtggagatacctgaattcaatgtttcttacaagccccagaaaatcagtccaaagtttccatccactgtcagagccttgttacattcaaaaattcgtgattcatatactcatccccaattcatgtcagatgtgatgaagcctcttcttattgaacaattaatggatcaagaagttctgaatctctctggtggagagttgcaaagggttgcattatgcctatgcctcgggaagcctgcagatatatatcttatagatgaaccgagtgcgtatcttgattctgagcagcgtattgttgcatccaaagtcataaagaggttcatcctacatgctaagaaaacggcattcatcgttgaacatgactttatcatggctacctacttggcagatagagttattgtctatgaggggcaggcatcaattgattgtactgcaaatgctccgcagtcattgttgacggggatgaatctcttcttatctcatcttgatatcacatttaggcgtgacccgactaactatcgcccaagaatcaacaaattggagtcgacgaaggatagggaacaaaaagctgctgggtcctattattacctggatgattgattaacccatatgatgatcgactttgcgtttttggccgaatatggagagggtgttagtatgattttattatggaatctcggcgaagtcacagcgtgctgacatttgatcggaggtccattgtctgttgaagagggtgatgtttgtttccaggcctttagatattgttgctactcgagtcaaatatgcacatataatgtgcttgcagttattcagtttttggtctcagagtatcaaaaaatcaaatggatgttcttttttgggatgcttaatatcagtttaatacgttttaattttcaccaaatgacattgtagttcgacatggctcttacttcaagtgcttttggaggattaacttg

SEQ ID NO: 4849 - DNA, 2466 bp, Prunus mume
taaaaaaaggtttttgtttaattttgtcaactagtcgtctcctctccaccgtccaaaactcccgtgcgactccacaccccccctccctatactcaacagtcattcagtatcttctctggtctgctctgcgcccctttatctctagcttgcattttcagtctcagctgctctgcgctcccttcctctcaatcttccttgccactacgatttcatctgctgcatcttttttctcaaagaagattaggagatggcagaccggttgacccgtatagcaatagtgagctccgacagatgcaaacccaagaagtgccgccaagaatgcaagaagagctgtcctgttgtcatgactggtagactatgtatcgaggttaccccggcatccaagattgcttatatctcagaagaattgtgcattgggtgtggtatctgtgttaagaaatgcccatttgaagcaatccaaatcatcaacttgccaaaggatttagacagagatacgactcatcgctatgggcctaacactttcaaactacacaggttaccagtcccaaggccaggtcaagttcttggtttggttggaactaatggcattgggaagtcaactgccctcaaagttttggcgggaaagttgaaaccaaatttaggtcgtttcaataatcctccagattggcaggaaatcttgacccactttcgaggatcggagctgcagaattattttacccgtatcctggaagataatttgaaggccattataaagccccagtatgttgatcacattccaaaagcagttcaagggaatgttggggaggtgctcaaccagaaagatgagagggatatgaaggaaaaactatgtgctgatcttgatctgaatcaggttatagagcgtaatgtaggggatttatcaggtggggagcttcaaagatttgccattgccgtcgttgccatacagaatgcagagatatatatgtttgatgaaccttcaagttatcttgatgtgaaacagaggcttaaagcagcccaagttgtccgatctttgctcagggctaatagctatgtaattgttgtggagcatgatcttagtgtcttggattacttatcagacttcatttgctgcttatatgggaaaccaggtgcatatggagttgtaactcttcctttctcagttagagaaggaatcaacatcttcttggccggatttgttcctacagaaaatcttaggttccgagatgaatctctgaccttcaaggttgctgagactccacaggaaagtgccgaggaaattgagtcatatgcacgatatagatacccatcgatgactaaaactcaaggaaacttcaggattcgtgtggttgagggtgaatttactgattctcagattattgtaatgctgggggagaatggaacggggaagacaacatttatccgtatgctggctggcctgttgaaacctgatactgtagaagactctgatgtcgaaatacctgaattcaatgtttcttacaagccccagaaaatcagtccaaagtttgcgtccactgtgagacacttgttacattcaaaaatccgcgattcctatactcatccccagttcatgtcagatgtgatgaagcctcttcttattgaacaattaatggatcaagaggttgtgaatctctctggtggagagctgcaaagggttgcattatgcctatgcctcgggaggcctgcagacatttatcttatagatgaaccaagtgcatatctcgattctgagcagcgtattgttgcgtcaaaagtgataaagaggtttatcctacatgctaagaaaactgcatttgtggttgaacatgactttatcatggctacctacttggcagatagagttattgtctatgagggcaagccgtcgattgattgtactgcaaatgctccccagtcattgttgactgggatgaatctcttcctatctcatcttgatatcacatttagacgcgaccccaccaactaccgcccaagaatcaacaaattggagtcaaccaaggatagggaacaaaaagctgcagggtcctattattacctggatgattgataaatgttttggccaaatttagagggcgtcaatctgatcttataaatggaatctcggatgagccatgacatgctgacaaatgatcctttgtatgctgagaggtgatgtttgttaccagcgtagcgtgaattgagtttacaggcccttacatgttgttgctacttgagttcattatgccctaataatataatgtggttgcagttttggtaaaattgtcatttgggcgagggaagtatgtacaatggtctctcatagtatgattatatgattatgattataatatgtacaatgctctgattttacaatgggcctttgacttttgtgacgacattattaactgttgccttttggggattgcaaagactccaccgcaagtcaataacaagtttataatctttact

SEQ ID NO: 4850 - DNA, 2116 bp, Silene vulgaris
aaattcaaccgcagtttccaaacaaccctgttcatcccttttagcttctcaattccgctgcacaaatcgtgtttctatcaagttttcgaggtcaagtgtttgacatccttctaaacaacaagcaagatgtcagaccgtttgacccgtatagccattgtaagctcagatcgttgcaagccaaagaagtgccgtcaagagtgcaagaagagctgtcctgtggttaagacagggaagctatgtatcgaggtcactacattagcaaaagtcgccttcatttcagaggaactgtgcattggttgcggtatttgtgttaagaaatgcccctttgaagcaattcaaatcatcaatttgcctaaagatttggacaaggatacaacacatcgctatggccccaacacattcaagttacacaggttacccgttccgaggccggggcaagttcttggtttagttggaactaatggtattggaaaatcaactgctcttaaagtgctagctggaaagttgaagcctaatttggggcgtttcaataacccccctgactggcaagagattttaacttactttcgtgggtctgagcttcaaaactatttcacgcgcatattggaagataatttgaaggcaattatcaagccccagtatgtggataacattccaaaggctgtccagggcaatgtgggacaggtgttagatcagaaagatgagagagatattaaggctgaaatgttgactgatcttgagcttaacaaagtgttggatcgtaatgttggcgatctttctggtggggaactgcagaggtttgctattgctgtggtggctatgcagaatgctgagatatatatgtttgatgagccttcaagttaccttgatgttaagcaaaggctcaaagctgcacaagttgtcagatcattgcttagacctaatagctacgtcattgttgtcgagcacgatcttagtgttctagactatctttcggatttcatttgctgtttgtatggtaaaccgggtgcttatggagttgtgacgctacctttctctgttagagaaggtatcaatatatttttgtccggatttgtgccaacagaaaatctgcgtttccgtgacgagtcccttacattcaaggttgcagagactccccaagacaatgcagaggagattgagacttatgctcggtacaaataccctgctatgacaaaaactcagggtgggtttaggctacgtgtcagtgaaggtgaatttactgattcccagatcgttgtgatgttgggagagaatggcactggaaagacaacatttattcggttgctggctggtttgcttaagcccgacaacgtgggagattccgatgtggaagtgcctgaatttaatgtttcatacaagccccaaaagatcagtccaaagttccaacactccgttagacatctactgcatcaaaagattagggactcgtatatgcatcctcagtttgtttcagatgtcatgaagcctttgcagattgagcaattaatggaccaagaagtcgttaatctatctggtggagaattgcagagagttgcgttagctttgtgtttgggaaagcctgcagatatttatctgatagatgaacctagtgcatatcttgattccgagcagcgtattgtagcttcaaaggttataaagaggtttatactccatgctaagaagactgcctttatcgtggaacacgactttattatggcgacatatctggcggacagagtcattgtttatgaggggtcaccttctgtggactgtactgcaaattccccccaatctttgttaactggaatgaatcttttcctatctcatcttgatatcacatttagaagggacccaaccaactaccgcccaaggatcaacaaattggaatccacaaaggacagagagcagaaatcagctggaacttactattacctggatgattgaagctgttgcaagagttcttataatgcatgaagcgcagctgagtgtcttcctacatgctcccggtgaatatttggccatcatggtaggagacatcctcgaggatgtattgatgtggggttgatctgttgaaaacctgggaatggctgccgtgaccattcccaatgtaaccctc

SEQ ID NO: 4851 - DNA, 2591 bp, Brassica rapa
agataatttctgaaaaccctacctcaagctctctcttttttttttgtctgtcaattagacaaaaagtgaaactctctcaagtgcgtgtgctctccgctggttccttaaaaagcaatcggcacacgcttctccactccgatcttcctcatctctcaatcaatctcagatcgttgagagatggcagatcgattgacatgtattgctatcgtgagcgcagaccgttgcaagccaaagaaatgtcgccaagagtgtaagaagagctgtcctgtggtcaagacaggaaaactttgtattgaggtcactgttggttccaaggttgcttttatctcagaggagttgtgcatcggttgcggtatctgtgtgaagaaatgcccatttgaagctatccagatcatcaatcttccccgagacttggagaaagatacgacccatcgttatgggccaaacactttcaagctgcacaggctccctgttccaaggccagggcaggtcttagggttggttgggactaatggtattggaaaatcaactgctctgaagattttggctggaaagctcaaaccaaacttgggccggttcactaatcctccagactggcaagagatcttgactcacttccgtgggtcagaacttcaaaactacttcacccgtattctggaagataatctcaaggccatcattaagccacaatatgttgaccacatcccgaaagctgttcgaggcaatgttggagaggtcctagaccagaaggacgagagaaacatgaaggcggagctgtgtgctgatctggagctgaaccaggtcattgatcgtgacgttgtgaatctatctggtggtgagctccagaggtttgctatcgctgttgttgccatacaaaacgctgagatctacatgtttgatgagccttctagttaccttgatgttaagcaaagactcaaagctgctcaagttgttcgttccctcctcaggcctaatagctacgtcattgtggtggagcatgatctcagtgttcttgactacttgtcggatttcatttgctgtctgtatgggaaaccaggagcctatggtgtggtgactctccctttctctgtcagagaaggaatcaacattttcttggctggctttgtccccactgagaatttacgttttagagatgaatcacttaccttcaaggtttctgagactccacaagaaagtgctgaggagatacagtcgtacgctaggtacaagtacccaaccatgaccaaaacgcaaggaaacttcaggttgaaagtctccgaaggtgaattcaccgactctcagattattgtaatgcttggggagaatggtacagggaagacaacgttcatccggatgctggcgggtttgttgaaacctgacgagacggaaggatcagaaatagagattccagagttcaatgtttcttaaaagccgcaaaagatcagtcccaagtttgagaactcagttagacacttgctgcatcagaagattcgggattcttacatgcaccctcagtttgtgtcagacgtgatgaagccgctgcagattgagcagctgatggatcaacaagttgttaatctctcaggaggagagttgcaaagagttgcattagccctgtgcctcggaaagcctgcggacatatacctgattgatgagccaagtgcgtatctcgattcagagcagcgtattgtggcttctaaagtcatcaagcggttcattctccatgcgaagaaaaccgcatttgtagttgagcatgactttataatggcgacctatctggcagaccgagtcatcgtctatgaaggacaaccatccattgattgtactgcaaattgtcctcagtcactgctcactgggatgaatctcttcttatcccatctgaacatcaccttcagaagggatcccaccaacttcagaccaaggatcaacaaattagagtcgactaaagacagggagcaaaagtctgctggctcatactactacttggatgattaagacaactaccatgagagcatatggcatgatgtggacaaaacattgtgcgagttacatgaaggtctttgctgtgaggaagttgatctaagtgagctcgagtattttgcgctaccatctgtttttcggagttctttaggagatgttactcttcaaagcttttgttcatcagttttgagcaaataataagagtttctgaatcttttttaacctttgtttcttttggcttttgtattttctgagttgataatttactgttgtggtgttggtatttggatttcataaggaatgaactgcttctgtttttgcttctcacatagcctctattgggaaactttttttcaacatggttcccgcagcagcagtgtacccatgagcttttgggattataaccaccccgtagaaagtttcacctaaagaaagatcttcaagatgagcacaagcttgttgtgttttaacgagtccatgtccaactatttattgtctaatttttttttttttgtctggttaattatgctattacaaattatgagaaacatatttattgtctaattagtacaatattgtcaattttagatttaataaattggtttgtatag

SEQ ID NO: 4852 - DNA, 2328 bp, Lupinus angustifolius
attgaagagtagtagcacacatctctctctctctctctctctcttgaatcacttccgaattcacaaccatgtctgatcgattgactcgtatcgccatcgtcagcaacgacaggtgtaagcccaaaaagtgccgccaggagtgtaagaaaagttgccctgtcgtcagaaccggtaggttgtgtattgaggttactcaggcatctaagattgctttcatatctgaggaattatgcattggatgtggtatttgtgttaagaaatgtccttttgaagccatccagattatcaacttgccaaaggatttggacaaagataccactcatagatatggtcctaatacttttaagctgcacaggttgcctgtgccaaggccggggcaggtgcttgggttggttgggactaatggaattgggaaatccactgcccttaaagttttggctggaaaactgaaaccaaacttgggtcgtttcactaatccccctgattggcaggaaattttaacatattttcgaggatctgaattgcagaattacttcactcgtattctagaggatgacttgaaggctatcatcaagcctcagtatgttgaccacattccaaaagctgtgcaaggaaatgtggggcaggtgcttgatcagaaagacgagagagatgctaaagcagaactttgtgctgatcttgatcttaaccaggttatagatcgtaatgttggagacctttcaggtggagagctccaaaggtttgccattgcagttgttgccatccagcatgctgagatatacatgtttgatgaaccttctagttatcttgatgtgaaacaaagactgaaagctgcccaagttattcgatcattgcttaggccaaatagctatgtaattgtcgtcgagcacgaccttagtgtcttggactacttatcagactttatttgctgtttgtatggcaaacctggtgcatatggagttgtaacacttcctttctcagtcagagaaggaattaacatcttcttggctgggtttgttccaacagaaaatcttagattccgggaagagtctcttaccttcaaggttgctgagactccacaggaaactgctgaggaagctcagtcatactctcgatacaaatacccaaccatgaccaaaactcaaggcaatttcagacttcgtgtagctgaaggagaatttactgattctcagattgttgtgatgctgggtgagaatgggacaggaaagactacatttattcgtatgctggctggtttattgaaacctgatgctatagaaggtggatctgatgtggagatgcctgagtttaatgtgtcttacaagcctcaaaagattagcccgaagttccaatcaactgttagaagcttgctacatcaaaaaatacgtgatgcatatacccatccccagtttatatctgatgtgatgaagccacttcttattgaacagttaatggaccaagaagttgtgaatctctctggtggagagttgcaaagagttgcattgtgtctatgtctcggaaagcctgcagatatctacctgatagatgagccaagcgcatatcttgattctgaacagcgaattcatgctgccaaagtcatcaagaggtttattcttcatgcaaagaaaacggcttttgtggttgagcatgattttatcatggcaacttatcttgctgacagagttattgtttatgagggccaaccatcaattgattgtactgcaaattctccacaatctttattgagtgggatgaaccttttcttatcacatcttaatatcacatttagaagagacccaactaattttcgaccaaggatcaacaaacttgattcaaccaaggacagagaacaaaagaatgctgggtcttattattaccttgatgactgagtttattatactcatgttcagtttctctttcaccaatgcaacattgcaccagtttctctttcaccaatgcaacatcatttgatacattgacatataagtgtccctattgctgttgaaggcttctttttcaatggattgaggaccctgcatgcatacattcaggcctaatatctagtgcagttgctcagcaccaatttttgcatgatttggatgggtgaatctgaatactacatgagtttatattattggtcttcatgtctctcaaatttagaggaacaactttgatgtcagattgagtttatcactattttggctcttataatttgttagattaatatgtaataagattgattttatccaatgtggagataaatttgtggtgggtgtttatgtgacattttataaagttttatatcccctctcgctcaatgattttaca

SEQ ID NO: 4853 - DNA, 2093 bp, Triticum aestivum
tgcaagcccaagaagtgccgccaggagtgcaagaagagctgccccgtcgtcaagaccgggaagttgtgcattgaagttggtccggcgtccaaggtttccttcatctctgaagagctgtgcattggttgtggtatttgtgtcaagaaatgcccatttgatgccatcgagatcatcaacctcccaaaagatctggaaaaggataccacccatcgctatgggccaaatacattcaaattgcacaggctgcctgttccaaggcctggtcaagttttgggacttgttggaaccaatggaattggaaagtccacagcgcttaaagtcttagctggcaagctgaaaccaaatttgggacgattcaaaaatccacctgattggcaggagatccttacatacttccgtggctctgaacttcagaattattttacacgtttattggaggataacctgaaggcaatcattaagcctcaatatgttgaccacattccaaaagctgtccatggaaatgtcgggcaagtacttgagctgaaagatgagagggatatgaaagctgagctgtgcgttgaccttgaattgaaccaagttattgaccgaaatgtgggagatctttctggcggtgagctccagagatttgcaatagcagttgttgctgtgcaaagtgcagaaatttacatgtttgatgaaccatcaagttatcttgatgttaagcagagactgaaggctgcacaagtcattaggtccttgctgagatcgaacagctacgtcattgttgtggaacatgacttgagcgtcttagattacttgtccgacttcatttgctgcttatatggaaagccaggagcttatggtgtagttacactgccattttcagtccgagaaggtatcaatattttcctggctggatttgttccaactgaaaatcttcggttccgagatgaatctcttacatttaagattgtggatacacaagacaacgcggaggagattgaaacataccaacgatacaagtaccctaccatgagcaaaaccctagcaaatttcaagctcactgtcatggaaggtgaattcactgattctcagattgttgtgatgcttggtgagaacgggacagggaaaactacattcatcagaatgctggctgggcacttgaagccagataccgtggatggagttgagatcgaaattcctgaatttaatgtgtcctacaagccccaaaagattagcccaaaattcccgggctcagtgaggcaactgcttcataagaaaatacgcgattcatatactcatcctcagtttatatccgatgtaatgaagccactacaaattgagcagctcatggatcaggaggtgctgaatttatcaggtggagaactccaaagggtggctctatgtctttgccttggacagcctgcagaaatctaccttatcgatgagccgagtgcgtaccttgattcggagcagcgcattgtcgcctcgaaggtgatcaagaggttcatcctccatgccaagaagacggcgttcatcgtcgagcacgacttcatcatggcagcctaccttgcggacaaggtggtggtctacgaagggcgcccctccgtcgagtgcactgcctgcacgccgcagtccctggtgtctgggatgaacaggttcctatcgcaccttgacatcacgtttcggagggacccgaccaactacaggcctcggatcaacaagatggactcaaccaaggaccgggagcagaaggccgcggggtcctactactacctcgatgactgactgattggcgcaccgcccctcccgagagaattcagtttgactgatcttgtttttaggtgaattgaattatgctcggatagacagacagacagacctgggtttgtccccgtttttgtcctgggttttgtactgacgttggagagatttggcagatgagacagcgaactgcacctgctctgtcccaggtcaaaagcaactctgttatcttggttacttaattagcagctactaattgaattagcatacatgcaaagccagacctgatctgaatctgatggttatgtttctgctctttcttgtgtcgctgggtttttctaattatg

SEQ ID NO: 4854 - DNA, 2916 bp, Ceratodon purpureus
gccagctccatcctcccaaccctcccccttggtcatggtacacagagtctgggggttagtcagcctggtgacctattcactgccacccctttcaacacacactcttccctcacagagttagacatcacacctttctccccttggtgtagtatatgggagtgaagtagttccataccttgaatcctacaaatagacacttaattcacgttggtttatgagaccaaagtttctctttttcttcttgcagcaactcaccaccttgggataaggttaagagtgtctagtcttggacactggttgaggttgagagtggaacagacagatagacatacatacacgttagttttgttgttgtttttttttggagaggagattgggttgagcagggtttgggagcatcatgtcgaaccggttgactaggattgctatagtcagctccgacaggtgcaagcccaagaaatgtcgccaggagtgcaagaagagttgccctgtggtcaagacagggaagctctgtatcgaggtttcttcggcttcgaaaattgccttcatttctgaggagctctgtatcggttgcggtatctgtgtcaagaaatgtccttttgaagccatccagatcattaatctgccgaaggaccttgacaaggatactacccatcgttatgggcccaatactttcaagcttcacagattgcctgttcctagacccgggcaagtattggggcttgtgggcacaaatggtattggaaagtcaactgctctcaaggttttggcaggaaagctcaagccgaaccttggacgtttccttaatccaccggactggcaagaaattttgacttatttccgcggttctgaacttcaaaattacttcactcgaattttggaggacaatttgaaggcgatcatcaaaccgcagtacgtggaccatattcccaaggccgttaagggtaatgtgggcgaagttcttgctcagaaagacgagagggagatgagatttgtactggcaaaggatctcgacctgaaccaagttcttgatcgcgatgtcggtgatctttctggaggagagctccaacgttttgcgattgctgtcgttgccacgcagcatgctgagatttacatgtttgatgagccatctagttatcttgatgtgaagcaaaggttgaaagctgctcaagtggttcgctctctgctccgtcccaacagctatgtcatcgtggtggagcacgacttgagcgtcttggattatctgtctgattttatctgttgcctgtacgggaagcccggagcttacggtgtggtgactttgcctttctctgtgagagaaggtatcaatatctttttggctggatttgttcccactgagaatctgagatttagagacgagtcccttaccttcaaggttgctgagactccccaggagagtgcagaggagatcagcacatatgcacgctacaaatatcctcaaatgactaagacacagggtggtttcaaattggctgtgaaggaaggggagtttactgattcacagattattgttatgctcggagagaatggaactggcaaaacaacgttcatccgaatgttggcaggtttactaaaacccgatgaagctggcgacgccaatgttgaggttccagagttcaacgtgtcttacaagccacaaaaaatcagtcccaaattcgcatcaactgttcgacacctcttgcatcagaagatcagggactcttacatgcatccgcagttcaattcagatgtgatgaaacctttacagatcgaggcgctgatggaccaagaagttgttcatctttcgggaggagagcttcaacgtgtcgctctttgtctctgccttggcaagcccgcagatatttatttgatcgatgagccgagtgcatatctcgattcagagcagcgtatcgtcgcagctaaagttattaagcgattcatccttcacgcaaagaagactgcctttgtggtggagcatgatttcatcatggctacatacttggctgacagagtgattgtgtatgagggacgaccatctattgattgtgtggcaaatactccccagagcttgttaacaggaatgaatctctttctttcgcacttggacattactttccggcgtgacccaacaaactacaggcctcgtatcaacaagcttgattcgacgaaggacagggagcagaagaacgcaggatcctactactacttggatgactaaatggccagcgttgagctcggttcaaagtccggcatgagggtacctagtaccagcaaaactgtactgtaccatttctttttcggccataggcaagatcactttcatgaaccattgttggaatactttgagctcctttcagtgtgcgcaaaccaggagtgtccatcctcgaactgaccttgagcgcaacaccagttgtgttgtcttttcttggagtttttcctcgaaacttatttttctgtgcgaatggaatttgcttctggaggatcagatctagaagcatgaagcttgggtgatcctttgaatttactgagagaccttcaaggcatgagttctgatctggacgatgttcacatttgtgaattcccttgtcagtcgtaaccgacacatgttctcggaggtctctgagcacttcactggattcttctcaaacagagatgccgagaggagcagccttggttgaaaatagaggttcagacttggaggcttagtaataaatggtttggtgaattttgttatttagatggaattgtacaccttggtcaatcgggtgcaataaacaatgcttgtatcttcttggatggaggtgaaggagttgtagagttggtatcaacttgaaggtattgttacacgcgccatcgtgaacgggtttcatgttttggtaaagtctggttctgacatttcaatgcatcatacgtaac

SEQ ID NO: 4855 - DNA, 2351 bp, Trifolium pratense
acatgtcggatcgattgacacgtattgctattgttagcaacgacagatgcaagcccaagaagtgtcgtcaggagtgcaagaagagttgccctgttgtcagaaccggcagactgtgtatcgaggtttcttctgcatccaagattgcttacatatctgaggaattgtgcattggatgcggtatctgtgttaagaaatgcccttttgaagctatccagattatcaacttgccaagggatctggacaaagataccactcacagatatggtcctaatacttttaagctacacaggttgccggttccaaggccgggacaagtgcttggtttggttgggacaaatggaattgggaagtccactgcacttaaagttttggctggaaaattgaagccgaatttgggccgtttcactcaaccccctgattggcaggaaattttgacccattttcgaggatctgaattgcagaattactttactcgcattctagaggatgatttgaaggctatcatcaagccccagtatgttgatcacattccaaaagcagtgcaagggaatgtggggcaggtgctagaccaaaagaacgagagagatatgaaggaagagctttgtgctgatcttgagcttaatcaagttatagatcgtaatgttggtgatctttcagggggtgagctccaaaggtttgccattgcggttgttgccatccaaaatgctgagatatacatgttcgatgaaccttctagttatcttgatgtgaaacagaggctgaaagctgcccaagttgtccggtcattgctaaggcctaatagctatgtaattgttgttgagcacgatcttagtgtgttggactacttatcagactttatttgctgtttgtatggcaaacctggtgcatatggagttgtaacacttcctttctcagtccgagaaggaattaatatcttcttgtctggctttgttccaacagaaaatcttaggtttcgggaggactctcttaccttcaaggttgcagagactccacaggaaactgctgaagaagctcaatcatatgctcgatacaaatacccaaccatgaccaaaactcaaggcaatttcaggcttcgtgtagttgaaggagaatttacggattcacagattgttgtgatgcttggggagaatgggacgggaaagacaacattcattcgtatgctggctggtttgttgaaacctgacactatagaagggggatctgatgtggagatgcctgagttcaatatttcatacaaacctcagaaaattagcccaaagttccaatcgactgttaggcacttgctacatcagaaaatccgtgattcatatacacatcctcagtttatatcagatgtgatgaaaccactacttatagaacagttgatggatcaagaagttgtgaatctttctggtggagagttgcaaagagttgccttatgcctttgtctcggaaagcctgcagacatctatctgatagacgagccaagtgcatatcttgattccgaacagcgtattattgcggctaaagttatcaagaggtttattcttcatgcaaagaaaacagcctttgtggttgagcatgatttcatcatggcaacttatcttgctgacagagttattgtttatgagggtcaaccttcaattgattgtactgcaaattgtccacaatcattgcttactgggatgaaccttttcttatcacatcttgatatcacatttagaagagacccaactaatttccgcccaaggatcaacaaacttgattcaaccaaggacagagagcaaaagcatgctggttcttattattaccttgatgattgactttatacacaaaagccagtctgctcttttgccattgcaacagtgcaccgatttgagcttcccaattttgattcatttgattccttgacatatgagatagtccttttgccttgacatacaagagtctgcttgcatgcagagcatttgttggttggtgcatttgtatatgtatccgtaatatttagtgatgttgcccattgcaagttttggtatgattttggttagtgaatctgtttattactcagtttatatcgctcatgttccttgagtgaataatgatgccatagattaagtttatctccatctcgtttcacaatttatcagttgaatatgtaacgaagtatacattaacttccatgttacttggttttgatagatggtttctttttggaatatattgctacttagactctatttggtaaaaatagcggttagctgataagctagcttgtagctgatagctgatagccaatcatatgctcccatttttaataagattctggctaaaagcatacaagtgctgtaatg

SEQ ID NO: 4856 - DNA, 2502 bp, Physcomitrella patens
ggtttggcctggtcgggtttgggctcgcatgaggttcatattagggttggtggcttcagaaacccttcctctctagagcctttacctgtggctgcttgggctgctgggagggtcttgctccaatttagggtgtgggtttgttttcccaagagttgggtggtgcaccaagtgtagcgccgtggttggaagtgagagggaacaaggtacgacatcaagatgtcgaaccggttgactaggattgccattgtaagctcggatagatgcaagccgaagaaatgccggcaggaatgtaagaagagttgtcctgtggtgaagacagggaaactttgcattgaggttacctcacaatccaaaattgcattcatttccgaggagctgtgcatcggttgtggtatctgtgtcaagaaatgcccatttgaagcaatccagatcattaatctgccgaaggatcttgacaaagacactactcatcgttatggtcccaacaccttcaagctgcacagattacctgttccgaggcctggacaagtactggggcttgttggaaccaatggaattggcaagtcaactgccctgaaggttttggctggaaaactcaagccaaaccttggacggtttcttagtccgcctgattggcaagaaattctgacctatttccggggttctgaacttcaaaattatttcactcggattttggaggacaacttgaaggcaatcatcaagccgcagtatgtcgaccacatccccaaagccgtaaagggtaatgtaggtgaagttcttgcccagaaggatgagagagagatgagatttgaactggcgaaagaccttgacctcaatcaagttcttgaccgtgacgttggtgacctttctggaggagagttgcagcggtttgctattgctgttgttgcaacacagcatgctgaaatttacatgtttgacgagccttcaagttatcttgatgttaagcaaaggctgaaagctgcccaagttgtgcgttctcttctccgtcccaacagctatgtcattgtggtggagcacgacttgagtgtgttggattatctttctgattttatatgctgtctttacgggaagcctggagcttatggagtagtgactttgcccttttctgtcagagaaggtatcaacatcttcctagctgggtttgtgcccactgaaaacttaagatttagggatgagtccctgaccttcaaggttgctgagactcctcaggagagtgcagaagagattcgcacgtatgcacgatataaataccctcagatgtcaaagacacagggtggcttcaaactgatggttaaggagggagagtttactgactcccaaattatcgttatgcttggagaaaatgggactggcaaaacaacattcatccgaatgttggcaggtttgcttaagcctgatgaggctaccgacagtgacgttgaggttccagagttcaatgtgtcttacaagcctcaaaaaatcagtcccaagttcacatcaactgtacgacatctattgcatcagaagatcagggattcttacatgcatccacagttcaataccgatgtcatgaagcctttacagattgaagctctcatggaccaagaagttgttcacctttcagggggagagctccaacgtgtggcactgtgtctctgccttggcaagcccgcagatatctacttgattgacgagccaagtgcatacctagattctgagcagcgtattgttgcagctaaagttattaagagattcatccttcatgcaaagaagactgcttttgtggtggaacatgatttcatcatggccacatacttggcagacagagtgattgtgtatgaaggtcaaccatctatcgattgtatagcaaacacaccccagagtttgctaacaggaatgaaccttttcctctcgcacttggacatcaccttccggcgtgacccaaccaactacaggcctcgcatcaacaagctggattcgacaaaggacagggagcaaaagaatgcaggctcatactactacctagacgactaaatgctcggcatagagctcgcttgcttgcttcaaagttttgggtgagggtacatagtaccagtctaaccgtatattgtaccatttgttttccgtcataggccaggccacatcaatgaaaccattgctgggttcttctttgagctacctctattgtggcgcaaaccaggagtgaacatccttgaactgaccttgagcgcaacagaagttgtggtcttttcttggagtttttcctcgaattattgttcagtaccaagggaatgttgtgtttcacgagaattagttttagcagcgtgacgcataacctgcatgatgcatgagttctgatcctagcttatattctacaactgctaaatgctggcatttattagtattatttatatctcattctcggcggtctggacatttcactggaattgctgaggggagagccgtcttggataataatcgatgtttaaatcttagtcttat

SEQ ID NO: 4857 - DNA, 2013 bp, Allium cepa
tgcaggcaggagtgttaaaaagagtctgtcccgtcgtcaaaacaggttaagctttgtattgaagttacttcagctgctaagcttgcttacatctccgaggagctatgcatcggatgtggtatatgtgtaaagaaatgcccatttgaggccatacaaattatcaatcttcccaaaaatttggataaagataccacacatcgttatggaccgaatacctttaagttgcacaggctaccttttccaaggcctggacaagttcttggtcttgtaggaacaaatggtattgggaagtccactgcacttaaagtgttagctgggaagctgaaaccaaatttgggccgttttaataatccaccagattggcaggaaattttgacgcatttcagaggatctgagctccaaaactatttcacccgtatactggaggacaatctcaaggctcttattaagccacaatatgttgatcacatacccaaagccgtacaagggaacgtgggtcaggtgcttgatcaaaaagatgagactgatagaaaggctgaactttgtgttgatcttgaattgaatcaagttattgaaagaaatgttggagatctgtcaggtggtgagttacagaggtttgcaattgctgtggttgctgtacaaaatgcagagatatatatgtttgatgaaccatcaagttaccttgatgtaaaacagagactgaaagcagcaaaggttattcgttcattactcagatcacaaagttatgtaattgttgtggagcatgatcttagcgtcctggattacttatcagattttatttgctgtttatatggcaaaccgggagcttatggagtggttacgttacctttctcggttagggaaggaatcaacatttttttggctggttttgtgccaactgaaaatctgaggttccgggaagagtcgcttacatttaaggtatccgagacacctcaagaaagtgctgaagaaattgaaacataccagcgttacaaatatcctagcatgagtaaaactcaagggaattttaagctaactgtttgtgaaggggaatttactgattctcagattattgtgatgttgggagagaatggaactgggaagaccacatttattcgtatgctggctggattgttgaaacctgatgtggtggaaggcgcagcagatgttgagatacctgagtttaatgtttcatacaaaccacagaagataagccctaaatttcaatctacggttaggcacttgctgcatcaaaaaattagagagtcctatatgcatccacagtttgtctctgatgtcatgaagcccttacaaatcgaacaactaatggaccaagaagttgtcaatctctctggtggagagttgcaaagagttgctttatgcctttgccttggaaagcctgcagatatatatcttattgatgaaccgagtgcttaccttgattcggagcagcgtattgttgcttcaaaggttattgagaggttcatacttcacgcaaagaaaactgcttttgtggttgaacacgattttataatggcaacatatttggctgataaagttattgtctatgaggggaaaccatctattgattgtatagcgaacgctcctcaatcgttggtgtctgggatgaaccttttcttatctcatctcgacattacattcagaagagatccaacgaactacaggcctcgcataaacaagcttgaatctgccaaagatagggaacaaaagaatgctggatcctattactatctcgatgattgattttggctatcagcacatatttaactggaaaaatgagacctggagcttctggtttttgaacctaaaactatttccgttaggtccatatgcagttacataatctgtctacgttgagtttcaaactagtgaacatttagtattttcttcactgaggtggggtatcaagctatcagcggtaaacagcttgtttggtttcttcataattttttgtttaaatgctattactttgcagtgtttctatataattcc

SEQ ID NO: 4858 - DNA, 2511 bp, Prunus persica
gcataaaaatacttttatgaagaatcacttctttatataatcacaagtggtctcctctcacaaaaggtttttgtttaattttgtcaactagtcgtctcccctccaccgtccaatactcccgtgcaactccacacccccctccctatactcaacagtcattcagtatcttctcttctctgctctgcgcccctttatctctagcttgtattttcagtctcagctgctctgcgctcccttcctctcaatctccctcaccactacgatttcatctgctgcttcttttttctcaaagaagattaggagatggcagaccggttgacccgtatagcaatagtgagctccgacagatgcaaacccaagaagtgccgccaggaatgcaagaagagctgtcctgttgtcatgactggtagactatgtatcgaggttaccccggcatccaagattgcttatatctcagaagaattgtgcattgggtgtggtatctgtgttaagaaatgcccatttgaagcaatccaaatcatcaacttgccaaaggatttagacagagatacgactcatcgctatgggcctaacactttcaaactacacaggttaccagtcccaaggccaggtcaagttcttggtttggttggaactaatggcattgggaagtcaactgccctcaaagttttggcgggaaagttgaaaccaaatttaggtcgtttcaataatcctccagattggcaggaaatcttaacccactttcgaggatcggagctgcagaattattttacccgtatcctggaagataatttgaaggccattataaagccccagtacgttgatcacattccaaaagcagttcaagggaatgttggtgaggtgctcaaccagaaagatgagagggatatgaaggaaaaactatgcgctgatcttgatctaaatcaggttatagagcgtaatgtaggggatttatcaggcggggagcttcaaagatttgccattgccgtcgttgccatacagaatgcagagatatatatgtttgatgaaccttcaagttatcttgatgtgaaacagaggcttaaagcagcccaagttgtccgatctttgctcagggctaatagctatgtaattgttgtggagcatgatcttagtgtcttggattacttatcagacttcatttgctgcttatatgggaaaccaggtgcatatggagttgtaactcttcctttctcagttagagaaggaatcaacatcttcttggccggatttgttcctacagaaaatcttaggttccgagatgaatctctgaccttcaaggcaagattataaattttgttgctgagactccacaggaaagtgccgaggaaattgagtcatatgcacgatatagatacccatcgatgactaaaactcaaggaaacttcaggattcgtgtggttgagggtgaatttactgattctcagattattgtaatgctgggggagaatggaacagggaagacaacatttatccgtatgctggctggcctgttgaaacctgatactgtagaagattctgatgtcgaaatacccgaattcaatgtttcttacaagccccagaaaatcagtccaaagtttgcgtccactgtgagacacttgttacattcaaaaatccgtgattcatatactcatccccagttcatgtcagatgtgatgaagcctcttcttattgaacaattaatggatcaagaggttgtgaatctctctggtggagagctgcaaagggttgcattatgcctatgcctcgggaggcctgcagacatttatcttatagatgaaccaagtgcatatctcgattctgagcagcgtattgttgcgtcaaaagtgataaagaggtttatcctacatgctaagaaaactgcatttgtggttgaacatgactttatcatggctacctacttggcagatagagttattgtctatgagggcaagccctcgattgattgtactgcaaatgctccccagtcattgttgactgggatgaatctcttcctatctcatcttgatatcacatttagacgcgaccccaccaactaccgcccaagaatcaacaaattggagtcaaccaaggatagggaacaaaaagctgcagggtcctattattacctggatgattgataaatgttttggccaaatttagagggcgtcaatctgatcttattaatggaatctcggatgagccatgacatgctgacaaatgatcctttgtatgctgagaggtgatgtttgttaccagcgtagcgtgaatgagtttccaggcccttacatgttgttgctacttgagttcattatgccctaataatataatgtggttgcagttttggtaaaattgtcatttgggcgagggaagtatgtacaatggtctctcatagtatgattatatgattatgattataatatgtacaatgctctgattttacaacgggcctttgacatttgtgctttctaggattatgattatatgattattcttaaaaatatattagaattg

SEQ ID NO: 4859 - DNA, 2275 bp, Ceratodon purpureus
ctcaggtcagtcccatcgtcgtcctcgtgccgcactaaccaaaatactaaccaaaacatgtcatcaacccaaagaggatggagaatatttgacaaagaagtcatcaaccctaagacgccgttccggcgtagggaactactgcggctacgccgcagggacagagggaggcccgagggaggccgggccgagagggaggcgggcagggttgcgtttcctcaaacgtgcccagcccttagtggcgagggccggcgccagagcgcatgtgcgttaggacgttgttgtttgccgctacaccactcaacacatcgatttccccctcttttcttaatctgtctcagagactgggagctttaggcgatcactgccggcaataccatgtcagaccgcctcactaggattgcgatcgttagctccgaccgctgcaagcctaagaaatgccgtcaggagtgcaagaagagttgccccgtcgtcaagacagggaagctttgtattgaggtctcttcggcgtccaaaattgctttcatctctgaggagctttgcatcggttgtggtatctgtgttaagaaatgtccctttgaagctatccagatcatcaatcttcccaaggaccttgacaaagacaccactcatcgttatggtcccaacaccttcaagcttcacagattgcctgttccccgaccggggcaagtcttggggcttgtcggcactaacggtattggaaagtcaactgctctcaaggtcttggcgggaaaacttaaaccaaatcttgggcgattcctcaatccacctgattggcaagagatcttgacctatttccggggttccgagctccagaactatttcactcgaattttggaggacaatttgaaagcaattatcaagccgcaatatgttgaccatattcccaaggccgtgaaagggaatgttggtgaagtccttgctcagaaagatgaaagagagatgaggtttgaactggcgaatgatctggaccttaagcaagttcttgaccgtgacgtgggcgacctatctggaggagagctacagcgctttgccattgctgttgttgctacacagcaagctgagatttacatgtttgatgagccttcaagttatcttgatgttaaacaaaggttgaaagctgcacaagttgttcgatctcttcttcgtccgaacagctatgttatcgtggtggagcacgacttgagtgttttggattacctttcggattttatctgctgtctgtacggaaaacccggagcttatggtgtggtgactttgcctttttctgtaagggaaggtatcaacatctttttggccggctttgtgcccactgagaacctgagatttagagacgagtcccttaccttcaaggtagctgagactcctcaagagagtgcagaggaaattcaaacatatgcacgctacaaatatcctggaatgtcaaagactcaaggtggtttcaagctggccgtgaaggaaggagaatttaccgattctcaaattattgttatgcttggagagaatggaactggcaaaacgacgttcatccggatgttggctggtctgctaaaaccagacgaagctggcgacagtaacgttgaggttccagagttcaatgtgtcttacaagcctcaaaagatcagtccgaagttcacatcaaaagtcagacatcttttgcatcagaagatcagggactcctacatgcatccacagttcaacacagatgtggtgaagcctttgcagattgaggctctgatggaccaagaagttgtccatctttcgggtggagagctccaacgtgtggctctatgtctctgcctcggcaagcctgcagatatttacttgattgacgagccaagtgcatatctcgattcagagcagcgcattgtagcatctaaagttattaagcgattcatccttcatgcgaagaaaacggcttttgtagtggagcatgattttatcatggccacgtacttggccgacagagtgattgtatatgagggacaaccatctatcgattgcttggcaaatacacctcagagcttgctcacgggaatgaatctttttctctcgcacttggatatcactttccggcgtgatccaacaaattacaggcctcgtatcaataagcttgattcaaccaaggatagggagcaaaagaatgcaggatcttactattacctagatgactaaatgccattcgtcaggcccgcttcaaattttggatgagtttacttggtgccatattttttttaatattgtattacttgttttt

SEQ ID NO: 4860 - DNA, 2725 bp, Ceratodon purpureus
cccctcttcctccgggatcgtggcggacttgcacccggcgtcatcatgtcggatcgcctcactaggattgcgattgttagctccgaccgctgcaagcccaagaaatgtcgccaagagtgcaagaaaagttgccccgtcgtcaagaccgggaagctttgcatagaggtttcgtcggcgtccaaaattgccttcatctccgaggagctttgcatcggttgtggtatatgtgttaagaaatgccccttcgaagctatccagatcatcaatctccccaaggacctcgacaaggacaccactcatcgttatggtccaaatgccttcaaactccacagattgcctgttcctcgacctgggcaagttttagggcttgttggcactaacgggattggaaagtcaactgctctcaaggttttggcaggaaagctgaaaccgaatcttgggcgatttctgaatccacctgactggcaagagatcctaacttatttccggggctctgagctccagaattattttactcggattttggaggacaatttgaaggcgatcatcaagcctcaatatgttgaccatattcccaaggccgtcaaaggcaatgtgggtgaagtcctcgctcagaaagatgaaagagagatgaggtttgaattggccaaggacctcgacctgaaccaagttcttggtcgtgacgttggcgatttatctggaggagagctacagcgctttgccattgctgtcgttgctactcagcatgctgagatttatatgtttgatgagccttcaagttatcttgatgttaaacagaggttgaaagctgcccaagttgttcgttctctccttcgccctaacagctatgttatcgttgtagagcacgacctgagtgtgttggattacctgtcggattttatctgctgtctgtacgggaaacctggagcctatggcgtggtgactttgcctttctctgtaagagagggtatcaacatctttttagctggctttgtgcccactgagaacctgaggttcagagacgagtccctcaccttcaaggtagctgagactcctcaggagagtgcagaggaaattagaacgtatgcacgatacaaatatcctgtaatgtcgaagacacaaggtggcttcaagctagccgtgaaggaaggagaatttaccgattctcaaattatagttatgcttggagagaatggaactggaaaaacaacgtttatccggatgttggctggtttgcttaaagcagacgaagctgacgacagcaatgttgaggttccagagtttaatgtgtcttacaagcctcaaaagatcagccctaagttcacatccactgttcgacatcttttgcatcagaagataagggactcttacatgcacccacagttcaatacagacgtgatgaagcctttgcagattgaggctcttatggaccaagaagttgttcatctttcgggtggagaacttcaacgtgtggctctatgtctctgccttggcaagcctgcagatatttacttgattgacgagccaagtgcatatctcgattcagagcaacgtatcgtagcatccaaagttatcaagcgattcatccttcatgctaagaaaacagcttttgtagtggagcatgattttattatggccacgtacttggccgacagagtgattgtgtatgaaggagaaccatctattgattgcgtggctaatacacctcagagcttgctcacgggaatgaatctttttctttcacatctggatatcacttttcggcgtgacccaactaattacaggcctcgtattaacaagcttgactcaacgaaggacagggagcaaaagaatgcaggatcgtattactatcttgatgactgaatgcccatcgccaggccagcttcaagtcttggatgagggtatatagtgcctgctcttcctttaatattgtaccattggtttttctagctcctgcaggtaagtcgctgcagtgaatcattcatgtgatatttttccagctccctttgatgtacggaacccctaaggcactagttcaggcttatgttcaatattgtgaattactgactttgtgaacctcttaagttaacggacgcttatattttcggagggatattcacagcgttagttctatcatactttttatggcttaggtcccaaaaaatctagtgtcgtgatggaggtttaagttttgcaaggtgtgcgtcatgatgttgctcaataaattgttatgttgtttgaatttcttgatttaaaggtatttcgattatccatcgtatttctgcatattccatcttagatttctgtatttatttttgagatgttcatacctcatgctttttatataccacaataattatatgtgagtccattcttgacatagaaaatagcaacgtagagctgttgacttacgcatcttgagtgggttatcaaacatgttcaaaatatgtattgtccatcatttgattcgggcaagcattagagtctagacctgggatgagccatcattacaagcagtctccggattttgtcttacagacgtcagcgaatacatctcctttcctttaaaacaggaacttaatgttttttctggttcgctcattgtggttgctctagaacttgtctaccgtttctgaactcgtgctgctaagtacgatgcaccgccttaacttatgcggaggagtatattttacggctctctgacgaatatacgggattggatggt

SEQ ID NO: 4861 - DNA, 1883 bp, Lotus japonicus
cgccgttctccgatcgattccgccaccgtggttcaaccgcagcgaacaattcccatttccgcaagttgaaatcaagggtttgaggcgacatgtctgatcgattgacccgtattgccatcgtgagcaacgacaggtgcaagccgaagaagtgtcgtcaggagtgtaagaagagttgccccgtggtcagaaccggtaggttgtgtattgaggtgtcttctgcatcgaagattgcttacatatctgaggaattgtgcattggatgcggtatttgtgttaagaaatgtccttttgaagctatccagattatcaacttgcccaaggacttggacaaagacaccactcatagatatggtcctaatacttttaagctgcataggttgccagtgccgaggccagggcaagtgcttgggttggttgggacaaatggaatcggcaagtccactgcccttaaagtgttggctggaaaattgaaaccaaacctgggtcgtttcactaacccgcctgattggcaggaaattttgacctactttcgaggatctgaattgcagaattacttcactcgaattctagaggatgatttgaaggctatcatcaagcctcagtatgttgaccatattccaaaagctgtgcaagggaatgtgggggaggtgctagagcagaaagatgagagagatgtaaaggcagagctttgtactgatctggagcttaaccaggttatagatcgtaatgttggtgatctttcaggtggtgagctccaaaggtttgcaattgcagttgttgccatccagaatgctgagatatacatgtttgatgaaccttctagttatcttgatgtgaaacaaaggctgaaagctgcccaagtcattcgatcattgctcaggcctaacagctatgtaattgttgtagagcacgatcttagtgtcttggactacttatcggactttatttgctgcttgtatggcaaacctggtgcatatggagtggtaacccttcctttctcagtcagagaaggaattaacatcttcttggctgggtttgttccaacagaaaatcttaggttccgggatgaatctcttacgttcaaggttgctgagactccacaggaaactgccgaggaagctcaaacatatgctcgatacaagtatccagccatgagcaaaactcaaggcaatttcaggcttcgtgttgctgagggagaatttactgattctcaaattattgtgatgctgggtgagaatgggaccggaaagacaacatttattcgtatgctggctggtttattgaagcctgactctgtagaaggtggttctgatgtggatatgcctgagtttaacgtttcatacaagcctcagaagattagccctaagttccaatcaactgttagacacttactgcaccaaaaaattcgtgatgcatatacccatccccagtttgtatcagatgttatgaagccacttcttatcgaacaattaatggaccaagaagttgtgaatctttctggtggagagttgcaaagagttgcattatgtctttgtctcggaaagcctgctgacatctatctgatagatgagccaagtgcatatcttgattctgaacagcgaattcacgctgccaaagtcattaagaggtttattcttcatgcaaagaaaacggcttttgtggtcgagcatgatttcatcatggcaacataccttgctgacagagttattgtttacgagggtagaccttcaatcgattgtactgcaaattgtccacaatcattgttgtctgggatgaaccttttcttatcacatcttgacatcacatttaggagagacccaaccaactttcgtccaaggatcaacaaaattgattcaaccaaggacagagaacaaagacgaatt

SEQ ID NO: 4862 - DNA, 1829 bp, Solanum phureja
atatgtcggatcagagattgagccgtatagccgtccttaacagcgacaggtgcaagccaaagaagtgcgggctactatgtaaaaagtgctgcccagttgttaaaactggtaagttatgtatagaggtcactgcaacctcgaagattgctttcatctcggaagagttgtgtattggatgtggtatttgtgtgaagaaatgtccatttgaagcaattatgatcatcaatctgccaaaggatttagacaaggatacaacccatcgttatggtcccaacacttttaaattgcacaggttaccagtccctaggccaggacaggttcttggtctggttggcacaaacggtattgggaagtcaactgccctaaaaattttggctggaaaattgaaaccaaacttggggcgcttcagtaaccctcctgattggcaagagatcttgactcacttccgaggatccgaactgcagaactatttcactcgcattctggaagataacttaaaggcaattatcaagcctcagtatgtcgaccatattccaagggcagttcagggcaatgtcggacaagtgcttgaccaaaaagatgagagaggcgtgaaggaaaaactctgtgttgatctagagctgaatcaagttttggatcgtaatgtaggtgatctatctggtggagagcttcagaggtttgctattgctgttgttgctatacaaaatgcagagatatacatgtttgatgagccctcgagttaccttgatgtgaggcagaggcttaaagctgcccaagtagtcagatccttgcttcgaccagatagctatgtcatcgttgtggagcatgatcttagtgtgcttgattatttgtcggatttcatttgctgcttatatgggaagcctggtgcatatggggttgtgactctacccttctcggtcagggaaggaattaatatatttttggctggatttgttcctacagaaaatctacgtttccgtgatgaatctcttacttttaaggttgctgagatcccacaagaggccgctgaggaaattgaatcatatgcacgttacagatatccaaccatgactaagactcagggtaatttcaagcttaaggttgccgagggtgaatttactgattcacagattgttgtgatgcttggtgagaatgggactgggaagacaaccttcattcgcatgctggctgggctattaaagcctgatgtggtggaaggttctaatgttgagataccagagtttaatgtttcatacaagccccagaaaattagtccaaaatttcaatccaccgtgaggcatttgctacatcagaaaatacgtgattcttatatgcacccccagttttgttcagatgtgatgaagcctctccaaattgagcaattgatggaccaagaagttgtgaacctttctggtggtgagttgcaaagagttgccttaaccctgtgccttggaaagcctgctgatatatatctgatcgatgagccgagtgcttatcttgattctgagcaacgtattgtagcttccaaagtcatcaagagattcattcttcacgcgaagaagactgcatttattgtagagcacgactttataatggcaacttacctggcagatagagtcattgtatacgaggggacgccttccatagattgtgttgcaaatgcacctcaatcattgttgaccggaatgaacttatttttatcacatctgaacatcacatttagaagggacccgactaattttcgtccaagaattaacaaacttgaatcaactaaggatagagagcagaagtcagctggatcctattattatttggatgattaaccagac

SEQ ID NO: 4863 - DNA, 2505 bp, Trigonella foenum-graecum
ctccaatttttgttcgtttcactcaaaccctaagtcccttcttctatctctctaaagaacactcccaatccctcgattctctttcggtttagtcgaacgagccaactccattcttttctcgattcgggttttgtttgcttcgtcatcgtcaacatgtcggatcgattgactcgtattgctatcgtcagcaacgacagatgcaaacccaaaaagtgtcgccaagagtgtaagaagagttgtcctgtcgtcagaaccggaagattatgtgttgaggttacttctgcgtccaaaattgcttacatatctgaggaattgtgcattggatgcggtatttgtgttaagaaatgtccttttgaagccatccaaattatcaacttgccaaaggatttggacaaagataccactcatagatatggtcctaatacttttaagctacacaggttgccggttcccaggccgggccaagtgcttggtttggttgggacaaatggaattgggaagtctactgcacttaaggttttggctggaaaattgaagcccaacttgggtcgtttcacagaaccccctgattggcaggaaattctgacccattttcgaggatctgaattgcagaattactttactcgcattctagaggatgatttgaaggctattatcaagcctcagtatgttgaccacattccaaaagctgtgcaaggaaatgtggggcaggtgctagaccaaaaaaatgagagagatatgaaggaaaagctttgtgctgatcttgagcttaatcaagttatagatcgtaatgttggtgatctttcagggggtgagctccaacggtttgccattgcggttgttgccatccaaaatgctgagatatacatgtttgatgaaccttccagttatctggatgtcaaacagaggctgaaagctgcccaagttgttcgttcattgctcaggcctaatagctatgtaattgttgtcgagcacgatcttagtgttttggactacttatcagactttatttgctgtttgtatggcaaacctggtgcatatggtgttgtaacacttcctttctcagtcagagaaggaatcaatatcttcttgtccggctttgttccaacagaaaatctcaggtttcgggaggtttctcttactttcaaggttgcagagactccgcaggaaagtgccgaggaagctcaaacttatgctcgatacaaatacccaaccatgaccaaaactcaaggcaatttcaggcttcatgtggttgaaggagaatttacagattcacagattattgtgatgctgggcgagaatgggacaggaaagacaacattcattcgtatgctggctggtttgttgaaacctgacactatagaaggtggatctgatgtggagatgcccgagttcaatgtatcatacaaacctcagaaaattagtccaaagtcccaattatctgttagacacttgctacatcaaagaatccgcgatttttacactcatccccagtttatatcagatgtgatgaagccactgcttattgaacagttgatggaccaagaggttcagaatctttctggtggagagttgcaaagagttgccttatgcctctgtcttggaaagcctgcagacatctatctgatagatgagccaagtgcatatcttgattccgaacagcgtattgttgctgcaaaagtcatcaagaggtttattcttcatgcaaagaaaacagcctttatcgtcgagcatgatttcatcatggcaacttatcttgctgacagagttattgtttacgagggtcaaccttcaattgattgtactgcaaattgtccacaatcattgctgactgggatgaaccttttcttatctcatcttgatattacatttagaagagacccaactaatttccgcccaaggatcaacaaacttgaatcaaccaaggacagagagcaaaagaatgctgggtcttattattaccttgatgactgagtttatactcaaaaggcagtctgctcttttgccaatgtaacagtgcatcaatttttagccttttccccaaatctcggcttcaattcatttgatgtcttgccataaaagttggtctttttcctgttgaagatatactttcaatggatatatgtcggttggtgcatatatgtttttgtaatatttaatgcagttgctcatgaccatttttttttagaggactcatgaccagttttgttatgctttgatgggtgaattattactcgagtttatatcggtcatggtttcatattttatgttcgttgagagattcattacgccacagattatgtttatggccatcatcacggctttcataatttatcagttgaatatgtaatgttacttgattttgatgtctggtttctttttagaatctatccctactcagagggtcggtattttaatggttattaatcataattttatatatatttcttgtatgaattgcaggtggctgtttaatgcgactatttagaagcattattattaccc

SEQ ID NO: 4864 - DNA, 2341 bp, Medicago truncatula
ctaaatcccttttctctctctaaaaagaacaaccctaattccccaacactcccattccctaattcacttctctctctctccattcggtttttttgttgcgtcgccgttgtcaacatgtcggatcgattgacacgtattgccatcgttagcaacgacagatgcaaacccaaaaagtgtcgtcaagaatgtaagaagagttgtcctgtcgtcagaaccggaagattatgtgttgaggttacctctgcttcgaaaattgcttacatatctgaggaattgtgcattggatgtggtatctgtgttaagaaatgtccttttgaagctatccaaattatcaacttgccaaaggatttggacaaagataccactcatagatacggtcctaatacttttaagctacacaggttgccggttcccaggccggggcaagtgcttggtttggttgggacaaatggaattgggaagtcgactgcacttaaggttttggctggaaaattaaagcccaacttgggtcgtttcacagaaccccctgattggcaggaaattttaacccattttcgaggatctgaattgcagaattactttactcgcattctagaggatgatttgaaggctatcatcaagcctcagtatgttgaccacattccaaaagctgtgcaagggaatgtggggcaggtgctagaccaaaaaaatgagagagacatgaaggaaaggctttgtgctgatcttgagcttaatcaagttatagatcgtaatgttggtgatctttcagggggtgagctccaaaggtttgccattgcggttgttgccatccaaaatgctgagatatacatgtttgatgaaccttccagttatcttgatgtgaaacagaggctgaaagctgcccaagttgttcgatcattgctcaggcctaatagctatgtaattgttgttgagcatgatcttagtgttttggactacttatcagactttatttgctgtttatatggcaaacctggtgcatatggtgttgtaacacttcctttctcagtcagagaaggaattaatatcttcttgtccggctttgttccaacagaaaatcttaggtttcgagaggtttctcttactttcaaggttgcagagactccacaggaaactgccgaggaagctcaaacttatgctcgatacaaatacccaaccatgaccaaaactcaaggcaatttcaggcttcatgtagttgaaggagaatttacagattcacagattattgtgatgttgggcgagaatgggacaggaaagacaacattcattcgtatgctggctggtttgttgaaacctgacactatagaaggtggatctgatgtagagatgcctgagttcaacgtatcatacaaacctcagaaaattagcccaaagtcccaattatctgttagacacttgctacatcaaagaatccgtgatgcctacactcatccccagtttatatcagatgtgatgaagccactacttattgaacagttgatggaccaagaggttcagaatctttctggtggagagttgcaaagagttgccttatgcctttgtcttggaaagcctgcagacatctatctgatagatgagccaagtgcatatcttgattccgaacagcgtattgttgctgcaaaagtcatcaagaggtttattcttcatgcaaagaaaacagcctttatcgttgagcatgatttcatcatggcaacttatcttgctgacagagttattgtttatgagggtcaaccttcaattgactgtactgcaaattgtccacaatcattgctgaccgggatgaaccttttcttatctcatcttgatatcacatttagaagagacccaactaatttccgcccaaggatcaacaaacttgaatcaacaaaggacagagagcaaaagaatgctggctcttattattacctcgatgactgagtttatactcaaaagtctgctcttttgccaatgtaacagtgcatcaaattgagccttttcctcgaatctcagctttaatttatttgatgccttgccataaaagttggtctttttccgttgaaggcatattttcaacggattgaatagtctacatgtgggcaggacatatgttggttgatacatgtttctgtaatgtttaatgcttttgctcatgaccagtatttttttttttgaggggatgaccagttttgttatgctttgatgggtgagtctgattagtactcagatttatatcggtcgtggtttcacatgatgttctttgtgattcattacgccacagatttagtttatggtcatcatcatggccttcataattcgatcagttggatatgtaacaaagttatac

SEQ ID NO: 4865 - DNA, 2599 bp, Physcomitrella patens
cttcagtgcaagccttctcctgtggctgcttgggctgccggaagggttggcttcgaaacagggtgctaattttctgtgtgttcaattttgctttgggggaagacggtttacgaagtgcagtcggagggttgggagagggaccaggatctgagatcaagatgtcggatcgattgactaggattgctattgtgagctcggatagatgcaagccaaagaaatgtcggcaggagtgtaagaagagttgtcctgtggtgaagacaggtaaactttgcattgaggttacctcgcaagccaaacttgcgttcatttctgaggagctctgtatcggttgtggtatctgtgtaaagaaatgtccttttgaagccatccaaatcatcaatctgccgaaggaccttgacaaggataccactcatcgttatggtcccaataccttcaagctgcacaggttgcctgttccaagacctggacaagttctgggacttgttggaacgaatggtattgggaagtcaactgccctaaaggtgttggctggaaaacttaagccaaaccttggaaggttccttagtccacctgattggcaagaaattttgacgtattttcggggttcagaactccaaaattattttactcgaattttggaggacaacttgaaggcaattatcaagccgcaatatgtcgaccacatccccaaggctgtcaagggtaatgtgggtgaagttcttgctcagaaagatgagagagagatgagatttgaactggcgaaggacctcgacctgaaccaggttcttgaccgtgatgttggtgacctttctggaggagagttgcagcgctttgctattgctgttgtggcgacgcagcatgccgaaatatatatgtttgatgagccttcaagttatctcgacgtaaaacaaaggttgaaagctgcccaagttgttcgatctcttcttcgtcccaacagttacgtcatcgtagtggagcacgacttgagcgtgttggattatctgtctgattttatctgctgcctttacgggaagcctggagcgtatggggtagtgactttgcctttctctgttagagagggcatcaacatctttttggctggttttgttcctactgaaaatttgagatttagggatgagtcccttaccttcaaggttgctgagactcctcaggagagtgccgaggagattcggacgtatgcacgatacaaataccctcaaatgacaaagacgcaaggtggttttaagctgcaggtcaaggaaggagagtttactgattctcaaattattgtcatgcttggagagaatggaactggcaagacaacattcatccgaatgctggcaggtttacttaaaccagatgatgttggcgatagcgatgtggaggttccagagttcaatgtgtcttacaaacctcaaaaaatcagtcctaagtttacatctacagtacgacatcttttgcaccagaagatcagagactcctacatgcacccacagttcaacacggatgtgatgaagcctttacagattgaagccctgatggaccaggaagttattcatctctcgggaggagagcttcaacgtgtggctctgtgtctctgccttggcaagcccgcagacatatacctgattgatgagccgagtgcatatctcgattcagagcagcgtattgtagcagccaaagttattaagagatttattcttcatgcaaagaagacatcgtttgtggtggagcatgatttcataatggcgacgtacttggctgacagagtaattgtgtacgagggacaaccgtctattgactgtatagcaaatacccctcagagcttgctgacgggaatgaatcttttcctctcgcacttggacatcactttccggcgtgacccaaccaactacaggccccgtatcaacaagcgtgattcgacgaaggatagggaacaaaagaacgcagggtcttactactacttagatgactgagtgtccggcattgagttcgcttgcttacctcaaaatcttgcatgagagcactataccagagaacccgtatattgtaccattggttttccccccttagtcaaggtcgcttcaatgagccattgctgggatactcttagagcaccctctaatgtgacgcaaacgtggagtgtccatccctgaactgaccttgggcgcaacttaatctatgtagacttttcttgaaattttcctcgaactactgttcagcacaaagaggtacatcctggttgagagtttcgttttacagcgtggagcataacctgcacaatgtgtgagctctagccttacgctgtgttcgacaactgcggattgctggcttctcagaagcaccatcttcatgttctcggcggtttggacattttattggaattgccgagtggatagcagttgtagttagcaaagataatcaaatatttgatgtccagtgatttatggtttgaccaactatgtttatgatggacgaaattgtacaccagtcatagcatctgtaataaactgtgatcgtatcctgtcaagcaaataggcctctttaatgtaaaaatattgaatttattgaaacgaatcaaatgatccactaccgacag

SEQ ID NO: 4866 - DNA, 2235 bp, Rosmarinus officinalis
aggagtgcaaaaagagttgtcccgttgttaaaactgggaaactttgtattgaggtgactcctttatccaggattgctttcatctcagaagaattatgcattggttgcggtatttgtgttaagaaatgcccgtttgaagccatccagattatcaatttacctaaagatttggacaaggatacaacccatcgctatggtccaaataccttcaaattgcataggttgccagttccaagaccaggacaggtccttggcctggttgggacgaatggaattggaaaatcaactgccctaaaagttctggctggcaaattgaaacctaatttggggcgcttcaataaccctcctgattggcaagagattttgacttatttccgtggatcagaacttcagaattattttactcgtattctggaagacaacttaaaggcaatcatcaaaccacagtatgttgaccatattcccaaggctgtccaaggcaatgttggtcaggtgctggatcaaaaagatgagagagacatgaaagaagaactttgtgttgatcttgagctgaatcaggttttggaccgtaatgtgggggatttatccggtggagagctccagaggtttgccattgcagttgtggcaatacagaatgctgaaatctatatgtttgatgaaccctcaagttaccttgatgtgaaacagaggctaaaagctgctcaagttgtccgctcattgctccgccctaatagctatgtaatcgtggtggagcacgacctgagtgtactggactatttgtcagacttcatttgctgtttatatgggaaacctggtgcatatggtgtcgtaacccttccattctccgtaagagaaggaattaatatatttttggctggatttgtccctacagaaaatctgcgatttagggatgaatcacttacttttaaggttgctgagactccgcaggagagtggagaggaagttgaaacgtatgcacgatataagtatccaaccatgacaaaaactcagggtaatttcaagcttaaggttattgagggtgaattcactgattctcagatagttgtaatgcttggtgagaatgggactggaaaaacaacattcatccgtatgctggctggtttactaaaacctgatttagttgagggctctgatgtggagatccctgagttcaatgtctcctacaaaccacagaagatcagtccaaagtttcagtctagtgtgaggcacttgcttcatcaaaaaatacgggattcatatactcaccctcagtttatatcagatgttatgaagcctctccagattgagcaattaatggatcaagaagttgtgaacctctctggtggagagttgcaaagagttgccctagcactatgccttggaaagcctgccgatatatatcttattgatgaaccaagtgcatatctggactcagagcagcgtattgttgcttcaaaggttataaagaggtttatacttcatgcaaagaagacggcatttgttgtggagcatgacttcataatggcaacatatctggcagatcgggtcattgtatacgaggggaagccatctgtagattgtgtggcaaatgctcctcaatcattgttgaccggaatgaacttattcttatctcatctggatattacattcagaagggatccgaccaattttcgtccaagaataaacaagttggactcaactaaggacagggagcaaaagtctgccggatcctattattacctggatgattaacttgttaatcaacaaggttatagctgtataccttgatcacacacgtctctcgggatccaagatatatatcaagaagctttgcctccccttggctggcatttctctgcaagggcaattcgttttgctcattatgtgatgacgtgacccaacaagaagttctcttccggcagtgcaatctttattcatgcagattgacaaatgcttgccctgtggcttgatggaatgatccattcttctgcttctcgagtacttttcccatgattttctgtggtttagtttgctatgtgcctttcctagccagttttggccttgttggctgagtagatattgaagatttccttttttgtctaatgatatcccctttatattgtatccctgggttgatgtgaggaaacctaaacaaaagagcagcagtagaattaggggggtaatgtgtggattttggtgcgttgggttatggagttcttttctatagttcatcgcc

SEQ ID NO: 4867 - DNA, 1815 bp, Chrysanthemum coronarium
gttttcattcattaatcatctgaaaccctaaaagtcatctatggctgatcgattaacgcgtatcgctatattgaaagaagaccgctgcaaacccaagaagtgccgtcaagagtgcaagaaatcatgccctgttgtcaaaactggtaagctatgtattgaggtcagttctgcatccaaagtggcatatatttctgaggagctttgcatagggtgtggtatatgtgttaagaaatgcccatttgatgcgattgagatcattaatttaccaaaagatttggaaaaagatacaactcaccgttacggggtcaacaccttcaagttacacaggttgcctgtcccgaggcctgggcaagttcttggtttagttggaacaaatggaattgggaagtcgacggctctaaaagtcttggctggaaaattgaaacccaatttgggacgctttaacaaccctccagattggcaagaaattctgacctacttccgaggatctgagttgcaaaactacttcacacgtattctggaagataatctaaaggctatcataaaaccgcagtatgttgaccatattccaaaagcagttcaaggaaatgttggacaagtccttgagcaaaaggatgagagagatgcaaaggcggagctttgtgctgatcttgagctgaatcaggttatagatcgtaatgttggagacttatctggtggagagcttcagaggtttgccattgctgtcgttgccatacaaatggcagaaatatatatgtttgacgaaccttcaagttatcttgatgtgaaacaaaggcttaaagctgcccaagttatccgatccttacttagacctaacagctttgtgattgttgttgagcacgatttaagtgtgcttgattacctatcagacttcatttgctgcctgtatgggaaacctggtgcatatggtgttgtgactctacccttctctgtcagagaaggaataaatatatttttagagggttttgtgcccactgagaaccttcgtttccgcgatgaaagacttacttttagggttgctgagacagcacaggagaccgctgaggagattcaaacatatgcacagtataggtacccaactatgtctaaaacacagggtggttttaaactcaaggcggttgagggtgaattcacagactcgcagattatagtaatgcttggtgaaaatggaactgggaagacaacgtttattcgaatgctggctggtttactaaagcctgataccgtggaaggatctgaggtggagatacctgagtttcacgtctcgtacaagccccaaaagatcagtcccaagttccctcattcagttaggcatttgctgcattcaaagattcgtgattcatatatgcatcctcagtttgtttcggatgtcatgaagcctcttcaaatcgagcagctaatggatcaagaggtcgtgaatctttctggtggtgaattgcaaagagttgctttgtgcctatgccttggaaagcctgctgatatctacctgatagatgaaccaagtgcgtatcttgattctgagcagcgtattgttgcttcaaaggttataaagagattcatactacacgccaaaaagactgcatttgtggttgaacatgacttcatcatggccacttatctagcagatagggtaattgtttatgaagggcagccgtctgttgattgtgttgctaatgcccctcagtcgttattgacgggaatgaatctctttttatctcatttgaccatcacatttagaagggatccaggtaattatcgcccgagaattaacaagctaaattcaacaaaggacag

SEQ ID NO: 4868 - DNA, 1906 bp, Trifolium pratense
caacccaagtcgaaaaaccctttgacagtcgtttactctcacaggcacagcacacacgaaaggaaactccatccgctttgagtcgacatggcagatcgattgactcgtattgctattgttagcaacgatagatgcaaacccaaaaagtgtcgtcaagagtgtaagaagagttgtcctgtagtcagaaccggtaaattatgtattgaggttacttctgcttcaaaaattgcttacatatctgaggaattgtgtattggatgcggtatttgtgttaagaaatgtccttttgaagctatccagattatcaacttgccaaaggatttggacaaagatacaactcatagatatggtcctaatacttttaagctacacaggttgccggttccgaggccggggcaagtgcttggtttggttgggacaaatggaattgggaagtccactgcacttaaagttttggctggaaaattgaagccgaatttgggtcgtttcacccaaccccctgattggcaggaaattttgacccattttcgaggatctgaattgcagaattacttcactcgcattctagaggatgatttgaaggctatcatcaagcctcagtatgttgatcacattccaaaagctgtggaagggaatgtggggcaggtgctagaccaaaagaacgagagagatatgaaggaagagctttgtgctgatcttgagcttaatcaagttatagatcgtaatgttggtgatctttcaggaggtgagctccaaaggtttgccattgcagttgttgcaatccaaaatgctgagatatacatgtttgacgaaccttctagttatcttgatgtgaagcagaggcttaaagctgcccgagttgttaggtctttgctcaggcctaatagctatgtaattgttgtcgagcacgatcttagtgtcttggactatttatcagactttatttgctgtttgtacggtaaacctggtgcatacggagtcgtaacacttcctttctcagtcagagaaggaattaatatcttcttgtccggctttgttccaacagaaaatcttaggtttcgggaggaatctcttaccttcaaggttgcagaaactccacaggaaagtgctgaggaaactgacacttatgctcgatacaaatacccaaccatgaccaaaactcaaggtaatttcaggcttcgtgcagttgaaggagagtttacagattcacagattattgtgatgctgggtgagaatgggacaggaaaaacaacattcattcgcatgctggctggtttgttgaaacctgacgctatagaaggtggatctgatgtggagatgcccgagttcaacgtctcatacaaacctcagaaaattagtccaaagtcccgattatctgttagacaattgctgcatcaaaaaatccgcgatgcatacactcatccccagtttaattcagatgtgatgaagccactacttattgaacagttgatggaccaagaagttatgaatctttccggcggagagctgcaaagagttgccttatgcctttgtcttggaaagcctgcagacatctatctgatagacgagccaagtgcatatcttgattcggaacagcgtattgttgctgcaaaagtcatcaagaggtttattcttcatgcaaagaaaacagcctttatcgttgagcatgatttcatcatggcaaattatcttgctgacagagttatcgtttacgaggggcaaccttcaattgattgtactgcaaattgtccacaatcattggttaccgggatgaaccttttcttatctcatctggatatcacatttagaagagatccaactaatttccgcccaaggatcaacaaacatggatcaacaaaggacagagagcaaaagaatgctcggtcttattattaccttgatgact

SEQ ID NO: 4869 - DNA, 2580 bp, Spinacia oleracea
gtacctacagcccacgaaccaaacacactcgtacctttaaggaattgcgaacaatcgaacaataaaagagtgaacaaaaacacaacagcatctcccttctcctcatttctgctgctgctcgatccctccctggtttttccttaaggttgtggtttttctccttaaactctacaacaaccaggatgtcagaccgtttgacacgtattgctatagtgagctcagatcggtgcaagcctaaaaagtgccgtcaggagtgcaaaaagagctgtcccgtggttaagacagggaaattatgtatcgaggttacaccattaacaaaacttgctttcatctcggaggaactgtgcattggatgcggtatttgtgtcaagaaatgcccttttgaagcaattcagatcattaatcttccaaaagatttgagcaaggatactacacatcgttatggccccaacactttcaaattacataggctacctgtcccaagaccaggacaagttcttggcttagtgggaacaaacggcattgggaagtcaactgctctcaaagttttggctggaaaattgaagcccaatttggggaggttcaataacccacctgactggcaagagatcttaacatatttccgtggatcagaactgcaaaattattttacgcgcatattggaagataatctaaaggccaacatcaagccccagtatgtggataacattccaaaggcagtacaaggaaatgttggagaggtcttagataagaaagatgagagagacatgaagcttgtactctgtgaagatctggagcttaataaagttctagatcgcaaagtgggtgatctatctggtggtgaactgcagaggtttgccattgcagttgtggctatgcagagtggggagatatatatgtttgacgaaccttctagttatttggatgtgaaacagagactcaaagcagcacgggttattagatcattgctgagccccaaaagctatgttattgtcgtggagcatgatcttagtgttttagactatctttcagacttcatttgctgcttatatggtaaaccgggtgcatatggagttgtgacccttccattctctgttagagaaggaatcaatatattcttagcagggtttgtgcccacagaaaatctccgtttccgagaagaatctcttactttcaaggttgctgagactcctcaagataatgctgaggagattgagacgtatgctcggtacaaatatccaacaatgtcaaaagttttgggtaattttaaaatgcgtgtcgtggagggtgaatttacagattcacagattattgtgatgttgggagaaaatggtacagggaagacaacatttatccgtatgctggctggtttactaaagcctgataacgtggaaactggggatgtggaaatacctgaatttaacgtctcttacaagccccagaaaatcagtccaaaattcctgggctctgttagggctcttttacatcagaagataagggattcatacactcatcctcaattcaactcagatgtcatgaaacctcttcagattgagcagttaatggatcaagaagttgtgaatctatctggtggagagttgcagagagttgctttaactttgtgtctgggaaagcctgcagatatttatttgatagatgaaccaagtgcatatctggactctgagcagcgtattgtggcttcaaaggtgataaagagatttatactccacgccaagaagactgcatttgttgttgaacatgattttataatggcaacatacttagcagatagagtagttgtttatgaggggataccatcggtggattgtactgctaattctccccaatcgttgttgaacggaatgaatcttttcttatcgcatctggatatcacatttagaagggaccccactaattatcgcccgagaattaacaagctggagtccgcaaaggacagggagcagaaatcggcagggacttattattacctggatgattgatggagtttgcatttttcaccaagcatctggatatcacaagtaagcttcacccaagcattgagaaactagactccatgaaagacaaggggcagaaatttgacgacaacttattccctggacgattgatgtgaatgtcatgagtttatggaattggatgctggctattgtttgttgaagtctagaagactgaatgttgggaagagattgttttgagggtggcagttttttgtatactgattcgtgttcgtgcggcctatgtactaatgttctatgaagaatgagatctctgctgttttgactaattttgcgccaagtttaggcagtaggtttcaggtttgcttatgctgctgcatgtttgtggttcttattagtgttactgtctgtgtggattcaagtcagaaatagaattaaggttgagatgtcttgtgcgaactaaggttctcacgttgacttacttaatagtctatacaaaagtttagcttgtaacagatgttactcgggcactcatctatacacgattattacacttttaagtgtccaactcacctgtataactgtattccatgtttggtccaaaatg

SEQ ID NO: 4870 - DNA, 1812 bp, Castanea mollissima
cgcgtatagcgattgtgagctctgataggtgcaagcccaagaagtgccgccaggaatgcaaaaaagctgccctgttgtcaaaaccggaaaactctgtattgaggttgctcctgcatcgaagattgctttcatctctgaggaattgtgtattggatgtggtatctgtgtcaagaaatgcccgtttgaagctattcagatcatcaacttgccaaaagatctggacaaagatacaacccatcgctacggccctaacacttttaaattgcacaggttaccagtcccaagacctgggcaagttcttggcctggttggaactaatggcattgggaagtccactgcccttaaagttttggctggaaaactgaaaccaaacctcggtcgcttcaataatcctccagattggcaggaaatcttgacatacttccgaggatctgagctgcagaattattttacacgtattcttgaagataatttgaaggccattataaagccccagtatgttgatcacattccaaaagctgttcaaggtaatgtagggcaggtgctggaccaaaaggatgagagagacatgaagtcagaactctgcgctgatcttcagctgaaccaggttatagaccgtaatgtaggggatttgtcaggaggagagcttcagagatttgctattgctgttgttgctgtacagaatgcagaaatatatatgtttgatgaaccttcaagttaccttgatgtaaaacagaggcttaaagctgctcaagttgtccgttctttgctcaggcctaatagctatgtaattgttgtggagcatgatcttagcgtcctggattacttgtcggacttcatttgctgtttatatgggaaaccgggagcatatggagttgtaacccttcccttctcagtcagagaaggaatcaatatcttcttggctggatttgttccaacagaaaatttacgttttcgggatgaatcccttacctttaaggttgctgagactccacaagaaagtgcggaggaaattgagacatatgcacgttacaaatacccaaccatgaccaaaactcaaggaaatttcaggcttcgtgttgttgagggtgaatttactgattctcagattattgtgatgctgggtgagaatgggactggcaaaacaacatttatccgtatgctggcaggtttactgaaacctgattctgtagaaggttctgatgtggagattcctgagtttaatgtttcttacaagccccagaagatcagtccgaaatttccatccactgtgcggcacttgctacattcaaaaatacgtgattcatacatgcatgctcagtttgtgtcggatgttatgaagcctcttcttattgaacaattaatggatcaagaagttgtgaatctttctggtggagagttgcaaagagttgcattatgcctatgccttgggaagcctgcagacatttatctgatagatgaaccaagtgcatatcttgattctgagcagcgtatagttgcttcaaaagtcattaagaggtttatccttcatgcaaagaaaactgctttcgtggttgaacatgattttataatggcaacttatctggcagatagagttattgtgtatgaggggaggccatcgcttgattgtattgcaaattctccacagtcattgttgactgggatgaatctcttcttatctcatttggatatcacatttagaagggacccaactaatttccgccctagaatcaacaaactggaatcaaccaaggacagggagcagaaatctgctgggtcctattattacctggatgactgacaattttaaat

SEQ ID NO: 4871 - DNA, 2544 bp, Trifolium pratense
caggaaccctaaccctcttctctctcgtgtgattgccgccgccaatccttccccgtccggcaatacacgtcattcccgtgcgccatctctattcaccgatagttgaatataggtggtttgaggcaacatgtcggaccgattgacacgtattgctattgttagcaatgacagatgcaagccgaaaaagtgtcgccaggagtgtaagaagagttgccctgttgtcagaaccggtagactgtgtattgaggtttcttctgcatcgaagattgcttacatatctgaggaattgtgcattggatgtggtatctgtgttaagaaatgtccttttgaagctatccagattatcaacttgccaaaagatttggacaaatataccacttacagatatggtcctaatacttgtaagctacacaggttgccggttccaaggccgggacaagtgcttggtttggttgggacaattggaattggaaagtccactgcccttaaagttttggctggaaagttgaagccaaacttgggtcgtttcactaacccccctgattggcaggaaatattgacctattttcgaggatctgagttgcagaattactttacacgcattctagaggatgatttgaaggcaatcatcaagccccagtatgttgatcatattccaaaagcagtgcaagggaatgtgggacaggtgctagaccaaaagaacgagagagatatgaaggaagagctttgtgctgatcttgagcttaatcaagttatagatcgtaatgttggtgatctttcaggaggtgagctccaaaggtttgccattgcagttgttgcaatccaaaatgctgagatatacatgtttgacgaaccttctagttatcttgatgtgaagcagaggcttaaagctgcccgagttgttaggtctttgctcaggcctaatagctatgtaattgttgtcgagcacgatcttagtgtcttggactatttatcagactttatttgctgtttgtacggtaaacctggtgcatacggagtcgtaacacttcctttctcagtcagagaaggaattaatatcttcttgtccggctttgttccaacagaaaatcttaggtttcgggaggaatctcttaccttcaaggttgcagaaactccacaggaaagtgctgaggaaactgacacttatgctcgatacaaatacccaaccatgaccaaaactcaaggtaatttcaggcttcgtgcagttgaaggagagtttacagattcacagattattgtgatgctgggtgagaatgggacaggaaaaacaacattcattcgcatgctggctggtttgttgaaacctgacgctatagaaggtggatctgatgtggagatgcccgagttcaacgtctcatacaaacctcagaaaattagtccaaagtcccgattatctgttagacaattgctgcatcaaaaaatccgcgatgcatacactcatccccagtttaattcagatgtgatgaagccactacttattgaacagttgatggaccaagaagttatgaatctttccggcggagagctgcaaagagttgccttatgcctttgtcttggaaagcctgcagacatctatctgatagatgagccaagtgcatatcttgattccgaacagcgtattgttgctgcaaaagtcatcaagaggtttattcttcatgcaaagaaaacagcctttatcgttgagcacgatttcatcatggcaacttatcttgccgacagagttattgtgtatgagggtcagccttcaattgactgtactgcaaattgtccacaatcattgctgactgggatgaaccttttcttatctcatcttgatatcacatttagaagagacccaactaatttccgcccaaggatcaacaaacttgaatcaaccaaggacagagagcaaaagaatgccggatcttattattacctcgatgactgagttcatactcaaaagtctgctcttttgccaatgcaacattgcatcaaattgagctttttctcgaatcccagctctaattcatttgatgcattgccaagaaagtttgtcctcttcctgttgaaaggcatctttctcaatggatagaagagtctgcattccggccatatgttggttggtgcatttatatatgtttcagtaatacttaggacctgtttggactaacttttttaagcttatctaccggcacagacacttgtgacaatgtttgggagaacttatgaaaacagcgtatgacatacatgtcataagctgttttcaacttatttcaataagctcttcaagatagcttatgaaaacagcttatagattatacgaagaccattatttgactttattttatctcgtgttatagaaatagcttattcataagtgtttatcatataaacacttatgctataatttgcaaaataggctgtttagtcaaacacggctttagtacatgtacatttgctcatgaccagttttggtatgactatggtgagtgaatcttattatttcttgagtttatatcggtcacattttcatatttgatgttt

SEQ ID NO: 4872 - DNA, 1999 bp, Selaginella moellendorffii
agttgaggtgtgcctccagccgcccaagccgcggtgagggggggcgcgatggatcgcctcactaggatcgcgattgtcagctccgatcgttgcaaacccaagaagtgccggcaggagtgcaagaagagctgccccgtggtgaaaacagggaagctgtgtatcgaggtctcgtccgcatcgaagatcgcatttatttcggaggagctgtgcatcggttgtggtatttgcgtgaagaaatgtccctttgaagcgatacagatcatcaatcttcccaaggaccttgataaagataccacgcatcgatacggagcaaacactttcaagctccacaggctgcctgttccaaggccaggccaggtcttgggtcttgttggcacgaacggtatcgggaaatctactgcgctgaaagttcttgctggaaaactcaagcccaaccttgggaagtttgcgaatccgccggactggcaagagatcttgacatacttccgaggatccgagctacagaactacttcactcgtattctagaagatcacctgaaggccatcatcaaaccacaatacgtcgatcatattcccaaagcagtcaagggcaacgtcggggaagttctctcgcagaaggacgaaaaggatctgaaaacggatctgtgccatgatctggatctaaataacgtcttggaccgagatgtcggggatctgtccggtggggagctccaacgtttcgctattgccgtggtggccgtgcagaatgctgagatttacatgtttgacgagccatccagctatctcgatgtcaagcagaggttgaaagctgctcaggtcgttcgatcccttctgaggccaaatagctatgtgatcgttgtggagcatgacttgagcgtgctagactacctgtccgacttcatctgctgcctctacgggaaaccaggtgcttatggtgttgtgacgcttccattctccgtgagagaaggtatcaacatttttctcgctggattcgttcccacggaaaatctgaggttccgtgatgagtcactcactttcaaggttgctgagagtgctcaagaaagcgttgaggaagtccagacgtacgctcggtacaagtatccgtctatgtcgaagactcaaggaggcttcaagcttcaaatcaaggagggcgagttcacggactcgcaaatcatcgtgatgcttggggagaatggaactgggaagacgacgttcataaggatgctagctggtttgctgaaacctgacgaagtggatgactccgttgacattccggagttcaacgtctcgtacaagccacaaaagatcagtcccaagttccagtcgacagtgcggcatcttcttcactcgaaaatccgggactcgtacatgcatcctcaattcaacacggacgtgatgaagccgctccagatcgaagcgctcatggatcaggatgttgtcaacttatccggtggagagctccagcgcgttgcgctctgcctttgccttggaaagcctgctgatatctaccttatcgacgagcccagcgcttacttggactccgagcagcgtattgtggcatccaaggtgatcaagcgattcatcctccacgccaagaagaccgccttcgtggtggagcacgactttatcatggcgacatacttggcggacagggtcatcgtctacgaggggaggccatcggtggattgcattgccaatccgccccagagtctcctcacaggaatgaatctcttcctctctcacctggacatcaccttccggcgagaccccacgaacttcaggcctcgcatcaacaagctcgactccaccaaagatcgagagcaaaaggccgcgggatcctactactatctcgacgattgagcaagagatatcgtcagcgatctctccttttgcgcaagttttgtatcagtagcaatgtagagtactcatatctaagttctaagctgtgatcgcgctcgtgagtaacttcttcgtaataaaatgatatattacaaatatt

SEQ ID NO: 4873 - DNA, 2129 bp, Amaranthus tuberculatus
cgtcaggagtgcaagaagagctgtcccgtagttaagactggtaaactttgtattgaggtcacttctgcatcaaagcttgcttttatttcagaggaattgtgcattggatgtggtatttgtgtcaagaaatgcccttttgaagccattcaaattattaatcttcctaaaagatcttgacaaggatacaacacaccgttatggtgccaatacttttaagttacataggttacctgtcccgaggccaggtcaagttcttggcttggtgggaacaaatggtattgggaagtcaactgctctaaaagttttggctggaaaattgaagcccaatttgggcaggttcaataatccacctgactggcaggaaattttaacatacttccgcggatctgaattgcaaaattatttcacacgcatattggaagataatctgaaggctattatcaagccccagtatgtggatcatattccaaaggcagtacagggaaatgttggacaggtccttgagcaaaaagatgagagagatatgaaggctgaactctgtgaagatttggagctgaataaagttctggatcgtaatgttggagacttgtctggtggtgaactgcagaggtttgcaattgcagtggtggctatacaaagtgctgagatatatatgtttgatgaaccctcaagttatttggatgtaaaacaaaggcttaaagctgcccgagttgttagatctttgcttaggccaaatagctatgtcattgtggtggagcacgatcttagtgttttagactacctttcagatttcatatgctgcttgtatggtaaaccaggtgcatatggggtcgtcactctgccgtttcctgtagagaaggaatcaatatattcttggcaggatttgtacccacagagaatcttcgtttcgggatgaatctcttacttcaaggttgctgagacacctcaagataatgctgaggatattgacacatatgctcgatacaaataccctaccatgacgaaaactcaaggtggttttagactgcgtgctgtggagggtgaatttacagattcccagattattgtaatgttgggagaaaatggaacaggaaagacaacttttattcgtatgctggctggtctattaaagcctgatacggtggagggttctgatgtggaaatacccgaattcaatgtttcttacaagccccagaagatcagtccaaagttccaaaatactgtgaggcatctattacatcaaaagataagggatatgtatcttcatccccagtttgtttcagatgttatgaagcctcttcagatagagcagttaatggatcaagaagttgtgaatttatctggtggagaattgcagagagttgcattagctttgtgccttggaaagccggcagatatctatttgatcgatgaaccaagtgcatacctggattctgagcaacgtattgtggcttcaaaagttataaagagatttattctccatgcgaagaagactgcatttgttgtcgaacatgattttataatggcaacatatctagctgatagagttattgtgtatgaagggatgccatcagtggattgtactgccaatgctcctcaatcattgttgaccggaatgaatcttttcttatcccatttggatatcacatttagaagagaccctactaattatcgtccaaggattaacaagctagaatccacaaaggatagggagcagaaatctgcaggaacttattactacctggatgattgagattgatgtttggttcatccttcacgacaatttttcagtgtcttatttatttccttttatggagtctgtggtaagtggtaacctctcaaggatgtattgcacaaaagcgttaaacgtgctgctgattatctttttgtcgatatgtcaaagaaggggggtgatgagctgaaaatggttattctcgtttcatctttcatacagatgtatgcttctgatcattactatgtagcattagatctcttctgttatgagcaattttgcactgagtttgggttggcagcttgataattcggctgatttagattctaattagtgacttaaagtggattttgccgaggccaattttggtttgatcagattttatttaatacttcac

SEQ ID NO: 4874 - DNA, 1973 bp, Avena sativa
agtccagcagtgaaacttgcattcatttcggaagagctgtgtattggttgtggtatttgcgttaagaaatgcccattcgatgctattgaaatcatcaatcttccaaaagatttggaaaaagatactactcatcgctatggaccaaataccttcaagttgcataggttgcctgttccaagacctgggcaagtcttgggtcttgttggaaccaatggaattggaaagtcaacagcccttaaagtgttggctggcaagctgaagcctaatttgggacgtttcaaaaatccacctgattggcaagagatccttacatacttccgcgggtctgaacttcagaactattttacacgtatattggaagataatctgaaggctatcatcaagcctcagtatgttgaccacatcccaaaagctgtccaaggaaatgtagggcaagtacttgagcaaaaagatgagcgggatatgaaaaatgagctatgtgttgatcttgaattaaaccaagttattgatagaaatgtaggagatctgtccggtggcgagcttcagagatttgcaatagcagttgttgctgtacaaagtgcagaaatttacatgtttgatgagccatcaagttatcttgatgttaagcagcggcttaaggctgcacgagtcattaggtccttgcttagatccaacagctatgtcattgttgtggaacatgacttgagtgtcctagattacttgtccgactttatttgctgcttatatgggaagccaggagcttacggtgtagtgaccttgccattttcggtccgagaaggtatcaatattttcctcgctggatttgttccaacagaaaaccttcggtttcgagatgaatctcttacatttaagatcgcggagacccaggaaaatgcggaggaagttgcttcgtaccagcggtacaagtaccctaccatgaccaaaacacagggaaacttcaagctctgtgtagctgagggtgaatttactgattctcagattgttgtgatgcttggtgagaatggcacagggaaaactacattcatcagaatgctggctgggctattgaagccagatactgtggaaggaactgagattgaaatccctgagttcaatgtgtcctacaagcctcaaaagattagcccaaagttccagcatccagtgaggcacttgcttcattctaagatacgggattcttatactcatcctcagtttgtgtctgatgtcatgaaaccactacaaattgaggcactcatggaccaggaagttattaatttatcaggtggagagctccaaagagttgcattgtgtctgtgccttggaaagcctgcagatatttatttgattgatgagccaagtgcatatctcgattcagagcagcgcattgttgcttcgaaggttatcaaacgattcatccttcatgcaaagaaaactgcatttattgttgagcacgatttcattatggcaacctacttagcagacaaggttattgtttatgagggccgtgcttctattgattgtactgccaatgcaccgcagtctttggtatctgggatgaataaattcttatcgcatcttgacattacgtttagaagagacccgaccaactataggccccgaattaacaaactggaatctacaaaagacagagaacaaaagaatgcaggatcctactactaccttgatgactaatgagattcttctgggagaacttcatgcccgtaatgtttgaatccgttggacttatatacacaaggctaactggaagctggcactacatgagacgcgtggaaataattgctagacaaaatgaaagaagcacatttagtgaagtgcttgggttataaagcagtgcacgtgatcctgttactgtatttttgttttgacctctatgattcgacggaagttgaggtcttgaggggagaacgattatcagtttttgtgtatttgcattgttgtatcatggctttacc

SEQ ID NO: 4875 - DNA, 2394 bp, Trifolium pratense
caacccaagtcgaaaaaccctttgacagtcgtttactctcacaggcacagcacacacgaaaggaaactccatccgctttgagtcgacatggcagatcgattgactcgtattgctattgttagcaacgatagatgcaaacccaaaaagtgtcgtcaagagtgtaagaagagttgtcctgtagtcagaaccggtaaattatgtattgaggttacttctgcttcaaaaattgcttacatatctgaggaattgtgtattggatgcggtatttgtgttaagaaatgtccttttgaagctatccagattatcaacttgccaaaggatttggacaaagatacaactcatagatatggtcctaatacttttaagctacacaggttgccggttccgaggccggggcaagtgcttggtttggttgggacaaatggaattgggaagtccactgcacttaaggttttgtctggaaatctgaagcccaacttgggtcgtttcacagacccccctgattggcaggaaattttgactcattttcgaggatctgaattgcagaactactttactcgcatgctagaggatgattcgaaggctatcatcaagcctcagtatgtcgacaacattccaaaaaatgtgcaagggaatgtggggcaggtgctagaccaatataatgagagagatatgaaggaaagcctttgtgctgatcttgagcttaatcaagttatagatcgtaatgttggtgatctttcaggaggtgagctccaaaggtttgccattgcggttgttgccatccaaaatgctgagatatacatgtttgatgagccttctagttatcttgatgtgaagcagaggcttaaagctgcccgagttgttcggtctttgctcaggcctaatagctatgtaattgttgttgagcccgatcttagtgtcttggactacttatcagactttatttgctgtttgtatggtaaacctggtgcatatggagtcgtaacacttcctttctcagtcagagaaggaattaatatcttcttgtccggctttgttccaacagaaaatcttaggtttcgggaggactctcttaccttcaaggttgcagagactccacaggaaactgctgaggaagctcactcttatgctcgatacaaatacccaaccatgaccaaaactcaaggtaatttcaggcttcgtgtagttgaaggagagtttacagattcacagattgttgtgatgcttggtgagaatgggacgggaaagacaacattcattcgtatgctggctggtttgttgaaacctgacgctatagaagggggatctgatgtggagatgcctgagtttaatatttcatacaaacctcagaaaattagtccaaagttccgattgtctgttaggcacttgctgcatcaaaaaatccgtgattcatatactcatccccagtttatttcagatgtgatgaagccactacttattgaacagttgatggaccaagaagttgtgaatctttctggtggagagttgcaaagagttgccttatgcctttgtctcggaaagcctgcagatatctatctgatagacgagccaagtgcatatcttgattctgaacagcgtattgttgctgcaaaagttatcaagaggtttattcttcatgcaaagaaaacagcctttgtggttgagcatgatttcatcatggcaaattatcttgctgacagagttatcgtttatgagggtcaaccttcaattgattgtattgcaaattgtccacaatcattgcttactgggatgaaccttttcttatctcatcttgatatcacatttagaagagacccaactaatttccgcccaaggatcaacaaacttgattcgaccaaggacagagagcaaaagcatgctggttcttattattaccttgatgactgactttatactcaaaagccagtctgctctcttgccattgcaacagtgcaccgatttgagcttcccattttttatttatttgatgccttgacatatgagatagtccttttgctttgacatacaagagtctgctgcatgcagagcatatgttggttggtgcatttgtatatgtatccgtgatacttggtgattttcctcatggccagttttggtatgattttggcctgtgaatctgcttattactcggtttaatatcggccatgttccttgagcgaataatgatgccacagattaagtttatgcccatctcagctctcataatttgtctgttgaatatgtaacgaagtatacattcacttccatgttacttgattttgttagatggtttctttttggaatataatgctacttagaggattgatgttttaatggttatcatggcgtttttagatgaaattactggcagctgtttaatgcactattagaaac

SEQ ID NO: 4876 - DNA, 2469 bp, Medicago truncatula
gtcatattattagcccatgcaaaactatcgtgcttccgaagaagaaccctaacattcccattccctcgattcgattctcgacccaactccaatcctttctggattcagcgagcacttcaattttgtattctctctcaattcaattcaattcaattcattttctgattgtaatttgggatttaggttttgtttgctgcaacatgtctgatgaacgattgacgcgtattgccatcgttaacaacgacaaatgcaaaccgaaaaagtgtcgtcaagagtgcaagaagagttgtcctgtcgtcggaaccggaaaattatgtgttgaggttacttctgcgtccaagattgcttacatttccgaggaattgtgcattggatgcggtatttgtgttaagaaatgtccttttggagccatcgaaattatcaacttgccaaaaaatttggacaaagataccactcatagatatggtcctaatacctttaagcttcacaggttgccggttcccagaccggggcaagtgcttggtttggttgggacaaatggaattgggaagtccactgcacttaaggttttggctggaaaactcaagcccaacttgggtcgtttcacggaaccccctgattggcaggaaattttgacccactttcgaggatctgaattgcagaattactttactcgcattctagaggatgatttgaaggctatcattaagcctcaatatgttgaccacattccaaaagctgtgcaagggaacgtggggcagacgctagactcaaaaaatgagagagatatgaaggaaaaactttgtgctgatctcgagcttaatcaagttatagatcgtaatgttggtgatctttcagggggtgagctccaaaggtttgccattgcagttgttgccatccaaaatgctgagatatacatgtttgatgaaccttccagttatcttgatgtgaaacagaggctgaaagctgcgcaagttgttcggtcattgctcaggcctaatagctttgtaattgttgtcgagcacgatcttagtgttttggactacttatcagactttatttgctgtttgtatggcaaacctggtgtatacggtgttgtgacactccctttctcagtcagagaaggaattaatatcttcttgtccggcttcgttccaacagaaaatcttaggtttcgggaggtctctcttactttcaaggttgcagagaatccacaggaaactgctgaggaagctcaaacttatgctcgattcaaatacccaaccatgaccaaaactcaaggcaatttcaggcttcatgcagttgaaggagaatttacagattcacagattattgtgatgctgggcgagaatgggacaggaaagacaacattcattcgtatgctggctggtttgttgaaacccgatactacagaaggtgtatctgacgtggagatgcccgagttcaacgtatcatacaaacctcagaaaattagcccaaagtcccaattacctgttagatacatgctacatcaaaaaatccgtgatgcatatactcatccccagtttatatcagatgtgatgaaaccactacttattgaacagttgatggaccaagaggttcagaatctttctggtggagagttgcaaagagttgccttatgcctttgtcttggaaagcctgcagacatctatctgatagatgagccaagtgcatatcttgattcagaacagcgtattgttgctgcaaaagtcattaagaggtttattcttcatgcaaagaaaacagcctttatcgttgagcatgatttcatcatggcaacttatcttgctgacaaagttatcgtttatgagggtcaaccttcaattaattgtactgcaaactgtccacaatcattgcttaccgggatgaaccttttcttatctcatcttgatatcacatttagaagagacccaactaattttcgcccaaggatcaacaaacttgaatcaacaaaggacagagaacaaaagaatgctgggtcttattattaccttgatgactgagtttaacaatggaggtctgtctgggtaacaatggaggtctggacgatgatctgggtaacaatggaggtatggctaacaatggaggtggttttgatggtttcaattttgatggagcttatgcagaatgattagtatttttttttaattcaccagatttacttttttgctcccatggtacatgttgggaatcttggtttagctttgtttttatgttctagaaacatggttaattactttgattgttgatagtttatattcaaaatatagtaatgaccattatcctctccgaagaaaagtgagtacgttgataaaacgaatataacgagaataataacatttaaataatttcctagatgtgtcatatttatgattgggacttttatactccaaaatttgtacggaaatgatgttttacagctatttataatagttttgggacaaatct

SEQ ID NO: 4877 - DNA, 2232 bp, Pennisetum glaucum
atcaccacccctcttcatcctcggagccttcctcccggcggcggcggaagaaggaagagatggcggaccggctgacccgtatcgcgatcgtcagcgaggacaagtgcaagcccaagaagtgccgccaggagtgcaagaagagctgccccgtcgtcaagaccgggaagctttgcattgaagtgacttcggcgtccaaactcgctttcatttctgaggagctgtgcattggttgtggtatctgtgttaagaaatgcccatttgatgccattgaaatcatcaaccttcccaaggatttggaaaaggataccactcaccgatacgggcccaataccttcaagttgcacaggttgcctgtcccaaggcctggtcaggttttgggccttgttggaacaaatggaattggaaagtcgactgcactcaaagttttggctggcaagctgaaacctaatctgggacgcttcaaaaacccacctgattggcaggaaatccttacatacttccgtgggtctgaacttcagaactacttcacacgcatattggaagataacctgaaggcaatcatcaaacctcagtatgtcgatcacattccaaaagctgttcaaggaaatgtaggagaagtacttgcacagaaggatgagagggatatgaaaactgagctgtgtgttgaccttgaattaaaccaagttattgaccgaaatgtaggggatctgtctggtggtgagctccagagatttgcaatagcagttgttgctgtacaaaatgcagaaatttacatgtttgatgagccatcaagttaccttgatgtcaggcagaggcttaaagctgcacaagtcattaggtctttacttaggcccaacagctatgtcattgttgttgaacatgacttgagtgtcttggattacttgtccgacttcatttgctgcttatatggaaaaccaggtgcttatggtgtggttaccttgccattctcagttcgagaaggcatcaatattttcttggctggctttgttccaacagagaatcttcggttccgagatgaatctcttacatttaagattgcagagactcaagaaagtgctgaggagattgagacatatcaacggtacaagtaccctaccatgagcaaaacacagggaaatttcaagctaactgttgttgagggtgaatttactgattcccagattgttgtgatgcttggtgaaaatggtacagggaaaactacgttcatcagaatgctggctgggttgttgaagcctgacacagtggaaggaactgatattgaaattcctgaattcaatgtgtcgtacaagccccagaagattagtcctaaattccagaataccgtgaggcatttgcttcatcagaaaatacgtgattcttatatgcaccctcagtttgtgtctgatgtcatgaaaccactacaaattgagcaactcatggaccaggaagttattaatttatcaggtggagagctccaaagagtggctatatgcctctgcctgggaaagcctgcagatatctacttgattgatgagccaagtgcttatcttgattcagagcagcgtattgttgcctcaaaggttatcaaaagattcattcttcatgcgaagaaaactgcatttattgttgagcacgatttcatcatggcaacctacttggctgacaaggtcattgttatgaggggcggccttccattgactgtactgccaatgcaccacagtctttggtatctgggatgaataagttcttatcgcatcttgacattaccttcagaagagacccgaccaactacaggccccgtataaacaagctggagtccacaaaggacagggagcagaagtcagctggatcctactactacctcgatgactaatcagcaattacagaaacttctcagagagctttctgcgcatgatctttccaggctgtgggaaagctgaggctagattgaagctgccaactacatcacggcatgagacttgttgaataattggctgcaaggagtaaagcgcactgattaacttataaagcagagcatgctgtgttgatagtttgataccgagttttttgttggcttgatctatcaatatgacaaaggaagatgagatcagtgttaaagttgagttttgccaggagagattatggctagtagtttctgtttattttgctatacttcactgttgatttgccatcgagtaactgaaatcccagatttgatagatgacattaaag

SEQ ID NO: 4878 - DNA, 2003 bp, Avena sativa
gttagtccagcagtgaaacttgcattcatttcggaagagctgtgtattggttgtggtatttgcgttaagaaatgcccgtttggcgcaattgagatcataaacattccaaaagacctggagaaggataccacccatcgctacgggccaaatgccttcaaattgcataggttgcctgttccaagacctgggcaagtcttgggtcttgttggaaccaatggaattggaaagtcaacagcccttaaagtgttggctggcaagctgaagcctaatttgggacgtttcaaaaatccacctgattggcaagagatccttacatacttccgcgggtctgaacttcagaactattttacacgtatattggaagataatctgaaggctatcatcaagcctcagtatgttgaccacatcccaaaagctgtccaaggaaatgtagggcaagtacttgagcaaaaagatgagcgggatatgaaaaatgagctatgtgttgatcttgaattaaaccaagttattgacagaaatgtaggagatctgtctggtggtgagcttcagagattcgcaatagcagttgttgctgtacaaagtgcagaaatttacatgtttgatgagccatcaagttatcttgatgttaagcagcggcttaaggctgcacgagtcattaggtccttgcttagatccaacagctatgtcattgttgtggaacatgacttgagtgtcctagattacttgtccgactttatttgctgcttatatgggaagccaggtgcttacggtgtagttacattgccattttcggtccgagaaggtatcaatatattcctggctggatttgttccaacagaaaaccttcggtttcgagatgaatctcttactttcaagatcgcggagacccaggaaaatgcggaggaagtagcttcgtaccagcggtacaagtaccctaccatgaccaaaacacagggaaacttcaagctctgtgtagctgagggtgaatttactgattctcagattgttgtgatgcttggtgagaatggcacagggaaaactacattcatcagaatgctggctgggctgttgaagccagatactgtggaaggaactgagattgaaatccctgaatttaatgtgtcctacaagcctcaaaagattagcccaaagttccagcatccagtgaggcacttgcttcattctaagatacgggattcttatactcatcctcagtttgtgtctgatgtcatgaaaccactacaaattgaggcactcatggaccaggaagttattaatttatcaggtggagagctccaaagagtggcatgtgtctgtgccttggaaagcctgcagatatttatttgattgatgagccaagtgcatatctcgattcagagcagcgcattgttgcttcgaaggttatcaaacgattcatccttcatgcaaagaaaactgcatttattgttgagcacgatttcattatggcaacctacttagcagacaaggttattgtttatgagggccgtgcttctattgattgtactgccaatgcaccgcagtctttggtatctgggatgaataaattcttatcgcatcttgacattacgtttagaagagacccgaccaactataggccccgaattaacaaactggaatctacaaaagacagagaacaaaagaatgcaggatcctactactaccttgatgactaatgagattcttctgggagaacttcatgcccgtaatgtttgaatccgttggacttatatacacaaggctaactggaagctggcactacatgagacgcgtggaaataattgctagacaaaatgaaagaagcacatttagtgaagtgcttgggttataaagcagtgcacgtgatcctgttactgtatttttgttttgacctctatgatttgacggaagttgaggtcttgaggggagaacgattatcagtttttgtgtatttgcattgttgtatcatggctttaccatctggtattcttcaatccttgaattat

SEQ ID NO: 4879 - DNA, 2421 bp, Capsicum annuum
ctaaataaaatagatccaaaccaaataaatgtcggtttcttaaatcgcgtagatcctatttaaggtcacgtgtggttttccttaaaagaaccaaattggaaaacagaaaataaatagtgaaattcaaaatcagccctattactatgtgaagaacaatataattaacagccgtgccatccacactcctctctctctctctctctaaaatctctctattaggggttatagagaatcagatttggtgaagagagacgatgtcggatcagagattgacccgtattgctatcgttagcgccgacaagtgtaaacccaaaaagtgccgtcaagaatgcaagaagagttgtccagttgttaaaactggtaagctctgtatagaggtcagtgctgcctcgaagattgctttcatctcagaggagctgtgtattggatgtggtatttgtgtaaagaaatgcccatttgaagcaattcagatcatcaacctgccaaaagatttggacaaggatactacccatcgttatggtcccaacacttttaaattgcacaggttacctgtccctaggccaggacaggttcttggtctggttgggacaaatggtattggaaagtcaactgcccttaaagttttggctggaaaattgaaaccaaacttgggacgcttcagcgtactaatctctgccatcttcatcatttgtcaatttctgccatacggttgcttatgctttctttattcttttctgtggcagaaccctcctgattggcaagagatcttgactcactttcgaggatctgagttgcagaactacttcactcgcattctggaagataacttaaaggcgattatcaagcctcagtatgtcgaccatattccaaaggctgttcaaggaaatgtcggacaagtgcttgaccaaaaagatgagagagacgtgaaggaaaaactctgtgttgatctagagttgaatcaggttttggatcgtaatgtaggtgatctatctggtggagagcttcagaggtttgctatcgctgttgttgcaatacaaaatgctgagatatacatgtttgatgagccctcaagttaccttgatgtgaagcagaggcttaaagctgcccaagttatcagatccttgcttcggccaaatagctatgtcatcgttgtggagcatgatcttagtgtgcttgattatttgtcggatttcatttgctgcttgtatgggaagcctggtgcatatggggttgtgaccctaccgttctcagtcagggaaggaattaatatattcttggctggatttgtgcctacagaaaatctacgttttcgtgatgaatctcttacttttaaggttgctgagaccccgcaagaggctgccgaggaaattgaatcatatgcacgttacagatatccaaccatgaccaagactcaaggtaatttcaagctgaaggttgctgagggtgaatttactgattcacagattgttgtgatgcttggtgagaatggaactgggaagacgaccttcattcgcatgctggctggtctattaaagcctgatatggtggaaggatctgatgtcgagataccagaattcaatgtttcatacaagccccagaaaattagtccgaaatttcaatccactgtgaggcacttgctacatcaaaaaatacgcgattcttatacacatccccagttttgttcagatgtgatgaagcctttgcaaattgaacaattgatggaccaagaagttgtgaatctttctggtggagagttgcaacgagttgccttagccctttgcctcggaaagcctgctgatatatatctgatcgatgagccaagtgcctatcttgattctgagcaacgtattgtagcttcaaaggtcatcaagagattcattcttcatgcaaagaaaactgcgtttgtcgtagagcatgactttataatggcaacttacctggcagatagagtcattgtatacgaggggaaaccttccatagattgtgttgcaaatgcaccccaatcattgttgactggaatgaatctatttttatcacatctgaacattacatttagaagggacccaactaattatcgtccaagaatcaacaaactggaatcaacaaaggatagggagcagaaagcagctggatcctattattatttggatgattaaccacagacaggtgctaattgatgatcacaccagtagcctctggtcatttagacttatgcctgacatgattctgagaggttgatgtcaatggttgggtgtgagcagaatgccttttgtttcatcgttggtttttatacgatttagtaattattactggtattatgtactcataatgtagttttgttcaccaattttgactgcagagggagtagtttatcctcggatttttcattttgtatgttgatctttgacacatgaatgaggc

SEQ ID NO: 4880 - DNA, 6166 bp, Solanum lycopersicum
aagtaacgcgtggaatcattaaaatatctcattcacaaaacagccttcaaatactccattcgtaggtccaatcgtattgttaaacaaaactttcgttcaacttctcaaggggaaaaatctactgtttttgggttgaggattgtcctattctgaaactgaatttggatgctttagcaaatgaggattttgtcctcttgcatgatttgagatctgttttaatttgagttttgtctttttcaggtgtactataaacaaatagtcatgcaactttagattagttccttttgtttcattagatttagtcacttttccttctttattatccacccctttaaaaaaggcctctactttcccctcaaaaatgcaagttgtttccaacttatatccaaaacaaagaaaaagaacttttgatgcttctaatctttagttgtgaaggtctttttttccctaagggtgatctgaaaacttattcagtactggaggcaagggcactgtatagaaattcataaaaatgtactagtgaaatatgggaggtggtaaggatgattctgataagggaatctttagcaatatagcgggaggtatgagtcatcttgctggtggtcatcacggacatccaggacagtatcctccacagcacggtggttaccctccgcagcaagggtatcctcctcaagggtaccctcctcaacaagggtaccctccacagcaagggtatccaccgcagggttatcctccgcaaggaggatatcctccacaacaaggatatcctccacaagggtatcctcctgcaggtcatcatggtgctccacagcatcagtcaggacatggtggcatgggggtaatgttagctggaggtgctgcagctgcagctgctgcttatggcgctcataagctgtctcacggacacggtggatctcacatgggaggacatggtatgccatttgttggaggcgccagtcattatggaggaggcaagtttaagcatggcaagggagggaaattcaaacatggaaagcacggcaagtttaagcatggcaagggagggatgttcggaggtaaattcaagaagtggaagtaaactaggtacagtatcgaagacttcagctggctttacagtgttctaatgttcgtctctttaaataagacatactacatgttattatggcctatatgtggcctgtgagatattgtcttgctatgcattttcaattactaatttgagtgagtttctgcagtcgaaaagctcccataggggcataaactttccttatttcttcctatcttcttctgtattcgcgctcattcgcttcgtttcctagcttttttgtacagtattgcagtactactaactccatggttgaaaaagttgcagactttttttttctagtcttgttatcaattgtttgtttctgtgtgagtttaataaattgtgaagccgagttgtttgcgtttgggatttttatatcggatgtctcaagttggcaaagagtttaccttctgggttgagctctatcacaccggactagtgtgggttacctctacaattggattaaaatgttcagtgaggaagagctttttggcccataatggtgaacttttagtggggaagaatctcttttagttatatttcccactacaaaagcataaataatttaggggaatctatgagaagacatatgttctcttcttttttttaaaaaaaaaaaccttgttctgtttttattttttagaatagtcttcaaaagcacaaaacgttttatgtatttttgcataatatttgacaagctccacaaaaatgtgtatatatatccatttaatctttttacaaattttaataatttataagaacatttttatgtaccatccatttcaagtgattatctaaaaaaaaatctcttagatttcatattggtctaaattacttcaaaacaattgtggattattgcacatgaaatcaaacacgagatagattcttaatacgacaaatatactgtttcatcgaatatgtactttcagaatattaaattcatgtatcaaataagttcaaattatttcatgtaaaatcactctcctggaatttcaatttcatattggatttacttttttttattattataaatgttgaatatttgcttctcagattgggcctatctattatattattatttggtctcaaatgctttggccccaagaaatatttattgaatttttttctttaatttatcgatattcaatagggacattttacttgaaagttgaaactttaaactcaaataataacaaacactccgataaatttatgatttgttaaatgtggaatatattgttgtttttcaagtatgaaaaaatgggttgaacttggtgtttatttagtaagataaatttacaatttgttgaagtattataaattataatcatgttgttacaccaagaatatatatgtaaaatccctaagatatttttgtcaagtaacatattaaaaagaattgattagtaaactagtcacaatttctaatttaattagtacaaatatctacactttaaaatatttatttaaaatgttaatattttaagaataacttgtattcaaatactattatttgtctttccttttatttatttctcaaaacagtcttacattaaatacattcattatccatttagacttcttcctaaactttaatgggcaactttcacgtataacaaataaaaaattcatatttgtatgctaaaacaaagtttgcataattgtgcttcatagcaaacatagaaactgttgtataattcgctatacatacacagttggagcaaattgtataaaacgaagtgtataaaacaagaaagagaaagacacttgggtagaaaactgtataaaacgaattgtattattataagtgtataaaacgagtatatacaatttgaatttgtataaaatgagaaagagagaaagacaaaagagacttgacaaggaatatacaattgaatcaaattgtataaaacgagaaagagataaattagatacaatttgaaaattgtataaaacgaggaagagagaaagacaaaaaaactgagcaggggagtatttttattatataattataagtgtataggacgaaaatatacgtacttgcatgtgtatatacaattttctcacgctttatacaaacagaaacgccatttatacattttgcttctgtttgtataattgagaaaggcgagggtggcgagcgagatctggaagaggggagagaagggaacaaagatatatgtatttatacaattttctctgctttatataattagaaataatttttatacacttgtatttgtataaaaagtgaggaagcgagcgagaaattggaggagagtggcgagcgagatatttgtgagagagacgcctgacaatttttcgcaaacgtttgctatggagcatagttaaatcaaaccctagctactccatttattttaggttattagtttgcttttatatacaattttctcaactttaataccgttaaatttattctcatctttaaggttttcaatttttttttcttattcaagttcataccaatttgctcagatctatcgattaaaaattgatgatgtggccgaattataattgatcacatgtcaaaaatgattttacaaaatcaccgttaaaaaaataatggcatgaatgaactttttcttttacaataatggcataaatgatctaaatttttaactggtgacatatatgagccttttgtgaaagtttgatactttgagcttctccctctgaataatgcaaatcttaaaaatcaaataaataaaaaatatataaatcaaatacgtaacaaattaaaaataaagaatatataacaaattaaaatattgaaattctattagttttataattgtcaattaattaagttgatttgatcctaattaaggttaagttttatattttgtagttctccttcaaaacaatcccaactaggaattgtaaaacacaactctaaaatcgatccttttagtgtgaaagagagatatgtcgaatcagaaattgagccgtatcgccatccttaacagcgacaggtgcaaaccgaagaagtgcgggctacaatgtaaaaagtgctgcccagttgttaaaactggtaagttatgtatagaggtcactgcaacctcgaagattgctttcatctcggaagagttgtgtattggatgtggtatttgtgtgaagaaatgtccgtttgaagcaattatgatcatcaatctgccaaaggatttagacaaggatacaacccatcgttatggtgccaacacttttaaattgcacaggttacctgtccctaggccaggacaggttcttggtctggttggcacaaacggtattgggaagtcaactgccctaaaagttttggctgggaaattgaaaccaaacctgggacgcttcagtaaccctcctgattggcaagagatcttgactcacttccgaggatccgaactgcagaactatttcactcgcattctggaagataacttaaaggcaattatcaagcctcagtatgtcgaccatattccaagggcagttcagggaaatgtcggacaagtgcttgaccaaaaagatgagagagacataaaggaaaaactctgtgttgatctagagctgaatcaggttttggatcgtaatgtaggtgatctatctggtggagagcttcagaggtttgctattgctgttgttgcaatacaaaatgcagagatatacatgtttgatgagccctcgagttatcttgatgtgaggcagaggcttaaagctgcccatgtagtcagatccttgcttcgaccagatagctatgtcatcgttgtggagcatgatcttagtgtgcttgattatttgtcggatttcatttgctgcttatatgggaagcctggtgcatatggggttgtgaccctacccttctcggtcagggaaggaattaatatatttttggctggatttgttcctacagaaaatctacgtttccgtgacgaatctcttacttttaaggttgctgagatcccacaagaggtcgctgaggaaattgaatcatatgcacgttacagatatccaaccatgactaagactcagggtaatttcaagcttaaggttgccgagggtgaatttactgattcacagattattgtgatgcttggtgagaatgggactgggaagacaaccttcattcgcatgctggctgggctattaaagcctgatgtggtggaaggttctaatgttgagataccagagtttaatgtttcatacaagccccagaaaattagtccaaaatttcaatccactgtgaggcagttgctacatcagaaaatacgtgattcttatatgcacccccagttctgttcagatgtgatgaagcctctccaaattgagcaattgatggaccaggaagttgtgaatctttctggtggtgagttgcaaagagttgccttaaccctgtgccttggaaagcctgctgatatatatctgattgatgagccaagtgcctatcttgattctgagcaacgtattgtagcttccaaagtcatcaagagattcgttcttcacacgaagaagactgcatttgttgtagagcatgactttataatggcagcttacctggcagatagagtcattgtatacgaggggacaccttctatggattgtgttgcaaatgcacctcaatcattgttgaccggaatgaacttatttttatcacatctgaacatcacatttagaagggacccgactaattttcgtccaagaattaacaaacttgaatcagccaaggatagagagcagaagttagctggatcctattattatttggatgattaaccagaccaagttgcatccatgatccttgcttacctcttccattaggtgctaatcgatgatcatgagcagcctctggttatttatatcatagatgtctaacgtgattatcgtaggttgattctcagtgaacatatattagatatcagcagaatacgtttctctttagtcgttggtttttatagtaattattactggtatcatgtactcaaaataccgcaattttgtcctccaattttgaccgttaagagattactctctcctcagattttcattttgtacatgaatttttggcaaataattgaggcattt

SEQ ID NO: 4881 - DNA, 1828 bp, Musa acuminata
acaagatccgccaccttatatacgtcggccggagtcctagctagggttctagaccacttcggctggcgagcatcggcagcgagtggtggtcttatttttgaggcgtcgctagggccacgtcccctccatcatggccgatcggttgacccgtatcgctatcgttagctctgatcgatgcaaaccaaagaagtgccgacaggagtgcaagaagagttgccccgtcgtgaaaacaggaaaactttgcatagaagtaactcctgcctcaaagattgctttcatatctgaggagttatgcattggatgtggtatctgtgttaagaaatgtccttttgaggccattcagattatcaatctaccaaaggacttagacaaagacacgacccaccgttatggaccaaatacatttaaattgcacaggttgccagttccaagacctggacaagttctgggcttggttgggacaaatggtattggaaagtctaccgcacttaaagtgttggctgggaagttgaagcccaacttgggtagattcaataatcctcctgattggcaggagattttaacatatttccgtggctctgagcttcagaattattttacacgtatactggaggacaatctaaaggcaatcatcaagccgcagtatgttgatcacattccaaaagctgttcaaggtaatgttggacaggttcttgaccaaaaagatgagagagagatgaaagcagagctttgtaatgacctagaattgaatcaagttattgatcgaaatgtgggggacttgtctggtggagagttgcaaagatttgctattgctgtggttgccatacaaaatgcagagatttatatgtttgatgagccatcaagttatctcgatgtgaagcagaggcttaaagcagctcaagttatccgttccctacttagacgtaacagctatgtgattgttgtagagcatgatctcagtgtattggactacttgtccgatttcatttgttgtctctatggaaagccaggagcttatggagttgttacgctacccttctctgtacgagaaggaatcaacatttttttggctggttttgttcctacagaaaatctccggtttcgagatgaatcacttacatttaaggttgctgagactcctcaagaaagtgctgaggagattcagacgtaccaacgatataaatatcctaccatgagtaaaacccaagggaatttcaagcttaaagtgatcgagggtgaatttacagattctcagattattgtaatgctgggtgagaacgggactgggaagacaacatttattcggatgctggcaggattgctgaagcccgattctgtggaagattcagattttgagatgcctgaatttaatgtttcatataagcctcagaaaattagtccaaagtttccatctacagtgagacacttgctgcatcaaaaaattcgcgattcatatatgcatccgcaatttgtgactgatgttatgaagccattgcaaattgaacaattgatggaccaagaagttgtgaacctttctggtggagaactgcaaagagtagcattgtgtttgtgtcttgggaagccagcagatatttatctgatagatgaaccaagtgcttatcttgattcggagcagcgtattgtcgcctcaaaggtgataaagagatttatccttcatgccaagaaaactgccttcgttgttgagcatgatttcatcatggcaacctacctggctgataaggtcattgtatatgagggaaggccctctatagattgcactgcaaatgcacctcagtctttggtatccggaatgaacctgttcttatct

SEQ ID NO: 4882 - DNA, 2175 bp, Papaver somniferum
aaagtgccgccaggagtgcaaaaagagttgccccgtcgtcaaaaactgggaaactgtgtattgaggtaaccgtagctgcaaagattgcttacatatctgaggagttgtgtattggatgtggtatctgtgtcaagaaatgcccatttgaagccattcagattatcaacttgcctaaagatttggacaaggacacaactcatcgttacggtcccaacactttcaagctgcacaggttaccggtgccaagaccaggacaagttctaggtttggtcggaactaatggaattggaaaatctacagccctcaaagtcttggcagggaagctgaagcctaatttgggtcgtttcaataacccacccgattggcaggaaatattgacatacttcagagggtctgagcttcagaactatttcacccgtatcttggaagataacttgaaggcgatcatcaagcctcaatatgtggatcacatcccaaaagcagtccaagggaatgttgggcaagtactggagcagaaagatgagagaggtgtgaaagaggacctgtgtcgtgatcttgagctcaatcaggttatagagcgaaatgtcggtgatctgtcaggtggagagctgcaaagatttgctattgctgttgttgccatacagaatgcagagatttatatgtttgacgagccttccagttaccttgatgtgagacagaggcttaaagctgcccaagttatccgatcattgctcagggcaaacagctatgtgattgtcgtggagcacgatcttagtgtcttagattacctgtctgacttcatttgctgcttatacgggaaacctggagcttatggagttgtaacccttcccttttctgttagagaaggaattaatattttcttggctggatttgtcccaactgagaatctgagattccgtgacgaatcacttactttcaaggttgctgagacaccacaggaaagtgcagaggagattcagtcatacgcacgatacaagtacccaactatgagtaaaacccaaggaaacttcaagcttcgtgttctggagggagaattcactgattcccaaattgttgtcatgcttggtgagaatgggacagggaagacgacatttatccgcatgctggctggtctcttgaagccagatgaggtggaaagttcagatgcagaaatacctgaattcaatgtttcttacaagccccagaagatcagtccaaagtttcaagcttctgtcagggccttgctgcatcaaaagatccgtgattcatacatgcatcctcagtttgtgtcagatgtcatgaaaccacttcaaattgaacaattaatggatcaggaagttgtgaatctctcaggtggagagctgcaaagagttgcattatgtctttgccttggaaagcctgcggatatatatctgatagatgagccaagtgcttatcttgattcagagcagcgtattgttgcctcaaaggtcattaagaggtttatcctccatgcgaagaagactgcttttgtcgttgagcatgattttattatggcaacttatcttgctgacagagtgattgtgtacgaggggcaaccatctatcgactgtactgccaatgctcctcagtctttgttgacagggatgaaccttttcctatctcaattggacattacattcagacgggacccaaccaattttaggccgcgtatcaacaagatgaattccacgaaagacagggaacagaagaatgctgggtcttactattacctcgacgactaaaacaccatatatactacagaggtgtttgttcggtggtgtaagattaaaagagcaccactctgttgcaattgggaaggaccgctaactcgatgtgcatctgttgagtacttaggtagggtgaccagttgttggagaggtcatgtatgttggaaggacaaagtaaagtagtgtcgcgttaccctaatttaagctgtgcacccccctgaatctgcttcctggttcatttttcttgttgcttccttggggtgtatgaacgagtaaagcagattttattagtactactacaatatttgatgttttcgagcttttgaagagcaacgaaggcgtgagaacagagagcagtttaagcaactgtacttaaaaggcctagctcatactttatattattcgttctatgatgatatttgacaag

SEQ ID NO: 4883 - DNA, 2224 bp, Lactuca sativa
catttccttttggcaggtaagttgtgtattgaagtcacttctgcatccaaggtggcatatatctctgaggagctttgcatagggtgtggtatatgtgttaagaaatgtccatttgatgcaattgagatcatcaatctaccaaaagatctggataaagatacaactcatcgttatggggtcaacacctttaaattacacaggttgcctgtcccaaggcctggacaagttcttggtttggttggcacaaatggaattgggaagtctacagctctcaaagttctagcaggaaaattgaaacctaatttgggtcgtttcaataaccctccagattggcaagaaattttgacctacttccggggatcagagttgcaaaactactttacacgtattcttgaagataatctaaaggctatcataaaacctcagtatgttgaccatatcccaaaagcagttcaagggaatgttgggcaagtgcttgatcagaaagatgagagagatgtgaaggcagaactttgtgctgatcttgagcttaatcaagttatagatcgtaatgttggagatttatctggtggagagcttcaaagatttgcaattgctgttgttgccatacaaaatgcagagatttatatgtttgatgagccttccagttatcttgatgtcaaacaaaggcttaaagctgcacaagttatcagatccttgcttagacccaacagctatgtgattgtggttgagcatgatttaagtgtgctggattacctatcagacttcatttgctgcctttatgggaaacctggtgcttatggtgttgtcacactacccttctctgtccgagaaggaattaatatatttctagaaggatatgtgcctactgaaaatcttcgttttcgtgacgaatcccttacttttaaggtggctgagactccacaagagaccgctgaagagattgaaacatatgcacgatataagtacccatcaatggctaaaactcagggtggtttcacacttaaggtggttgagggtgaattcacagactctcagatcatagtaatgcttggtgaaaatggaacagggaagacaacgtttatccgtatgctggctggtttgctgaagcctgacactgtggaagattctgatgtggagatacctgaatttaatgtttcttacaagcctcaaaagatcagtcccaaattccctcattcagtcaggcatttgttgcatcaaaaaattcgggactcttacatgcatcctcagtttgtttctgatgtcatgaagcctcttcagattgagcagttaatggatcaagaggttgttaatctttctggtggtgaattgcaacgtgttgctttgtgcctgtgccttggcaagcctgctgatatatacctgatagatgagccgagtgcatacctggattctgagcagcgtattgtggcctctaaagtgataaagagattcatcctacatgctaaaaagactgcatttgtggttgaacatgatttcataatggcaacctacttagcagatagggtgattgtttatgaagggaagccatctattgattgtgttgcaaattcacctcagtcattattaaccggaatgaatctcttcttatctcatctgaacatcacgtttaggcgggacccaactaattacaggccaagaatcaacaagcttaattcaacaaaggacagggagcagaaatttgctggatcttattactatctggatgaataaatttcttctcttgtcattgcagggcaaaccctaccctacatgactcctagctctgtcacatacatagcatagcacttgtataaccagagagaggcttgagctcatcttccttcagttgttgaacgtgtttgatgtttgatgtttgttttgtttgaaaagagagtttttagatcatatagcatatgcaaatgctaatatacttgttttatagtttgtaatttccggcttcctccatgattgctttactttactttgagcacatgttttttttagccggaggtgatgatttttgagatgactgatgatgatgtttggaacctctttcttttctttggtcatgtttatttatttttttgacgcttaaaaagatatttccaggtgagaatgaatagagtaaaaaactgatattttatttttaagcttcatttgtgtttttatctctctttctttagggatgtttggaacctctttcttagttgtacaaatatggtct

SEQ ID NO: 4884 - DNA, 2162 bp, Papaver somniferum
aagtgccgccaggaatgcaaaaagagttgccccgtcgtcaaaactgggaaactctgtattgaggtaaccgtagctgcaaagattgcttacatctctgaggagttgtgtattggatgtggtatctgtgtcaagaaatgcctattcgaagccattcagattatcaacttgcctaaagatttggacaaggatacaactcatcgttacggtcccaacactttcaagctgcacaggttaccggtgccaagaccaggacaagttctaggtttggtcggaactaatggaattggaaaatctacagccctcaaagtcttggcagggaagctgaagcctaatttgggtcgtttcaataacccacccgattggcaggaaatattgacatacttcagagggtctgagcttcagaactatttcacccgtatcttggaagataacttgaaggcgatcattaagcctcaatatgtggatcacatcccaaaagcagtccaagggaatgttgggcaagtactggaacagaaagatgagagaggtgtgaaagaggacctgtgtcgtgatcttgagctcaatcaggttaaagagcggaatgtgggtgatctgtctggtggagagctgcaaagatttgctattgctgtcgttgccatacagaatgcagagatttatatgtttgacgagccctccagttaccttgatgtgagacagaggcttaaagctgcccaagttatccgatcattgctcaggccaaacagctatgtgattgtcgtggagcatgatcttagtgtcttagattacttgtcagacttcatttgctgcttatacgggaaacctggagcttatggagttgtaacccttcccttttctgttagagaaggaattaatattttcttgtctggatttgtcccaactgagaatctaagattccgtgacgaatcacttactttcaaggttgctgagacaccacaggaaagtgcagaggagattcagtcatacgcacgatacaagtacccaactatgagtaaaacccaaggaaacttcaagcttcgtgttctggagggagaattcactgattcccaaattgttgtcatgcttggtgagaatgggacagggaagacaacatttatccgcatgctggctggtctcttgaagccagatgaggtggagagttcagatgcagaaatacctgaattcaatgttcttacaagccccagaagatcagtccaaagtttcaagcttctgtcagggccttgctgcatcaaaagatccgtgattcatacatgcatcctcagtttgtgtcagatgtcatgaaaccactccaaattgaacagctaatggatcaggaagttgtgaatctctcaggtggagagctgcaaagggttgcattatgtctttgccttggcaagcctgcggatatatatctgatagatgagccaagtgcttatcttgattcagaacagcgtattgttgcctcaaaggtcattaagaggtttatcctccatgcgaagaagactgctttcgtcgttgagcatgattttataatggcaacttatcttgctgacagagtgattgtgtatggaggggcaaccatctatcgactgtactgccaatgctcctcagtctttgttgacagggatgaacctttcctatctcaattgacatacatcagacggaccaacatttaggccgcgtatcaacaagatgaattccacgaaagacagggaacagaagaatgctgggtcttactattacctcgacgactaaaacaccatatatactacagaggtgtttgttcggtggtgtaagattaaaagagcaccactctgttgcaattgggaaggaccgctaactcgatgtgcatctgttgagtacttaggtagggtgaccagttgttggagaggtcatgtatgttggaaggacaaagtaaagtagtgtcgcgttaccctaatttaagctgtgcaccccccctgaatctgcttcctggttcatttttcttgttgcttccttggggtgtatgaacgagtaaagcagattttattagtactactacaatatttgatgttttcgagcttttgaagagcaacgaaggcgtgagaacagagagcagtttaagcaactgtacttaaaaggcctagctcatactttatattattcgttctatgatgatatttgac

SEQ ID NO: 4885 - DNA, 1931 bp, Trifolium pratense
attgttagcaacgacagatgcaagcccaagaagtgtcgtcaggagtgcaagaagagttgccctgttgtcagaaccggcagactgtgtatcgaggtttcttctgcatcgaagattgcttacatatctgaggaattgtgcattggatgcggtatctgtgttaagaaatgcccttttgaagctatccagattatcaacttgccaagggatctggacaaagataccactcacagatatggtcctaatacgtttaagctacacaggttgccggttccaaggccgggacaagtgcttggtttggttgggacaaatggaattgggaagtccactgcccttaaagttttggctggaaagttgaagccaaacttgggtcgtttcaccaacccccctgattggcaagaaattttgacatattttcgaggatctgaattacagaattactttactcgcattctagaggatgatttgaaggctatcatcaagccccagtatgttgatcacattccaaaagcagtgcaagggaatgtggggcaggtactagaccaaaagaacgagagagatatgaaggaagagctttgtgctgatcttgagcttaatcaagttttagatcgtaatgttggtgatctttctgggggtgagctccaaaggtttgccattgcatgtgttgccatccaaaatgctgagatatacatgtttgatgaaccttccagttatcttgatgtgaaacagaggctgaaagctgctcaagttgttcggtcattgctcaggcctaatagctatgtaattgttgtcgagcacgatcttagtgttttggactacttatcagactttatttgctgtttgtatggccagcctggtgtatacggtgttgtaacactccctttctcagtcagagaaggaattaatatcttcttgtccggctttgttccaacagaaaaccttaggtttcgtgatgtctctcttactttcaaggttgcagatactccacaggaaattgctgaggaagctcaaacttatgctcgattcaaatacccaaccatgactaaaactcaaggcaatttcaggcttcgtgcagttgaaggagaatttacagattcacagattattgtgatgctgggcgagaatgggacaggaaagacaacattcattcgctggtttgttgaaacccgatactatagaaggtgaatctgatgcggagatgcccgagttcaacgtatcatacaaacctcagaaaattagcccaaagtcccaattacctgttagacacttgctacatcaaaaaatccgtgatgcatatactcatccccagtttatttcagatgtgatgaagccactgcttattgaacagttgatggaccaagacgttcagaatctttctggtggagagttgcaaagagttgccttatgcctttgtctcggaaagcctgcagacatctatctgatagacgagccaagtgcatatcttgattctgaacagcgtattattgcggcaaaagttatcaagaggtttattcttcatgcaaagaaaacagcctttgtggttgagcatgatttcatcatggcaacttatcttgctgacagagttattgtttatgagggtcaaccttcaattgattgtattgcaaattgtccacaatcattgcttactgggatgaaccttttcttatcacatcttgatatcacatttagaagagacccaactaatttccgcccaaggatcaacaaacttgaatcaaccaaggacagagaacaaaagaacgctggatcttattattacctcgatgactgagttcatactcaaaagtctgctcttttgccaatgcaacattgcatcaaattgagctttttctcgaatcccagctctaattcatttgatgcattgccaagaaagtttgtcctcttcctgttgaatggcatctttctcaatggataga

SEQ ID NO: 4886 - DNA, 2428 bp, Conyza canadensis
ccaaaaaatgccgccaggagtgcaaaaaatcatgtcctgttgttatgactggtaagcaatgtattgaggttacttcggcatccaaggtggcgtatatatctgaggaattgtgcataggatgtggtatatgtattaagaaatgcccctttgatgcaattgagatcattaatataccaaaagatctggataaagatacaactcatcgttacggagtcaataccttcaaattacacaggttacctgttccaaggcccgggcaagttcttggcttggttggaacaaatggaattgggaagtctacacccctcaaagttttggctggaaaattgaaacccaatttgggccgttttaataacccaccagattggagtgaaattttgcagcacttccgtggatctgagttgcaaaactacttcactcgtattcttgaagataatctaaaggccatcataaaaccgcagtatgtggatcatattcctaaagcagttcaagggaatgttggtcaagtacttgatcaaaaagatgagagagatgcgaaggcagagctttgtgctgatcttgaactgaatcaggttatagatcgtaatgttggagacttatcaggtggagagcttcaaaggtttgcaattgctgttgttgctatacaaatggcagagatttatatgttcgatgagccttcaagttatcttgatgtgaaacaaaggcttaaagctgcacaagttatcagatctttgcttagacctagcagctatgtgattgtagttgagcacgatttaagtgtgcttgattacctatcagacttcatttgctgcctctatgggaagcctggtgcatatggtgtcgtgacactacccttctctgtcagagaaggaataaatatctttttagaagggtttgtgcctacagaaaacctacgttttcgtgaagaatctcttacattcaaggttgctgagacacctcaggatagtgctgaagaaactgaaacatacgcacgttatagataccctactatgtctaaaacgcaaggtggtttcaaactgaaggtggttgggggtgaattcactgactctcagatcatagttatgcttggagagaatggaacagggaagacaacttttattcgtatgctggctggtttactgaagcctgatactgtggaagattctgaagttgagatacccgagtttaatatttcttacaagccccagaagatcagtcccaaatataagcactctgtcaggcatttatttcatgataagattcgtgactcgtacatgcatcctcagtttgtttcggatgtcatgaagcctcttcaaatggatcaattaattgatcaagaagttttgactctttctggtggagaattgcaaagggttgcattggttctgtgtcttggcaagcctgctgatatttacctgattgatgaaccaagtgcataccttgattcggagcaacgtattgttgcttcgaaggttataaagagatttatactgcatgctaaaaagactgcatttgtggtggaacatgacttcatcatggcaacttatctagcagatcgggtgatcgtttatgaagggaaaccgtctattgattgtgttgcaaattcgcctcagtcattattgactggcatgaatcttttcttgtcacatctgacaatcacgtttaggcgggatccaacaaatttccgaccaagaatcaacaagctgaattcaacaaaggacagggagcagaaacttgccggatcgtattattatttggatgattgattgaggattctagttacaaggtaccacatgacttttggctgtcgcgcaacaactgcataagcagtcattcccttctaggaatctgccggttaaaccactatcaatatatgctgtgcatggcattggtgctacaccatggctagtacttattttgtttgaatcaagagtttagataacattcagtggtgggttatggatgcttgtatctagattgctttcatctttatttggtggtaatcctgcctagtaaccctgttgcctttataactgtaattccggctcttgattacattgtcagttactgatatacgagcgctgtgttcttttgttcattttgagcatgcatttcaaaagtgatatttggaataccttttgatgcttattttgttgttttcaacaatggtctgaaagatatagacggtagatttagttttatgctggattttgacagctctttgggcttaagcgggagttactgacttactggtaaaattattttgtttgtgtaaatatggtctaaagcttgttatttttacttgatgcaaacattgcgattctcaagtgactttgaggactctctctctgtcgaagatcctcgagacgaagatactgtctggaagcaatgatggtgaatactgaagctaccactgaaggacgacagc

SEQ ID NO: 4887 - DNA, 2466 bp, Ricinus communis
ctggggtttagtaattggagtcacagagagagaatcaggcaacattccggctaaatctccggtcatcaacctttaactttgcggtaactcaccgggtatctcttagacgaaaagaaacaagaaagcctagctccgatcagcgaatctgtgaagttgttgcagtgtatacgtggctgtggcatgaaaaattattaggttctactttgaagatgctgatgacattgctcattcttcctgtttgcttggtggtaaacagacttttgtattgacatttagactattaacatttttcattgactagctcttttttaagctcaaaagttgtaaatgtgcgtaatgtgttcaattaattgcctcttaattttactggctgtgctattgtgtttgggtagggagaaaggggtgatagagatggcagacagactgacacgtatcgcaattgttagctccgatagatgcaagcctaagaaatgtcgtcaagaatgcaagaagagctgccctgttgtgaaaactggaagattgtgtattgaggttactcctgcatctaagatagctttcatctctgaggagttgtgcattggatgtggtatctgtgttaagaaatgcccttttgaagcaattcaaatcatcaacttgccaaaggatttggataaagatacgacccatcgttatgggcccaatacctttaagttgcacaggctgccagtcccaagacctggacaagttcttggcttggttggaacaaatggtattgggaagtccactgctctcaaaaatcctccagattggcaggaaatcttgacctactttcgaggatctgaattgcagaattatttcactcgtatcctggaagataatttgaaggccatcataaagcctcagtatgtcgatcacattccaaaagcagtccaaggcaatgtagggcaggtgctcgaccaaaaagatgagagagagatgaaagcagagctttgtcatgatcttcagctgaaccaggttatagatcgtaatgtgggggatttatccggtggagagctccagcgatttgccattgctgtggttgccatacagaatgctgagatatacatgtttgatgaaccatcaagttatcttgatgtcaaacagaggcttaaagctgcccgagtaatcagatctttgctcaagcctaatagctatgtaattgtggtggagcatgaccttagcgtcctggattatttatctgacttcatttgttgcttatatgggaaaccgggagcatatggagttgtaacccttcccttttcagtcagggaaggaattaatatttttttggctggatttgttcctacagaaaatttacgatttcgtgaggagtctctgaccttcagggttgctgagactccacaagagagtgctgaggagattgaaacatatgcgcgatacagatatccaaccatgactaaaactcagggcaactttaagcttcaggtcattgagggtgaatttacagattctcagataattgtaatgctgggtgagaatgggacgggaaagacaacctttatccgtatgctggctggcttactgaaacctgataccatggaaggttccgatattgagatacccgaatttaatgtttcttacaaaccccagaaaattagtcccaagttccaatctactgttagacacttgctacatcaaaagattcgtgattcatatatgcatcctcagtttgtgtcagacgtcatgaagccacttcttatagaacaactgatggatcaggaagttgtgaatctatctggtggggagttgcaaagagttgctttatgtctctgcctcggaaagcctgcagacatttacctaatagatgaaccaagtgcatatctggattccgagcagcgtatagtcgcttctaaagtcattaagcggtttatccttcatgcaaagaaaactgcatttgtggtagaacatgattttataatggcaacttaccttgctgatagagttatcgtatatgaggggaagccgtctttggactgtactgcaaattctcctcagtcattattgaccggaatgaatctcttcttatctcatttggatatcacatttaggcgggacccaactaatttccgaccaagaatcaacaaattggactcaaccaaggacagagatcagaaagctgctgggtcatattattacctggacgattgatgcaaattattggcagcttctatgagtttcatctcgttggaaactcttgctagaccgcaaagtccagctgggtcttcctgtcagttgcctggaggcctcctggctggcgacaaagtatttaatcaaatgaggccatctgctgcgctctgcttttttctatctcctgttttaagggataatttcatttgcagtccctgattttaggtgtgtttcctttaaatgttcttaaattttaatttgtcccttaaaaatcccctggagatcaaaatttttgtatat

SEQ ID NO: 4888 - DNA, 2597 bp, Brachypodium distachyon
gatatttcacaaaacggaaatatatgaaaaaggggatttgtaatagaaaacccggttcggttgtgaatttgttacccccgccgccacgcccaactctagggttcccgcagccgcatcgccatggctacgacgcgtatcgcgatcttgaacgaggacaggtgcaagccgaagaagtgccggcaggagtgcaagaagagctgccccgtcgtcaagaccgggaagcattgcatagaagttaatccgacgtccaagtctgccttcatctctgaagagctgtgcattggttgtggtatttgcgttaagaaatgcccgtttgatgccatccagatcattaacctcccgaaagatttggacaaagatactactcatcgctatggggcaaataccttcaaattgcacaggttgccggttccaagaccaggccaagttttgggccttatcggagccaatggaattggaaagtcaacagcacttaaggtgttacaaggcaagatcaagcctaatttgggaagattcaaaaatccacccgattggcaggaaatccttacttactttcgggggtctgaacttcagaattactttacacgtatgctggaggacaacctcaaggcaattataaagcgccaagacgttgaacgcattccggaaaaagttcaagggaatgtagggaaactacttgagcgattagaccagaggggtatgatagatcagttatgcattgaccttgagctgaaccaactactagaccggaatatacaagatctttctggtggtgagctgcagagatttgcaatagcaggcattgctgcacaaagcgcagaaatttacatgtttgatgaaccatcggtttatctcgatgttaagcagagacttaaggctgcacaagttattagatccttgcttagaacaaacagttatgtcattgttgtggaacatgacctgagtgtcttagattacatgtccgactttatttgctgcttatatgggaagccaggagcttatggtgtagttacgctgccattttcggtgcgagaaggtatcaatgttttcctggctggttttgttccaacagaaaatcttcggtttcgaaatgaatctcttacatttaagattgcggaggtccaggaaaatgctgaagagattgagacataccagcggtacaagtaccctaccatgaccaaaacatacgataatttcaagctgactgtcatggaaggcgaattcaccgattctcagattgttgtgatgcttggtgagaacggaacagggaaaactacattcatcaaaatgctggctgggctggagaagccagatactgtggaaggaactgatactgaaattccgaaattttatgtgtcccacaaacctcagaagcttaaaccaaaattccagggaacagtcaggcaattgcttcatctgaaaatacgggattcgtatacttatccccagtttacgtctgatgtcatgaaaccactacaaattgagcaactcatggaccaggaaattataaatttatctggtggagaacgccaaagagtggcattatgtctttgccttggaaagcctgcagatatctatctgatcgatgaaccaagtgcatctcttgattcagagcagcgtattgttgcctcaaaagttatcaaaagattcatacttcatgcaaagaaaactgcatttgttgttgagcatgatttcatcatggcgacctacttagctgacaaggttgtcgttttcgagggacggccttctgtcgactgtactgccaatgcaccgcagtctttgcaatctggaatgaataaatttttatcacatcttgacattacttttagacgagacccgaccaactataggccgcggataaacaagctggggtctacaaaagacagggagcaaaagtctgaaggctcctactactacctctgatacaggcaccacggttgatgtttcattaccattacaacgcactctgcctagggtgcttgttgttggaggagaagaaactgaactggattcgtccaagtgggaggagaggcacatcggcaagggacggacggcaggacccttgcgagcagcaaaacaacacggaggacgtcggagcaggaaggagaaaggccaacatcacgagcaggagaaacatggtaacctctcacagaatccagtgaagagatgcaggtcggatcagatcaaggagcctgcgccagaagaagtagttccaaccttcagaagtcctcctggagtgttctgctggaagctacagtcatcgcaggatgctatgagatcaagcaaggcattgatggcgctgaagcctcgccgatctgagaactgcctgagcttttctctgacgaagaacagcagcttaggcttttactgctgagactgtttttctttctgtaacagggtagtttggtgcaccaggttttttgtcccatagtttgtattctagattgaatacaaagcagtgggttttcctggtgagccacgaaacccgcaccatcttattttccttttttcatcttttcagacctacatatgtttgcatgcaacatcttgtgggatactatcattgcaaggaaatatctgatgtttatcgagtcctt

SEQ ID NO: 4889 - DNA, 1688 bp, Castanea mollissima
ctttcatctctgaggaattgtgtattggatgtggtatctgtgtcaagaaatgcccgtttgaagctattcagatcatcaacttgccaaaagatctggacaaagatacaacccatcgctacggccctaacacttttaaattgcacaggttaccagtcccgagacctgggcaagttcttggcctggttggaactaatggcattgggaagtccactgccctcaaagttttggctggaaaactgaaaccaaacctcggtcgcttcaataatcctccagattggcaggaaatcttgacatacttccgaggatctgagctgcagaattattttacacgtattcttgaagataatttgaaggccattataaagccccagtatgttgatcacattccaaaagctgttcaaggtaatgtaggacaggtgctggaccaaaaggatgagagagacatgaagtcagaactctgtgctgatcttcagctgaaccaggttatagaccgtaatgtaggggatttgtcaggaggagagcttcagagatttgctattgctgttgttgctgtacagaatgcagaaatatatatgtttgatgaaccttcaagttaccttgatgtaaaacagaggcttaaagctgctcaagttgtccgttctttgctcaggcctaatagctatgtaattgttgtggagcatgatcttagcgtcctggattacttgtcggacttcatttgctgtttatatgggaaaccgggagcatatggagttgtaacccttcccttctcagtcagagaaggaatcaatatcttcttggctggatttgttccaactgaaaatttacgttttcgggatgaatcccttacctttaaggttgctgagactccacaagaaagtgcagaggaaattgagacatatgcacgttacaaatacccaaccatgaccaaaactcaaggaaatttcaggcttcgtgttgttgagggtgaatttactgattctcagattattgtgatgctgggtgagaatgggactggcaaaacaacatttatccgtatgctggcaggtttactgaagcctgattctgtagaaggttctgatgtggagattcctgagtttaatgtttcttacaagccccagaagatcagtccgaaatttccatccactgtgcggcacttgctacattcaaaaatacgtgattcatacatgcatgctcaatttgtgtcggatgttatgaagcctcttcttattgaacaattaatggatcaagaagttgtgaatctttctggtggagagttgcaaagagttgcattatgcctatgccttgggaagcctgcagacatttatctgatagatgaaccaagtgcatatcttgattctgagcagcgtatagttgcttcaaaagtcattaagaggtttatccttcatgcaaagaaaactgctttcgtggttgaacatgattttataatggcaacttatctagcagatagagttatcgtgtatgaggggaggccatcgcttgattgtattgcaaattctccacaatcattgttgactgggatgaatctcttcttatctcatttggatatcacatttagaagggacccaactaatttccgccctagaatcaacaaactggaatcaaccaaggacagggagcagaaatctgctgggtcctattattacctggatgactgacaattttaaata

SEQ ID NO: 4890 - DNA, 3385 bp, Hordeum vulgare
gttttggggggtgagacatataatccaacgtttggccggcggcaagggagctgaggaggaaagggaattaaggagcccaattcccaaaattcgaactattaaatcccacctcacaccaaacatgggttttagattaataatcaatttccaaagcctaatccctaacaaactcccaccctaaactcccatccctttccctaacattgccaagcacgttgacacattatgcatgctagagggtttcctagctaaagtgctgctcaattaactgtcttattgtacaggaaagctttgcattgaagttagtccagcggccaaacttgcattcatttctgaagagctgtgtattggttgtggtatttgtgttaagaaatgcccatttgatgccattgaaatcatcaatcttccaaaagatttggagaaagatactacccatcgctatggaccgaataccttcaaattgcacaggttgcctgttccaagacctggtcaagttttgggccttgttggaaccaatgggattgggaagtcaacagcacttaaagtcttagctggcaagctgaagcccaacctgggacgattcaaaaatccacctgattggcaagagatccttacatatttccgtgggtctgaacttcagaactattttacgcgcatattggaggataacctgaaggcaatcatcaagcctcagtatgttgaccatattccaaaagctgttcaaggaaatgtagggcaagtacttgagcagaaagatgagcgggatatgaaaaatgagctgtgtgttgaccttgaattgaaccaagttattgacagaaatgtaggagatctgtctggtggcgagcttcagaggtttgcaatagcagttgttgctgtacaaagtgcggaaatttacatgtttgatgagccatcaagttatttggatgttaaacagaggctcaaggctgcacgagtcattaggtctttgcttagatcaaacagctatgtcattgttgtcgaacatgacttgagtgtcttagattacttgtccgactttatttgctgcttatatgggaagccaggtgcttacggtgtagttacattaccattttcggtccgagaaggtatcaatattttcctggctggatttgttccaacagaaaaccttcggtttcgagatgaatctcttacatttaagattgcggagacccaggaaaacgcagaggaagttgctacgtaccagcggtacaagtaccctaacatgagcaaaacacagggaaatttcaagctttctgttgttgagggtgaattcactgattctcagattgttgtgatgcttggtgaaaacggcacagggaaaactacattcatcagaatgctggccgggttgttgaagccagataccatggaaggaaccgaggttgaaattcctgaattcaatgtgtcctacaagcctcaaaagatcagtccaaaatttcagcatccagtgaggcacttgcttcattcgaaaatacgcgattcatatactcatcctcagtttgtatctgatgttatgaaaccactacaaattgagcaactcatggaccaggaagttattaatttatcaggtggagagctccagagagtagcattatgtttgtgccttggaaagcctgcagatatttatttaattgatgagccaagtgcatatctcgattcagagcagcgtattgttgcctcgaaggttatcaaaagattcatccttcatgcaaagaaaactgcatttattgtggagcatgatttcatcatggcaacctacttagcggacaaggttattgtttacgaaggacttgcttctattgactgtactgccaatgcaccacagtctttggtatctgggatgaataaattcttatcggtaagtgcagggtaataaatatttacaagatagtactccttgtattttggtttattgggcctccttgtattttgggtcaacctttgaccatacgtttgactgcaaaatagaaatgacatgacatagaaattatattgttggattccttgttgaaacttgtggctttctgtacctcgctggtagattttgtgttggttttcatgttttgcataaaattatacctgtctaacctcctattcagtcatggaagtttacatttacatcttctcttgtctttatcaacatgtatgcgtaatgaatagatatgcaggtgtgaggtagttattggaggctattgtttgggttttaatatattgtatcagagttacctctgtaagcttgatttaggaacaatatatagagccacaaaagtgtataggaaaacagcagcaaactgatcgaaatttatgttcacctactccatatcatatatttccatgtacatcaacatgtaaatatgagctgcagcctgcagcatttaagcatatttgtgcacatcaaggctaaagtcctaaaaatgatggcacaatattaaacagagtttacaaactatacaattacctaaacgctttgtaggagcaacaaatagtacagcccataggaaaatgctcataattctagaagtgttctagaactgaaaccctccaagttccacatcttgacctgcatttggatatgatgtatttatatacacatggatcacataattttacagtaaaaatagtgatagttgaatccgcttcacaacttgtggtaactgaatgaacctcctgtaacttgtgttcgatccagatcggaaggaggcacatgtaaaatgacttcgttgagcaaaacctacattgattatcttctctgtgaccatattaaatcatcaattaggagaacattttagcagcattttaattacattgacatcaaaatcttataactcataaattatgcttagcagaaatcaagaataaatgccatgatttcatctgttgtgtttcattttgcatagtcatagaagaaactcaacaatgaacattgtcggtcgtttgcactaaattaaacaacatcatacgatagcaaattccccattcacatcaccaatttcccctttagatagcatgtccctgattcaaaagaaaaaagtgtgactaagtcagaaagaacacactacaaagtatgttttgtgttgaaccggtatgggcccaagcccatcctcttatctcttatggcccaagcccatgtggagggactaacctagaaggggcatccaaccctctcgttcccagctccagcctccacacgagagtctcctcgtgcgagctatcagacaacggctcgtcctgcctgtaggtaccactctctcgattcaacatggcctcgtgcgagctatcaaacaacggctcgtcctgcctgtaggtaccactctctcgattcaacatggtatcagagcatgctgcggcggtatagtcgctcaccgac

SEQ ID NO: 4891 - DNA, 1919 bp, Chrysanthemum coronarium
tcatgccctgttgtcaaaactggtaagctatgtatcgaggtcagttctgcatcaaaggtggctactatttccgaggagctttgcatagggtgtggtatatgcgttaagaaatgcccgtttgaagctattgatatcattaatttaccaaaagatttggaaaaagatacaactcaccgttacggggtcaacaccttcaagttgcacaggttgcctgtcccgaggcctgggcaagttcttggcttagttggaactaatggaattgggaagtcgacagctctcaaagttttggctggaaagttgaaacccaacttgggtcgcttcaataaccctcctgactggcaagaaattttgacctacttccgaggatctgagttgcaaaactacttcacacgtattcttctgaaggccatcataaaaccgcaatatgttgaccatattccgaaagcagttcaaggaaatgtcgggcaagttcttgatcaaaaggacgaaagaggtgcaaaggcggagctttgtgctgatcttgagctgaatcaggttatagatcgtaacgttggagacttatctggtggagagcttcagaggtttgccattgctgtcgttgccatacaaatggcagaaatatatatgtttgacgaaccttcgagttatcttgatgtgaaacaaaggcttaaagctgcccaagttattcgatccctgcttagacctaacagctatgtgattgttgttgaacacgatttgagtgttcttgattacctatcagacttcatttgctgcctctatgggaaacctggtgcatatggtgttgtgactctacccttctctgtcagagaaggaataaatatatttttagagggttttgtgcccactgagaaccttcgtttccgcgatgaaagacttacttttcgggttgctgagacagcacaggagaccgctgaggagattcaaacatatgcacagtataggtacccaactatgtctaaaacacagggtggttttaaactcaaggcggttgagggtgaattcacagactcgcagattatagtaatgcttggtgaaaatggaactgggaagacgacgtttattcggatgctggctggtttactaaagcctgataccgtggaaggatctgaggtggagatacctgagtttcacgtctcgtacaagccccaaaagatcagtcccaagttccctcattcagttaggcatttgctgcattcaaagattcgtgattcatatatgcatcctcagtttgtttccgatgtcatgaagcctcttcaaatcgagcagctaatggatcaagaggtggtgaatctttccggtggtgaattgcaaagagttgcattgaccctgtgccttgggaagcctgctgatatttacctgatagatgaaccaagtgcatacctcgattctgagcagcgtattatgcttacaaagtgatcaagagattatactacacgctaagaagactgcttgtcgtagaacatgattttataatggcgacttatctagcagacagggtgattgtttatgaagggcagccgtctgttgattgtgttgctaatgcccctcagtcgttattgactggaatgaatctctttttatctcatttgaccatcacatttagaagggatccaggtaattatcgcccgagaattaacaagctaaattcaacaaaggacagggagcagaaacttgctggatcttactattatttggatgactaaatttatcagtctgagttgtaggctataccctctcttgttttctgattgtaacttccggctcatgacgacttttgtcagttaactgatatacgagaacatgattttgttgtttattttgaggaacgtgtttaaaatgcttagagattttgaacattttatggttctttattaatgcagctttcaatcttgattgca

SEQ ID NO: 4892 - DNA, 2408 bp, Picea glauca
aaattgcatttatatcggaggagttgtgcattggttgtggtatctgtgttaagaaatgtccatttgaagctatccagatcattaacctaccaaaggatttagataaagacacaacacatcgatatggaccaaacacattcaaactccacaggctgcctgtaccaagaccaggacaggtgctcggacttgttggaacaaatggtatcggaaagtctactgcacttaaagttcttgctggaaaactgaaacccaacctcggccggttccataatcctcccgattggcaggaaattcttacatatttccggggatcagagttacagaattatttcactcgtattctggaagataatctaaaggcaataatcaagcctcaatatgttgatcacataccaaaagcagtgcaagggaacgtgggtcaggtgctcgaacaaaaggatgaaagagacataaagtcagagctttgcactgatctggacttgaatcaggttatggatcgaaacgttggtgatttatctggaggggaattgcagcggtttgcaattgcagttgttgcaattcagaatgctgaaatatatatgtttgatgagccctctagttatcttgatgtaaagcaacggcttaaagctgcgcaagtggtccggtcccttctaaggccgaacagctatgttattgttgtcgagcatgaccttagtgtccttgattatttatcggactttatctgctgtctgtacgggaagcctggggcttatggtgtagtaacacttccattttcagttagagaagggatcaatatctttttggctggttttgttcccactgaaaatcttagatttcgagatgaatcacttactttcaaggttgcagaaactccacaggaaagtgcggaagagataaaaagctatgcacgatacaaatatccaactatgtctaaaactcagggtaatttcaaacttaatgtgaaggagggagaatttactgattcacagataattgtaatgttgggagaaaatggaacagggaagaccacatttatacgcatgctggctggtttattgaaaccagatacagttgacaatacagacgtggagatacccgaatttaatgtgtcatacaaaccgcagaagatcagcccaaagttccagtcaactgttaggcatttattgcaccaaaagattcgtgattcatacactcaccctcaattcacatctgatgtcatgaaaccacttcagattgaacaactaatggatcaagatgttgtaaatctttctggtggagaattacagagagtggcattgtgcttatgccttggcaagcctgctgacatttatctgatagacgagccaagtgcatacttagattcagagcagcgtattgttgcagcaaaggtcataaaacgatttattcttcatgcgaagaagactgcttttgttgttgagcatgattttattatggcaacttatttggcagatagggttattgtatatgaaggacgaccttctgttgactgtgttgccaatactccacaaagtctacaaacaggaatgaatctgtttttatcgcacttggatattacatttagacgagatccaacaaactacaggccacgcataaataaattggattcaacaaaggacagggaacagaagaatgcaggctcatattactatctggatgactaaaaaatgttccaagtatgagagaagcatgatttgtgtcattcacaggtgatcaacagtacattttactctgctacttgcagcctttgcaggattgttactccacaaacctgctatcaccaagagatatggtggtgtatttttcttgaacttaagtgtattattctttggatttgatgcaagaacatgtggagactagcaattagaaggagagtaataatagagaagcagcagagattctggtattctgggttttgcgggcttaaatgatagaaagggaaaagtgccctttaaagatttgcagtaaattggcgtgggtaaaatatttggcactttttgcttttaatggagcagtgttgaattttataactgcgctgttaaggtaaaatgaattatatattatgagtaaaaagaagtgattcattcttgcatgacagtgatccaatctagattttttcttgcccctgcctagaagggacttgaatccattttttgttgttttacggaggagttcaccagtatgcagagaattatttgaagaaatatctcatgaaaccacgagtgaagatatttcgaacttcctttaaaagtgaaaagaggcttctttctctagttttgatcagaactcgtttacattaatatttctccacattaatggtatttgatggttttgggaatttggatatacaatagtactgatacaataaactatgaagaacaatcctagaa

SEQ ID NO: 4893 - DNA, 2378 bp, Secale cereale
gactagaggcgtgtgttgaacggactctgatcacgcgtgtaaaactcttgtgcttgtttcagaagctggtctaaagccagaaaggtctgaccgcctccgcacgtccccaactcggtcgaacgccgacgcggctgccgccagggctctccaccgcgatcccagatggcggcgcgaatcgcgatcatcaacgaggataggtgcaagcccaagaagtgccgccaggagtgcaggaagagctgccccgtcgtcaagaccgggaagcattgcattgaagttactccggcgtccaagaccgcgttcatctctgaagagctgtgcattggttgtggtatttgcgtcaagaaatgcccatttggtgccattcagatcatcaacctcccaaaagatctggataaagataccacccatcgctatggcccaaacaccttcaaattgcacaggttgcctgttccaagacctggccaggttttgggccttgttggagccaatgggattggaaagtcgacagcgcttaaggtgttatgtggcaagttgaaacctaatttggggaaattcgataatccgcctgactggcaggaaatccttacatacttccgggggtctgaacttcagaattactttacgcgtctgttggaggataatctcaaggcaatcataaagcgtcaagacattgaaagcattccgaaagcagttcaagggaatgttggtcaactacttgacaagttagaccagaggggtgtgaaagctcaattgtgcattgaccttgaattgaaccaagttctggaccggaatgtagaagatctttccggtggtgagctgcagagatttgccatagcaggcacggctgcacaaagtgcagaaatttacatgtttgatgaaccatcagtttacctcgatgtcaagcagaggcttaaagctgcacaagtcattaggtccttgcttaaagcaaacagctatgtaatcgttgtggaacatgatttgagtgtcttggattatatgtccgatttcatttgctgttcatatgggaaaccaggagcatttggtgtagttacgctgccattttcagtccgagaaggtatcaatgttttcctggctgggtttgttccaacagaaaatcttcggtttcgagatgaatcacttacatttaagattgttgaagcccaggaaaatgctgaagagattgagacataccagcggtacaagtaccctaccatgagcaaaacaattggaaatttcaagctcactgtcatggaaggtgaattcactgattctcagattgttgtgatgcttggtgagaacgggacagggaaaactacattcatcaaaatgctggctgggcggctgaagccagatactgtggaaggagctgagattgaaattcctaaattttacgtgtcccacaagcctcagcagcttgcaacaaaattccagggtacagtgagtcaattgcttcatcagaaaataccggattcatgtgctcatcctcaatttaggtctgatgtcataaaaccactacaaattgagcaactcatggaccggcaagttacaaatttgtcaggtggagaacgccaaagagtggcattatgcctttgccttggaaagcctgcagatatatatctgatcgatgaaccaagtgcatctcttgattcagagcagcgtattgttgcctcaaaggttatcaaaagattcatccttcatgcaaagaaaaccgcatttgttgttgagcatgacttcatcatggcaacctacttagctgacaaagttatcgtttatgagggacggccttctgtagactgtactgctaatgcacctcagactttactctctgggatgaataaattcttatcgcaacttgacatcacatttagaagagacccaaccaactataggccgcggataaacaagctggactctacgaaagacaaagaacaaaagtctgtagggtcctactactacctgtgatacaggcaccacggttgatactttggtaccgttgcaacagcaacgcactctgcctgggttgcttgttgttggagaagaaactgagctggatttgtccaagggggaggcgagacacggcaagggagcgacgactggagcgtctcgaggagcaagacaacaaggaggacgtcggagcaagaatggccaacgccgccagcaggcggaacatgttaacctcccatggaatctggtgaaggaatgcagagaaagggaagcaggaagtgctgcaaggttggatcagatcaaggagcctgcgccagaagaagtaatcccaacctttagaacccctcctgaacctggagtgctctgtcgaactttggccacagtcattgcaggatgctgtgagatgaagcaacgcgtttgatggtgtcgaagcc

SEQ ID NO: 4894 - DNA, 3368 bp, Triticum aestivum
taccgcggacgcgtggggtctgaccgcctccgcatacgtccccaactcggacgaacgtcgccgccgcggccgccagggctctccaccgcgatcccagatggcggcgcgaatcgcgatcatcaacgaggataggtgcaagcccaagaagtgccggcaggagtgcaggaagagctgccccgtcgtcaagaccgggaagcattgcattgaagttactccggcgtccaagaccgcgttcatctctgaagagctgtgcattggttgtggtatttgcgtcaagaaatgcccatttggtgccattcagatcatcaacctcccaaaagatctggataaagataccacccatcgctacggcgcaaacaccttcaaattgcacaggttgcctgttccaagacctggccaggttttgggccttgttggagccaatgggattggaaagtcgactgcacttaaggtgttatgtggcaagttgaaacctaatttgggaaaattcaataatccgcctgactggcaggaaatccttacatacttccgggggtctgaacttcagaattattttacgcgtctattggaggataatctcaaggcaatcataaagcgtcaagacgttgaaagcattccgaaagcagttcaagggaatgtcggtcaactacttgacaagttagaccagaggggtgttaaagctcaattgtgcattgaccttgaattgaaccaagttctggaccggaatgtagaagatctttcaggtggtgagctgcagagatttgccatagcaggcactgctgcacaaagtgcagacatttacatgtttgacgaaccatcagtttacctcgatgtcaagcagaggcttaaagctgcacaagtcattaggtccttgcttagagcaaacagctatgtgatcgttgtggaacatgatttgagtgtcttggattacatgtccgattttatttgctgttcatatgggaaaccaggagcatttggtgtagttacgctgccattttcagtccgagaaggtatcaatgttttcctggctggatttgttccaacagaaaatcttcggttccgagatgaatcacttacatttaagattgttgaagcccaggaaaatgctgaagagattgagacgtaccagcggtacaagtaccctaccatgagcaaaataattggaaatttcaagctcactgtcatggaaggtgaattcactgattctcagattgttgtgatgcttggtgagaacgggacagggaaaactacattcatcaaaatgctggctgggcggctgaagccggatactgtggaaggagctgagattgaaattcctaaattttatgtgtcccacaagcctcaggagcttgaaacaaaattccagggtacagtgagtcaattgcttcatcagaaaataccggattcatgtgctcatcctcaatttaggtctgacgtcattaaaccactacaaattgagcaactcatggaccggcaagttacaaatttatcaggtggagaacgccaaagagtggcattatgtctttgccttggaaagcctgcagatatttatctgattgatgaaccaagtgcatctcttgattcagagcagcgcattgttgcctcaaaggttatcaaaagattcatccttcatgcaaagaaaaccgcatttgttgttgagcatgacttcatcatggcaacctacttagctgataaggttattgtttacgagggacggccttctgtagactgtactgctaatgcacctcagactttactatctgggatgaataaattcttatcgcaacttgacatcacatttagaagagacccgaccaactataggccacggataaacaagctggactctacgaaagacaaagaacaaaagtctgtagggtcctactactacctgtgatacaggcaccacggttgatactttggtaccgttgcaactgcaacgcactctgcttgggttgcttcttgttggagaagaaactgaactggatttgtccaagggggaggcgagacaacatggaggacgtaggagcaaggagacaggccaacgccgccagcaggcgcaacatgctaacctcccatggaatctggtgaaggaatgcagagaaagggaagcaggaagtgctgcaaggttggatcggatcaaggagcctgcgccagaagaagtaatcccaacctttagaacccctcctgaacctggagtgatctgtcggacttcggccacagtcattgcaggatgctttgagatcaagcaagacgtttgatggtgtcgaagcctcggcaccgagctgagaactgctttaagcttttctctgaagaagaattgggtgttgcttgaacttacgagactactacgttttctgtaatagggttgtaccaggttttttgccccatagcttgtattcaggtatacaagcagtgggttttcctggtgaacatcgaacccacaacctacctactattttcaataaaaatcatataagaatttgccgaggggcaagtctatgcctcgtataatctttcggcagaccccacctggtggaggagcttctagcactgggtttgaccttttttaataatttgcaaaatatagcattgcatatctttggaatgcatgaatttcacttgaaaatccccatgtttggcacgaggcctgattaacatgttatacaagctcaggaaagctacaagattcaataaaactggtcatgtatgtcattgccaaatactgacactatggagctacagctgcagctcagaccacaacaagtactgtattatctaaggttaagaacacaagtgatacagtttcagattttcaggctaaaactcaaattccctaactaaaagaactcaaagtcgaggaatttccctccagactccacatggtctgcccctggccctgctggcaccctcttgctgctgttgtaattcgtctccaccctgtccatggacgccgacttcgccggcattgctgcgaaggcgatgggctccacgggcctgggcacgccgggcggcgtgctgcaccggatgagcgcccagttgacaccctcgaagaaggggtgctgcttgatctcggccgcccccctcttcacgccgagccggccctggggctccttggccagcaggcccctgatgaggtccttgctggcgcagctcgtcggcgggccgccctccgggaaccggagctgctggccgacgacgttgaacagcgtggcccggttcgtctgccccttgaacggcgtcttgccgtacatgagctcgtgcaggaacacgccgaaggtccaccagtccaccgcgctgccgtggccctcccccttgatgatctccggcgccaggtactcgtgcgtgcccacgaacgacatggaccg

SEQ ID NO: 4895 - DNA, 1728 bp, Cyclamen graecum
tgccgacacacgcctctctctcaagatttcagcttttctctgtgcagtggaagggagagatgtcggatcgattgacgcgaatcgcaattgtcagctccgacagatgcaagccgaaaaagtgtcgccaggagtgcaaaaagagctgccctgttgttaaaactggtaaactatgcattgaggttactcccgcaactaaaattgctttcatctctgaggaattgtgcattgggtgtggtatttgtgtcaagaaatgcccttttgaagcaattcaaatcattaatctgcctaaagatttggataaagatactacccatcgttatggccccaatacattcaaattgcacaggttacctgtaccaaggcctgggcaagttcttggtttggttggaaccaatggtatcgggaagtcgactgctcttaaagttttagctggaaaactgaagcctaatttgggccgttttgataaccctccagattggcaagaaatcttgacatattttcgtggttctgagctgcaaaattatttcactcgtattttggaagataatttgaaggccattatcaagcctcaatatgttgatcacatccctaaagcagtcgtaggaaatgttgggcaagtgcttgatcagaaagatgagagagagttaaaagaaagcctttgtgttgatcttgacctaaatcaggttctcgaccgtaatgttggtgatttatctggcggagagcttcagaggtttgctattgctgtcgtggcaattcaaaatgcagaaatatttatgtttgatgagccctcgagttatcttgatgtgaagcagagactaaaggctgcccaagtcatccggtctctattgagacctaacagctatgtgattgtcgtggagcatgatcttagcgtcctagattatttgtcagacttcatttgttgtctgtatgggaagcctggtgcctacggagttgttacacttcctttttctgtcagagaaggaattaacatatttttggcgggttttgtccctacagaaaatcttcgtttccgtgacgagtctcttaccttcaaggttgctgagaccccacaagaaagtgccgaggaaatcgagacctatgcacgttataagtacccaaccatgtgcaaaactatgggtaatttcaagattcgcgtggttgaaggagaattcactgattctcaaattgtggtcatgcttggtgagaatggtactgggaagacaacattcattcgcatgctggctggtttattgaaacctgatacagtagaaggttctgatatggatataccagagtataatgtctcttacaagccccaaaagatcagtccgaagttccagtctagtgttaggcatttactgcatcaaaaaatacgtgattcttatatgcatcctcagttcgtgtcggatgtaatgaagcctcttatgatcgagcaattaatggatcaagaagttgttaacctctctggtggggagttgcaaagagttgcattatgtctttgccttggaaagcctgcagatatttatctgatagacgaaccaagtgcctatcttgattctgagcagcgtattgttgcctccaaagtcatcaagagattcattcttcatgctaagaagactgcatttgtggttgaacatgactttataatggcaacttatttggcagatagggtcattgtatacgagggcagaccatcagtggattgtattgcaaatgcacctcagtctc

SEQ ID NO: 4896 - DNA, 2515 bp, Triticum aestivum
atcacgcgtgtaaaactcttgtgcttgtttcagaagctggtcttaaagccagaaaggtctgaccgcctccgcgtacgtccccaactcggtcgaacgtcgccgccgctgccgccagggctctccaccgcgatcccagatggcggcgcgaatcgcgatcatcaacgaggataggtgcaagcccaagaagtgccgccaggagtgcaggaagagctgccccgtcgtcaagaccgggaagcattgtattgaagttactccggcgtccaagtccgcgttcatctctgaagagctgtgcattggttgtggtatttgcgtcaagaaatgcccatttggtgccattcagatcatcaacctcccaaaagatttggataaagataccacccatcgctatggcccaaataccttcaaattgcacaggttgcctgttccgagacctggccaggttttgggccttgttggagccaatggaattggaaagtcgacagctcttaaggtgttatgtggcaagttgaaacctaatttggggaaattcgataatccgcctgactggcaggaaatccttacatacttccgggggtctgaacttcagaattactttacgcgtctgttggaggataatctcaaggcaatcataaagcgtcaagacgttgaaagcattccgaaagcagttcaagggaatgtcggtcaactacttgacaagttagaccagaggggtgttaaagctcaattgtgcattgaccttgaattgaaccaagttctggaccggaatgtagaagatctttccggtggtgagctgcagagatttgccatagcaggcactgctgcacaaagtgcagacatttacatgtttgacgaaccatcagtttaccttgatgtcaagcagaggcttaaagctgcacaagtcattaggtccttgcttagagcaaacagctatgtaatcgttgtggaacatgatttgagtgtcttggattacatgtccgattttatttgctgttcatatgggaaaccaggagcatttggtgtagttacgctgccattttcagtccgagaaggtatcaatgttttcctggctggatttgttccaacagaaaatcttcggtttcgagatgaagcacttacatttaagattgttgaagcccaggaaaatgctgaagagattgagacataccagcgatacaagtaccctaccatgagcaaaacaattggaaatttcaagctcactgtcatggaaggtgaattcacagattctcagattgttgtgatgctgggtgagaacgggacagggaaaactacgttcatcaaaatgctggctgggcggctgcagccagatactgtggaaggagctgagattgaaattcctaaattttatgtgtcccacaagcctcagcagcttgaaacaaaattccagggtacagtgagtcaattgcttcatcagaaaataccagaatcatgtgctcatcctcaatttaggtctgatgtcattaaaccactacaaattgagcaactcatggaccgggtagttacaaatttatcgggtggagaacgccaaagagtggcattatgtctttgccttggaaagcctgcagatatttatctgatcgatgaaccaagtgcatctcttgattcagagcagcgcattgttgcctcaaaggttatcaaaagattcatctttcatgcaaagaaaaccgcatttgttgttgagcatgacttcatcatggcaacctacttagctgacaaggttattgtttacgagggacggccttctgtagactgtactgctaatgcacctcagactctactctctgggatgaataaattcctatcgcaacttgacatcacgttcagaagagacccaaccaactataggccgcggataaacaagctggactctacgaaagacaaagaacaaaagtctgtagggtcctactactacctgtgatataggcatcacggttgatactttggaaccgttgcaactgcaacacactctgcctgggctgcttcttgttggagaagaaactgaactggatttgtccaagggggaggcgagacacggcaagggagcgacgactggaacgtctggaggagcaagacaacatgggggacgtcggagcaaggagacatgccaacgccgccagcaggcgcaacatgttaacctcccatggaatctggtgaaggaatgcagagaaagggaagcaggaagtgctgcaaggttggatcggatcaaggagcctgcgccagaagaagtaatcccaacctttggaacccctcctgaacctggagtgctctgtcggacttcgcccacagtcattgcaggacgctgtgagatgaagcaacacgtttgatggtgtcgaagcctcggcaccgagctgagaactgcttgggcttttctctgaagaagaattgggtgttgcttgaacttatgagactactgtgttttctgtaatagggttgtaccaggttttttgccccatagcttgtattcaggtatggaatacaagcagtgggttttcctggt

SEQ ID NO: 4897 - DNA, 1639 bp, Hordeum vulgare
gtttcctagctaaagtgctgctcaattaactgtcttattgtacaggaaagctttgcattgaagttagtccagcggccaaacttgcattcatttctgaagagctgtgtattggttgtggtatttgtgttaagaaatgcccatttgatgccattgaaatcatcaatcttccaaaagatttggagaaagatactacccatcgctatggaccgaataccttcaaattgcacaggttgcctgttccaagacctggtcaagttttgggccttgttggaaccaatgggattgggaagtcaacagcacttaaagtcttagctggcaagctgaagcccaacctgggacgattcaaaaatccacctgattggcaagagatccttacatatttccgtgggtctgaacttcagaactattttacgcgcatattggaggataacctgaaggcaatcatcaagcctcagtatgttgaccatattccaaaagctgttcaaggaaatgtagggcaagtacttgagcagaaagatgagcgggatatgaaaaatgagctgtgtgttgaccttgaattgaaccaagttattgacagaaatgtaggagatctgtctggtggcgagcttcagaggtttgcaatagcagttgttgctgtacaaagtgcggaaatttacatgtttgatgagccatcaagttatttggatgttaaacagaggctcaaggctgcacgagtcattaggtctttgcttagatcaaacagctatgtcattgttgtcgaacatgacttgagtgtcttagattacttgtccgactttatttgctgcttatatgggaagccaggtgcttacggtgtagttacattaccattttcggtccgagaaggtatcaatattttcctggctggatttgttccaacagaaaaccttcggtttcgagatgaatctcttacatttaagattgcggagacccaggaaaacgcagaggaagttgctacgtaccagcggtacaagtaccctaacatgagcaaaacacagggaaatttcaagctttctgttgttgagggtgaattcactgattctcagattgttgtgatgcttggtgaaaacggcacagggaaaactacattcatcagaatgctggccgggttgttgaagccagataccatggaaggaaccgaggttgaaattcctgaattcaatgtgtcctacaagcctcaaaagatcagtccaaaatttcagcatccagtgaggcacttgcttcattcgaaaatacgcgattcatatactcatcctcagtttgtatctgatgttatgaaaccactacaaattgagcaactcatggaccaggaagttattaatttatcaggtggagagctccagagagtagcattatgtttgtgccttggaaagcctgcagatatttatttaattgatgagccaagtgcatatctcgattcagagcagcgtattgttgcctcgaaggttatcaaaagattcatccttcatgcaaagaaaactgcatttattgtggagcatgatttcatcatggcaacctacttagcggacaaggttattgtttacgaaggacttgcttctattgactgtactgccaatgcaccacagtctttggtatctgggatgaataaattcttatcggt

SEQ ID NO: 4898 - DNA, 1819 bp, Amborella trichopoda
tatggcagatcagagattgaatcgaattgctatcgtcaatgcagatcgatgcaagccgaaagagtgtcggcaagagtgtaaaaagagctgccctgttgttagaactggtaaactttgtatcgaggtttcccctgcctcaaagattgcttatatttcagaagagttatgcattggatgtggtatttgcgttaagaaatgcccatttgatgccatccagataatcaatttgcccaaagatttggacaaagatacaactcatcgatacggcccaaacacattcaagttgcataggttgccggttccaaggccagggcaagtccttgggctggttgggacaaatggtattgggaaatcaactgctcttaaagtgctggctgggagattgaaacctaatttgggacgctttaggaatcctcctgattgggaggagatattgacatatttcagggggtcagagcttcaagattattttattcgtcttttagaagacaatctaaagcctgccatcaagcctcagtatgttgatcacataccaaaggcagcacgggggactgtccgtgaggttcttgctcagaaagatgagaggggaatgatgactgaaatttgttgtgacctagagttgaatgaggttatggatcatgacattggtgacttatctggtggagaattgcagcggtttgctattgctgttgttgcagttcagaatgctgacatatatatgtttgacgagccatccagttatcttgacgtaaagcaaaggataaaagctgcgcaagtgattcgatctttgctcaggcccaacagctatgtaatcgtagtggaacatgaccttagtgttctggattacttatcggacttcatttgctgcctttatggaaagcctggagtttatggagttgtaacacttccattttctgttagagaaggaattaatatctttttagctgggtttgttccgactgagaaccttcggttcagggataaccacctgacattcaagattgcgagcaatcatcaagaaaatgcagaggagatgaagtcctatgcccgacatagatacccaacaatgagtaaaactcagggtaaattcaagcttacagtaattgagggtgaatttactgattctcagattattgtaatgttaggggagaatgggactgggaagacaacgtttatccgcatgctggctggtcacttgagagccgatgaagtggatggaggtttgggtgtggaagtacctgaattcaatgtctcttacaagccccagaagattagtcccaaatacccttcaaaagtcagacatctactgcatcaaaagattcaggattcctatatgcatcctcagttcatgactgatgtcatgaaaccccttcaaattgagcaattaatgaatcaagaagttgtaaatctatctggtggagagttgcagagggtggcattgtgcctatgccttggcaagcctgctgacatctatctgattgatgagccaagtgcttatctggattcagagcagcgtattgtggcctcaaaggttatcaagagttttattcttcattccaagaaaactgcttttgttgtggagcacgatttcataatggcgacttacctggccgacaaagtaattgtatatgcggggaaaccatctgtagaatgcactgctaatgctcctgaagaattgttgacaggaatgaaccgattcctatcacatctggatgttacattgaggcgagatacaaccagctataggcctcgaatcaacaaattggactccacaaaggacagggaacagaaagcagctgggacctattactataattaa

SEQ ID NO: 4899 - DNA, 1762 bp, Ambrosia trifida
ggtcgtatataagtcttccgacggtagcgtttgtcgtatagggtgtggttatattagtgttaagaaattagacccgtttgtatgtcaattagtagatcattaatttacctaaaagatttaggataaagacacaactcatcgttatggggccaacaccttcaaactgcacaggttgcctgtcccaaggcctgggcaagttcttggtttggttggaacaaatggaattgggaagtctacagcttcttcaaagttcttggctggaaagttgaacccaatttgggccgttttaataaccctccagattggcaagaaattttaacctacttccgaggttctgagttgcaaaactactttacccgtattcttgaagataatttaaaggcaatcataaagccacagtatgttgatcatattccaaaagcagttcaagggaatgttggacaagtacttgaacagaaagatgagagagatgtgaaggcagagctttgtgtggatcttgagctgaatcaggttattgatcgtaatgttggcgatttatctggtggagagcttcaaaggtttgcgattgctgttgttgccatacagaatgctgagatttatatgtttgatgagccctcaagttatctcgatgtcaaacaaaggctcaaagctgctcaagttattagatctttgcttagacctaacagctatgtgattgttgtggagcacgatttaagtgtgcttgattatctatcagacttcatttgctgtctctatgggaagcctggtgcatatggtgttgtgacactacccttctctgtcagagaaggaattaatatctttttggaagggtatgtgcccacagaaaaccttcgttttcgtgatgaatctcttacatttaaggtagctgagacaccacaggagagtgctgaagaaattgaaacctatgcacgttatagatacccaactatgactaaaacacaaggtggttttaaacttaaagtggctgagggtgaattcacagactctcaaatcatagtaatgctgggtgaaaatggaacaggaaagaccacgtttatccgtatgctggctggtatacagaagcctgataccatagaaggatctgagacagagatacccgagttcaatgtgtcgtacaaacctcaaaagatcagtcccaagttccctaattcagtcaggcatttgttgcatcaaaagattcgggactcatatatgcaccctcagtttgtttctgatgtcatgaagcctcttcaaatcgagcagttaatggatcaagaagttgtcaatctttctggtggtgaattgcaaagagttgcattgtgcttgtgtcttggcaagcccgctgatatttacctgatagatgaaccaagtgcatatcttgattctgagcagcgtattgttgcttcgaaagttataaagagatttatactacacgctaaaaagactgcatttgtggttgaacatgatttcattatggctacttatctagcggatcgggtgattgtttatgaagggacaccgtctgttgattgtgttgcaaatgcacctcagtctttgttaaccggaatgaatctctttttatcacatctgaccattacatttaggcgggacccaaccaattatcgaccaagaattaacaagcttaattcaacaaaggacagggagcagaaacttgctggatcctattattacctggatgactaaataatctatttcagtttcatacaagcctacatgacttttgggtatacatactgtataa

SEQ ID NO: 4900 - DNA, 2857 bp, Prunus mume
gtactggttctatactttttcgaatagaaccggccgcacccaactagtgagctttctgaaactcattagggttctctactctactctcacacccaaaatttctcctctctctcgccgctcaggccgccgcacgcatccgcctcatttcttctagtctctatcataatctcagcgtcctcgaatctctctctaatctcagcctcatcgcttccctctatctcatccgatcattggcgtcagctccttcaaatcttggggctgcggcgttgtcaatttccagtacttcatccaactacattcgaagattaggagatggcagatcggttaacccgtatagcaatagtgagctccgacagatgcaagcctaagaagtgccgccaggaatgcaagaagagctgtcctgtcgtcaagactgggaaactatgtatcgaggttacccctgcatccaagattgcttttatctcagaagaattgtgcattgggtgtggtatctgtgttaaggtctgtagaaagtgttattactgtcatttttcttgttctatacactagtcatgttttaaaggcattctttggactctataccatctgatgatgcagaaatgcccatttgaagcaatccaaattatcaacttgccaaaggatttagacaaagatacaacacatcgttatgggcctaacactttcaaactacacaggttaccagtcccaaggccagggcaagtacttggtttggttggaactaatggcattgggaagtcaactgccctaaaagttttggctggaaagttgaaaccaaatttaggtcgtttcaataatcctccagattggcaggaaattttgacctactttcgaggatctgagttgcagaattattttacccgtatcctggaagacaatttgaaggccattataaagccccagtatgttgatcacattccaaaagcagttcaaggaaatgttggggaggtgctcaaccagaaagatgaaagggatatgaaggaagaactgtgtgctgatcttgagctgaaccaggttatagatcgtaatgtaggggatttatcaggtggggagcttcaaagatttgccattgctgtcgttgccatacagaatgcagagatatatatgtttgacgaaccttcaagttatcttgatgtgaaacagaggcttaaagcagcccaagttgtccgatctttgctcaggcctaatagctatgtaattgttgtggagcatgatcttagtgtcttggattacttatcagacttcatttgctgtttatacgggaaaccgggtgcatatggagttgtaactcttcctttctcagttagagaaggaattaacatcttcttggccggatttgttcctacagaaaatcttaggttccgggatgaatctctgacctttaaggttgctgagactccacaggaaagtgctgaggaaattgagacatatgcacgatataaatacccatctatgactaaaactcagggaaactttaggcttcgtgttgttgagggagaatttacggattctcaaattattgttatgctgggtgagaatggaacagggaagacaacatttatccgtatgctggctggtctattgaaacctgatattgtagaagattccaatgtggagatacctgaattcaatgtttcttacaaaccccagaaaatcagtccaaaatttcaatccactgtcagacacttgttacattcaaaaattcgtgattcatatacccatccccagttcatgtcagatgtgatgaagcctcttcttattgaacaattgatggatcaagaagttgtgaatctctctggtggagagctgcaaagggttgcattatgcttatgcctcgggaagcctgcagatatctatcttatagatgaaccaagtgcctatcttgattctgagcagcgtattgttgcttcaaaagtcataaagaggtttatcctacatgctaagaaaactgcattcgtggttgaacatgactttattatggctacctacttggcagatagagttattgtctatgaggggaagccatcaattgattgtgttgcaaattctccacagtcattattgactgggatgaatctattcttatctcatcttgatatcacatttcgacgtgaccccactaactaccgcccaagaatcaacaaattggagtcaacgaaggatagggaacaaaaagctgctggatcctattattacttggatgattgatataaccacgaagttttggccaaatttagagggcttcaatgtgatctaataatggaatcccggctgagtcatgacatgctgacaaatgatgggacgccctttgtctgtgaagaggtgatgtttgtttaccagtgagtttccgtgaatgagagtttccaggcccttccatattgttgctagttgagtacattatgccctatgtgtgcttgcacttatcccaattttgttaaaatttgtctctgggcgacggaatctaaatgtacaatggtctctcatagtatcaatttttctttctttttgattaacttttgtgcttccagggtttatgtaacttttgtctctgccattatgatttttagttttcacaccagaaatgcatgggtgttttaactctgaattaaaaagaagtttgcttcatatttgcacatgacgggtttgattgctgggcaggatttgatgaaccaccctttctaactgcacagaggaggtaccactctcctgccatgtttgtttggtgaagtgccaaacgaaaaatctgaaaagatgaggataatagatattttattgtcttgtctggtgtgtgattgaattggattatgattatatggttatacctacggtcctttggatt

SEQ ID NO: 4901 - DNA, 1617 bp, Plantago ovata
gaagatgtcggatcagaggctgacgcgtatcgccatcgtgagctctgacaagtgcaagccgaagaaatgccgtcaggagtgcaaaaagagctgccctgttgtcaaaacaggtaagctgtgcattgaagtgtcatcagcatcgaagatagcttttatttcggaggaactgtgtatcggatgtggtatctgcgtgaagaaatgtccgtttgaagctatccagattatcaatctgccgaaggacttggaaaaggataccacccaccgttatggtcccaacacgtttaaattgcacagattgccagttccaaggcccggacaagttcttggtttggttggaactaatggcattggaaaatcaactgctatcaaagttttggctgggaagctgaaaccaaacttgggacgctttaaaaatcctcctgattggcaggagatcttgacatacttccgaggatctgagttgcaaaattactttactcgcattctggaagataatttgaaggcgatcatcaagccacagtatgttgaccatatcccaaaagctgttcaaggcaatgttggcgaagtgcttactctgaaagatgagagagatatgaaagaagaacttggtatagaacttgagctgaatcaggttatggaccgaaatgtgggagatttatctggtggggagcttcaaaggtttgctatagctgttgtctgtatccagaatgctgagatttatatgtttgatgagccctcaagttaccttgatgtgaggcagagactcaaggcagcccaagttatcagatccttgcttcgtcccaatagctacgtgattgttgtggagcatgatcttagtgtgcttgattatttatcggatttcatctgctgcctttatgggaagcctggtgtgtatggagtggtgacccttccattctcggttagagaaggaatcaatatatttctggctggatttgttcccactgagaatctaagatttcgggacgaatctcttacatttaaggttgccgagactccacaggaaagtgccgaggaaattgagacatatgctagatacaggtatccgggcatgtgtaaaactcagggcaatttcaaacttcaggtgaaggagggcgaattcactgattctcaaatcatagtgatgctcggtgagaatggtactgggaagacaacatttatacggatgctggctggtcttttgaagcccgattcagtagaaggttctgatgttgaaatacctgagttcaacgtctcttacaagcctcagaagatcagtccaaagtttcagtataacgttaggactttgttgcaccaaaaaatccgtgattcatacatgcatccccagtttgtatcagatgttatgaagcctctgcaaattgaacagctaatggatcaagaagttgtgaatctatctggtggagagttgcaaagagttgctctaaccctttgcctcggaaagcctgcagatatatatctgattgatgaaccaagcgcatatctagattcggagcagcgtattgttgcttccaaagtcatcaagagatttattcttcatgcaaagaagactgcttttattgtggagcatgacttcattatggcaacataccttgcagatag

SEQ ID NO: 4902 - DNA, 2491 bp, Medicago truncatula
gcggtaaaagacaacagtttcacaaaccctccactctccttgcgattgcgccgtcgcacctttcccgtccagcgaggctcacctttcaccgtcctccctctctattcaccgacagttgaatattggtggtttattgcaacatgacgcgtattgccattgtcaatgaagacagatgcaagccgaaaaagtgtcgacaggagtgtaagaagagttgccctgtcgtcaaaaccggaaaattgtgtattgaggttaattctgcatcgaagattgcttacctatccgaggaattgtgcaatggatgtggtatttgtgttaagaaatgtccttttgaagcaattaagattatcaacttgccggagaatttggacaaagaaacaactcatagatatggtcctaatacttttaagctacacaggttgccgattccgaggccggggaaagtgcttggtttggtagggaaaaatggaattgggaagtccactgcccttaaagttttggctggagagttggagccaaatttgggtcgtttcaccaacccccctaaatggccggaaattttgactttttttcggggatctgaattgcagaattactttactcgctttcgaggggaaggtttgaaggctatcatcaagcctcagtatgttgatgactttcgaagaaaggagcaagtgaatgttgggcaggcgctagaccaaaagaatgagagagatatgaaggaagagctttgtgctgctcttgagcttaatcaagttatagatcgtaatgttgttgatctttcagggggtgagcttcaaaggtttgccattgcaggtattgccatccaaaatgcggagatatacatgtttgatgaaccttctagttatcttgatgtgaaacagaggctgaaagctgcccaagttgtccggtcattgctaaggcataatagctatgtaattgttgttgaacacgatcttagtgtcttggactacttatcagactttatttgctgtttgtatggaacacctggtgtatatggagtcgtaacacttcctttctcagtcagagaaggaattaatatcttcttgtctggctttgttccaacagaaaatcttaggtttcgggaggactctcttaccttcaaggttgcagagactccacatgaaactgatgaagctcaaacatatgctcggtacaagtacccaaccatgaccaaaactcaaggcaagttcaggcttcgtgtagctggaggagaatttacggattctcagattgttgttatgattggtgagaatgggacgggaaagacaacattcattcgtatgctggttggttcattgaaacctgacactataggtggatctgatctggagatgcctgagttcaatatttcttacaaacctcagacaattaccccaaagttcaaatcaactgttagacacctgttacatgaaagaattcataaatcttatactgatccccagtttatatcagatgtgatgaaaccactacttattgaacagctgatggacaaagaagttttgaatctttctggtggagagttgcaaagagtttacttatgtctttgtcttggaaagcctgcagacatttatctgatagatgagccaagtgcatatcttgattccgaacagcgtattattgctgcaaaagttatcaagaggtttattcttcatgcaaagaaaacagcctttgtggttgagcatgatttcatcatggcaacttatcttgctgacagagttattgtttatgagggtcaaccttcaattgactgtactgcaaattctccacaatcactgctgactgggatgaaccttttcttatcacatcttgatatcacatttagaagagatccaactaatttccgcccaaggatcaacaaacttgattcaaccaaggatagagagcaaaagcttgctgggacttattattaccttgatgactaagttcagcctgctcttttaccaacgcaacaactcaacaatttgagcttcccagttttagtttattaccttgatgactgagttcagcctgctcttttgtgaatgcaacaactcaacaatttgagcttcccagttttaatttatttgatgccttgacctataagatagtccttttttccctgttgaagccatctttctcaatggatatagagaagagtttgctgcatgcagagtatatgttggttggtgcatttgtacatgtttccgcaatacttggcgatgttgctcatggccagttttggtatgatttcggccagtgaatctgtttattacacagtttattcggtcatggtttcacatttgatgttcctcaactgaataacgatgccatgtattaagtttattgccatctcagctctcataatttatcatatgtgacgaagtatacgttcactttcaagttacttgattttggtagatcgtttcttttaagaatattttgctacttagaggattgatattttaatggttatcatatcatttttagatga

SEQ ID NO: 4903 - DNA, 1814 bp, Prunus persica
atggaaaatcggtcgactcgcatagcaatagtgaacactgacaaatgcaagcccaaaaaatgtaaccaggaatgtaagaggacttgcccggtcgtacgtactggtaaattatgcattgaggtcaaacctgtgtccaaggttgctcgtatctccgaagagttgtgcattggctgtggtatatgtgttaagaaatgcccatttggagcaattgaaatcatcaacttgccaaaggcactggacaaagacacaacctatcgctatgggtctaactcttttaaattacacaggttaccagtccctaggccaggggaagttcttggtttggttggaactaatggcattgggaagtcaactgccctcaaaattttggctggcaagctcaaaccaaatttgggtcgtttcaataatcctccaaattggcaggaaatcttgacttactttcgaggatcggagctgcaaagttattttattcgtctcttggaagataagttgaaggctgttataaaaccccaatacgttgactacattccaaaagtagctgaaggcaatgtaggggagttgctcaaacagaaagatgagagaggtgtgatggaagaagtcattgttgatcttgagctaaaccaggttctagatcgtaaagtagtcaatttatctggtggggagcttcagagattcgccattgcttttcttgctttgcaaaaggcagatatatacatgtttgatgaaccttcaagttatcttgatgtgaaacaaaggcttaaagctgccaaagtcatccgatctttgatcaggcctgatagctatgtaatcgttgtggagcacgatttgagcgtcctagactacttatcagatcacatttgttgcttatatgggaagccgggtgcatatggagttgtaaccctacctttctcagttagagaaggaatcaacatcttcttggcgggatttgttcctacagaaaacctaaggttccgagatgaatctttgacttttaaggtttctgagactccacaagaaagcggtgaggaaattgagacatatgcacggtatgggtacccatcgatgactaaaacgttgggagacttcaagcttcaagttatagagggcgaatttagcaattctcaaattattgtgatgttgggtgagaatggatccggaaagactacatttatgagaatgctggttggcctattgaaacctgattctgatgtggagatacctgagctttgtgtttcctacaagacccagaaaattaatacaaagcgtgcaataaaagtcaaagacatgcttcatgaaaaaattcgggattcctgtacacatccccagtttgtgacagacgtgatgaagcctcttcaaattgggcaattaatggatcaagatgttaccaaactctctggtggagagctgcaaagggttgctctatgtctatgccttggaaagcctgcagacatctatctgatagatgaaccaagtgcatatcttgattctgagcagcgtatcgttgcagcaaaagtcataaagaggttcatcctccacgctaagaaaaccgcattcgtggttgagcatgatttcattatggctacttacttggccgacaaagttattgtctatgaaggaaagccatcagtcgattgtattgcaaattctccacaatctttgttgactgggatgaatctcttcttatctcaactggatatcacatttagacgtgaccctacaaactatcgcccaagaatcaacaaactgaactcaaccaaggatagggagcaaaaagctgctgggtcctattattacttggacgactaaactggaac

SEQ ID NO: 4904 - DNA, 2059 bp, Brassica rapa
agtcgatttgtaggggctcatagatctttctactcgccgactgatctgctgtaaactgtgtaagttgaggaatggcagatcgattgacgcggattgctattgtgagcgaagaccggtgcaaaccaaaaaaatgtcgccaggaatgcaagaagagctgtcctgttgtcaagacagggagactttgtattgaagtcactcctacttccaagactgctttcttatcagaggagctgtgtataggatgtggtatctgcgtgaagaaatgcccgtttgaggctattcaaattatcaatcttccaaaggatctagagaaagatacaacccaccgctataggtccaatgctttcaaattgcacaggctcccagttccaaggccgggccaagtcctagggttggtcgggacaaacggtattgggaaatcaacggctctcaaaatcttggctggaaaacttaaaccaaatcttggcaggttcgataatcctccggactggcaagaaattttggcccacttccgcgggtcagaacttcaaagctatttcacccgagttgtagaagaaaatctaaagacggctataaagccccaacatgtggaccagataaaaaaaattgttcaaggtgatcttgggaagatgcttgagaagctggacgagagaggaatgatggagcagattgtcgctgatctggagttgaacccggtactggaccgtagagcaaaagatgtatctggtggagagcttcagaggtttgccattgccgctgttttcatcaagaaggctgagatatacatgtttgatgaaccatctagcttcctcgatgtgaggcaaagactcaaagctgctcaagttatacgctcactcctcaggcctgacagctacgtgattgttgtggagcatgacctcagcgtcctagactatttgtcagacttcatctgctgtctgtatggaaaaccaacagcatacggtgtcgtgactctccccttttctgtcagagaaggaatcaacgtgttcttggctggctttattcccactgaaaacttgcgtttcagggacgaatctctgaccttcaaggtttctgagactccacaagagagtgatggggaagtgaagtcctatgcaagatacaaatacccaaacatgagtaagactcttggaagtttcaagctggaggtgatggaaggtgacttcaccgactctcagattgttgtaatgcttggggagaacggtactgggaaaactaccttcatccggatgctggcaggtgcactgaaacctgacgagggtgtagaagaagatatgccagtgtttaatgtgtcttacaaaccgcaaacttatgatgcgcagcgtgagtgttccgtgagacagttgctccatgagaggatccgtgatgcttatatgcatcctcaatttgtatcggatgtaatgaaaccgcttcagattgagcagctgttggatcaagcaatttgcacgctctcgggtggagagtcgcagagagttggcataacgttatgcctggggaagcctgctgatatatatctgatagatgagccaagtgcgtatctcgactctgagcagagaatcacagcgtcaaaggtcataaagcgcttcatcctccacgcaaagaaaacagcatttattgtggagcatgactttattatggcaacctatctggcggaccgagtcatagtgtatgaaggacaaccatctatcaagtgtatggctcattctccacagtcactccttagcggaatgaacctcttcttatcgcacctgaacatcacattcagacgtgatcccactaacttcaggccaaggatcaacaaattagagtctacaaaggacagggagcagaagtctgctggctcatactactacttggacgactgaccctttttttttatgaatatgctgcctgcacaaaataaactcgcaagttgtttgtgtacttcccctttgataaaatttttaattatgactatggtttataacttgtttgtaatgttgttccatacatcagaccaatgatactgtcttttatatgattttattatatcgtttttaaa

SEQ ID NO: 4905 - DNA, 1991 bp, Prunus mume
atgggctgggatgaagaggaagggtgtggggctgagaagagagctcaggggcttcgcataccctctcattcatcgatcatcccctctctctctctctctctctctctcaaagctatcaaagctatcaaagccatcttcatctacagtaacacaatggaaaatcggtcgactcgcatagcaatagtgaacattgacaaatgcaagcccaaaaaatgtaaccaggaatgtaagaggacttgcccggtcgtacgtactggtaaattatgcattgaggtcaaacctgtgtccaaggttgctcgtatctccgaagagttgtgcattggctgtggtatatgtgttaagaaatgcccatttggagcaattgaaatcatcaacttgccaaaggcactggacaaagacacaacctatcgctatgggtctaactcttttaaattacacaggttaccagtccctaggccaggggaagttcttggtttggttggaactaatggcattgggaagtcaactgctctcaaaattttggctggcaagctcaaaccaaatttgggtcgtttcaataatcctccaaattggcaggaaatcttgacttactttcgaggatcggagctgcaaagttattttattcgcctcttggaagataagttgaaggctgttataaaaccccaatacgttgaccacattccaaaagtagctgaaggcaatgtaggggagttgctcaaacagaaagatgagaggggtgtgatggaagaagtcattgttgatcttgagctaaaccaggttctagatcgtaaagtagtcaatttatctggtggggagcttcagagattcgccattgcttttcttgctttgcaaaaggcagatatatacatgtttgatgaaccttcaagttatcttgatgtgaaacaaaggcttaaagctgccaaagtcatccgatctttgatcgggcctgatagctatgtaatcgttgtggagcacgatttgagcgtcctagactacttatcagatcacatttgttgtttatatgggaagccgggtgcatatggagttgtaaccctacctttctcagttagagaaggcatcaacatcttcttggcgggatttgttcctacagaaaacctaaggttccgagatgaatctttgacttttaaggtttctgagactcaacaagaaaccggtgaggaaattgagacatatgcacggtatagatacccatcgatgactaaaacgttgggagagttcaagcttcaagttatagagggtgaatttagcaattctcaaattattgtgatgttgggtgagaatggatccgggaagactacattcatgagaatgctggttggcctattgaaacctgattctgatgtggagatacctgagctttgtgtttcctacaagacccagaaaattaatacaaagcgggcaataaaagtcaaagacatgcttcatgaaaaaattcgcgattcctgtacacatccccagtttgtgacagacgtgatgaagcctcttcaaattgggcaattaatggatcaagatgttaccaaactctctggtggagagctgcaaagggttgctctatgtgtatgccttggaaagcctgcagacatctatctgatagatgaaccaagtgcatatcttgattctgagcagcgtatcgttgcagcaaaagtcataaagaggttcatcctccacgccaagaaaactgcgttcgtggttgagcatgatttcattatggctacttacttggccgacaaagtcattgtctatgaaggaaagccatcagttgattgtattgcaaattctccacaatctttgttgactgggatgaatctcttcttatctcaactggatatcacatttagacgtgaccctacaaactatcgcccaagaatcaacaagttgaactcaaccaaggatagggagcaaaaagctgctgggtcctattattacttggacgactaaactggaacactgtccaacatgttcgagacaac

SEQ ID NO: 4906 - DNA, 3609 bp, Volvox carteri
taggcagtgtctgcaagctgactggacgtctttctgacactagccccagcctggggtcgcagggcgcttcctactggacagcgctgcgcaaggacacataacctttttcaattgtacatttgcaatccgttaaacttaggaggaaagagaatcggcaagaatgccgcccaaaaagggcgaagaccgcaagggcggcgaggagacgctgacgcgtatcgctatcgtcagtgaagacaaatgcaagcccaagaagtgccgacaagagtgcaagaagagttgccctgtggtcaaagttggcaagctgtgtattgaggttgcgccaaactccaagattgcctggatttctgaggagctttgtattggttgcggtatctgcgtgaagaaatgcccgtttgaggccatcatgattattaacctgcccaaggacttggagaaagagacgacccacagatatggacccaactcgttcaaactccacaggctgcccatgccccgtccggggcaggtattgggcctggtgggcaccaacggcattggcaagtccacagccctgaaggtgctggcagggaagctcaaacccaacctgggcaggttcacgaacccgccggactggcaagagattctgacctacttccggggctcggagctccaaaactacttcacccgtgtcctggaggacaacctcaaggccatcatcaagccgcaatacgttgaccacattcccaaggccgtgcgcggcaacgtgctgacggtgctggagcagaaggaccagcgggacgtcaaggccatgctgctcagggatctggacctggagcaggtgacggaccgcaatgtggagaacctgtctggtggggagctgcagcgcttcgccatcgcggtagtcgcctgtcagcaggctgatgtgtatatgctagacgagccgtcatcgtacctggatgtacggcagcgactcaaggcagcgcaggtgatccggtcgttattggacgtggacaagttcgtcattgttgtagagcacgacttgtccgtgctggactacctgtcagacttcatctgctgtctttacggcaagccgggagcgtacggcgtcgtgacgctgccgttcagcgtcagggagggcatcaacatcttcctggcgggtttcgtgcccactgagaacctgcgcttccgcgaggagtcgctcagcttcaaggtcacggagcagacggacgccgctgaggtcgtcaagaagtttagccgctacaagtaccccaagctcaagaagacacagggcaacttcacgcttgaggtggagccgggcgagttcacggacagcgagatcctggtcatgcttggcgagaacggaaccggcaagacgacctttatccgcatgctggcgggcgccctgccctctgacctggctgagggtgaagacggggagctttcggagctgccccagttcaacgtcagctacaagccgcagaagatttcccccaagttcgaggggaccgtacggcagctgctgcacaagcgcatccgagagtcgtacatccatccgcagttcaatgcggatgtgatgaagccgctcagcattgaggcgctgatggaccaggaggttcagaacctgtcgggtggtgagctgcagcgtgtggccatcactttggcactggggcagccggctgacatctaccttatcgacgagccgtcggcttacctggatagcgagcagcgcatcatggccgccaaggtcattaagcgcttcattatgcactcgaagaagacggcgttcattgtggagcacgacttcatcatggcgacctacatggccgaccgggtcattgtgtacgagggagagccgtccaaacacgcctttgctcgtacgccgcagagcctgcagacgggcatgaaccagttcttgcgcaacctggacatcaccttccgccgcgaccccaccaactaccgcccccgtatcaacaagtggggctccaccaaggaccgcgagcagaaggatgcagggaccttttactacattggtgacgactaaggggcaaccagtagtccgtgactgcaagtgggttgcgtatgctgatggtggctgttgcggcttgcacggcggcagcagcctgctaatcgccgcagttatggccaccagaaacggttttcattacgaatggcggattcacaccagggcaggcatagaggttcggggcctccgagtgcgcaacgacagtcgatggtagatggtatgttcgccccgcggtgttcactacacggtaggcaccggcgatgtgggcaatcccaggaccgggatctcggccgctctggcggttgggctgcagcgacctgctgggtgtgggattagcgctggagcctgcccacacggcgacggatgaacgagagaggaatgaggctatctgctagtctctgctgaaagcgcgcgggcggcatgcagatgggcttctcgatggtgcaaccgacgaagatcgtgccgatagtggctcagcagcgagaagtccaagaaggacagggcagggaggctttgcaggtcctttttgaaggacgcaccaatgtgtgctgggatggacgatcgccgatgcagcacgcggagggggtctggctcgccacaaggatggcggcgtggacggagatttcttgtcctgaatggcgttcagtggggggggaaagctaagggagaaggtagttaggcaaagagacggccttcagtgcagcaattgctggtcacggtttttccggacgcattctgcaatgcggttgtggtcaccggcacgggcgggcatggtggttgtctgggcggttactgcagcagggaaaaggaaccgtgggactggaagtggcagtgcggtggcgggatggagaggcaaaaagggcaaagtggagaaaggagcaaccacgcaacctgaaggagaggtggcgtgcgatgtccctaataggtggtatgcagcaagattccctgacggctcgcgtccttaagcagtcggttgtgtgacaagggatgtgaggaggctttgttggtgcgcaggagaattaggacgagtgggtgtttaggaagggtcttttctcaagacatgtttgacctgataaatacttgggacatcgttttgtgcatgtggtggtgcttgtggacggggtgcgtttgtggggtcggaaaggggcgtcgggacgtggggggcacgaggcatgaccttgcgagaagagaatgcgggagggaggtcggacacgggagattgtaaaaggagcttgaaagcgtgttatgtgctagcgtgacgtggcgcgagcgtgagggaagatatgcaggtaaacagtgtcgcgtcagtgaatcgacagatgccaggtggaggcatgtcgacctgagtgcgtcgctccctgaatgtgcggttggacattgtgaggtgggcacgagcaattttggctgaattacgccgtagtacactgcggagaggatgcctgctgctattttaactttaaatcaaaagttacgatagctgcgcaggttaatccgccggagtttccgctctgaaatctgtatgcgcgcaaaaatgttcgcatatgtgcagcaggggcctgttgttacatcagggaaaagtcgcatagctgacagacagctttccttcc

SEQ ID NO: 4907 - DNA, 6009 bp, Chlamydomonas reinhardtii
gtgagggagctttactttcactcccgaccggaccttgcggctttctttaggtcctcgccgccgacggtctcgcggtgtgcttcagcattttcacacatcaatctcctgccataccctacctcctttttagctcggacctctaagtagagcagcgccaagatggcgcccaagaaggaggaccgcaagggcggcgaggagaccctcacgcgtattgccatcgtcagcgaggacaagtgcaagcccaagaagtgtcgtcaggagtgcaagaagagctgccccgtcgtcaaagtcggcaagctctgtattgaggtcgcgccgaactccaagattgcatggatttccgaggagctgtgcatcggttgcggtatctgcgtgaagaaatgcccgttcgaggcgatcatgatcatcaacctgcccaaggacctcgaaaaggagaccacgcaccgctacggccccaacaccttcaagctgcacaggctgcccatgcctcgccccggccaggtgctgggcctggtgggcaccaacggcatcggcaagtccacggcgctcaaggtgctggcgggcaagctcaagcccaacctgggccgcttcacgaacccgcctgactggcaggagatcctcacctacttccgcggcagcgagctgcagaactacttcacgcgcatcctggaggacaacctgaaggccatcatcaagccccagtacgtggaccacatccccaaggctgtgcgcggcaacgtgctggaggtgctggtgcagaaggaccagcgcgacgtcaaggacatgctgctgcaggacctggacctggagcaggtgacggaccgcaacgtggagaacctgtcgggcggcgagctgcagcgcttcgccatcgcggtggtggcgtgccagcaggcggacgtgtacatgctggacgagccgtcctcctacctggacgtgcggcagcgcctcaaggcggcgcaggtgatccgctcgctgctggcggttgacaagttcgtcatcgtggtggagcacgacctgtccgtgctcgactacctgtccgacttcatctgctgcctgtacggcaggcccggagcgtacggcgtggtcacgctgcccttcggcgtgcgcgagggcatcaacatcttcctggcgggtttcgtgcccaccgagaacctgcggttccgcgaggagtcgctgacgttcaaggtggtggagcagcaggagggcgaggtggtgaagaagttcagccgcttcaagtaccccaagctcaagaagacgcagggcaacttctctctggaggtggaggcgggcgagttcacagactcggagatcctggtcatgctgggcgagaacggcaccggcaagaccaccttcatccgcatgctggcgggcgcgctgccctccgaccccatggagggcgaggacggcgaggagcccgagtcgctgccgcagttcaacgtgagctacaagccgcagaagatcagccccaagttcgagggcacggtgcggcagctgctgcacaagcgcatccgcgagagctacatccacccgcagttcaacgcggacgtgatgaagccgctgaccatcgaggcgctgatggaccaggaggtgcagaacctgtcgggaggagagctgcagcgtgtggccatcactctggctctgggccagccagccgacatctacctcatcgacgagccgtccgcctacctggactcggagcagcgcatcatggccgcaaaggtcatcaagcgcttcatcatgcacagcaagaagacggcgttcatcgtggagcacgacttcatcatggccacctacatggcggaccgcgtcatcgtgtacgagggcgagccctccaagagggcctttgcgcgcacgccgcagagcctgcagaccggcatgaacaagttcctggccaacctggacatcaccttccgccgcgaccccaccaactaccgcccgcgcatcaacaagtggggctccacgaaggaccgcgagcagaaggaggccggcaccttctactacatcggcgacgactagatgcggggcgactagatgcggggcgactagatgcggctaagatgtggcgggtgtgaaagaggctgctgtggaagaggcgggtgaggaagaggcaggtatggatgaggcgggtgtagatgaggcggctaggctggtggccaggcggccaggcggccggagcgcatgcgcgaggctatggcggtgacggtggagtgtgagcatgggacaaagctgcatcggcagctcggcagtcgggcgcggaggttgcgcggcgggccgagacgaggagacgagtgtggggagggcgccagggctggaggcttgcgtttggggcagattaaggcgcggcaagggtgcgtgtggggcgcggtgtcggcgtttgtgtgtattgttgtttcgctttgcacgatcctgtgtaccggcgcgtcaacacaacgggactgtgccgtgggtttgccgtacgcaagggagatccgggtcggggctggtgcgtggggtgctggcgcactggtcattgtgatgacgcagcgcgccggggtggtgtgggtttggcgtgtgtgttggggttgttgggcgtgcaagcccgtgcattcggatactatgatagctcggtcggagggcaggtggtgatacggacgggagttcgttgaagggcttcggacaggcacgggcctgcagcttcgctggcaattaccggtagatacagaagacgctaatcgtggggttcgcggagagccttgctgcgcgcctagagtggctttgagatatccgagcgctgagacgaaattacgaaaagagaggtgcgagcggcataggcagagatgtagcacatgtgctggcggtgccagtcccagtcccgcaaaacagggaaggctttcgtgtgcgcctgctcggcacatggcgcttggaagggatgtgtcagggatgtgtgtctgtgtggagcggaacgggctttcgtggcttgcggacggccgcatagtcagtcagcttgccatccggctcgggatgtgggtgatgccgacgcagctcgggtgtgaattggcgtgtcgaaggggcacacacgttgcgcggcaaacgacctaaaacgaccaatgtaagacggccaggtatgaccgccaagtgtcaccccgcagcgggtggagagctgcacggctggcaggtcgtgtcgatacgcgaacggggagctgcgagaggatgcgtgcgcggggcctcaggttgggcccaggcaaagtcccaggctgtgccgacacaggcacttggcggttggcaggatgtcagggagtcctaaaagcgtaggattacgctcgtaaaacgctcacggttgcagtggctttaggccgcccgcgaggccgacgctatccgtctccgtcggttcgggcgccgcggcatcgcaaacgtggcgttgtcgtatttgggttgcgaaccctacgccaccggcagcatttcataccagcttgcatcatcaagcaggctgtcatcattgagacgccacgtgttcagagttctataacaggctgtttccactcggcccactccacttgggttagtgggagctctagtggggcgcaagtggttcgctagtggaaggcgtctccacatgggctccactagcgatggggttcgaaataaaagcccccccaaacgcacgccagtagttataatttcaattgcaaccaatacaaatgaacgattgaacgttacttttgctatgcctggcgcctttgctgctgcaaaactaccgagcctttcggtcggcatgccgggtgcccgcgcaagcggctgctgcgagggctgcccgaacaccccggctgtctgtgtcatgttgaggtgttcagccatgaggctgacagcaggcggaagtgcgagacgcgttgacctttgagcttctggccccagcgatgaccgcgagcgaaagaaaagaactgtccaacagctacgtataaggcctgaagttggtttgagcaagtttgtgttgcgcgccaaaacggtttccaggctcggtgcgatttgggcgcctccgctgatgaaaccaagagctgtctgcccatagaagacggcgcctcgaggcggagaccgcggcacgacctgccagctcggcagctgctgcgacctctcgcgtttgtcgtgtacggagcaaggctcccagaggggttttgccaacgtcatcgccggcttcacagcagtatacatgcatcaggaacaagaaaccagctgctgtggaggtcgcatgggcggcgggggcaggcacgactgcagctgcgtgcgtggtgcgggtgagggcgatgtcatgcgcaccgcgagatagattcccggttccatgtggaccgtcggactcggagcgcgctgtggcggagctctttctctgcatttatgcgcggacagcggcagtcaattaggatgcacgcgcggctttggtgggacacgcattatcgccgacgacggttgcgcgggtgtgacctggatgctcgcacaacgcacagccggcagccttggccaccgagctagcgacgctatgaaacgctcggtgcaatccaggaatcggcgtttgctgttataaatggaggcactctcattgtaattagagactggtttggtgggtttgccaggggcctaaacctgattggagtgggggcaagcaggagaggcttcatctgaagctggcaagtaccaggcttgcttgttcattactcaacatcaatgcatgcatgagattcccacactagcacgatgcgatctgcttggttcggtacgggttaactcgccgtttcgcgcgcatgtggggaagtcagtcaatgtaccggaaggcggtttggctgaataaatatgagcgccctttggaaagcagcgaatatgagacgatagtgtttcgtttgtttgcagtggcgcatcattgcatttcatgcaattattattgctgggacacagcattgcccatgcccgtgataacagatatgcggtgcgtgaggccctttatgccaacgcttgccacgctgcatgccacgtctgtacatttgcatttgtggtgttattatgcatccttgaggctggcttcgcaggcttgcatgaaaaccggacccatgaagaacccaatgcgcattcttgaagcttgactgaagaggaagtctttggaggcgcacggctgttaggcagcgctgtacacggtaaagtagggcaatcctggcacgttcgattttggacatgcaacagcgaggctggacctgccagcaatcaaataaaaggctacaagctgatagtggaagatgaagtaaggtgccaaccctaaagacgtaccccacagtttgttttggcgccatgggctggagtgattcgtatgtatgtgcgcgcccccatgaacgttgcaaggacccggctgcggcacaatcgctttgatgggggcatacaaggctctcgtgtgtgcgctttggatggcaggcttgagacgtgtgtggggaagtgagtcaggtggcagttgcggtaatccttagcatatgcttggacttggaagccgctacaaaacacttggtaggtagtatgattcaacgttgaaagcccaggtgggccggcctaacatggctacaaataaatcatgcattcttatttcttgtctgggtctcacgcgctttgagtgggttcctgcagaggcagctccgtttgggcctctttgttgacaatccagggttgtctataatgaagagactggcaaagtggcaaaccacatcacccccttttacctgttaccgtactttccatttcaatccttcctaaatcctgtgtttcggtgggcatgggacgcagcgtctgcgtggcgccaacccggtgagacccgtgtgtgcgtgtgtgtgtgtgtgtgtgtgtgtgtgtgtgtgtgtgtgtgtgtgtgtgtgtgtgtgtgtgtgtgtgtgtgtgtgtgtgtgtcggcgtggtgcctgtgtgggtcagaaagcgaggcagctgaggacgcagcagaggagggccgactgcactgggtagtgtggcacggagcgacaggacgcg

SEQ ID NO: 4908 - DNA, 1900 bp, Eutrema parvulum
gatttgtgtaactttgtacgtagtgtagtgtccttgagggatggcagatcgattgacccggattgctatcgtgagcgaagaccggtgcaagccgaagaaatgccgccaggagtgcaagaagagctgtcctgttgtcaaaacaggaagactatgtatcgaagtcactcctgcttccaagactgctttcttatcagaggagctgtgtataggatgtggtatctgcgtgaagaaatgcccgtttgaagctattcagattatcaatcttcccaaggacttagagaaagacacaacccaccgctataggtccaatgcttttaaattgcacaggcttccagttccaaggccggggcaagtcttggggttggttggaacaaacggtattgggaaatcaacggctctcaaaatcttggctggaaaactcaaaccaaatctcggcaggttcaataatcctccggactggcaagaaattttggctcacttccgcggttcagaacttcaaagctatttcacccgagttgtagaagaaaatctaaagaccgctataaagcctcaacatgtcgaccaaattaaaaaagttgttaaagatgatcttggggagatgcttgagaagctggacgaaagaggaatgatggcgcagatttgtgttgatctggagttggacccgatcctggaccgtagagcaaaagatgtatctggtggagagctgcagaggtttgcaattgccgctgttttcgttaagaaggctgaaatatacatgtttgatgaaccatctagcttccttgatgtgaggcaaagactcaaagctgctcaagttatacgctcgctcctcaggcctgacagctacgtgattgttgtggagcatgacctcagcgtgctagactatttgtcagacttcgtttgctgcttgtatgggaaaccgacagcgtatggtgtcgtgactctccccttttctgtcagagaaggaatcaacgtgttcttggccgggtttattcccacagagaacttgcgtttcagggatgaatctctgaccttcaaggtttctgagactccacaagagagtgatggggaagtgaagtcctatgcaagatacaaatacccaaacatgagtaagactcttggaactttcaagctggaagtgatggaaggagacttcaccgactctcagattgttgtaatgctaggggagaacggtacagggaaaacaacctttatccggatgctggcaggtgcattgaaacctgacggcggtgtagaagacgaagaagcggacatgccagtgtttaatgtgtcgtacaaaccacaaacatatgatgcgcagcgtgagtgtacagtgagacagttgctccatgagaggatccgtgatgcgtatatgcatcctcagtttgtatcggatgtaatgaaaccgcttcagattgagcagctgttggatcaagcaatatgcacgctctcaggtggagagtcgcagagggttggcataacgttatgcctggggaagcctgcagatatctatctgatagatgagccaagtgcgtatctggactcagagctgagaatcacagcttcaaaagtcataaagcgcttcatcctgcacgcaaagaaaacagcgtttattgtggagcatgactttataatggcaacttatctggccgacagagtcatagtgtatgaaggacaaccatcaatcaagtgtatggctcattctccacagtcactacttagcggaatgaacctcttcttatcgcacctgaacatcacattcagacgtgatccgactaacttcaggccaaggatcaacaaattagagtccaccaaggacagggagcaaaaggttgcaggatcatactacttcttagacgattgattgatcggttaaaaagagagggagcttttatgtatatgc

SEQ ID NO: 4909 - DNA, 1989 bp, Chrysanthemum coronarium
gaatgatagaagcttttggtggatttgaggcaagttttgtattgaagtcagttctacatctaagatagcaacaatctctgaggagctttgcatagggtgtggtatatgtgtcaagaaatgcccgtttgatgcaataaatatcattaatttacctaaagatttggaaaaggatacaactcatcgttacggggtcaataccttcaaattgcacaggttgcctatcccaaggcgtggggaagttcttggtttagttggaacaaacggaattgggaagtcgacagccctcaaaattttggctggaaaattaaaacccaatttggggcgttttaataaccctccagattggcaagaaattttgacccactttcgaggctctgagttgcaaaactactttacacgtgttgtggaagatagtctaaaggctattataaaaccacaatatgttgaccatattccgagagcaattcaaggcaacgttggagaattacttgaacaaaagaatgagaggggtgtgatggcggagctttgtgctgatcttgagctgaatcaagttatagatcgtaatgttggagatttatctggtggagagctgcaaaggtttgcaatagctgttatagccatacagaaggcagatatatatatgtttgatgagccttcaagttatcttgatgtgaaacaaaggcttaaagccgcccaagttatccgctccttgtgtgaactcgacagctatgtgattgtagttgagcacgatttaagtgtgcttgattacctatcagacttcatatgctgcttgtatgggaagcctggtgcttatggcgttgtgactctacccttctctgtcagagaaggcattaatatctttttagatgggtttgtgcaaacagaaaatcttcgttttcgtgactggcctcttacgtttagggttaccgagatacatgataatgctgaggaaattcgaacacatgcacgttatagatacccgactatgtctagaacgcagggtggttttaaacttaaggtgctcgagggtgaattcacagactctcagattatagtaatgcttggtgaaaatggaaccgggaagacaacttttatccgcatgctggcaggtatactcgagcctgatactgtggaaggctctgactcggagatacccaagtttaacatctcttacaagccccaaaagatcagtccgaagttcaaaagttccgtcagacttttgttacatacaaagattcctaattcatatcagcatcctcaatttgtttcggatgtcatgaagcctcttcaaatcgagcagctaatggatcaagacgtcgtgaatctttctggtggtgaactgcaaagagttgcactgtgcgtgtgccttggcaagccggctgatatttaccttatagatgaaccaagtgcataccttgattctgagcagcgtattgttgcttcgaaagttataaagagatttatactacattctcagaagactgcatttgtggttgagcatgattttataatggcgacttatctagcagatagagtgatcgtttatgaagggcaaccgtctattgattgtattgctaatgcccctcagtcgttactgacgggaatgaatctcttcctatctcaattgactatcacgttcagacgggatccagataattatcgcccaagaatcaataagctaaattcaacaaaggacagggagcagaaacttgctggatcttattattatctggacgactaaatttcctatttcgagttgcaaactaattgcaggaggttttgatggcaagcaattatgtgttactgacgcctctacttggagagcttccatttttatatagagtaatttataggccatgattacttagtcagggagcagaaacttgcatgcattttttgtcagtgattttgatcacagtttagtttgcggaaatgttttgaacatcttgtggtgttctctatgcttttatcttcttaatatttacatga

SEQ ID NO: 4910 - DNA, 1661 bp, Brassica napus
cgactttgcttttatctctgaggagttgtgcatcggttgcggtatttgtgtcaagaaatgcccatttgaagctattcagattatcaatcttcccagagacttggagaaagatacgacccatcgctatggggccaacactttcaagttgcacaggctgccagttccaaggccagggcaagtcctagggttggttggcaccaatggtattggaaaatcaaccgctctgaaaattttggcagggaagctcaaaccaaacttaggccgtttcactaatcctccagactggcaagaaatcttgactcacttccgtgggtcagaacttcaaaactacttcacccgtattctagaagataatctgaaggccattataaagcctcagtatgtggaccacatcccaaaggctgttcgaggcaatgttggagaggtccttgaccagaaggacgagagagacaagaaggcagagctctgtgctgatctggagctgaaccaggtcattgatcgtgctgttgagaatttgtctggtggtgagctgcagaggtttgccatcgctgttgttgccatacaaaacgccgagatttacatgtttgatgagccgtctagttaccttgatgttaagcaaagacttaaagctgctcaagttgttcgttctctcctgagacctaacagctacgtcattgtggtggagcatgatctcagtgttcttgactacttgtcggatttcatttgctgtctgtatgggaaaccaggagcctatggtgtcgtgactctccctttctctgtcagagaagggatcaacattttcttggctgggtttgttcccactgaaaatttacgttttagagatgaatcgctgaccttcaaggttgctgagactccacaagaaagtgctgaagaaatacagtcgtacgctaggtacaagtaccctacgatgaccaaaactcaaggaaacttcaggttgaaagtgacggaaggtgaattcaccgactctcagattattgtaatgcttggggagaatggtacagggaagacaacatttatccgaatgctggcgggtttgttgaaacctgacgagacagaagagtcagacatagagataccagaattcaatgtttcttacaagccacaaaagatcagccccaagtttcagaattcagttagacacttgctacaccaaaagattcgagattcatacatgcatcctcaattcgtgtcggacgtgatgaaaccacttcagattgagcagttgatggatcaagaagttgtcaatctctctggaggagagttgcaaagggttgcattagctctgtgcctcggaaagcctgcggatatctacctgatcgatgagccgagtgcgtatctggattcagagcaacgtattgtggcttctaaagtcattaagcggttcattctccacgcaaagaaaactgcatttatagtcgagcatgactttataatggcaacatatctcgcagaccgagtcattgtctatgaaggacagccatccattgactgtattgcaaactgtcctcaatcactgctcagtggaatgaatctgtttctatctcatctgaacatcacattcaagaagagactcccaacctaattttccaagaacccaaaggactaccaaaactaaaattagaagtcctaggaacgaaccg

SEQ ID NO: 4911 - DNA, 2068 bp, Hordeum vulgare
atgggccaaatacattcaaattgcacaggtacgttttgttggatcaagacttctcgatctgtatcaagtttcgtgttatttttcatttgtgcaattacaaattttgcacttgcaggctgcctgttccaaggcctggtcaagttttgggccttgttggaacaaatggaataggaaagtccacagcgcttaaagtcttagctggcaagctgaaacctaatttgggacgattcaaaaatccacctgattggcaggagatccttacatacttccgtggctctgaacttcagaattattttacacgtttattggaggataacctcaaggcaatcatcaagcctcaatatgttgaccacattccaaaagctgtccaaggaaatgtggggcaagtacttgagcagaaagatgagagggatatgaaagctgagctgtgcgttgaccttgaattgaaccaagttattgaccgaaatgtgggagaactttctggcggtgagctccagagatttgcaatagcagttgttgctgtgcaaagtgcagaaatttacatgtttgatgaaccatcaagttatctcgatgttaagcagagactgaaggctgcacaggttattaggtccttgctgagatcgaacagctacgtcattgttgtggaacatgacttgagtgtcttagattacctgtccgacttcatttgctgcttatatggaaagccaggagcttatggtgtagttacattgccattttcagtccgagaaggtatcaatattttcctggctggatttgttccaactgaaaatcttcggtttcgagatgaatctcttacatttaagattgtggatacgcaagacaacccggaggagattgaagcataccaacgatacaagtaccctgccatgagcaaaactctgggaaatttcaagctcactgtcatggaaggtgaattcactgattctcagattgttgtgatgcttggtgagaacggaacagggaaaactacattcatcagactgctggctgggcacttgaagccagatgccgtggaaggagttgagatcgaaattcccgaatttaatgtgtcctacaagccccaaaagattagcccgaaattcccgggctcagtgaggcaactgcttcataagaaaatacgtgattcatatactcatcctcagtttatatctgatgtagtgaagccactacaaattgagcagctcatggatcaggaggttatgaacttatcaggtggagaactccaaagggtggcgctgtgtctttgccttggacagccagcagaaatctaccttatcgatgagccgagtgcgtacctcgattcagagcagcgcattgtcgcttcgaaggtgatcaagaggttcatcctccatgccaagaagacggcgttcatcgttgagcacgacttcatcatggcaacctaccttgcggacaaggtggtggtctacgaggggcgcccctccgtcgagtgcactgcctgcacgccacagtccctggtgtctgggatgaacaggttcctatcgcaccttgacatcacgtttcggagggacccgaccaactaccggcctcggatcaacaagatggactcgaccaaggaccgggagcagaaggcggcggggtcctactactacctcgacgactgactgactgactgactgactgactgattggggcgccgcccctcctgagagaattcggtttgattgatcttgtttttaggtgaaaaattaggtgaattgaattgtgcttggatagacttatagacagatagacggtgttagcccccaaagcgtaggaaacaaatcagtcaaatcttgccttgttcatctgacgacaaattctgtgcttttgtactgggttttgtactgatgttgcagagatttggcagatgagagagacagaaactctacacctgctctgtcccaagtcaaagcaacccctgtcatcttcattacttaattagcagctactaattgaattagcatacatgcaaacccggacttgatctgatgattttgtttctggtctttcttgtgtcgctgggattttataattatgttcaggctgc

SEQ ID NO: 4912 - DNA, 1567 bp, Amaranthus tuberculatus
ccgatccaagcttgcttttatctcagaggaactgtgcattggatgtggtatttgtgtcaagaaatgcccttttgaagcgattcagatattaatctcccgaaagatcttgacaaggatacaactcaccgttatggcgccaatactttcaagttacataggctacctgtcccgagacctggtcaggttcttggcttggttggaacaaatggtattgggaagtcaactgctctaaaagtattggctggaaaattgaagcccaatctggggaggttcaataacccacctgactggcaggaaattttaacatactttcgtggatctgaactgcaaaattatttcacacgcatattggaggataatctgaaggctatcatcaagccccagtatgtggatcatattccaaaggcagttcagggaaatgttggccaggttctagagcagaaagatgagagagatatgaaggctgaactctgtgaagatttggagctgagtaaagttttggatcgtaatgtgggagatttgtcaggtggtgaactgcagaggtttgcaattgcagttgtggctatacagagtgctgagatatatatgtttgatgagccttcaagttatttggatgtgaagcaaaggcttaaagctgcccaagttgttagatcattgcttaggccaaatagctatgtcattgtggtagagcacgatcttagtgttttagactatctttcagacttcatctgctgcttatatggaaaaccgggtgcatatggagttgttactctgccattctctgttagagaaggaatcaatatattcttggctggatttgtacccacagagaatcttcgtttccgcgatgaatctcttacttttaaggttgctgagacacctcaagataatgctgaggagattgagacatatgctcgatacaagtacccgaccatgtctaaaactcaaggtggttttaagcttcgtgttatggagggtgaatttacagattcacagattattgtgatgttgggagaaaatggaacagggaagacaacttttattcgtatgctggctggtctattgaagcctgatactgtggaaggctctgatgtggaaatacctgaattcaatgtttcttacaagccccagaagatcagtccaaagttccaaaatactgtgaggcatctattacatcaaaagataagggatatgtatcttcatccccagtttgtttcagatgttatgaagcctcttcagatagagcagttaatggatcaagaagttgtgaatttatctggtggagaattgcagagagttgccattaccgctttgtgccttggaaagccggcagatatctatttgatcgatgaaccaagtgcatacctggattctgagcaacgtattgtggcttcaaaagttataaagagatttattctccatgcgaagaagactgcatttgttgtcgaacatgattttataatggcaacatatctagctgatagagttattgtgtatgaagggatgccatcagtggattgtactgccaatgctcctcaatcattgttgaccggaatgaatcttttct

SEQ ID NO: 4913 - DNA, 2821 bp, Zea mays
ccaaatcccctcccccctgctcggccacaaacccacaatcccgtgtctccggccaccgtgctgcgcaggccgaggcccgagcttgagcgtttggtctgctgccatggatgacgaatctaagtctgctcctaaatcggatgtgaacaccgacgctggcgcggaagccgcggcggccgccgctccgctgccgccctcgagctcagaaacggcggagacggaggcaagggttgaggcggcggatggggagagccaggtggttgagcggttggtcgagcttgtgagcgagatcgcggccatctcggacttcaggaactcgtaccggcgtcagttctgcaacctgtcgcggcggatccggctcctcgtgcccatgctggaggaggccaaggaagcgcccacgccacttacggtggcatcggaggccgcgctacggcggctcagggaggcgctccacgccgccagggatctgctccagctcggcagcagcggcagcaagatcttcctggttcttgatagagagaaaataatgaagactttccaggatgtcactgcaagacttgaacaagccttagctggtatctcgtttgatgaacttaatatatctgatgaagtaagagagcaggttgaattggtgcatactcagttcaaaagagctaaggaacggtcagattcatctgatgatgatctttttaatgagctgatgtctctatgtaattcaagcagcagtgatagtgttgacccagatactcttcgaaggttatctgagaagttgcagcttgtcacaatatatgacctcaatcatgaatctctgaccttgcatgagatggctagtggcggtgatcctggtgcagttgttgaaaagatgtcaatgctcctcaaaaggattaaggattttgtgcagacagaagaccctgagatgggtgcccaagcaagtacagcaaccatttctacaaaagacaattcagcatgtcctgttattcccgatgatttccgttgcccaatatcactggatttaatgaaagatccagttattgttgccactgggcagacttatgagcgggggtacatagagatgtggctggaggctggccatgatacctgtccgaagacacaacagaagcttgccaataaatccctgaccccaaattatgtcttacgtagtctcataactcaatggtgcgaggcaaatggtattgagcctccaaaacgccctgctcaacttagggatgcaccactgtcatgtagtgctgctgagcatagcaatgttcttgagcttcttcagaaattgtcttcccaaaaccttgaagatcaacgtggctctgctggtatgcttcgtcaacttgccaagcgcagtgctgaaaatcgtgcttgtattggagatgctggtgctattcctattcttgttagtctgctatcaaccactgatgttagcacccaggaacatgtggttactgctctcttgaatctttccatctacgaagagaacaaggcaagaataatatcttctggagctgttcctggaattgtgcatgtgttaaagaggggcagcatggaggctcgggagaattcagctgccacacttttcagcctatctattgtagatgagaacaaggtgactattgggtgttcaggggcaattcctgcacttgtgcagctattgagtaatggaagccaacggggtaaaaaggatgcggcaacagcactatttaacttgtgtatttaccagggcaacaaggggaaagctgtaagagctggattggtacctatactactagaactgctcatggagactgaaagtgggatggtagatgaggcccttgcaatattggcaatcctctcaggccatcctgaggggaagacagctatcggcgctgcttctgcaatacctgtacttgttggagttatcagaaatggatctccaaggaacaaggaaaatgctgctgctgttatggtgcatctatgcagtggtgagcagcagcaacagcatcttgctgaagcacaggagcagggcatcgtgtctttgctggaggagctagcagaaagtggcacggacagaggaaagaggaaagctgtgcagctgctcgaacgaatgaatcggttcctaaagcagcagagtcaagccgaagccgaagcagaggccatggcacaggctcatgcacaagcacaagcacaagcacaagcgcagcctcagatcctggttcaagctcaagcacatgcagatatgcaagctgaacgatcactacttcccacatcatctgacatttcggatagatgaggtttttgatcagcagcttgttttgtctagtaactggcttgttttttttaagctcaggctgtcaggtggaagattgcctgcaactgttattgtggaggtttctggtttctgttgaacactgcaaattaggaggtctgggcagcgtgatttaggtccatgagcatgttgacaggtgggttctgagtcagtttttaacctgcgtgtgttcgtaaaatgtaccggtgattgaaggtagtaagtatatcctcgagttttaggaggtatcgttgaacttgtacccggtacgagcccagtacaggactaattctggcgccctaggctaagtgcctgacaaagttgcaggaaagctttagttcagaaaaatgtttgttcatcgagtccggtgcagttggttcagctgtcttctgtgagttgtttgcgttgaaaaaaagcggttggttcagctgtcttgtgtgggttgtttgttgtgaaaaaactgccgcaagctgtatgctgtgaaaagttaaaaatcgtttggcttaagctgctgtgaaacagtagacttaacaa

SEQ ID NO: 4914 - DNA, 3022 bp, Panicum virgatum
cggcgccgcggtgccgcggagggaggcagcggctcgtatatcagagaggggacgacgctgaccggtgggaccggccggctggcccgcatggcagagcgaagctatactaggcgagggaggagccacagcctcgctcgcctactccaaatccccttccccacgctccgccaccacgcgcggtctccggccaccgtgctgcgcgcaggacgaggtgcgggcctcagccccagctgcgctgccatggacgaggaagcgaaggctggcccgaaacccgactcgaacgccaacgctgccgccgcggtcgaggcggcggcagccgctccgctgccgccctcgagctcggaggcggcggagagggaggcgaaggcggagggtgcggcggaggaggaaggggaggtggtggagcggttggtcgagctggtgggcgagatcgcggccatctcggacttcaggaactcgtacaggcgccagttctgcaacctgtcgcggcggatccggctgctcgtgcccatgctggaggaggccaaggaggcgcccgcgccgctgcctgcggcgtcggaggccgcgctccgccgtctcagggacgctctccacggcgccggggagctgctccggctcggcagcagcggcagcaagatcttcctggttctcgagagagagaaaataatgaagagtttccaggacattacagcaagacttgaacaagctttagctggtatctcatttgatgagcttaacatatcagatgaagtaagagagcaggttgaattggtgcatgctcagttcaaaagagcaaaggaacgatccgattcatctgatgatgatctatttaatgatctgatatctgtctataactcgagcagcagtgctaatgttgaccctgatattcttcgaaggttatctgagaaattgcagcttgtaacaatacatgacctcaatcaagaatctcttaccttgcatgagatggctagtggcggtgatcctggtgcaattgttgaaaagatgtcgatgcttctgaagaggatcaaggattttgtgcagactcaagaccctgaaatgggtgctcaagcaagtgcaacagacatttccccaaaggacaattcaacatgtcctgttattcctgatgatttccgttgcccaatatcactggatttaatgaaagacccagttattgtcgccactgggcagacttatgagcgagggtgcatagagaggtggctggaagctggccatgacacctgtccgaaaacacagcagaagcttccgagtaaatccctgactccaaattatgtcctacgcagcctcataactcaatggtgcgaggcgaatggtatagagccaccgaagcgctcagctcaacttagtaatgcaccagtgtcatgtactgctgcggagcataacaatgttttcgagcttcttcagaaactctcatcccaaaaccttgaagatcaacgtggtgctgctggtatgcttcgtcagcttgccaagcgtagtgcggagaatcgtgcttgtattggagatgctggtgctattcctgttcttgttagcctgttatcaaccactgatgttagcacccaggaacatgtcgttactgctctcttgaatctatccatctatgaagagaacaaggccagaataatcacatctggagctgttcctggaattgtgcatgtattgaagaggggcagcatggaggctcgggaaaattcagctgccacactgttcagcctctcaattgttgatgagaataaggtgactattggggcttccggggcaattcctgcgcttgtactgctattgagtaatggaagtcaacggggtaaaaaggatgcagcaacagcactatttaacctgtgcatttatcagggcaacaagggcaaagctgttagagctggattggttcctatactactagaactactaacagagactgaaagtggtatggtagatgaggcccttgcgatattggcaatcctctctggccatcctgagggcaaagcagctattggtgctgcatctgcaatacctgttcttgttcgagttatcagaaatggatctgcaaggagcaaagaaaatgcagctgctgtaatggtgcatctctgcaatggtgaacagcagcaacagcatcttgctgaagcgcaggagcaaggtatcgtttctttgctggaggagctagcagaaagtggcacagacagaggaaagaggaaagcaatccagctgcttgaacgaatgaatcggttcctaaagcagcagagtcaagcccaagcccaggcagaggccatggcacaggcgcaggcgcaggcacaggctcaggcccttgttcaagctcaagggcaggcagatatgcgatcactgcttcccacgtcatcacatattcctgattgatgaggcgactgatcagcaacatcttttctggtagttagtggctcgttttttggccagagctggcaggtggaagatcgcctgcaattgctattgtggatgtttgtggtttctgctgcgcactgcaaactaggatgtctgggcagcttgatttagggccactggcatgttgacgagtgagttttgaggcagctgttaacctgtgtgtgttgtccctacagtgtaccggtgattgaatgtggtatcctcgagttttagggaggtgtcgttgtacttgtacccggtgcccagtacagagctaatcactggcgtcctaggttgtttacatgcctgacaaagagctgcagtaaagatttagttcgagtgtttgttcatcccaaactcatgttctatcttgaattcttgataccgtggagcatccgaacatcttgccctagtggaatgatcttgggtttgtacgtactttatagcccagctggtctggtgcaacttctgtctatgttccttttatcccatcactgctgttactgccatagcccatagctccatgtgtgcacagaactgaggaaaaatcggcgtgttgggatcataagcaattgagcatcatgatcatttgtgccctgttattcttgtttcctca

SEQ ID NO: 4915 - DNA, 3337 bp, Panicum virgatum
cggatggctggcccgcatggcagagcgaagcagctatactaggcgagggcggagcctcagcctcgctcgcctactccaaatccccttccccacgctccgccaccacgcgcggtctccggccaccgtgctgcgcgcaggacggggtccgggcctgagccccagctgtgctgccatggacgaggaagcgaaggccggtccgaaatccgacgcgaacgccaacgctgccgacgcggtcgaggcggcggcggccgctccgctgccgccctcgagctcggaggcggcggagagggaggcgaaggcggaggaggaaggggagctggtggagcggttggtcgagctggtgggcgagatcgcggccatctcggacttcaggaactcgtacaggcggcagttctgcaacctgtcgcggcggatccggctgctcgtgcccatgctggaggaggccaaggaggcgcccacgccgctgcccgcggcgtcggaggccgcgctccgccgtctcagggacgctctccatggcgccggcgagctgctccggctcggcagcagcggcagcaagatcttcctggttctcgagacagagaaaataatgaagagtttccaggacattacagcaagacttgaacaatccttagctggtatctcgtttgatgagctaaacatatcagatgaagtaagagagcaggttgaattggtgcatgctcagttcaaaagagcaaaggaacgatcggattcatctgatgatgatctattcaatgatctgatgtctgtctataactcgagcagcagtgctaatgttgaccctgatattcttcgaaggttatctgagaaattgcagcttgttacaatacatgacctcaaccaagaatctcttaccttgcatgagatggctagtggtggtgatcctggtgcaattgttgaaaagatgtcgatgctcctgaagaggatcaaggattttgtgcagactcaagaccctgaaatgggtgctcaagcaagtgcaacagacatttccccaaatgacaattcaacatgtcctattattcctgatgatttccgttgcccaatatcactggatttaatgaaagacccagttattgtcgccactgggcagacttatgagcgagggtgcatagagaggtggctggaggctggccatgacacctgtccgaagacacagcagaagcttccgaataaatccctgactccaaattatgtcctacgcagccttataactcaatggtgcgaggcgaatggtatagagcctccaaagcgctcagctcaacttagtaatgcaccagtgtcatgtactgctgcggagcataacaatgttgtcgagcttcttcagaaactctcatcccaaaaccttgaagatcaacgtggtgctgctggtatgcttcgtcagcttgccaagcgtagtgctgagaatcgtgcttgcattggagatgctggtgctattcctattcttgttagcctgctatcaaccactgatgttagcacccaggaacatgtcgttaccgctctcttgaatctatccatctatgaagagaacaaggccagaataatcacatctggagctgttcctggaattgtgcatgtattgaagaggggcagcatggaggctcgggaaaattcagctgccacactgttcagcctctcaattgttgatgagaacaaggtgactattggggcttctggggcaattcctgcgctggtacagctattgagtaatggaagtcaacggggtaaaaaggatgcagcaacagcactatttaacctgtgcatttatcagggcaacaagggcaaggctgttagagctggattggttcctatactactagaactactaacagagactgaaagtggtatggtagatgaggcccttgcgatattagcaatcctatctggccatccagagggcaaagcagctatcggtgctgcatctgcaatacctgttcttgttggagttatcagaaatggatctgctaggagcaaagaaaatgcagctgccgtaatggtgcatctctgcaatggcgaacagcagcaacagcatcttgctgaagcgcaggagcagggtatcgtgtctttgctggaggagctagcagaaagtggcacagacagaggaaagaggaaggcaatccagctgcttgaacgaatgaatcggttcctaaagcagcagagtcaagcccaagcccaggcagaggccatggcgcaggcacaggctcaggcccttgttcaagctcaagggcaggcagatatgcgatcactgcttcccacgtcatcacatattcctgattgatgaggtgactgatcagcaacaccttttctgatagttagtggcttgttttttggccagagctggcaggtggaagatcgcctgcaattgctattgtggatatttgtggtttctgctgcgcactgcaaactaggaggtctgggcagcgtgatttagggccactggcatgctgacgagtgagttttgaagcagctgttaacctgcgtgcgttgtccctacagtgtaccggtgattgaatgtggtatcctcgagttttagggaggtgtcgttgtacttgtgcccggtgcccagtacagaactaatcactggcgtcctaggttgtttacatgcctgacaaagagcggcagtaaagctttagttcaagtgtttgttcatcccaaactcatgttctgtcttgaattcttgataccgtggagcatccagacatcttgccttagtggaatgatcttggatttgtactttatagcacagctggtcaggtgtaacttctgtccagttgcatgttccttttatcccatcactgctgaactgccatagtccatagctccatgtgtgcacggaactgaggaagaatcggcatgttgggatcatgagcatttgtgccctgttattcttgcttcctcagttgctctaaccaggaaagttgaatcgaaaatttgaaatactgctgccaggcagacagcgccagagaaaggggacttatctaagtattggggctggacatctgtggtacgcttcactttggagcttgcctacatgaactcatgtatatttgcgtgtccgttgttgcaggttcagttccatcatccgagcagctatcctatttgcctacctggacccttcgatgcacctgaccctgcgtgcgcgacatgcatcacgagctgatctgcaacatagcccgtagctcctcgacagcacagggcgggggcgccagcgctgcgctgtcgccgggacagacaagaccgggccgcacatcgtgccctcgtggcgcgccgcgccccgtacagtcccgtgccccgccacacctgggtgggcaagtcctcgccg

SEQ ID NO: 4916 - DNA, 2307 bp, Zea mays
acactctcatccccgcaacaaccgcctaccggcccgcgcgcgctgtagtctccggcagacaccaacaaggctcgtcactcccctacctccctcggtactcgctccgtctctcgtctctcgctcgcgcatcggctgggggcacggagaacgggaggcgcggaaggtcagaagcggcggccggcggcgcatcggcctcgcccaggcctagtcccgcacggtgctcggtccttctccgattctcccacagcctcgccccctcgcccctgcgcccctgcgcccctgcgcgtccagcgccccaaccccagcggcctgcggcactgatccacagtccacagacccggacaccggccgggcgaggatccgctgaccacgcagcctccaacgccgcatggagatcgtgcgctcccagaggcaggtcgccgccgcagccagtggcggcggcggcggcggcgcgggggccctgccgacctacaaggcggcgccgcagctcgaggtgcggctggaggagttcgagctcttcgccatcgaccgcctccgagttctcaaggggatttcggatggactctcgcgtgggaagaggccggaggagatggagaaactggtcagtgaattgtggaagacacacatgaggcaccaggatccagcagagaatttgaacaaggatataatatcgcactttgtgctccgtctagtctactgcagaacggaagaattgcggaagtggtttctctccatggagactacactttttcggtatcgctttcggcttgagagtcctgaaacacagaggatgcttatgactgagtttcaattgccgtataaagcactgccatactcagagtttgaggctgtgaaagacaaattgagccaagttgcacgttccattggtcaatctgccagtgttgagcatgtgttcttcaaggtacctttcgaagaagttcctgatcttgttgctggccgtcgggtatttctttcaaaaggctatgcttatgtggccatgagccaggtggtttctctagtggttactcaattccgctgcaatatctcaaaggcacttgctttaacaaacagaaaatggacagcaactattaaagaacaagaaaaggacaggttgactcctattgttgaagcattaagcaatgcgtattttggacctgattactctcagccaaaggatgctgttgacatatctctaaaggatattgaccaactggctaaaagttctttccctctttgtatgcggcatatgctagataagttgagagaaaaccaccatctgaagcatggcggcagaatgcagtttggtctttttcttaagggtgctggactaaagttggaagatgctcttgcgttttggagggcggaattttctcaaaagattggttctgagcggtttgacaaggaatatgcctatgccatcagacataattatggaaaagaaggaaaacggacagattacactccatattcatgtcaaaagatcatttctgcaacacctggcgttggagatcaccatggatgtccgtttcgacattttggtgaagaaaatttgcgggcagcactcaacaaaatgggcgttggtgggcatgcattggaagaggtaatggataaagtgaagaacaggcattaccaggtagcttgcacattaacctttgaggccacacacggtgtctcctgtgattctggaatcaaccatccaaatcaatatttcagtgaaagccagaaagttctgcgagccaaaaaccaaacaatggagagccaatcgcaatcagcaacctaaattgtgtcagcagctggagaaactatacatttccaaaaaacttaccagcaggtaagcactgaagcaaaattcatccttgatgccaattatgttatcgtcattggctgtacctttggcgcttacctggaatattgttgctccctggtgtttccaaatcccagctgctggcttggcctaaaacgaaaacctccaggctccagctgctagctgtcataccctacaagtgatggcaccgcactctacactagaattgttacctagtgctgcgaacagcagcaggtcaaggcgtctgtagactctgtacatgtaattctcgaaagaaccaagacttctgcatttaatgtaggatcagctgtgctgtgctcttagacctcatccaccagtttatctataaatttatccaaaatactgtctttcattgttctatattgtaaaccgcgttgttcgcgtagtagggtttgaaatggggatgataatggataaactgttggagatagtattatgttattgttaaactctttgagtag

SEQ ID NO: 4917 - DNA, 1544 bp, Setaria italica
cgccgcccccacccgctccgtaatatccaactccatatcgctggccaccgacgccggccgggcgaggatccggctccgcgctcccgacccgtgactgcgccacctccgaggcctcatggagatcgtgccctcccgccggcagctcgacgccgcagccgccgccggcagcggcggcactggtgccctgccgacctaccgggcggcgccacagctggaggtgcggctggaggagttcgagctcttcgccatcgaccgcctccgtgttctcaaggggatctcggatgggctctcgcgggggaagaggccggaggagatggagaagctggtcagtgagttgtggaagacacacatgaggcaccaggatccagcagaaactttgaacaaggatataatatctcactttgtgctccgcctagtctactgcagaacggaagaattgcgaaagtggtttctctccatggagactacactttttcggtaccgctttcggcttgagacttctgaatcacagaagaagctaatgactgattttcaacttccttacaaagcattgccacgctcagaattcgaggttgtgaaagacaagttgagccaagttgcacgttccattggtcaatctgcaaatgttgagtctgtgttcttcaaggtaccttttgaagaagttcctgatcttgttagcagccgccgagtatttctttcaaaaggctatgcttatgtggcgatgagccaggtggtttcccttgtggttactcaattccgctgcaatatctcgaaggcacttgttttgacaaacagaaaatggatggcaactattaaggaacaagaaaaggacaggttgacgcctattgttgaagcgttaagcaatgcgtattttggacctgattactctcagccaaaggatgctgtcgaaatatctctaaaggatattgaccaactggctaaaagttctttccctctttgtatgcggcatatgctagataagttgagagaaaaccatcatctgaagcatgggggtagaatgcagtttggtctttttcttaagggtgctggactaaagttggaggatgcccttgcattctggagagcggaattttctcagaaggttggctctgagcggtttgacaaggaatatgcctatagcatcagacataattatggaaaagaaggaaaacgaacagattacactccatattcatgtcaaaagatcatttctgcaacacctggtgttggagatcaccatggatgcccttaccgacattttggcgaagaaaatttgcgggcagcactcaacaaaatgggtgttagtgggcatgccttggaagagataatggataaagtgaagaacaggcattaccagctagcttgcacattgacctttgaggcaacacatggtgtctcctgcgattctggaatcaaccatccaaatcagtatttcagtgaaagccagagagttttgcgagccaaaaaccaaacagtggagagcaagtcagcaacataaattgtattgtagctgcagaaagcatccatcaacaaaaggttaccag

SEQ ID NO: 4918 - DNA, 2649 bp, Oryza sativa
cacaaacgcgccgacggagagacgggaggggaacgggagggcttagcgcgtcgctcccaacggtgattcgagccaagacctagccgccgccatggagatcgtgagatcccaccggcagatcgcggcggaggcggcggccggcgtaggatgtggcggcggggcgggaggcctgccaacctaccgggtggcgccgcagctggaggtgcggttggaagagtttgagctcttcgccatcgaccgcctccgagtattgaaggggatcgccgacgggctctcgcgagggaagagaccggaggaaatggagaaattggtcaaggaattgtggaaagcccatatgaggcaccaggatcctacagagactttgaacaaggacataatatctcactttgttctccgtcttgtctactgcagaacggaggagctgcggaagtggtttctctccatggagactacgctttttcgctatcgctttcggctcgagagtcctgaatcacagaggatgcttatgagtgagtttcaacttccatacaaagcattgccacactcggaatttgaggctgtcaaagacaagttgagccaagttgcacgcaccattggtcaatctgcagctgttgaatctgtgttcttcaaggtgccttttgaagaagttccagatcttgttgccagccgccgagtatttctttcaaaaggatatgcttatgttgcgatgagtcaggttgtttcacttgtggttacccaattccgctgcaatatctcgaaggcacttgttttaacaaatagaaaatggacggccaccattaaggaacaagaaaaggataggttgactcctattgtcgaagcattgagtaatgcatattttggacctgattactctcagccaaaggatgctgttgagatttctctgaaggatattgaccaactggctaaaacttctttccctctttgtatgcgccacatgctagagaagttgagagaaaaccatcatctgaagcatgggggcagaatgcagtttggtcttttccttaagggagctggactaaagttggaagatgctctagcattttggagggcagagttttctcagaaggttggctctgagcgatttgacaaggaatatgcctacagtatcaggcataattatggaaaggaaggaaaacgaacagattacactccgtattcatgtcaaaagattatctctgcaacacctggtgttggtgatcaccatggttgcccttatcgacattttggtgaagacaacttgagagcagctctcaataaaatgggaatcagtggtcatccattagaagagataatggataaagtgaagaacaggcactaccagctagcttgcacgatgacttttgaggcagaacatggtgtctcatgtgatactggaatcaatcatcctaatcagtacttcagtgaaagccagaaagtcttgaaagcaaagaatcaagcagtgcagagccaaggaacaacctaaactgtaatgctgctggcaaaagtcagtccatccaaatgcggaatttcagttcgtatcaagatttcatccttgctgctaatgatatggagaacaacaattactaatctttattctgatgcctagatggaattctattgctttgcacggtttcagaattccaacggctgaatatgtcatcccccaaaagtgatggatgtccctgtaaacatgacttgagcacagaaagtagatagaaccgtacaagtacgtacttgtcaaaaccaaaggaaaccatgattatggatatcaaattattgtttgtgttggtaagtggtaactatgtaaccatggtaactatgaccagggggagttgtgaacacctcatcagttaagttgcgctgtaatgtttctgtaatcgaaaacttgttcgacaaaacaattgcgcttccagatatgcaatttcattaatctgcttgaactattcgatctggctgccttgaccagtctgggctcatgatcctgactagccaaaaaagtctggaggtaaccattcaataaactgtggggcactgatgctgcaggagttctgatgctgtggtagtgcaagcaagcaaccccggcggccgcggcgcacgcgtagaggaagggagcagccccggcggcgacgagcgcggaaggaggagccatggcggtgggaacgcgcagagggagaagccccggtggcagcgcgcgaggagagagcagccgcggcgcgcgcggagggagaagcggcaacggcggcggcgcgcacggagggagaagcggcaactgcagcgacgagcggggagggaggcggaggccggcgcgcggagggcgggcggcgagcggcagccagttcgctgagggagggaggttgggatccgcacagcgcccgcgctcaccggcgacgagcacagagggaggcacggggaaggagtcgcgatgggtcattcctcgcgccgccgccgccgccgctgcccccttccaccccgcgtcggcgccgcatctccctccctccctccgagcggacgcagccagtgtcgccgcccctccgcgcactgatgtcgccgctcctcctctctctccgcgcgttggagcagcccctctccctccctccgtccctctgtgcagcagcacccgacgccgctgctcctccgccggagccaccc

SEQ ID NO: 4919 - DNA, 1936 bp, Oryza sativa
acaaacgcgccgacggagagacgggagggcaacgggagggcttagcgcgtcgctcccaacggtgattcgagccaagacctagccgccgccatggagatcgtgagatcccaccggcagatcgcggcggaggcggcggccggcgtaggatgtggcggcggggcgggaggcctgccaacctaccgggtggcgccgcagctggaggtgcggttggaagagtttgagctcttcgccatcgaccgcctccgagtattgaaggggatcgccgacgggctctcgcgagggaagagaccggaggaaatggagaaattggtcaaggaattgtggaaagcccatatgaggcaccaggatcctacagagactttgaacaaggacataatatctcactttgttctccgtcttgtctactgcagaacggaggagctgcggaagtggtttctctccatggagactacgctttttcgctatcgctttcggctcgagagtcctgaatcacagaggatgcttatgagtgagtttcgacttccatacaaagcattgccacactcggaatttgaggctgtcaaagacaagttgagccaagttgcacgcaccattggtcaatctgcagctgttgaatctgtgttcttcaaggtgccttttgaagaagttccagatcttgttgccagccgccgagtatttctttcaaaaggatatgcttatgttgcgatgagtcaggttgtttcgcttgtggttacccaattccgctgcaatatctcgaaggcacttgttttaacaaatagaaaatggacggccaccattaaggaacaagaaaaggataggttgactcctattgtcgaagcattgagtaatgcatattttggacctgattactctcagccaaaggatgctgttgagatttctctgaaggatattgaccaactggctaaaacttctttccctctttgtatgcgccacatgctagagaagttgagagaaaaccatcatctgaagcatgggggcagaatgcagtttggtcttttccttaagggagctggactaaagttggaagatgctctagcattttggagggcagagttttctcagaaggttggctctgagcgatttgacaaggaatatgcctacagtatcaggcataattatggaaaggaaggaaaacgaacagattacactccgtattcatgtcaaaagattatctctgcaacacctggtgttggtgatcaccatggttgcccttatcgacattttggtgaagacaacttgagagcagctctcaataaaatgggaatcagtggtcatccattagaagagataatggataaagtgaagaacaggcactaccagctagcttgcacgatgacttttgaggcagaacatggtgtctcatgtgatactggaatcaatcatcctaatcagtatttcagtgaaagccagaaagtcttgaaagcaaagaatcaagcagtgcagagccaaggaacaacctaaactgtaatgctgctggcaaaagtcagtccatccaaatgcggaatttcagttcgtatcaagatttcatccttgctgctaatgatatggagaacaacaattactaatctttattctgatgcctagatggaattctattgctttgcacggtttcagaattccaacggctgaatatgtcatcccccaaaagtgatggatgtccctgtaaacatgacttgagcacagaaagtagatagaaccgtacaagtacgtacttgtcaaaaccaaaggaaaccatgattatggatatcaaattattgtttgtgttggtaagtggtaactatgtaaccatggtaactatgaccagggggagttgtgaacacctcatcagttaagttgcgctgtaatgtttctgtaatcgaaaacttgttcgacaaaacaattgcgcttccagatatgcaatttcattaatctgctt

SEQ ID NO: 4920 - DNA, 1900 bp, Secale cereale
agcctcattccgccgcgcttggaaccaaacacccacagccatggaaatcgtgcgatcccaacggcagctcgcggcggcggccgcagccgccagcggcggaggcagcggcacggggggcctgccaacgtaccgtgtggcgccgcagctggaggtgcggctggaggagttcgagctcttcgccatcgaccgcctgcgagtcctgaaggggatctcggatgggctatcgcgggggaagaggccggaggagatggagaagctggtaagcgaattgtggaaggcacatatgaggcaccaggatccagcagagactttgaacaaggacataatatctcactttgtgctccgtcttgtatactgcagaacggaggaattgcgtaagtggtttctctccatggaaaatacactgtttcggtatcgctttcgtctcgagagtcccgaatcacagaggcttcttatgagtgagtttcagcttccatacaaagcattgccacactcggaattcgaggctgtgaaagataagttaagccaagttgcacgttccatcggtcaatcggcaagtgttgaatctgtgttcttcaaggtaccttttgaagaagttccagatcttgttgccagccgccgagtattcctttcaaagggctatgcttatgttgcgatgagtcaggtggtttcacttgtggtaacccagttccgctgcaatatctcaaaggcacttgttttaacaaataggaaatggactgcgaccattaaggaacaagaaaaggacaggttgactcctattgttgaggcgttaagcaatgcatattttggacctgattactctcagccaaatgatgctactgagatttcgccgaaggatattgatcaactggccagagcttctttccctctttgtatgcgccatatgctagagaagttgagagaaaaccatcatctcaaacatgggggtagaatgcagtttggtcttttcctcaagggtgctgggctaaagctggaggatgctctcacattttggagatctgaattctctcagaaggttggctctgagcgatttgacaaggaatatgcatatagtatcagacacaattatggaaaagaaggaaaacggacggattacacttcatattcatgtcaaaagatcatctccgctacacctggtgttggtgatcatcatggttgcccttatcgacattttggtgaagagaacttgagagcagctctcaacaatatgggtgtcggtggtaatgctttggaaaggatactcgataaagtgaagaacagacattaccagctagcttgcacaatgacttttgaggcaactcatggtgtctcatgtgataccggaatcaatcatcctaatcagtatttcagtgaaagccagaaagtcttgcaagctaagaaccaaacagtacagagtcagttatcgacctaagttgggatgctcctgcagaaagcagtccatccaccaagtagaaacccagcagctcgtgtcgaatcaagagtggtgcttgactgcaacgttgccagtacatggagatcaagtttgctcatgtttagcctgatgtgtggagcgagttctgctgctctctgtggttcggggagctccaactgccggtccatggtgtcgcatcctgtactactattagcaacataagggaaactaatgtgtactgtattgtcgcacaacagtacttctcaaaatcagagcgaatcgagactgatatggtttttggtggtactgtaatcttctagtaccaccgacttgtgaacgccctgatcagttgtgctgcttcttggagaggaatattatggagtacgtagaaggcagaaaaaatcactaaaatactgaccagagatatcagactgccatcttactgttaaacattttagaacattaaaa

SEQ ID NO: 4921 - DNA, 2030 bp, Brachypodium distachyon
ccgccacgccgcctcagtcagagagagagagagagagagagagagagagagagagcctcttgcttccaaggcgacgattcgaatcaagccctcacagccatggaaattgtgcgatcccaaaggcagctcgcggcggaggccgcagccgccactggcggaggcggggcgggggccctcccaacgtaccgggtggcgccgcagctggaggtgcggctggaggagttcgagctcttcgccatcgaccgcctccgagttctgaaagggatttcggatgggctctcccgtgggaagaggccggaggagatggagaaattggtcagcgagttgtggaaggcacacatgagacaccaggatccagcagagactttgaacaaggacataatatctcactttgtgctccgtcttgtctactgcagaacggaagaattacgcaagtggtttctctccatggagatgacactttttcggtaccgctttcggctcgagagccctgaatcacagaggcttcttatgagtgagtttcagctcccatacaaagcattgccacactcagaatttgaggctgtgaaagataagttaagccaagttgcacgttccattggtcaatctgcaagcgttgaatctgtgttcttcaaggtaccttttgaagaagttccagatcttgttgccagccgccgagtattcctttcaaaaggctatgcttatgttgcaatgagtcaggtggtttcgcttgtggttacccaattccggagcaacatctcaaaggcacttgttttaacgaataggaaatggacatcgaccattaaggaacaagagaaggacaggttgactcctattgttgaggcattaagcaatgcgtattttggacctgattactctcagccaaatgatgctgctgagatttctccgaaggatattgatcaactggctagaacttctttccctctttgtatgcgtcacatgctagagaagttgagagaaaaccatcatctgaagaatgggggtagaatgcagtttggtctttttcttaagggtgctgggctgaagttggaggacgctcttacattttggagagcagaattctctcagaaggttggctctgagcgatttgacaaggaatatgcttatagtatcagacataattatggaaaagagggaaaaagaacggattacactccatattcatgtcaaaagatcatctctgcgacacctggtgttggtgattaccatggttgcccttatcgacattttggtgaagagaacttaagagcagctctcaacaatatgggtgtcagtggaaatgctttggaaggaatactggataaagtgaagaacaggcattaccagctcgcttgcacattgacttttgaggcaactcacaatgtctcatgtgatactggaattaatcatcctaatcagtatttcagtgaaagccagaaagtcttgcaagccaagaaccaaacagtgcaaaaccagtcatcgacctagcttgtgatgctcctgcacaaaccagtccatcgacaaaaaagaaactcagtccgacaggagcacggtggttcaatcgaagtcatgcttgttgccaacaatgtgaagatcacactgttgatacttatttaatctggtccgtggagtgtgttatgttggtcattaggagttgaggattccgcacatgttcatgaggcttcatcctgtagtactagtaacatgtcagaagtaattcattgtcgcacagcgttaggtatatgagaaagcgaatcgaggcttgatattgattctgtagtctattctaacttgctactgcaatcctgtaataccagtgacttgtaaatgcccggttcagttgtgctgcttcgggaggacaattgctgagtatgcaagttcttcgtttcagatatggcatttcacattgttctgtaaaaggtaagcactagatgttgctgaccgatatatcctgtgcatgttcgatttggagaacattctgagcagtattatttctgctgttacctgatcaaagatacgatttgtctttc

SEQ ID NO: 4922 - DNA, 1799 bp, Hordeum vulgare
gagagggagagagagagagagagagaggctcattccgccgcgcttggaaccaaacacccacagccatggagatcgtgcgatcccaacggcagctcgcggcagcagccgcagctgccagcggcggaggcagcggcgcgggggctctgccaacgtaccgtgtggcgccgcagctggaggtgcgcctggaggagttcgagctcttcgccatcgaccgcctccgagtcctgaagggtatctcggatgggctatcgcgggggaagaggcccgaggagatggagaaactggtaagcgagttgtggaaggcacatatgaggcaccaggatccagcagagactttaaacaaggacataatatctcactttgtactccgtcttgtatactgcagaacggaggaattgcgcaagtggtttctctccatggaaaatacactgtttcggtaccgctttcgtctcgagagtcctgaatcacagaggcttcttatgagtgagtttcagcttccatacaaagcattgccacactcggaattcgaggctgtgaaagataagttaagccaagttgcacgttccatcagtcaatctacaagcgttgaatctgtgttcttcaaggtaccttttgaagaagttccagatcttgttgccaaccgccgagtattcctttcaaagggctatgcttatgttgcgatgagtcaggtggtttcacttgtggtaacccaattccgctgcaatatatcaaaggcacttgttttaacaaataggaaatggactgcgaccattaaggaacaagaaaaggacaggttgactcctattgttgaggcgttaagcaatgcatattttggacctgattactctcagaaaactgatgctgctgagatttcgccaaaggatattgatcaactggctagaacttctttccctctttgtatgcgccatatgctagagaagttgagggaaaaccatcatctcaaacacgggggtagaatgcagtttggtcttttcctcaagggtgctgggctaaagctggaggatgctgtcacattttggagatcggaattctctcagaaggttggctctgagcgatttgacaaggaatatgcatatggtatcagacacaattatggaaaagaaggaaaacgaacggattacactccatattcatgtcaaaagatcatctctgcgacacctggtgttggtgatcaccatggttgcccttatcgacattttggtgaagagaacttgagagcagctctcaacaatatgggtgtcagtggaaatgctttggaagggatactggataaagtgaagaacaggcattaccagctagcttgcacaatgacttttgaggcaactcacggtgtctcatgtgataccggaatcaatcatcctaatcagtatttcagcgaaagccagaaagtcttgcaagccaagaaccaaacagtacagagtcagttatcgacctaagttgggatgctcctgcagatagtagtccgtccaccaagtagaaactcaggttttgacactactattttggaagttgtaactttgcacttcatggttgaacgttaactgcaattcgttcattatataacgtttctaatgtgtgacgaataattactgtaggcatgctgctcaccattgttttttatggacctgtgatgcgtatttctgccggcatttgagtttctcaagtatatattgttcatgatatacttagttttaagtgtttatcttccttttgaggaaatggccaggagcactgccttttcaatagcaggagtgatttactgggtcactgttttagag

SEQ ID NO: 4923 - DNA, 1949 bp, Hordeum vulgare
ggaaaagcacacccatttcccgccaaactgggcagaaaaatccccaatccccttcccccacccccgccgcactccccacccccgccgcagaggagagggagagagagagagagagagaggctcattccgccgcgcttggaaccaaacacccacagccatggagatcgtgcgatcccaacggcagctcgcggcagcagccgcagctgccagcggcggaggcagcggcgcgggggctctgccaacgtaccgtgtggcgccgcagctggaggtgcgcctggaggagttcgagctcttcgccatcgaccgcctccgagtcctgaagggtatctcggatgggctatcgcgggggaagaggcccgaggagatggagaaactggtaagcgagttgtggaaggcacatatgaggcaccaggatccagcagagactttaaacaaggacataatatctcactttgtactccgtcttgtatactgcagaacggaggaattgcgcaagtggtttctctccatggaaaatacactgtttcggtaccgctttcgtctcgagagtcctgaatcacagaggcttcttatgagtgagtttcagcttccatacaaagcattgccacactcggaattcgaggctgtgaaagataagttaagccaagttgcacgttccatcagtcaatctacaagcgttgaatctgtgttcttcaaggtaccttttgaagaagttccagatcttgttgccaaccgccgagtattcctttcaaagggctatgcttatgttgcgatgagtcaggtggtttcacttgtggtaacccaattccgctgcaatatatcaaaggcacttgttttaacaaataggaaatggactgcgaccattaaggaacaagaaaaggacaggttgactcctattgttgaggcgttaagcaatgcatattttggacctgattactctcagaaaactgatgctgctgagatttcgccaaaggatattgatcaactggctagaacttctttccctctttgtatgcgccatatgctagagaagttgagggaaaaccatcatctcaaacacgggggtagaatgcagtttggtcttttcctcaagggtgctgggctaaagctggaggatgctgtcacattttggagatcggaattctctcagaaggttggctctgagcgatttgacaaggaatatgcatatggtatcagacacaattatggaaaagaaggaaaacgaacggattacactccatattcatgtcaaaagatcatctctgcgacacctggtgttggtgatcaccatggttgcccttatcgacattttggtgaagagaacttgagagcagctctcaacaatatgggtgtcagtggaaatgctttggaagggatactggataaagtgaagaacaggcattaccagctagcttgcacaatgacttttgaggcaactcacggtgtctcatgtgataccggaatcaatcatcctaatcagtatttcagcgaaagccagaaagtcttgcaagccaagaaccaaacagtacagagtcagttatcgacctaagttgggatgctcctgcagatagtagtccgtccaccaagtagaaactcagcagctcggtgtcgaatcaagagtggtgcttgactgcacgttgccagttcatggagatcaaatttgctcatgtttagcctgatatgtgtcccgctgggattcggtgagtttcaactgccgatccatggcgttgcatcctgtactactattagcaacagaagagaaacttatctattgtcgtacaacagttgtcaaaatcagagcgaatcgagactgatatggtttttggtaatactgtaatcttctggtaccaccgacttttgaacgccctgactagttgtgctgcttcttggagaggaatgttatggagtacgtatggatgttcttcatttcaaaaaaaaaaaaaaaatac

SEQ ID NO: 4924 - DNA, 1672 bp, Hordeum vulgare
cagaggagagggagagagagagagagagagaggctcattccgccgcgcttggaaccaaacacccacagccatggagatcgtgcgatcccaacggcagctcgcggcagcagccgcagctgccagcggcggaggcagcggcgcgggggctctgccaacgtaccgtgtggcgccgcagctggaggtgcgcctggaggagttcgagctcttcgccatcgaccgcctccgagtcctgaagggtatctcggatgggctatcgcgggggaagaggcccgaggagatggagaaactggtaagcgagttgtggaaggcacatatgaggcaccaggatccagcagagactttaaacaaggacataatatctcactttgtactccgtcttgtatactgcagaacggaggaattgcgcaagtggtttctctccatggaaaatacactgtttcggtaccgctttcgtctcgagagtcctgaatcacagaggcttcttatgagtgagtttcagcttccatacaaagcattgccacactcggaattcgaggctgtgaaagataagttaagccaagttgcacgttccatcagtcaatctacaagcgttgaatctgtgttcttcaaggtaccttttgaagaagttccagatcttgttgccaaccgccgagtattcctttcaaagggctatgcttatgttgcgatgagtcaggtggtttcacttgtggtaacccaattccgctgcaatatatcaaaggcacttgttttaacaaataggaaatggactgcgaccattaaggaacaagaaaaggacaggttgactcctattgttgaggcgttaagcaatgcatattttggacctgattactctcagaaaactgatgctgctgagatttcgccaaaggatattgatcaactggctagaacttctttccctctttgtatgcgccatatgctagagaagttgagggaaaaccatcatctcaaacacgggggtagaatgcagtttggtcttttcctcaagggtgctgggctaaagctggaggatgctgtcacattttggagatcggaattctctcagaaggttggctctgagcgatttgacaaggaatatgcatatggtatcagacacaattatggaaaagaaggaaaacgaacggattacactccatattcatgtcaaaagatcatctctgcgacacctggtgttggtgatcaccatggttgcccttatcgacattttggtgaagagaacttgagagcagctctcaacaatatgggtgtcagtggaaatgctttggaagggatactggataaagtgaagaacaggcattaccagctagcttgcacaatgacttttgaggcaactcacggtgtctcatgtgataccggaatcaatcatcctaatcagtatttcagcgaaagccagaaagtcttgcaagccaagaaccaaacagtacagagtcagttatcgacctaagttgggatgctcctgcagatagtagtccgtccaccaagtagaaactcaggttttgacactactattttggaagttgtaactttgcacttcatggttgaacgttaactgcaattcgttcattatataacgtttctaatgtgtgacgaataattactgtaggcatgctgctcaccattgttttttatggacctgtgatgcgtatttctgccg

SEQ ID NO: 4925 - DNA, 1900 bp, Triticum aestivum
agcggcggaggcagcggcgcgggtgccctgccaacgtaccgtgtggcgccgcagctggaggtgcggctggaggagttcgagctcttcgccatcgaccgcctgcgagtcctgaaggggatctcggatgggctatcgcgggggaagaggccggaggagatggagaaactggtaagcgaattgtggaaggcacatatgaggcaccaggatccagcagagactttgaacaaggacataatatctcactttgtgctccgtcttgtatactgcagaacggaggaattgcgtaagtggtttctctccatggaaaatacactgtttcggtatcgctttcgtctcgagagtcctgaatcacagaggcttcttatgagtgagtttcagcttccatacaaagcattgccacactcggaattcgaggctgtgaaagataagttaagccaagttgcacgttccatcggtcaatcggcaagcgttgaatctgtgttcttcaaggtaccttttgaagaagttccagatcttgttgccagccgccgagtattcctttcaaagggctatgcttatgttgcgatgagtcaggtggtttcacttgtggtaacccagttccgctgcaatatctcaaaggcacttgttttaacaaataggaaatggactgcgaccattaaggaacaagaaaaggacaggttgactcctattgttgaggcgttaagcaatgcatattttggacctgattactctcagccaaatgatgctactgagatttcgccgaaggatattgatcaactggctagaacttctttccctctttgtatgcgccatatgctagagaagttgagagaaaaccatcatctcaaacacgggggtagaatgcagtttggtcttttcctcaagggtgctgggctaaagctggaggatgctctcacattttggagatcggaattctctcagaaggttggctctgagcgatttgacaaggaatatgcatatagtatcagacacaattatggaaaagaaggaaaacgaacggattacacttcatattcatgtcaaaagatcatctccgctacacctggtgttggtgatcatcatggttgcccttatcgacattttggtgaagagaacctgagagcagctctcaacaatatgggtgtcggtggaaatgctttggaagggatactcgataaagtgaagaacaggcattaccagctagcttgcacaatgacttttgaggcaactcatggtgtctcatgtgataccggaatcaatcatcctaatcagtatttcagcgaaagccagaaagtcttgcaagctaagaaccaaacagtacagagtcagttatcgacctaagttgggatgctcctgcagaaagcagtccatccaccaagtagaaacccagcagctcggtgtcgaatcaagagtggtgcttgactgcaacgttgccagtacatggagatcaagtttgctcatgtttagcctgatgtgtggagcgagttctgctgctcgctggggttcggggagttccaactgccggtccatggcgtcgcatcctgtgctactattagcaacataagagaaacttaatctattgtcgtacaacagtactcgctcaaaatgagagcgaatagagattgatatggattttggtagtactgtaatcttctagtaccaccgacttgtgaacaccctgatcagttgtgctgcttcttggagaggaatattatggagtacgtacgcatgttcttcatttcatataggcatctgttgatgttttgtagaaggcagaaaaatcactaaatactgaccagagatatcctactgccatcttactgttaaacatttggaacatcaattttctgctgttgtctggtcaaagataagaacagtcttcctccttgaaaaaggaaac

SEQ ID NO: 4926 - DNA, 1408 bp, Avena sativa
ctcgcttcctccgcgattcgaaccaaaccctcaccgccatggagatcgtgcgatcccaaaggcagctcgctgcggcggcagcagcctccagcggcggaggcagtggcgcggggggcctgccaacgtaccgtgtggcgccgcagctggaggtgcggctggaggagttcgagctcttcgccatcgaccgcctccgagtcctgaaggggatctcggatgggctatcgcgggggaagaggcaggaggagatggagaaattggtcactgagttgtggaaggcacacatgaggcaccaggatccagcagagactttgaacaaggacataatatctcactttgtgctccgtcttgtctattgcagaacggaagaattacgcaagtggtttctctccatggagacgacactctttcggtatcgttttcggattgagagtcctgatacacagaggcttcttatgagtgagtttcagcttccatacaaagcattgccacactcagaatttgaggccgtgaaagaaaagttaagccaagttgcacgttcaattggtcagtctgcaagcgttgaatctgtgttcttcaaggtaccgtttgaagaagtcccagatcttgttggcagccgccgagtattcatttcaaaaggctacgcttatgttgcgatgagtcaggtggtttctctggtggttacccaattccgctgcaatatctcaaaggcactagttttgacaaataggaaatggactacaagcattaaggaacaagaaaaagataggttgactcctattgttgaggcattaagcaatgcctattttggacctgattactctcagcctagtgattctgctgagatttcttcgaaggatattgatcaactgtctaaaacttctttccctctctgtatgcgccacatgctagagaaactgagagaaaaccatcatctgaagaatgggggtagaatgcagtttggtcttttccttaagggtgccgggctaaagttggaggatgctcttgcattttttagagcggagttctctcaaaaggttggctctgagcggtttgacaaggaatatgcttatagtatcagacataagtatggaaaagaagggaaacgaacggattacactccatattcatgtcaaaagatcatctgcgcgactcctggtgttggtgatcaccatggttgcccttatcgacattttggtgatgagaacttgagagcagctctcaacaatatgggtatcagcggaaatgctttggaagggatcctggataaagtgaagaacagacattaccagctagcttgcacattgacctttgaggcaactcacaatgtctcatgtgacactggaattaatcatcctaatcagtatttcagtgaaagccagaaagtcttgcaagccaagaaccaaacagt

SEQ ID NO: 4927 - DNA, 1614 bp, Panicum virgatum
tcccgtggataacatttcggcatatttcgggatgggcctctcacgaattattgcaccataaaaatggtacagtaagaaaaatactccgggtcaggcttgggccaggccagtttggaaatctgcgcaaagccatgctagtttacggcccaccggcgccgcggcgggaaaaagcaggtccttttcccgccaaagcttccccaattttctttctcccgccgccctctcctctcccactctccatccccactccccactccccacagccgccgcctgcccgcccgccccgtaatctccgacgccagtgcgccggccaccgaacccttccgtgcgagggccctgctccgcgaccgcgcatggagatcgtgcggtcccaccggcagctcgccgccgcagccgccgccgccgccgccggcggcgcgggggccctgccgacctaccgggcggcgccgcagctggaggtgcggctggaggagttcgagctcttcgccatcgaccgcctccgtgttctcaaggggatctcggatgggctctcgcgggggaagaggccggaggagatggagaagctggtctgtgagttgtggaagacacacatgaggcaccaggatccagcagagactttgaacaaggatataatatcgcactttgtgctccgcctagtctattgcagaacggaagaattacgaaagtggtttctctccatggagactacacttttccggtatcgctttcggcttgagagtcctgaatcacagaggatgcttatgactgagtttcaactgccttacaaagcattgccacactcagaatttgaggttgtgaaagacaagttgagccaagttgcacgttccattggtcaatctgcaaatgttgagtccgtgttcttcaaggtaccttttgaagaagttcctgatcttgtggccagccgccgagtatttctttcaaaaggctatgcttatgtggcgatgagccaggtggtttcattagtggttactcatttccggtgcaatatctcaaaggcacttgttttaacaaacagaaaatggacggcaactataaaggaacaggaaaaggacaggttgactcctattgtcgaagcattaagcaatgcgtattttggacctgattactctcagccgaaggatgctgttgaaatatctctaaaggatattgaccaactggctaaaagttctttccctctttgcatgagacatatgctagataagttgagagaaaaccatcatctgaagcatgggggtagaatgcaatttggacttttccttaagggtgctggactaaagttagaggatgccctggcattttggagagcggaattttctcagaaggttggctctgagcgttttgacaaggaatatgcctatagcatcagacataattacggaaaagaaggaaaacggacagattacactccatattcatgtcaaaagatcatttctgcaacaccaggtgttggagatcatcatggatgcccttatcgacattttggtgatgaaaatttgcgggcagcactcaacaaaatgggtgtcggtgggcatgcattggaagagataatggataaagtgaagaacaggcattaccaggtgctgtagttcattg

SEQ ID NO: 4928 - DNA, 5943 bp, Zea mays
gcttccgaggaggttagagcgttggctgctatggcgccgcctcgcgtcaccaggaagaaggggaagggcgccggcggcaagaccgacctgcgtcccgaccggaagcagttcaaaaggcaccacaaggaggatgcagccgctgagcagggggatggcaacggagagcggcagcagtcggcagcgccgggttctgcagcgctcctcgccgcagcttctgacgaagctgactttccaagagggggacacagcctcctgagcaaggatgagatggcggaggctcgtgcggaggcggagcaggatttcgagagggaggcgaagaaggggaagggaaaaaggaagaggagtggcggcgagtcgtctggttttggcgtggatgacgacttggggatactcttcggtggggccaccactgggaagctcccacgctttgctaatcgcatcacagtaaagaatatttcaccaaatatgaagctctggggtgttgtaattgaggttaaccagaaagatattgtgttaagtctacctggtggaattagaggctttgttcgctcagaggatgtttgcgacattgctttgcaggaaaatcgtaaggatagtgggaacaatttatgcgcagaagttgttcatgttggtcagcttgttccttgtatagtcctacgagtcgacgatgatagtagagaaggaaaagtaaacaaacgggtttggctatcattgcgattaagcctattgtacaagggacttgccctggatggcttgcaggaaggaatggtacttactgcccaagtcaaaagcatcgaggatcatggttacattcttcattttggagtatcttcctttagcggatttatgcagaaggatgacaaagaagatgtgaagactgagcgccgacaactgatgcaatgtgttgtgaaggcgattgacaaaactcgggccattgttcacttgagttctgatgaagacttgctttctaaatctactattaaggatctgaaaggcctttctattgatcatttgattcctgggatgatggttaatgcacgtgtccattcatttcttgaaaatggactcatgttatcatttcttacttatttcagtggaacagttgatatttttaatttgttgaattccttcccctctggtaattggaaagatgattacagtaagaataagaaggtaaatgctcgcatcctgttcgttgatccatcaacaagagcagttgggcttacattgaacaaacatttacttcatcttgaagtaccccctattaatctaaaagctggagatatctacgataaatcaaaggtgctgagggtagataaaaaggccggtctctttcttgaaataccttctccaactccatcacctggatttattagtatacgtgatgtgtcagacaaggatgcaaaaaacttggagaagttcaaggaaggcagtagcttacgtgtccgtatacttggagtgcggaatcttgaaggagttgcaataggcaccataaaagacagtgcttttgaagggtctgttttcactcatgatgatgttaaacctggaatgttagtgagagctaaggttgctactgttgagccattcggtgctattgtacagttttcaagtggcgtgaaagcactttgtccgcttcctcacatgtcagagttggaacatgttgttaaaccaccaaagaaatttaaggttggagctgagcttcttttccgtgtgttgggctgcaaatccaagagagttacagtgacatacaagaagtctctggtgaaatcaaaacttgatgtgctttcatcatatgctgatgcaaaaattggtttagtgactcatggatggattactcatattgaaaagcacggttgctttgtaaaattctacaatggagttcaaggttttgttagcagatctgaccttggattagaggctggaactgaagcagaaaatgtttatcatgttggccaagtggtcaaatgtagaattatcaatgtgatccctgcttcaaggaaactaaatgttagttttgtcatatcccataataggattgctccaatagacactccaaagttgggcagtattgtctctggtgttgtggaacggcttactcctgcagctgttgttgttagtgtaaatggcttctccaaggggacaatactgaatgaacatttggcagaccatcatgatactgaaggtcaaaatttagttctttcggcaaagcactcacttataaattgtgcaaatgacattccttcagagatatcacagatgcatcctggtgttgtagttcatggttacatctgcaacattattgaagctggttgttttgtccgtttcctcggacatttgactggtttctctcccaaggacaaagcagttgataggtggatagaaaagctttctgatgcgttctatgttggccagtcagttcggagtcatatactcagcgtaaatgcagaaactgctagagtaaaactcgcacttcaacagtcaatgtgctcctcaatggattcttcatttattcagggatactttcttctggatcagaagattgcagcattgaagtactcaagcaatgactgggctcgccattttggcattggtagcttagttgaggcggaggtgggagctatagaagaatatggtattatccttaacttcaaagaccatctggatactgttggtttaatcgagcaccatcaacttggtggcagtagtgtggaagtgggatcttctgtgaagggtcttgttttggatttatctgatggagttgttaacttgtccgtcaaaccagagctaattgacagtgtcagaattgttggaaaaaagaagaaacgccaaagggccgtagttgcagacttggagcttcatgaggaagtgaatgcagtcgtggaaataatcaaagacagctatatggtcctttccatccctgagtacaattatgcaattgggttttcaccactgatggattataactcacaactgcttccccaccaccactatgataatggacaacgcattactgtggttgttggaaatatcccaagttctgactcttctggaagacttatcttactaccaaaagcttcagcacagtattcttccctctctgattctaaaagggctaagaagaaatcaggctacaaaattgggtcacttgttgaagcagagattattgatatcaaaccgcttgagcttctactgaaatttggtggcaatcttcatggaagaatccatattactgagattcttgaagaggattctgctgagcatccctttagtgaactcagaatagggcaaaagcttactgccagaattgtttcagaggctgaaccttctggaaagagtggcaaaaaattcaaatgggaattgtctattaggccatgtatagtcaatggagagtttgctcaaaaagaacaaaatcacaccacaaatgggattgtacgtgcttatgttgtcaaggtggataaggaatgggtctggttaactgtatcaagaaatgttatggctcatttatttttacttgatagttcttccgagcccagcgaactgaaagaattccagcagcgctttagtgttggccaagcagtgaaaggtcgtgttatcagtgtgaaccaggagaaaaggttacttcggttgaaggcacttgataaccaatgcacacaaccgaatatagatgaaacacaagaaccaaagtcctctgtgtttggacaaacaaaacaaggagatatcattggtggacgtgttcaaaaaattctacctggtgttggtgggctcgtcgttcagattggacctcatctccatgggagggttcattatactgaaattgttgactcttgggtgtctgaacccttgtctggattccatgagggccagtttgtgaagtgcaaggtcctgtctgtgagccgctcatcagaaggatcacttcgagttgatctatcactccgttcatcaaacctgatcagagactctaacaactcaagactagatgatctggaaacctgtacctcccggattgagaagatcaaggatctgctccctggaactgagattaagggctatgtgaagaacgtgaattccaaaggatgttttattatgctttctcgaatggttgatgctaggattactctatcaaatttatcagatgaatatgttgaaaatccacagaaggatttccccgttggaatgcttgtacacggaaggatcctgtctacagacccatcatcagggagagttgaggcatcacttaggaagaccactggttcaaaattggaaaagctggatgatattagttatagtgacttgcatgttggggatatcgttgatggccaagttaagcgggtggaatcctttggattattcgttacaattcggagaagtgaattggttggtctgtgccatgtatcagaactttctgatgaacctgtcgttgatattaactcttgctataaagctggtgatatggttaaagccaaaattctgaagattgatgagacgcggcatcgagtatcacttggaatgaagaagtcatactttgattctgatctgactgctgacacaaatgatgatgaaagtgctcttatggacatcagcgttgcccctcagatggttgaatatcataacagaaatttagttcaccgcaaagcagaaccaagggcttctgttctgcctcttcaggtttccttggatgaatcggaaggttccgacctagaggataatattagtaatacatgtcttgaaattgctaatggaactgaagcaaatgctaaaaagagtgataaacagttaaagaaggaagcaagaaaacaaagggaactagaaatcagtgctatggaggaaagggctttgcaggaagatataccacaaactccagatgattttgagaagttagttaggagctccccaaatagtagttttatctggataaagtatatggcaactttgttagatcttgcagatgttgagaaagcacgtgcagtagctgagagggctttaaaaacaataatccccagagaagaagaagagaaactaaatgtttgggtagcatatttcaatctggaaaatgaatacggtagtccaagggaggatgctgtgaaaaaggtattccaaagagccttgcaatattgtgatcccaaaaagctgcacttggctcttcttgcgatgtacgagaggaccgaacagtatgagcttgcagatgaacttctagacagaatgaccaaaaggttcaaaacttcctgcaagatatggttatgccgcattcagtttgctctcaagcaaggcaaggatgttgagtacatcaaagccattgtaaaccgtgcacttctaagtttgccacacagaaagcgcataaaattcctctcacaaactgctattctagaattcaaatgtggggtgcctgaagaaggaagatccagatttgaactaatattgcgggagtacccaaaaagaacagacctttggagtgtttatctagaccaagaaatccgccttggtgacgtagaagttatacgggcattgtttgagagggtgacttgtctgaccctacctccaaaaaagatgcagttcttgttcaagaagtatcttaatttcgagaagtcactgggtaaagacaacgaaagaattcagcttgtgcaacagaaggcaatcgaatatgttcagagttcactgccgtcacaagacaactcttgaactacatggagacttaataagcccacaaacaatcattaggaaataccagtcgtactgtagatgtgatctctttgatgactccttgaacattattgtgaaaaggtcaatgtaaaatgtgggctgttcaaaattttgtttgaaacctttatataagttatgagtctagtatgtcatgtttcacccaattttttggaaggaactattctaagccggatctggttcgaatattgaccttttctatctgtggtattgactgatgaggcacaa

SEQ ID NO: 4929 - DNA, 6150 bp, Setaria italica
ggcggcgactccgtgctgacggcgagcggcgacagacgagcaagccgcgctcggggagctacgagcgtgcgcgccgaggctgccgcagcgaaccagcgccgcaagcaaggagcctgagccctcgcagccatggcgccgccgcgcggcgataggaagaaggggaagggcggtggcggcggcaagaccgacctgcggcccgaccgcaagcagttcaaaaagcaccgcaaggaggaggcggcgtctgagcagggggattgcgacggggagcaccagcagccgggctccgccgcgctcctcgccgcggcgtccgacgaagctgacttcccgagagggggacgcagcttcctcagcaaggacgaggtggcggaggcccgcgcggaggccgaggaggatttcgagagggaggggaagaaggggaagaggaagaggaaggccggcgagtcgtctggtttcggtgcggatgatgacttggggacgctcttcggcggggccaccaccgggaagctcccacgatttgctaatcgcatcacactgaagaatgtttcaccaaatatgaagctctggggtgttgtaattgaggttaaccaaaaagatattgtattaagtctacctggtggaatgagagggtttgttcgctcagaggatgtatgtgacatcgctttgcatgaaaatcgtaaggatagcgagaacagtatatgtgctgaagtcgttcatgttggtcagcttgttccttgtatagtcctgcgagttgatgatgacaggaaagaaggaaaagtaaacagaagggtttggctatcattgcgattaagccagctgtacaagggactttctctggatgccttgcaggaaggaatggtacttgctgcccaagttaaaagtgttgaggaccatggttacattcttcattttggagtaccttccttcagtggatttatgcaaaaggctgacaaagaaaatgtgaagattgagcccagacaactgatacaatgtgttgtgaaggctatcgacaaaactcgggctattgttcacttgagttctgatgaagacttggtttctaaatctattattaaagatctgaagggcctttccattgatcatttgattcctggtatgatggttaatgcacgtgtccattcagttcttgaaaatggagtaatgttatcatttcttacttatttcagtggaactgttgacatctttaatttgtcaaatccctttccctctggtaattggaaagatggttacagtaagaataagaaggtaaatgctcgcatcctattcgttgatccatcaacgagggcagttgggcttacattgaacaaacatttacttcatcttgaagtgccccctattaatctaaaagctggagatatctacgataaatcaaaggtgttgaggatagataaaaaggctggtctttttcttgaaataccttcttcaactccatcacctggatttattagtatacatgacgtgtcagacaaagatgtgaagaacttggagaagaagtttaaggaaggcagtagcctacgcgtccgtatacttggagtgcgaaatcttgaaggagttgcaataggcactgtaaaagacagtgcttttgaaggatccgttttcactcatgatgatgttaaacctggaatgttagtgagagctaaggttgttactgttgagccatttggtgcaatcgtgcagttttccagtggtgtgaaagcactttgcccgcttccacacatgtcagagttggaacatgttgtaaaaccaccaaagaaatttaaggctggagctgagcttctattccgtgtattgggctgcaaatccaagagagttacagtgacatgcaagaagtctctggtgaaatcaaaacttgatgtgctggcatcgtatgctgatgctaaagtcggtttagtgactcatggatggattgctaaaatcgaaaagcatggttgctttgtaaaattctataacggagttcagggttttgttagcagatctgagcttggattagaggcaggaactgaagcggaaaatgtttatcatgttgggcaagtcatcaaatgtagaattatcagtgtgctccctgcttcaaggagaataaacgttagttttgtcatatctcataataggattattccagcagatattgcaaagttgggtagtattgtctcgggtgttgtggagcggcttactcctgctgctgttgttgtcagtgtaaatggcttctccaaggggacaatactaaatgaacatttggcagaccatcatggtcaagctgctcagttgaagaatttgctgaaacctgggcacgagttcaaccaactcttagttctcgatatcgaaggccaaaatttagttctttcagcaaagcactcacttatcaatagctcaaatgacattccttcagagatactgcagatgcatcctggagctttagttcatggttatatttgcaacatcatagaagctggttgttttgtccgctttcttggacatttgactggtttctctcccaaggacaaagcagttgataggcgggtggaaaagctttctgatgcgttctatgttggccagtcagttcggagtcatatactcagcgtaaacgcagaaactgctagagtaaaactctcacttcaacagtcaatgtgctcctcaacggattcttcgtttattcaaggatactttcttttggatcagaagatttcggcattgaagtactcaagccatgattgggctcacgcttttggcattggtagcctagttgagggggaggtgggagcaatagaagaatatggtattgtccttaacttcaatgaccatccggatgttgttggtttaattgaacatcatcaactcagtgacagtactctagaagtggggtcttctgtgaagggccttgttttggatttatctgatggagttgttaacttatcccttaaaccagagctaattagtagtgtcagaattggtggaacaaagaagaaacgccaaaggcctacagttgcagacttggagcttcatgaggaagtgaatgcagttgtggagatagtcaaagagagctatgtggttctttcaatccccgagtataactatgcaattggttttgcatcactgatggattacaactcacaactgcttgccacccaccgctatgataatgggcaacgcattactgtggttgttggaaatatcccaagttctgacccgtctggaaggctcatcctactccctaaagcatcagcccaggattctggcctgtctggttctaaaagggctaagaaaaaatcagaatacaaagttgggtcacttgttgaagcagagataattgatatcaagccactagaactaatactgaaatttggtgccaatcttcatggaagaattcatattaccgaggttcttgaagaggattctgctgagcgtccctttagtaaactcagaatcgggcaaaagcttactgccagaattgttgcagaggctgaaccttctggaaagaatggcaaaaacttcaaatgggaattgtctattagaccgtctatgcttaagggtgagtttgaagaatcaactgctcataaagaagaatttaatcacaccacgaatgtggttgtgtgtggttatgtcgtcagagtggataaggaatgggtctggttaactgtatcaagaaatgttatggctcatttgtttattctggatagttcttctgaccccagtgaactaaaacagttccagcagcgctttagtgtaggccaagcagtaaaaggctgtgttattagtgtgaaccgggagaaaagattgcttagggtgaaagcacttgataaccaatgtgcacaacataatatagacaaaatacaacaatcagagtcctcgttggttgaacaaacaaaacaaggagatgtcattggtggacgtgttcaaaaaattctacctggtgttggtggacttgtcgttcagattggacctcatcttcatggaagggttcattatactgaaattgtcgactcatgggtggcagaccccttgtctggattccatgagggtcaatttgtgaagtgcaaggtcctgtctgtaagccgctcatctgaaggatctcttcgagttgatctatcactccgctcatcaaacatacgcacagattctagcaattcaagactatttgatgaaggggcaacctgtatcccacggattgagaagatagaggatctgcttcctggaactgagattaagggctatgtgaagaatgttaatcccaaaggatgttttattatgctttctcgaatggttgaggctaggattactctgtcaaatttatcagatgaatacgttgaaaatcctcagaaggatttccctgttggaatgcttgtacatggaagggtcttgtctacggacccatcatcagggagagttgaggcgtcactcaggaagaacactggtagcaaattagaaaagccggatgatattaattatagtgatttacatgttggggacatcattgatggccaagttaagcgggttgaatcctatggattatttgtcacaattaggagcagtgaattggttggtctgtgccatgtatcagaactttctgatgagccagtccttgatattaactctcgctataaagctggtgatatggtcaaagccaaaattttgaagatcgatgagaagcggcaccgagtatcccttggaatgaagaaatcgtactttgattgtggtctgactgctggtacaaatgatgatgatgaaattgctcctatggacatcagcattgcctctcaggttgcaggatatcacaacaaagttcattccgcagcagaaccaagggcttctgtgctgcctcttcaggtctccttggatgaatctgaaggttctgacctagaggataatagtaatgaaggccatgaaattgccaatggatctgaagcaaatgctaaaaagagtgacaaacggttgaagaaggaagcaaggaaacaaagggaattagaaatcagtgccttggaggaaagggcattacagggagatataccgagaactccagatgattttgagaagttggtcaggagctcaccgaatagtagttttgtctggataaaatatatggcgtgtttgttagatcttgcagatgttgagaaagcacgtgcaatagcagagagggctttaaaaacaataatccccagagaagaggaggaaagacttaatgtttgggtagcatatttcaatctggaaaatgaatatgggagtccacgggaggatgctgtcaagaaggtattccaaagagccttgcaatactgtgatcacaaaaagttgcacttggcccttctcgcagtgtatgagaggactgagcagtacgaacttgcagatgaacttcttgatagaatgaccaaaagattcaaaacttcctgcaagatatggttatgccgtattcagtttgccctcaagcaaggcaaggatgttgagtacatcaaagctgttgtaaaccgtgcgcttctgagtttgccacagagaaagcgtataaaattcctctcgaagacagctattctagaattcaagtgtggggcgcctgaagaaggaaggtccagatttgaactaatcttacgggagtacccaaaaagaacagatctttggagtgtttatctagaccaagaaatccgccttggtgacatagaaattataaggggattatttgataaggctacttgtcttaccctacctccaaaaaagatgcagttcttgttcaagaagtaccttaagttcgagaagtcgctgggtgaagacaatgaaaggatccagcatgtgcagcagatagcaatgaaatatgttcagagttcactgccatccgaaagccacccctgaacttgagcggttgccaccactggcaatgcagtgtgcgagttgctcctctgatctttacttccaggagtcaaacgctgacatcaggcagaatcagaatcgctgcagacacaattttgctcgtgataggaacaagacagaatattaggaaaattcgctgttgtgatttgaggatcaatagctgtatccggtcggcatttagcatgcctattgaacatctttgtgaaaaacattaatgcaagtgctgattgcctgaaaggaaaggaaactacaattttgaatattgcaaactcttcgcacgtctcaccc

SEQ ID NO: 4930 - DNA, 1024 bp, Zea mays
gcaacaataaagggcggtgtcgaagaggagcttggagcttggaccgacccgagccccatcgagcgagagaggaaataatgggtgaagaggccagctgcaacgccgccagcgcgatggaggccgccaccaacgccaggccggccaaggagaacggacgcgcgccggctgtggcggaggtagtggcccaggaggcggccgctgacccccggctgcagggcatctccgacgccatccgcgtcgtgccgcacttccccaagcacggcatcatgttcaacgacatcaccacgctgctgctgcgccccagggtgttcaaggacgccgtcgacctgttcgtcgagcgctaccgcgggatgcgcatcgacgccgtcgccgggattgaggccaggggcttcatatttggcccggcagtcgcattggctattggcgccaagttcatacctttgcgcaagcctaggaagctccccggcgaggtgatctccgagaaatacgttctcgagtacgggaccgattgcttagagatgcatgtcggagccatcgaacggcctggtgagcgcgtgctgatcaccgacgacttggtcgcgacgggagggacgctctgtgctgcaatcaggcttcttgaacgtgctgaagctgatgtggtcgagtgcgcatgcctcattggcctcccaaaattcaaggatttctacaagttgaatggaaagcccgtctacgtgctggttgagtcccgggaatcagataaataagaacttatgggtcagaggaaagctggcggttcattccttgctgttgtgattgagcagtggagggacatcgacaagccaaccatgggggtgctttagcgttactaaggctagctactaagatcgacttggtgagaggagaggttagaagtgctggggggggcgttagtcttgtaggctgagtagattttcagagtactgaagagcttgtagttctgccaggaacatgcttattagttgaagcaagagtgttgatggtccattgcttgttggattttgtggtt

SEQ ID NO: 4931 - DNA, 1003 bp, Saccharum officinarum
cgaagaggacggtaggggttttcgaaaaagaagaggacggtaggaggagctttggacggagcgagagagcgagggagccgagagggagagcgagaggaattaatgggtgaggaggccagctgcaacgccgtcagcgcgatggaggccgccaccaacgccaagccggccaaggagaacggctgcgcgccggccgtgacggaggcggcggcggaggccgtagcggcggtggtggcccaggaggaggcagcccccgtggccgcggcagccgacccccggctgcagggcatctccgacgccatccgcgtcgtgccgcacttccccaagcaaggcatcatgttcaacgacatcaccacgctgctgctgcgccccggggtgttcaaggacgccgtcgacctgttcgtcgagcgctaccgtgggatgcgcatcgacgccgtcgccgggattgaggccaggggcttcatatttggcccggcaattgcgttggctattggcgccaagttcatacctctgcgtaagcccaggaagctcccaggtgaggtgatctctgagaagtatgttctggagtacgggactgattgcttagagatgcatgttggagctatcgaacggcctggagagcgtgtgctgatcgtcgatgacctggttgcaaccggagggacactttgtgctggaattaggcttcttgaacgtgctgaagctgatgtggtcgagtgcgcatgtctcattgggctcccaaaattcaaggatttctacaagttgaatggaaagcctgtatacgtgctggttgagtcccgtgaatcagataaataagaacttatggtcagaggaatgctggtgggttcattccttgtcctttgctactgcggttggacagtggagggacatcgacaaggcaactatgcggtgcattacaactaaggctagctactaaaagtcttggtgaggggagagattaaagtgttgagagtgtagtcttgtaggctgagtagttttcagagtactg

SEQ ID NO: 4932 - DNA, 1350 bp, Setaria italica
gataataaacgctgcccagctcacttcgccccgcccgccactcgcctcccctgctcggctgccctgctctgctctgctcgggatatatatacacgcgggcgcaccagtccagcgagcaacaataaaggctgggtcgaggaggaggagggggaggagctgcttggttggaccgaacgagctgagagccagcgagagaggagggccgagcgagagggagaggaactaatgggtgaggaggccagctgcaacaccgtcagcgtgatggaggccgctaccaacgccaagccgcagccgcagcagcccaaggagaacggccgcgccgctgccgccgccgtcgcggccgaggcgacggcgcctgtggccgaggcggcggccgacccccggctgcagggtatctccgacgccatccgcgtcgtgccccacttccccaaggaaggcatcatgttcaacgacatcaccacgctgctgctgcgccccggcgtgttcaaggacgccgtcgacctcttcgtcgagcgctaccgcgggatgggcatcgacgccgtcgccgggattgaggccaggggcttcatatttggcccggcaattgcgttggccataggcgccaagttcataccgctgcgcaagcctaggaagctcccaggcgaggtgatatccgagaaatatgtgcttgagtacgggactgattgtttagagatgcacgttggagccatcgaacctgcagagcatgtgatcatcgttgatgacttggttgctaccggtgggacactgtgtgccgcgattaggcttcttgaacgtgctggagctgaggtggtcgagtgcgcatgtctcattgggcttccaaaatttaagaatttctacaagctcaatggaaagcctgtctatgtactggtggagtcccgtgaatctgataaataagaagtgatggtcaggaatgctggtgtgttcattccttgctgctgcaattgagaggtggacgggcatcgacaactatgcggtacattactaagactagctgctaagtcttggcaaggggagaggttagagtgttgagagtgtagtcttgtaggttgagtagtttttttttcagagtaatggcgcttgtagttcttccgggaacattgttattagctgaaacaaggttgctgctgttccattgttgttgaattgtgcggttttaatttgaaaatgtcagcaatcaggatatagatggagcttcagagaagaacttcggcagcatgacagcatggttaacgtctaggaacctgttaccgttagcttgttactagaaaacatgggggcgcggcgttgccgcgccaacttgagctggtctggcctggacaacttgtgcat

SEQ ID NO: 4933 - DNA, 1489 bp, Panicum virgatum
tggggggagttggatggagggaatggttggagaaagccgaaggcgggggctagggacggggagcttttctccaaaagagaaacggctagcctcttgtcacgtacaacaactgtgcaagtagggaaggacgcacagagagggagggggaggaccggaggaggcctacgcacggtagagtcctgcaggggctacccctggcgtgcgtggcagcgctggtctctggcggtctggcctgccctcccgctagggtagtaggcgagggaggagagcgagctgcctgggagccccgccccggcgcttgtttccgagggacaataaacgctgcccacccagtctctcactccgcgcgccatcgcctccccctgctcggctctatatatacgctggcgcactggcccagcaagcaacaataaaggctgggtcgaagaggaaggggaagcttggaccgagcgagcgagagaggaactgaggaagggccggccgagcgagagggagagaggaattaatgggtgaggaggccagcggcaacgccgtcagcgtgatggaggccgccaagcagcagcagccgccgcccaaggagaacggcctcgccgctgccggggaggccgcggccgcggccgacccccggctgcagggcatctccgacgccatccgcgtcgtcccccacttccccaaggaaggcatcatgttcaacgacatcaccacgctgctgctgcgccccggggtgttcaaggacgccgtcgacctcttcgtcgagcgctaccgcggcatgggcatcgacgccgtcgccgggattgaggccaggggcttcatatttggcccggcaatcgcattggccattggcgccaagttcataccgctgcgcaagcccaggaagctcccaggtgaggtgatatccgagaaatatgttcttgagtacgggactgattgtttagagatgcacgttggagccatcgtgcctgctgagcgtgtcatcatcgtcgatgacttggttgcgaccggtggtaccctttgtgctgcgattaggcttctcgaacgtgctggagctgatgtggtcgagtgtgcatgcctcattgggctcccaaaatttaagaatctctacaagctcaatggaaagcctgtctacgtactggtggagtcccgtgaatctgataaataagaagtgctggtcaggtggtgtcatgttatcgttttcagctgcgggtgcggcacaccaagtgcttcccttgattcgtttctgcgtgttcttaagcttagcggcacacttcttttgctcatttcctatccgacacccgtatttttcaggaatgctggtgggatggctaggtgctaagtcttcggtgggggggggggggggggagttagagaagagtgtagtcttgtagccttggtagtttttttttcagagtactgatggagcttgtagttctactgccgagaacacatggttattagatgatgaatcaaggttgctgctgttccattactt

SEQ ID NO: 4934 - DNA, 1146 bp, Pennisetum glaucum
gagcaacaattaaggctgggtcgaggaggagggtgaggagctgcttggttggaccgagcgagctgagactgagaggagggccgagcgagagggagaggaattaatgggtgaggaggccagctgcaacacggtcagcgtgatggaggccgccaagcagcagcccaaggagaacggctgcgccgctgctgctggggaggtcgtgccggtggcggtggccgaggaggaggcggcggcgcccgcggctgacccccggctgcagggcatctccgacgccatccgcgtcgtgccccacttccccaaggaaggcatcatgttcaacgacatcaccacgctactgctgcgccccggggtgttcaaggacgccgtcgacctcttcgtcgagcgctaccgcggcatgggcatcgacgccgtcgccggtattgaggccaggggcttcatatttggcccggcaattgcgttgtctattggcgcaaaattcataccgctgcgcaagcctaggaagctcccaggcgaggtgatatctgagaaatatgtgctcgagtatgggactgattgtttagagatgcacgttggagctattgaacctgtggagcgtgtgatcatcgtcgatgacttggttgcaaccggtgggacactgtgtgctgcgatcaggcttctcgaacgcgctggagctgatgtggtcgagtgcgcatgcctcattgggctcccaaaatttaagaatttctacaagctcaatgggaagcctgtttacgtactggtggagtcccgtgaatctgacaaataagaagtgatggccaggaatgctcgtgggttcattccttgctgctgcaccatgggtgggcgtcgacaactatgcggtacattactaagggtaggtgcaagtcttgcgaagggagaggttagagagtgttgagcgtgtagtcttgtaggctgagctgagtagttttttctctcttcagagtactggagcttgtagttcttccgaaaacatggttattagctgaaacaaggttgctgctattccaaaaaaaaatgttgtcaaattaacatgaactaaattttataacccaacaaaaagtagcttataaggatgtgcataaggtggtgatatatttaggttagatcatttggcaccaatgcaatgac

SEQ ID NO: 4935 - DNA, 1389 bp, Zea mays
gcacttgcttcaatactagctcgctcaccactcaccagtcaccagtctagcaagcaacaacaaaggcgtaggaggaagcttgttttggaccgagcaagcgagccagccgagcgtgggagagagagaaagaggaattaattgatgggcgaggaggccagctgcgacgccgtcagcctgacggaggccggcaccaacgccaagccggtgggcaaggaggtcggccgcgagccggctgcagcccccgccgccgcggccgacccccggctgcagggcatttccgacgccatccgcgtcgtgccgcacttccccaagcaaggcatcatgttcaacgacatcaccacgctgctgctgcgccccagggtgttcaaggacgccgtcgacctgttcgtcgagcggtaccgcgggatgggcatcgacgccgtcgccgggattgaggccaggggcttcgtgttcggcccggcgatcgcgctggctattggcgccaagttcatacctctgcgcaagccaaggaagctcccaggtgaggtgatctccgagaagtacgttctcgagtacgggactgattgcctggagatgcgtgtcggggccatcgagcgatccggcgagcgggtgctggtcatcgacgacctggttgcgaccggagggacactctgtgctgcgatcaggcttctagaacgtgctggagccgatgtggtcgagtgcgcgtgtgtcattgggctcccgaaattcaaggatttgtacaagttgaatggaaaacctgtatacgtgctggttgagtctcgtgaataatcggagaaatgacaacttattctcaggtgtcagagtgatcagggatattggctgtttactccttgctactgcgattgaacagtggagggacgacatggacaaggacaagtatattcggtgcatcactaagtcttggtgaggggagagattgtagtgttttaggctgagtagtgaagagcctgtagttctgcacggaacatgatggttattagttgatgcaacagcgttgctgttctattattgtttgttgaattttgtggctttggtttgaagcctagcctgggctcaaacagggatatgcatggcgcttgagtgaacaacttcgacagcaacacacacatgcttaatgtcagggaagtagctaggaacctgctacttgttacccgtacgtgtgtcatggaactcataaggtttagtggcaaaattcataaaaatgacacaggaaacgaacacagcacgcgtagcaggggaaaaaaatgcgtagatagatatacttcgtactagtaaaactatcacacagctcgtattttgagcctcggtatccactaaatattgggggcgtagtattcgcgtgagcagtgaataaatgcgtagcgggag

SEQ ID NO: 4936 - DNA, 1084 bp, Cenchrus ciliaris
ccagctgcaacacggccagcgtgatggaggccgccaccaacggcaagccgcaggccaaggagaacggctgcgccgctgctggggaggccgtggcggtggctgtggccgaggcggcggcgcccgcggctcgtgacccccggctgcagggcatctccgacgccatccgcgtcgtgccccacttccccaaggaaggcatcatgttcaacgacatcaccacgctgctgctgcgccccggggtgttcaaggacgccctcgacctcttcgtcgagcgctaccgcgggatgggcatcgacgccgtcgccgggatcgaggccaggggcttcatatttggcccggcaatcgcgttggccattggcgccaagttcattccgctgcgcaagcctaggaagctgccaggcgaggtgatatctgagaaatatgtgcttgagtacgggactgattgtttagagatgcacgttggagctatcgaacctgctgagcgtgtgatcatcgttgatgacttggttgcaaccggtgggacactgtgtgctgcaattaggcttcttgaacgtgctggagctgatgtggtcgagtgcgcatgcctcattgggctcccaaaatttcagaatttctacaagctcaacgggaagccggtctacgtgctggtggagtcccgtgaatctgataaataagaaatggttgccaggaatgctggtgggttcattatttccttgctcctgcaattgaaagctggaccgtggacaggcgtcgacaactatgcggtacattactaaggctagcggctaagtcttggcgaggggagaggttagagagtgttgagagtgtagtcttgtaggcttagtttttttttcgagtactggagcttgtagttcttccgagaacatggttattagctgaaacaaggttgctgctgttccattgttggttcaattgtgtggttttgattcgaaaagatcagcaatcaggttagatggagctttcagaggaacttcgagcgcagagacgaaccatcccgaaaagggatgagaagagggattatcgggtcactcacttcctgtgagccagatcaaacgtggtggattac

SEQ ID NO: 4937 - DNA, 1211 bp, Triticum aestivum
cttgttgagctccacactccagctccagcgcagcctcagagtgcagaggagagtgagtgggcatgggcgaggaggccaattgcgacgccgtgatggaggccggcaacggcaacggcaaggccaaggagaacggccacgccacagccgttttggccatgccggacgtcaaggccgacgacgccgtggtggcgcccgccgaccctcgcctgcagggcatctccgacgccatccgcgtcgtcccgcacttccccaagcaaggcatcatgttcaacgacatcacgacgctcctgctgcggcccggggtgttcaaggacgccgtggacatgttcgtggagcgctaccgcggcatgggcatcgccgccgtcgccgggattgaggcgagaggatttatatttggccccgcgattgcactagccatcggtgccaagttcattccgttgcgtaagcctaagaaactcccaggtgaggtgatttctgagacctatgttctcgaatacggaactgattgtctggagatgcatgttggtgctatcgaaccccgtgagcgtgttttgatcgttgatgatctggttgcaactggtgggacactttgtgctgctataaatcttctggaacgtgctggagctgatgtcgttgagtgtgcttgtctcattgggctccctaaatttaaggatttttacaagctcaacgggaagcctgtctatgtactggtggagtctctcgaatatgaaaaatgagaaaccggtgaccagggacgcatcatggcttcatcctgctgcggtagtattagggagtgggggaggttagggagcggtacgtgaatggatgtgtgtagtctttgtaggctgagtggtttcttcaactgtactgaagagcttccttgtgctcgggagaaatgatcgttagctgagacgtgagtcctgtagttccattattattggttattattaattgtgtggtttgatttcttggcacgggcaagaggatggagagaaatcctgcatcgtggtgtgtgacgagaatcacagagtgcagtgttttgtcctgggcgatcccgtgtacgttggatattgcttcacggacgacaccgtatgcacgatctgcagccgatatttccttcccaactacgctagcttcagctttcgaataaaaaacaattgcctaaacgctgatggtgctgtcatgtactcccttcgttcctaaatacttgt

SEQ ID NO: 4938 - DNA, 1260 bp, Hordeum vulgare
ggggtcacaggctatgcgttgtgaacaggggcccgtggtggtccgctgcttgtttccaagtccaaggatcgatgatagtaataaaggaagcaacgcccccgcaaccccaaccccccttctcctttccttttccctgctatatatacaccggcacccgtcagcaagcaacattaactcacttgttcacctcaacactccagctcctatctagcgcagcgcagctctgtagagtgagtggaaatgggcgaggaggccaattgcaacgccgtgatggaggccgccaacggcaacggcaacggcaaggtcaaggagaacggccacgccgttgtggccatgccggacgtcaaggccgacgacgccgtggtggcgcccgccgacccccggctgcagggcatctccgacgccatccgcgtcgtcccgcacttccccaagccaggcatcatgttcaacgacatcacgacgctcctgctgcggcccggggtgttcaaggacgccgtggacatcttcgtcgagcgctaccgcggcatggacatcgccgccgtcgccgggattgaggcgagagggtttatatttggcccggcgattgcactagccatcggtgccaagttcattccgttgcgtaagcctaagaaactcccaggtgaggtgatttctgagacctatgttctcgaatacggaactgattgtctggagatgcatgttggtgctatcgaaccccgtgagcgggttttgatcgtcgatgatctggttgcaactggtgggacactttgtgctgctataaatcttctggaacgtgctggagctgatgtcgttgagtgtgcttgtctcattgggctccctaaatttaaggatttttacaagctcaatgggaagccggtctatgtactggtggagtctctggaatatgaaaaataagaaacttgtgaccagggacgcatcgtggcttcatcctgcaggtgaacggtgatgatccacaagtctgcggcacattgctaaggctagctgctacgcgttagggagggagtgggggaggttagggagcggtacgtgaatggatgggtgttagtagtctttgtaggctgagtagtttcttcaagagtactgaagagcttccttgttctcgggaaaaatgatcgttagctgaaacgcgagtcctgtcgttcttccattgttattggttattaattattaattgtgtggttttgatttcttggcacgggcatgcgtcgtttgcagatggtgtgtgtttagccatggctg

SEQ ID NO: 4939 - DNA, 971 bp, Brachypodium distachyon
ttgagactcaagagaagagagaaaggaagaatgggtgaggaggccagttgcaacaccgtgatggaggtcaccaccaaggcaaaggagaacggccacgccgtgcccgtgcccgtgcccgtgccggacgatgatgccaaggccaaggctgcagacgccgtggcggcgccggcggagactacgaccgacccccgcctgcagggcatctccgacgccatccgcgtcgtcccgcacttccccaagcaaggcattatgttcaacgacatcacgacgctgctgctgcggcccggggtgttcaaggacgccgtggacatcttcgttgagcgctaccgcggcatgggcatcgccgccgtcgccgggattgaagcgaggggatttatattcggaccggcgattgcattagccatcggtgccaaattcatacccttgcgtaagcctaagaaactcccaggcgaggtgatttccgagacctatgttcttgagtacgggactgattgtttggagatgcatgtcggggccatcgaacacggtgagcgtgtcttgatcgtggatgacttggttgcaacgggtgggacgctttgtgctgctataaatcttcttgaacgtgctggagctgatgtcattgaatgtgcttgtctcattgggctccctaaatttaaggatttctacaagctcaacggaaagccggtctatgtactcgtggagtccctcgaataggaaaaataagaaatcgacggccaggaatgcaacatggctgcaagtgaacggtgggcggatgtcgacgaagcctgcggtacattattaaggcgtattagctgctgtcttagagagagagtggggggaggctagagagtgagtggtactacgtgaatggatcgatgtagtcttcgtaggctgagtagtttttccgagagtacttgaagagcttgttgttctcgggaaaatgatatcattggacgaaaacgcgagttctg

SEQ ID NO: 4940 - DNA, 3067 bp, Zea mays
gggaagaaggaagtataaagcaatgatgcggcaccgacgcagacgagagtggcacaaaaacatgacacatcacactggtttatgtgcaatttctaattttgtcattctcaattttgggtttccgttattataccatcctgtgtttatgactggtggaactatctgtgtctataatttctgaattcaataacatattaacgaaacctataaattataatggcgaaattgccaatggctcggctcgtctcacctgtcacgaagaacgcgcgcgcgcatacagtttttgaagagccacttaccccggtcccagaggccagagcacgtccgtgctctcgcgttcccgcgcgaagccgaaaaccctttggcgctctgcgcgcgatcgcgcccctcccctccacgcccccgcccgcccttttcttccccacccgtctccgttccccgccatccacatccgacattcctcccccaagttctctcccatccccaaagtatcatccaatttccctccccgctagccacaatgccgactcttcgcagcgcgacggcgaacgcgtcccccgtggccaccccatcccctgccgcggcgagcacgccgcgcagcgtcaagcgccggctgacgccaggccgcgccggcgagtcgcccaaagcgtcgcggcacacctcccctcaccgatcccctcacgccggcaccggaactgtatgcattccgaagctgctctcggcgtcgcccaagtcctccaggaagcgtctctacggcgaccttgtcgcagccgagaagcccaagtggaatccccgagatgccgcgcagattagggctgtcaaggaggcgctgcacgtggcaacagtgccatcgtctgaattggtttgccgggataacgagctcaggcgtgtccttgagttctgcaaggtgtgcgtccaacaggagaaggctggtagtctctatgtctgcgggtgccctggcacagggaagacattatctattaacaaggtcaaggatagcttggtgtgttgggcagatgagatgggaatggagacacctgatgccttagcaatcaattgtacaaacctagcaaacacctcagagatttttggcaagatactaggcaaattgcagaaccaaaagaagggaagcagcaaattgttgccacttcagcaacttcagagcatgttttccaacaaggatttagctccaagaagaatgatgttggttattgtggatgagatggactacttaataacaagagaccgtgctgtgctacatgaccttttcatgcttacgacttatccattctctagatgcatactaataggaattgctaatgccatagatttagcagaccggtttcttccaaagcttgaatccttaaattgcaagcctcttgttgtgacttttcgagcatattccaaagatcaaataactgacatagttaagcataggctaaaggttcttgagtatgatgtatttgaaccactagctctggagttctgtgctagaaaagtggcggcagcctctggtgacatgagaaaagctctaggcgtatgcaggagtgctgtggaggttcttgaagcaaggctacatgattcgcctgatcaagaattaggaatagtgacatttgaccatatggatatggctttgtcaaaagcattcaagtctgctgtcgtagatagcatactgtgtcttccccagcaccaacagatggtgctgtgtgcgttggcaaatacttttcagcattgcaagaaaaaagcaactactctaggagagctcaacaaatcatacattgagatttgtagatcaacccaagttccagcagttggaatgcttgaattttctaacatgtgtatggttttgagcgatcaggggttcatgaaactagggcagtccaaggaagataagcttaggagagtaacacttcagattgatagttcagatatcacatttgcttttaagggaaatcgcttctttcaaaaatgtctggagcagccaagatgctaactagacccatagcagagagtagatcaatacacttactgttgtaatacattacagtattagtttattgacattatcaagtaccagcaatttcaacccctggatgtgctgctcaggtggtttcattcaacatggtcaaacgtaccttggttacatcatgaagctctttcttgcagtgcagggataagtacgtgggacgagttatgatagtattatgtgacacaattctcccaaagatggctgagtgttgttatgatttctcaatttttggttcttccagaactgattgatcatgtagctaaacatttaacatacaagaacatttgtttacacatttcttgcctaaaggctaaatcagtaatgagaagctgcactaatttaatgtgtctgccagatcaattgcatgcttctgatactttatacagtgacagtgacattgttgatgtaaatgcttccccccttatgtggaaatggcaatagggatgcttctcgaataaagatcaaaacaattgaacttacagcgacaatacatccactgaatgaactggttgctgtatctcgcaaatgactactttctgttgtacattgtaatttgtaattgttctctgcctttcatactactttcatcctttgtacttgcgaacgtagtcagttagatacgggttttgctgaggagtcaaacttgttctctctaactaccttttgcagtatcgagatgcgctgacaaaaattgttttgttgagataaagaaatgttttggttactccacaggctttgaaaaaggttgggccaaccccgagcttcgctgctggcttgattgggaatttgggaggatatgaatatggatggtctatggccatcaaatccgaagctcactttaggtcgtagggcagcacatctgaattctgtgcgatgaagcgttggaattttcctatttttatttaattcgcttttttgtaaaataattgtcacaaaacaaaacgcattgccaagtaaagtgtgggtattcaattttgctattcagttagtcgaaatttcccttcccgtcagtggtatgggcagaagtttgctttctac

SEQ ID NO: 4941 - DNA, 1966 bp, Setaria italica
ccacgagccctccccaattcgtcaattcccccacatcttccaagtaaccgccaatctcccgtccctccaagcagcaatgccgactctccgcagcgccacggcgagcgcgtcccccgccgccaccccctcccctgccgctgcgagcacgcctcgcagcgtcaagcgtcggctgacgccaggccgcgccggcgagtcgccgaaagcgtcgcggcacacttcccctcaccgatccccgcacgccggcgccggaacggcctgcacgccgaagctgctgtcggcgtcgcccaagtcctcgaggaagcggctctacggggaccttgtcgcggctgagaagcccaagtggaatccccgagatcccgcgcagatgagggctgtcaaggaggcgctgcacgtggcgacggtgccgtcgtgtgaattagtttgccgggacaatgagcagaggcgcgtgtttgagttctgtaaggcttgcatcgagcaggagaaggctgggagcctgtatatctgcgggtgccccggcacagggaagacactatctgttaacaaggtcaaggaaagcttggggcgttgggcagatgagatgggaatggagacacccgattcgctagcaatcaattgtacaaacctagcaaacacatccgagatttttagcaagatactgggacaatttcagaaccgtaagaagggaagcagcaaactgtcaccacttcagcaacttcagagcatgttttccaacgaggaatcagctccaagaagaatgatgttggtcatcgtggatgagatggactacttaataactagagacagggctgtgctacatgaccttttcatgcttacgacttgcccatattcaagatgcatactaataggaattgcgaatgccatagacctagcagatcggtttcttccaaagcttgaatccttaaattgcaaaccttttgctgtaactttccgtgcttattccaaggatcaaatttctgacataattaagcatagactaaaggttcttgagtatgatgtttttgaaccactggccctggagttttgtgctagaaaagttgcagcagccaccggtgacatgagaaaagctctaggtgtttgcaggagtgctgtggaggttcttgaaacaaggctacaagattctgatcaagaattaggaattgtgacatttgaccatatggatatagccttgtcaaaggcattcaagtcaccaatagtagatagcatactgtgtcttccccaacaccaacagatggtactgtgtgcactggcaaatactttccagcattgcaagaaaaaggctactactctaggagagctcaacaaatcatacattgaaatctgtagatcaacccaagtcccagcagttggaatgcttgaattttctaacatgtgcatggttttgagcgatcagggattcatgaagctagggcaatccaaggaagataagcttaggagagtaacccttcagattgacatttcagatattggttttgcatttaagggaaatcgtttctttcaaaaatgtctgaagcagccaagatgctagctagactcatggttaccaacaattacaaccctcgatgtgcaacactcaggtgcctgactgatacaagtatacaaccccatcattctagcccagtccttgacgtgctgaaggatgccagtgatagtcaagcaggctgcaccgtatgcctttggtcatacactcagcaactgcagtttactgcattcagcgagctgtcctcgtttgaaattatgagaaaactctttcttggaattcggagagaagtgtacatgtgatgagttatgatagtattatctgacacaattctttcgaaagatagttgactgtagtttttatttctccattttttgttcttccaaaaccgattgatgatgtaactaaccattagcaaatgaataacatttattggtacattgttgaaaattgaattcaataatgaga

SEQ ID NO: 4942 - DNA, 2308 bp, Panicum virgatum
gtgctggagcgtggactccctggagatctctactatcctacacgcatctgctcacgcagccgcttagctcccaagctcccgtgtatacgcgcgcatacaaattttgaagaagcacgcgcacggcgcacctaccccggtcccagacggcagagccgcaccccacgttcgtgctctcgcgttcccgcgcgaagccgaaaaccctttcgcgctctgcgcgcggtcgcgcccctccccgccccgcccttttattccccgccatccgcatccacgattccccccccccccaattccaccacatcatcttaagtaaccgcaattttcccgccccgccaagcacaatgccgactctccgcagcgccacggcgagctcgtcccctgccgccaccccgtcccctggcaccgcgagcacgccgcgcagcgtcaagcgccggctgacgccaggccgtgccgggaagtcgccggacgcgtcgcggcacacttcccctcaccgatccccgcacgccggcgccggaacagtctgctcgccgaagctgttatcggcgtcccccaagtcctctaggaagcggctctacggcgaccttgtcgcggctgagaagcccaagtggaatccccgagatcccgcgcagatgagagctatcaaggaggcgctgcacgtggcaacggtgccgtcgtgcgaattggtttgccgggacaatgagcagaggcgcgtgtttgagttctgtaagtcctgcgtcgagcaggagaaggctgggagcctgtatatctgcgggtgccccggcacggggaagaccttatctattaacaaggtcaaggagagcttaatgcgctgggctgatgagatgggaatggaggcacccgactcgctagcaatcaattgtacaaacctgtcaaacacatccgagatttttagcaagatactgggacaatttcagaaccgtaagaagggaagcaacaaactgtcaccacttcagcaacttcagagcatgttttccaacaaggaatcagctccaagaagaatgatgttggtcattgtggatgagatggactacttaataactagagaccgggctgtgttacatgatcttttcatgcttacaacttgcccatattctagatgcatactaataggaattgcgaatgccatagaccttgcagatcggtttcttccaaagcttgaatccttaaactgcaaacctcttgttgtaactttccgtgcttattccaaggatcaaatatctgacattattaagcatagactaaaggttcttgagtacgatgtttttgaaccactggctctagagttttgtgctagaaaagtcgcagcagccactggtgacatgagaaaagctctaggtgtttgcaggagtgccgtggaggttcttgaagcaagactacaagattctgatcaagaattaggaatagtgacattcgaccatatggatatagccttgtcaaaggcattcaagtcgccaatagtagataccataatgtgtcttccccaacaccaacagatggtactgtgtgcattggcaaatactttccagcattgcaagaaaaaggctactactctaggagagcttaacaaatcgtacattggaatctgtagatcaacccaagtcccagcagttggaatgcttgaattttctaacatgtgcatggttttgagtgatcagggattcatgaagctgggacaatccaaggaagataagcttaggagagtaacacttcagattgacatttcagatataggttttgcatttaagggaaatcgtttctttcaaaaatgtctggagcagccaagatgctagcaagacagacttaccaaaaataccaccctggacgcccaatgctcaggtgactgactgatacaatcccattatgctagctcaggctgagtccttgacgtgctgaaggatgccagtgatagtcaagcaggccgcaccgtctgtattttgtcatgcattcagcaaactgcagtttagtgcttcttcctcttaatggattacttataattcagggagcttcactcagttcaggccgccttcgatctacaggatcaaaacttgttgaaatatgataaactctttcttggagtgcggagagaagtgtacatgtgatgagttattacagtaaaacctgacacaattattacaaaagatagttgactgtagttttgatttctccacttttggttcttgcagaaccgattatgtagctaatcactagtataggaacaacatttgttgtcacatttcttgctgaaaattgaaatcgataatcagaagatgggattatgcgatgtctttgg

SEQ ID NO: 4943 - DNA, 1627 bp, Panicum virgatum
cgattcccccacatctgccaagtaagtaacagcagatttcccgtcccgtcccctcaggcagcgatgccgaccctccgcagcgccacggcgggcgcgtcccccgcggcggccagcacgccgcgcagcgtcaagcgccggctgacgtcgccggacgcgccgcggcacacctcccctcaccgatccccgcacgccggcgccggaacggtctgcacgccgaagctgctgtcgacgtcgcccaagtcctccaggaagcggctctacggcgaccttgtcgcggccgagaagcccaagtggcatccccgagatcccgcgcagatgagggctgtcaaggaggcgctgcacgtggcaacggtgccgtcgtgtgaattggtttgccgggacaatgagcagaggcgcgtgtttgagttctgcaaggcgtgcgtccagcaggcgaaggctgggagcctgtatgtctgcgggtgccccggcacagggaagaccttatccattaacaaggttaaggagagcttggtgtgttgggcagatgagctgggaatggagacacctgactcactagcaatcaattgcacaaacctagcaaacacatccgagatttttagcaagatactaggacaatttcagaaccgtaagaaggtaaccagcaaattgtcaccacttcagcaactccagagcatgttttccaacaaggaatccgctccaagaagaatgatgttggtcattgtggatgagatggactacttaataacaagagatcgggctgtgctacatgatcttttcatgcttatgacttgcccatattcaagatgcatactaataggaattgcgaatgccatagacctagcagatcgctttcttccaaagcttgaatccttaaattgcaaacctcttgttgtaactttccgtgcttattgcaaggatcaaatatgtgacataattaagcatagactaaaggttctagagtacgatgtttttgaaccactggccctggagttttgtgctagaaaagtcgcagcagccactggtgacatgagaaaggctctaggtgtctgcaggagtgctgtggaggttcttgaagccaggctacaagattcttctgatcaagaattaggaatagtgacatttgaccatatggatatagccttgtcaaaggcattcaagtcagcagtagtagatagcatattgcctcttccacaacaacaacagatggtactgtgtgcattggcaaatactttccaacattgcaagagaaaggctattactctaggagagctcaacaaatcatacatcgaaatctgtagatcaacccaagtcccagcagttggaatgcttgaattttctaacatgtgcatgattttgagtgatcagggattcatgaagttagggcaatccaaggaagataagcttaggagagtgacacttcagattgacatttcagatattggttttgcgtttaagggaaatcgtttctttcaaaaatgcctggagcagccaagatgctagctagactcaattacaccatgaagccaattgtggctatacattttttgtgtaccaacaattacaaccctggatgcgcaaacgctcggtgactgactgatacaatcccatcacgccagctcagttctta

SEQ ID NO: 4944 - DNA, 2153 bp, Brachypodium distachyon
gcctaccgaagccgcaggcgcacgttcttacgctgccgttcccgcgcgaagtcgaaaactctttggcgcgggcgcgctcaggcgcctctcccgcgcgcccgcgccctttacatcccgccccttcttccctcctctcaaccccactcgcttcttccccaattccctcccaatctcactcacctccaaattccacagccaattcgcacggctcgccatgccgacgcttcgcagcgccacgtcgagcccggtcaaggcggccaccgtctccccgactgcggtcaccaccccgcgcagcgccaagcgccgcctgacttctcgccgtgccgccgagtcgcccgattcgccccagttcacctcccccggcatctccccgctcgccggcttcggcaccatttgcaccccaaagatgctttcggcgtcgccaaagtcctcccggaagcgtctgtacggcgacctcgtcgcggccgagaagcccaagtggaatccgcgagatccggcgcagatgcaggcggtcaaggaggcgctgcacgtgggcacggtgccctcgtgcggcttggtttgccgggacgacgagcaaatgcgcgtgttcgatttttgcaaggcgtgtgtcgaacaggagagggcagggagcctctatgtatgcgggtgccccggtacagggaagactctgtcaattaacaaagtcaaggagagcgtgtcgtgctgggctgataagatgggaatagagacgcctgatgatttgtcaatcaattgcacaagccttggaaaaacatctgacatttttattaagatacttgaaaaactccacgttcgaaagaaggcaagtggcaaattgtcgccacttcagcaactgcagcggatgttttcccacaaagaatctgctccaagaaggatgttattggtcattgtggatgagatggactacttaataacaagagaccgggctgtgctacatgaccttttcatgcttacgacccaacagttctcaagatgcatactcataggaattgcgaatgccattgacctagcggatcggtttcttccaaagcttgaatccttgaactgcaagccgcttgttgtaactttccgtgcttattccaaggatcaaatatccaacataattaatcataggttaaaggttcttgagtataatgtttttgaaccactggccttagaattttgtgctaggaaagtagctgcagcctctggagacatgaggaaagctcttggtgtttgcaggagtgctgtggaaatatttgaatcaaaactacaagattcttctgatcaagaatttggagttgtaacatttgaccatatggatattgccttgtcaaaggtattcaagtcaccagtagtcgatagcatactttgtcttccacaacaccaacagatggtgttgtgtgcattggcaaatacctttcaacattgcaagaaaaaggttacaactctaggcgagctcaacaaatcatacatagaaatttgcagatcaacccaagttccaggaattgggatgcttgaattttctaacatgtgcatgattctgagtgatcagggatacttgaagctagggcaatccaaggaagataagctcaggagagtaacacttcagattgacatttcagatatcacttttgcatttaagggtaaccgattctttcagaagtgcctggaacaaccgaaattttagcgataacaccatgctgccttgctatgtgtatacattatctctttatagtcatgtactagtacaaatgtatcaaaccgaggttgcccaaaaatctcaggggcttgcattgttgtaccatgccgtggtaaattaccaggatcgttgatttatgaagaaactctttagcaccgagagtgtacatttgagatgagtttttgtagttctcacacattttttccaaaggatagtggtttgtgattcatctttctttcttccgttgcaattgatcatgaagtagccattgatctacccacaagttttttagctgagagaagtaatgctgagctgggtcattttgtagtgtctgagttttcaaagcaaccgtatactagtgatatctaattcagacctctttttccttgaggctgttacggaaaacatattttttgttgatgacaatgaatccttactgttcgctgattaaaaa

SEQ ID NO: 4945 - DNA, 5295 bp, Oryza sativa
ctctccccctccccgatcggctcagccatcccccatcccccctcccaccgccggccgcctccccgcacgacgcggcctctccccctcccctcaccggcgccgactctcccttcacccctccagcggcgccgcttcccttcccctcccttctccactccggcggcgccactccctctccccctctccctcctgtctcgctggcaaggcgcggcgacagcggggtacggcggtgataacgcacgatccggcgacgtcgacggcgacgacgatgtcgtcagcctccgcgggtggatctgtcggtggtggcggctaccgcttgcggatctggcagcgacagctccctccgtcgcctctcttcttcctctggcgacggtggtggcgtcggcggtggtcgtggatgaatccggcagtagtggcgacggccgaggggatccgacgacgccccgtggtcggattcggtggcgacgacggcgttggtggcttctcggtgatgtttttatttttcttccctttttttttctcaatcgcttgttgtccgattgaattttgtatgaattttttttttgctttttttttgccttattatgatgcaaccggatttgattttttttcaccttttttttttttttgccctttttcacggacggacgacggaaacaccttttaatttttagacgatggaaacaccttttaattttttaaatagtagagatgtagttgacagagttgccaggcctataaaaacacgattccaactggcccaacggtcttccctagccaactggcccacggcccacggcccactagcagcacatctgatgctcatctttgtaacctaggtcacatagccaacttgacagttgacactcgggcccgcgagcccccgactcgcccgccgccggccgccaggccgatgtccgacgacgctccagcctcctgcgctcctcacctcctgttcgtgcttgcttgacgtcgacgctggcctggcctcgctcggtcctgaccgagcctcgaggagacgtcgccgccgaccgccggggctgacctctcctccgattgcccgacgcccgctccagcgctcctactccatctccggcctccgactcccagccacaggggcgcaggcggctgatccccaggctgctatccgcggcggcggcggcgcgtgcggcacaactcgccatttcgaagggagtagccgctctttgatgagcgggcgaatgggtacagcaatcagtcctggaagcattggcaacagtacgcagctatggttgctgtaatcagagaagtcaagcacgcatgcatgagcagaaaatggaagagacgaagctagagggtttgggactgattccagaatcatcggccaattcaatttcagtagcttgtgctttagaaatcttccgttgtgaagacattagatgacttgtctctggtagttggagcatgtggttgtgttcaatagataaatcatgcaaggtgtaaagaccagaatccctatctaaggtaattcccattcgggcatcacaacctgttcttgtctcagctcggggaagttttgtcaagtgatctctcttgtcctgtgctcggtagccctgattggaacatacaaatctacatgatgtaactaccttgtcaattttacttgtgttctcatacttcttcctagcattgaatcctacttgacctccatagaatacccaaaagttccaagcctcatcagcacaactaaaattcatgcctattcgaggtatccaagaaggtgtgttatttgtgctgcaaaacatggcatcgcttcttattttaccaaacatgattaatgtaagatatgaaatgaaatggtcggactggatttagatggtacatatggaactatgaatcagatcctgatatggcactcacaagtttgatgactcagaaggagcaggtttttcttgcagcgattgctttcgtactagcgtctgatctccctcaatctcattgcttcaatcaattgtaatattgttttaatcataggagaactaattatatgtattacagatgaagatgataatatgacttacttatttggagtctctgttgttgttggggtacctcgatcttcagaattatccagtgaagacatttctttaactcagatcttgcttgcatatactttggcctcttgaaactctcgatcaagagatggcatcagaccctttggagagaaaggtgaaaactgatttctataggtttctatcctctaaaatgaatgggtgaaattggcgccaagttatctgcttgccgcgcgccatttctctcgcgtcagaaggttgcaacgcctatattgccacaccagccgattggttagtgggctgaaatggacttgcaggcctggtatttggatccttctaaatcctaatcgtccaaagaaaaggaacgatcaggatttgccaacggcatggccgtgccgttatagttacgacggcagacgtgccgttatagttacgacggcagacgatgcgcttccgggggacccatacccgcgaagcattaagcggtccccaaaattttcaacgcgccctttcacactttcgtgtcgttcccgcgcgagggtgggaaaccctttggcgggcttggctctcgcgccactctccaccaccgcgccctttttcttgtcgcccacctctcgccccatcccccacaaacaattcctccccaatttccctcccaaatctctcccgcctccgatcccacagtctctctctctctctctctctctctctctcgatgccgacgcttcgcagcgccacagcgagcgcgtcaacggcgggcacggcctcgccgacggcaatcgccaccccacgaagcgccaagcggcgcctcacgagccctcgccgagccgcagggtcacccgacgcgtctcagttcacatccccccacaaatcccccaatgtcggaatcgttggcaccccgaagctgctctcggcgtcgcccaggtcatctaggaagcggctttacggcgacttcgtcgcggccgagaagcccaagtggaatcctcgaggcaagtctccagaatcccatttcagtagggctcagagttctgattgggatctgacgaaagaattcatctgttctgcagatcccgctcagatgcaggtggtcaaggaggcgcttcacgtggctacggtgccctcttgcggattggtctgccgagatgatgagcagagtcgcgtgcttgagttctgcaagggttgcgtggagcaggagcgttcagggagcctgtatgtgtgcgggtgccctggtacagggaagaccttgtcgattaacaaggttaaggagagcgtggcgcgttgggcagacgagaccggaatggagacacctgatgccttatcgatcaattgtacaagcctagcaaagacgcatgaaatttttagtaagatacttgcgaagtttcagactcggaagaaggcaacctgcaaactgtcaccacttcagcaacttcaaaccatgttttcccacaaggaatcagccccaagaaggatgttgttggtcgttgtggatgagatggactacttaataacaagagaccgggctgtgctacatgatcttttcatgcttacgacttaccaattctcaagatgcatactgataggtattgcaaatgctatagacctagcggatcggtttcttccaaagcttgagtccttaaattgcaaaccacttgttgtgactttccgtgcttattccaaggatcaaatatctgacataattaagcataggctgaaggttctcgagtatgatgtttttgaaccactggcccttgaattttgtgctaggaaagtcgctgcagcctctggagacatgagaaaagctcttggtgtttgcaggagcgctgtagaggtttttgaagcaaggttacaagagtcttctgatcaagaatttggacttgtgacatttgaccacatggacattgctttgtcaaaggctttcaagtcacctgtagtagatagcattctctgtcttccccaacatcagcagatggtattgtgtgcattggcaaatacttttcatcattgcaagaaaaaggcaacgactctaggagagctcaataaatcatacatagaaatttgtagatcaacccaagtcccagcagttggaatgcttgaattttcaaacatgtgcatggttttgagtgatcagggattcatgaagcttgggcaatccaaagaagataagctcaggagagtgatgcttcaaattgacagttcagatatcacttttgcatttaagggtaaccggttctttcagaaatgtttggagcaacaaaaattttagttagtcactcaattcagcaacgacgtctatacacagtttgcattgtatcttataccaagtgccagcaaatcaaaagcaataatgcccaaaagttcaggattttgcattctattggatcaaaccaacgtaaattttgaccccgtcctcaatgtttatcaatatttatgatttatggcgaaaccctttgctgagaaaactgtacatgcgggatgagttatgattgtttttcttacagttcttctgaaagattcctaactgtatttgtaattctaaaaggtagttgattgtagttctgatttttccccctagtcttattttccttcaacacagtctacattgattatgatttaatccattgacataaaagataatttatgacggttgagatctgtaatgcagacctctctctctctctctctcttttactttaccaaaggttatgtataatttcactttatttataatcaagctacaaggctcgaagcactttatttgttctgtatgcagttttatctcagacctggaaaaaataattctgttacttaggctggctatataaatgggcctggaagtgctattgacaattgggcttctgtgggctctttcttgggcacattttcttctctccttttccctgcaaaaactataggttggcttacctgggcaaggaggttgcaaggatatgcacacatttgtatcggaccgagttaaaatgcacctatgtttttcttcgacagtgacggatcgagtagatactagccaagtacccatgtgttgcaacatattattaaaaataaattatgttgtgcatgtcatttaaaattcaatataactctaaaaagttgagttttttttcatcgagatgaaataaagcaatagatgacacctcgtgtgttgtttctgagcaactataaacattaaaaattggatttcgttgctatttcagaaggaaattatgtcatgctaataatagtaataagc

SEQ ID NO: 4946 - DNA, 1653 bp, Zea mays
gttcctgtcccgaggcgggaaactacacatcggagctttcgcggggaggcggcggcggatccgcgctcggttcgccttgccttgccgacgccgccgacgtgccatgggaatcaagggcttgacgaagctgctggcgcagcacgcaccgacagccgcggtgcagcggcgggtggaggactaccgcggccgcgtcatcgccgtagacgccagcgtcagcatctaccagttcctcgccgtggttggaaggaaaggatcagagcttctgaccaatgaggctggtgaaatcacaagtcatctgcagggtatgttgaaccggacgataagaatgctagaagcagggataaagcccgtgtttgtgtttgatggcgagccacctgaaatgaagaaaaaggagcttgcaaaaaggtccttgaagagggatgatgctattaaagatcttaatagagctatggagattggggatgagaatgcaattgaaaaatttagtaaaaggactgtcaaggttacaggaaggcataatgatgactgcaagaggctgttaaggttgatgggtgtccctgtagttgaggcaccaggtgaggctgaagcacagtgtgcagcactttgtgaaaatcaccaggtttatgctgtagcttcagaggacatggacacactgacttttggtgcccgaaggtttcttcgtcacttaactgaccttggttataagaaatctcctgtgacagaatttgatgtgtcaaaggttttggaagaacttggactcacgatggatcagttcattgacttgtgtatccttagtggatgtgattactgtgagaatattagaggtatcggaggacaaagagccttgaaactcattcgtcagcatggttgcatagaagaagttctgcaaaatctgaaccagacgagattcagtgttccagaagactggccttaccaggaagttcggacattgtttaaggaacctaatgtttgtgcaggaattccagatttcacgtggacctcaccagatccagagggccttatggatttcttgtcaacagaaaacagtttcagtcctgatagagtaacaaaggcagtagaaaagataaaggttgctagggataggtattccccaggcagaatgaagcatttaacaccagttgctagcttacgaggatctcatactgagaaggaaccccagtgcatactaggttctccaggacaaactctgaaggtcatgtcatctccacaagtatgcaagagtccaagctctggtttcagatatggtagctcaaagccatttatgctgggcagacagtcaggatttcatggaatgccttatgctctctcttttatctaaaatctgtagctgctctggtttatgagaaggttgaccgaagctgtagctgcggctacatttttagatgatggaaaccgatatccggctttcacctcactgggaggatatggccaagtagctgtagctgcagctacatgaaaggatgctcacttataatatgttaatctcgtgctactattgtaatctttccatttctattgtaacgtagttaatcagctactgcagttcatcgttgacatctaatgctggttgctgctacaccggttgaccttaccttttgtcaatatattctgagttttcgggatggtgttttt

SEQ ID NO: 4947 - DNA, 1584 bp, Setaria italica
ccgaggcgggaaactacgagtggggattcgccgccgcctggctgcgctttggtgctccaccgtcgatccgtcgccgccggtcactgccgccaccgcaaccgccaccatgggaatcaagggcttgacgaagctgctggcggagcacgcgccgagggccgcggtgcagcggcgggtggaggactaccgcggccgcgtaatctctgtcgacgcaagcctcagcatctaccagttccttattgtggttggaaggaaaggatcagagcttctgaccaatgaggctggtgaagtcacgagtcatctgcagggtatgttgaaccggacagtaagaatgctagaagcagggataaagcctgtttttgtttttgatggagagccacctgaaatgaagaaaaaggagcttgcaaaaaggtccttaaagaggaatgatgctaccaaagatcttaatagagctatggagatcggagatgaggattcaattgaaaaatttagcaaaaggactgtcaaggtcacaaaaaagcacaatgatgattgtaagaagctgttaagattgatgggtgtccctgtagttgaggcaccaggtgaagctgaagcacagtgtgcagcactttgtgaaactcaccaggtctatgctgtagcttcagaggacatggactcactgacttttggtgctcgaaggtttcttcgtcacttaactgaccttggttataagaaatctcctgtgacagaatttgaagtgtcaaaggttttggaagaacttggactcacgatggatcaattcattgacttgtgcatccttagtggatgcgattactgtgagaatattaaaggtattgggggacaaagagccttgaaactcattcggcagcatggttgcatagaagaagttctgcaaaatcttaaacagacgagattcagtgttccagaagactggccttaccaggaagttcggaccttgtttaaggaacctaatgtttgtacaggaattccagatttcatgtggacctcacctgactcaaagggcctcatggatttcttgtcaactgaaaacagtttcagtcctgatagggtagcaaaggcggtagaaaagattaaggctgcaagggatagatattccccaggaagattgaagcttttgacaccagttgctagcttaccgggatctcacacggagaaggaacccacatgcacactaggttctacaggacaaagtctgaaggtcaggtctgctcaagtgtgcaagagttcaggccctggtttcagatacggtagctcaaagccatttatgctgggcatgcaatcaggatttcatggaagaccttgtgctttctcttttatctaaatatgtacctgctctggtttacaagacctggctggttgaagctgtaactgcagctacatgaaggatgcttacttaaaattgttaatctgatcctactattctaatcttttccttttgtattgtaacctagctagtgaactgctgcagttcatcttctcacatctaatgatgattaccgctacaccacttgatctttccttgctggtcttcaaggatttgaacgttatatcctgagatgttaagag

SEQ ID NO: 4948 - DNA, 1673 bp, Panicum virgatum
ggcttgacgaagctgctggcggagcacgcttcgagggccgcggtgcagcggagggtggaggactaccgcggccgcgtcatcgccgtcgacgccagcctcagcatctaccagttcctcattgtggttggaaggaaagggtcagagcttctgaccaatgagtctagtgaagtcacgaggcaagaaatatcgcttgccctgtttatggtctgtcatctgcagggtatgttgaaccggacagtaagaatgctagaagcagggataaagcctgtttttgtttttgatggcgagccacctgaaatgaagaaaaaggagcttgcaaaaaggtccttaaagaggaatgatgctacaaaagatcttaatagagctattgagattggggatgaggatttagttgaaaaatttagcaaaagaactgtcaaggtcacaaaaaagcacaatgatgattgtaagaggctgttaagattgatgggtgtccctgtagttgaggcaccaggtgaggctgaagcacagtgtgcagctctttgtgaaaatcaccaggtctatgctgtagcttcagaggacatggactctctgacttttggtgctcgaaggtttcttcgtcacttaactgaccttggttataagaaatctcctgtgacagaatttgaagtgtcaaaggttttggaggaacttggactctcaatggatcagttcattgacttgtgtatccttagtggatgtgattactgcgagaatattaaaggtattgggggacaaagagccctgaaactcattcgacagcatggttgcattgaagaagttgtgcaaaatcttaaacagacgagattcaatgttccagaagactggccttaccaggaagttcggacattgtttaaagaacctaatgtttgtacagaaattccagatttcatgtggacctcgcctgactcacagggccttatggatttcttgtcaactgaaaacagtttcagtcctgatagggtagcaaaggcggtagaaaagattactgttgcaagggataaatattccccaggaagattgaagcttttgacaccagtttctagcttaccgggatcttatactgagaaggaacccacatgcatactaggctctccaggacaaggtctgaagatcaggtctgccccacaagtgtgcaatagttcaagttctggcctcagatatgctagctcaaaaccatttatgctgggcatgcaatcaggattccatggaagaccttatgctttctcttccctctaaatatctagctgctctggtttacaagagctgattggttgaagctgtaactgcagctcatgaaggatggatgctcacttaaaatatgttaatcgcatggtactattgtaatctttccttttgtactgtaacctagctagtgaactgctgcagttcttctcaaatctaatgctgattgctgctacaccacttgatctttcctttctgcccttcaagtatttgaccaccttttggttatatcctgagatattggtaaaggtgtttcttccagcccatggtgagaggagaaacattcagaagttgcttgactttaaagtgattgcgttgtatgaattgtgtaattatttcattatccaaacttattcaaattgtaaattattattttttatgatccgtagaggatgcacagtagtatgaaa

SEQ ID NO: 4949 - DNA, 1697 bp, Brachypodium distachyon
ccgaggcgggaaaaatctcgtacagtacaaggagtgagcggcggcgggagcggagacagacggaggctgcccgcgccgcgcttggacgctcgccgcacggcccgccgccgacgacatgggcatcaagggtttgacgaagctgctggcggagcacgcgccgagggcggcggcgcagcggcgggtggaggactacaggggccgcgtcatcgccatcgacgccagcctcagcatctaccagttcctggttgtggtaggaaggaaaggaacagaagttctgaccaatgaggctggtgaagtcacaagtcatttgcagggcatgttgaaccgtactgtaagattgttagaagcaggaataaaacctgtatttgtatttgatggcgagccacctgatctgaagaaaagggaactggccaaaaggtccttgaggagggatgatgcttcagaagatcttaatagagctattgaggttggggatgaagattcaattgaaaaatttagcaaaaggactgtgaagatcacaaaaaaacacaacgatgactgtaagaagctgttaagactgatgggtgtccctgtagttgaggcaccaggtgaggcagaagcacagtgtgcgtcactttgtaaaaaccataaggcctatgctgttgcttcagaggatatggactcgctgacttttggttctctaagatttcttcgccacataactgaccttagttttaagagatcccctgtaacagaatttgaagtgccaaaggttttggaggaacttggactcacaatggatcagttcatagacttatgtatcctcagtgggtgtgactactgcgagaatattaaaggtattggggggcaaagagccttgaaactcatacgccagcatggttgcatagaagaagttgtgcaaaatcttaacaataggtttactgttccagaagattggccttaccaggaagttcggaccttgtttaaggaacctaatgtttgtacagaaattccagatttccagtggacctcagtagacaaagagggcattgtgaatttcttggcaatcgaaaacagtttcagttctgatcgagtagaaaaggcagtacaaaagataaaggctgctagggatagatattccccagggcgagtgaagcttttgacaccggtagctaacttatctggatccataacaaagaaggaacccgagtgtgttctaggttcttcaggacaaggtctgaagagctggtctgctcttcaagtatgcaggagctcaagctctgatttcagatatcgtagttattatagttcaaagccattagtgctgggaaggcaatcaggatttcatggaatacctcatgccttttctctcatctaaatctggagttattcttggctcccaagattggtgggtgatgatgtgatactgctatacgaagaatggtgatcatttgggatatgttaagcatatgctatgattgtaatttaggctcttgtcttgtaatctagcagatttattttacatctaatgctgcttcctgctggagtgtcccatgaagtatttgatcgccttttagctataatatgaagaagggtcaatgcatcccctttcatgagtgagctatgtcaatcatatactatctcacaatttccaaattctagttgcaatgatcttttcatggaacacacatgctcttgatattcaggaagttgagaag

SEQ ID NO: 4950 - DNA, 1645 bp, Secale cereale
aaagtctagtattatccacttccccggcggcgggaaaaaagtcttggacaagcagcggcgggagcggagacggtcggaggttgctcgccgccggccgccgccgacgcaatgggaatcaagggtttgacgaagctgctgtcggagcacgcgccgagggccgcggtgcagcggcgcgtggaggactaccggggccgcgtcatcgccatcgacgccagcctcagcatctaccagttcctggttgtggtaggaaggaaaggaacagaggttctgaccaatgaggccggtgaagtcacaagtcatctgcaaggcatgctgaaccggactgtaagattgcttgaagcaggaataaaacctgtgtttgtgtttgatggtgagccacctgacctgaagaaaaaggaactggccaaaaggtccttgaagagggatgatgcttccaaagatcttcatagagctattgagggtggagatgaagattcagttgaaaaatttagcaaaaggacagtgaagatcacaaaagaacacaacgatggctgtaagaggttgttaagattgatgggtgtccctatagttgaggcaccaggtgaggcagaagcacagtgcgcatcactttgtaagaaccataaggcatatgctgtcgcttcagaggatatggacacactgactttcggtgctccaaggtttcttcgccatgtaactgaccttagttttaagaaatctcctgtaacagagtttgaagtgccaaaggttttggaggaacttggactcacaatggatcagttcatcgacttatgtatccttagtggatgtgactactgcgagaatattaaaggtattgggggacaaagagccttgaaactcatacgtcagcatggttgcatagaagaagttgtgcaaaatcttcacaagaggtacactgttccagaagattggccttaccaggaagttcgaaccttgtttaagcaacctaatgtttgtacagaaattccagatttccagtggacgtcagcagacaaagagggccttgtgaatttcctggcattcgaaaacagtttcagttctgatcgagtggaaaaggcagtagaaaagataaaggctgctagcgataaatattccccagcagggcgagcgaagcttttgacaccagtagctaacctatcaggatctacagagaaggaatccaagtgcgttttaggtgcttcaggacaaggtctgaggagcaggactgctgtacaagtatgcagtagctcaagctctggtttcagatatggtagttctagttcaaagccattggtgctgggaaggcaatcaggagttcatgtgaagcctcccaccttttctttcatctaaatctggagttgctttggttctcaagattacctagcgaagctgtgaccaagctacaggaagaatagatggccacttggaatatgtcaagtaaatgttttggttgtaatttaggcttgtcttgtaatctagaaaattagcttcaatgcttcaacttattcacatctaatgctgcttcctgctaggtcgcatggtgaccagcaagtatttggtcgccttttcgctataatatggaaatttgtcagtgcgccagtgttttcgctgacaaaatatacatataccccttgcattaccttgaact

SEQ ID NO: 4951 - DNA, 1651 bp, Triticum aestivum
gagccgtcgtcttcctcttgaaaaaaaagaaagaagagagaggcccaaaaatctattatccacttcaccggcggcgggaagagggtcttggacaagcagcggcgggagcggagacggtcggaggttgctcgccgccggccgccgccgacgcaatgggaatcaagggtttgacgaagctgctggcggaacacgcgccgagggccgcggtgaagcggcgcgtggaggactaccggggccgcgtcatcgccatcgacgccagcctcagcatctaccagttcctggttgtggtgggaaggaaaggaacagaagttctgaccaatgaggccggtgaagtcacaagtcatctgcaaggcatgttgaaccggactgtaagattgcttgaagcaggaataaaacctgtgtttgtgtttgatggtgagccacctgacctgaagaaaaaggaactggctaaaaggtctttgaagagggatgatgcttcgaaagatcttcatagtgctattgaggttggagatgaagattcagttgaaaaatttagcaaaaggactgtgaagatcacaaaagaacacaacgatggctgtaagaggctgttaagattgatgggtgtccctatagttgaggcaccaggtgaggcagaagcacagtgcgcatcactttgtaagaaccataaggcatatgctgtcgcttcagaggatatggacacactgactttcggtgctccaaggtttcttcgccatgtaactgaccttagttttaagaaatctcctgtaacagagtttgaagtgccaaaggttttggaggaacttggactcacaatggatcagttcatcgacttatgtatccttagtggatgtgactactgcgagaatattaaaggtattgggggacaaagagccttgaaactcatacgtcagcatggttgcatagaagaagttgtgcaaaatcttcacaagaggtacactgttccagaagattggccttaccaggaagttcgaaccttgtttaagcaacctaatgtttgtacagaaattccagatttccagtggacctcagcagacaaagagggccttgtgaatttcctggcatttgaaaacagtttcagttctgatcgagtggaaaaggcagtagaaaagataaaggctgctagcgataaatattccccagcagggcgagcgaagcttttgacaccagtagctaacctatcaggatctacagagaaggaatccaagtgcgttttaggtgcttcaggacaaggtctgaggagcaggactgctgtacaagtatgcagtagctcaagctctggtttcagatatggtagttctagttcaaagccattggtgctgggaaggcaatcaggagttcatgtgaagcctcccaccttttctttcatctaaatctggagttgctttggttctcaagattacctagcgaagctgtgaccaagctacaggaagaatagatggccacttggaatgtgtcaagtgaatgctatggttgtaatttaggcttgtcttgtaatctagaaaattagcttcaatgcttcaacttattcacatctaacgctgcttcctgctagagtgtcgcatggtgaccggcaagtatttggtcgccttttggctataatatggaaaattgtcagtgcgccagtgttttt

SEQ ID NO: 4952 - DNA, 4952 bp, Glycine max
cgaaagtgtttgcccgccactatcaatttacgaaagcctccccaaaaccctacattgccatctgttctcacacttctcagttttcagtttccttctctccattcctttcccccttctcttccgccaatttcaatttgcattattttgcgtttgtttatcgggaaagccgggaacgaaggagaaagagggcttcaatttcattccggaatgtcgtgggaagacgagattgtgatgcgcgatgtcacgaatgcgggccttgttatcagcgatcgcattggtcgtgaagtttcgtctcagctcgacctcgaagaagctctagaagcttccagatacgctagccacccttattccactcacccccgagagtggccccctttagttgaggtggtgaatacctgggagttgcctcccgtgctcattgaaagatacaatgcagctggtggggaaggaactgctttttgtggaatatttcctgaaatacgaagggcgtgggcgtctgtggacaattcattgtttctttggcgttttgataagtgggatggccaatgtcctgaatttagtggggaagagcaagctatttgtgcagttggtcttgcaaaatcaaaacctggagtttttgttgaagctattcaatatcttttagttttagcgacacctgttgagttaattttagtaggagtatgctgctctggaggagcagatggttcagatccatttgcagaagttacattgcagccattgccagagcatacaataccatctgatggggttacaatgacttgtgtggcatgtactaataagggccgcattttccttgctggtcgggatggccacatatatgagattctttattcaactggttctggatggcaaaaacggtgcagaaaaatctgcatcactgctggtttgggaagtgtaatttcaagatgggttataccaaatgtattcagttttggagctgttgaccccattgttgaaatggtttttgacaacgagagacaaatattgtatgcacgaacggaagagatgaagcttcaagtttatgttctaggaccaaacggtgatggccccttaaagaaagtagctgaagaaaggaatcttgtcaatcagagggatgcacattatggagctagacaatcgacagggtcaagagtctctagtcgatctccaaagccatctattgtttgcatctcacctttatctacacttgaatccaagtggctacatcttgttgctgttttatcagatggcagaaggatgtacctatctacctctccttctagtggaagcttgactgggttcaacaccaaccaccacaagcctagctgtttaaaggttgtcactacaaggcctgctcctccttggggtgttagtggtggtctcacctttggagccatggctcttgctggtagacctccgaatgaggatctctccctgaaagttgaggcagcttattattctgctggaactcttatcctttctgatgcatcaccttcgaccatgtcttcactccttgttttgaacagggattcaagctcacaatcatcaccgtcgggtaatctaggaacaagtacgagaagttcccgggcattaagggagtcggtatcttctttaccagttgaaggacgaatgctttctgtggcagatgttttacctttgccagataccgcagctactgtgcagtctctatattcggaaattgagtttggtggttatgagagctctatggaatcatgtgaaagggtgtctggcaaactctgggcaagaggggatcttgcaacccaacatatactaccaagaagaaggattgtcgtcttcagcaccatgggcatgatggaaattgtttttaacaggccactggacattataaggcggctattggaatccaactctccacgatcagttttagaagatttcttcaatcgttttggtgcaggtgaggcagctgcaatgtgtctaatgttagctgcaagaatagtgcattctgaaaaccttatcagcaatgttattgctgagaaggcagctgaagcttttgaggacccaagagttgttggcatgccacaacttgaaggtagtaatgcattatcaaacacaagaagtgctgctggtggatttagcatgggccaggttgttcaggaggctgagcctgtattttcaggtgcacatgaagggctctgtttgtgttcatctagattactttttcctctgtgggaacttcctgtaatggttgtaaagggaagtttaggcccttcaggcactctatctgaaaatggagtagttgtgtgcagactctctgttggggctatgcaagtccttgaacagaaactccgatctttggagaaattcttaagatctagaaggaaccagaggaggggactttatggctgtgtagcaggtttaggagatctgagtggttccattctgtatggtaatggttcggcattaggagccggggatcgaaacatggtaagaaacttatttggtgcgtattccagaaatatggagtccaatggtggcagaacatctaataaacggcaaaggttgccatatagtcctgctgaattagctgccatggaggtgagggcaatggagtgcattaggcagttgctccttagatctggtgaagccctatttttgcttcaacttctttcacagcatcacgtgactcgattgattcagggatttgattctaaccttcaacaagcattagttcagttgacatttcatcaactagtttgttctgaggagggtgaccatcttgctacaagacttatatctgttctcatggagtattatactggtcctgatggcaggggcactgtagatgacattagtaggagattgagagatggttgtccaagctactataaggagtctgattacaaattctttttagccgtggaagccctagagagagctgctatgactatagatgctaaggacaaggagaatcttgcaagggaagcatttaattccttaagtaaagttccagagtctgtggacctacgaactgtttgcaaacgttttgaggatttaagattttatgaagctgttgtgcgcttaccactacaaaaggcacaggctattgaccctgcaggcgatgcttataatgatgaaattgatgcaactgtcagagagcaagcacttgctcagcgggggcagtgttatgaaataattatcggtgctttgcggtctctgaaaggtgacaccttacagagagaatttgggactcctattagatcaactgcttcacaatctgctcttgatccagcctctcggaaaaaatatatatgtcaaattgttcagctgggtgtccaatcacctgacagaattttccacgagtatctttaccaggctatgattgatttaggtctcgagaatgaattgctagagtatgggggtcctgacctgttgccatttttgcaaagtgccggtcgtaattctctacacgaggttcgtgctgtgacagccacaatttctccagtgggacaatcgggagcacctatgtcatctaatcaagtcaagtactatgaacttttggcacggtattatgttttgaaacgccaacatatgcttgcagctcatgcgttgcttagactagctgaaaggcgttctattgatggagttcctactcttgaactgaggtgtcaatacctaagtaatgcagttctacaggccaaaaatgcaactaatagtgatgggttagtaggttctggtcgaagttccattgacagtgggttcctagatttgcttgaagggaagcttgctgttcttcggttccagataaaaatcaaagaagaactagagtctgtggcttccaggtctgatgttttacctgccacaccagattctgctgaaaatggtgtagtgcctgagggaagttctactgctgatgctaattttgcaaatgcaacacgagagaaggctaaagagctagcttcagatgtaaagagcataacccagttatataatgaatatgctgttccctttgggctctgggagatatgcctggagatgctgtactttgccaatttttccagtgatactgacagcagcattgtcagagagacatgggctagacttatagatcaagctatatcaagagggggtattgctgaagcttgctcagtactaaagagggtcgggccccgcatttatcctggtgatggagctgttttaccactcgacattatttgtcttcacttagagaaggctggactggagaggttaaattctggggttgaagctgttggagatgaagatgttgcaagagcccttgtttctgcttgtaagggtgcagctgaacctgtattgaatgcatatgaccaattgttatcaaatggggctattttgccatccgcaagtgttagattacgtatgctgagatcggttctagtggtacttcgagagtgggcaatgtctgtatattcacaaagaatgggtagcagtgccgctgggcattccctaatactaggtggaggattctcatcggaacgtactattgctagccaaggaattcgggacaagatcacaagtgcagcaaacaggtatatgactgaattgcggaggttagcccttccacagaaccaaacagaacatgtctaccgaggttttagagaacttgaagaatcgtttataagccaacattcatttgatcgattttgatgtttgttgcaatatatagtgttgtatcaattgttcttgtcatataaattattctcaaataagttgtttttaattttccatattggagctcatgtgattctcttactatgatctcgtgtatcaattagaaatatatagagcctaattttgaaagtctcgcggcctgctcaatgtatcggccaagttgtgataccaatcagttctctactggcgtcaggattcacttcataatccaaactccagatatgtcaagtagtaaaatatgtatgggttgcttttaagcatta

SEQ ID NO: 4953 - DNA, 5036 bp, Glycine max
attttgtagtggtcggaaaacgaaagtgtttgcccgccactatcaatttacgaaagcctccccaaaaccctacatcgccatctgttctcacacttctcagttttcagtttccttctctccattcctttcccccttctcttccgccaatttcaatttgcattattttgcgtttgtttatcgggaaagccgggaacgaaggagaaagagggcttcaatttcattccggaatgtcgtgggaagacgagattgtgatgcgcgatgtcacgaatgcgggccttgttatcagcgatcgcattggtcgtgaagtttcgtctcagctcgacctcgaagaagctctagaagcttccagatacgctagccacccttattccactcacccccgagagtggccccctttagttgaggtggtgaatacctgggagttgcctcccgtgctcattgaaagatacaatgcagctggtggggaaggaactgctttttgtggaatatttcctgaaatacgaagggcgtgggcgtctgtggacaattcattgtttctttggcgttttgataagtgggatggccaatgtcctgaatttagtggggaagagcaagctatttgtgcagttggtcttgcaaaatcaaaacctggagtttttgttgaagctattcaatatcttttagttttagcgacacctgttgagttaattttagtaggagtatgctgctctggaggagcagatggttcagatccatttgcagaagttacattgcagccattgccagagcatacaataccatctgatggggttacaatgacttgtgtggcatgtactaataagggccgcattttccttgctggtcgggatggccacatatatgagattctttattcaactggttctggatggcaaaaacggtgcagaaaaatctgcatcactgctggtttgggaagtgtaatttcaagatgggttataccaaatgtattcagttttggagctgttgaccccattgttgaaatggtttttgacaacgagagacaaatattgtatgcacgaacggaagagatgaagcttcaagtttatgttctaggaccaaacggtgatggccccttaaagaaagtagctgaagaaaggaatcttgtcaatcagagggatgcacattatggagctagacaatcgacagggtcaagagtctctagtcgatctccaaagccatctattgtttgcatctcacctttatctacacttgaatccaagtggctacatcttgttgctgttttatcagatggcagaaggatgtacctatctacctctccttctagtggaagcttgactgggttcaacaccaaccaccacaagcctagctgtttaaaggttgtcactacaaggcctgctcctccttggggtgttagtggtggtctcacctttggagccatggctcttgctggtagacctccgaatgaggatctctccctgaaagttgaggcagcttattattctgctggaactcttatcctttctgatgcatcaccttcgaccatgtcttcactccttgttttgaacagggattcaagctcacaatcatcaccgtcgggtaatctaggaacaagtacgagaagttcccgggcattaagggagtcggtatcttctttaccagttgaaggacgaatgctttctgtggcagatgttttacctttgccagataccgcagctactgtgcagtctctatattcggaaattgagtttggtggttatgagagctctatggaatcatgtgaaagggtgtctggcaaactctgggcaagaggggatcttgcaacccaacatatactaccaagaagaaggattgtcgtcttcagcaccatgggcatgatggaaattgtttttaacaggccactggacattataaggcggctattggaatccaactctccacgatcagttttagaagatttcttcaatcgttttggtgcaggtgaggcagctgcaatgtgtctaatgttagctgcaagaatagtgcattctgaaaaccttatcagcaatgttattgctgagaaggcagctgaagcttttgaggacccaagagttgttggcatgccacaacttgaaggtagtaatgcattatcaaacacaagaagtgctgctggtggatttagcatgggccaggttgttcaggaggctgagcctgtattttcaggtgcacatgaagggctctgtttgtgttcatctagattactttttcctctgtgggaacttcctgtaatggttgtaaagggaagtttaggcccttcaggcactctatctgaaaatggagtagttgtgtgcagactctctgttggggctatgcaagtccttgaacagaaactccgatctttggagaaattcttaagatctagaaggaaccagaggaggggactttatggctgtgtagcaggtttaggagatctgagtggttccattctgtatggtaatggttcggcattaggagccggggatcgaaacatggtaagaaacttatttggtgcgtattccagaaatatggagtccaatggtggcagaacatctaataaacggcaaaggttgccatatagtcctgctgaattagctgccatggaggtgagggcaatggagtgcattaggcagttgctccttagatctggtgaagccctatttttgcttcaacttctttcacagcatcacgtgactcgattgattcagggatttgattctaaccttcaacaagcattagttcagttgacatttcatcaactagtttgttctgaggagggtgaccatcttgctacaagacttatatctgttctcatggagtattatactggtcctgatggcaggggcactgtagatgacattagtaggagattgagagatggttgtccaagctactataaggagtctgattacaaattctttttagccgtggaagccctagagagagctgctatgactatagatgctaaggacaaggagaatcttgcaagggaagcatttaattccttaagtaaagttccagagtctgtggacctacgaactgtttgcaaacgttttgaggatttaagattttatgaagctgttgtgcgcttaccactacaaaaggcacaggctattgaccctgcaggcgatgcttataatgatgaaattgatgcaactgtcagagagcaagcacttgctcagcgggggcagtgttatgaaataattatcggtgctttgcggtctctgaaaggtgacaccttacagagagaatttgggactcctattagatcaactgcttcacaatctgctcttgatccagcctctcggaaaaaatatatatgtcaaattgttcagctgggtgtccaatcacctgacagaattttccacgagtatctttaccaggctatgattgatttaggtctcgagaatgaattgctagagtatgggggtcctgacctgttgccatttttgcaaagtgccggtcgtaattctctacacgaggttcgtgctgtgacagccacaatttctccagtgggacaatcgggagcacctatgtcatctaatcaagtcaagtactatgaacttttggcacggtattatgttttgaaacgccaacatatgcttgcagctcatgcgttgcttagactagctgaaaggcgttctattgatggagttcctactcttgaactgaggtgtcaatacctaagtaatgcagttctacaggccaaaaatgcaactaatagtgatgggttagtaggttctggtcgaagttccattgacagtgggttcctagatttgcttgaagggaagcttgctgttcttcggttccagataaaaatcaaagaagaactagagtctgtggcttccaggtctgatgttttacctgccacaccagattctgctgaaaatggtgtagtgcctgagggaagttctactgctgatgctaattttgcaaatgcaacacgagagaaggctaaagagctagcttcagatgtaaagagcataacccagttatataatgaatatgctgttccctttgggctctgggagatatgcctggagatgctgtactttgccaatttttccagtgatactgacagcagcattgtcagagagacatgggctagacttatagatcaagctatatcaagagggggtattgctgaagcttgctcagtactaaagagggtcgggccccgcatttatcctggtgatggagctgttttaccactcgacattatttgtcttcacttagagaaggctggactggagaggttaaattctggggttgaagctgttggagatgaagatgttgcaagagcccttgtttctgcttgtaagggtgcagctgaacctgtattgaatgcatatgaccaattgttatcaaatggggctattttgccatccgcaagtgttagattacgtatgctgagatcggttctagtggtacttcgagagtgggcaatgtctgtatattcacaaagaatgggtagcagtgccgctgggcattccctaatactaggtggaggattctcatcggaacgtactattgctagccaaggaattcgggacaagatcacaagtgcagcaaacaggtatatgactgaattgcggaggttagcccttccacagaaccaaacagaacatgtctaccgaggttttagagaacttgaagaatcgtttataagccaacattcatttgatcgattttgatgtttgttgcaatatatagtgttgtatcaattgttcttgtcatataaattattctcaaataagttgtttttaattttccatattggagctcatgtgattctcttactatgatctcgtgtatcaattagaaatatatagagcctaattttgaaagtctcgcggcctgctcaatgtatcggccaagttgtgataccaatcagttctctactggcgtcaggattcacttcataatccaaactccagatatgtcaagtagtaaaatatgtatgggttgcttttaagcattattttcatttcaattctgaagaatgtttaaacgcttcgtaagtccatatttcatggttgatatcg

SEQ ID NO: 4954 - DNA, 4894 bp, Cajanus cajan
ggatgtcgtgggaagacgagattgtgatgcgcgatgttaccaatgcgggccttgttgtcagcgatcgcattggtcgcgaagtttcgtctcagctcgacctcgaagaagctctagaagcttccagatacgctagccacccttactccactcacccccgagagtggcccccttcagttgaggtggtgaatacctgggagttgcctcctgtgctcattgaaagatataatgcagctggtggggaaggaactgctttttgtggaatatttcctgagataagaagggcgtgggcgtctgtcgacaattcattgtttctttggcgttttgataagtgggatggccaatgtcctgaatatagcggggaggagcaagctatttgtgctgttggtcttgcaaaatcaaaacctggcgtttttgttgaagctatccaatatcttttagttttagcgacacctgttgagttaattttagtaggagtatgctgctctggaggagcagatggttcagatccattctcagaagttacgttgcagccattgccagagcatacaataccatctgacggggttacaatgacttgtgtagcatgtactgataagggtcgcattttccttgctggtcgggatggccacatatatgaggttctctattcaactggttctggatggcaaaaacgctgcagaaaaatctgcattactgctggtttaggaagtgtgatttctagatgggttataccaaatgtattcaattttggagctgttgaccccattgttgaattggttttcgacaatgagagacaaatattgtatgcacgaactgaggagatgaaactccaggtttatgttcttggaccaaatggtgatggcccattaaagaaagtggctgaagaaaagaatcttgtcaatctgaaggatgcacattatggagctagacaatcaacaggatcaagagtctcaagtcggtctccaaagccatctatcgtttgcatctcacctttatctacacttgaatccaagtggctacatcttgttgctgttttatcagatggcagaaggatgtacctatctacgtctccttctagtggaagcttgactgggtttaacaccaaccatcacaagcctagctgtttaaaggttgtcacttcaaggcctgctcccccttggggtgttagtggtggtcttacctttggaaccatggctcttgctgggagacctcagaatgaggatctctccctgaaagtcgaggcagcttattattctgctggaactcttatcctttctgatgcatcaccttcaaccatgccttcactccttgttttgaacagggattcaagcacacagtcaccatcaggtaacctaggaactagtacaaggagttcccgagccttacaggagtctgtatcttctttaccagttgaaggacgaatgctttctgtggcagatgttttaccttttccagatactgcatctactgtgcattctctatattctgaaattgagtttggtggttatgagagctctatggaatcatgtgaaagggtgtctggcaaactctgggcaaggggagatctctcaacccaacatatactgccaaggaggaggattgttgtcttcagcaccatgggcatgatggaaattgtttttaacagaccactggacattttaagacggctattggaatcgacctctccgagatcagttttagaagatttcttcaatcgttttggtgcaggtgaggcagctgcaatgtgtctaatgctagctgcaagaatagtgcattctgagaatattatcagcaatgttattgctgagaaggcagctgaagcttttgaggacccaagagttgttggaatgccacaacttgaaggtagtagtgcattatcaaacacaagaagtgctgctggtggatttagcatgggccaggttgttcaggaggctgagcctgttttttcaggggcacatgaagggctctgtttatgttcttctagattgctttttcctttatgggaacttcctgttatggttgtaaaaggcaatttaggtccttcaggcactttatctgaaaatggggtagttgtgtgcagactctctgttggggctatgcaagtccttgaacagaaactccgatctttggaaaaattcttaagatctagaagaaaccagaggaggggactttatggatgtgtagcaggtttaggagacgtgagtggttccattctgtatggtaatggttcggcattaggtgctggagatcgaaatatggtcagaaacttatttggtgcatattctagacatatggagtccaatggtagcataacaactaataaaaggcaaaggttgccatatagtcctgctgaattagctgccatgggggtgagggcaatggagtgcattaggcagttgctacttagatctggtgaagccctatttttgcttcaacttctttcacagcatcatgtgactcgattgattcagggatttgattctaaccttcaacaagcattagttcagttgacatttcatcaactagtttgttctgaggagggtgaccatcttgcgacaagacttatatctgccctcatggagtattatactggtcctgatggcagggggactgtagatgacattagtaggagactgagagatggttgtccaagctactacaaggagtctgattacaaattcttcttagccgtggaagccctggagagagctgctatgaccatagatgctgaggacaaggagaatcttgcaagggaagcatttaattccttaagtaaagttccagagtctgttgacttacgaacagtttgtaaacgttttgaggatttaagattttatgaagctgtagtgcgcttacctcttcaaaaggcacaggctcttgaccctgcaggcgatgcttataatgatgagattgatgaaactgtcagagaacaagcacttgctcagcgtgagcagtgttatgagataattatcagtgctttgcggtctctgaaaggtgacaccttgcagaaggaatttggctctcccattagatcaagtgtttcacaatctgctcttgatccagcctctcggaaaaaatatatatgtcaaattgttcagctgggtgttcaatcacctgacagaatctttcacgagtatctttaccaggctatgattgatttaggtcttgagaatgaattgctagagtatgggggtcctgacctgttgccatttttgcaaagtgccggtcgcaaacccatacaggaggttcgtgctgtgacagccacaacttctccagtggggcaatcaggagcacctatgtcttctaatcaagtcaaatactatgaacttttggcacggtattatgttttgaagcgccaacatatgcttgcagctcatgctttgctaagactagctgaaaggcgttctaccgagggagttcctactcttgaacagaggtgtcaatacctgagtaatgcagttctacaggcaaaaaatgcatctaatggtgatgggttagtaggttctgcacgaagctccattgacagtggattcctagatttgcttgaagggaagcttgctgttcttcgtttccagataaaaatcaaagaagaactagagtctatggcatctaggtctgatgctttacctagcacgtcagattctgcccaaaatggtatggtccttgagggcagttcaactgttgatactaattttgccaatgcaactcgagagaaggccaaagagctagcttcagatgtaaagagcataacccagttatataatgaatatgctgttccctttgggctctgggagatatgcctggagatgctgtactttgccaattattctggtgatactgacagcagcattgtcagagagacatgggttagacttatagatcaagctatctcaagaggaggcatcgctgaagcttgctcagtactaaagagggtcgggccccgcatttatcctggtgatggagctgttttacccctcgacattatttgtcttcacctagagaaggctggactggagaggttgaattcaggggtggaatccgttggagatgaagatgttgcaagagcccttgtttctgcttgtaagggtgcagctgaacctgtattgaacgcatatgaccaattgttatcaaatggggctattttgccatccccaagtgttagattacgtatgcttagatcggttttagtggtacttcgagagtgggcaatgtctgtaaattcccaaaggatgggtaccagtgctgctgggcattccctgatactaggtggaggattctcatcggaacgtgctgttgctagccaacgagctcgggacaagatcacaagtttggcaaacaggtatatgactgaagtgcgaaggttagctcttccacagaaccaaacagaacacgtctaccgaggttttaaggaacttgaagaatcgtttataagccaacattcatttgatcgattttgatgtttgttgcaatatagtgttgtatcaattgttcctgttaaataattattttcaaataagtttttaattttccataatggatgtgctcatgtgatttttttaatataatctcgtgtatcaattagaaatatcatacatcctgatctatagagcctaattttgtgagtctcgaggcctgctcatttgcatgaattttccatcttgtaatgtcagcctaatttggtcagttagttctccactggcgtctggattgacttcttaatccagtctcaggagcattatgtcactttatagagtaaaacgaacctatatttactatttaattatttaatggtttagtttaattcatatttaagatttaaaaaattatataatccaaaatattctttctaagaattatgatcccctctcccctgataaaaaaaaaagaaagaaaa

SEQ ID NO: 4955 - DNA, 4851 bp, Phaseolus vulgaris
gtcagaaaacgaaagtgtttgcccgccactatcaatttacgaaagcctccccaaaaccctacatttttctcactcctctcttctcttctcttctcttcactgcaaaaactttttcttttccgccaattttcaattttcattttccgtttgattctcggaaaagccacaaacgaaagagggttttgaatttcattcccaaattcagattaagcttctaccgaatgatgtcgtgggaagatgagattgtgatgcgcgatgtcacgaatgcggggcttgttgtcagcgatcgcattggtcgcgaagtttcctctcagctcgacctcgaagaagctctagaagcttccagatacaccagccacccttattccactcacccccgagagtggcccccttccgttgaggtagtgaatacctgggagttgcctcctgtgctcatcgaaagatacaatgcagctggtggggaaggaactgctttttgtggaatatttccagaaatacggagggcatgggcgtctgtggacaattcattgtttctttggcgttttgacaagtgggatggccaatgtcctgaatttagtggggaggagcaagccatttgtgcagttggtcttgcaaaatcaaaacctggtgtttttgttgaagccatccaatatcttttagttttggcaacacctgttgagttaattttagttggagtttgttgctctggaggagcagatggctcagatccgttcgcagaagttacattgcagcctttgccagagcatacaatatcatctgatggggttacaatgacttgtgtagcatgtactgacaagggtcgcatttttcttgctggtcgggatggccacatatatgaggttctttattcaactggctctggatggcaaaaacgctgccggaaaatctgcatcactgctggttttggaagtgtaatttcgagatgggttataccaaatgtattcaattttggagctgttgacgccatcgttgaaatggttttcgacagtgagagacaaatactgtatgcacggactgaagagatgaagattcaagtttatgttataggaccaaatggtgacgggccgttaaagaaagtagctgaagaaaaaaatcttgtcaatcagagggatgcacattatggagctagacaatcaacaggatcaagagtctcaagtcgatctccaaagccatctattgtttgcatctcacctttatctacacttgaatcaaagtggctacatcttgttgctgttttatcagatggtagaaggatgtacctatctacctctccttctagtggaagcttgactggatttaacaccaatcatcacaagcctagctgtttaaaggttgtcactacaaggcctgctcctccttggggtgttagtggaggtctaacatttggagcaatggctcttggtggtagaccccagaatgaggatctctccctgaaaattgaggcatcttattattctgctggaactcttatcctatctgatgcatcatcttcgaccatgccttcacttcttgttttgaatagggattcaagcacacagtcactgccatcaggtaatttaggaacaggtaccaggagttcccgggcattacgggagtctgtatcttctttaccagttgaaggacgaatgctttcagtggcagatgtgttaccattgccagatactgcagctactgtgcagtctctatattcagaaattgaatttggtggttatgagagctctatggaatcatgtgaaaaggtgtctggcaaactctgggctaggggagatctctcaacccaacatatactgccaagaagaaggattgttgtcttcagcaccatgggcatgatggaaattgcttttaacaggccactggacattctaaggcggctattggaatccaacactcctaggtcagttttagaagatttcttcaatcgttttggtgcaggtgaggctgctgcaatgtgtttaatgctagctgcaagagtagtgcattctgaaaaccttatcagcaacgttattgctgagaaagcagctgaagcttttgaggacccaagagttgttggtatgccacaacttgaaggtagtaatgcattatcaaacacaagaagtgctgctggtggatttagcatgggccaggttgttcaggaagctgagcctgttttttcagctgcacatgaagggctgtgtttgtgttcatctagattactttttcccctgtgggaacttcctgtaatggttgtaaaaggcaacttaggtccttcaggtgccctaactgaaaatggggtagttgtgtgcagactctctgttggggcaatgcaagtccttgaacagaaactccgatcgttggagaaattcttaagatcaagaaggaaccagaggaggggactttacggctgtgtagcaggattaggagatctgagcggttccattctgtatggtaatggttcgacactaggtgctggtgatcgcaatatggtcagaaacttatttggtgcttattccagaaatatggagtccaatggtaacagaacaactaataaaaggcaaaggttgccttatagtcctgctgaattagctgccatggaggtgagagcaatggagtgcattaggcagttgctccttagatctggcgaagccctatttttgcttcaacttctttcacagcatcatgtgactcgattaattcatggatttgactctagccttcaacaaacattagttcagttgacatttcatcaactagtttgttctgaggagggtgaccaacttgctacaagacttatatctgctctcatggagtattatactggtcctgatggcagggggactgtagatgacattagtaggagactgcgagatggctgtccaagttactataaggagtctgattacaaattcttcttagccgtggaagctctggagagagctgctacgactatagattccgaagataaggagaatcttgcgagggaagcatttaattcgttgagtaaagttccagaatctgtagacttacgaactgtttgcaagcgttttgaggatttaagattttatgaagccgtagtgcgcttacctcttcaaaaggcacaggctcttgaccctgcaggtgatgcttataatgatgaaattgatgcacctgtcagagaacaagcacttgctcgccgtgagcagtgttatgagataattatcaatgctttgcgatctctgaaaggtgacaccttgcagaaggaatttggctctcccattagatcaactgtttcacaatctgctcttgatccatcctcaaggaagaaatatatatgtcaaattgttcagctgggtgtccaatctcctgacagaattttccatgagtatctttaccaggctatgattgatctaggtcttgaaaatgaattgctagagtatgggggtcctgacctattgccatttttgcaaagtgctggtcgtaaacctatacatgaggttcgtgctgtcactgcgacaacttctccaatggggcaatcgggagcaccaatgtcaactaatcaagtcaagtactatgaacttctggcacgatattatgtcttgaaacgccaacatatgcttgcagctcatgcacttcttagacttgctgaaaggcgttctattgatggagttcctaccctcgaacagaggtgtcaatacctaagtaatgcagtgctacaggccaaaaatgcaactaatagtgatgggttactaggttctggtcgaagttccattgacagtgggttcctagatttgcttgaagggaagcttgcagttctccggttccagataaaaatcaaagaagaactggagtctatggcttccaggtctgatgttttacctagcacatcaggttctaccgaaaatggtgtaatccctgagggtagttctactgatgttgatattgtaaatgctacaagagagaaggcaaaagagctagcttcagatgtgaagagcattacccagttgtataatgaatatgctgttccccttgggctctgggagatatgcctggagatgctgtactttgccaattattctggtgacaccaacagcagcattgtcagagagacgtgggctagacttattgatcaagctatatcaagagggggcattgctgaagcttgctcagtactaaaaagggttgggccccgcctttatcctggtgatggagctgttttaccccttgacattatttgtcttcacctagagaaggctggactggagaggttgaattcaggggtcgaagctgttggagatgaagatgttgcaagagcccttgtttctgcttgtaagggtgcagctgaacctgtattgaatgcatatgaccaattgttatcgaatggagctattttgccatcccctagtgttagattacgtatgttgagatcggttctagtagtacttcgagagtgggcaatgtctgtatattctcaaaggatcggtagcagtgttgctgggcattcctctctaatactaggtggaggattctcatcggaacgtgctgtcgccagccaaggaattcgggacaagatcacaagtgctgcaaacaggtatatgactgaggtgcggaggttagcccttccacagaaccaaacagaacacgtctaccgaggtttcagagaacttgaagaatcgtttataagccaacattcatttgatcgattttgatgtttgttgcaatatatagtgttgtatcaattgttcttatcatataattattttcaaataagaagattataatttttcacatgggatgtcatcatgtgattctttttaatacaatctcgtgtatcaattagaaatatcatcagctgcatttaagctttaaacgtttcat

SEQ ID NO: 4956 - DNA, 5234 bp, Cicer arietinum
tttgttttccgtaaaaaaaaatttgtttattttgatgaccggaaattttgcccgccactatcaatttacgaaacccacccccaaaaccctacatcgccgtttcttctcactcttcactcactctctctctccacggtcttctttctctccctttcccgctctctccctaatttgattctccatttgtttatcgggaaacaaaagagggcttcaatttgattccacctaattgcagctctccaattcacaatgtcgtgggaagacgagattgtgattcgtgatgttacgaatgctggtcttgttgtcagtgatcgcattggccgcgaagtttcgtctcagcacgacctcgaagaagctttagaggcctctagatatgccagtcatccttattctactcaccccagagagtggccccctttggttgaggtagcaaatacatgggagttgcctcctgttctcattgaaagatacaatgcagctggtggggaggggaccgctttttgtggcatatttcctgaaatacgcagagcatgggcttccgtggacaattccttgtttctttggcgttttgataagtgggatggccagtgtcctgaatatagtggggaggaacaagctatttgtgctgttggtcttgcaaaatcaaaacctggtgtttttgttgaagctatccaatatcttttaatcttagcaacccctgttgagttaattatagttggagtttgctgctctggaggagcagatggctcagatccatttgcagaagtttcattacagccattgccagattatacaataccatctgatggtgttacaatgacatctgtagcatgtactgataagggccgcatttttcttgctggtcgcgatggccacatatatgagcttctatattcaactggctcaggatggcaaaagcgctgcagaaaaatatgtgtcacggctggtctaggaagtgtaatttcaagatgggtcataccaaatgtgttcaattttggagctgttgaccctgttgttgaaatggtttttgacaatgagagacagatattgtatgcacgtactgaagagatgaagcttcaggtttatgttcttggaccaattggtgatgggccattaaagaaagttgctgaagaaaggaatcttatcaatcagaaggatgcacatcacggaggtagacaatcaaatggatcaagagtatcaagtcgatcaccaaaggcctctattgtttgcatctcacctttatctacacttgagtccaaatggctacatcttgttgctgttttatcagatggcagaaggatgtatctatctacctctccttctagcggaagcctgactggattcaacaccacccatcctaagcctagctgtttaaaggttgtcacaacaaggcctgctcctccgtggggtgttagtggtggtctcacctttggaaccatggctcttgccggtagacctcagaatgacgatctctcactgaaagtcgaggcagcctattattcttctggaactctaatcctttctgatgcatcacctcccactatgccttcactcctgcttttaaacagggattctaccacccagtcatcagcatcgggtaatctagggacaggtacaaggagttctcgggcattacgggaatctgtatcttctttaccagtcgaaggacgaatgcttgctgtggcagatgttctacctcttccggatacttcagctactgtgcagtctctatattcagaaattgagtttggtggttatgagagctcaatggaatcgtgtgaaagggcgtctggtaaactgtgggcaaggggagacctctcaacccaacatatattgccaaggaggaggattgtcatcttcagcactatgggcatgatggaaattgtttttaacaggccactagacattttaaggcggctgttagagtccaattctccaagatcagttttagaagatttcttcaatcgttttggagccggcgaggcagctgcaatgtgtttaatgctagctgcaaggatagtgcattctgaaaaccttatcagcaatgttattgctgagaaggcagctgaagcttttgaggacccacgacttgttggcatgccacaacttgaaggtagtaatgcattatcaaacacaagaactgctgccggtggatttagcatgggccaggttgttcaggaggctgagcctgtattttcaggtgcacatgaagggctctgtttgtgttcatctagattactttttcctctatgggaacttcctgtaatggttgtaaaaggaagtttaggtgcttcaggcacttcatatgaaaatggggtagttgtatgcagactatccattggggctatgcaagttcttgaactcaaacttcgatctttagagaaattcttaagatctagaaggaaccagaggaggggactttatggctgcgtagcaggtttaggagatctgagtggttcgattctatatggtactggttctgcattgggtgctgatgatcgaagtatggtaagaaacttgtttggtgcatattccagaaatatggagtccaatggtggtggagccacaaataaaaggcaaaggttgccatatagtcctgcagaattagctgccatggaggtgagggcgatggagtgcattaggcagttgctccttagatccggtgaagctctctttttgcttcaacttctttcacagcatcatgtcactcgtctgatccagggatttgatgctaaccttcaacaagccttagttcagttaacatttcatcaactagtgtgttctgaggagggtgaccgtctcgctacaagacttatatctgctctaatggagtattatactggtccagatggcagaggaactgtagaggacattagcaagagattaagagagggttgtccaagctactataaggagtctgactacaaattcttcttagctgtggaagccctggagagagctgcggtgactatagatgatgaggaaaaggagaatcttgcgcgggaggcactgaattccttaagcaaagttccagagtctgcggacttacgtaccgtttgcaaacgttttgaggatttaaggttttatgaagctgtagtgtgcttacctcttcagaaggcacaggctattgatcctgcaggtgatgcttataatgatgaaattgatgcaactgtcagagaacaagcacttgctcggcgtgagcagtgttatgagataattatcagtgctttgcggtctcttaaaggtgacaccttgcggaaggaatttggctctcccattagatctgcttcacaatctgcactcgatccagcctctcggaaaaagtatatcagccaaatcgttcagctgggtgtccaatcacctgacagaattttccatgagtatctctaccaggctatgattgatttaggccttgagaatgaattgttagagtatggaggccctgacctgttgccatttttacaaagtgctggtcgtaaaaccatacacgaggtccgtgctgtgactgcaacaacttctccaatggggcaatcgggagcgcccatgtcatctaatcaagtcaagtactatgaacttttggcacggtattatgtcttgaaacgacaacacatgcttgctgctcatgcattgctaagactagctggaaggccttctattgatggagttcctactcttgagcagaggtgtcaatacctaagcaatgcagttttacaggcaaaaaatgcatctaatagtgatgggttagttgcttctactcggggttccagtgacagtggtttactagatatgcttgaaggaaagcttgctgttcttcggtttcagataaaaatcaaagaggaattagaggctatggcttccagttctgaggttttacatagcacacccggctctgttgaaaacggtttaggccctgagaccagttcagctgttgatgccgattttgcaaatgcaacaagagagaaagccaaagagctatcatcagatttgaagagcataacacagttatataatgaatatgctgttccctttaagctttgggagacatgcctggagatgctatactttgccaattattctggtgatagtgacagcagcattgtcagagagacatgggctagacttatagatcaagcaatttcaagaggtggcattgctgaagcttgctcggtattaaagagagttgggccccgcctttatccgggtgatggaactgttttacagcttgacattatttgtcttcacctggagaaggctggactggagagattaaattcaggagttgaatcagttggagatgaagatgttgctagagctcttgtttctgcttgtaagggtgcagcagaacctgtattgaacgcatatgaccaattgttatcaaatggggcgattttgccatccccaaatcttagattacggatgctgagatcagttctagtggtacttcgtgagtgggctatgtctgtatattcacagagaatgggtacaggtgccactgggtcttccctaatactcggtggaggaggattctcattggagcgtacagttgctagccaaggaattcgggacaagatcacaagtgtggcaaacaggtatatgactgaagtacggaggttagcccttccacagagccaaacagaagtggtttacagaggctttaaagaacttgaagagtcgcttataagtcctcattcatttggtcgattttgatcttcattgcaatataatataatgttgtatcaattgctcttgtcaaataattattttgaaataagtttctattgttccatattggaggtgatccagtgatcttcttttgcttttcttttaccccttcttccaaatcggtctcgtgtaatcattaatcaattgttaagaatatcatatattggggtttataatattcatcccaatttagtaagcctcactacgtccttggacatagaaaccaagcctacttcgagcctaattctgttggatgttttctactggcatagagaattcacttcataattcaaagcattgtatcaaatcagtttgttcaatatgtatatttggcctttaggcttttattttataatttcttttttggagaatgttttaatgttctccaaacgtcagcatacaaccgagttcatgttaatgctcgtgacacttgtaacggtaaggatctgtatggaccacaaatattcagtgttatactgctatggtaatacgaatgaattcttcatcaaata

SEQ ID NO: 4957 - DNA, 4929 bp, Medicago truncatula
ggaaattttgcccgccactctgaaatttacgaaacccaccccaaaaccctacatcgccgtttattctctcactcttaaaacacacacactctctctctctctaactgtttctctctctagtttcacgaaagagggtttgaacttgattccaccgctctctctctctctctctcatcggtggtggaatgtcgtgggaagacgagattgtgattcgtgatgtcaccaacgccggtcttgtcgtcagtgatcgaattggccgtgaaatttcttctcagctcgacctcgaagaatctctagaagcttcccgatatgccagtcatccttattcaactcaccctagagagtggccccctttggttgaggtagcaaatacatgggagttgcctcctgttcttattgaaagatacaatgcggctggtggggaaggaactgctttttgtggaatatttcctgaaatacgtagggcatgggcgtcagttgacaattctttgttcctctggcgttttgataagtgggatggtcagtgtcctgaatatagtggcgaggaacaagctatttgtgctgttggtctggcaaaatcaaagcatggtgtttttgttgaagctatccagtatcttttaatcttagcaacccctgttgagttaattttagttggagtgtgctgctctggaggagcagatggctcagatccatttgcagaagtttcgttacagccattgccagattatacaataccatccgatggggttacgatgacaagtgtggcatgtactgataagggccgcattttccttgctggtcgtgatggccacatatatgagcttatttattcaactggctcaggatggcaaaagcgctgcagaaaagtatgcgtcactgctggtctaggaagtgtaatttcaagatgggtcataccaaatgtattcaattttggagctgttgaccctgttgttgaaatggtttttgacaatgagagacagatattgtatgcacggactgaagagatgaagcttcaggtttatgttcttggaccaattggtgatgggccactaaagaaaattgctgaagaaaggaatcttgtcaatcacaaagatgcacatcatggaggtagacaatcaagtggatcaagagtatcaagtcgatcaccaaagccatctattgtttgcatctcacccttatctacccttgaatcgaaatcgctacatcttgttgctgttttatcagatggtagaaggatgtacctatccacctctccttctagcggaagcctgaatggattcaacaccagccatcacaagcctagctgtttaaaggttgtcacaacacggccttctcctccttggggtgttagtggcggtctcacctttggaaccatggctcttgctggtagacctcaaaatgaggatctctcgttgaaagtcgaggcagcctattattctgctggaactcttatcctttctgatgcatcacctccaactatgccttcactccttgttttaaacagggattcgagcactcagtcctcaccatcaggaaatctaggaacaggtacgaggagttcccgggcattacgggaaactgtatcttctttaccagttgaaggacgaatgctttctgtggccgatgttttacctctaccagacacttcagctactgttcagtctctatactcagaaattgagtttggtggttacgagagctcaatggaatcatgtgaaagggcgtctggcaaactgtgggcaagaggagatctctcaacccaacatatactgccaaggaggaggattgtcatcttcagcaccatgggcatgatggaaattgtttttaacaggccattagacattttaaggcggctattagagtccagttctccgagatcagttttagaagatttcttcaatcgttttggagccggagaggcttctgcgatgtgtttaatgctagcttcgaggatagtacattctgaaaactttatcagcaatgttattgcagagaaggcagctgaagcttttgaggatccaagacttgttggcatgccacaacttgaaggcagtaatgcattatcaaacacaagaacagctgctggtggatttagcatgggccaggttgttcaggaggctgagcctgttttttcaggtgcacatgaagggctctgtttgtgttcatctagattactctttcctctatgggaactacctgtaatggttataaaaggaagtttaagtgcttcaggcacttcatttgaaaatggggtagttgtatgtagactatccatcgaggctatgcaagtccttgaacacaaacttcgatctttagaaaaattcttaagatctagaaggaaccagaggagaggactctatggttgtgtagcaggattaggagatgtaagtggttccattctatatggtggtggttctgcattgggtgctggtgaccgaagtatggtaagaaccttgttcggtgcatattccaaaaatatggagtctaatggcggtggagccgcaaataaaaggcaaaggttgccgtacagtcctgcagaattagctgccatggaggtgagggcaatggagtgcattaggcagttgctccttagatctggtgaagctctctttttgcttcaacttctctcacagcatcatgtcactcgtctgattcaaggatttgatgctaaccttcaacaagccctagttcagttaacatttcatcaactagtttgttctgaagagggtgaccatcttgctacaaggcttatatctgctctaatggagtattacactggtacagatggtaggggaactgtagatgacattagtaagagattaagagagggttgcccgagctactataaggaatctgattacaaattcttcttagccgtggaagccctggagagagctgctgtgactatagatgatgaggaaaaggagactctcgcgcgggaggcattgaatgccttaagcaaagttccagagtctgcagacttacgtactgtttgcaaacgttttgaggatttaaggttttatgaagctgtagtttgcttacctcttcagaaggcacaggctatcgaccctgcaggcgatgcttataatgatgaaattgatgccacggtcagagaacaagcacttgctcagcgtgagcagtgttatgaaataatcatcagtgcgctgcggtctcttaaaggtgacccctcacggaaggaatttggttctcccattggatctgcttcacaatctgcacttgatccagcctctcggaaaaagtatataagccaaattgttcagctgggtgtccaatcacccgacagaattttccatgagtatctttatcaggctatgatagacttaggtcttgagaatgaattgttggagtatggaggccctgacctattgcccttcttgaaaagtgctggtcgtacacccatacatgaggttcgtgctgtgactgcaacaacttctccaatgggccaatcgggagcacctatgtcgtccaatcaagtcaagtactttgaacttttggcacggtattatgtgttgaagcggcaacacatgcttgctgctcatgcattgctaagactggccggaaggccttctactgatggagttcctactcttgagcagaggtgtcaatacctaagcaatgcagttttacaggcaaagaatgcaacaaatagcgatgggttggttagttctactcggagttccagcgacactggattactagatatgcttgaagggaagcttgctgttcttcggtttcagataaaaatcaaagaggaactagagcatatggcttccagttctgaggttttacacagcacatccaattctgttgaaaatggtttagtctctgatgccagtccaactgttgatgccaattttgcaaatgcaacacgcgagaaagccaaagagctatcatcagatttgaagagcataacacagttatataatgaatatgctgttccctttaaactctgggagacatgcctggagatgctgtactttgctaactattctggtgatagtgacagtagcattgtcagagagacatgggctcgacttatagatcaagctatttcaggaggtggcattgctgaagcttgctctgtgctaaagagacttgggccccgcctttatcctggtgatggaactgtttttcagcttgacattatttgtcttcaccttgagaaagctgcactggagagattaaatacaggggttgaatccgttggagatgaagatgttgcgagagcccttgtttctgcttgtaagggtgcagcagaacctgtattgaacgcatatgatcaattgttatcaaatggggcaattttgccatccccaaatcttagattacggatgctgagatctgttctagtggtacttcgtgagtgggctatgtctatatattcacacaggatgggtacaggtgccactggttcttccataataataggcggtggattctcattggaacgtacagttgctagccaaggaattagggacaaaatcacaagtgtagcaaacaggtatatgactgaagtacggaggttagcccttccacagagccaaacagaaggggtttactgcggctttaaagaacttgaagagtctctcataagtcctcattcatttgatcgattttgatctttgttgcaatatatttgttgtatactatcaattgctcttgtcaaataattattattttgaaataagtttctaatgttccatattggaggtgatcttcttttgctttcctttttaccccttcttccaaaattagtctccatggacgtgtcaactatgccgtcattcgagcctagttctctgaagttttctactggcgtgagaattgatttcagtccaaagcattgtatcaaatcaaatactccagttaaaaatatgtatacgcctgttatgctttatttttacttca

SEQ ID NO: 4958 - DNA, 4463 bp, Lotus japonicus
gtagtgaatacgtgggagttgcctcctgtgctcattgaaaggtacaatgcggctggcggggaagggactgctttttgtggaatatttccggaaatacgtagggcatgggcatctgtggacaattccttgtttctatggcgatttgataagtgggatggccaatgtcctgaatatagtggggaggaacaagctatttgtgctgttggtcttgcaaaatcaaaacctggtgtttttgttgaagctatccaatatcttttaatattagcgacacctgttgagttaattttagtaggagtatgctgctctggaggagcagatgattcagatccatttgaagaagtttcattacagccattgccagagtatacaataccatctgatggggttacaatgacatgtgtatcatgtactgataagggccgcattttccttgctggtcgtgatggccacatatatgagcttctttattcaactggttcaggatggcaaaagcgatgcagaaagatctgtgtcactgctggtctaggaagtgtaatttcaagatgggtcataccaaatgtgttcaactttggagccgttgaccctattgttgaaatggtttttgacaatgagagacaaatattgtatgcacgaactgaggagatgaagcttcaggtttatgttcttgggccaaatggtgatggtcaattaaagaaagtggctgaagaaaagaaccttgtcaatcagagggatgcacaaggtagacaatcaacaggatcaagggtctcaagtcgattgccgaagccatctattgtttgcatctcacctttatctacacttgaatccaagttgctacatcttgttgctgttttatcagatggcagaaggatgtacttatctacctctccttcaagtggaagcctgactggatttaacaccaaccatcataagcctagctgtttaaaggttgtcgcgacaaggcctgctcctccttggggtgttagtggtggtcttacctttggaaccatggctcttgctggtagacctcagaatgaggatctctcactgaaagttgacgcagcctattattctactggaactcttatcctttctgatgcatcaccttcaactattccttcactccttgttttgaacagggattcaagcacacagtcatcatcatcaggtaatctcgggacaggaatgaggagttcccgggcattacgggaatctgtatcttctttaccagttgaaggaagaatgctttctgtggcagatgttttacctttgccagatactgcagctactgtacggtctctatattcagaaattgagtttggtggttatgagaactcgatggaatcatgtgaaagggcatctggcaaactctggtctaggggagacctctcaactcaacatatattgccgaggaggaggattgtcatcttcagcaccatgggcatgatggaaattgtttttaacaggccactggacattctaaggcgactattagagtcaaattctccaagatcagttttagaagatttcttcaatcgttttggtgctggcgaggcagctgcaatgtgtctaatgctagctgcaagaatagtgcattctgaaaatcttattagcaatgttattgctgagaaggcagctgaagcttttgaggacccaagagttgttggcatgccacaacttgaagggagcagtgcattatcaaacacaagaactgctgctggtggatttagcatgggccaggttgttcaggaggccgagcctgttttttcaggtgcacatgaaggactctgtttgtgttcatccagattactttttcctctatgggaacttcctgtgatggtcgtaaaaggaagtttaggtccttcaggcactttatcagagaatggggtagttgtatgcagactctctgttggggctatgcaagtccttgaactcaaacttcgatctttagagaaattcttaagatctagaaggaaccagaggagagggctttatggctgtgtagcaggtttaggagatgtgagtggttccattctatatggtaatggttccgcattaggtgctggtgatcgaagtatggtaagaagcctgtttggggcatattcaagaaatatggagtctaatggtggtggaaccactaataaaaggcaaaggttgccatatagtcctgcagaattagctgccatggaggtgagggcaatggagtgcattaggcagttactccttagatctggcgaagccctgtttttgcttcaacttctttctcagcatcatgtcactcgtttgattcagggatttgatgctaaccttcaacatgcattagttcagctaacattccatcaacttgtttgttctgaggagggtgaccgtcttgctactagacttatatctgctctgatggagtattatactggtcctgatggcaggggaacagtagatgacattagtaggagattacgagagggttgtccaagctactataaggagtctgattacaagttcttcttatctgtggaagccttggaaagagctgctgtgactgtggatgctgaggaaaaggaaaatcttgcaagggaggcattaaattccttgagtaaagtcccagagtctgcagacttgcgtactgtttgcaaacgttttgaggatttaaggttttatgaagcagtagtgtgcttacctcttcaaaaggcacaggctcttgaccctgcaggtgatgcctataatgacgacattgatgcaactgtaagagagcaagcacttgttcagcgtgagcagtgctatgaagtaattatcagtgctctacggtctctgaaaggtgacaccttgcagaaggaatttggctctcccatcagatctgctgcatcacaatctgctcttgatccagcctctcggagaaaatacattagccaaattgttcagctgggtgtccaatcacctgacagaatattccacgagtatctctaccaggctatgattgatttaggtcttgagaacgaattattagagtacggagggcccgacctgttgccgtttttacaaagtgctggtcgtaaacccatacatgaggttcgtgctgtgactgcgacaacttctccaatagggcaatcaggagctcctttgtcgtcaaatcaagtcaagtactatgaacttttggcacggtattatgtcttgaagcggcaacatatgctggcagctcatgcattattaagactcgctgaaaggcgctctattgatggagttcctactcttgaacagaggtgtcaatacctaagtaatgcagttctacaggcaaaaaatgcaacaaataatgacgggttggtaggttctactcggagttcctttgatatccccgagggaagttcaactgctgatcctaattttgcaaatgcaatacgagagaaagctaaagagctatcatcagatgtaaaaagcataacacagttatataatgaatatgctgttccctttgagctctgggagatatgcctggagatgctttactttgccaactattctggtgaaaatgacagcagcattgtcagagaaacatgggctagacttatagatcaagctatttcaagaggtggcattgctgaagcttgctctgtattaaagagggtcgggccccgcatttatccgggtgatggagctgttttaccacttgacattatttgtcttcacctagagaaggctggactggagaggttaaattcaggggttgaacctgttggagatgaagatgttgcaagagcccttgtttctgcttgtaagggttcagctgaacctgttctgaatgcatatgatcaattgttatcaaacggggctattttgccatccccaaatcttagattgcgtttattgagatctgttctagttatactccgtgagtgggctacgtctgtatattcccataggatgggtattggtgcctcgccttcccgagtactggagggaggattctcattggaacgcacagttgctagccaaggaattcgggacaagatcactagtgcagcaaacaggtatatgactgaagtgaggagacttgcccttccacagaaccaaacagaagttgtgtatcgaggctttagagaacttgaagagtcggttattagtcctcattcatttaatcgattttgatatttgttgcagtatatagtgttgtatcaattgtcaaataattgttttcaaataagaggtttcagattttataacactggacgtgctctcgtgattgccctctttatcccatgttataaaaatagtcttttgtgtatcaatttagaaattagaatatcatatctgctggtctatattcagccaagtcttgcagcgtgctgggatgtatcaaccaagctgtaatagcaggctaattttgtatggatttctctgctgccgtgataattgacttcatattccattgaactatatcaatcaaatagtgtaatatgttgtgttaatttaat

SEQ ID NO: 4959 - DNA, 4604 bp, Prunus persica
aagacttgccctgtttggtttcaacaaagggagggaaaaccgacttccggctccaattcaatctagcaggcagtgtttcaatttgtgcaattttcttgttcagagttctagggtttccaacggcatgtcttgggaggacgaaatcgttatgcgcgatgtcactaatgcgggcctcgtcgtgagtgaccgcattggccgagaagtctcgtctcagcttgatcttgaagaagccctagaagcttccagatacgctagtcacccctattctactcatcccagagagtggccgcctttggttgaggtggtggatacttgggagttgcctggggtacttattgaaagatataatgcagctggtggggaaggaaattcattatgtgggatatttcctgagattcgtagggcatgggcatcggtagataattccttgtttctctggcgttttgacaagtgggatggacaatgtcctgaatatagtggggaggatcaagctatttgtgctgttggccttgctaaatctaaacctggtgtttttgttgaagctattcagtatcttttgattttggcaacacctgttgagttaattcttgtaggagtatgttgctctggaggggctgatggcacagatccatatgcagaagtctcactacagccattgccagaatatacagtaccatctgatgggatcaccatgacatgtatcacgtgtactgacaagggtcgtattttccttgctgggcgtgatggccacatttatgagctacattatacaactggatcaggctggcaaaagcgttgccgaaaagtttgtctgactgccggtttaggaagcgttatttcaagatgggtagtaccaaatctttttaagtttggagctgttgaccccatcattgaaatggtttttgataatgaaagacacatcttgtatgcacgaactgaagaaatgaaacttcaggtgtttattgtggggcaaaatgttgatgggccattgaaaaaggtggcagaagaaaggaatctgataaatcagagggatgctcattatgggggtagacaatcaactggacctagaggtccaaatcgatctacaaagtcatctatagtctgcatttcacccttgtctaccctggaatctaagtctctacaccttgttgctgttttgtccgatggcagaaggatgtaccttaccacttctccatctagtggaaatttgggtgggtttaataccaaccataaacctagctgtttaaaagttgtgacaactaggccttctcctccactaggggtcggtggtggacttgcctttggaagcatgtctcttgctggtagacctcagaatgacgatctctccctaaaggttgaggcagcatattattctgctggaactcttgtcctttctgattcatctccaccaaccatggcttctcttcttcttgtgagccgcgattcaagcacacaatcagctgggtcaagtacttcggggacaagttcaaggagttctcgggcattacgggaatctgtatcttctttaccagttgaaggacggatgctttttgtagccgatgttttccccttgcctgatactgcaaccactgtacagtctctgtattcagaaattgaatatggtggttatgaaggctctgatgagtcctgtgaaaaggtaactggaaaactttgggccagaggtgacctttcaatccaacatatattgccaaggagacgagttgttgttttcagtactatgggcatgatggaaatagttttcaataggcctgtggacattctgaggaggttgtttgagactaacatccccaggtcaatcgtagaagaattcttcaatcgttttggagctggtgaggcagcggcgatgtgtttaatgctagcagctaggatagtccattcagaaactcttataagtaatgttgtttctcagaaggcagctgaagctttcgaggacccaagacttgttggaatgccacaacttgagggcagcaatgcattatcaaacactagaacagctgctgggggattcagcatggggcaggttgttcaggaggctgagcctgtgttttcaggtgcacatgaagggctctgtttgtgttctgcaaggttgctatttcccatatgggaacttcctgttgtggttgtaaaaggtggtttaggttctgcagatgcaatgtcagaaaatgggttagtcgtatgcaggctctctcttgaggctatgcaagtgcttgaaaacaaaattcgctctctagagaagtttctgaagtccagaaggaaccaaaggaggggactttatggttgtgttgctggtttaggagatgtgactggttctatcctttatggaattggttcagaattaggtggtggtgaccacagtatggtgagaaacttatttggtacttactcacggaacactgagtctaatgatggtggtatgtctaataaaaggcagagattaccatatagtcccgctgaattggcagccatggaggtgagggcaatggaatgcatcaggcagttgcttcttagatccagtgaagccctgtttctgctccagcttctttcacagcaccatgtaacacgcttggttcaggggtttgatgctaatctgcgacaggcattagttcaaatgacatttcatcagttagtttgttccgaggagggtgaccacctcgctacaaggctcatatctgctctgatggagtattatactggtcctgatggcaggggggcagtaaatgatattagtgggagattacgggaaggctgtccaagctattataaggagtctgattacaagttttttctagctgtggagtgtcttgagagagctgctgtaattccagatcctgaggagaaggagaatcttgctagagaggccttcaattttttgagtaaagttccagaatctgctgatttacgaactgtctgcaaacgatttgaggatttaaggttttatgaagccgtggttcgcttgcctttacaaaaggcacaggctcttgaccccgcaggtgatgcttttagtgaccaaattgatgcagcagtccgacagcatgcacgtgctcaacgtgaacagtgctatgagattgtcatcagtgcattgcgttctctaaaaggtgagccttcacagagggagtttggttctcctcttaggcctgctgctatgcgatctgcccttgatccggtctctcggaacaaatatatatcccagattgttcagctgggcatccaatctcctgacagattatttcacgagtacttgtaccatgctatgattgatatgggccttgagaatgagttgctggagtatggaggtcctgatttggtgccgttcctacaaagtgctggccgtgaacccatacaagaggttcgggctgtttctgcggtcacatcggccgcttctccaattagttactcaggaacagccatcccattcaatcaagccaaatattctgatctgttggcacgatattatgtcttgaagaggcagcatctgcttgcagctcatgtattactaagactggcagagaggcgttcaaccaattctggggatgttcctactctagatcaaaggtatcattacctaagtaatgcagtcctacaggctaaaaatgcaagtaacagtgaaggcctggtaggttctaccagaggtgcgtatgatgatgggttgttagatttgttggaaggaaaacttgctgtccttcgttttcagataaagatcaaggaggaacttgaggcttccgcttccaggatagaagctttgcctggtgcatctgagcctgtccaaagtggaactgttcccactagcactttgagtggtgatgccaatcttgcaaatattgcacgagaaaaggccaaagagctgtcattagatttaaagagtataactcagctatacaatgaatatgctcttccatttgaactttgggagatatgtctagaaatgctatactttgcatactattctggtgatgctgatagtagcgttgtaagagatacttgggccagattaattgatcaagctctttcaaggggtggcattgctgaagcttgttcagtattgaagagagttggttctcacatttatcctggagatggagctggtttgcccttggacacactgtgtctccacctcgagaaagctgcactggaaagactggaatcaggggttgaatctgttggagatgaagatgtggcaagggctcttcttgctgcttgcaagggtgcaattgagcccgtattgaacacttatgaccaattgttgacgagtggtgctattttgccatcaccaaaccttaggttacgccttctacgatcagtattagttgtacttcgagagtgggcaatgtctgtgtttgcacaaagaatgggtacaagtgctactggagcttctttaattctaggtggaacattttcactggagcaaacatcagggattaaccaaggggttcgagataagatctcaagtgcagcaaacaggtatatgactgaggtacggaggttggcccttccacagagccagactgaagctgttttccatggctttcgagaactcgaagagtcactgataagtcccttttcttttgatcgtttttgatcttttt

SEQ ID NO: 4960 - DNA, 5152 bp, Theobroma cacao
gtggcttaatttgcccgccactgccaaaaacccttgaataaaccctattttttacactcacgcttttacgctccctttcttcttcctgggctttgcttccatttcactaaccgctctgctctctctttccctctctggtttcaattcaaaatacctcttcaccagaactcaaaatcaaatctacgctttcattcaatttcacgcccctaaacaaaaaccctggggctcttcttttcgaattaaatcccattctctctcccccactttctgattctagggtttgtcgatgtcgtgggaggaggagattgtgatgcgcgatgtcaccaatgcggggctcgtcgtcagcgaccgcattggccgtgaagtggcggcgcagttggacctcgaggaagctctagaagcctctagatacgctagccatccctactctactcaccccagagagtggcctcctttgattgaagtggtggatacttgggagctgcctcctgtactcattgaaagatataatgcagctggtggagaaggaactgcattatgtggaatatttccagagatacgcagggcatgggcatctgtggataattctttgtttctttggcgttttgacaaatgggatggccaatgtcctgaatacaatgcagaggaacaagcaatatgtgctgttggactcgctaaatctagacctggcatttttgttgaagctatacagtatcttttaatattagcaactcctgttgagttgattcttgtaggagtgtgctgttctggagggggtgatggtacagatccttatgcagaagtttcactgcagcctttgccagagtatacagtaccttctgatggagttactatgacatgtataaattgtactgataagggtcgtattttcatggctggccgagatggccacatctatgaactgcattatacgactggttcaggatggcataaacgttgtcgtaaagtttgcctcactgcaggtgtaggcagtgtgatttcgaggtgggtcataccaaatgtgttcaagtttggagttgtagatcccattgttgaaatggttgttgataatgaaagacagattttatatgcaagaactgaagagatgaaaattcaagtttttgttatggggccaaatggagatggtccattgaagaaagtggctgaagaaaggaatctgttaaatcagaaagatggacattatggaggtagacaaacagcggcaccaagagcctcaaatcgatcagcaaaaccatccatcgtttcaatttccccattatccacactagaatcgaagtggctgcaccttgttgctattttatcagatggtaggaggatgtacctttccacctcctcatctagtggaagtaatggtactgttggaggtttgggtggatttaacaatcatcaccacaggccaagctgtttaaaagttgtaacaactaggccttcgcctcctttaggggttagcggtggacttacctttggggcaatgtctttggctggtaggacccagactgaggatctctcactgaaggtagaaacatcatactattctgctggaactcttgtcctttctgatgcgtcaccaccaaccatgtcttctcttctcattgtgagcagggactcaagctcacagtcatctcagtcaggtggcttgggagcaagtgctaggagttcccgtgcattacgagaatctgtttcttccttgcccgttgaaggacggatgctctttgtagctgatgttcttcctttaccagatgcagctgccactgtgttatcactgtattctgagcttgaattttgcggatttgaaagctcagcagagtcctgtgaaaaggcatcaggaaagctgtgggctagaggtgacctttcaactcagcatatactgccaaggaggagaatagttgttttcagcaccatgggcatgatggaagtggttttcaatcggcctgttgatattttgagaagattgttggagtcgaactctccaagatcaatattggaggacttatttaatcgttttggtgctggtgaagcagctgcaatgtgtttgatgctagctgcaaggatagttcattgtgaaaaccctataagcaatgttgttgcagagaaggcagctgaagcttttgaggacccaagaattgttggagtgccacaactcgagggcagtagtggattatcaaacactagaacagcagctgggggttttagcatggggcaggttgttcaggaggctgaacctgttttctctggtgcacatgaagggctctgcctttgctcttcaaggttgctatttcctgtttgggagctccctgttatggttgcaaaaggtggtcaagatgctgcatcagaaaatggggtgattgcatgcagactttctgttggagctatgcaagtccttgagaacaagattcgtgcattggagaagttcttaaggtctagaaggaaccaaagaagggggctctatggatgtgtagctggtttaggtgacttgactggttctattttgtatggaactggttcagaattaggtgcgggtgataggagcatggtaagaaatttatttggtgcttactcccggagtgtggagtctaatggaggtggagcatcgaataaaagacagagactgccatatagtccagctgagttggctgcaatggaggtgagggcaatggaatgtatcagacagttgcttcttaggtctgctgaagctctgtttttactacagcttgtttctcagcatcatgtaacacgcttggttcaggggtttgatgctaatctccgccaggcattgcttcaattgacttttcaccaacttgtttgttctgaggagggtgaccgccttgctacaagacttatttctgctctgatggagtattatactggccctgatggcaggggaacagttgatgatattagtgggaaattacgtgagggatgtccaagctatttcaaggagtctgactataagttcttcttggcggtggaatgtcttgaaagagctgctgtaactcctgatcctgatgtaaaggaaaatcttgccagggaggccttcaatttcctaagtaaagttccagaatctgctgatttaagaaccgtttgcaaacggttcgaagacttgagattttacgaggctgtggttcgcttatctctacaaaaggctcaggcacttgaccctgcaggtgatgccttcaatgagcaaattgatccagcaatcagagaatatgcaattgcacagcgtgaacagtgctatgagataattactagtgctttacgttctctaaaagatgggggctcacagagggaatttgggtctcctgctaggcctgttgctgtgcgatctacccttgatcaggcttcacggagaaaatacatatgtcagattgttcagcttggtgttcaatcacctgacagattatttcatgagtatttgtatagagctatgattgacttaggtcttgaaaatgagttgttggagtatggaggtccagacttggtgccttttctgcagactgctggtcgtgaacctgtgcaagaggttcaagctctctctgcattgacatctgcaaccccttcaatgggtcaaccaggagcacctattcattctgatcaagccaaatattttgatcttttggctcgatattatgtcttaaagcggcagcatgtacttgcagcgcatgtgttattgaggttggctgaaagacgctcaactgatgggagcaatgctcctactctggaacagaggcgtcaatacctaagcaatgctgttctccaggccaagagtgcaagtaataatgatggtctggtaggttctagccggggtgcttttgacagtggattgctagatttacttgaagggaaacttactgttctccagtttcaaataaaaataaaagaggaactggaggcaattgcttccaggttagaagctacacctgttacatccgaatctgttcaaaatggatctgtccctgatagcaggtataatggggatgcccatttagcaaatgctgcacgggagaaggccaaggagttatcattagatttgaagagcattactcagttgtataatgaatatgcagttccttttgagctttgggagatatgtctggaaatgttgtactttgcaaactattctggtgatgctgatagtagcattatacgagaaacctgggctagactaattgatcaagctcttttgaggggtggagttgctgaagcttgcgctgttctgaagagggttggttctagagtatatcctggagatggaactgttttacctctggacactctatgccttcatctagagaaggctgcattggagagggtggaatctggacttgaaactgttggagatgaagatgtggcaagggctcttcttgctgcttgcaagggtgcagctgaacctgtattgaacacttatgatcaattattatcaaatggggctattttgccatcaccaaacctcagattacgccttcttcgatcagtgctagtgatacttcgtgagtgggcaatgtctgtctatgcacagagaatgggcacaagttctactggtgcttctttaattttaggtggaacattctcactggagcagacaacagttttaaatcaagggattagagacaagatcacgagtgcagcaaataggttcatgaccgaggtgcggaggttggccctcccacagagtcggactgaggctgtttatagaggatttcgggaacttgaggagtctttgataagtccactttcttttgatcgattttgatttgataatttgttcaaaacatgttgttgtatgataagcatataaacaaaatatattttgactcaaatttgctaaagaagatggaaagtgaattctgtttcagtatgcgaccaaaataattgacaccccattccttgtttctctatcattccactcccatctcctttcctttgtctctttccatcaaatgcaagttaagggcccaagactagtgtaattgctgtgggaagaagtttggatattttccgaggatactacaagttgaggaggaaaagccatatcgaagcaggattgctttgccaccgcaactgctttaagtgcagtgatgatgctctgtttctagagtgtgtttggtgttatgttggtaggaatgaatcgaac

SEQ ID NO: 4961 - DNA, 4791 bp, Prunus mume
caaatctctctactccaacactctctaccttagcggtgtgaatagtgctctccaattcaagacttgccctgtttggtttccacaaagggagggaaaaccgacttccggctccaattcaatcttgcaggcagtgtttcaatttgtgcaattttcttgttcagagttctagggtttccaacggcatgtcttgggaggacgaaatcgttatgcgcgatgtcactaatgcgggcctcgtcgtgagtgaccgcattggccgagaagtcgcgtctcagcttgatcttgaagaagccctagaagcttccagatacgctagtcacccctattctactcatcccagagagtggccgcctttggttgaggtggtggatacttgggagttgcctcgggtacttattgaaagatataatgcagctggtggggaaggaaattcattatgtgggatatttcctgagattcgtagggcatgggcatcggtagataattccttgtttctctggcgttttgacaagtgggatggacaatgtcctgaatatagtggggaggatcaagctatttgtgctgttggccttgctaaatctaaacctggtgtttttgttgaagctattcagtatcttttgattttggcaacacctgttgagttaattcttgtaggagtatgttgctctggaggggctgatgggacagatccatatgcagaagtctcactacagccattgccagaatatacagtaccatctgatgggatcaccatgacatgtatcacgtgtactgacaagggtcgtattttccttgctgggcgtgatggccacatttatgagctacattatacaactggatcaggctggcaaaagcgttgccgaaaagtttgtctgactgccggtttaggaagcgttatttcaagatgggtagtaccaaatctttttaagtttggagctgttgaccccatcattgaaatggtttttgataatgaaagacacatcttgtatgcacgaactgaagaaatgaaaattcaggtgtttattgtggggcaaaatgttgatgggccattgaaaaaagtggcagaagaaaggaatctgataaatcagagggatgctcattatgggggtagacaatcaactggacctagaggtccaaatcgatctacaaagtcatctatagtctgcatttcacccttgtctaccctggaatctaagtctctacaccttgttgctgttttgtccgatggcagaaggatgtaccttaccacttctccatctagtggaaatttgggtgggtttaataccaaccataaacctagctgtttaaaagttgtgacaactaggccttctcctccactaggggttggtggtggacttgcctttggaagcatgtctcttgccggtagacctcagaatgacgatctctccctaaaggttgaggcagcttattattctgctggaactcttgtcctttctgattcatctccaccaactatggcttctcttcttcttgtgagccgtgattcaagcacacaatcagctgggtcaagtacttcggggacaagttcaaagagttctcgggcattacgggaatctgtatcttctttaccagttgaaggacggatgctttttgtagcagatgttttccccatgcctgatactgcaaccactgtacagtctctgtattcggaaattgaatatggtggttatgaaggctctgatgagtcctgtgaaaaggtaactggaaaactttgggccagaggtgacctttcaatccaacatatattgccaaggagacgagttgttgttttcagtactatgggcatgatggaaatagttttcaataggcctgtggacattctgaggaggttgtttgagactaacatccccaggtcaatcgtagaagaattcttcaatcgttttggagctggtgaggcagctgcaatgtgtttaatgctagcagctaggatagtccattcagaaactctcataagtaatgttgtttctcagaaggcagctgaagcttttgaggacccaagacttgtcggaatgccacaacttgagggcagcaatgcattatcaaacactagaacagctgctgggggattcagcatggggcaggttgttcaggaggctgagcctgtgttttcaggtgcacatgaagggctctgtttgtgttctgcaaggttgctatttcccatatgggaacttcctgttatggttgtaaaaggtggtttaggttctgcagatgcaatgtcagaaaatgggttagtcgtatgcaggctctctcttgaggctatgcaagtacttgaaaacaaaactcgctctctagagcagtttctgaagtccagaaggaaccaaaggaggggactttatggctgtgttgctggtttaggagatgtgactggttctatcctttatggaattggttcagaattaggtggtggtgaccacagtatggtgagaaacttatttggtgcttactcacggaacactgagtctaatgatggtggtatgtctaataaaaggcagagattggatgtgagggcaatggaatgcatcaggcagttgcttcttagatccagtgaagccctgtttctgctccagcttctttcacagcaccatgtaacacgcttggttcgggggtttgatgctaatctgcgacaggcattagttcaaatgacatttcatcagttagtttgttctgaggagggtgaccacctcgctacaaggctcatatctgctctgatggagtattatactggacctgatggcaggggggcagtaaatgatattagtgggagattacgggaaggctgtccaagctattataaggagtctgattacaagttttttctagctgtggagtgtcttgagagagctgctgtgattccagatcctgaggagaaggagaatcttgctagagaggccttcaattttttgagtaaagttccagaatctgctgatttacgaactgtctgcaaacgatttgaggatttaaggttttatgaagccgtggttcgcttgcctttacaaaaggcacaggctcttgaccccgcaggtgatgcttttagtgaccaaattgatgcagcagtccgacagcatgcacgtgctcaacgtgaacagtgctatgagattgtcatcagtgcattgcgttctctaaaaggtgagccttcacagagggagtttggttctcctcttaggcctgctgctatgcgatctgcccttgatccggtctctcggaacaaatatatatcccagattgttcagctgggcatccaatctcctgacagattatttcacaagtacttgtaccgtgctatgattgatatgggccttgagaatgagttgctggagtatggaggtcctgatttggtgcctttcctacaaagtgctggctgtgaacctatacaagaggttcgggctgtttctgcggtcacatcggccgcttctccaattagttactcaggaacagccatcccatccaatcaagccaaatattctgatctgttggcacgatattatgtcttgaagaggcagcatctgcttgcagctcatgtattactaagactggcagagaggcgttcaactgattctggggatgttcctactctagatcaaaggtatcattacctaagtaatgcagtcctacaggctaaaaatgcaagtaacagtgaaggcctggtaggttctaccagaggtgcgtatgatgatgggttgttagatttgttggaaggaaaacttgctgtccttcgttttcagataaagatcaaggaggaacttgaggcttccgcttccaggatagaagctttgcctggtgcatctgagcctgtccaaagtggaactgttcccaatagcactttgagtggtgatgccaatcttgcaaatattgcacgagagaaggccaaagagctgtcattagatttaaagagtataactcagctatacaatgaatatgctcttccatttgaactttgggagatatgtctagaaatgctatactttgcatactattctggtgatgctgatagtagcgttgtaagagatacttgggccagattaattgatcaagctctttcaaggggtggcattgctgaagcttgttcggtattgaagagagttggttctcacatttatcctggagatggagctggtttgcccttagacacactgtgtctccacctcgagaaagctgcactggaaagactggaatcaggggttgaatctgttggagatgaagatgtggcaagggctcttcttgctgcttgcaagggtgcaattgagcccgtattgaacacttatgaccaattgttgacgagtggtgctattttgccatcaccaaaccttaggttacgccttctacgatcagtattagttgtacttcgagagtgggcaatgtctgtgtttgcacaaagaatgggtacaagtgctactggagcttctttaattctaggtggaacattttcactggagcaaacatcagggattaaccaaggggttcgagataagatctcaagtgcagcaaacaggtatatgactgaggtacggaggttagccctttcacagagccagactgaagctgttttccatggctttcgagaactcgaagagtcactgataagtcccttttcttttgatcgtttttgatcctttttactgttcatcgtgccatatatggtgttgtatgaaatttttcttgttacatgtataacattttccaaaaataaaaaaaatgttataatttcattattgaatgcgtcatgtagttttgtgcaaaacagactctattattcaaagggagtgttgactggat

SEQ ID NO: 4962 - DNA, 4961 bp, Gossypium raimondii
attgaattcatattgtagaaaaagagaatgaaaactcaaaactttaaggcccgctctctgaaaaaatagcttaatttccccgccactggaaaacccttgaataaaccctattttatatacttacgctttaacgctttctttcctttcttttttttttttatttcctgtactttcactaacttctgccattcccccccttgatttcatttaaggaaaaaaaaatcaaaatcgatagccaaaattaagctagggttgcattcaatttgacagcccctagaagaaaaccttggggctcttctttttgaatccaaccacattctccccctttctgattctaggttttttacgatgtcgtgggtggaggaggttgtattgcgtgatgtcaccaatgcgggactcgtcgttagcgaccgtattggccgtgaagtggcggctcagttggaccttgaggaagctttggaagcttccagatacgccagtcatccctactccacacaccccagagagtggcctcctttgatcgaggtggaagatacttgggagctacctccggtactcatagaaagatataatgcagctggtggagaaggaactgcattatgtggaatatttccggagatacgtagggcgtgggcatctgtggataattctttgtttctttggcgttttgacaaatgggatggccaatgccctgaatacaatgtggaggaacaagctatatgtgctgttggcctcgccaaatctagacctggcattttcattgaagctatacagtatcttttaatattagcaactcctgtcgagttgattcttgtaggagtatgctgctctggagggggtgataatagtgatccttatgcagaggtttcactgcagcctttgccagagtatacaataccttctgacggagttactatgacttgtatctcttgtactgataagggtcgtattttcttggctggccgagatggccacatatatgagctgcattacacgaccggttctggctggcataagcgttgtcggaaagtttgcctcactgcaggtgtagggagtgttatttcaaggtgggttataccaaatatgtttaagtttggagctgtagatcccattgttgaaatggttgttgataacgaaaggcagattctatatgcaagaactgaagagatgaaaattcaggtttttgtcatggggccaagtggagacagtccattgaaaaaagtggctgaagaaaggaatttgttaaatcagaaagatgcacattatggaggtagacaagcaacagcatcaagagcgtcaaatcgatcagcaaaaccatccattgtttcaatttcccctttatccacgttagaatcaaagtggctgcatcttgttgctattttatcagatggtaggcgaatgtacctttctacctccacatctagtggaagtaatagtactgttggaggtttgagtggatttaacaatcatcaccacaggccaagctgtttaaaagttgtaacaactaggccttcacctcctttaggcgtcagtggtggacttacctttggcgcaatgtctttggctggtaggactcagactgaggatctttcactgaaggtagaaacagcatactattctactggaactcttgtcctttctgattcttcaccaccaaccatgtcttctcttctcattgtgagcagagattcaagctcacagtcatctctgtcaggtaatttaggagcaagtgctcggagttcccgagcattacgagaatctgtttcttccttgcccgttgaaggccgaatgctctttgtggcagatgttcttcctttaccagatacagctgccactgtgttatccctgtattccgagcttgaattttgtggatctgaaagctcagttgagtcttgtgaaaaagcatcagggaagttgtgggctagaggtgacctttcaactcaacatatattgccaaggaggagaattgttattttcagcaccatgggcatgatggaagtagttttcaatcggcccgttgatattctgagaagattgttggagtcaaactctccaagaccaatattagaggatttctttaatcgttttggtgctggtgaagcagctgcaatgtgtttgatgctagctgcaaggatagttcattctgaaaatcttataagcaatgttgttgctgaaaaggcagctgaagcatttgaggacccaagaattgttggagtgccacaagttgaaggtaccagtggactatcaaatactagaactgctgctgggggtttcagcatggggcaggttgttcaggaggctgagccagtgttctcaggtgctcatgaagggctctgcctctgctcatcaaggttgctatttcctgtttgggagctccctgttatggttgtgaaaggtggttatgatgcagcatcggaaaatgggttgattgcatgcagactttctgttggggctatgcaagtccttgagaacaagactcgtgctttggagatattcttaaggtctagaaggaacaaaagaagagggctttatggatgtgtagctggtttaggtgacatgactggttctattctctatggaactggttcagaattaggtgctggtgataggagcatggttagaaacttatttggtgcttatttccggagtgtggagtctaatggtggtggaacgtccaataaaagacagcggttaccatatagtcccgctgaattggctgctatggaggtgagggcgatggaatgcatccggcagttgcttcttaggtctgctgaagctctgtttttactacagcttgtttctcagcatcatgtaacacgcttggttcagggatttgatgctaacatccgccaggaattggttcagttgacattccatcaacttgtttgttctgaggagggtgaccgccttgctacaagacttatttctgctttgatggagtattatactggccctgatggcagggggacagtggatgatataagtggtaaattacgtgagggttgtccaagctatttcaaggagtctgattataagtttttcttagctgtggaatgtcttgaaagagctgctgtaactcctgatcctgatgtgaaggaaaatcttgccagggaagcctttgatttcctaagtaaagttccagaatctgctgatttaagaactgtttgcaaacggtttgaggacttaagattttatgaggctgtggttcgcttacccctacagaaagctcaggcacttgatcctgcaggtgatgctttccatgaacaaattgagcaagcaatcagagattatgcaattgctcagcgtgaacagtgctatgagataattgctagtgctttacgttctctgaaaggtgagggctcacagagggaatttgggtctcctgctaggcctgttgcagtgcgatctgtccttgatcatgcttcacgaagaaaatatatatgccagattgttcagcttagtgttcaatcacctgacagattgtttcatgagtacttgtacagaactatgatcgatttaggtcttgagaatgagctgttggaatatgggggtcctgatttggtgccttttctgcagactgctggttgtgaacctgcacaagaggttcgagctctctctgcattgacatcagcaaccccttcagtgggtcaacctggagctcctattcattctaatcaagctaaatactttgatcttttggctcgatattatgtcttgaagcgacagcatttgcttgcagctcatgtattgttgaggctggctgaaagacgctcaattgatgggagcaatgctcctagtcttgaacagaggcgtcaatacctaagtaatgctgttctccaggccaagagtgctagtaacaatgatggtctggtagcttctaaccggggtgcttttgacagtggattgctggacttactagaagggaaacttgctgttcttcagtttcagataaaagtaaaagaggaactggaggcaatggctaccaggttagaagctacacctggtacatcagaatctgttcaaaatggatctgctgctgatagcaggtttaatggtgatgccaatttagcaaatgctgcacgagagaaggccaaggagttatcttcagatttgaagagcattactcagttgtataatgaatatgcagttccttttgaactttgggagatatgcctggaaatgttgtacttcgcaaactattcaggtgatgctgatagtagcattatccgagaaacttgggctagacttattgatcaagctcttttaagcggtggagttgctgaggcttgctccgttttgaagcgggttggttctaaagtttatccgggagatggagctgtattacctctggatactctatgccttcatctagagaaggctgcattggagagggtggaatctggaaccgaatctgttggggatgaagatgtggcaagggctcttctggctgcttgcaagggtgcagctgaacctactttgaacacttacgatcaattattatcaaatggggctattttgtcatcaccgaatctcagattacgccttcttcaatcagtgctagtggtacttcgagaatgggcaatgtctgtatttgcacagaggatgggcacgactgctgctggtgcttctttaatattaggtggagcattctcgccagaacaaacaatggttctaaaccaggggattcgggacaagatcactagtgcagcaaacaggtacatgacggaggtgaggagattgccacttccacagagtcggactgaggctgtttatagaggatttcgggaacttgaagaatctttaattgccccattttcttttgaccgattttgatagtttgttcggttcaaagttaaaacttggttttgttgttgtatgaataataaacaaattgtatcacatttcaaatttgctattcatttaatgaaaaagtgaattctctattgttcgtcgttgctttt

SEQ ID NO: 4963 - DNA, 3563 bp, Glycine max
cttaaaaaaaaaaaccctgcaacagggagacagcaaacgcagagagaaagtgatagaagctaacaaaaaccctacccatatttatgttattaggttcttcctccattgatccgagaagctaagcctcgcctactgtctagccctataaactaaaaacctttcctttcaattcccatccatccgtccacactgcaccgcccaactctgttcttcagaatatcatggatgatctggagagagcgattcttgttatgtttgatgaatcgggagccctcgacgatgacttgaagaaacaggctaaagtttactgtaacgatattaaggagaagccattaatttgtagattgtgcattgaaaaattatgcttttcaaatcttgttcaagtccagttttggtgcctacagaccttgcatgaggtcattcgaacgcgatacttgacaatgaccccagatgagaggcacatgatcaggggctccgtcttttcaattgtgtgcctcgaagacaagaacctcacaagggttttggaaggccctgcatttataaagaacaagcttgcacaggttttgataactttgatttacttcgagtaccctttggtttggtcctccgtctttgttgatttttttccacatttgagcaaaggaaacgtggtcatagacatgttctgtagagttttgaatgccctagatgatgagctcattagtttggactaccctagaacccctgaggagttggcagttgctggccgggttaaggatgcaatgagacagcagtgcgtgcctcagatagttagagcttggtatgacattgtttctatgtaccggaattctgatcatgagctatgcactagtgtgttagattccatgaggagatatatttcttggatagacattgggttgatagtcaatgatgctttcatccctttgttgtttgatttgattttggttggtcctctgtctgatcagcttcgtggtgcttcagtcagatgcttattagcagttgtttctaagcgaatggagcccgaatcaaaactgtcattgttgcaaagccttcaaattagtcgtgtacttaggttagtgaccgaggatgtcgatgttgagctggtctctgatatagctgcattgctttctgggtatgctgtggaggccttggattgctttaaacgcataaattctgaggatgctaaaggaatctctatggagcttttgagtgaagttttaccctccattttctatgtaatgaagaattttgaggtagatgttacattcaacatcattcagtttctttcaggttatgttgccatttttaagagctttgttcctttgccggagaagcagctacttcacctgggacagatattggaagttatccttgtgctaatccgttatgacccagtgcaccgcaccaatcttgatgtgatggacaaaattggtaaagaggaggaagataggatggtggagttcagaaaggatttatttgttctgcttcgcaatgtgggtcgtgtagcgcctgatgtaactcagttgtttatcagaaattcgttagcaagtgctgtttcaagatcttcagatagcaatgtggaggaggtggaaggtgcactttctcttttgtatgcacttggagaatccataagtgaggaagccataagaactgggagtgggttgttgagtgagctggtgcttatgcttctatcgacaaagtttccttgtcactctaataggcttgttgctcttgtttatttggagacagtgacaagatatattaagtttattcaggataatactcaatatattcccatggttctggctgcctttctcgatgaaagaggcatacatcattcaaacatcaatgtaagtcgtagagccagttatttgtttatgagggttgtaaagtttctgaagatgaagttggtgccttttatagagactattttgcagagcctgcaagatacagttgctcaattcactattatgaattatacgacagaagagctatcagggtcagaagatggtagccacatttttgaggcaattggtttattgattggaacagaagatgtcctgcctgaaaagcaatctgattatctatcttctttgctcagtcctctttgtcaacaggttgaggcactgctcataaatgccaagttattgaatgctgaggagactaatgccaaaattgctgtaatccagcaaattattatggcaattaattctctcagtaagggctttagcgagcgtcttgtaaccgctagtcgccctgcaattggtatcatgtttaagcagacattggatgtacttcttcaagttcttgttatatttccaaaagttgaacctctgcgaaacaaggtcacatcttttatacaccgcatggtggatacactaggagcatctgtctttccttaccttccaaaggcattggagcagttgcttgaagaaatcgaaccaaagcagatggttggttttcttttgttactcaatcaacttatctgcaaattcaatactttggtgcgtgacattttggaggaaatatttccatctatcgccgagcggatattcagtgttattcctagaaatggattaccttcttctggttctgatgcaatcactgaggaaattcgtgaattgcaagaacttcagcgaacattgtatacatttcttcatgtgattactacacatgacctgtctcctgtatttctttccccaaaatgtaaagcatacctggatccagtgatgcagttgcttttgtactcttcttgtaatcataatgatattcttgtaagaaaggcatgtgtacagatttttattagattaattaaagattggtgtgcccagccttatgaagaaaaggttcctggttttcgaagttttgtgattgaagcatttgctacaaactgctgtctgtacagtgtgctggacagatcttttgagtttcatgatgcaaatacttttgttttgtttggagaaattgtgctggcacagaaggtaatgtatgaaaaatttggggatgattttctcgtaaattttgtatcgaaaggattttcttctgcacattgcccaccagatcaggcagagcaatatcgtcaaaaattgcagggtggtgatttcaaggcactaaaatctttctatcagtcactagtggaaaatttgagagtgcagcagaatggaagccttgtgttcagatagcatacttgtatcggaaaaattaagagtcctcttcctatatgcctatgttttttggccgtatcctagtttggggcttgatttctgtttacataagggttgtgtatatagcttttgcggatgagcgatggatattctgcttgccctaattttgatgagttcctcatgcaacctgaccaatcaactaattgtttcaggtctttctatattctttttgtccctcctcaattgtaaattttttctattctctttaacagtggagttccatccatcggtttgaagcttgtcaatatgagatcaaattttggtgtttgatttctcaattctctttctccctgtaatatcgtatccgtttccgttatttatagatacgaattcggttta

SEQ ID NO: 4964 - DNA, 3776 bp, Glycine max
aatcccccttaaaaaaaaaaaccctgcaacagggagacagcaaacgcagagagaaagtgatagaagctaacaaaaaccctacccatatttatgttattaggttcttcctccattgatccgagaagctaagcctcgcctactgtctagccctataaactaaaaacctttcctttcaattcccatccatccgtccacactgcaccgcccaactctgttcttcagaatatcatggatgatctggagagagcgattcttgttatgtttgatgaatcgggagccctcgacgatgacttgaagaaacaggctaaagtttactgtaacgatattaaggagaagccattaatttgtagattgtgcattgaaaaattatgcttttcaaatcttgttcaagtccagttttggtgcctacagaccttgcatgaggtcattcgaacgcgatacttgacaatgaccccagatgagaggcacatgatcaggggctccgtcttttcaattgtgtgcctcgaagacaagaacctcacaagggttttggaaggccctgcatttataaagaacaagcttgcacaggttttgataactttgatttacttcgagtaccctttggtttggtcctccgtctttgttgatttttttccacatttgagcaaaggaaacgtggtcatagacatgttctgtagagttttgaatgccctagatgatgagctcattagtttggactaccctagaacccctgaggagttggcagttgctggccgggttaaggatgcaatgagacagcagtgcgtgcctcagatagttagagcttggtatgacattgtttctatgtaccggaattctgatcatgagctatgcactagtgtgttagattccatgaggagatatatttcttggatagacattgggttgatagtcaatgatgctttcatccctttgttgtttgatttgattttggttggtcctctgtctgatcagcttcgtggtgcttcagtcagatgcttattagcagttgtttctaagcgaatggagcccgaatcaaaactgtcattgttgcaaagccttcaaattagtcgtgtacttaggttagtgaccgaggatgtcgatgttgagctggtctctgatatagctgcattgctttctgggtatgctgtggaggccttggattgctttaaacgcataaattctgaggatgctaaaggaatctctatggagcttttgagtgaagttttaccctccattttctatgtaatgaagaattttgaggtagatgttacattcaacatcattcagtttctttcaggttatgttgccatttttaagagctttgttcctttgccggagaagcagctacttcacctgggacagatattggaagttatccttgtgctaatccgttatgacccagtgcaccgcaccaatcttgatgtgatggacaaaattggtaaagaggaggaagataggatggtggagttcagaaaggatttatttgttctgcttcgcaatgtgggtcgtgtagcgcctgatgtaactcagttgtttatcagaaattcgttagcaagtgctgtttcaagatcttcagatagcaatgtggaggaggtggaaggtgcactttctcttttgtatgcacttggagaatccataagtgaggaagccataagaactgggagtgggttgttgagtgagctggtgcttatgcttctatcgacaaagtttccttgtcactctaataggcttgttgctcttgtttatttggagacagtgacaagatatattaagtttattcaggataatactcaatatattcccatggttctggctgcctttctcgatgaaagaggcatacatcattcaaacatcaatgtaagtcgtagagccagttatttgtttatgagggttgtaaagtttctgaagatgaagttggtgccttttatagagactattttgcagagcctgcaagatacagttgctcaattcactattatgaattatacgacagaagagctatcagggtcagaagatggtagccacatttttgaggcaattggtttattgattggaacagaagatgtcctgcctgaaaagcaatctgattatctatcttctttgctcagtcctctttgtcaacaggttgaggcactgctcataaatgccaagttattgaatgctgaggagactaatgccaaaattgctgtaatccagcaaattattatggcaattaattctctcagtaagggctttagcgagcgtcttgtaaccgctagtcgccctgcaattggtatcatgtttaagcagacattggatgtacttcttcaagttcttgttatatttccaaaagttgaacctctgcgaaacaaggtcacatcttttatacaccgcatggtggatacactaggagcatctgtctttccttaccttccaaaggcattggagcagttgcttgaagaaatcgaaccaaagcagatggttggttttcttttgttactcaatcaacttatctgcaaattcaatactttggtgcgtgacattttggaggaaatatttccatctatcgccgagcggatattcagtgttattcctagaaatggattaccttcttctggttctgatgcaatcactgaggaaattcgtgaattgcaagaacttcagcgaacattgtatacatttcttcatgtgattactacacatgacctgtctcctgtatttctttccccaaaatgtaaagcatacctggatccagtgatgcagttgcttttgtactcttcttgtaatcataatgatattcttgtaagaaaggcatgtgtacagatttttattagattaattaaagattggtgtgcccagccttatgaagaaaaggttcctggttttcgaagttttgtgattgaagcatttgctacaaactgctgtctgtacagtgtgctggacagatcttttgagtttcatgatgcaaatacttttgttttgtttggagaaattgtgctggcacagaaggtaatgtatgaaaaatttggggatgattttctcgtaaattttgtatcgaaaggattttcttctgcacattgcccaccagatcaggcagagcaatatcgtcaaaaattgcagggtggtgatttcaaggcactaaaatctttctatcagtcactagtggaaaatttgagagtgcagcagaatggaagccttgtgttcagatagcatacttgtatcggaaaaattaagagtcctcttcctatatgcctatgttttttggccgtatcctagtttggggcttgatttctgtttacataaggtaattatgattgtgtttgatgaaatcaagtttgaggtctcttccatttttattttatttttcccaatcacttgtaaaatttccccctcaatagtgcggtcatgaaacggtgaacactgcagggttgtgtatatagcttttgcggatgagcgatggatattctgcttgccctaattttgatgagttcctcatgcaacctgaccaatcaactaattgtttcaggtctttctatattctttttgtccctcctcaattgtaaattttttctattctctttaacagtggagttccatccatcggtttgaagcttgtcaatatgagatcaaattttggtgtttgatttctcaattctctttctccctgtaatatcgtatccgtttccgttatttatagatacgaattcggtttattcgtttgtctttggaggttaaaattatgttccgcacaatgttactcccttcggtcacttaataagatttttttgttttaccta

SEQ ID NO: 4965 - DNA, 3615 bp, Cajanus cajan
atattatggatgatcttgagaaagcgattcttattatatttgatgaatcgggagccattggcgatgacttgaagaaacaggctaaagtttattgtaacgatattaaggagaagccttcaatttgtagattgtgcattgaaaaattatgcttttcaaatcttgttcaagtccagttttggtgcctacagacattacatgaagtcattcgaacacgatacttgacaatggcccctgatgagaggcacatgatcaggggctccgtgttttcaattgtgtgccttgaagacaagaacctgactagggttttggaaggccctgcatttataaagaacaagcttgcacaggttttgataactttgatttacttcgagtaccctttggtttggtcctccgtctttgttgatttttttccacatttgagcaaaggaaacgtggttatagacatgttctgtagagttttgaatgctctggatgatgaattgattagtttggactaccctagaacttccgaggagttgacagttgctagccgggttaaagatgcaatgagacagcagtgtgtgactcagatagttagagcttggtatgatattgtttctatgtacaggaattcagatcaagagctgtgcactagtgtgttagattccatgaggagatatatttcttggatagacatcacgttgatagtcaatgacgctttcatcccgttgctgtttgatttgattttggttggtcctctatctgatcagctgcgtggtgctgcactcagatgcttgttagcagttgtttctaagcgaatggatccccaatcaaaactgtcactgttacaaagccttcaaattagtcgtgtacttaggttagtgactgaggatggtgatgccgaactagtctctgatatagctgcattgcttactgggtatgctgtggaggccttggattgctttaaacgcataaattctgaggatgctaaaggaatctctatggagcttttgagtgaagttttaccctccattttctatgtaatgaagaattttgaggtagatgctacattcaatatctttcagtttctttcaggttatgttgccattttgaagagctttgctcctttgcgggagaaacagctacttcacctggggcagatattggaagttatccttgtgctaatccgttatgacccagcataccgcactaatcttgatgtgatggacaaaattggtaaagaggaggaagataggatggtagagttcagaaaggatttatttgttctgcttcgcactgtgggtcgtgtagcgcctgatgtaactcagttgtttatcagaaattcattagcaagtgctgtttcaagatcttcagatagcaatgtggaggaggtggaaggtgcactctctcttttatatgcacttggagaatccataagtgaggaagccataagaactggcagtggattgttgagtgagctggtgcttatgcttctatcgacaaagtttacttgtcactctaataggcttgttgcccttatttatttggagacagttacacgatatgttaagtttattcaggataatagtcaatatattcctatggttctggctgcctttcttgatgaaagaggcatacatcatccaaacatcaatgtaagtcgtagagccagttatttgtttatgagggttgtaaaattgctgaagatgaagttggtgccttttatagagacaattttgcagagcctgcaggatacagtcggtcaattcactattatgagttatacgacagaagagctatcagggtcagaagatggtagccacatttttgaggcaattggtttattgattggaacagaagatgtcctgcctgaaaagcaatctgattatctatcttctttgctcagtcctctttgtcagcaggttgaggcattgctcataaatgccaagttattgaattgtgaggagactaatgccaaaattgctgtaatccagcaaattatcatggcaattaattctctcagtaagggctttagcgagcgtcttgtaactgctagtcgccctgcaattggtctcatgtttaagcagacactggatgtacttcttcaagttcttgttatatttccaaaagtagaacctctgcgaaacaaggtcacatcttttatacaccgcatggtggatacactaggagcatctgtctttccttaccttccaaaggcattggagcagttgcttgaagaaattgaaccaaagcaaatggttagctttcttttgttactaaatcaacttatctgcaagttcaatacttcggtgcgcgacattttggaggaaatatttccagctgttgctgagcggatattcagtgttattcctagaaatgaattaccttctggtcctgatgcaatcactgaggaaattcgtgaactgcaagaacttcagcgtacattgtatacatttcttcatgtgattactacacatgatctgtctcctgtatttctttccccaaaatgtaaagcatacatggatccagtgatgcagttgattttgtactcttcttgtaatcataaggatattcttgtaagaaaggcatgtgtacagatttttataaggttaattaaagattggtgtgccctgccttatgaagaaaaggttcctggttttcgaagttttgtgattgaagcatttgctacgaactgctgtttgtacagtgtgctggacagatcttttgagttccatgatgcaaatacttatgttctatttggagaaattgtgctggcacaaaaggtaatgtatgaaaaatttggggatgattttcttgttcattttgtgtcaaaaggattttcttctgcacattgcccaccagatctggcagagcaatatcgtcaaaaattgcagggtggtgatttcaagactctaaaatctttctataagtcactagtggaaaatttgagattgcaacagaatggaagccttgtgttcagatagcatacttgtattgaaaaaacttatcgattcctcttcctatatggctttattttttggccgtctcctagtttagggtttgatatctgtctgtctacagaagacagaaggtaattatgcttgtttttgacgatatcaagtttgagctctattcaatcacaagtaaaatttccccctcaatagtgcggtcatggaacggtagtgaacactgcagggttgtgtatatagcatttgcggatgagcgattgatattctcctggccctaattttgctgagttcctcgtgcaacttgaccgacaatcagctaattgtttcaggtcttcctttattcattttgtcccacagttgtaaatttttcgtattctctttaacattggagttccatccatcggtttgaagcttgttaatatgagatcaaaattttggtgtttgatttcacgagtcttcctttccccatgtaaaatcgtttccgtttccattaagatttattcgtttgtctttggatgttgaaatttcggtcgacattattgagcttgtgttcgattactacaaatatggtaagttatattccaatttccaaactaatgttattaaacttgtaattgtaatcaacttgaccaaagtatttggagtttgatacgagtattacagttat

SEQ ID NO: 4966 - DNA, 3596 bp, Phaseolus vulgaris
aaaacaaaaccttgaacagcagacacagagagaaagggacagaagcgaaggaaaaaccctaccctaacccataacccatatttatgttattaggttcttcctccattgattgatccgtaactcaaaacctgcccttgccgagacccatccttccacaccccacaactccactctttagaacaacaccatggatgatctcgagaaagggattcttattatgtttgatgaatctggtgcccttgacgatgacttgaagaaacaagccaaactttactgtaactctattaaggagaagccatcaatttgtagactttgcattgaaaaattatgcttttctaatcttgttcaagtccagttttggtgcctacagaccttacatgaagtcattcgaacccggtacttgacaatgaccccagatgaaaggcacatgatcaggggctccgtcttttcaattgtgtgcctcgaagacaagaacctcacaagggttttggaaggccctgcctttataaagaacaaacttgcacaggttttgataactttgatttacttcgattaccctttggtttggtcctccgtctttgttgatttttttccacacttgaacaagggaaacgtggtcatagacatgttctgtcgagttttgaatgccctggatgatgaattgattagtttggactaccctagaacccaggaggagttgactgttgcgagccggattaaagatgcaatgagacagcagtgtgtctctcagatagtcagggcttggtatgacattgtttccatgtaccggaattctgatcaagaactatgcactagtgtgttagactccatgaggagatatatttcttggatagacattgggttgatagtcaatgatgcttttatccctttgttgtttgatttgattttggttggttctctgtctgatcagcttcgcggtgctgcagtcagatgcttgtcggcagttgtttctaagcgaatggagccccaatccaaactgtcgttgttgcaaagccttcatattagtcgtgtagttaggttagtgaccgagaatgatgatgccgagctggtctctgatgtagctgcattgcttactgggtatgctgtagaggccttggattgcttcaaacgcataaattctgaggatgctaaaggaatctctatggagcttttgagtgaagttttaccctccattttctatgtaatgaagaattttgaggtagattctacattcaacattattcaatttctttcaggttatgtttccattttgaagagcttttctcctttgcgggagaaacagctacttcatcttgggcagatattggaagttatccttgtgctaatccgttataaccaagcataccgtgctaatcttgatgtgatggacaaaattggtaaagaggaggaggataggatggtagagttcagaaaggatttgtttgttcttcttcgcactgtgggtcgtgtagcacctgatgtaactcagatgtttattagaaattcgttggcaagtgctgtttctagatcttcaaatagcaatgtggaggaggtggaaggtgcactttctcttttatatgcacttggagaatccataagtgaggaagccatgaaaactgggagtggattgttgagtgagctggtgcttatgcttctatctacaaagtttccttgtcactctaataggcctgttgcccttgtttacttggagacagtgacaagatatgttaagtttattcaggataatactcaatatattccaatggttctggctgcctttcttgatgaaagaggcatacatcattcaaacatcaatgtaagtcgtagagccagttatttgtttatgagggttgtaaaattgctgaagatgaagttggtgccttttatagagactattttgcagagcctgcaagacactgttgcccaattcactattatgaattatacggcagaagagctttcagggtcggaagatggtagccacatttttgaggcaattggtttattgattggaacagaagatgtccagcctgaaaagcaatctgattatctttcttctttgctcagtcctctttgtcagcaggttgaggcattgcttataaatgccaagttattgaatgttgaggaggctaatgccaaaattgctgtaatccagcaaattatcatggcaattaattctctcagtaagggctttagtgagcgtcttgtaactgctagtcgcccagcaattggcctcatgtttaagcagacactggatgtacttcttcgagttcttgttacatttccaaaagtagagcctctgcgaaacaaggtcacttcttttatacatcgtatggtggatacactaggagcatctgtctttccttaccttccaaaggcattggagcagttacttgaagaaattgaaccaaagcaaatggtttgttttcttttgttactcaatcaacttatctgcaagttcaatactttggtgcgtgacattttggagcaaatatttccagctgttgctgagcggatattcagtgttattcctagaaatgggttaccttctactggtcctgatgcaatcactgaggaagttcgtgaattgcaagaacttcagcgaacattgtatacatttcttcatgtgattactacccatgacctgtctcctgtatttcttgtcccaaaatgtaaagcatacctggatccagtgatgcagttgcttttgttctcttcttgtaatcataaggatatccttgtaagaaaagcatgtgtacagatttttattagattaattaaagattggtgtgcccagccttacgaggaaaaggttcctggtttccgaagttttgtgattgaagcatttgctacaaactgctgtttctacagtgtgctggacagatcttttgagtttcatgatgcaaatacttttgttttgtttggagaaattgtgctggcacagaaggtaatgtatgagaaatttggggatgattttctcgttcattttgtatcaaaaggattatcctctgcacagtgcccacaagatctggcagagcaatatcgtcaaaagttgcagagtggagatttaaaggcactaaaatctttctaccagtcagtagtggaaaatttgagactacagcagaatggaagccttgtattcagatagcatacacttgtattggaaaaattagcgaggcctcttcctatatatataaatatggctttgttttttggccgtctcctagtttggggtttgatttctttctacagaaggtagttacgatttgtttttgatgaaatcaagtttgatttaatttttgaatgaccagtaaatgttggccctcaatagtgaggtgatgaaacggtggggcactctgcagagttgtgtatatagctttgacgtcttcctcatgcaacctcaccacccagctctttattctttttgtcccacatttgtaaatttttcctattctcttaacattaacactccacctccacccatcggtttcaagcttgtcaatatgaggttcaaattttggttttcctattctgtttactccctaattacaatcacatttctgcccatatatatttaaaaactacatttgtcgcat

SEQ ID NO: 4967 - DNA, 3311 bp, Trifolium pratense
attctattgacctagaaagttgaacgctaccgtcaaaagctttccttgctttttgcagaaatcgattgatcgaataatatggacgacttggaaaaagggattcttatcatgtttgatgaatggggagctatagacgatgaattgaagaaacaggctaaaagttattgcagcaatattaaggagaagccatcggtttgtagattatgcattgaaaaattatgctgttcaaatcttgttcaagtccaattttggtgcttacagaccttacatgaagtcattcggacacggtactcgacaatatcaccggaagagaagcacatgatcaggggcactgtcttttcaatagtttgtctcgaagacaagaacccaataagggttttagaaggccccgcatttattaaaaacaagcttgcacaggtttttatagctttaatttacttcgagtatcccttgatttggtcctccgtctttgttgatttcttaccccatctacgcaagggtaacgtggtcatagacatgttctgtagagttttgaatgcacttgacgatgaattaattagtttggactaccctagaacccctgaggagttgacagttgccggtagggttaaagatgcaatgagagagcagtgtgtatcccagatagtgagagcttggtatgacatcatttctatgtaccgtaattccgatcaagacctatgcaccactgttttagattccatgaggaggtatatttcttggatcgacatcagcttgatcttcaatgatacttttctccctttgttatttgatttgattttggttggtgccccatctgatcagctccgaggtgcttctgtcagatgcttgttagcaatagtttctaagcgaatggagccccaatcaaaactctctttgttgcaaagtcttcaaattactcgtgtgtttaggttggtcactgaggatggcaatgcagaactggtccctgacatagctgcattgctttctgggtatgctgttgaggccttggattgctttaaacgcataagttctgaggatgctaaacgaatctctatggagcttttgaatgaagttctaccatccattttttatgtaatgaagaactttgagatagatgctacattaaatatcgttcagtttctatcaggttatgtttctacattgaagagccttactcctttgagcgagaaacatatacttcatgtggggcagatattggaagttattcttgtgctaattcgttatgatcctgtataccgtactaatcttgatgtgatggacaaaattggaaaagaggaggaagataggatgaccgagttcagaaaggatttatttgttctacttcgcactgtgggtcgagtagcccctaatgtaactcaattgtttatcagaaattcattaggaagtgctatttcaagaccatcagatagcaatgtggaggaggtggaaggtgcactttctcttttatatgcacttggagaatccttgagcgaggaagccataagaactgggagtggattattgagtgagctgttgcttatgcttctatcaacaaagtttccttgtcattctaataggctagttgctcttgtttacttggagacagtgacaagatatgttaagtttatccaggacaatgctcaatgtattcctattgttttggctccctttcttgatgagaggggcatacatcatccaaacaatagtgtaagccgcagggccagttatttgtttatgagggttgtgaaactgctgaaggtgaagttggtgcctttcattgcagtgattttgcagagcctacctgatacagttgctcggttcactactatgaattatacaacagaggagatatcgggctcagaagatggtagccacatttttgaggcaattgggttattgattggaatggaagatgtcccacctgaaaagcaatctgattatctctcttctttgctcagccctctttgtcagcaggttgaggcgctgctgagaaatgctaaatcgttaagttatgaggagtctaaagccagaattgctgtaatccagcaaattatcatggcaattaattctctcagcaagggcttcagcgagcgtcttgttactgctagtcgccctgcaattggcaacatgtttaagcagacattagacgttcttctccatgttcttgttatatttccaagagtagaacctctgcaaaacaaggtcacatcatttatacaccgcatggtggatacactaggagcatctgtccttccttaccttccaaaggcacttgaacagttacttgcagaaactgagccaaagcaaatgtctggttttcttttgttgctcaatcaactcatctgcaagttcaatattttggtgcgtgacattttggaggaaatatttccatctgttgctgatcggatattcagagttatcccaagagagggattaccttcaggtcctgatgcagtcaccgaggaaattcgtgaattacaagaacttcagcgaacattgtatacatttcttcatgtgattgctacacatgatctgtcaactgtatttattgccccaaaatgtaaagcatacctggacccagtgatgcaattgcttttttactcttcgtgtaatcataaggatgttcttctaagaaaggcatgtgtgcagatttttattagattaattaaagattggtgtgcccagccatatgaagaaaaggttcctggtttccgaagttttatgatcgaaacatttgctacaaactgctgtttgtacagcgtgctggacagatcttttgatttccgtgatgcaaacactcttgttttatttggagaaattgtggttgcacagaaggtcatgtatgacaaatttggggatgattttctcgttcattttatatcaaaaggattttctgttgcacattgcccgccagatcttgctgaacaatatcgtcaaaagttgcagggtactgatatcaaggcactaaaatctttctatcagtcactcgtagaaaatttgagactgcagcagaatggaagccttgtgtttagatagcatatatattttaaaacggacaaatttcgagtcttcgttctgtacgggcttattttctggccgacttctagcacggggtaatgatttcggtctacaaaagtgctgtgtatatagcttttgcggatgagctacggataatctcttggccctatttttgatgagttcctctgcaatctgaccaataactaaattgtctcaggtctttctttattcttttgtcctactgttgtaaattttgggaattctcttattacaatggggttacttctgtctgt

SEQ ID NO: 4968 - DNA, 3572 bp, Cicer arietinum
aaaatgtttgggcgagaagggagaaacaacccagcgaaagcaacataaaccctaggcttcatattctagttctactgatcttgaaactagaaaggtgaacagtatcatcaaaaactttcgttgttaatctaaatcacagttgcagaaatcgattgatcgaataatatggatgacttggaaaaagggattcttattatgtttgatgaatcgggagctatagatgatgaattgaagaaacatgctaaaagttattgcagcgatattaaggaggaggcttccgtttgtagaatatgcattgaaaaactatgttgttcaaatctcgttcaagtccaattttggtgcctacagacattgcatgaagtaattcagacccgatactcgacaatatccccggaagagaagcacatgatcaggggcactgtggtttcaattgtgtgtctcgaagacaagaaccgaataagggttttagaaggacccgcatttataaaaaacaagcttgcacaggttttgatagctttgatttacttcgagtaccccttgatttggtcatccgtctttgtcgattttttaccccatttacgcaagggcaacgtcgtcatagacatgttctgtagagttttgaatgccctcgatgatgaattaattagtttggattaccctagaacccctgaggagttgacagttgccgggagggttaaagatgcaatgagacagcagtgtgtatcccaaattgtgagagcttggtatgacattatttctatgtaccggaattctgatcaagagctatgcaccaatgtgttagattccatgaggaggtatatttcttggatcgacattgggttgatcgtcaatgatgcctttgtccctttgttatttgatttgattttggttggtgccccgtctgatcagctccgagctgctgcagtcagatgtttgttagctgtagtttctaagcgaatggagccccaatccaaactgtcattgttgcaaagccttcacattagtcgtgtatttaggctggtgaccgaggatggcaatgccgagctggtccctgacatagctgcattgctttctgggtatgccgtggaggccttggattgcttcaaacgcataagttctgatgatgccaaaggaatctctatggagcttttgaacgaagttctaccatccgttttctatataatgaagaactttgaggtagatgctacttttagtatcgttcagtttctattaggttatgtttctacgatgaagggccttactcctttgagtgagaaacatatgcttcacatggggcagatattggaagttgtccttgggctaatccgttatgaccctgtataccgtactaatctcgatgtgatggacaaaattggaaaagaggaggaagatagaatgacagagtttagaaaggatttatttgttctacttcgcactgtgggtagggtagccccaaatgtaactcaattgtttatcagaaattcgttagcaagtgctatttcaatatcatctgatagcaatgtagaggaggtggaaggtgcactttctcttttatatgcacttggagaatccttgagtgaggaatccataagaactgggaatgggttattgagtgagctgctgcttatgcttctatcaacaaagtttccttgtcattctaataggctagttgctctcgtttacttggagacagtgacgagatatgttaagtttattcaggataatactcaatgtattcctatagttctggctccttttcttgatgaaaggggcatacatcatccaaacatcagcgtaagccgtagggccagttatttgtttatgagggttgtgaaattgctcaaggtgaagttggtgcctttcattgcggtgattttgcagagcctacccgatacagttgctcggttcactactatgaattatacaactgaagagctatcagggtcagaagatggtagccacatttttgaggcaattgggttattgatcggaatggaagatgtcccacctgaaaagcaatctgattatctatcgtcattgctcagtcctctttgccagcaggttgatgcactgctgagaaatgctaaattgttaagttatgaggagactaatgccagaattgctgtaattcagcaaattatcatggcaattaattctcttagcaagggcttcagtgagcgtcttgtaacagctagtcgccctgcaattggcaacatgtttaagcagacattagatgtacttctccatgttcttgttatatttccaagagtagaacctctgcaaaacaaggtcacatcatttgtacaccgcatggtggacacactaggagcatctgtctttccttaccttccaaaagcacttgagcaattacttgcagaaactgagccaaagcaaatgtctggttttcttttgttgctcaatcaactcatctgcaagttcaaaattttgatgcgtgacattttagaggagatatttccacctgtcaccgatcggatattcagtgttattccaagagagggattaccttcaggtcttgatgcaatcactgaggaaatccgtgaattgcaagaacttcagcggacgttgtatacatttcttcacgtgattgctacacatgatctgtcaactgtattaatttccgcaaaatgtaaagcatacctggatccagtgatgcaattgcttttttactcttcgtgtaatcataaggatattcttgtaaggaaggcatgtgtgcaaatttttattagattaattaaagattggtgttcccagccatatgaagaaaaggttcctggttttcgaagttttgtgattgaaacatttgctacaaactgctgtttgtacagtgtgctggacagatcttttgatttccgtgatgcaaatactcttgttttgtttggagaaattgtggttgcacagaaggttatgtatgacaaattcggggatgactttctcgtttattttatatcaaaaggattttctgctgcacattgcccaccagatctggccgaacagtatcgtcaaaagttgcagggtaccgatatgaaggcactaaaatctttctatcagtcactcatagaaaatttgagactgcagcagaatggaagccttgtttttagatagcatatacttataatggacaaattacgagtcatcgggcttagtttctggccgtcttcaagtacggggtaatgatttgagtctacaaaaggtaattgattgtttgtgattatattaattttgagctctcactatcattttatttatttacttttaatcctcccttctcccaaataaaatagtcacggaactgtggtaaatactgcagtgtctcgtgtatatagcttttgcggacgagctacgggataagtctcttgccctatttttgattagttcctctgcaacctgatcaatcagtaaaattttctcaggtctttctttattctttggtcccacagttgtaaattttgggaattcttttattacattagagatccttctgcctgattgaaacctgtctatataagataaaaattttggtatttgattttcagtcttttttctcccgtcga

SEQ ID NO: 4969 - DNA, 3247 bp, Trifolium pratense
ccattatactccattctattgacctagaaagttgaacgctaccgtcaaaagctttccttgctttttgcagaaatcgattgatcgaataacatggacgacttggaaagagggattcttatcatgtttgatgaatggggagctgtagacgatgaattgaagaaacaggctaaaagttactgcagcaatattaaggagaagccatcggtttgtagattatgcattgaaaaattatgctgttcaaatcttgttcaagtccaattttggtgcctacagactttacatgaagtaattcggacacggtactcgacaatatcaccggaagagaagcacatgatcaggggcactgtgttttcaatagtgtgtctcgaagacaagaacccggtaagggttttagaaggccccccatttattaaaaacaagcttgcacaggtttttatagctttaatttacttagagtatcccttgatttggtcttccgtctttgttgatttcttaccccatctacacaagggtaacgttgtcatagacatgttctgtagagttttgaatgcacttgatgatgaattaattagtttggactatcctagaacccctgaggagttgacagttgccggtagggttaaagatgcaatgagagagcagtgtgtgtcccagatagtgagagcttggtatgacatcatttctatgtaccgtaattccaatcaagacctatgcaccattgttttagattccatgaggaggtatatttcttggatcgacatcggcttgatcttcaatgatacttttctccctttgttatttgatttgattttggttggtgccccatctgatcagctccgaggtgcttctgtcagatgcttgttagcaatagtttctaagcgaatggagccccaatcaaaactctctttgttgcaaagtcttcaaattactcgtgtgtttaggttggtcactgaggatggcaatgcagaactggtccctgacatagctgcattgctttctgggtatgctgttgaggccttggattgctttaaacgcataagttctgaggatgctaaacgaatctctatggagctcttgaatgaagttctaccatccgttttccatgtaatgaagaattttgaggtagatgctacattaaatatcgttcagtttctatcaggttatgtttctacattgaagagccttactcctttgagcgagaaacatatacttcatgtggggcagatattggaagttattcttgtgctaattcgttatgatcctgtataccgtactaatcttgatgtgatggacaaaattggaaaagaggaggaagataggatgaccgagttcagaaaggatttatttgttctacttcgcactgtgggtcgagtagcccctaatgtaactcaattgtttatcagaaattcattaggaagtgctatttcaagaccatcagatagcaatgtggaggaggtggaaggtgcactttctcttttatatgcacttggagaatccttgagcgaggaagccataagaactgggagtggattattgagtgagctgttgcttatgcttctatcaacaaagtttccttgtcattctaataggctagttgctcttgtttacttggagacagtgacaagatatgttaagtttatccaggacaatgctcaatgtattcctattgttttggctccctttcttgatgagaggggcatacatcatccaaacaatagtgtaagccgcagggcaagttatttgtttatgagggttgtgaaactgctgaaggtgaagttggtgcctttcattgcagtgattttgcagagcctacctgatacagttgctcggttcactactatgaattatacaacagaggagatatcgggctcagaagatggtagccacatttttgaggcaattgggctattgatcggaatggaagatgtcccacctgaaaagcaatctgattatctctcttctttgctcagccctctttgtcagcaggttgaggcgctgctgagaaatgctaaatcgttaagttatgaggagtctaaagccagaattgctgtaatccagcaaattatcatggcaattaattctctcagcaagggctttagcgagcgtcttgtaactgctagtcgccctgcaattggcaacatgtttaagcagacattagacgttcttctccatgttcttgttatatttccaagagtagaacctctgcaaaacaaggtcacatcatttatacaccgcatggtggatacactaggagcatctgtccttccttaccttccaaaggcacttgagcagttgcttgcagaaactgagccaaagcaaatgtctggttttcttttgttgctgaatcaacttatctgcaagttcaatattttggttcgtgacattttggaggaattatttccatctgttgctgatcggatattcagtgttatcccaagagagggattaccttcaggtcctgatgcagtcaccgaggaaattcgtgaattacaagaacttcagcgaacattgtatacatttcttcatgtgatcgctacacatgatctgtcaactgtatttattgctccaaaatgtaaagcatacctggacccagtcatgcaattgcttttttactcttcgtgtaatcacaaggatgttcttctaagaaaggcatgtgtgcagatttttattagattagttaaagattggtgtgcccagccatatgaagaaaaggttcctggtttccgaagttttatgatcgaaacatttgctacaaactgctgtttgtacagcgtgctggacagatcttttgatttccgtgatgcaaatactcttgttttgtttggagaaattgtggttgcacagaaggtcatgtatgacaaattcggagatgattttctcgttcattttatatcaaaaggattttctgttgcacattgcccgccagatcttgctgaacaatatcgtcaaaatttgcagggtagcgatatcaaggcactaaaatctttctatcagacactcgtagaaaatttgagactgcagcagaatggaagccttgtgtttagatagcatatattttaaaatggacaaattttgagtcttcgtcctatacaggcttattttctggtcgacttctagcacggggtaatgatttcggttttcgaaagtgctgtgtatatagcttttgcggatgagctacggataatctcttggccctatttttgatgagttcctctgcaatctgaccaataactaaattgtctcaggt

SEQ ID NO: 4970 - DNA, 3328 bp, Trifolium pratense
aagctttccttgtttttgcagaaatcgattgatcgaataacatggacgacttggaaagagggattcttatcatgtttgatgaatggggagctgtagacgatgaattgaagaaacaggctaaaagttactgcagcaatattaaggagaagccatcggtttgtagattatgcattgaaaaattatgctgttcaaatcttgttcaagtccaattttggtgcctacagactttacatgaagtaattcggacacggtactcgacaatatcaccggaagagaagcacatgatcaggggcactgtgttttcaatagtgtgtctcgaagacaagaacccggtaagggttttagaaggccccccatttattaaaaacaagcttgcacaggtttttatagctttaatttacttagagtatcccttgatttggtcttccgtctttgttgatttcttaccccatctacacaagggtaacgttgtcatagacatgttctgtagagttttgaatgcacttgatgatgaattaattagtttggactatcctagaacccctgaggagttgacagttgccggtagggttaaagatgcaatgagagagcagtgtgtgtcccagatagtgagagcttggtatgacatcatttctatgtaccgtaattccaatcaagacctatgcaccattgttttagattccatgaggaggtatatttcttggatcgacatcggcttgatcttcaatgatacttttctccctttgttatttgatttgattttggttggtgccccatctgatcaactccgaggtgctgccgtcagatgcttgttagcaatagtttctaagcgaatggagccccaatcaaaactgtctttgttgcaaagccttcaaattactcgtgtgtttaggttggtcactgaggatggcaatgcagaactggtccctgacatagctgcattgctttctgggtatgctgtagaggccttagattgctttaaacgcataagttctgaggatgctaaacgaatctctatggagctcttgaatgaagttctaccatccgttttccatgtaatgaagaattttgaggtagatgctacattaaatatcgttcagtttctatcaggttatgtttctacgttgaagagccttactcctttgagcgagaaacatatacttcatctggggcagatattggaagttattcttgtgctaattcgttatgatcctgtataccgtactaatcttgacgtgatggacaaaattggaatagaggaggaagataggatgaccgagttcagaaaggatttatttgttctacttcgcactgtgggtcgagtagcccctaatgtaactcaactgtttatcagaaattcattaggaagtgctatttcaagaccatcagatagcaatgtggaggaggtggaaggttcactttctcttttatatgcacttggagaatccttgagtgaggaagccatacgaactgggagtggattattgaatgagcttttgcttatgcttctttcaacaaagtttccttgtcattctaataggctagttgctcttgtttacttggagacagtgacaagatatgttaagtttatccaggacaatgctcaatgtattcctattgttttggctccttttctcgatgagagaggcatacatcatccaaacaatagtgtaagccgcagggcaagttatttgtttatgagggttgtgaaactgctgaaggtgaagttggtgcctttcattgcagtgattttgcagagcctacctgatacagttgctcggttcactactatgaattatacaacagaagagatatcaggctcagaagatggtagccacatttttgaggcaattgggctattgatcggaatggaagatgtcccacctgaaaagcaatctgattatctctcttctttgctcagccctctttgtcagcaggttgaggcgctgctgagaagtgctaaattgttaagttatgaggagtctaaagccagaattgctgtaatccagcaaattatcatggcaattaattctctcagcaagggctttagcgagcgtcttgtaactgctagtcgccctgcaattggcaacatgtttaagcagacattagacgttcttctccatgttcttgttatatttccaagagtagaacctctgcaaaacaaggtcacatcatttatacatcgcatggtggatacactaggagcatctgtccttccttaccttccaaaggcacttgagcagttgcttgcagaaactgagccaaagcaaatgtctggttttcttttgttgctgaatcaacttatctgcaagttcaatattttggttcgtgacattttggaggaattatttccatctgttgctgatcggatattcagtgttatcccaagagagggattaccttcaggtcttgatgcagtcactgaggaaattcgtgaattacaagaacttcagcgaacattgtatacatttcttcatgtgatcgctacacatgatctgtcaactgtatttattgctccaaaatgtaaagcatacctggacccagtcatgcaattgcttttttactcttcgtgtaatcacaaggatgttcttctaagaaaggcatgtgtgcagatttttattagattagttaaagattggtgtgcccagccatatgaagaaaaggttcctggtttccgaagttttatgatcgaaacatttgctacaaactgctgtttgtacagcgtgctggacagatcttttgatttccgtgatgcaaatactcttgttttgtttggagaaattgtggttgcacagaaggtcatgtatgacaaattcggagatgattttctcgttcattttatatcaaaaggattttctgttgcacattgcccgccagatcttgctgaacaatatcgtcaaaatttgcagggtagcgatatcaaggcactaaaatctttctatcagacactcgtagaaaatttgagactgcagcagaatggaagccttgtgtttagatagcatatattttaaaatggacaaattttgagtcttcgtcctatacaggcttattttctggtcgacttctagcacggggtaatgatttcggttttcgaaagtgctgtgtatatagcttttgcggatgagctacggataatctcttggccctatttttgatgagttcctctgcaatctgaccaataactaaattgtctcaggtctttctttattcttttgtcctactgttgtaaattctgggaattctcttgttacaatggggttacttctgtgtctgtttgaagcgtgtcaatataagatcaaaattttggtattgatattttagtcttcct

SEQ ID NO: 4971 - DNA, 3481 bp, Medicago truncatula
tttggggcgagaaccgggagaaacaaacataaaccctagccttctttcttcgtatgcttcttctttctattgattgagtgatccatccatcgattgattgatcgaagttacagtaatatcaaatatggatgacttagaaaaagggattcttattatgtttgacgaatctggagctatagacgatgaattgaagaatcaagctaaaacttattgcacagatgttaagcagaagccttctgtttgtagactgtgcattcaaaagttatgctcttcaaatctcgttcaagttcagttttggtgtcttcagactttgcatgaactcattcagactcgatactccgcaatacccccggaggagaagcacgccataagaaccaccgtcttttcaattgcgtgtctcgttgttgtcgaagacaacaacaataacactccaattagggttttagaagccgcccctgctttcatcaaaaacaagcttgctcaggttttgattgctttaatttactacgagtaccccttgatttgctcatccttcttccttgattttttaccacatctacgcaagggcaatgtcgtcattgatatgttctgcagagttctcaatgctctcgacgacgaattaattagtatggattaccctagaacccctgaagaggtcactgttgccaatagggttaaagatgctatgagagagcaatgcgtttcccagattgtcagagcttggtatgacattctttctatgtaccgcaattctgatcagcacttatgcatcactgtcttagactcaatcaggaggtttatttcttggatcgacatcgctttcatcttcaatgatacttttctccctttcttgtttgatttcattttggttaccaccacatctgatcaccttcgagctgctgctgtcagatgcttgttagcaattgtttctaagcgaatggagtcccaatctaaactctcattgttgcaaacccttcaaattactcgtgtatttaggttgctcaccgacgatgccaatgccgaccttgtccctgacatagctgctttgctttctggctatgctacggaggccttggattgctttaaacgcataacttctgaggatgctaaaggaatctctatggagcttctcaatgaagttctgccctccgttttctatgcaatgaagaattttgagctagacaccactacattgaatatcgttcagtttctatcaggttatgcttctacgttgaagacccttgctcctttgagcgagaaacatatacttcatgtggggcagatattggaagttatccttgtactaatccgttatgatcctgtataccgtaccaatctcgatgtcatggataaaattggaaaagaggaggaagataggatgacagagttcagaaaggatttatttgttctacttcgtaccgtgggtcgagtagcccctgatgtaactcaattgtttatcagaaattcgttagcaagtgctatttcaagatcatcagacagcaatgtggaggaggtggaaggtgcactttctcttttatatgcacttggagaatccttgagtgaggaagccgtaagaaatgggaatggattattgagtgaactgttgtttatgcttctatcgacaaagtttccttgccattctaataggctagttgctcttgtttacttggagacagtgacgagatatgttaagttgattcaagacaatgctcaatgtattcctattgttttggctccctttcttgatgaaaggggcatacatcatccaaacattagtgtaagccgcagggccagttatttgtttatgagggttgtgaaattgctgaaggtgaagttggtgcctttcattgcggtgattctgcagagcctacctgatacagttgctcggttcactgctacaaattatacaacagaagagctgtcagggtcagaagatggtagccacatttttgaggcaattgggttattgattggaatggaagatgtaccacctgaaaagcaatccgattatctatcttctttgctaagccctctttgtcagcaggttgaggcattgctgagaaatgctaaactgttaagttatgaggagactaatgccagaattgctgtaatccagcaaattatcatggccattaattctctcagcaagggcttcagcgagcgtctggtaactgctagtcgccctgcaatcggcaacatgtttaagcagacattagatgtacttctccaggttcttgttatttttccaagaatagaacctctgcaaagcaaggtcacatcatttatacatcgcatggtggataccctaggagcatctgtccttccttaccttccaaaggcaattgagcagttacttgcagaaacggagccaaagcaaatgtctggttttcttttgttgctcaatcaactcatctgcaagttcaatattttggtgcgtgacattttggaggaaatatttccatccgtcgctgatcggatattcagtattattccaagagagggattgccttcaggtcttgatgcagctactgaggaaattcgtgaattacaagaacttcagcgaacattgtatacatttcttcatgtgattgctacacatgatctgtcaaccgtatttatttccccaaaatgtaaagcatacctggatccagtgatgcaattgcttttttactcttcgtgtaatcacaaggatattcttctacgaaagacatgtgtgcagatttttattagattaattaaagattggtgtgcccagccatatggagaaaaggttcctggtttccgaagttttgtgatcgaaacatttgctacaaactgctgcctatacagtgtgctggacagatcttttgattttcgggatgcaaatactcttgttttgtttggagaaattgtagtcgcacagaaggtcatgtatgacaaattcggggatgattttctcgttcattttatatcaaaaggattttctgttgcacattgcccgccagagatggctgaacaatatcgtcaaaagttgcagggtagcgatatcaaggcactaaaatctttctatcagtccctcatagaaaatttgagactgcagcagaatggaagccttgtgtttagatagtatacctataataatggacaaatttcgagtcttcgttctatacgggtttaatttgttgctggccgtcttctagtacggggtaatgatttcggtctacaaaagtcatggaatggcggtgagtactgcagtgctgtgtatatagcttttgcggatgagctatggataatctcttgaccatgtttttgatgagttcctctgcaacctgaccaaacagtaaattgtctcaggcctttctttattcttttgtcccacagctgtaaattttgagaaatctcttattacaatggggttacttctgtctgtttgaagcctgtcaatataagatcaaaattttggcatttgatgttgtgttctttttcgcccctattaatttcg

SEQ ID NO: 4972 - DNA, 2567 bp, Nicotiana benthamiana
ctctcactgccgccaaccaaaaactacccctacttaaaaataaaataaaaacaaagcatcaaaaagcaaaaatcatttgcttatgcctatcttgtaaaatactcaaatatcaaaattcccactttactttttatactccactccttataaaagtttaatttaaatcatttgctaattaagcttccgtttagtcacactgttgaattctaggcatttcttttttatttcttgataagaattatcagtattattctgttcatgtacgaaactggttagctgcaacattaattagggtcattactcctctcatgcagctcagtttggaccaactaggctggtgtttgtgatatacatattacatactctagttgagttttttgggcagagtaagaagaattggcaaaatgagcatgaacatgttcggtttgaaggtggaggagggaaaagaaggtcaaaatggacagccatcagttggtcctgtttatcgaaatccaattgctaaaaatggttttcctcaaactgatcctgatttgtctacagcttggcaacttttcagagcagctgttgaaaaatacccagggaataaaatgctgggatggcgtgattttaaggatggaaagtggggtccttatctctggaaaacatacaaagaagcttatgaagagattttgcacactggttctgcattacgggctcacggtattgaacctggtgctcgaattggaatttatggatccaattgtcctcagtggatagtagcaatgcaggcttgcagtgcccacagcttaatatgtgtccctctctatgatacccttggatccggcgctgtagattttattattgaacatgctgaaattgatatcgtttttgttcaagataagaaagtgaaagaactttcgaattcggaatgcactcatgctaaacggctgaaattgctcgtgtgtttcacatcactgcagcaggaacagaaggataaggcagtttctatgggtattaagccatactcttggaatgaattcctcaatatgggaaaagagaatccatcagagccttcaccgcctcagccattagacatatgtacaatcatgtatactagtggaactagcggagaacctaaaggtgtaatattgactcatgaaaatatgacagcatctgttacaggagttgatcattttatggaagaatttgaggacaagatgacggtggatgatgtgtacatatctttcttaccacttgctcatatacttgatcgaatgattgaagaattcttctttcataggggtgcttctgtcggctattaccatgggaatatcaatgagatacaagaagacctaatggagttgaagccaacttttttggccggagtaccccgagtttatgaaaagattcacgaaggtgttctgaaagcacttggagaactcaatccctttaggaggagcatgttccacattctatataactacaaactcaaatggatgaagcttgggtacaaacagaagtatgcttcaccactggctgatctgctagctttcagaaaggtaaagaataggttaggtgggcggattcgcctcatagtctctggtggtgctcccttaagcactgaggtggaagaattcttgcgggttacctcctgtggcttcgtcctccaaggctatggtttgacagagacctgtggtttggccaccattgggcatccagatgaaatgtccatgcttggaaccgttggtccaccatttgtcttcacagaagtgcgtttggaggaagttccggagatgggctatcatcccctaggagatcctcctcggggagagatatgcgtgagagggaggaccgcttttactggatactacaagaatcaagaattgacaagagaggtcatcaaagacgggtggtttcatacaggtgatatcggagaaatgttgcctaatggagttgtaaaaatcattgatagaaagaaaaatgttataaagctatctcaaggagaatatgttgcaatggaatatctggaaaaggtttatagtattgcgccgatcattgaagatatatgggtatatggggacagcttcaagtccatgttggtggcggttgtggtgccacacgaagggaacaccaaaaaatgggccgatcaaaatggacacaagggttcaattcctgaactttgttctctccaagaactgaatcactatattctccttgagctgaaaactgctgcagagagaaacaagctaagaggtttcgagtgcatcaaaggcttgattctagaacctcaaccctttgagtttaaccaggactttgtaacagcaacaatgaaaaaaagaagggagagattgcttaagcattacaaggtggaaattgatgacctctaccaaaggcttaatgcagtacctaaacgctaataacattttcgattgctgaggcagtgcaactctcgatctactgagcaatatgtggagttttgtgctgtaataatttgaacttatacacattaagttaatgtctgatataacagtgtttttgtgcgaataatctgtattgctgcagtcataatttctgaattaagcacctct

SEQ ID NO: 4973 - DNA, 2525 bp, Solanum phureja
cttctttcttcccaaaccctccgcttgtttttcttttctctctctctgtttctactacaaactccttcaactgactaagaagaagaggaaacaaaggaaagaagaagaaaaactatggcggatgttgtacagttcaagctggagcgtatgctccctgagctcgacgaccttgaaaaacgcagtctatttagccgccaggaaatagcggaaatagtgaaacagcgccggaaatttgagtacaggttgaagagacctagtccattgaagcaggattttgtagcatacattgactatgagaaaagtctcgattctctacgacttctacgtaaaaaagctcagatgaaaacaaccggcgatagaaagttgaaaaagtctgtttcagattatgctggagtttccaggattattgagatttatcggctcgccaccactaggtttaagggagatatagagctttggtttcagtatttggagttctgtagggagcgaaggaatggtcgaatgaagaaggcccttgcgcaggtaatcaggtttcaccctaaggtgcctggagtatggatatatgctgcagcttgggaattcgataacaacttaaatgctgctgctgctcgtgccctaatgcatagcggcttgagagcatgtccaacttctgaggatctgtgggtagaatatctccgaatggagcttacatacctaaataaattaaaggcccgcaaagttgtgctaggagaggatgagggaacactagctcgttctggcaaaagtgctaaagaggaacagtggagagatgagaacaaggaattatttattgtccttgatgataaaagagaggaagacaaattatccaaccttcacgacggagactcgaaggagaaattagatttatttagggaacaaggtttaagtgttcttcagacagtttacggtggttctattaaagccctcccttccagtttcagtttaagaacaaagtttcttgacatactagaagcaacagatttaggtcattcagaagatatgcgaaatgaaatacttgctgatatgaaacgggacttctcaaaagaaccaaaatattgggattggcttgcaagacaggaagtgattgatcttaataatccagagactactggagcaatgacagctgatcagttaagcagagcaattgaggtttatgaggagggtttaaaaattgtgccttcagcttcaatgtttgattgttatgcaaagttcctgatggacgtcatccattttaaaaataagggaagtcaatcttctgagctcttcagtacagctaggcatgttatggatcctatttcacatctcctggtagtatatgaaaaggctgaaaccatgggatgcatcacagaagatcttgcttgccagcatgtttcttttctactgcaacttgggaaagtagatgaagctaagactttggcggagaaattgtgttctggaaaattttcagaagcagtgcagctatgggctttacggttctcaatagaaatgagatttatccagaagaactgtactccaaataaggcagctctgtcttctatctttgaactcctgagaagtgttttgttgaaacttcccatattagaagcagaaactatatggcttatggcgctcaaatatttttccactcataagaaattctttgacaagttggttgagacttctatatctttactggccaaagatggtggaagtgatgatggtttttccctctctactaccatcgtcaattttgttctgcaaagggatggacttgggagtgctagagagttgtataagagatttcttgctttaccgcatccaggactttctttatacaggaattgcattgagctggaattgaaccttgcgtctagtggagataagattagtcttggaaatgtccgaaaactatttgaaactgcacttacaacttatgatcaagatgtcagattgtggcaagactattataatatggaaatcaagatgggaacatcagaaactgcagcagccgttcactggcgagcacggaaaaccctcaagaagagtatttcccttgtaccctcactggatatgtgatcaatctcatgtgtgaataccgtcaaaatttgacttgggaatactttgatcaagtaatataaccaaagctctctgtggaggtctggctaatgtgatttgttatgtggtgcaccatctcatatatcattgagctgccaatcttaatctacatcacaatttgcagtattggttctcttttgaggacatcttatgtaatctgagtcactgttaaaggagccttgctatattcttaggcagcaactgtgatataaagcttttaggagagctattgtcaattttcttgacctctcaaactacttggaacgacaaaattttgtagacgagtacctttagctttgtgtgtcaaacaaacaatgtaccatttctatcaagaaagccctcatatggtttcttctaatttcattatttcaagactttgtttttgttcaaatatagtaatattttcatgttga

SEQ ID NO: 4974 - DNA, 2641 bp, Capsicum annuum
ctagacttaggtttaatctcattctcactctctcactctctccgtctctcaaaccgaaaatgtcagtatacccaaaagtcgatattatttgatgaaaactgaagaggctagagacggccaaagacgatttgctgatcggcttttgttgttgcgctcacaattttgaagggacagaagaagagaaagcaaaaatggcggatgtggtacagtacaagatggagcgaatgctccatgagctagacgaccttgaaaaacgcggcctatttagccaccaagaaatagaagaaatagtgaaacagcgccgcaaatttgagtacaggttgaagagacctagaccattgaaacaggattttgtagcatacattgactatgaaaaaagtctcgattctctacgacttctacgtaagaaagctctcatgaaaaaaactggcgataggaagttgaaaaaatcggtttcggattatgctggcgtttccaggattattgacatttaccggctcgctactagaaggtttaagggagatatagagctttggtttcagtatttggagttttgtagggaccgaaggaatggtcgaatgaagaaggcccttgcacaggcaattaggtttcatcctaaggtgcctggagtatggatatatgctgcagcttgggaattcgataacaacttaaatgctgctgctgctcgtgccctaatgcatagcggcttgagagcttgtccaacttctgaggatctgtgggtagaatatctccgaatggagcttacgtacctaaataaattaaaggcccgcaaagttgtgctaggagaagataagggaacactggctcattctggcaaaaatgctaaagaggaacagtggagaaatgaaaacaaggaattatttatggcccttgatgataaaagagaggatgacaaattatccgaccttcacgacggagactcaaaggagagactagatttatttagggaacaaggtttaagtgttcttcagacagtttacagtggttctataaaagccctcccttccagtttcagtttaagaacacagtttcttgagatactagaagcaacaaatttagctcattcagaagatatgagaaatgagatacttgctgatatgaaaagagacttttcaaaagaaccaaaatattgggattggcttgcaagacaggaagtgattgatcgtaataatccagagagtactgaaggagtgacagctgatcaattaagcagagcaattcaggtttatgaggagggtttaaaatttgtgcctttggcctcaatgtttgattgttatgcaaagttcttgatggatgtcatccattttaaaaatcagggaagtcaatcttctgagcacttcagtgcagctagtcatggtatggatcctatttcacagctcttggtagtatatgaaaaggctgaaacaatggggtgcatcacagaggatcttgcttgtcagtatgtttcttttctactgcaacttgaaaaagtagatgaagctaggactttggcggctaaattttgttctggaaaattttcagaagcagtgcggctatgggctttacggttctcaacagaaatgagatttatccagaataactgtactccaaataaggcagctctgtcttctttctttgaacccctgagaaatgttctattggaagtgcccatatcagaagcagaaaccatatggcttatggcactcaaatatttctccactcataagaagttctttcacaagttggttgagatctctatgatttcactggccaaatatggtggaagtgatgatgggttttccctctctgctaccatcgtcaattttgttctgcaaagcaatggatttgagagtgctagagagttatataagagattccttgctttaccacatcctggactttctttatataagaattgcattgagctggaattgaaccttgcatctaatggagataagattagtcttggcaatgcccgaaaattgtttgacactgcagtcactacttatgatcatgatgtcggattgtggcaagactattacaatatggaagtcaagatgggaacatcagaaactgcagcagctgttcactggcgagcacggaaaaccctgaagaagagtatttcccttctacccccctcacaatgatcaatctttgaatgtgggaacacgttcaaaatttaagctgggaatactttgagcaagtaatatgaccaaaggttctatccggagggctggctaatgtgatttcttatgcagtgcagtgcaccatctcttatcattgatttgcagtattgattctcttctgatgacttactttaggattttatgtgatctgagtcactgtcaaaggagctttagtatattctcagtcaagacctttgacagcagctgacagctgtgatataaagctttgaaggagagctttaatgtcatctcagttcaatttttttgctctctcaaactactttggccgacaattttgtagactagtacctttagctttgtgtgtgaaacaaacattttacgatctttatcaagaaagccttgtaacttttaataggaattgcagttatctggctgaatttgttggtaatccctatccgttgtttaatttgatatattgaggacaatttaatcta

SEQ ID NO: 4975 - DNA, 2916 bp, Solanum phureja
aagccctaacaatttctttcttcaatcccaatctgcaatccttacagctacatccgagaaagttccggcgaacggcggatggcttccgactcatctccggtcaacgctcgcggcggtccatctacaccagatgattccatttcaagtccaattggcaacacttactcttctcccggcgactctgctcgccggaagcgtggccgccgctcggcctcatcgacaccagtagcaccgtcaaatcggcgattcacaactcctgaggctacaccaacaccgtcgagtactaatcctcgccgaggcggaagaagagcatcctccaacacccctactggtgccgcgactccatcctatgcctctgatgttccgccttcctcagaaggcggggaaggtgatgatgccgatgataccccacctatgtatgtgtggggcacaaacatcagcgtgcaagatgtaaacgctgcaattcttaggtttttgaggaatttccgggaggatccttttcaaactgaggggaaatacatgagggcagttcataatgtaattgaaatggaaggcgactcactcgatgttgatgcgcatgatgtgttcgactatgatggtgatttgtataccaaaatggtcagattcccacttgaggttctagcaatttttgatattgtcttaatggacatggttagcagaattaacccactatttgagaagcacatacaagctagaattttcaatcttaagacgtccacttcaatgagaaatctcaatccatctgatattgagaagatggtgtcactcaaagggatgattatccgttgtagtgcaattattccagagataagagaagcaatatttagatgtcttgtttgtggatattactctgacccaattgttgtagacagaggaagaattagtgagccgacaatatgcggcaagcaagaatgtctggcaaggaactcaatgactttggttcacaatagatgcaggtttgctgataaacaaattgtgagagttcaagaaacaccagatgagatccctgagggaggaacacctcacacggtaagcttgttgatgcatgacaagctggtggatgtggggaagccaggtgacagagttgaagtcactggaatttatagggctatgagtgtcagaatcgggtcagcacataggactgtaaaatcattgttcaagacttacattgattgtcttcatcttaagaagactgacaagtcaagaatgcatgcagaggatccaatggaaattgaaaatggtgttgttggaaatgaagagcctcttgatcatgaagaaaaggtggagaaattaaaagaactatctaaacagcctgatatctatgaaaggctgaccaagtccttggcaccaaacatatgggagttggatgatgtaaagaaaggccttctttgccagctctttggcggaaatgcattgaccttgctgtctggggcaagcttccgtggtgatatcaacattcttcttgttggtgatccggggaccagcaaatcacaactgctccagtatattcacaaactgtctcctcgtggtatatacacaagtggacgaggaagttcagctgtggggttgactgcttatgtagccaaagatcccgagactggtgaaactgtccttgagagtggtgccctggtcctgagtgacagagggatctgctgtatcgatgagtttgacaaaatgtctgacagtgccaggagtatgttacatgaggtgatggagcaacaaactgtttcaattgcaaaggctggaattatcgcttcgcttaatgctaggacttcagtattggcatgtgcaaatccaattggctcccgttacaatccccgattatctgtcattgataatatacaccttccacctaccctgctgtctagatttgatttgatatatttaattctagacaaagcggatgagcagaccgacaggcgccttgcaaagcacatagttgctttacactttgagaatcctgagaactctgagcaagaagtgattgaccttccaacattagcttcatacttgagctatgctcgaaaacatatacatccacaattatctgatgaagcagctgaagaattgactagaggttatgtggagatgagaagaagagggaatttccccggcagcagtaaaaaggtgattacagccacaccaaggcagctagagagtttaatacgtctaggcgaaggtcttgctcggattcgtttttcagaaaaggtggagaaaagagatgtagtggaggcttttcgacttctagaagttgcattgcagcagtctgcaactgaccatgctacaggaaccattgacatggatctcatcacaactggagtatctgcaagtgaaaggatgagaagggagaatttggtgtcaaccacccgcaacataattatggagaagatgcagcttgggggaccatcaactcgtttgctagagttactggaagacgtcaagaagcaaagttctggtggtgaagtccacctagcagatctgcgaaatgcactggctaccctcgcaaccgaaggactggttgttgttcatggagacactgtgaagagaatatgatgagaggagtgctcaggaaacttaggttgatatgcacattggcattatttgctagagcactgacaggcactttgccatatccgcggtctacttcactgtgccctttaaaacagttggccatattgtaagagtaacgtgtgtgactttgaaatgtagtgtttgtctttgaacttgatctttaattaagagcttgggctaagttgaaacctgaatctgtaaattagaaattagatgataggttacgtgcacaacatcgctggttttggcgtatatctgttgagagttgacgaaaaacatttcattcataggtttctttaaactgtctccaatttatctgttgtt

SEQ ID NO: 4976 - DNA, 2798 bp, Nicotiana benthamiana
aagccctaaacattctcttccaacacctccgccggcgatcctcgcagtatctcagccaagctcaggcgaatagatcatgccttccgactcatctccggtcaacactcacggcggtccatttacaccagatgactcaacttcaagcccaattggtaacacttactcatctcccggtgacaacactcgccggaagcgtggccgccgctcgtcagccacatccacaccagttgcaccgtcaaatcggcgattcacaactcccgatgctacaccaacgccttccagtactaattcgcgccgtggccgaagaagagcgtcctccaccaccccttctggtgcagccgccacgactccgtcctatgcgtctgatgttccgccgtcctcagagggcggggaaggtgatggtgccgatgaggccccaccaatgtttgtgtggggcacaaacatcagcgtacaagatgtaaacgctgcaattcttaggtttttgaggaattttcgagaagatccttctcaaactgaagggaaatacatgagggcgattcatcatgtaattgaaatggaaggcgactcactcgacgttgatgctcacgatgtgtttgattatgataatgatttgtataccaaaatggtcaggttccctcttgaggttctagcaatttttgacattgttctaatggacatggttagcagaattaacccactattcgagaagcacatacaagctagaattttcaatcttaagagttcgacttcaatgagaaatcttaatccggcagatattgagaagatggtgtcactcaaagggatgattattcgatgtagtgcaattattcctgagataagggaagcaatatttaggtgtcttgtttgtgggtattactctgatccaattgttgtcgatagaggaaggattaatgagccaacaatatgcggcaagcaagaatgtctagcaaggaactcaatgactttggtccacaatagatgcaggtttgctgataaacaaattgtgagagttcaagaaacaccagatgagattcctgagggaggaacacctcacacagtaagcttgttgatgcacgacaagctggtggatgctgggaagccaggagacagagttgaagtcactggaatttatcgggctatgagtgtcagaattgggtcaacacagaggaccgtaaaatcattgttcaagacttacattgattgtcttcatcttaagaagactgacaagtcaagaatgaatgcagaggatcccatggaaattgaaaatggagttgttggaaatgatgactctcttggctatgaagaaaaggtggagaaattgaaagaactatctaaacaacctgatatctatgaaaggttgactaggtccttggcgccaaacatctgggagttggatgatgtaaagaaaggtcttctttgccagctctttggggggaatgcattgacgttgccatctggggcaagcttccgaggtgatatcaacattcttcttgttggtgatccggggaccagcaaatcgcagctgcttcagtatattcacaaactgtctccccgtggtatatacaccagtggacgaggaagttccgctgtggggttgactgcttatgtagccaaagatcctgagactggtgaaaccgtcctcgagagtggggccctggtcctgagtgacagggggatctgctgtatcgatgagtttgacaaaatgtctgacagtgcacggagcatgttacatgaggtcatggagcaacaaactgtttcaattgcaaaggctggaattattgcttcgcttaatgctaggacttcagtattggcttgcgcaaatccaattggctctcgttacaatccccgtctatctgtcattgataatatacaccttccacctaccctgctgtcaagatttgatttgatatatttaattctagacaaggctgatgagcagatggacaggcgccttgcaaaacacatagttgcattacactttgagaatccagagaagtcagagcaagaagtgattgaccttccaacattaactgcatacttgagctatgctcgaaaacatatacatccacaattatctgacgaagcagctgaagaattgactagagggtatgtggagatgagaagaagagggaatttccctggcagcagtaaaaaggttattacagccacaccaaggcaattagagagcttaatacgccttagtgaaggtctcgcccggattcgtttttcagaacgggttgagaaaagagacgtaatggaagctattcgtcttctagaagttgcgctgcagcagtctgcaactgaccattctacaggaaccattgacatggatctcatcacaactggagtatctgcaagtgaaaggatgagaagggagaatttcgtgtcaaccacccgcaacataatcatggagaagctgcagctggggggaccatcaactcggatgctggagttactggaagagctgaagaagcaaatttctggtggtgaagttcacctagcagatctacgaaatgcacttgctactctagcaactgaaggattggttgctgttcatggtgatgctgtgaagagagtatgatgagtcgaaatcaggaggctttctcaaattcattgctcagggagcagaagatgtagattgctactatttacaagagcactttgcaggcatgttaggcagagtcatgtttttggttcctgatcttcttcactatctagtctttgaaacagttggccattcgttagagcaatgtgtactacactttgcaatgtctgagtatttgcttgaacttgttctt

SEQ ID NO: 4977 - DNA, 2648 bp, Amsonia hubrichtii
tattggcttccgattcatctccggccaacatccacggtccctcttcaccggatgacacgctgtctagcccaatcggaaacacgttctcgtcaccaggcgatgccagtcgccggaaacgtggtcgtcgctcatctgcggcaacatatgctgctaccccacctcctcctgctaacggccgctttaccactcctgaggccaccccaaccccatctagcacaaatccgcgccgacgtggaaggagagcatcgactgcaacccctactgctgcgacaccttcttccactgatgattttccgccatcatctgaagctggtgacggtgacgatgctgatgagaccccaccaatgtacgtatggggcactaacatcagcgttcaagacgtgaacgctgcaattttaaggtttctgaggcattttcgcgaaaatccttctcagattgaagggaagtacatgagcgcaattcactctgtcatcgaaatggaaggcgattcacttgaagttgatgcacatgatgtgtttgattatgatagtgatttgtataccaaaatggtacggtacccacttgaagtactggctattttcgatattgtgttgatggatatggttagcagaattaaccctttattcgaaaagcatatacaagctaggatattcaatctcaagtcctctaccgcgatgagaaatctcaatccatctgatattgagaagatggtctcactgaagggaatgatcatacgttgtagctccatcatacctgagatcagggaagccatatttagatgtcttgtatgtggatattactcagatcctgttgttgtggatagaggaaggattagcgagcctactatttgtggaaagcaagaatgtcttgcccggaattcaatgaccttggttcataataggtgcaggtttgctgataaacagattgtgagactccaagaaacacctgatgatatcccagagggaggaacacctcatacagtaagcttgttaatgcatgacaagttggtggatgcagggaagcctggtgacagggttgaggttactgggatttacagggctatgagtgttagaattgggccaacacagagaactgtaaaatcattatttaagacgtacattgattgtcttcacctgaagaagactgacaagtcaagaatgcaaactgaggatcctatggagactgaaagtggcactggcagcaacactaatgacaatgtcaactacgaagataaggtggagaagttaaaggaactttctcggcaacctgatatttatgaaaggttaacaaggtctttggcaccaaatatatgggagttggatgacgtaaagaaaggacttctttgccagctttttggtggaaacgcgttgaagttgccatctggggcaagcttccggggtgacataaacattcttcttgttggtgaccctggaaccagcaaatcacagctgctgcagtacattcataagttgtctcctcgtggtatctataccagtggacgaggaagctcggctgttggattgactgcttatgtttctaaggatcctgagactggtgaaactgttttagaaagtggagcactggttctgagtgacagagggatttgctgtattgatgaatttgacaagatgtctgagaatgcaaggagcatgttacacgaggtcatggagcaacaaacagtctcaatagctaaggcaggcatcattgcttcccttaatgctaggacttcagttttggcttgtgcaaatcctattggctcacgttataatcctcgtttatctgtgattgataatattcatctccctcctaccttattgtccaggtttgatttgatctacttaattcttgacaaggctgatgaacacacagatagacgccttgctaagcatattgtggcactacactttgaaaaccctgagaattcagaggacttcatagatcttccaactttgactgcttatgtgagctatgctcgacataacatacacccaaagctatctgatgaagctgccgaagaattgacaagggggtatgttgaaatgagacaaagaggaaatttcccaggcagtagtaagaaggtaataacagacaacaccaaggcaaattgagagtttgattcgcctgagtgaggctctagctcgaattcgtttctcagaattggttgagaaacaggatgttatggaggctttccggcttcttgaagttgcaatgcagcaatctgcaacagaccattccactggaaccattgacatggatctcattaccactgggatttctgcaagtgagcgaatgagaagagagaatttggtatcaacaactcgcaacataattatggagaaaatgcatattggtggatcatctacccgcttaatagagctactcgaagagttgaagaagcaaaattctgctgttgaagttcacctcaatgatctgaggaatgcacttgcaacactcgcagccgaaggtctggttgttgtgcatggcgacagcgtgaagagaatatgatgacagtttagtgatgcgagacaactggtgaaaatgtttagttccttctttactggtgctgcaaatagaaagaagatatgaccgtcccaggcctgcatgttgttattgggagccgatgcaatttcacagacaagcttgatcaa

SEQ ID NO: 4978 - DNA, 3143 bp, Capsicum annuum
agtaaattggcgccaaaaagcaccgcatttttcccgccaaagatgcccatcacatttacattgttgcctccctccacaaatcaaccctaacaatttcttccttcaattcccgccaaagacacccagcactactttcagctgcttccgtccaatctcaggtgaacggaaaatggcttccgactcatctccggtcaacactcctggcggtgctaatccatctacaccagatgtctcaatttcaagcggagaaggtgatgatgctgatgaggccccaccaatgtatgtgtggggcacaaacatcagtgtgcaagatgtaaacgctgcgattcttaggtttttgaggaatttccgggaggattcttctcaaactgaggggaaatacatgagggcaattcatcatgtgattgaaatggaaggcgactcactcgatgtggatgcgcatgatgtgtttgactatgacggcgatttgtataccaaaatggtcaggttccctcttgaggttcttgcaatttttgacattgtgttaatggacatggttagtagaatcaacccactcttcgagaagcacatacaagctagaattttcaatctcaagacatcgacttcaatgagaaatctcaatccatctgatattgagaagatggtgtcactcaaagggatgattatccggtgtagcgcaattattccagagatcagggaagcaatatttagatgtcttgtttgtggatattactcagacccaattgttgtcgatagaggtaggattaatgagccgacaatatgtggcaagcaagaatgtcttgcccggaactcaatgactctggttcacaatagatgcaggtttgctgataaacaaatcgtgagagttcaagaaactccagatgagatccctgagggaggaacacctcacacagttagcttgttgatgcatgacaaactagtggatgttgggaagccaggtgacagagttgaagtcactggaatttatcgggctatgactgtcagaattgggccagcacacaggactgtaaaatcattgttcaagacttacattgattgtcttcatcttaagaagactgacaagtcaagaatgcacgcagaggatccaatggaagttgaaaatggtgttgttggaaatgatgagcatcttgacaatgaagaaaaggtggagaaattgaaagaactatctaaacagcctgatatctacgaaaggctgaccaggtccttggcgccaaacatatgggagttggatgatgtaaagaaaggccttctttgccagctctttggcggaaatgcattgagcttgtcgtctggggcaagcttccgtggtgatatcaacattcttcttgttggtgatccagggaccagcaaatcacagttgctccaatatattcacaaactatctcctcgtggtatatacacaagtggacgaggaagttcagctgtggggttgactgcctatgtagccaaagatcctgagactggtgaaactgtcctcgagagtggggctctggtcctgagtgacagagggatctgctgtatcgatgagtttgacaaaatgtctgacagtgccaggagcatgttacatgaagtgatggagcaacaaactgtttcaattgcaaaggctggaattatcgcttcgcttaatgctaggacttcagtattggcctgtgcaaatccaattggctcccgttacaatccccgtttatctgtcattgataatatacaccttccgcctaccctgctgtcaagatttgatttgatatatttaattctagacaaagcggatgagcagactgacaggcgcctcgcaaagcacatagttgctttacactttgaggatcctgagaactctgagcaagaagtgattgaccttccaacattagctgcatacttgagctatgctcgcaaaaatatacatccagaattatctgatgaagcagctgaagaattgactagaggttatgtggagatgagaagaagagggaatttccctggcagcagtaaaaaggttattacagccacaccaaggcagctagagagtttaatacgccttagtgaagctcttgctcggattcgtttttcagaaaaggttgagaaaaaagatgtaatggaggcttttcgacttctagaagttgctctgcagcagtctgcaactgaccatgctacaggaaccattgacatggatcttatcacaactggagtatctgcaagtgaaaggatgagaagggagaatttggtgtcaaccactcgcaacataattatggagaagctgcagcttgggggaccatcaactcgtttgctagagttattggaagacgcaaagaagcaaagttctggcggtgaagttcacctggcagacctgcggaatgcacttgctactctcgcaaccgaaggactggttgttgttcatggtgacactgtcaagagaatatgatagaaggaaatcaggagtgaaaatgaattttcaaattcactgctcagggaaacttacatatgcacattggcattatttgctagagcagacactcggccatatcggcggtctacttcactgtgccctttgaaacagttggccgcctttgtacgagcaatgtgtagaactttgcaatgtagtgttttgtctttttaactttatcttaattaaaaactttggtgaacttaagacctgaatctgtatattagaaaatgagcgcgccatagctggttttgacaaaagatactccattcgtaggtttatgggctatctacaatttatctgttgttaatagtccaaattgattcatgaaattgtgcaaatcaacctatatatagctcatccaaaattagagacttgaatctgcagcccaagtctttagcctcttcacctcgtcttggaatctgcaattgagaggaagactgaattttcatctacagatgttcatgttcttttctgtaaaggtaggaagttgaaaaacggactaggggaatgtaggcagaaactagaaatattatcaacaaattgatgtggctggagggacacttggaacgtgcaagtttgtttgttttagtgtgtgggtcccatcttcatcatgtgttcattatttgtccacacttgatcctccctccggaaatttcgtctacagatttttattagggccagc

SEQ ID NO: 4979 - DNA, 2962 bp, Sesamum indicum
cgctctctctctccgtgtctttatcacgtatagacaatctctcggtcacagagtgaaatatggcttccgattcttctccggctaacatacacggaggcccttcttcgccggatgactgggctacgagcccaatcagtaatacagtctcctcccctggagatcgtaggcgtccaaaacgcggtcgtcgctccagctacgccaccccatcaccactgccctctgattctcgttttccaacccctgatgcgactccaacgccctccggcagtaactcccgtcggcgtggccgagctaggcgaccggctggaacccccactgctgctgccacgccatcttccactgatgatgcaccgatgtcctctgaggctggtgacggggatgatgatgaggccccaccaatgtatgtgtggggaaccaacattagtgtacaagatgttaatgcagcgattttgaggttcttgaggcattttagggaaaatccccagcaaattgaggggaagtatatgagaattattaatcatgtgattgaagttgagggggattcgctcgatgtcgacgcccacgatgtgtttgattatgacaatgatctttatgctaaaatggttagatatccacttgaggttttagcgatttttgatattgtgttgatggatatggtcagtagaatcaatcctttatttgagaagcatatacaagctaggattttcaatcttaagagttcaacatcgatgagaaatcttaacccatctgatgttgagaagatggtttcactgaaagggatgattattagatgtagctccattatacctgagataagggaagctgtattcagatgtctcgtgtgtggctattactccgaccctattgtggttgatagaggaagaattgatgagccgacaatttgtggaaagcaagaatgtcgatctaaaaactccatgacccttgtgcacaacaggtgcagatttgctgataagcaagttgtgagagtccaggagatgccagatgagatacctgagggaggaacaccgcacaccgtgagcttattgatgcacgacaagctggtggatgctggcaagccaggtgacagggttgaggttactggaatctatagggctatgagtgtcagagttggtcaaacacagaggacagtgaagtcaattttcaagacttacattgactgtcttcatctaaaaaagacggacaagtcaagaatgcatgtggaagatccaatggaaactgaaaatgggccaagtaggaatgagaatgaatcaactctggacgaagataaggtggagcaattaaaggagctatccaaacagcctgatatatacgagagattgacaaagtctttggcaccaaacatatgggagttggatgatgtaaagaaaggccttctttgccagctttttggtggaaatgcactgaagctgccatctggggctagcttcagaggtgatatcaatattctacttgttggagatcctggaaccagcaaatctcagctgctccagtacattcacaagctctcccctcgtggtatctacactagtggacgaggaagctctgctgtgggattaactgcatatgtggcgaaggatcctgagactggtgaaactgtcctggagagtggagcgttggttctgagtgacagaggcatatgttgtattgatgaatttgataaaatgtctgacaatgcaagaagcatgctacatgaggtgatggagcagcaaactgtttcaattgcaaaggcagggatcattgcttccttaaatgcaagaacttcagtgttggcttgtgccaatccgattggttcacgttataaccctcgtttgtctgtgatcgaaaatatacaccttcctcctactctactgtccaggttcgatttgatctatttaattcttgacaaggctgatgagcaaatggataggcggcttgcaaagcacattgtggcattacactttgaagatcctgataactcagagcaggatgtcattgacctgccgacgttaactgcttatgtaagctatgcacgaaaacatatacatccacagttatcagatgaagctgctgaggagttgacaaggggatacgtggagatgagaagaagaggaaatttcccaggaagcagcaaaaaggtcataactgcaaccccgaggcaaattgaaagtttgatacgcctcagtgaggccttggctcgtattcgtttctcacaatgggtcgaaaagcgagatgtaactgaggcttttaggcttcttgaggttgcaatgcaacagtctgctacagaccattcaactggaaccatcgatatggatctcattacaactggtgtttctgcaagtgaacggatgagaagggagaacttggtttcaaccacccgtaacataattatggagaagatgcaacttggaggcccgtcaactaggctgttagagttacttgaagagttgaagaagcagagttctggagctgaaatccatcttagtgatcttcggaatgcacttgctactctttcaaccgaaggatttgttgttgttcatggcgacagtgtaaagagaatctaatgaaaagggagatgggccaaactggtgggtaccaagtgaaaggtcagctgagaattcactgtcttaaaagctggactttgggtcaccatattcagacatgaacaacggatgtatgactgtaattagtttaattgaaaggttgaaaaatctccactttcatatttgattttagtggttaattatgtttgtataaaagcaagtttagtcttttgtactctttgtattggaaacgtatctgtataactctctctatctagcgtgtagctatgctttcgtgctcaacatgtcgtctgcgggcaaaaacatgcaatggcttccttttctatttttaactttgggtacccgttcccacttcccggcttcatttcaattcaattgaaacacttatattctttgggcaa

SEQ ID NO: 4980 - DNA, 2605 bp, Tabernaemontana elegans
gtccaatcggaaacacgttctcatcacccggcgatggcaatcgccggaaacgtggtcgccgctccactgctgctgcagcatacgctactccacctcctcctattaacagccgctttaccactcctgaggccacccctaccccctctagcacaaatccacgtcgacgtggaaggagagcatccactggaacccccacggctgcgacaccttcgtccactgacgatatcccgccgtcctctgaagctggtgacggtgacgacgctgatgaggccccaccaatgtacgtatggggcactaacataagtgttcaagatgtgaacgctgcaattttaaggtttctgaggcatttccgagaacacccttctcagattgaggggaagtacatgaccgcaattcactctgtgatagaaatggaaggcgattcgcttgaagttgatgcgcatgatgtgtttgattatgatagtgatttgtacaccaaaatggttcgctacccacttgaagttctggctattttcgatattgtgttgatggatatggttagcagaattaaccccttgttcgaaaagcatatacaagcaaggatattcaatctcaagacctccacgtcgatgagaaatctcaatccatctgatattgagaagatggtgtcactgaagggaatgattatacgttgtagctcgatcattcctgagatcagggaagccatatttagatgtcttatatgtggatactactcggatcctattgttgtcgatagaggaaggattaacgagcctactatttgtgggaagcaagaatgtcttgcccggaattctatgaccttggttcataataggtgcaggtttgctgataaacagattgtgagactccaagaaacacctgatgagatccccagagggagggacacctcacacagtgagcttgttaatgcatgacaagttggtggatgcagggaaacctggcgacagggttgaggttactgggatttacagggctatgactgttagaattgggccaacgcagagaactgtcaaatcattatttaagacatacattgattgtcttcacttgaagaagactgacaagtcaagaatgcaaacagaggatcctatggaaactgaaagtgtctctggcagaaacactaatgacaatgttgaccatgaagataaggtggagaagttaaaggaactttctcggcagcctgatatttatgaaaggttgacaaggtctttggcaccaaacatatgggagctggatgatgtaaagaagggacttctttgccagctttttggtggaaatgtgttgaagttgccatctggagcaagcttccggggtgacatcaacattcttcttgttggtgaccctggaaccagcaaatcacagctgttgcagtacattcataagttgtctcctcgtggtatttataccagtggacgaggaagctctgctgttggattgactgcttatgttgctaaggatcctgagactggtgaaactgttctagaaagtggagcattggttctgagtgacagggggatttgctgtattgatgaatttgacaaaatgtccgatagtgcaaggagcatgttacatgaggtcatggagcagcaaacagtctcaatagctaaggcagggattattgcttcccttaatgctaggacttctgttttggcttgtgcaaatcctgttggctcacgttataatcctcgtttatctgtgattgataatattcatctccctcctaccttattgtccaggtttgatttgatctacttaattcttgataaagcggatgaacagacagacaggcgtcttgctaagcatattgtggcactacactttgaaaaccctgagaattcagaggacttcatagaccttccaactttggctgcatatgtgagctatgctcgaaaaaacatacacccaaagctgtctgatgaatctgctgaagaattgacaagggggtatgttgaaatgagacgaagaggaaattttccaggcagtagtaagaaggtaataacagcaacaccaaggcaaattgagagtttgatacgcctcagtgaggctctagctcgaattcgtttctcagaattggttgagaaacaggatgtgatggaggctttccggcttcttgaagttgcaatgcagcaatctgcaacagaccatttcactggaaccattgacatggatctcattacaactgggatttctgcaagtgagcggatgagaagagagaatttggtatcaaccactcgcaacataatcatggagaaaatgcaaattggtggatcatcgacccgcttagtagagttactcgaagagttgaagaagcaaaattctgctgtcgaagttcacctcagtgatctgagaaatgcacttgcaacactagcaagcgaaggttttgttgctgtgcatggggacagcgtgaagagaatatgatgagagttgagagatttgagacaactgatggaatagtttcagttcattcctcaatggtgctgcaaatagaaagaagataggactgtcccaggcctgccttttgttcttaggaggtgaagcaatctccggacaggcttaatcaccctgttccaaaaccagctaaatt

SEQ ID NO: 4981 - DNA, 2731 bp, Vitis vinifera
cacactcgcccaaccccagcttctcgccctttctttcttctcatggcttccgattcttctccggccaacatcaatggcggaccttcctctcccgatgactcgtactcgagcccgatcggcaacactttctcgtccccaggcgatggcactcgccggagaagagggcggcggccgtccgcgtctcctgcatttgcgactccgccacatccacactcccgattcgccgcttctgagacaacgccaactccgtctgaggcaaccccaacaccctctagcggacgccggagaaggggatctagaagggcttccgtgtccactccaattgccacgccttcatcaactgatgaagcaccgccttcgtctgaaggtgaaggggatgacatggatgaagctccaccgatgttcgtgtggggcacgaacattagcgtgcaggatgtaaatgctgcaattcttaggtttttaaggcattttcgtgaacacccatctcatacagaggggaagtacatgagagccatacacagagttcttgaaatagagggagaatcacttgatgtggatgcccacgatgtgtttgattatgactcggacctttacaccaagatggttagatacccacttgaggttcttgcgatatttgacattgttttgatggacatggtcagtagaatcaatccgctgtttgaaaagcatatccaggctcgcatttttaatctcaagacatcaacatcgatgagaaatctcaacccatctgatattgagaagatggtgtcattgaaagggatgattattcggtgtagttcaattatacctgaaatcagggaagcagtatttagatgccttgtatgtagacactactctgaccccattgttgtggatcgagggcgaatcaatgaaccaacaacttgtgggaggcctgagtgtcttgccaagaactccatgacactgattcacaaccgatgcaggtttgctgataagcaaattgtgaggcttcaagagacaccagatgatatccctgagggagggacaccacacactgtgagtttgttgatgcatgacaagctggtggacgctggaaagcccggtgacagagttgaggtgactggaatttacagggctatgagtgtcagagtcggaccaacacagagaaccacttacattgactgtcttcatttaaagaagactgacaagtcaagaatgcaagcagaggatcccatggaagttgaaaatggctcaggtagaaatgaagaagacaccctgcttggctatgaagacaaggtggcacaattaaaggagctgtcaaagcagcctgatatatatgaccgactgaccaggtctttggcaccaaacatctgggagctggatgatgtgaagaaaggccttctttgccagctttttggtgggagtgctttgaagttgccatctggggctagcttccgtggtgacatcaatatccttcttgttggtgatcctggaacgagcaaatcccagttgctccaatacatacacaagttatctcctcgtggaatttacactagtggaagggggagctctgctgttggcttgactgcttatgttacgaaagatcctgaaacaggggaaactgttttggagagtggagctctggttctgagtgacagaggaatctgctgcattgatgaatttgacaaaatgtctgacaatgctaggagcatgttgcatgaggtgatggaacaacaaactgtttcaattgcaaaagcgggaattattgcctctcttaatgctaggacttccgtattggcttgtgcaaatccaagtggctcacgttacaatcctcgcttgtcagtcatagacaacatacaccttcctcctaccttattgtccaggtttgatttgatttacctaattcttgacaaggctgatgaacaaacagacaggcgtctcgccaagcatattgttgctttacactttgagaatcctgagagtctagagcaagatgtattggaccttcctacattaactgcatatgtgagctatgcccgaaagcatatccatcccaagttatctgatgaagctgctgaagagctgacacgaggttatgttgagatgaggaggagaggaaacttccccggcagtagcaaaaaggttataacagccacacctagacagattgagagtttgatacgccttggtgaagccctggcccgtattcgtttctcagaatgggttgaaaagcgagacgtaatggaggcatttcgacttctggaagttgcattgcaacagtcagccacagatcactccaccggaacgattgacatggatctcattaccactggagtgtcagcaagcgaaaggatgagacgggagagtctggtatcaacaacccgcaacataattatggagaagatgcaacttggaggaccctcaatgcggttgctggagttacttgaagagctgaagaagcaaagttcttgcagcgaagcgcaccttaatgatctgagaaatgcacttgccactcttgctagtgagggatttctgtcggtccatggtgacagtgtgaagagaatatgactgggtctgggagggagggaagagaactacttcaatggagatagcctttaactcaactgctcctgtccccaggagcaaccgctgtagcagctttacattacattttagtggtcaaatgtactactattacatgaattgactgagaatgtacatatttttacattacattatatgaattttggtt

SEQ ID NO: 4982 - DNA, 2750 bp, Daucus carota
ccaactctaacccatggcttccgattcttcgccggccaacaatcacgacggtccatcatcccccgatgacgaatccatgtctagtccaatcggcaacacattctcctcccccggaaacccccgccgccgcggccgccgctcctccgtcgccactccaccctctcgccgcagctcccgcttcgctacccccgaaccaacccccactccaactactcgcactaatcgccgcagacgccgcagccccgaccccattaccaccccaatcgccgccactccttcctcagccgacgaagcgccgccctcttccgaaggcggcgagtttgggcaccccgatgaggccccgccgatgtttgtttgggggactaatattagtgttcaggatgtcaatgctgctattttgcgatttcttcggaattttcgaggcagggatgatgcgcgtgttgaggggaagtatatgatagccattcatcatgtgattgaaatgcaaggggagtcgcttgaggtcgatgcccacgacgtgtttgattatgataatgatttgtataataagatggttaggtatcctttggaggttcttgccatttttgatattgtgttgatggatatggttagtcggattaatccgttgttcgagaagcatattcaagctcggatttttaatctcaagacgtcgactacaatgaggaatttgaacccttctgatattgagaagatggtgtcattgaaaggaatgataattcggtgtagttcgataatacctgaaatcagggaagccatgttcagatgtcttgtgtgtggatatttctctgaacccattgttgtggatagaggaagaattagtgaaccaacaacgtgcgggaaacaagaatgtcttgcaaagaactccatgacattggtgcacaatagatgcaggttcgctgacaaacaagttgtgagactacaggagacaccagatgagattcctgatggaggaacgccccacacagtcagcttgttgatgcatgacaaattggtggatgccggcaaaccaggtgacagggttgaggttacagggatctacagggctatgactgtccgaattgggtcatcacaaaggacagtaaaatctttattcaagacttacattgattgtctccatctaaagaagactgacaaatcaagaatgaatgcagaggacccaatggaagttgaaaacggagctagtaccaatgacgaagatattcctcatgattatgaagacaaggttgagaaattgaaagagctatcaagaaagcctgatatatacgagaggttaactaagtctttggcaccaaatatatgggagcttgatgatgtgaagaagggtctcctttgtcagctttttggtgggagtgcattgacattgcaatctggggctagctttcgaggagatatcaatatccttcttgttggcgatcctggaaccagtaagtcacagcttctcacttacatacataagctatcccctcgtggaatttatacaagtggacgagggagctctgctgttggattgactgcctatgtagccaaagatcccgagtctggtgaaactgttctagagagtggagccttagttttaagtgataaaggcatttgctgtattgatgaatttgacaagatgtcagaaaatgcaaggagcatgttacatgaggtgatggaacaacaaacagtgtcaatagcgaaggcggggatcattgcttccctcaatgcaagaacttcagtattagcctgtgcaaatccaagtggctcgagatataatcctcgcttatctgtcattgacaatattcaccttcctcctacattgttgtccaggtttgatttgatatatctaattctggacaaggctgatgagcaaactgacaggcgacttgctaagcacattgttgggttacactttgaagatactgagaactcagagcaggatgtcattgaccttccgacgctaacagcttatgtgagctatgcccggaaaaacatacatccagaattgtctgatgaagctgccgaagagttgacacgaggctatgttgaaatgagaagaagaggaaatttcccaggcagtagcaaaaaggttataacagcaacacctagacaaattgaaagtttgatacggctcagtgaggccctggctcggattcgtttctccgaattggttgagaaaaaagatgtagtggaggcttttcggcttcttgaagttgctatgcagcagtctgccacagaccacgctacagggaccatcgatatggatctcatcacgactggggtttctgcaagcgaaaggatgagaagggagagtttggtatcacttacacgcagcattataatggagaaaatgcaaataggaggaccctccattcgcccgttggagttattggaagaattgaagaaacaaagttcaggtgctgaataccatcttagtgatctacggaacgctctttctactcttgcaagtgagggatttgttgtgattcatggtgacagtgtaaagagagtatgaaaccagcaacaaggtgcaagtgtaaccttcagtacaaccaaaggtggctaatcacagcttttataactcggaaactttcctcatcgtctgttctttggttaggtaaacatatgtgtagttgaaaggcattattaatgtgattgagtttgatttatccttatagtgtaggagtatgatatgaagacttgtattaaagattgaaagttgtaatctactttacattactgcattcggt

SEQ ID NO: 4983 - DNA, 2604 bp, Vinca minor
ccgctgcatacgctaccccaccacctcccacaaatggccgatttgccactcccgaggccacacctactccatctagcacgaatccacgtcggcgtggtcggagagcatctacggcgactcctacggctgcgacgccttcttccaccgacgatgtcccgccatcctccgaagctggtgacggcgacgatgctgatgagacacctccgatgtatgtctggggaacaaatataagcgttcaggatgtgaacgctgcaattttaaggtttctgaggcatttccgtgaacaaccttctcaaattgaaggaaagtacatgggcgcaattcactctgtgatagaaatggaaggcgattcacttgaagttgatgcacagaatgtgtatgattatgatattgatttgtacactaaaatggttcgttatccacttgaagttctggctattttcgacattgtgttgatggatatggttagcagaattaaccctgttgaaaagcatatacaagctaggatatttaacctcaagacctccacttctatgcgaaatctcaatccatctgatattgagaagatggtgtcactgaagggaatgattatacgttgtagctccgttatacctgagatcagggaagccatatttaggtgccttatatgtggatactactctgatcctattgttgtggatagaggccggatcagcgagcctactacttgtggaaagcaagaatgtctcgccaagaattctatgaccttggttcataataggtgcaggtttgctgataaacagattgtgagactccaagaaacacctgatgagattccagagggaggaacacctcacacagtaagcttgttaatgcatgacaagctggttgatgcagggaaacctggtgatagggttgaggttactgggatttatagggcgatgagtgttagaattggaccaacgcagagaactgtgaaatcattgttcaagacatacatcgattgtcttcacctaaaaaagacagatatctcaagaatgcgaacagaagatcctttggaaactgaaactggtcctgacagaagcacgaatggaagtgttgactatgaagataaggtagagagactaaaggaactttctcaacagcctaatatttatgaaaggttaacaaggtctttggcaccaaacatatgggagttggatgacttaaagaaaggacttctttgccagctttttggtggaaaccaattgacattgacatctggagcaagcttcaggggtgacatcaacattcttcttgttggtgaccctggaaccagtaaatcacagcttctacagtacattcataaattgtctcctcggggtatttataccagtggacgaggaagctctgctgttggattgactgcttatgttgctaaagatcccgagaccggggaaactgttctagaaagtggagcactggttctgagtgatagaggaatttgctgtattgatgaatttgacaaaatgtccgagaatgcaaggagcatgttacatgaggttatggagcaacaaacagtctcaatagctaaggcaggcattattgcttcccttaatgctcggacttcagtgttggcttgtgcgaatcctattggctcacgttataatcctcgtttatctgttattgataatattcatctcccgcctaccttgttatccaggttcgatttaatctacttaatacttgacaaagctgatgaacagacagacagacgtcttgctaagcatattgtggccctacacttcgaaaaccccgagaattcagaggacttcatagaccttccaactttgactgcttatgtgagctatgctagaaaaaacatacacccagagctatctgatgaagctgcagaagaattgacaagggggtatgttgaaatgagacgaagaggaaatttccctggcagtagtaaaaaggtaataacagcaacaccaaggcaattggagagtttgctacgcctcagtgaggctcttgcccgaattcgtttctcagaattggttgagaagccagatgttatagaggcattccggcttcttgaagttgcaatgcagcaatctgcaactgaccattccactggaacgattgacatggatcttattacaaccgggatttctgcaagtgagaggatgagaagagagaatttggtatcaatcactcgcaatgtaattatggagaaaatgcaaattggtggatcgtccacccgcttaatagagttacttgaagaggtgaagaagcaaaattctactgttgaagttcacctcaatgatctgagaaatgcactttcaacactcgcaaatgaaggttttgtagtggtgcatggtgacagcgtgaagaggatatgatgacagtttagagatagtatgagacaaatggtgaaatggttattttatttattcttgaattttttgctgccaatagaaggtttctgggcctacattctattatcaagaggcaatgcaatctcactcacaggctaatcactcttttccaaaaccagctacattgcaaaagtcatggttgtttgtaaggttgtgataaccgtaacttttgcgcacatgatttatgacgcgtaatttatttttc

SEQ ID NO: 4984 - DNA, 2733 bp, Rosmarinus officinalis
cacacttagtatcaccatagcagacactcgtttgagcgctgaagatcatggcttccgattcttctcctgtcaacacgcacgacggtccgtcctctccggatgcgtggccgatgagcccagttggcaacacaatctcacccccgggagatcgctcgcgacgaaaacgtggccgccattccagctacgctacgccgtctccgatgccgtcggattcacgtgtcagaacccccgaggcaactccgacgccctctagtaacgctcgacgccgtggccgaggtaggcggtcgtcggctaccccgactgctgctgccactccgacctcgaccgatgatgtcccgccctcttcagatgctggtgaggggaatgaggatgagccccccgtagtgtacgtttggggcacgaatatcagtgtacaagatgttaatgcggcaattttgaggttcttgaggcatttcagggaagatcctcagcaaatagaggggaaatatatgagaatgattaatcatgtaattgaaattgagggcgattcactagatattgatgcacacgatgtgtatgattacgacagtgacctgtatactaaaatggttaggtatcctcttgaggtgttagctatattcgatatggtattgatggacatggtggggagaatcaatcctttatttgagaagcacatacaagccaggatatttaatcttaagagttcaacttcaatgagaaatcttaacccctctgatgttgaaaagatggtttctttgaaagggatgattattcgttgtagctccattatacctgagatcagagaagctgtatttagatgtctggtctgtggttattactctgacccaattgttgttgaaagaggaagaattaacgagccaacagtttgtgcaaagcaagaatgtctctccagaaactccatgacccttgttcataataggtgcagatttgctgataagcaagtagtgagagtccaagagacgccggatgacatccccgatggaggaacaccacacaccgtgacactgttaatgcatgacaagttggttgatgctggcaagcctggtgacagggtagaggttacgggaatttacagggctatgaatgtgagagttggtcagacccagaggacagtgaagtcgattttcaagacttacattgattgtcttcatctaaagacgacggataagtcaagaatggatgtacaggatccaatggaaactgaaaatggagcaagcacgggggatgatgattcaactcagaaatctgaaatcaatgtggaacaattaaaagaactatccagacagcctgatatatatgagagactgactaggtctttggcaccaaacatatgggagttggatgatgtaaagagaggcctcctttgccagctttttggagggaatgcgttgaagttgccatctggtgctagcttcagaggtgatataaatattctccttgttggggatcctggaaccagcaaatctcagcttctccagtacattcataagctctctcctcgtggtatatacactagtggaagaggaagctctgctgtggggctaactgcttatgtcgctaaggatcctgagaccggtgaaactgtcctggagagtggagccttggttctgagtgatagaggcatctgttgtattgatgaatttgacaaaatgtctgacaatgcaagaagcatgttacatgaggtgatggagcagcaaactgtttcaattgcaaaggcaggaataattgcttccctgaatgcaagaacttcagtgctcgcttgcgccaacccaattggttcacgctataaccctcgcttgtcagtgattgaaaatatccaccttcctcctactttattgtccaggttcgatttgatctatttgattcttgacaaggctgatgaacagacagatagacgcctggcgaagcacattgtggcattacacttcgaaaatcctaatagctcccagcgtgatgtcattgacctaccaactttgacagcttatgtaaactatgcacggaaacatatacacccacaattatcagatgaagctgccgaggagttgacaagggggtatgtggagatgagaaaaagaggaaatttcccaggaagcagcaaaaaggtcataactgcaaccccaaggcaaatcgaaagtttgatacgccttagtgaggccttggcccggattcgtttctcagaattggtcgagaagtcggatgtaattgaggcttttaggcttctcgaggtggcaatgcaacagtctgcaacagaccattcaacaggaacgattgatatggacctgatcacaacgggggtatccgcaagtgaaagaatgaggcgggggaatctgttgttggccacgcgcagcctcatcatggacaagttgtcaatcggagggtcgtcagctcggttgatggagttacttgaagagttgaagaagcagaatcccggtggtgctgaggtgcaccttagtgatcttcgaactgctatggcgactctctcagctgaaggcttcctcgttgttcacggtgactctgttaagagaatttagaaagtaccttcattcatgataattatttgtgttaggagctactctctacctacatgtactgtattttagttttgtaattttggagtacctaattgagagatactgatgatgttgtaattacagcagcaaccctagaaagcattacggcttacattattaccaaaatatattcagtgctctc

SEQ ID NO: 4985 - DNA, 2765 bp, Nicotiana benthamiana
gtccatttacaccagatgactcaacttcaagcccaattggtaacacttactcatctcccggtgacaacactcgccggaagcgtggccgccgctcggtcatgctccactgaaagctcgcaccgtcaaatcggcgattcacaactcccgatgctacaccgacgccttccagtactaattcgcgccgtggccgaagaagagcgtcctccaccaccccttctggtgcagctgccgccactccgtcctatgcgtctgatgttccgccgtcctcagagggcggggaaggtgatgacgatgaagccccaccaatgtatgtgtggggcacaaacatcagcgtacaagatgtaaacgctgcaattcttaggtttttgaggaattttcgtgaggattcttctcaaactgaggggaaatacatgagggcaattcatcatgtaattgaaatggaaggtgactcactcgacgttgatgctcacgatgtgtttgattatgataacgatttgtataccaaaatggtcaggttcccacttgaggttctagcaatttttgacattgttttaatggacatggttagcagaattaacccactattcgagaagcacatacaagctagaattttcaatcttaagagttcgacttcaatgagaaatcttaatccggcagatattgagaagatggtgtcactcaaagggatgattattcgatgtagtgcaattattcctgagataagggaagcaatatttaggtgtcttgtttgtgggtattactctgatccaattgttgtcgatagaggaaggattaatgagccaacaatatgcggcaagcaagaatgtctagcaaggaactcaatgacgttggtccacaatagatgcaggtttgctgataaacaaatcgtgagagttcaagaaacaccagatgagattcctgagggaggaacacctcacactgtaagcttgttgatgcacgacaagttggtggatgctgggaagccaggagacagagttgaagtcactggaatttatcgggctatgagtgttagaattgggtcaacacagaggaccacttacattgattgtcttcatcttaagaagactgacaagtcaagaatgaatgcagaggacccgatggaaattgaaaatggagttgttggaaatgatgactctcttggctatgaagaaaaggtggagaaattgaaagaactatctaaacagcctgatatctatgaaaggttgactaggtccttggcgccaaacatctgggagttggatgatgtaaagaaaggtctcctttgccagctctttggggggaatgcattgacgttgccatctggggcaagcttccgaggtgatatcaacattcttcttgttggtgatccggggaccagcaaatcgcagctgcttcagtatattcacaaactgtctccccgtggtatatacaccagtggacgaggaagttcagctgtggggttgactgcttatgtagccaaagatcctgagactggtgaaactgtcctcgagagtggggccctggtcctgagtgacagggggatctgctgtatcgatgagtttgacaaaatgtctgacagtgcaaggagcatgttacatgaggtcatggagcaacaaactgtttcaattgcaaaggctggaattattgcttcgcttaatgctaggacttcagtattggcttgcgcaaatccaattggctctcgttacaatccccgtctatctgtcattgataatatacaccttccacctaccctactgtcaagatttgatttgatatatttaattctagacaaggctgatgagcagatggacaggcgccttgcaaaacacatagttgcattacactttgagaatccagagaactcagagcaagaagtgattgaccttccaacattaactgcatacttgagctatgctcgaaaacatatacatccacaattatctgacgaagcagctgaagaattgactagagggtatgtggagatgagaagaagagggaatttccctggcagcagtaaaaaggttattacagccacaccaaggcaattagagagcttaatacgccttagtgaaggtcttgcccggattcgtttttcagaacgggttgagaaaagagacgtaatggaggctattcgtcttttagaagttgcactgcagcagtctgcaactgaccattctacaggaaccattgacatggatcttatcacaactggagtatctgcaagtgaaaggatgagaagggagaattttgtgtcaaccacccgcaacataatcatggagaagctgcagctggggggaccatcaactcggatgctggagttactggaagagctgaagaagcaaagttctggtggtgaagttcacttagcagatctgcgaaatgcacttgctactctagcaactgaaggattggtttctgttcatggtgacgctgtgaagagactatgatgagcctaagtcaggagtgagtcattctcaaatgcattgctcagggagcagaagttgatatgtcgattgctactatttacaagagcactttgcagccatgttaggcagagtcatgttttttgttcctgatcagcagtcttattcactatctgccctttgaaacaattagccatacgtaagagcaatgtgtagtactttgcaatgttcagtatttatttgaagttgatcttaattaagaacataggtgaaaatgaaacttgaaagcttgtgtactggaaattggaaggtatgtgtcttgttctatggcgctggctttgg

SEQ ID NO: 4986 - DNA, 2761 bp, Triphysaria pusilla
tctctgtagctcactctcacaatccctcacacacagagtgacgaacatggcgtcggattcatctacacctaacgtacacgaaggcgcatcctctccagatgcttggccaacaagcccaatcagtaacacaatatccactcccggcgacgcaaggcgtcctaaacgtggccgtcgatccacctacgctactccatctccactgccctccggctctcgttttgacacccctggtgcaactccaacggcaacgccctccagcactaaccaccctcgtggccgacgcagggcaccatccggaacccccaatgctgctgccactccgtctgatgacgtgccgctttcgtcagatgctggtgagggatttgatgatgaggccccgcccttgtttgtatggggaacgaacatcagtgtgcaagatgttaatgcagcaatattgaggtttttgaggaattatagggagagttctgagcaggtagaggggaagtatatgagagctataaataatgtgattgaaactgagggggattcgattgatgttgatgcacaagacttgtttaattatgatagtgacctgtatgctaagatggttaggtacccacttgaggttttggcaatttttgatatggtgttgatggacatgattactagaatgcatcccacgtttgagaagcatattcaggccaggatttttaatctcaagacttcgacctcgctgagaaatcttaacccttctgatgttgagaagttggtttgtttgaaagggatggttatccgatgcagctccattatacctgaaatccgggaagcaatattcagatgtcttgtatgtggttattactctgagcctattgttgttgatagaggaagaattgatgagcccaaaatttgctcaaggcaagaatgtctttctcgaaatgccatgacacttattcacaataggtgcagatttgctgataagcaagttgtgagactccaagagacacctgatgaaatccccgagggaggaacaccacacacagtaagcttgttgatgcatgacaagctggtcgattctggcaagccaggtgacagagttgaggttacaggaatttacagggctatgagtgtcaggattggtcaatcacagaggactgtgaagtcaattttcaagacgtatgttgattgtcttcatctaagaacgatggataagtcaagaatgtatgtggaggattcaatggtaactgaaaacagtgaaagtaggaatgataatgaatcaagtcttgataatgtggataaggtccagaaattaaaagatctatctaaactgccagatatatacgaaaggttgacaaggtctttggctccaaacatatgggagttggatgatgtcaagaaaggccttctttgccagctttttggtgggaatgcattgaagttgccatctggagctagcttcagaggtgatattaatattctactagttggggatcctggaaccagcaaatctcagctgctccagtatatccacaagctcgctcctcgtggtatttacaccagtggacgaggaagctctgctgtgggattaactgcttatgtgactaaagatcctgagactggtgaaacagtcctggagagtggagccttggttctgagtgatagaggcatctgttgtattgatgaatttgataaaatgtctgataatgcaagaagcatgttacatgaggtgatggagcagcaaactgtctcaattgctaaggcagggatcattgcttccctaaatgcaagaacttcagtattggcttgtgctaatccaatcggttcacgttataaccctcgtttgtctgtgattgacaatatacatctccctcctactttgttgtcgaggtttgatttgatctatttacttcttgacaaggctgatgaagagaacgataggcgccttgcaaagcacattgtggcgttacactttgatgatcctgagaactcggaacaagatgtcatagacctgccaactttaactgcttatataagctatgcacgacaacgtattcatccacagttatcagacgaggctgctgaggaattgactcggggatatgtagagatgagaagaagaggaaattttccaggaagcagcaaaaaggtcataactgcaactccaaggcaaatcgaaagtctgatacgccttagtgaggctctggctcgaattcgtttctcagaagtggttgaaaagaaggatgtaactgaggcttttaggctgcttgaggtagcaatgcaacagtctgcaacagaccattcaactggaaccattgatatggatcttatcacaactggggtttctgcaagcgaaaggatgagacgcgagaacttggtttcaaccactcgcaacataatcatggagaaactgcaacatggaggcccgtcaactcgcttgctcgagctactcgaagaggtgaagaagcagaatcccactgtagaaatccaccttaatgatcttcgaaatgcactgtccactctttcgaccgaaggactcgttagtgttcatggggatagtgtaaaaagagtttagttaaatgacagaaaaagagacaaatgtgtctgaaagtccatgtccaagtgaaggttagcctttagcctagactaaaaggatccctaggaaactgtcttcacatttgtgctcaactattgcactgtgttatttattattcttgtgttgttcacttgacttcatattaaacatcttattaacacatttttggtttgttaccaaaaaaaaaaaaaa

SEQ ID NO: 4987 - DNA, 2882 bp, Lactuca sativa
agcaacagctctttcccgccaaaagttccaagatacccttttttactctccactggttaacctacgtaccatagttgcatctcaatctcccgccctcaacactccggaaactgaaaatggcttccgattcttctccaggacctacgtcaactgatgatttaatttcaagcccaggcaggaacacactttctcctgcgaacaatactcgcaacagccgtcgaaagcgcggtcgtccatctgcggcagttgggacgccgccagtaccatcacattcccgctatgttagcacgcctgaaccatccccaacacccaattccacggctccatcatcgcgtcgtggtggtagagggagatccggctccgtgcccctgacgtctccttcgaccgacgatgtagtcccttcatccgaaggtggagaagaagacgaagcaaatggagcccctgcaatgtttgtttggggaactaatatcagcgtgcaagacgtgaatgctgcgatcttgaggtttttgaggcatttccgcgaacacgagtcgcacaccgacgggaaatacatgaaagccatcaaccatgtcatcgagatcgaaggggagtcgttggaagtcgatgctaacgatgtagatgcctatgatagcgacctgtatacgaagatggtgaggtatcccttagaagttcttgccatattcgatattgtgctgatggatatggttagtagaatcaatccattattcgagaagcacatacaagcgcggatttttaatttgaaaacgtcgacttccatgagaaatctcaacccagctgatattgagaaaatggtgtcattgaaaggaatggttatcagatgcagttcgatcattcccgaaatcagggaagcagtgttcagatgcatagtgtgtgggcacttttctgaacccattgttgtagacagagggcaaatcagtgaaccaactatatgtatgaaggaagagtgcaaaacaaagaactcaatgacattagttcacaatagatgcaggtttgcagataaacaaattgtaagactccaggagacacctgatgaaatccctgaagggggtacacctcacacagtgagcttgctgatgcatgacaaattggtcgatgctggaaaacctggtgacagagttgaggtaactgggatatacagagctatgagtgtgagggttggcccaactcaaagaactgtcaagtctttattcaagacttatatcgattgtcttcacttaaagaaaactgataattcaagaatgaatgctgaagatccaatggaaactgaacagaactctactcaaaatggtgaagagccccgtgtggataatgaagagcttgttgagaagctgaaagagctatcaaaacagcctgatatatatgacatgcttacaagatctttagctccaaacatatgggagttggatgatgtgaagaaaggtcttctttgtcagctttttggtggaagtgctttgacacatgatacaggagccacattcaggggagacattaatattcttttagtaggtgatcctggaactagtaaatcccagcttttacaatacattcacaaattagcaccacgtgggatttacacaagtggaagaggaagctcagccgttggattgactgcttatgtgtccaaagatcctgaaactggtgaaactgttttggagagtggggctttggttcttagtgacagaggcatttgctgtatcgatgagtttgataaaatgtctgaaaatgcaaggagcatgttacacgaggtgatggaacaacaaactgtgtcaatagcaaaagcagggataattgcgtcattaaacgcaaggacttcagttttagcatgtgcaaatccaagtggctcacgttataatcctcgtttatctgtaattgataacatacatcttcccccaacattgctctcaaggtttgatttgatttatttgcttcttgacaaagctgatgaggtgacagataggcgactcgccaaacatattgttgcattgcattttgaaaatcccgagaattcggagctgaatgcgatagacattccaaccttgactgcttatttgagttatgctagaaaaaacatacacccggaattgtctgatgaagctgctgaagagttgacacgtggctatgttgaaatgagaagaagagggaatttcgcaggaagtagtaaaaaggtgataacagctactcctagacaaattgaaagtctgatacgtctgagtgaggctttggctagaattagattttcagaattggtggagaaaaaagatgttgtggaggcttttcggcttcttgaagttgcattacagcaatctgcaacagatcatgctactggaactattgacatggatctgataacaactggtgtgtctgcaagtgaaagaatgagaagggacaatttggtagggatggctcgcaatattattatggaaaaaatgcaattgggaggtccatctactagaatgctagagttactggaagagctgaagcagcaaagtaataatgctgaacttcaccttaatgatctacgaaatgcacttggtactcttgcaagtgagggatttgtggtgatccatggtgacagtgttaaacgagtatgaaaaaacttgttgttttataggaaagaaaggcatgagaaagagggctcaactttaagcaatcgtattttattattattatttttgttgttaaacccatgacacagattgttgatgatttgtgtagtttttagctgtgtactgaagataattatggtttgactttgtgttactttagttgttgaggttgtggtaaactattttatatcaaagatcaaatgcaacttatcgaaaactcttccaaatatttctggctgcaatagaaagaggaat

SEQ ID NO: 4988 - DNA, 2897 bp, Chrysanthemum coronarium
tcttccaaatttgcaacctataaaaaagttaaatcaatcaacacgtcggtcatttctctgattttcccgccataaccacttgacacagaaatggctcgcccccgtaacactccccctgccgccggaaacacacctcccgccgccgccactccgtccgccggaaacacgcccacccgcacacccggccgcgctactcgtagccgcagtattcctcccgtccctactccagtcagcgatatgtcatcaccagtttcaagccctattgaaaacacattttcgtcgccaaacaatgtcaccagcagtgtccgtaaacgtggacgccgtggcatggaaacaccaccaccgccgcctcattcgcggtttgctgccacacctgacgggagtggaattggtggtagtggtggcggtggcggtggtgatacgcctccggatactagtactcctggcggtggcggaaatggaccgtcttcggaaggcgaagatgctgaggcgtacgaggcgccaccgatgtatgtttgggggaccagtattagtgttcaggatgtgaacgctgcgattttgaggtttttgaagcattttcgtgaacatgcttcacacgatgaagggaagtatatgaaagcgattgatagtgttattgaaatggaaggggagtcacttgaagttgatgcgaatgatgtgtttgattatgataatgatttgtataccaaaatggttaggtatcccttagaagtgttggcgatttttgatatcgtgttgatggatatggttagtaggattaatcctttgtttgagaagcatattcaagcgaggatatttaatttgaaggcatcgacttctatgcgaaatttgaatccttctgatattgagaagatggtgtcattgaagggaatgatcattagatgcagctcgattatccctgagattagggaagctgtgtttaggtgtttggtgtgtgggcatttttctgatcccattattgtagacagagggcgaatcaatgaaccaactatgtgtttgaaggatgaatgtaaaacaaagaactcaatgacattggtccacaatagatgcaggtttgcagataaacaaatcgtaagagttcaggagacccctgatgaaatcccggaggggggtacacctcacactgtgagcttgctgatgcatgacaaattggtcgatgctgcaaaacctggtgaccgagttgagatcactgggatatacagggctatgagtgttcgagttggccaaactcaaaggactgtgaaatctctatttaagacatacatcgattgtcttcacataaagaagacagataagtcaagaatgaatgcagaagatccaatggacactgaagagggttctacacaaaatgagcaaggaacccctatggaccatgaaaagctggtggagaagttgaaagagctatctaaaaatccggatatttatgaaatgcttacacggtctctagcaccaaacatttgggagttagatgacgtgaagaaaggactcctttgccagctttttggtggcagtgctttgacactaaaatctggggctagtttcaggggagacattaatattcttttagttggtgatcctggtaccagtaaatcgcagcttcttacatacatacacaaactagcacctcgtggtatctatactagtggaagagggagttcagctgttggattgactgcttatgtggcaaaagatcccgaaactggtgaaacggttttggagagtggggctttggttcttagtgacagaggtatctgctgcattgatgaattcgataaaatgtctgaaaatgcaaggagcatgttacacgaggtgatggaacaacaaaccgtgtcaatagcaaaagcaggaattattgcttctcttaatgcaaggacttctgtcttggcctgtgcaaatccaagtggttcacgttataatcctcgcttgtctgtcattgacaatattcatcttccacctacattgctctccaggtttgatttaatttacttaattcttgacaaagctgatgagcagacagacaggcgtctcgccaagcatatagttgcattacattttgaaaatcctgagaattcggagcagaatgttattgaccttccaacattgactgcttatttgagttatgccagaaaaaatattcacccacagttgtctgatgaagctgctgaagagttgacccgtgggtatgttgaaatgagaagaaggggaaatttcccaggaagcagtaaaaaggtgataacagctactcctagacaaattgaaagtctgatacgtctcagtgaggcccttgctcggattcgtttttcagaatgggttgagaaaaaagatgtcttagaggcttttcgtctccttgaagttgcactacagcagtctgcaactgatcacgccactggaacaattgacatggacctgataacaactggcgtgtctgcaagtgaaagaatgagaagggacaatatggtggggctgactcgcaacattattatggaaaagatgcaattaggaggtccatctactcgtttgttagagttgctggaagagttgaagcagcgaagcggtaattctgaactacaccttacagatttacgaaatgcacttagtactcttgcaagcgagggatttgtggtagtccatggtgacagtgtaaaaagagtatgaccaaatgaagtgtgtttaaggagggctaaaggctatgcttagcattgaagacacaaaaggtgttgctgatttatgtgtttatgttggagacaatgatggttcaacataataatgtgtgatgttagcgaatatttatgcaccatggtcacttcaatagtgtattagtgtagtcagggttgtttgctgaactgttttctccaagatgaattaagttattagatatc

SEQ ID NO: 4989 - DNA, 1435 bp, Populus trichocarpa
aaacacccccaagcaagatacagtgagccagtgacatactcggtgctgtaattccgagtgtggatttcttttagctatagcgtagatctattgcagaggattcttgggttaagtagagaagatggattcctcaactgttttgtttaaccagctcaaggcagcagaaccatttttcttgctagctggacccaatgtgattgaatctgaggagcacattcttagaatggccaaccatctcaagactatctcaaccagagttgggttgccacttgtttttaaatcaagctttgataaagctaatagaacatcctccaaatcctttcgaggtccagggatgagcgaagggttgaagattcttgagaaggttaaaatagcatatgacatccccattgttactgatgtgcatgaaacaattcagtgtgaaccagtcggccaagttgcagatatcattcagattccagcatttttgtgtcgtcagacagatcttctagttgcagctgccaagactggaaaaattatcaatattaagaaaggccaattctgtgctccttctgtcatgtcaaattctgctgagaaggtaagattggcgggaaatccaaatgtcatggtttgcgagaggggaactatgtttggctataatgatttgattgttgatccacgtaatttggaatggataagggaagctaaatgtcctgttgtagctgacatcacgcattcactacaacagccggctgggaaaaagttggatggtggaggtgttgcaagtggaggtcttcgtgaattgataccatgcattgcaagaacagcagtggccgttggggtggatggaattttcatggaggtgcatgacgatcctctaaatgccccagtggatggtccaactcaatggcctctgcgccatttagaggagctgctagaagagcttgtggcaatagctaaggtgagcaaggggaagaaacaaatggccattgatctcacaccatttcgcgattagggaattgaagacctctctcaaggagtaacaaggcaaagttattgggctgtaagatcctcttccgtagttgaataactagttttaagaaccttccatttgcggatgccaaaatcatgccagatgcatccagttagtgtgttcttagccattgtttctcagtttccacaggttattgttcacgaagcaaaacctttggtgctagatgacaagcttcacgtgtacctatgaggtgcatccttcgaatattggtatttattgttttcatactgcatctcttaaagcttctcgtgttattgttttcatatcgcatctctcctcgtgagagaggccgtttgctcgttcagtggagtagtcggattaggatttctgaagtagggttatcgcttacatccctcccgttgattatgcatgcatgccattatatttatcgttttatttaag

SEQ ID NO: 4990 - DNA, 1642 bp, Populus trichocarpa
acccactgactcgctaaagcgacacacagtgagtgaatcagtgaatgtttcaccctgtccctgtgctgtaattctgagagtggatttctgtcagctctagcgtagatctacgtaaggcgagatctctcttgttttgctttgttaaaatccgaaaacgcaactgcacaacataaagttttgcagctgaagagctttcttggtccaagtagagaagatggattcctcaactgctttgtttgaccagctcaaggtagcagaaccatttttcttgttagcgggacccaatgtgattgaatctgaagaacacattcttagaatggccaaccatctcaagactatctccaccaaagttgggttgccactggtttttaaatcaagctttgataaagctaacaggacatcctcaaaatcatttagaggtccaggaatgagcgaaggcttgaagatccttgagaaggttaaaatagcatatgacatccccattgttactgatgtgcatgaaacaattcagtgtgaaccagttggcaaagttgcagatatcattcagattccagcctttttatgtcgtcagacagatcttctagttgcagctgccaagactgggaaaattatcaatattaagaaaggccaattctgtgctccttctgtcatgtcaaattctgctgagaaggtaagattggctggaaatccaaatgtcatggtttgtgagaggggaactatgtttggctatagtgatttgattgttgatccgcgtaatttggaatggatcagggaagctaattgtcctgttgtagctgacatcacacattcactacaacagcctgctgggagaaagttggatggtggaggtgttgctagtggaggtcttcgtgaattgataccatgcattgcaaggacagcagtggccgttggggtggatggaattttcatggaggttcatgatgatcctctgaatgccccggtggatggtccaactcagtggcctctacgccatttagaggagctgctagaagagcttgtggcaatagctaaggtaagcaaggggaagaaaccgatgaacattgatctcacaccatttcacgaataggaaattgattgcctctctcaaagattaccaaggagaaattatttgattgtaagattgcttttcactgttgaattcttaattcttaagacacttgaatttgcatccagtctattcatgcattcttagacattgtttctcaatttttaagattctttgtattcattcatattgcaaatctcctctcgtcatagcagatagaaaactttccatgttatttgatggctgtaaactgtgaataaagtatggttctttctagagagttattagcggtgatgcaagaaatttcatgcagcatacatggattcttataatttatgattggttatcgcttatttgaagtggggttacctgttgcggcatggaatgaagcttttggtgaccctaatgtaaatccagcccatgatgatgaacttacgtgtattttaccattttactttaacaaaaaaatttatttaagataaatatttggaaacttcttgcaaaatagaaggcatttgacactcaaaccccttccattcaccaacatgtaagatgagtcctttttcattttggatt

SEQ ID NO: 4991 - DNA, 1313 bp, Mimulus guttatus
cccggcccgtacaatatctgcaactgcaccgacaaactgagaattgattgattcttcacgatctctgggtggtttcatggacatggcgatagtaacattaggaaaaagtattcattagatctcagatccaatattatcatttcattttctctgttttacttttgctcttcatttttcacctgcaattttcgtaccggagatatggattcgtcgacgctgctttacaatcagctgaaggcagcggagccatttttcttactagcaggaccaaacgtgatcgaatcggaggaacacattctctacatggccaagcaactcaaacaaatcgcttctaaacttggattgccgctggttttcaagtccagcttcgacaaagctaatcggacatcgtcgaaatcgtttcgcggacctggtttggccgaaggattgaagatactcgagagagtgaaaatcacatacgacattccgatagttaccgatgtgcacgagacaatccagtgtgaagctgttggcagagttgcagatataatccagattccggctttcttgtgtagacagacggatctgcttgtcgcagctgccaagactggaaaaattatcaatatcaagaaaggccaattttgcgcgccttctgttatggcaaattctgccgaaaagattaggatggctggaaatgaaaatgttatggtttgtgagagaggcacaatgtttggctataatgacttgattgttgatccacgtaacttcgagtggatgagggaggccaactgtcctgtggtggctgatataacacattcgttacaacaacctgctggaagaaagcttgaaggtggtggtgttgcaagtggaggtcttcgtgaactaataccctgcattgcacggaccgcagttgctgtcggggtggatggaatctttatggaggtgcatgatgaccctttaaatgctccagttgatggtccaacacagtggcctcttcgccacctggaagaacttctagaagagctcgtcacaattgcaaaggttagcaaggggaagaagcaatttcaaatcgacctcactccgttccatccgtgaaacctggaacagattcatcctgcggaaatatgtcgagaatatattattgtctggttttattaataagtcggcttttatacactgattaatcgaggctcggttttcagcctcgtcgttgttctactattagttagactcttggcaagtctgaagattctttgtattcgacactatatgtattattttttgtaaatcgaaattgggcaaaatgcatacgttacgaaggttttagatcgtaa

SEQ ID NO: 4992 - DNA, 1098 bp, Capsicum annuum
tgtcggcaaaattacttattgcagccaaatggattcatctacattgctcttcaatcagctcaaggcagcggagccgtttttcttattagcgggtccgaatgtgattgaatcggaggatcatattctttatatggctaaacatttgaaggatatcacttccaaacttgggctgaagtttgtgttcaagtcaagctttgacaaggctaatcgaacctcgtctaagtcattccgtggtcctggcttggctgaaggcttaaagatccttgaaaaggtgaaaacgacgtatgacgtacccattgttactgatgttcatgaatctattcagtgtgaagcagtaggccgagttgcagatataattcaaattccagctttcttatgtcgtcagaccgacctacttgttgcagctgccaagactggaaaaattatcagcattaagaaaggccagttttgtgctccttcagtgatggcaaattctgctgaaaaagtgagattggctggaaatcaaaatgtcatggtgtgtgagagaggaacaatgtttggctataatgacctgattgtggatccccggaactttgagtggatgagggaggccaattgccctgtcgtggctgatataactcattcactacaacagcctgcaggaaaaaagctggaaggtggtggtgttgctagtggaggtcttcgcgaattaattccttgtattgccaggactgctgttgctgtgggagtagatggaatttttatggaggtgcacaatgaccccctgagtgctccagttgatggtccaacacagtggcctctgcgccatctgaaggaactactagaagagcttgtcgcgattggtagagttagcaaggggaagcagcaattcaaaattgatctcactccatttcatgattagcgcacaaaagtttggctatcaatgactctgcagagacaatgtctccagtcattttagcttacacgtggcgatgggcttcttgcatttttcgtttgctgcttcaaagacattacagcgtgtattcgttactgtactgaacattattgaattttcaatgctcctagactgattcattggtgagagttgtaacacttccg

SEQ ID NO: 4993 - DNA, 891 bp, Manihot esculenta
atggattcctcaactctgctatttaaccagctcaaggcagcagaaccatttttcttattagcaggccccaatgtgattgaatctgaggaacaccttcttagaatggccagccacctcaagacgattgcatcaaaacttgggttgccattggtttttaagtcaagctttgacaaagctaacagaacatcctcgaagtcattccgaggtccaggcatgattgaaggcttgaagattcttgagaaagttaaaatagcatatgatcttcctattgttactgatgtgcacgaaactattcagtgtgaaccagttggcagagttgcagatatcatacagattccagcatttttatgtcgtcagacagatcttctagtttcagctgccaagactgggaagattatcaatattaaaaaaggccagttttgtgcttcttctgtcatgataaattctgctgagaaagttagattggctggaaattcaaatgtcatggtttgtgaacgaggaactatgtttggctataatgatttgatcgttgatccacgtaattttgagtggatgagggaagctgattgtcctgttgtagctgatgtgacacattcactacaacagcctgctgggagaaagttggatggtggaggtgttgctagtggaggtctccgtgaattaataccatgcattgcaaggacagcagtagctgttggagtggatggaattttcatggaggtgcatgatgatcctttgaatgcccctgtggatggtccaacgcaatggcctctgcggaatttggaggaactgctagaagagctcatggcaatagctagggtcagtaaggggaagagacgaatggagattgatctcacacccttccgtgaatagaaaagcttgaaggcctct

SEQ ID NO: 4994 - DNA, 1211 bp, Nicotiana benthamiana
cctggatctggcaaatcagaataactgcttgctttcacattcggaaatcactccggcaaactcttgcttcaaactgcttactttccgaaatttgcagcaaaaatggattcctcaaccctgctcttcaaccagctcaagacagcagagccattttttttactagcaggtcccaatgtgattgaatcagaggatcacattctttacatggccaagcacttgaaggatattacttctaaacttggattgaagtttgtgttcaagtcgagcttcgacaaggctaatcgcacttcctctaaatcatttcgcggtcctggcttggctgagggcttgaagatccttgaaaaggtgaaagcaacatatgatgtacccattgttactgatgttcatgaatctattcagtgtgaagcagttggacgggttgcagatataattcagattcctgctttcttatgccggcagaccgacctacttgtcgcagctgccaagactagaaaaattatcaacattaagaagggccagttttgtgctccttcagtgatggcaaattctgctgaaaaagtgagattggctggaaatcataatgtcatggtgtgtgagagaggaacaatgtttggctataatgacttgattgtggatccccggaacttcgagtggatgagagaggccaattgtcctgttgtggctgatataactcattcattacaacagcctgcaggcaaaaagctggaaggtggtggtgttgccagtggtggtcttcgcgaattaattccttgtattgccaggacagctgttgctgtgggaatagatggaatttttatggaggtgcacaatgatcccctgagtgctccagttgacggtccaacacagtggcctctgcgccatctggaggaactactagaagagcttgtcacgcttggtagggttagcaaggggaagcagcagttcaaaattgatctcactccatttcgtgattaggacacagaagtttggctatcagtaagcattccaatctaccagataactatgtgcagacaatgtctcctccattctgtggcagtggaattgctgcattatcagtttgttgcttggaagacactacagcgtgtattcattactgtactgaacgtgtattaattttcattctttattgtaatcttgatctaagattattttattcattggtaagagttgtgacacttcaagtgcactta

SEQ ID NO: 4995 - DNA, 1104 bp, Petunia hybrida
tcgagacactgttggcctactggatagcgagctggatctgaataactgctttttgctttcactttgagaaaattcttgctttgagaaaattgcagcaaaatggattcatcaacactactctttaaccagctcaaggcagcagagccatttttcttattagcaggtcctaatgtaattgaatctgaggatcacattctttacatggccaaacacttgaaggacattacttctaaacttggattgaaatttgtgttcaagtcgagctttgataaggcgaatcgaacttcctctaaatcatttcgcggtcctggcttggaacaaggcttgaagattcttgaaaaggtgaaaacaatgtatgatgttcctattgttactgatgttcatgaatctattcagtgtgaagcagttgggcgggttgcagatataatccagattcctgctttcttatgtcggcagaccgacctacttgttgcagctgccaagacaggaaaaattatcaacattaaaaagggccagttttgtgctccttctgtgatggcaaattctgccgaaaaagtgagattggctggaaatcaaaatgtcatggtgtgtgagagaggaacaatgtttggctataatgacttgattgtggatccccggaacttcgagtggatgaaggaggccaattgcccagttgtggctgatataactcattcattacaacagcctgcaggcaaaaagctggaaggtggtggggttgccagtggcggtcttcgcgagttaattccttgtattgccaggacagctgttgccgtgggagtagatggaatttttatggaggtgcacaatgatccccagaacgctccagttgatggtccaacacagtggcctcttcgccatctggaggaactattagaggagcttgtcgcaattggtagaattagcaaggggaagcagcaattcaaaattgatctcactcccttttgtgattaggacactgaagtttggctattaatgactctgcagagtcgatttctcccgtcattttatctacacgtggcgatgagattcttgcattatcacgttgctccccttgagacattacagtgtgtatttgttactgta

SEQ ID NO: 4996 - DNA, 1136 bp, Ricinus communis
ttcaattcccgcgtacagttggttgtctgtttgttgaattcttgaatttttttagatccaactgaattaaaagaagaagtagaagagaagaaattggatctcctctttggctttctggttgatagctgtagatggattcttcaacagtgctatttaaccagctcaaggctgcagaaccgtttttcttgttagctggccccaatgtgattgaatctgaagaacacattttcagaatggctaagcacctcaagaccatcacttcaaatctagggttgccactggtttttaagtcgagctttgataaagctaatagaacatcttcaaagtcatttcgaggccctggtatgagtgaaggcttgaagattcttgagaaggttaaagtagcatatgacattcctattattactgatgtgcatgaaactattcagtgtgaaccagttggcagagttgcagatattatacaaattcctgcatttttatgtcgtcagacagatcttctagttgcagctgccaagactgggaaaattatcaatattaaaaaaggccagttctgtgctccttctgtcatgatgaattctgcagagaaggtaagattggctggaaattcgaatgtgatggtttgtgagagaggaactatgtttggctacaatgatttgatcgttgatccacgtaacttggagtggttaagggaagctgattgtcctgttgtagctgatattacacattcactacaacagcctgccgggaaaaagttggatggtggaggtgttgcaagcggaggtcttcgagaactaataccttgcattgcaaggacagcagtcgctgttggggtggatggaattttcatggaggtgcatgatgatcctctgagcgcccctgtggatggtccaacacaatggcctctacgccatttagaggaattgctagaagagctcacggcgatagctagggttagcaaagggaagaggcatatggacattgatctcacaccattccatggttaagaaagcttgaagtatggatactatttggtcctttccctaaaactggcgatggtgatgaagttaggtctctgctgcgttattttttatgtaaatcattggagtcaagtttctgtctccatttttctttttttg

SEQ ID NO: 4997 - DNA, 1383 bp, Solanum phureja
ggactttatgaactcacaagcccaaattccatccaagctagctggatctgaataactgctttgctttcactttcggaaaattactccggcgaactctttggaaaattactccggcgaacaaatggattcatctacactgctcttcaaccagctcaaggcagcagagccatttttcttactagcaggtcccaatgtgattgaatctgaggatcacattctttacatggccaaacacttgaagaatatcacttctaaacttgggttgaagtttgtgttcaagtcgagctttgacaaggctaatcgaacctcgtctaaatcattccgtggtcctggcttggctgaaggcttgaagatccttgaaaaggtgaaaacaatatatgacgtacccattgtaactgatgttcatgaatctattcagtgtgaagcagttggccaggttgcagatataattcaaattcctgctttcttgtgtaggcagactgacctacttgttgcagctgccaagactggaaaagttattaacattaagaagggccagttttgtgcttcttcagtgatggtaaattctgctgaaaaagtgagattggctggaaatcaaaatgtcatggtgtgtgagagaggaacaatgtttggctataatgacttgattgtagatcctcggaactttgagtggatgagggaggccaattgccctgttgttgctgatataactcattcattacaacagccagcaggcaaaaagctggaaggtggtggtgttgctagtggcggtcttcgtgaattaattccttgtattgccaggacagctgttgctgtaggagtagatggaatatttatggaggtgcacaatgatcccctgagtgctccagttgatggtccaacacagtggcctctgcgtcatctggaggaactactagaagagcttgttgcgcttggtagagttagcaaggggaagcagcagttcaaaattgatctcactccattttgtgactagagcacagaagtttggctatcaatgattctgcagagaagatgtctccagtcgttttagcttacatgtggtgatgagcttcctgcatttttagtttgctactttgaagacattacacagcgtgtattcgttactatactgaacattattaaattttcactgtttattgtaatttgatccaagaccgaatcattggtgagagttgtaacacttccatgcatttagaaggctaaaaatgctctctttggacttcctttagaacctttcggtaccatatgttacacctttgtaagaaattcatgctatttaacttacactgtgaattcattcaagttcttttgttgttgaggaagtattccttctatgcattcgattgagatgcaacagttgct

SEQ ID NO: 4998 - DNA, 1378 bp, Solanum lycopersicum
gttttggcattttgaagttaggactttatgaattcacaagcccaaattccatccaaaggtagctggatctgaataactgttttgctttcactctcggaaaattactccggcgaaccctttggaaaattactccggcgaacaaatggaatcatcatcactgctcttcaaccagctcaaggcagcagagccatttttcttactagcaggtccaaatgtgattgaatctgaggatcacattctttacatggccaaacacttgaagaatatcacttcaaaacttgggttgaagtttgtgttcaagtcgagctttgacaaggctaatcgaacctcgtctaaatcattccgtggtcctggcttggctgaaggcttgaagatccttgaaaaggtgaaaacaatatatgacatacccattgtaactgatgttcatgaatctattcagtgtgaagcagttggccgggttgcagatataattcaaattcctgctttcttatgtaggcagaccgacctacttgttgcagctgccaagactggaaaagttattaacattaagaagggccagttttgtgcttcttcagtgatggtaaattctgctgaaaaagtgagattggctggaaatcaaaatgtcatggtgtgtgagagaggaacaatgtttggctataatgacttgattgtagatccccggaactttgagtggatgagggaggccaattgccctgttgttgctgatataactcattcattacaacagccagcaggcaaaaagctggaaggtggtggtgttgctagtggcggtcttcgtgaattaattccttgtattgccaggacagctgttgctgtaggagtagatggattatttatggaggtgcacaatgatcccctgagtgctccagttgatggtccaacacagtggcctctgcgtcatctggaggaactactagaagagcttgttgcgcttggtagagttagcaaggggaagcagcagttcaaaattgatctcactccattttgtgactagagcacagaagtttggctatcaatgattctgcagagaagatgtctccagtcgttttagcttacatgtggtgatgagcttcctgcatttttagttttctacttgaagacattacacagcgtgtatccgtactatactgaacattattaatttttcactgttcattgtaatttgatccaagactgatttgctgttgagagttgtaacacttccagtgcatttggaacactgttcattctaaagatgctctttgtggacttcctttaaacctttaggtaccatatgttacacttttgtaagaaattcatgctatttaacttacactgtgaattcatttaagttctgttgttgttgaggaagtattcc

SEQ ID NO: 4999 - DNA, 1434 bp, Rosmarinus officinalis
gactttttgaccacactgtgttgatgctttgcattgaattgaatctcagatccaaataattccgagatgatcgttacgtatatttcactcacagtctgtgtcgaaacattgcattagtctatcatcagatccggagaatttcgatttctcactccgcttttgagctgctcgtctcgtttccgtttgtgttccatcgtccggctgcaaattctcgagcggagatatggattcgtcaactctgctttacaatcagctcaaggctgcagagccattcttcctgctggcaggccccaatgtgattgagtcggaggagcacattctttacatggccaaaaaccttaaatccatcgctactaaacttggtctgccgttggtttttaaatcgagcttcgacaaagctaatcgaacatcgtctaagtcgtttcgtggcccgggtttggctgaaggcttgaagatccttgagagggtgaaaacaacttacgacattcctatagttactgatgtccacgagacaatacagtgtgaagctgttggcaaggttgccgacataatccagattcctgcttttttgtgccgacagacagatctgcttgtagcagctgccaagactgggaaaattatcaacattaagaaaggccagttttgtgctccttcagtcatggaaaattctgctgaaaagattagattggctggaaacgataatgttatggtttgtgagagaggcacaatgtttggctacaatgacttgattgttgatccacgcaattttgagtggttgagggaggccaattgtcccgttgtagctgatataacacactctctacaacaaccagctgggagaaagcttgaaggtggtggtgttgccagtggtggtcttcgcgaactgataccttgcattgccaggacagcagttgctgttggggttgatgggatctttatggaggtgcatgatgacccgttaaaggcgccagttgatggtccaacacagtggcctctgcgtcatctggaggaacttttggaagagctcattgcaattgctcgggttagcaaggggaagaaacagtatcagatcgacctaactccatttcacccgtgagaaccagagcatcgacttccttgtataagccagagcagattctactgcgcgcctctacttccatgggcaggactggcgttcgagaagacccttcgctttgtgatatatttaaccttattattatttcgttgatgatttgtatcagcatccctgcttgtatttgtagtcaaattaaaaattctattttttctttcctctgtacgtggtacgatcggtcttagaatcctgtagtgaaagatttatatattgtgaacatgcaataaacattcgtaatttcttcttacagaaaggtagtatgttttactttccatatggaagacttgattaatcgagtacaa

SEQ ID NO: 5000 - DNA, 1329 bp, Solanum tuberosum
ctgctttgctttcactttcggaaaattactccggcgaactctttggaaaattactccggcgaataaatggaatcatcatcactgctcttcaaccagctcaaggcagcagagccatttttcttactagcaggtccaaatgtgattgaatctgaggatcacattctttacatggccaaacacttgaagaatatcacttctaaacttgggttgaagtttgtgttcaagtcgagctttgacaaggctaatcgaacctcgtctaaatcattccgtggtcctggcttggctgaaggcttgaagatccttgaaaaggtgaaaacaatatatgacgtacccattgtaactgatgttcatgaatctattcagtgtgaagcagttggccgggttgcagatataattcaaattcctgctttcttatgtaggcagaccgacctacttgttgcagctgccaagactggaaaagttattaacattaagaagggccagttttgtgcttcttcagtgatgttaaattctgctgaaaaagtgagattggctggaaatcaaaatgtcatggtgtgtgagagaggaacaatgtttggctataatgacttgattgtagatccacggaactttgagtggatgagggaggccaattgccctgttgttgctgatataactcattcattacaacagcctgcaggcaaaaagctggaaggtggtggtgttgctagtggcggtcttcgtgaattaattccttgtattgccaggacagctgttgctgtgggagtagatggaatatttatggaggtgcacaatgatcccctgagtgctccagttgatggtccaacacagtggcctctgcgtcatctggaggaactactagaagagcttgttacgcttggaagagttagcaaggggaagcagcagttcaaaattgatctcactccattttgtgattagggcacagaagtttggctatcaatgattctgcagagaagatgtctccagtcgttttagcttacatgtggtgatgagcttcctgcatttttagtttgctactttgaagacattacacagcgtgtattcgttgctatactgaacgttattaaattttcactgtttattgtaatttgatccaagaccgattcattggtgagagttgtaacacttccagtgcatttagaaggctaaaaatgctatctttggacttcctttagaacctttcggtaccatatgttacacctttgtaagaaattcatgctatttaacttacactgtgaattcattcaagttctgttgttgttgaggaagtattccttctatgcattcgattgagatgcaacagttgct

SEQ ID NO: 5001 - DNA, 1226 bp, Echinacea purpurea
tggaaatatgactttttgaccacactgtgttgatgctttgcattgaattgaatctcagatccaaataattccgagatgatcgttacgtatatttcactcacagtctgtggcgaaacattgcattagtctatcatcagatccggagaatttcgatttctcactccgcttttgagctgctcgtctcgtttccgtttgtgttccatcgtccggctgcaaattctcgagcggagatatggattcgtccactctgctttacaatcagctcaaggctgcagagccattcttcctgctggcaggccccaatgtgattgagtcggaggagcacattctttacatggccaaaaaccttaaatccatcgctactaaacttggtctgccgttggtttttaaatcgagcttcgacaaagctaatcgaacatcgtctaagtcgtttcgtggcccgggtttggctgaaggcttgaagatccttgagagggtgaaaacaacttacgacattcctatagttactgatgtgcacgagacagtacagtgtgaagctgttggtaaggttgccgacataattcagattcctgcttttttgtgccgacagacagatctgcttgtagcagctgccaagactgggaaaattatcaacattaagaaaggccagttttgtgctccttcagtcatggaaaattctgctgaaaagattagattggctggaaacgataatgttatggtttgtgagagaggcacaatgtttggctacaatgacttgattgttgatccacgaaattttgagtggttgagggaggccaattgtcctgttgtggctgatataacacactctctacaacaaccagcagggagaaagcttgaaggtggtggtgttgccagtggtggtcttcgcgaactgataccctgcattgcccggacagcagttgctgttggagtcgatgggatctttatggaggtgcatgatgacccgctaaaggcaccagttgatggtccaacacagtggcctctgcgtcacctggaggaacttttggaagagctcattgcaattgctcgggttagcaaggggaagaaacagtatcagatagacctcactccatttctcccttgagaaccagagcatcgacttccttgtataagccagagcagattctactgcgcgcctctacttccatgggcaggactggcgttcgagaagacccttcgctttgtgatatatttaaccttattat

SEQ ID NO: 5002 - DNA, 1241 bp, Rosmarinus officinalis
gagatgatcgttacgtttatttcactgtctgtggcgaaacattgcattaatacatcatcagatccggcgaatttcgatatctcactccgctttgtgagctgctcgtctcatttccgtttgtgttgcatcttgctcgagcggagatatggattcgtcaaatctgctttacaatcaactcaaggccgcagagccattcttcctgctggcaggccccaatgtgatcgaatcggaggagcacattctttacatggccaaaaaccttaaatccatcgcttctaaacttggtctgatgctggtttttaaatcgagcttcgacaaagctaatcgaacatcgtctaagtcgtttcgtggcccgggtttgactgaaggtttgaagatcctggagagggtgaaaacaactttcgacattccaatagttactgatgtgcacgagacaatacagtgtgaagctgttggcaaggttgccgacataatccaaattcctgcttttttgtgccgacagacagatctgcttgtagcagctgccgagactgggaaaattatcaacattaagaaaggccaattttgtgctccttcagtcatggaaaattctgctgaaaagattagattggctggaaatgataatgttatggtttgtgagagaggcacaatgtttggttacaatgacttgattgttgatccacgcaattttgagtggttgagggaggccaattgtcccgtcgtagctgatataacacactctctacaacaaccagctgggagaaagcttgaaggtggtggtgttgccagtggtggtcttcgcgagctgataccttgcattgccaggacagcagttgctgttggggttgatgggatctttatggaggtgcatgatgacccgttaaaggcgccagttgatggtccaacacagtggcctctacgtcatctggaggaacttttggaagagctcattgcaattgctcgggttagcagggggaagaaacagtatcaaatcgacctaactccatttcacccgtgaggatcagagcatcgacttccttgtataagccagagcagattccactgcgtgcctctacttccatgggcaggacaggcgtcgaggaaaacctttggctttgtgatatatttgaccgtaaaatgtattttctttccttgtacgtggtataatcatcttggactcctatagttgaagatagattcatatattttaaacatgcaataaatattcgtaatttcttctt

SEQ ID NO: 5003 - DNA, 1579 bp, Ananas comosus
aaacagcagcagcgcccaatacacactcggattcgtcactcgcttcttcccctcctccggtaaaaagcttctgagcggtccaaggatacagcggcgcgtgctaaataaattacttacaacaattgcgattttaatctctgtaatcttaacattttcgtgatcgccatttcttttctccattttccttcgactaattcaattagatccatttctcagaggaatttattactagatctaacactgctctgatggattttcttttacgagataggtcactctcactgcgttgaggcatggattcctctgtggcacttttcaaccagctcaaggccgcagagccctttttcttattagcaggccctaatgttatcgaatctgaagagcatgttctaaagatggctagaaatttacaaagtgtcgcatccaagctaggattgccgctggtcttcaaatccagcttcgacaaagctaatcgtacatcttcaaaatcatttcgagggcccgggttggaagaaggtttgaagatccttgaaaaggtcaaagtcacatatgacattccaataatcactgacgtgcatgaaagctaccagtgtgaagctgtaggaagagttgctgatattatccaaattcctgctttcctctgccgccagactgatcttctagttgcagctgctaagacaggaagaataatcaatattaagaaaggccaattttgcgctccttcggttatggtaaattctgcggaaaaaatcagactagctgggaaccaaaacgtgatggtttgtgagcgtggcaccatgtttggctacaatgatttgattgtcgatccaaggaacttggagtggatgagagaagcaaattgccctgttgtcgcagatattacacattcactgcaacaacctgctgggaaaaagcttgaaggtggcggcgtggcgagtgggggtctgcgagaactaataccttgtattgcaaggacatgtgttgcagttggcgtggatgggatcttcatggaggtacatgatgatcccctaaatgcgcctgttgacggtccaacacaatggccattgcgccagttggaggagcttttggaggaactcatagctatagctcgggtcactaaggggaaaaagccattcaaaattgatctcacaccgtttcgtgattaacctgaagcggccgataacaaaaggcgctgcatctgtggttgcagatctgcctactctgatgtgaaccagttcagtctaagtatcagtagtgttaaatgtcttccttctatcgaacatttagtcatcagtacctacttatcgtattttggaagcagcttttgaagacatcagtaaattgtaggtgtttattggatctagttggagattctggtaaaatcgctattcgaatgaaatggtcgaaacaagttttgatttccaataaaacttcctcgagagctctttgttgcagttataaatttaattgtgaattctcagatatggggttttgcttttgagcccagtacatttttacttccattgcgcaagctttttaactcgagtaggagttgctcttttgcataaaatgtgtgatg

SEQ ID NO: 5004 - DNA, 1184 bp, Helianthus annuus
ctcactagcgatctctcttcttcaatccagatttacttcttcttcttcttcaaatatggactcatcaactttgttatacaatcagcttaaggaagcccagccgttctttgtgttggctggtcccaatgtgattgaatccgaggaacatattttgcatatggcgaaacaacttaaggctgtcacttcaaaactcggattgccactagtttttaagtctagctttgacaaagctaacagaacttcatcaaaatcctttcgagggcctggattagccgagggattgaagatccttgaaaaggtgaaaacaacatatggcctgcccattgtgaccgatgtacatgaatctgaccagtgtgaagcagttggcagggttgcagatataattcaaattccagcttttttgtgccgacagactgatcttctagttgcagctgccaagaccggaaagattgtgaatataaagaagggccagttctgtgccccctctgtcatgacaaactctgcagaaaaagttagattggctggaaatcaaaacgtcatggtttgtgagagagggaccatgtttggatacaatgatttaattgttgatccacgcaacttcgagtggatgcgagaagctaattgccctgttgtagcagatgtcacacatgcattacagcaacctgctgggaaaaagctggaaggtggcggtgttgcgagtggaggtcttagggaattgataccttgcattgcaaggacagcagttgctgtcggagtggacggacttttcatggaggtgcatgatgatccacttaatgctccagttgatggtccaacacaatggcctctgcgccattttgaggagctgctagaagagctgatggcaatcgctagggttaccaaggggaagaagcaatacaaaatcgatctcactccatttcgtgagtaaaaaactcttgtagactggttttccatgcgtgatcaaacagaaaggcaagagtctgtggatgtgcctgaacgtgtgaaagatcacagcatcataatctattaatcgatgtcttagaatctattgtttgggaaatacaatgttgttgaattcatggtgtatcagtatctagctattagtttatgatttggttcctctatgttgttcctttcattttagggttggttatcttaatagatgttaaagagagtttgaatat

SEQ ID NO: 5005 - DNA, 1236 bp, Elaeis guineensis
agcactcaaaactagtggccactgcaacggctcttctttacctctcctgtgtctccgagctcgcgggcgacctctggagagaatctctcctatcacatctaccatggagtctcctgtggcactctacaaccagctcaaggctgcagagccatttttcttattagctggcccgaatgtaattgaatcagaggaacatattctcaagatggccaacatctaaaaatgtcacgtctacgtttggcttaccactggttttcaagtccagctttgacaaagctaaccgaacttcttcgaaatcatttcgcggtccgggttggaagaaggcttgaagatccttgagaaggtgaaactgacatatgatcttccaatcgtaactgatgtgcatgagagtagccagtgtgaagctgttggaagagttgctgatgttatccaaatacctgctttcctctgccgccagacagatcttctagttgcagctgccaagactgggaagataatcaacattaagaaaggccaattttgtgctccctctgttatgttaaattccgcagagaaagttagacttgctgggaaccaaaatgtgatggtttgtgagcgaggcaccatgtttggctacaatgatttaattgttgatccacgcaatttggagtggatgagggaagcaaattgtcctgttgttgcagatgttacacattcactgcaacaacctgccggaaaaaagctggaaggtggaggtgttgcaagtgggggtctgcgtgaactaataccatgtattgcaaggacatcagttgcagttggcgttgatggaatattcatggaggtgcatgacaatcccctaaaagcacctgttgatggcccaacacaatggcctttgcgccacttggaagagctactagaagagcttatagcaatcgcaagggtcagcaaggggaaaaagccattcaagattgatctcacaccctatgaagattaacctgaagcaaccaggataataacagtgcaagttgcattgcagtttatccacaactcctatgcattagccatgtatctctggagtctgagggtttttctttatccttgttgctctctttttcctttggagtttgattgtatgatagtataaaagtacattgtcaggccatatcaatttgttgtcaaattttatgttttttggacttaagctgttacttctggctctcttttgctagctattaattttttttccttgctacttag

SEQ ID NO: 5006 - DNA, 1256 bp, Euphorbia esula
actggcccctatctgctgcataaaaattggccatggattcatccactcccgttatttaacaagctcaaggctgcagaaccatttttcttactagctggccccaatgtgattgaatcggaagaacacattcttaaaatggccaagcatctcaagattattacagataaagttgggatcccgctggtttttaagtcaagctttgacaaagctaacaggacatcctcaaagtcatttcgaggtcctggcatgactgaagggttaaagattcttgagaaggtcaaaagagaatataacatccctattgttactgatgtacatgaaagtattcattgtgaagcagttgggaaagttgcagatattatacaaattcctgcatttttatgccgtcagacagatcttttagttgctgctgccaagactgggaaaattattaatattaaaaaaggacagttttgtgctccatctgttatggtaaattctgcagagaaggtccagttagctggcaattcaaatgtaatggtttgtgagcgaggaactatgtttggctaccatgatttgattgttgatccacgtaatctcgagtggttgagggaaggtggctgtcctgttgtagctgatattacacattcgttacagcagcctgctgggaaaaagttggaaggtggaggtgttgctagtggaggtcttcgagaattaatcccatgcattgcaaggacagcagttgctgtgggcgtggatggaattttcatggaggtgcatgataatcctctgaatgcccctgtggacggtccaacacaatggcctctacgccatttggaggaactgctagtggagctcgtggcgatagctagggcaagtaagggaaggaagacaatggaacttgatctcacaccattatccttggagtaaagcaagagatagtgaatttattcttactgtggattacctacctaaatcttaaagaattgagtattggaagagaagatatgttgtattattacatttttctagtaatattatacggtaaaattttaaattacaccgaagaaatagtatttcggaagcgagtaaagtgaaactgggatccccaagggctcaaggggccctgaatgcccaaggggatgggtatatgtgtgtttatgattccatttttttttcttgtactgttgtatataatggtctgttaaacatagcctaaaacagaataacggattaaattactgatgattcagattatatattctccaaactaagcc

SEQ ID NO: 5007 - DNA, 1729 bp, Glycine max
gaagacgaagggtatagagctcataacaatccatttcgtcttaatttgtttctgttttcttcattctgtcagccatggcgatggtgcaagatgaacgttgcgttcagagaagctactggattgaacataccacagatttgtccgtagagtcaatgatgctcgattccaacgcctctgatctcgacaaggaagaaagacccgaagttttgtccctactaccagcatatgaaggaaaatcagttgtagaacttggagcaggtattggaagattcacaggtgaattggccaagaaagctggccagttgcttgctgtggatttcattgagagtgctataaagaagaatgaaagcattaatggacaccacaagaatgtcaagttcatgtgtgctgatgtcacttctccaaacttgcatatttctgaaggatcagttgatctgatattctccaattggttactcatgtatctttcagataaagaggttgagaatttagctgcaaggatgatcaaatggttaaaagttggtggatatgtattcttcagagaatcatgtttccaccaatctggagattccaagagaaaatacaacccaactcactatagggaacctagattttacactaaggtatttaaagagtgccatataagtgatgacaccaggaattcctttgaactttcccttgttggctgtaaatgtattggagcttatgtccgaaataagaagaatcaaaaccagatttgctggttatggaaaaaagttagatcacaggatgatagggggttccagaggttcttagatagtgttgagtataatcataaggatatattactttatgagagtgtttttggtcaaggttttgtgagcacaggaggacttgaaacaaccaaggaattcgtggcaaagttgggactaaaacctggccaaaaagtactggatgttggttgtggtacaggaggaggtgacatttacatggctgaaaattttgatgttgaggttgttggcattgacctctccataaacgtgatttctcttgctattgaacgtgctattggactcaaatgctcggtagaatttgaatgtgccgattgcactaaaaaaacataccctgagaatacatttgatgtaatctattcccgtgacacattgttacacatcaaagataaaccaccactattcagatcattttacaaatggttgaagcgtggaggtacacttattattactgattactgcaaaagtgaaggaagtctatcattaggatatgctgagtatataaaaaaaggaggatatcatatccatgacatgaaaacatattgtcggatgctcgagaatgctggatttgatgatgttgttgccgaggatcgaactaatttgttcatgaaaacactacaacaggagttaaatgcccttgacagcaagaaggatgatttcattgatgacttctcggaggaagactacaatgaaattactgaaagatggaaggccaagcagatgcggggtgcagatggtgaacaaatatggggcttgttcgttgccaagaaagaataatgcttcttattatatgccttactatgcctctatattttgttcagtgtgaacagttttccaaatgatagtttggataagtattttgtttctatttatatcttctgagaaaaatctttgtgcgttctagcttaagattttcgaaacttctatgcatcctcttctatttgaatgtgatgtttact

SEQ ID NO: 5008 - DNA, 1767 bp, Glycine max
aaagcaaagaatagaagacgaagggtatagagctcataacaatccatttggtcttaatttgtttctgttttcttcattctgtcagccatggcgatggtgcaagatgaacgttgcgttcagagaagctactggattgaacataccacagatttgtccgtagagtcaatgatgctcgattccaacgcctctgatctcgacaaggaagaaagacccgaagttttgtccctactaccagcatatgaaggaaaatcagttgtagaacttggagcaggtattggaagattcacaggtgaattggccaagaaagctggccagttgcttgctgtggatttcattgagagtgctataaagaagaatgaaagcattaatggacaccacaagaatgtcaagttcatgtgtgctgatgtcacttctccaaacttgcatatttctgaaggatcagttgatctgatgttctccaattggttactcatgtatctttcagataaagaggttgagaatttagctgcaaggatgatcaaatggttaaaagttggtggatatgtattcttcagagaatcatgtttccaccaatctggagattccaagagaaaatacaacccgactcactatagggagcctagattttacactaaggtatttaaagagtgccatacgagtgatgatacccggaattcctttgaactttcccttgttggatgtaaatgtattggagcttatgtccgaaataagaagaatcaaaatcagatttgctggatatggaaaaaagttagatcacaggatgatagggggttccagaggttcttagatagtgttgagtataatcataaggatattttactttatgagagtgtttttggtcaaggttttgtgagcacaggaggacttgaaacaaccaaggaattcgtggcaaagttgggactaaaacctggccagaaagtactggatgttggttgtggtactgggggaggtgacatttacatggcagaaaattttgatgttgaggttgttggcattgacctctccataaacataatttctcttgccattgaacgtgctattggactcaaatgctgtgtagaatttgagtgtgccgattgcactaaaaaaacatttcctgtgaatacatttgatgtaatctattcccgtgacacattgttacacatcaaagataagccatcactattcagatcattttacaaatggttgaagcgtggaggtacacttctgattactgattactgcaaaagtgaaggaagtctatcattaggatatgctgagtatataaagaaagggggatattatattcatgacatgaaaacatattgtcggatgctcgagaatgctggatttgatgatgttgttgccgaggatcgaactaatttgttcatgaaaacactacaacaggagttaaatgcccttcacagcaagaaggatgatttcattgatgacttctcggaggaagactacaatgaaattactgaaagatggaaggccaagcagatgcggggggcagatggtgaacaaatatggagcttgttcattgccaagaaataataattcttcttctcatgatatgtcttactttgcctatatttagttcagtgtgaacagttttccaaatgatagtttggataactattttgttgttatttatatcttctgagcaaaatgtttctgcgttctagcaaaagataatcaaaacttctatccgttctcttctatttgaatgtgatgtttactaattatggcttccatgctcaaaat

SEQ ID NO: 5009 - DNA, 2222 bp, Glycine max
ataactcataacaagccatttctttcgtcttaatttgttctcttcagccatggcgatggtgcaagatgaacgatgcgttcagaaaagctactggattgaacatacgacggacttgtccgtagagtcaatgatgctcgattccaacgcctctgatctcgacaaggaggagagacccgaagttttgtccctactaccaccatatgaaggaaaatcagttgtagaacttggagcaggtattggaagattcacagttgaattggccaagaaagctggccagttacttgctgtggatttcattgagagtgctataaagaagaatgaaagcattaatggacaccacaagaatgtcaagttcatgtgtgctgatgtcacttctccaaacttgtatatttctgaaggatcggttgatctgatattctcaaattggttactcatgtatctttcagataaagaggttgagaatttagctgcaaggatgatcaaatggttaaaagttggtggatatgtattcttcagagaatcatgtttccaccaatctggagattccaagagaaaatacaacccaactcactatagggaacctagattttacactaaggtatttaaagagtgccatataagtgatgacaccaggaattcctttgaactttcccttgttggctgtaaatgtattggagcttatgtccgaaataagaagaatcaaaaccagatttgctggttatggaaaaaagttagatcacaggatgatagggggttccagaggttcttagatagtgttgagtataatcataaggatatattactttatgagagtgtgtttggccaaggctttgtgagcacaggaggacttgaaacaacaaaggaatttgtggcaaagttgggattaaaacctggccaaaaagtactggatgttggttgtggtacaggaggaggtgacatttacatggctgaaaattttgatgttgaggttgttggcattgacctctccataaacgtgatttctcttgctattgaacgtgctattggactcaaatgctcggtagaatttgaatgtgccgattgcactaaaaaaacataccctgagaatacatttgatgtaatctattcccgtgacacattgttacacatcaaagataaaccaccactattcagatcattttacaaatggttgaagcgtggaggtacacttattattactgattactgcaaaagtgaaggaagtccatcattaggatatgctgagtacataaaaaaaggaggatatcatatccatgacatgaaaacatattgtcagatgcttgagaatgccggatttgatgacgttgttgccgaggatcgaactaatttgttcatgaaaaccctacagcaggagttaaatgcccttgagagcaagaaggatgatttcattgatgaattctcggaggaagactacaatggaattactgaaagatggaaggccaagcagatgcggggtgcagatggtgaacaaatatggggcttgttcgttgccaagaaagaataatgcttcttattatatgccttactatgcctctatattttgttcagtgtgaacagttttccaaatgatagtttggataagtattttgtttctatttatatcttctgagaaaaatctttgtgcgttctagcttaagattttcgaaacttctatgcatcctcttctatttgaatgtgatgtttgctaattatggtttccatgcttagaatagatttcaatatcctgtttttgtttgcctttgacaaattaggccaccctagtgaacgttttttgtgtgtatataacaatctagccatttgtgaattgcggttttaaaagtagaaattagaaggttaaacacttaaaccagtttggttttagctttgaaacgctttgaagtaacaagtgcatttttctatctttgaaaaatttaatcatcaacatgatactccttattttaaagcgtgtaacacatgttatttagatatctaatcaaaatcttttcaataatattattcatattattagatatttttttctctttatcaaattattcatcttatctcatttttttcccactgttcctatttctcctggaacggcggaaccacaagcaaaagagaatgtaatttccatgtgttacactttgcggattaatccatttgtttgtatatttcttttttacatttttatctttgtagttacacaaattttacattttgac

SEQ ID NO: 5010 - DNA, 1857 bp, Medicago truncatula
tgatggtacaaatgttatatataagaaattacaagggctatagcttatagaaggcaaacacagcttcaccattgagtacttttttcatttctttctctctcatttttcttctccattctctcatatatggctcatttggaagcaatgaaacaaggtggtgaagatgaacgtgaagtgcaaagaagttactggaaagagcattgtgtaaatttgtcagttgagtcaatgatgctcgattcaaacgcctctcatctcgacaaagaagagagacccgaagtactttctctattaccatcatatgaaggaaaatcagttttagagcttggagcaggtattggaagatttacagctgaattggctcagaaagctggccagttgcttgctgtggacttcattgagagtgcaataaagaagaatgaaaatactaatggacaccacaagaatgtcaagttcatgtgtgctgatgtcacatctccaaatttgcatatttctgaaggatcagttgatttgatattctcaaattggttactcatgtatctttcagatgaagaggttaaaaacttagctgaaaggatggtcaaatggttaaatgttaatggatgtatattctttagagaatcttgtttccaccaatctggagattcaaagagaaaatacaatccaactcactatagggaaccaagattttacactaaggtatttaaagagtgtcatatgagtgatgataatgggaactcctttgagctttctcttgtgggctgcaaatgcattggagcttatgttagaaataagaagaatcaaaatcagatttgttggatatggcaaaaagttaaatcacaagatgatagacggttccaaaggttcttagatagtgttgagtataaccataaggatatcttactttatgaacatgtttatggtcatggctttgtgagcacaggaggacttgaaacaacaagggaaattgtggcaaagttaggactaaagccaggtcaaaaagtactagatgttggttgtggtattggaggaggtgacttttacatggctgaaaattttgatgttgaggttgttgctattgacctctccatcaacatgatttctctagctatcgaacgtgccatcggactcaaatacgcggttgaatttgaatgcgttgattgcacaaaaaaatcgtatcctgataagaccttcgatgtaatctacagtcgcgacaccttattacacatcaaagataaaccaacattgttcagatcattttataagtggttgaagcctggaggtacacttttaattactgactattgcaaaagtgttggaagtctttcagtagaatatgcagagtatataaaaaagagaggatattatatccatgacatgaaagcatattttcagatgcttgagaatgctggatttgatgatgtcattgctgttgatcaaaccaatttgttcttgaaaactctacaaatggagttgaatgcccttgagaacaagaaggttgatttcattgatgatttctctgaggatgactataatgaaattgttgaaagatggaaggctaagcagatgagaggtgtagctggtgagcagatatggggattgttcattgccaagaaaaaatgatgcttctttcttaagttatgtcatgtagtgtaatgaagatatttagttcagtgtgaacaaccttgccactaataattatgttgtttttagcttggatagcttgttattctgcttcctcttttatatggaagtaaatgtgatgttcacctattactcttatcatggtttttatgaatattatttctattaccatttttatcattatatgcaaactttggatatgtagcttagtgtttg

SEQ ID NO: 5011 - DNA, 1812 bp, Cajanus cajan
aatgtgaatatgagaataattaagcaggtgttggagatgaacgtcgagttcagagaagctattggattgaacattcaacagaattgtcagtagagtcaatgatgctcgattccaacgcctctgatctcgacaaggaagaaagacccgaagttttgtccctactaccagcatatgaaggaaaatcagttgtggaacttggagcaggtatcggaagattcacaggtgaattggctaagcaagctggacaattgcttgctgtggacttcattgagagtgctataaagaaaaatgaaagcattaatgggcaccacaagaatgtcaagttcatgtgtgctgatgtcacatctccaaacttgcatatttctgaaggatcagtcgatctcatgttctcaaattggttacttatgtatctttcagataaagaggtggagaatttagctgcaaggatgatcaaatggttaaaagttggtggatatatattctttagagaatcatgtttccatcaatctggagattccaagagaaaatacaacccaactcactacagggaacctagattttacactaaggtatttaaagagtgccatatgagtgatgataccgggaattcctttgaactttcccttgttggttgtaaatgcattggagcttatgttcgaaataagaagaatcaaaaccagatttgttggatatggcaaaaagttagatcacaagatgatagggggtttcaacgattcttagatagtgttgagtataatcataaggatatttttctgtatgagtgtgtttttggccaaggctttgtgagcacaggaggacttgaaacaacaaaggaatttgtggcaaagttaggactaaaacctggtcagaaagtgttggatgttggttgtggtactggtggaggtgacttctatatggctgaaaattttgatgttgaggttgttggcattgacctctctataaatatgatttctcttgctattgaacgtgccattggactcaaatgctcagtagaatttgaatgtgctgattgcactaaaaaaacatacgctgagaatacatttgatgtaatttattcccgtgacacattgttacacatcaaagataaaccatcactgtttagatcatttcacaagtggttgaagcatggaggtacacttctaattactgattactgcaaaagtgcaggaaatttatcattaggatatgctgagtacatacaaaaaggaggatattgtatccatgacatgaaaacatattgtcagatgctcgagaatgctggatttgatgatgtcattgttgaggatcaaacaaatttgttcatgaaaacactacaacgggagttaaatgcccttgaaagtaagaagggtaatttcattgatgaattctcagagaaagactacaatgagattactgaaaggtggaaggccaagcagatgaggggtgcaaatggagaacaaatatggggcttgttcattgccaagaaaaaatgatgcttcattctcatgatatgacttgttatgcctatatttagttcactatgaacagttttccgaatgatagtttggatgattactttggtgttatttataaatcttgaaaaaatatttaagcgttctatcaagataaacgaaacttctatgcatccacttgtatttgaatgtaatgtttgctacttatgtcttctatgcttaaaatagatttcaatatcctgtttttgattgtcttgacaaattaggccactataataacttgccacctatgaaatgcaatttgaaaagtaaaatggtaaaattagtttggttttagctt

SEQ ID NO: 5012 - DNA, 1872 bp, Trifolium pratense
atataagtaatgggaaggtaattagctatatcttataagaaggcaataataataacacaagattatttcattcctctctttctctctcaattttcttctccattccaccatggctaattcggaagcaatgacacaaggtggagttatgggagaagtaaaagaagatgaacgtgaagtacagagaagttactggaaagagcattgtgcagatttgtctgttgagtcaatgatgctcgattccaacgcctcaaatctcgacaaagaagaaagaccagaagtactctccttattaccagaatttgaaggaaaatcagttttagagcttggagcaggaattggaagatttacgagtgaattggctcagaaagctggacaattgcttgcggttgacttcattgagagtgcaataaaaaagaatgaaaataccaatggacactacaagaatgtcaagttcatgtgtgctgatgttacatctccaaacttgcatatttctgaaggatcagttgatttgattttctcaaattggttactcatgtatctttcagatgaagaggttaaaaacttagttgaaagaatggtcaaatggttaaaagttgatggatatatattcttcagagaatcttgtttccaccaatctggagattcaaagagaaaatacaatccaactcactatagagaacccagattttacactaaggtttttaaagagtgtcatatgagtgatgaaaatgggaattcctttgagctctctcttgttggttgcaaatgcattggagcatatgttagaaataagaagaatcaaaatcagatttgctggatatggcaaaaagttaaatcacaagatgatagagggttccaaaggttcttagatagtgttgagtataatcataaagatatcttactctatgaacatgtttatggtcaaggctttgtgagcaccggaggacttgaaacaacaagggaaattgtggcaaagttagaactaaagccaggtcaaaaagtactagatgttggttgtggtattggaggaggtgatttttacatggctgaaaattttgatgttgaggttattgccattgacctctccataaacatgatttctctagccatcgaacgcgccattggactcaaatattcagtagaattcgaatgtgtcgattgcactaaaaaatcgtatcctgagaacacattcgatgtaatctacactcgcgacaccttgttacacattaaagataaaccaacattattcagatcattttataagtggttgaagcctggaggtacacttttaattactgactattgcaaaagtgttggaagtctttcattagaatattctgagtacataagaaagagaggatattatatccatgacattaaatcatattgtcagatgcttgagaatgctggatttgatgatgtcattgctgaggatcaaaccaatttgttcttgaaaactctacaaatggagttaaatgcccttgagaacaagaaggttgatttcattgatgatttctgtgaggatgactacaatgaaattgttgaaagatggaaggctaagcagatgagaggtgtagctggtgagcaaatatggggcttgttcattgtcaagaaaaaatgatgcttccttctcatgaaataatgtcatgtaataaatatatttagtgtgtgaccaaatttctattaataattgttctgcttttagcttgaaatggataactttttatgcatcctcttctatatggaagtaaatgtgatgatctacaaaggatgtggtttttatgagtattaattttagaaaaataataaatggtgttcatgggtattagttaagaaaaatttatacagtaaaaatatattagaatttgtgcc

SEQ ID NO: 5013 - DNA, 2043 bp, Cicer arietinum
aaaattgggagccctgtggaagctttcttttaatgtgtgcacataaatatctcctttaaatttctctttcttgtatgatggtaagtgttttatataagtaccattggaaggataggaatatagcaacttatgcttatgaaggcaacaataacaacataacttccatttctttctttctctctctcatttttgttctccattcttttctttgttacaatttttcttctccattctaccatggccaatttggaagctatgacacaagaagaagatgaacgtgaagtccagagaaattattggagagagcattgtgcaaatttgtcagttgaatcaatgatgctcgattcaaatgcctctcatcttgacaaagaagagagacctgaagtactctccctattaccagcatatgaaggaaaatcaattttagagcttggggcaggcattggaagatttacaagtgaattggctaaaaaagcagggcaattacttgctgtggacttcattgagagtgcaataaaaaaaaatgaaaatattaatggacaccacaagaatgtcaagttcatgtgtgctgatgtcacatctccaaacttgcatatttctgaaggatcagttgatttgatattctcaaattggttactcatgtatctttcagatgaagaggttgaaaatttagctgaaaagatggtgaaatggttaaaagttgatggatatatattctttagagaatcttgttttcaccaatctggagattcaaagagaaaatacaatccaactcactatagggaaccaagattttacactaaggtatttaaagagtgccatatgagtgatgataatggaaattcctttgagctttctcttgttggctgcaaatgcattggagcttatgttagaaataagaagaatcaaaatcagatttgttggctatggcaaaaagttaaatcacatgatgatagaaggttccaaaggttcttagacagtgttgagtataatcataaggatatcttaatctatgagaaagtttatggtcaaggctttgtgagcacaggaggacttgaaacaacaaaagaatttgtggcaaagttaggactaaagccaggtcaaaaagtcctagatgttggttgtggtcttggaggaggtgacttttacatggctgaaaattttgatgttgaagttattgcaattgacctctccataaatatgatttctctagctatcgaacgcgcaattggactcaaatatgcagttgaattcgaatgtgtcgattgcactaaaaaaacatatcctgaaaagacatttgatataatctacactcgtgacactttgttacacatcaaagataaaccaacacttttcagatcattttataagtggttgaagcctggaggtacacttttaattagtgactattgcaaaagtgttggaaatctttcattagaatatgctgagtacattaaaaagagaggatattatatccatgacatgaatgcatattgtaagatgcttgagaatgctggatttgattatgtcattgatcaagatcaaacaaatttgttcttgaaaactctacaaaaagagttaaattcccttgagaacaagaaggttgatttcatcaacgaattttcggaggatgattacaatgaaattgttgaaagatggaaggccaagcagatgagaggtgaagctggtgagcaaatatggggactgttcattgccaagaaaatttgatgcttctttcttatgttatcatgtaatgaatgcatttagataagtgtgaacaaccttccattaataattgttctgcttttagaatggatagttttgtatgcatcctattttctattctatatggaagtaattgtgatgttcactaaattattatggtttttatatatacattactatttttattatcaataagcaaaatgcatgtctagcttagaggttgaaaggatttccacaaattaaagaagcttatgcttttatgatgttgtgtcaaatatttcttttattattagtgataattttacaattatcattaaa

SEQ ID NO: 5014 - DNA, 1659 bp, Trifolium pratense
agaagtaaaagaagatgaacgtgaagtacagagaagttactggaaagagcattgtacagatttgtctgttgagtcaatgatgctcgattccaacgcctcaaatctcgacaaagaagaaagaccagaagtactctccctattaccagaatttgaaggaaaatcagttttagagcttggagcaggcattggaaggtttacatgtgaattagctcagaaagctggacaattactcgcagttgacttcattgagagtgcaataaagaagaatgaaaataccaatggacactacaagaatgtcaagttcatgtgtgctgatgtcacatccccaaacttgcatatttctgaaggatcagttgatttaattttctcaaattggttactcatgtatctttcagatgaagaggttaaaaaattagctgaaagaatggtcaaatggttaaaagttgatggatatatattctttagagaatcttgtttccaccaatctggagattcaaagagaagatacaatccaactcactatagagaacccagattttacactaaggtttttaaagagtgtcatatcagtgatgaaaatgggaactcctttgagctctctcttgttggctgcaaatgcattggagcatatgttagaaataagaagaatcaaaatcagatttgctggatatggcaaaaagttaaatcacaagatgatagagggttccaaaggttcttagatagtgttgagtataatcataaagatatcttactctatgaacatgtttatggtcaaggctttgtgagcacaggaggacttgaaacaacaagggaaattgtggcaaagttaggactaaagcaaggtcaaaaagtactagatgttggttgtggtataggaggaggtgacttttacatggctgaaaattttgatgttgaggttgttgccattgacctctccataaacatgatttctctagctatcgaacgcgcaattggactcaaatattcagtagaattcgaatgtgttgattgcactaaaaaatcgtatcctgagaacacattcgatgtaatctacactcgtgacgccttgttacacataaaagataaaccaacattattcagatcattttataagtggttgaagcctggaggtacacttttaattactgactattgcaaaagtgttggaagtctttcattagaatatactgagtacataagaaagagaggatattatattcatgacatgaaatcatattatcagatgcttgagaatgctggatttgatgatgtcattgttgaggatcaaactaatttgttcttgaaaactctacaaatggagttaaatgcccttgagaacatgaaggttgatttcgttgatgatttctgtgaggatgactacaatgaaattgttgaaagatggaaggctaagcaggtgagaggtgtagctggtgagcagatatggggcttgttcattgccaagaaaaaataatgcatccttctcatgttataatgtcatgtaataattatatctatttagtgtgtgtgaccaaatttctgttataatttttctgcttttagcttggaatggatagctttttatgcatcctcttctatatatatagaagtaaatgtgatgttctataaaggatgtgatttttatgaatattatttttatta

SEQ ID NO: 5015 - DNA, 1630 bp, Arachis hypogaea
caaattaattaaaagttaaaactactcgcaaagcttgccttgcttcttccaccgtttcaatttcgtcattccgcagccatgaatgttatgatgccttcactggctgctacgacgccgcaagataatagaggtggtggtagagatgaacggtgcgttcagagaagctactggattgagcattctgcagatttgtcggtggagtcaatgatgctcgattcaaacgcctctgatctcgacaaggaagaaagacccgaagtactgtctctattaccagcatatgaaggaaaatcagtcttagagctgggagcaggtattggaagatttacaggtgaattggccaagaaagctggccagctgcttgcagtggacttcattgagagtgcaatcaagaagaatgaaagcattaatggacaccacaagaatgtcaagttcatgtgtgctgatgttacatccccaaacttgcatatttctgaaggatcaattgatttgatattctcaaattggttgcttatgtatctttcagataaagaggttgagaatctagctgaaaggatgatcaaatggttaaaggttggtggatatatattcttcagggaatcttgtttccatcaatctggagattccaagagaaaatacaacccaactcactacagggaacccagattttacacgaaggtatataaagagtgccatatgaatgatgaaacaggggattcctatgagctttcccttgttggctgtaaatgcattggagcttatgtcagaaataagaagaatcaaaaccagatttgctggatatggaaaaaagtcaggtcacaagatgataaagggttccagaggttcttagacagtgtggagtacagtcataaggatatcttaagatatgagcatgtttatggccaaggttttgtgagcacaggaggacttgaaacaacaaaggaaattgttaaaaagttgggactgaaaccaggtcagaaaatattggatgtcggttgtggtactggaggaggtgatatttacatggctgaaaattttgatgttgatgttgttgggattgacctctccataaatatgatttctcttgccattgaacgtgtcattggactcaaatgcacggttgaatttgaatgtgccgattgcaccagaaaaacatatcccaagaatacatttgatgtaatctacactcatgatgccatgttacacatcaaagataaaccggcactgtttgaatcattttataagtggttgaagcatggaggtacacttctaattactgattattgcaaacgagctggaagcatatcattagaatgtgaagaatacattaaaaaaggaggatattatatccatgacatggaagcatattatcagatgcttaagaatgctggattcgatgatgtaattgctgaggaccaaacagaactgttcatgaaaacactacaacaggagctaaatgcccttgagaacaagaagcattatttcattgatgaattctctgaggaagactacaatgagattgttgagagatggagggccaagcagattagaggtgcagctggggagcagaaatggggcttgttcattgccaagaaaaaatgatacttatttatcatgatatgtcatgttatag

SEQ ID NO: 5016 - DNA, 2151 bp, Panicum virgatum
ccccctgtgtgccttggcagtctcagccaagagctaataccagtatacccgccgccgcccgccccaccagcacctaacgccccccgcctgctttacagtttacaccgcgtcccgcgccgccgccgccgcgttgggttgcgtcccagatccgccgagctcttcgactggtcgctcgagcaagatgaagatcacggtgcgggggtcggagatggtgtacccggcggcggagacgccgcggcggcggctgtggaactcgggcccggacctggtggtgccgcggttccacacgcccagcgtctacttcttccgccgcagggacagcgagggcaacgacctggcggccgcggacgggagcttcttcgacggcgcccggatgcggcgcgcgctggcggaggcgctggtgcccttctacccgatggcggggcggctggcgcgcgacgaggacgggcgcgtggagatcgactgcaacgccggcggggtgctgttccaggaggcggacgcgcccgacgccaccgtcgacgacttcggcgacttcgcgcccactatggagctcaagcgcctcatccccaccgtcgagtacaccgacgacatctccgccttcccgctcctcgtgctccaggtgacacacttcaaatgcggtggcgtggcgatcggcgtgggcatgcagcatcacgtcgccgatggcttctccggcctgcacttcatcaactcgtgggcggacctctgccgcggcatcccgatcgccgtcatgccctacattgaccgctccctcctccgcgcgcgcgacccgccgaccccagtgtacccacacatcgagtaccagccggcgcccgccatgctgtccgagccgccgcaggcgcccctcacggccaagccggcgacgccgcccaccgctgtggccatcttcaggctcagccgcgccgaccttggccgcctccgctcgcagatccccgcgcgcgagggcgcgccgcggttcagcacgtacgcggtcctggcggcgcacgtgtggcggtgcgcgtccctggcgcgcggcctccccgcggaccagcccaccaagctgtactgcgccacggacgggcggcagcggctgcagccgccgctccccgagggctacttcggcaacgtgatcttcactgctacaccgctggcggacgccggcacggtgacggccggggtggcggagggcgcggccgtgatccaggcggcgctggaccggatggacgacgggtactgccggtcggcgctggactacctggagctgcagccggacctgtcggcgctggtccgcggcgcgcacacgttccggtgccccaacctggggctcactagctgggtgcggctgcccatccacgacgcggacttcgggtgggggcggcccgtgttcatgggccccggcggcatcgcgtacgaggggcttgcgttcgtgctccccagctccaaccgcgacggcagcctgtccgtggccatctcgctgcaggccgagcacatggagaagttccggaagttcatctacgacttctgatcgcctcgacacccaagtcatcgacgagcgcaggcgcggtagaagcaagcagagaagcgctaggcagatgcacagcacaggacagggagggtgatcttactaggttgcagcaaaattctttgattgcacacatagttcctgcacacttaattttttttccgttcctgcctgccccctttcgggcgggatgtatacttgtgccgtatgattcacgggcctgaacggcctgaacaaattgtaatatgaacaatttaatccgttctgagtgatacaggttaataaggtcaattgatttatctcctgagctttttagtttttttagaaaaaataatgtgcaggattgcaagacggcggtacaattctgagagttccagatgaatcgatctgcttgagaggaactctgttcttgttttatgtttacacatgtaaggttggacctgaaggtacagtctgaaccaatccttatcaaacctgcacagaattgaaccttctttccaaagcagttgacgaattgctgcattcaaacggccctgctgaatagtttggatggggaagaactgtacatgacaaagggcacggcactggatagagctctgcagactgcaacgcgctctcctatccttctcccg

SEQ ID NO: 5017 - DNA, 1651 bp, Echinochloa colona
agatgaagatcacggtgcggggatcggagatggtgtacccggcggcggagacgccgcagcgccggctgtggaactcggggccggacctggtggtgccgcggttccacacgccgagcgtctacttcttccggcggagggacgcggagggcaaggacctggcgggcgcggacgggagcttcttcgacggggcccggatgcggcgcgcgctggcggaggcgctggtgcccttctacccgatggcggggcgcctcgcgcacgacgaggacggccgcgtggagatcgactgcaacgccggcggggtgctgttccaggaggcggacgcgcccgacgccaccgtcgacgacttcggcgacttcgcgcccaccatggggctcaagcgcctcatccccaccgtagagtacaccgacgacatctccgccttcccgctcctcgtgctccaggtgacccacttcaagtgcggtggcgtggcgatcggcgtgggcatgcagcaccacgtcgccgacggcttctccggcctccacttcatcaactcgtgggcggacctctgccgcggcgtcccgatcgccgtcatgccctacatcgaccgctccctcctccgcgctcgcgacccgccggccccggcctaccctcacgtcgagtaccagccggcgcccgccatgctgtccgagccgccgcaggcgcccctgacggcgaagccggcggcgccgcccaccgccgtggccatcttcaggctcagccgcgccgacctcgggcgcctccggtcgcagctcccggcgcgcgagggcgcgccgcggttcagcacgtacgccgtgctggcggcgcacgtgtggcggtgcgcgtccctggcacgggggctccccgccgaccagcccaccaagctgtactgcgccacggacgggcggcagcggctgcagccggcgctgcccgagggctacttcggcaacgtgatcttcacggcgacgccgctggcggacgccgggacggtgacggccggggtggcggagggcgcgggcgtgatccaggcggcgctggaccggatggacgacggctactgccggtcggcgctggactacctggagctgcagccggacctgtcggcgctggtccgcggcgcgcacacgttccggtgccccaacctggggctcaccagctgggtgcgcctgcccatccacgacgcggacttcgggtgggggcggcccgtgttcatggggcccggcggcatcgcgtacgaggggctcgcgttcgtgctccccagcgccaaccgcgacggcagcctgtccgtggccatctcgctgcaggcggagcacatggagaagttccggaagctcatctacgacttctgatcgatctcctcgacacaagtcatcggtaagcgcaggcaacaggcgtaggcggcgcaggaggaggcagagaagcgctagatcaagagacgcaaagggagggtgatcttactaggttgcagcaagattctttgattgcacacattgttcctgcacacgttttccgttcctgcctgcctctttgggcgggatgtatacgtttttgtgccgtatgatttacgggcctgaacggcctgagcaattgtatgatgaacattttattaatcagttccaaatgatacagattaataaggttaattaatttatctgct

SEQ ID NO: 5018 - DNA, 3207 bp, Panicum virgatum
ttcacggttaaatatgagaaccggcaaaacggtaaaatcacggtaaaatcactaaactgatttcgccggtttttccggttgaaacagtatttggacgggaaaatcggtcgggacgggattttcccgtcccgttttcaaccctagcgccaccctcggagtaacatcggattggggcagactaccagcccccgcacccgcgtccagggtccggtgggggtggaccgcgcccaccgaggagccgaggtgcgagccctctccctgccacgccaaccagacgccagacgccgcccccgcgccgcgcctcccccgccgaatccacccccacccacctcggctggtcatccatcccaccaaacgccccggggggccacaaggggtcatggcggacggcaaggggacggcgggcgggctgcgcgcacgggatccccggctataaaagccgccccaccccccgcgagctcaccagctctccaccaagagctaatactaccagtataccgccgccgcctgctttacaccgcgtcctgcgctgccgccgcgttgggttgcgtcccagatccgctgagttcttcgaccgatcgctcgagcaagatgaagatcacggtgcgggggtcggagatggtgtacccggcggcggagacgccgcggcggcggctgtggaactcgggcccggacctggtggtgccgcggttccacacgcccagcgtctacttcttccggcgccgggacggcgagggcaacgacctggcggccgcggacgggagcttcttcgacggcgcccggatgcggcgcgcgctggcggaggcgctggtgcccttctacccgatggcggggcggctggcgcgcgacgaggacgggcgcgtggagatcgactgcaacgccggcggggtgctgttccaggaggcggacgcgcccgacgccaccgtcgacgacttcggcgacttcgcgcccaccatggagctcaagcgcctcatccccaccgtcgagtacaccgacgacatctccgccttcccgctcctcgtggtccaggtgacacatttcaaatgcggtggtgtcgcgatcggcgtaggcatgcagcaccacgtcgccgacggcttctctggcctgcactttatcaactcgtgggcggacctctgccgcggcgtcccgatcgccgtcatgccctacattgaccgctccctcctccgcgcgcgcgacccgccgaccccggtctacccgcacgtcgagtaccagccggcgcccgccatgctgtccgagccgccgcaggcgcccctcatggccaagccggcgacgccgcccgccgccgtggccatcttcaggctcagccgcgccgacctcggccgcctccgctcgcagatccccgcgcgcgagggcgtcccgcggctcagcacgtacgcggtgctggcggcgcacgtgtggcggtgcgcgtccctggcgcgtggcctccccgccgaccagcccaccaagctgtactgcgccacggacgggcggcagcggctgcagccgccgctccccgagggctacttcggcaacgtgatcttcacggcgacgccgctggccgacgccggcacggtgacggccggggtggcggagggcgcggcggtgatccaggcggcgctggaccggatggacgaagggtactgccggtcggcgctggactacctggagctgcagccggacctgtcggcgctggtccgcggcgcgcacacgttccggtgccccaacctggggctcaccagctgggtgcggctgcccatccacgacgcggacttcgggtgggggcggcccgtgttcatgggccccggcggcatcgcgtacgaggggctcgcgttcgtgctccccagcgccaaccgcgacggcagcctgtccgtggccatctcgctgcaggccgagcacatggagaagttccggaagttcatctacgacttctgatcgcctcgacacccaacacccaagtcatcggcgagagaaggcgcagcagaagcaagcagagaagcggtagacagaagcacagcagaggacagggagggtgatcttactaggttgcagcaagattctttaattgcacacatagttcctgcacttttttttccgttcctgcctgcccccttttgggcgggatgtaaacgttttgtgccgtatgattcacgggctaaaacggcctgaacaaattgtaatatgaacaatttaatccgttctgaatgatacaggttaataaggtcaatcaatttatctcttgagccttttattttttctaaaaaaatatgtgcaggattgcaggacggtggtacaattctgagagttccagatgaatctgcttgaaagaaactctgttcttgttttatgtttacacatgcaggttgaacctgaaggtacagtctggaccaatccttatcaaacctgcacagaattgaaccttctttccaaagcaattgacgaattgctgcattcaaaacgggcccgctgaatagtttggatagggaagaaactgtgcatgacaaagggcacggcaatggaaagagctctgcagatgcagcgcgttctcctatcctcctcggggagcttcgtcttcttccacgagcagttgcaggctcgcagcgatggttggttgcggaagtcccctcttctttatgaccttgggaccccccattgtgtggacaaggtgtcaaggagaagaggattcggtcgagttccattgatgcattggctgagcagatacggtgtcggccgtgggggctagcctagccggctagggatctgctcgagggatacagtgcaggttgctcgtcatccgatcaaacagccgaactttcacagagagttgagagacaccacgaagcgcgtggctaataacaacgccgactgccggatgatggcggacccccaccaactcatctaacagcagccaatgcagggttttttcacctgcttcaacgctttcttttctcttttcatccacgtagattctcggttggctctccaccaaccataatatttggatgttcagttggtggtggatgattggtgggcatctggtgaccgtgctgtctgcctgaccggttgcaagcaggtcagcaggtggtggcactggtgggttccactaggagaccggatggtgattggccattaggtcagttttggtgggagtatcataacagtgtcatgaatattaaatttattgacatagtaagatttttatgaagagag

SEQ ID NO: 5019 - DNA, 1734 bp, Zea mays
agctctccaccaagagctgtaccccacaccactaggcactagtccactacctaacgctacctgccttttcaccgcgtcgtgcgccaccgccacgttgagctcgcgtccgtcccagatccgccgtgctcctccatcgctcgcgcaagatgaagatcacggtgcgggggtcggagatggtgtacccggcggcggagacgccgcgccgccggctctggaactcggggcccgacctggtggtgccgcggttccacacgcccagcgtctacttcttccgccgcgaggacgcggacgggaacgacctggcgggcgcggacgggagcttcttcgacggggcgcggatgcggcgcgcgctggccgaggcgctggtgcccttctacccgatggccggccggctggcgcgcgacgaggacggccgcgtcgagatcgactgcaacgcgggcggggtgctgttccaggaggcggacgcgcccgacgccaccatcgactacttcggcgacttcgcgcccaccatggagctcaagcgcctcatccccaccgtcgacttcacggacgacatctcctccttcccgctgctcgtgctccaggtgacccacttcaagtgcggtggcgtggctatcggcgttggcatgcagcaccacgtagccgacggcttctccggcctgcacttcatcaactcgtgggcggacctctgccgcggcgtcccgatcgccgtcatgcccttcattgaccgctcgctcctccgcgcgcgcgatccgccgaccccggcctacccgcacatcgagtaccagccggcgcccgccatgctatctgagccgccacaggcggccctcacgtccaagccggcgacgccgcccacagccgtggctatcttcaagctctcccgcgccgagctcgtccgcctccgttcgcaggtccccgcgcgcgagggcgcgccgcggttcagcacgtacgctgtgctggcggcgcacgtgtggcggtgcgcgtccctggcgcgcggcctgccggccgaccagcccaccaagctgtactgcgccacggacgggcggcagcggctgcagccgccgcttccggagggctacttcggcaacgtgatcttcacggcgacgccgctggccaacgccggcacggtgacggccggggtggcagagggcgcgtccgtgatccaggccgcgttggaccggatggacgacgggtactgccggtcagcgctggactacctggagctgcagccggacctgtcggcgctggtccgcggggcgcacacgttccggtgccccaacctggggctcaccagctgggtgcgcctgcccatccacgacgcggacttcgggtgggggcggcccgtgttcatgggccccggcggcatcgcctacgaggggctcgcgttcgtgctccccagcgccaaccgcgacggcagcctgtccgtggccatctcgctgcaggcggagcacatggagaagttccggaagctcatctacgacttctgatctccaactcctccccacaagtcatcagtaccagtacgcgcaacacaaagaagcaagagaccgttgggagtaggttgcagcaatattctttgatttcacacatagttcctgcacacttttccgttcctgcctgccccctttgggcagggcgcataccttttgtgccgaattatttacgagcccctgcaattgtatgatgaatgaacaatgaatgatacagattaataagattaattaacttatctct

SEQ ID NO: 5020 - DNA, 1786 bp, Saccharum officinarum
gctatactatatacccccgcaccactacctaacgctacctgcttttacaccgcggcggctgctttgagctcgagttcgcgtccgtcccagatccgccgtgctcctccatcgctcgcgcaagatgaagatcacggtgcgggggtcggagatggtgtacccggcggcggagacgccgcggcgccggctctggaactcggggcccgacctggtggtgccgcggttccacacgcccagcgtctacttcttccgccgcagggacgcggacgggaacgacctgacggccccggacggcagcttcttcgacggggcgcggatgcggcgcgcgctggcggaggcgctggtgcccttctacccgatggcggggcggctggcgcgcgacgaggacggccgcgtcgagatcgactgcaacgccgccggggtgctgttccaggaggcggacgcgcccgacgccaccatcgactacttcggcgacttcgcgcccaccatggagctcaagcgcctcatccccaccgtcgacttctcagacgacaccgccttcccgctgctcgtgctccaggtgacccacttcaagtgtggtggcgtggctatcggcgttggcatgcagcaccacgtagccgacggcttctccggcctgcacttcatcaactcgtgggcggacctctgccgcggcgtcccgatcgccgtcatgcccttcattgaccgctccctcctccgcgcgcgcgacccgccgaccccggcctacccgcacatcgagtaccagccggcgcccgccatgctgtcctctgagccgccacaggcggccctcacggccaagccggcgacgccgcccgcagccgtggccatcttcaagctctcccgcgccgagctcggccgcctgcgttcgcaggtccccgcgcgcgagggcgcgccgcggttcagcacgtacgcggtgctggcggcgcacgtgtggcggtgcgcgtccctggcgcgcggcctgccggccgaccagcccaccaagctgtactgcgccacggacgggcggcagcggctgcagccgccgctgccggagggctacttcggcaacgtgatcttcacggcgacgccgctggcgaacgccggcacggtgacggccggcgtggcggagggcgctggcgtgatccaggcggcgctggaccggatggacgacgggtactgccggtcggcgctggactacctggagctgcagccggacctgtcggcgctggtccgcggggcgcacacgttccggtgccccaacctggggctcaccagctgggtgcgcctgcccatccacgacgcggacttcgggtgggggcggcccgtgttcatgggccccggcggcatcgcgtacgaggggctcgcgttcgtgctccccagcgccaaccgcgacggcagcctgtccgtggccatctcgctgcaggcggagcacatggagaagttccggaagctcatctacgacttctgatctccaactcctccccagaagtcatcatcagtaccaaccagtacgcgcagcacagagaagcggagaagcagtagcaagaggcgcagggagggtgatttttcagctaactactggaagtctggagggagtaggttgcagcaagattctttgatttcacacatagttcctgcacacgtttccgtttctgcttgccccctttgtgcagggtgtataccttttgtgccgtacgtatgatttacgagccccagcaattgtatgatgaatgaacaattttttttcgttctgaatgatacagattaataagattaattaacttacctcttg

SEQ ID NO: 5021 - DNA, 1873 bp, Sorghum bicolor
gttgcgcgcacggctgcctggctataaaaggcgctccaccccccgctagctcaccagctctccaccaagagctataccccccgcaccacttacctaacgctacctgcttttacaccgcggcggccgcgttgagctcggctcgatcgagttcgcgtccgtcccagatccgcccgtcgtgctcctccatcgctcgcgcaaagatgaagatcacggtgcgggggtcggagatggtgtacccggcggcggagacgccgcgccgccggctctggaactcggggcccgacctggtggtgccgcggttccacacgcccagcgtctacttcttccgccgcagggacgcggacgggaacgacctgacggccgccgacggcagcttcttcgacggggcgcggatgcggcgcgcgctggcggaggcgctggtgcccttctacccgatggcggggcggctggcgcgcgacgaggacggccgcgtcgagatcgactgcaacgccgccggggtgctgttccaggaggcggacgcgcccgacgccaccatcgactacttcggcgacttcgcgcccaccatggagctcaagcgcctcatccccaccgtcgacttctccgacgacaccgccttcccgctgctcgtgctccaggtgacccacttcaaatgcggtggcgtggctatcggcgttggcatgcagcaccacgtagccgacggcttctccggcctgcacttcatcaactcgtgggcggacctctgccgcggcgtcccgatcgccgtcatgcccttcattgaccgctccctcctccgcgcgcgtgacccgccggccccggtctacccgcacgtcgagtaccagccggcgcccgccatgctgtcctccgagccgccacaggcggccctcacggccaagccggcgacgccgcccgcggccgtggccatcttcaagctctcccgcgccgagctgggccgcctgcgttcgcaggtccccgcgcgcgagcgcgagggcgcgccgcggttcagcacgtacgcggtgctggcggcgcacgtgtggcggtgcgcgtccctggcgcgcggcctgccggcggaccagcccaccaagctgtactgcgccacggacggccggcagcggctgcagccgccgcttcccgagggctacttcggcaacgtgatcttcacggcgacgccgctggcgaacgccggcacggtgacggccggggtggcggagggcgcggccgtgatccaggcggcgctggaccggatggacgacgggtactgccggtcggcgctggactacctggagctgcagccggacctgtcggcgctggtccgcggggcgcacacgttccggtgccccaacctggggctcaccagctgggtgcgcctgcccatccacgacgcggacttcgggtggggccggcccgtgttcatgggccccggcggcatcgcgtacgaggggctcgcgttcgtgctccccagcgccaaccgcgacggcagcctgtccgtggccatctcgctgcaggcggagcacatggagaagttccggaagctcatctacgacttctgatctccgagctcctcccaagaagtcgtcagtaccataccaaccagtacgcgcagcacagagaagcagaagaagcggtagcaagaggtgcagggagggtgatttttcagctatgaagtctggagggagtactccgtaggttgcagcaagattctttgatttcacacatagttcctgcacactttcccgttcttgcctgccccctttgggcagggtgtatacttttttgtgccgtttggtttacgagccccagcaattgtatgatgaatgaacaatttaatacgttctgaatgatacagatcaataagactaattaacttacctcttga

SEQ ID NO: 5022 - DNA, 1716 bp, Oryza sativa
agctctcccccaagagctgcttacctaacatacttttacaactccaccattgtccattgccaaaggccttcgatctcgcctcccagatctgccccgcgtcggcgaagatgaagatcaacgtgcgggggtcgacgatggtgcggccggcggaggagacgccgcgggtgaggctgtggaactctagcctggacctggtggtgccgcggttccacacgccgagcgtctacttcttccggcgcggcgaggcggcggcggcggagggcgggagctacttcgacggggagaggatgcggcgggcgctggcggaggcgctggttccgttctacccgatggcggggcggctggcgcacgacgaggacggccgcgtggagatcgactgcaacggggaaggcgtgctgttcgtcgaggccgacgcgccgggcgccaccgtcgacgacttcggcgacttcgcgcccaccatggacctcaagcgcctcatccccaccgtcgactacaccgacggcatctcctccttccccatcctcgtgctccaggtgacccacttcaagtgcggaggcgtcgccctcggcgtgggcatgcagcaccacgtcgccgacggcttctccggcctgcacttcatcaactcgtgggcggacctctgccgcggcgtcccgatcgccgtcatgccgttcatcgaccgcaccctcgtccgcgcccgcgacccgccggcgccgtcgcacccgcacgtcgagtaccagccggcgcccgccatgctggcccccgagccgccgcaggcgctgaccgccaagccggcgccgccgcccaccgccgtggacatcttcaagctgtcccgctccgacctcggccgcctccggtcccagctgccccgcggcgagggcgcgccgcggtacagcacgtacgcggtgctcgcggcgcacgtgtggcggtgcgcgtcgctggcgcgggggctccccgcggagcagcccaccaagctgtactgcgccacggacggacgccagcggctgcagccgtcgctgcccgacggctacttcggcaacgtgatcttcacggcgacgccgctcgccgaggccgggagggtgaccgggtcgctggcggacggcgcggcgacgatccagtcggcgctggacaggatggacagcggctactgccggtcggcgctggactacctggagctgcagcccgacctgtcggcgctggtccgcggcgcgcacacgttccggtgccccaacctcggcctcaccagctgggtccgactgccgatccacgacgccgacttcggctgggggcggccggtgttcatgggccccggcggcatcgcgtacgaggggctcgccttcgtgctccccagcgccagcggcgacggcagcctgtcggtggccatctcgctgcaggccgagcacatggagaagttccgcaagatgatcttcgacttctgatcctctgaaatcaaacaacacgtacgtacgcacgcacgaacgcgcacatgcatggagaggaggcggggtggttcttaacacagcctatcatcggtaggatgcagcaacgattctttgattccacacgttagttcctgcaaatttttcccttcctgccttcccgcttttgggcaggacacattttgtgccaactgtatttgtattgtgaacagttaattaatccgtaaacattacgaaacacagagggttaataaggttaatcacggtggtttacttcgcc

SEQ ID NO: 5023 - DNA, 1732 bp, Oryza sativa
agctctcccccaagagctgcttacctaacatacttttgcaactccaccattgtccattgccaaaggccttcgatctcgcctcccagatctgccccgcgtcggcgaagatgaagatcaacgtgcgggggtcgacgatggtgcggccggcggaggagacgccgcgggtgaggctgtggaactctagcctggacctggtggtgccgcggttccacacgccgagcgtctacttcttccggcgcggcgaggcggcggcggcggagggcgggagctacttcgacggggagaggatgcggcgggcgctggcggaggcgctggttccgttctacccgatggcggggcggctggcgcacgacgaggacggccgcgtggagatcgactgcaacggggaaggcgtgctgttcgtcgaggccgacgcgccgggcgccaccgtcgacgacttcggcgacttcgcgcccaccatggacctcaagcgcctcatccccaccgtcgactacaccgacggcatctcctccttccccatcctcgtgctccaggtgacccacttcaagtgcggaggcgtcgccctcggcgtgggcatgcagcaccacgtcgccgacggcttctccggcctgcacttcatcaactcgtgggcggacctctgccgcggcgtcccgatcgccgtcatgccgttcatcgaccgcaccctcgtccgcgcccgcgacccgccggcgccgtcgcacccgcacgtcgagtaccagccggcgcccgccatgctggcccccgagccgccgcaggcgctgaccgccaagccggcgccgccgcccaccgccgtggacatcttcaagctgtcccgctccgacctcggccgcctccggtcccagctgccccgcggcgagggcgcgccgcggtacagcacgtacgcggtgctcgcggcgcacgtgtggcggtgcgcgtcgctggcgcgggggctccccgcggagcagcccaccaagctgtactgcgccacggacggacgccagcggctgcagccgtcgctgcccgacggctacttcggcaacgtgatcttcacggcgacgccgctcgccgaggccgggagggtgaccgggtcgctggcggacggcgcggcgacgatccagtcggcgctggacaggatggacagcggctactgccggtcggcgctggactacctggagctgcagcccgacctgtcggcgctggtccgcggcgcgcacacgttccggtgccccaacctcggcctcaccagctgggtccgactgccgatccacgacgccgacttcggctgggggcggccggtgttcatgggccccggcggcatcgcgtacgaggggctcgccttcgtgctccccagcgccagcggcgacggcagcctgtcggtggccatctcgctgcaggccgagcacatggagaagttccgcaagatgatcttcgacttctgatcctctgaaatcaaacaacacgtacgtacgcacgcacgaacgcgcacatgcatggagaggaggcggggtggttcttaacacagcctatcatcggtaggatgcagcaacgattctttgattccacacgttagttcctgcaaatttttcccttcctgccttcccgcttttgggcaggacacattttgtgccaactgtatttgtattgtgaacagttaattaatccgtaaacattacgaaacacagagggttaataaggttaatcacggtggtttacttcgcctatcagtttctcaagt

SEQ ID NO: 5024 - DNA, 1740 bp, Triticum aestivum
aaacgccctactttaattttaattatcgccgctgctcccacgcgccttcacgtacgtaccgacgacctttcgctcgcttttcttccgcctagtctgcccgccagatctgcatccgcggagatgaagatcacggtgcggggatcgacggtcgtggtgccggcggaggagacgccgcggctccggctgtggaacgccaacccggacctggtcgtgccgcggttccacacgccgagcgtctacttcttccggcgcggcgcgggggagggggaggaggcgggccgctacttcgacgcggagcggatgcgccgggcgctggcggaggcgctggtgcccttctacccgatggcggggcggctggcccgcgacgaggacgggcgcgtggagatcgactgcaacgcggaaggggtgctcttcgtggaggccgacgcgcccgacggcaccgtcgacgacttcggcgacttcgcgcccaccatggacctcaagcgccttatccccgccgtcgacttcaccgggggcatctcctcctacccgctcctcgtggtccaggtgacccacttcaagtgcggaggcgtcgccctcggcataggcatgcagcaccacgtcgccgacggcttctccggcctgcacttcatcaactcatgggccgacctctgccgcggcgtgccgattgccgtcatgccgttcattgaccgcaccctcctccgcgcacgcgacccgccgacgccgtcccacccgcacatcgagtaccagccagcgcccgccatgctggactcggaggagccgcaggccctcaccgccaagccggaagcgccgcccacggccgtggacatcttcaagctgtcccgcgccgacctcggccgcctccgcgcccagctccccacgggcgagggcgcgccgcggttcagcacctacgcggtgctcggggcgcacgtctggcggtgcgcgtccctggcccgtggcctgtccccagagcagcccaccaagctgtactgcgccacggacgggcggcagcggctgcagccgccgctcccggagggctacttcggcaacgtcatcttcacggccacgccgctcgcggtggcgggcaaggtgaccggctcgctggcggacggcgcgaccacgatccaggcggcgctggaggtgatggacaacgagtactgccgctcggcgctggactacctggagatgcagccggacctgtcggcgctggtccgcggcgcgcacacgttccggtgccccaacctcgggctcaccagctgggtgcgcctgcccatccacgacgccgacttcggctggggccggcccgtcttcatgggccccggcggcatcgcgtacgaggggctcgcgttcgtgctccccagcgccagccgcgacggcagcctgtcggtggccatctcgctgcaggccgagcatatggagaagttccggaagatgatctttgacttctgatcaaaccaacaagacgcacgcgcaacgcagaaagaaagaagcagcaccggagcgatagtaggatgcagcaatgattctttgattacacacgtagttcctgcacattttcccttccctctttccactttgggctggacgaattttgtgcatcgttatcaaatttccgacaaatgtatctacttaatgaacagtcaatgcatgcaaacatatgaagaatatacggagttactcctgtttatgtacacacactctcgagcgcgcgcctaaataaggtagaccattgacatgctt

SEQ ID NO: 5025 - DNA, 1701 bp, Secale cereale
tcgccgctgctcccacgcgcgttccacgtacgtagcgacgaccttttgctcgcttttcttccgcctagtctgcccgccagatctgcatccgcggagatgaagatcacggtgcggggatcgacggtcgtggttccggccgaggagacgccgcggctccggctgtggaacgccaacccggacctggtcgtgccgcggttccacacaccgagcgtctactttttccggcgcggcgcgggtgagcaggaggcggaccgctacttcgacgcggagcggatgcgccgggcgctagcggaggcgctggtgcctttctacccgatggcggggcggctggcccgcgacgaggacgggcgcgtggagatcgactgcaacgcggaaggggtgctcttcgtggaggccgacgcgcccgacggcaccgtcgacgacttcggcgatttcgcgcccaccatggacctcaagcgcctcatccccgccgtcgacttcaccgggggcatctcctcctacccgctcctcgtggtccaggtgacccacttcaagtgcggaggcgtcgccctcggcataggcatgcagcaccacgtcgccgacggcttctctggcctgcacttcatcaactcatgggccgacctctgccgcggcgtgccgattgctgtcatgccgttcattgaccgcaccctcctccgcgcacgcgaccagccgaccccgtcccatccgcacatcgagtaccagcccgcgccggccatgctggactcggaggagccgcaggccctcagcgccaagccggaagcgccgcccacggccgtggacatcttcaagctgtcccgcgctgacctcggccgcctccgcgcccagctccccacgggcgagggcgcgccgcggttcagcacctacgcggtgctcggggcgcacgtgtggcggtgcgcgtcccttgcccgtggcctgtccccagagcagcccaccaagctgtactgcgccacggacgggcggcagcggctgcagccgccgctcccggagggctatttcggcaacgtcatcttcaccgccacgccgctcgcggtggcgggcaaggtgaccgtctcgctggcggacggcgcgaccacgatccaggcagcgttggaggtgatggacaatgagtactgccgctcggccctggactacctggagatgcagcctgacctctcggcgctggtccgcggcgcgcacacgtttcggtgccccaacctggggctcaccagctgggtgcgcctgcccatccacgacgccgacttcggttggggccggcccgtgttcatgggccccggtggcatagcgtacgaggggctcgccttcgtgctccccagcgccagccgcgacggcagcctgtcggtggccatctcgctgcaggccgagcatatggagaagttccggaagatgatctttgacttctgatcaaaccaacaagacgcacgcgcaacgaagaaagaaagaagcagcaccggagcgattgtaggatgcagcaatgattctttgattacacacgtagttcctgcacatttttccttccctcgttccactttgggcaggacgaattttgtgcatcgttatcaaatttccgacaaatgtatctacttatgaacagtcaatgcatgcaaacatatatgaaaaatatacagagtttaactttttttaaagtaaaggaaaaaaaaaaactaagaagaaccccgacga

SEQ ID NO: 5026 - DNA, 1680 bp, Cenchrus ciliaris
ccaccaagagctgctgttaccaccggaaacgttcgctggattcgtctagagctttgcccgtttcggcggcctcagatctgatcctcggacctcggcgccgcgtctctgctgagatggcgatcacggtgaggcggtcgacgatggtgcgcccggcgcgggagacgccgcggcagcggctgtggaactccaacctcgacctcgtcgtgccgcgcttccacacgcccagcgtctacttctaccgccgcggcggcggcggccccgaggcggcggaggggttcttcgacggcgagcggatgcggcgcgcgctggcggaggcgctcgtgccgttctacccgatggcggggcgcctcgcgcgggacgaggacggcagggtcgagatcgactgcaacggcgaaggggtgctcttcgtcgaggctgacgcgcccaacgccgccgtcgacgactacggcgacttcgcccctaccatggagctcaagcgcctcatcccggcggtcgattacaccgacgacatctcggccttcccgctcctcgtgctccaggtgacttacttcaaatgtggaggtgtctcccttggcgtcggcatgcaacaccatgtagcggatggcatgtctggcttgcacttcattaactcatggtctgacctctgccgtggagctcaaattgctgtcatgcccttcatcgaccgcactctccttcgtgctcgtgatccaccaactccatctttccaacatattgaataccagcctgccccagctatgttgtcctccacacctcagtccttaacttccaagtcaaagccacctgccactgctgtagacattttcaagctcactcgctcagaccttggccgcctgcgctcccagcttcccacaggtgaaggtgcaccacggtacagcacgtatgcagtgctagctgcacatgtctggagatgtgcctcccttgcgcgtggcctgactcctgaacagcccaccaaattgtactgtgccactgacgggcgccaacggctacagcccccacttccagatggttactttggaaatgtcatcttcaccgcaacaccacttgctgaggcaggcaaggtgaccagtggggtggcagatggagcagcagtcatccaaggagcactagataggatggacaatgactactgccgctcggcgctggactacctggaactgcaaccagatttgtcagcactggtgcgtggagcacacaccttccggtgcccgaacctagggctcaccagctgggtgcgcctgcctatccatgatgccgactttggttggggccggcctgtgttcatggggccaggcggcattgcatatgagggtctggcgtttgtcctccctagcgccaatggagatggtagcctgtccatcgccatctcgttgcaggctgagcacatggagaagttccgaaagctaatctatgagttataagcgggatgcattataccttttgaagtaagatgtaatagggctaaaggctgtatccagttctcatataaaatgcctgaagtttcaagtgaaccaagttgctgcgatttcacacttcaagatcagtgttaatgaccaattcattttttaccctgggctgggaatgttttgggtaacttctagttgtatggattaccagtgttgagttgcctctgattgagctgcaaccgttgattgtttaaaa

SEQ ID NO: 5027 - DNA, 1929 bp, Oryza sativa
gccgccgcccgtcgcctataaaagccgctccacccccaacgagcccaccagctgctctccaccaagagctgctccgcccccctaccccgcaacccgttgctttgtgccgcgcctcgctttggtcttcatccgcctcagatctgattcgttctaggttggtctggggaagatggcgatcacggtgaggcggtcgacgatggtgcggccggcgtgggagacgccgcgggtgcggctgtggaactcgaacctcgacctcgtggtgccgcggttccacaccccaagcgtctacttctaccgccggggccccgagggagggggcgcgccggaggggttcttcgacggggagcggatgcggcgcgcgctggcggaggcgctcgtgccgttctacccgatggccgggcggctcgcgcgcgacgaggacgggagggtcgagatcgactgcaacggggaaggggtgctcttcgtcgaggccgacgcgcccgacgcctccgtcgatgactacggcgacttcgcgcccaccatggagctcaagcgcctcatccctgccgttgattacaccgacgacatctcctccttctcgctcctcgtgctccaggtgacctacttcaagtgcggaggtgtctcccttggagttggtatgcaacaccatgtggcggatggcatgtccggtttgcactttattaactcatggtctgacctctgccgaggaactcaaattgccatcatgcccttcattgaccgcactctcctacgagcccgagatccaccaactccatcatacccacatgttgagtaccagcctgccccagccatgctgtcctccgtaccccagtctgttactgctaataagacaacaccacctccaactgctgtggacattttcaagcttacccgctcagaccttggtcgactgcgttcgcagctcccatcaggagaaggtgcaccacgtttcagcacatatgcagttcttgctgcacatgtctggcgatgcgtatctcttgcacgtggcctgccttctgaacagcccactaagctgtattgtgccactgatgggcgacaacggttgcagcctccacttccagaaggttactttgggaatgtcattttcaccgccactccacttgctgaggcaggcaaggtgaccagtgggctggcagatggagcagcagtcatccaagaggcgctagataggatgaacgatagctactgccgctcagcattggactacctggagctgcagcctgatttatcagcattggtccgtggagcacacactttccggtgtccgaacctcgggctcaccagctgggtgcgcttgccaattcatgatgcagattttggatggggaagaccagtgttcatgggtcctggtggcatcgcctatgaagggctggcgtttgtcctcccaagcgcgaacaaggatggtagcctatccatagccatctcattgcaggctgagcacatggagaagttcaggaagctgatcttcgaggtgtaagcagactacttatgttatgtcagggagaagttgtagagctagagttctcaggtaaaataccttcaagtgagtcatgggggctatgctcttgctcctgttgagcaaattgtctggccacgttctcttgtaccttagcttgcaaggatatttggccatcaccacagccgtgtgacgatgtgagcaaccaataatgagctgtttttttgttttcgtttaggataggaatcaacaatgaagaaaaggtgctgtattctgtgaaactacatggcagtgttgttcttaccaaaaatacatgacaagtgaattgggtcaagttattgcctgttgtagctcaagtcgatagatgaacatcattgtacagtacgaatgtacgatacgactataacagcctgattgcctatgaactgcaagtaaatgcatgtgaataactg

SEQ ID NO: 5028 - DNA, 2007 bp, Oryza sativa
acgcctacgcgagctcggagctcagctctaccgcccccgcacgccgccgccgcccgtcgcctataaaagccgctccacccccaacgagcccaccagctgctctccaccaagagctgctccgccccccctaccccgcaacccgttgctttgtgccgcgcctcgctttggtcttcatccgcctcagatctgattcgttctaggttggtctggggaagatggcgatcacggtgaggcggtcgacgatggtgcggccggcgtgggagacgccgcgggtgcggctgtggaactcgaacctcgacctcgtggtgccgcggttccacaccccaagcgtctacttctaccgccggggccccgagggagggggcgcgccggaggggttcttcgacggggagcggatgcggcgcgcgctggcggaggcgctcgtgccgttctacccgatggccgggcggctcgcgcgcgacgaggacgggagggtcgagatcgactgcaacggggaaggggtgctcttcgtcgaggccgacgcgcccgacgcctccgtcgatgactacggcgacttcgcgcccaccatggagctcaagcgcctcatccctgccgttgattacaccgacgacatctcctccttctcgctcctcgtgctccaggtgacctacttcaagtgcggaggtgtctcccttggagttggtatgcaacaccatgtggcggatggcatgtccggtttgcactttattaactcatggtctgacctctgccgaggaactcaaattgccatcatgcccttcattgaccgcactctcctacgagcccgagatccaccaactccatcatacccacatgttgagtaccagcctgccccagccatgctgtcctctgtaccccagtctgttactgctaataagacaacaccacctccaactgctgtggacattttcaagcttacccgctcagaccttggtcgactgcgttcgcagctcccatcaggagaaggtgcaccacgtttcagcacatatgcagttcttgctgcacatgtctggcgatgcgtatctcttgcacgtggcctgccttctgaacagcccactaagctgtattgtgccactgatgggcgacaacggttgcagcctccacttccagaaggttactttgggaatgtcattttcaccgccactccacttgctgaggcaggcaaggtgaccagtgggctggcagatggagcagcagtcatccaagaggcgctagataggatgaacgatagctactgccgctcagcattggactacctggagctgcagcctgatttatcagcattggtccgtggagcacacactttccggtgtccgaacctcgggctcaccagctgggtgcgcttgccaattcatgatgcagattttggatggggaagaccagtgttcatgggtcctggtggcatcgcctatgaagggctggcgtttgtcctcccaagcgcgaacaaggatggtagcctatccatagccatctcattgcaggctgagcacatggagaagttcaggaagctgatcttcgaggtgtaagcagactacttatgttatgtcagggagaagttgtagagctagagttctcaggtaaaataccttcaagtgagtcatgggggctatgctcttgctcctgttgagcaaattgtctggccacgttctcttgtaccttagcttgcaaggatatttggccatcaccacagccgtgtgacgatgtgagcaaccaataatgagctgtttttttgttttcgtttaggataggaatcaacaatgaagaaaaggtgctgtattctgtgaaactacatggcagtgttgttcttaccaaaaatacatgacaagtgaattgggtcaagttattgcctgttgtagctcaagtcgatagatgaacatcattgtacagtacgaatgtacgatacgactataacagcctgattgcctatgaactgcaagtaaatgcatgtaaataactgaatatgtgatcgtaactgatatttgttgcttg

SEQ ID NO: 5029 - DNA, 1453 bp, Avena sativa
agaagatgaagatcacggtgcggagctcgacggtggtggtgccggcggcggagacgccgcggctgcggctgtggaacgccaacccggacctggtggtgccgcggttccacacgcccagcgtctacttctaccgccgcggcggcggcgaggacggcggcgacgcgtgctacttcgacgcggggaggatgcggcgcgcgctggcggaggcgctggtgcccttctacccgatggcggggcggctggcccacgacgaggacgggcgcgtggagatcgactgcaacgcggagggggtgctcttcgtggaggccgacgcgcccgacggcgccgtcgacgacttcggcgacttcgcgcccaccatggagctcaagcgcctcatccccgccgtcgactactccggcgacatctcctccttcccgctactcgtgcttcaggtgacctatttcaagtgtggaggcgtctcccttggcgttggcatgcaacatcatgtagctgacggcatgtctggacttcacttcatcaactcatggtctgacctctgccgtggagctcaaattgcagtgatgcccttcatcgaccgcactcttctccgtgcccgcgatccaccaactccatcttacacacatgttgagtaccagcctgccccagcaatgctgtcgtcggcgccccaagctctcactggcaagccaacgttggctccaactgcggtggacatcttcaagctcacccgctcggagcttggccgcttgcgctcgcagctccccacgggtgaaggtgcaccgcgtttcagcacgtatgccgtgctagccgcacatgtctggcgctgtgtctcccttgcgcgtggcctgcctgctgaacagcccaccaagctgtactgtgccactgacgggcgacatcggctgcagcccccgttgccggagggttacttcggaaacgtcatcttcaccgccaccccactcgctgaggcaggcaaggtgaccggcgccgtggcagacggagcagcggtcatccagggagcactggataggatgtccgacgactactgccgctcagcgttggactacctggagacgcagccggatttatcagcattggtccgcggagcccacactttccggtgccctaaccttggtctcaccagctgggtgcgcctgccgatccacgacgcggatttcggttggggacggcccgtgttcatgggacctggtggcatcgcctatgaggggttggcgttcgtcctcccgagcgcgaacaaggacggcagcctgtccatcgccatctcgttgcaggccgagcacatggagaagttccggaagctgatcgccgacgtgtaagcggactgcaacttttacgctgtcagagaaaagatacagggcaagaatatgttcaaggttcttttttgtcacaaatgttaaacaggtctctgtgctggtatctcttccggggtaaattgtac

SEQ ID NO: 5030 - DNA, 1794 bp, Brachypodium distachyon
tcaccagctctccaccaagagctacctaacgatttggtttaattatcacgcgtacatccacacgtatagaggagagaccttcgcttttccgttactccttcgctttactgttctacccagatctgcctgcctgcctgcgccgcggcggctgagagctcttcgatcgatcgcaagatgaagatcacggtgcgggggtcgacggtggtgcggccggcggaggagacgccgcggatgcggctgtggaacgctaacccggacctggtggtgccgcggttccacacgcccagcgtctacttctaccggcgcgacgcggcggttgaggtcgggtgctacttcgacgcggagaggatgcggcgggcgctggcggaggcgctggtgcccttctaccccatggcggggcggctggcccgtgacgaggacgggcgcgtggagatcgactgcaacgcggaaggggtgctcttcgtggaggccgacgcgcccgacggcaccgtcgacgactacggcgacttcgcccccacgatggagctcaagcgactcatccccgctatcgacttcaccggcggcatctcctcctacccgctcctcgtggtccaggtgacacactttaagtgcgggggcgtggccctgggcatcggcatgcagcaccacgtcgccgacggcttctcgggcctccacttcatcaactcgtgggccgacctgtgccgcggcgtcccgatcgccgtcatgccgttcatcgaccgcaccctgctccgggcccacgacccgccgaccccggcccacccgcacatcgagtaccagcccgcgcccgccatgctggactcggagccgccgcaggccatcctcgcgggcgccaagccggaccaaccccccgcggccgtggacatcttcaagctctcccgctccgacctgggccgcctccgcgcccagctccccacgggggaaggcgcgccccggttcagcacctacgcggtgctcggcgcgcacgtgtggcgttgcgcgtcgctggcccgcgggctggcgcccgagcagccgacgaagctgtactgcgccacggacgggcgccagcggctgctgccgccgctcccggagggttacttcggcaacgtcatcttcacggccacgccgctcgccgaggccggcaaggtgatcgcctcgctggcggacggcgcgaacacgatccaggccgcgctggagaggatggacaacgagtactgccgctcggcgctggactacctggagctgcagccggacctgtcggcgctggtccggggcgcgcacacgttccggtgccccaacctcgggctcaccagctgggtgcgcctgcccatccacgaagccgacttcggctggggccgccctgtcttcatgggccccggcggcatcgcctacgagggcctcgccttcgtgctccccagcgccagccgcgacggcagcctgtccgtggccatctcgctgcaggccgagcacatggagaagttccggaagatgatcttcgacttctgaaacaacgaaccaacaaacagcacacgacacaaggatgaaggacggcaccggatcagcacaaggcagcaggggcgatgtgtcacgacctttactaggatgcagcaaatgattctttgattccaaaccgtagttcctgcacattttcccttccttcttgccagtttgggcatgaccaggacgcgctttgtgcatcttatcaaatttcaacaagtgtaatttctatgatgaatggttaatgcatgcaaaatgtgaacaatacagaaccaataagttgttttgtttttctattta

SEQ ID NO: 5031 - DNA, 1638 bp, Avena sativa
agaagatgaagatcacggtgcggagctcgacggtggtggtgccggcggcggagaccccgcgggtgcggctgtggaacgccaacccggacctggtggtgccgcggttccacacgcccagcgtctacttctaccgccgcggcggcgacggcgacgcgtgctgctacttcgacgcggcaaggatgcggcgcgcgctggcggaggcgctggtgcccttctacccgatggcggggcggctggcccacgacgaggacgggcgcgtggagatcgactgcaacgccgagggggtgctcttcgtggaggccgacgcgcccgacggcgccgtcgacgacttcggcgacttcgcgcccaccatgggcctcaagcgcctcatccccaccgtcgacttcaccgggggcatctcctcctacccgctcctcgtggtccaggtgacccacttcaagtgcggaggcgtcgccctcggcataggcatgcagcaccacgtcgccgacggcttctccggcctgcactttatcaactcatggtccgacctctgtcgtggtgtcccgatcgctgtcatgccgttcatcgaccgcaccctcctccgggcccgtgacccgccggtcccgacccacccgcacatcgagtaccagcccgcgcccgccatgctgggctcggaggagccgcaagccctcgccggcaagccagagtcgccgcccacggccgtggacatcttcaagctgtcccgctccgacctgggccggctccgcgcccagctccccacgggcgagggcgcgccacggttcagcacgtacgcggtgctcggggctcacgtgtggcggtgcgcgtccctggcgcgcgggctggccccggagcagccaaccaagctgtactgcgccacggacgggcggcagcggctgacgccgaccctccctgatggatacttcggcaatgtcatcttcaccgccacgccgctcgccgaggcgggcaaggtgaccggctcgctggcggacggtgcgaccacgatccaggacgcgctggagaagatggacgacgagtactgccactcggcgctggactacctagagctgcagccggacctgtcggcgctggtccgcggcgcgcacacgttccggtgccccaacctcgggctcaccagctgggtgcgcctgccgatccacgacgccgacttcggctggggccggcccgtgttcatgggccccggcggcatcgcctacgaggggctcgcgttcgtgctccccagcgccaaccgcgacggcagcctgtcggtggccatctcgctgcaggccgagcacatggagaagttccggaagatgatcttcgacttctgaaactgaaatgaacaaacagcacgcccgcaaccgcaacagtttgcataatgaaagacggaagtacctgagcgaaggggcagagggcgatcttgattacagcttactaggatgcagcaatgattctttgatttccagacgtagttactgcaaaattcccccttctttcctcccactttgggcagggaatattttgtgcgtcttactatcaaacctccacaaatgtatttgcataatgaacagttgatacgtgcaaaatacgtaataacattataaacgttaataaggttgttcctctttatttcctcgctct

SEQ ID NO: 5032 - DNA, 1748 bp, Avena sativa
cacgcgtgtgaccgcggcttcttccacgtagagacgaccctttcgctttagtttcccccgagtcccagatctgcagcgagaaggagaagatgaagatcacggtgcggagctcgacggtggtggtgccggcggcggagaccccgcgggtgcggctgtggaacgccaacccggacctggtggtgccgcggttccacacgcccagcgtctacttctaccgccgcggcggcgagggcggcggcgacggcgacgcgtgctgctacttcgacgcggcaaggatgcggcgcgcgctggcggaggcgctggtgcccttctacccgatggcggggcggctggcccacgacgaggacgggcgcgtggagatcgactgcaacgccgagggggtgctcttcgtggaggccgacgctcccgacggcgccgtcgacgacttcggcgacttcgcgcccaccatgggcctcaagcgcctcatccccaccgtcgacttcaccgggggcatctcctcctacccgctcctcgtggtccaggtgacccacttcaagtgcggaggcgtcgccctcggcataggcatgcagcaccacgtcgccgacggcttctccggcctgcacttcatcaactcatggtccgacctctgtcgcggtgtcccgatcgctgtcatgccgttcatcgaccgcaccctcctccgggcccgcgacccgccggtcccgacccacccgcacatcgagtaccagcccgcgcccgccatgttgggctcggaggagccacaagccctcgctggcaagccagagtcgccgcccacggccgtggacatcttcaagctgtcccgctccgacctgggccggctccgcgcccagctccccacgggcgagggcgcgccacggttcagcacgtacgcggtgctgggggctcacgtgtggcgttgcgcgtccctggcgcgcgggctggccccggagcagccaaccaagctgtactgcgcaactgacgggcggcagcggctgacgccgaccctccctgacggatacttcggcaacgtcatcttcacggccacgccgctcgccgaggcgggcaaggtgaccggctcgctagcggacggcgcgaccacgatccaggacgcgctggagaagatggacgacgagtactgccactcggcgctggactacctagagctgcagccggacctgtcggcgctggtccgcggcgcgcacacgttccggtgccccaacctcgggctcaccagctgggtgcgcctgccgatccacgacgccgacttcggctggggccggcccgtgttcatgggccccggcggcatcgcctacgaggggctcgcgttcgtgctccccagcgccaaccgcgacggcagcctgtcggtggccatctcgctgcaggccgagcacatggagaagttccggaagatgatcttcgacttctgaaactgaaatgaacaaacagcacgcccgcaaccgcaacagtttgcataatgaaagacggaagtacctgagcgaaggggcagagggcgatcttgattacagcttactaggatgcagcaatgattctttgatttccagacgtagttactgcaaaattcccccttctttcctgccactttgggcagggaatattttgtgcgtcttattatcaaacttcgacaaatgtatttgcataatgaacagttgatacgtgcaaaatacgtaacattataaacgttaataaggtttataatcatcgataaagctactgccaaatgcagtatattt

SEQ ID NO: 5033 - DNA, 2328 bp, Zea mays
cccaccaacccccaaggcccaactccactcatcgccactgcgccgaaacccaaagcggggaggaggagcggaaaagaaaaggaaaatgggaggagcggaagcaagtccgagcaagtcagaggatccgccggcctatctccgcctataaaatgccgtcccaccccccaccttcctagcagctgctctccaccaagagctgctggcaccaccaaaccaatcgctggatttgtccagagtatttccggtttcaccgccctagatctgacccgagacgccgcgtcttcgctgagatggcgattactgtgaggcggtcgacgatggtgcgcccggcgcgggagacgccgcggcagcggctgtggaactccaacctcgacctcgtggtgccgcgcttccacacgcccagtgtctacttctaccgccgcgacggccccgtgccggatgcggaggggttcttcgacggcgagcggatgcggcgcgcgctggcagaggcgctcgtgccgttctatccaatggcgggccgcctcgcgcgggacgaggacggtagggtcgagatcgactgcaatggcgagggagtgctcttcgtcgaggccgacgcgcccgatgcctctgtcgatgactacggtgacttcgcgcccaccatggagctcaagcgcctcatcccgaccgtcgattacaccgacgacatctcggccttcccgctactcgtgctccaggtgacttatttcaaatgtggaggcgtctcccttggtgttggcatgcaacaccatgcagcggatggcatgtctggcttgcacttcattaactcatggtctgacctctgccgtggagctcaaatttctgtcatgcccttcattgaccgcacccttcttcgtgctcgtgatccaccaactccatcttttcaacatatcgagtaccagcctgccccagctatgttgtcctccacaacccagttccttgcttccaagtcaaagccacctgccactgctgtggacattttcaagctcactcgctcagaccttggccggctgcgctcacagcttcctgcaggggaaggtgcaccccggttcagcacatatgcagtgctagcggcacatgtctggaaatgtgtctcccttgcacgcagcctacctcctgaacaacccaccaagttgtattgcgccactgatggccgacaacggctacagcctccactaccagatgggtactttggcaatgtcatcttcaccgcgacaccacttgctgaggcgggcaaggtgaccagtgagctggcagaaggagcagcagtcatccagggagcactggataggatggacaacgactactgccgctcagcgttagactacctggagcttcaaccggatctgtcagcacttgtgcgtggagcgcataccttccgctgcccgaacctagggctcaccagctgggtgcgccttcctatccatgatgctgacttcggatggggccggcctgtgttcatggggccaggtggcattgcgtatgaaggtctggcgtttgtcctcccaagtgcaaatggcgacggcagcctgtccattgctatctcgttgcaggctgagcacatggagaagttccggaagctaatcggcgaagcttaaacggtgccaactgttgaaggaggatgttattgggcgagaaggattatgctctgcccaaattctcagataaaatactgaagtttcaagtgaacccagtggctgcactttcactttgaagacttgcagaggaaattcatggtcacttcattttgtgagattaattatagagaaagggtagaaattatatgaagaaacatagtaaaaaatcattgttaggaacaaactccaatagcaggctctacttgtacgtcgcagacataagctgagactgagctgcgattgcaacagattatactcttctatcaggttgactgaagttccctcagtggccaatcttggatctttctgcaggctgatgagatgcaactgagcacacagcctgaggttgtggcggtgtggcctgatctggcttgccattgtcggacatcgtcatcggcgccggggacaccgagcagttcgtcgaggcactagtttttcaacactgctgggtggtgagcagttctattacgccatgacgccaccttgcacaaactttacgttgcgattacctctgcatagcggcggtcctaacattctaagggcccgggacaagaatagaggcctttcaaattatttttaatgtataaatgttactaattaaacactcaaaatacatctaaaaatatttatatcaaataataagtaaataaaagaatatatattatagtattacctt

SEQ ID NO: 5034 - DNA, 1719 bp, Avena sativa
cgcgtgtgaccgcggcttcttccacgtagagacgaccaaccctttcgctttcccgctgctcagtttcccctccggctccgagtcccagatctgcgagtagaagatgaagatcacggtgcggagctcgacggtggtggtgccggcggcggagaccccgcgggtgcggctgtggaacgccaacccggacctggtcgtgccgcggttccacacgcccagcgtctacttctaccgccgcggcggcgacggcgacgcgtgctgctacttcgacgcggcaaggatgcggcgcgcgctggcggaggcgctggtgcccttctacccgatggcggggcggctggcccacgacgaggacgggcgcgtggagatcgactgcaacgcggagggggtgctcttcgtggaggccgacgcgcccgacggcgccgtcgacgacttcggcgacttcgcgcccaccatgggcctcaagcgcctcatccccaccgtcgacttcaccgggggcatctcctcctacccgctcctcgtggcccaggtgacccacttcaagtgcggaggcgtcgccctcggcataggcatgcaacaccacgtcgccgacggcttctccggcctgcacttcatcaactcatggtccgacctctgtcgcggtgtcccgatcgcggtcatgccgttcatcgaccgcaccctcctccgtgcccgtgacccgccggtcccgacccacccacacatcgagtaccagcccgcccccgccatgctgggctcggaggagccacaagccctcgccggcaagccagagtcgccgcccacggccgtggacatcttcaagctgtcccgctccgacctgggccggctccgcgcccagctccccacgggcgagggcgcgccacggttcagcacgtacgcggtgctgggggctcacgtgtggcggtgcgcgtccctggcgcgcgggctggccccggagcagccaaccaagctgtactgcgccacggacgggcggcagcggctgacgccgacgctccctgacgggtacttcggcaacgtaatcttcacggccacgccgctcgccgaggcgggcaaggtgaccggctcgctggcggacggggcgaccacgatccaggacgcgctggagaagatggacgacgagtactgccactcggcgctggactacctagagctgcagccggacctgtcggcgctggtccgcggcgcgcacacgttccggtgccccaacctcggctcaccagctgggtgcgcctgccgatccacgacgccgacttcggctggggccggcccgtgttcatgggccccggcggcatcgcctacgaggggctcgcgttcgtgctccccagcgccaaccgcgacggcagcctgtcggtggccatctcgctgcaggccgagcacatggagaagttccggaagatgatcttcgacttctgaaactgaaatgaacaaacagcacgcccgcaaccgcaagagtttgcataatgaaagacggaagtacctgagcgaaggggcagagggcgatcttgattacagcttactaggatgcagcaatgattctttgatttccagacgtagttactgcaaaactcccccttctttcctgccactttgggcagggaatattttgtgcgtcttactatcaaacctccacaaatgtatttgcataatgaacagttgatacgtgcaaaatacgtaataacattataaacgttaataaggttgttcctc

SEQ ID NO: 5035 - DNA, 1780 bp, Echinochloa colona
gcctccccggctccgagatctccgcctataaaaaccgccccaccccccactcgcccaccagctgctctccaccaagagctgctgctgctaccaccaaaccggtcgttggattcgtccagagttctgcccgtttcgcggccccagatctgatccgcggcgccgcgtctccgctgagatggcgatcacggtgaggcggtcgacgatggtgcgcccggcgcgggagacgccgcggcagcggttgtggaactccaacctcgacctcgtggtgccgcgcttccacacgcccagcgtctacttctaccgccgcggcggccccgaggtggaggggttcttcgacggcgagcggatgcggcgcgcgctggcggaggcgctcgtgccgttctatccgatggccgggcgcctcgcgcgggacgaggacgggagggtcgagatcgactgcaacggcgaaggggtgctcttcgtcgaggctgacgcgcccgacgccgttgtcgacgactacggcgacttcgcgcccaccatggagctcaagcttctaataccggcggtcgattacaccgatgacatctcggccttcccgctccttgtgctccaggtgacttacttcaaatgtggaggcgtctcccttggtgttggcatgcaacaccatgtagctgatggcatgtccggcttgcacttcattaactcatggtctgacctctgccgtggagctcaaatttctgtcatgcccttcattgaacgcactctcctccgtgctcgtgatccaccaactccatctttccaacatattgagtaccagcctgcgccagctatgttgtcctccacacctcagtccctcacatccaagtcaaagccacctgccaccgccgtggacattttcaagctcactcgctcagacatcggccggctgcgttcgcagcttcccacaggtgaaggcgcaccacgattcaacacatatgcagtgctagctgcgcatgtctggaaatgtgtttcccttgcacggggccttgcccctgaacagcccaccaaattgtactgtgccaccgatgggcggcaacggctacagcctccacttccagaaggttacttcggcaatgtcatcttcaccgcaacaccacttgctgaggcaggcaaggttaccagtggcctggcagaaggagcagcagtcatccagggagcactagataggatggacaacgactactgccgctctgcgctagactacctggagctgcaaccagatttgtcagcactagtgcgtggagcacacaccttccggtgcccgaacctaggtctcaccagctgggttcgccttccgatccatgatgctgacttcggttggggccgccctgtgttcatggggccaggcggcattgcatatgagggcctggcatttgtcctcccaagctcaaatggggacggtagcctgtccatcgccatctcattgcaggctgagcacatggagaagttccgaaagctaatctatgatatataaacaaaatggattataccttttgaagaaggatgtaataggactagaggataaaggctgtatccaattcatccagttctcatataaataccatacgcttcaagcggaccaagttgctgcgttttcactcatataggtcagtggagtaaattcatgaccacatctttttatacccttggctggggaatgtttttggtaacatctaattgtattggttaccaataatgtgttattttgaggggaaagatcaataatagtctaatagtgaggctagacatttttctatgaaga

SEQ ID NO: 5036 - DNA, 2504 bp, Sorghum bicolor
cgaaaagaaaagggaagaaaatgggtggagcggaagccagtccgagcaagtcagaggatccgcccgcctcccccgagatctgcgcctataaaatccgccccaccccccactctcccaccagctgctctccaccaagagctgctgccaccaccaccaaacccatcgctggatttgtccagagtctttcctgtttcaccgccccagatctgatccgcggcgccgcgtcttcgctcagatggtgatcactgtgaggcggtcgacgatggtgcgcccggcgcgggagacgccgcgccagcggctgtggaactccaacctcgacctcgtggtgccgcgcttccacacgcccagcgtctacttctaccgccgcggcgacggcgccgcggcgccggcggaggggttcttcgacggcgagcggatgcggcgcgcgctggcagaggcgctcgtgccgttctacccgatggcgggccgcctcgcgcgggacgaggacgggagggtcgagatcgactgcaatggcgagggagtgctcttcgtcgaggccgacgcgcccgacgtctccgtcgacgactacggtgacttcgcccccaccatggacctgaaacgcctcatcccgaccgtggattacaccgacgacatctcggccttccctctactggtgctccaggtgactcattttaaatgtggaggcatctcccttggtgttggcatgcaacaccatgtagcggatggcatgtctggcttgcacttcattaactcgtggtctgacctctgtcgtggagctcaaatttctgtcatgcccttcattgaccgcactcttattcgcgctcgtgatccaccaactccatcttttcatcatatcgagtaccagcctgccccagctatgttgtcctccacaccccagttccttgcttccaagtcaaagccacctgccactgctgtggacattttcaagctcactcgctcagaccttggccggctgcgctcacagcttgctgcaggggaaggtgcaccccggttcagcacatacgcagtgctagcagcacatgtctggaaatgtgtctcccttgcacgcagcctacctcctgaacaacccaccaagttgtattgcgccactgatgggcgccaacggctacagcctccactaccagatggttactttggtaatgtcatcttcactgcgacaccacttgctgaggcgggcaaggtgaccagtgggctggcagaaggagcagcagtcatccagggagcactggataggatggacaacgactactgccgctcagcgctggactacctggagctgcaaccggatttgtcagcactggtgcgtggagcacataccttccggtgcccgaacctagggctcaccagctgggtacgccttcctatccatgatgccgacttcggatggggccgtcctgtgttcatggggccaggcggtattgcatatgaaggtctggcgtttgtcctcccaagtgcaaatggagatggcagcctgtccattgctatctctttgcaggctgagcacatggagaagttccggaagctaatctgcgaagtttaaacagaatgtcagcgccgactattgaaggatggtgttatagggcaagaggctttatgttgtacccaaattctcccagataaaatactgaagtttcaagtgaacccagtggctgcactttcacttttgaagacttgcagagtaaattcatggccacttacttttgtgcccctttgggggatgtttttggcaaatctataattgtatgggttaccaatagacgttgttttaggggaaagatcaattatagagaaagggtagacattttctgtgaagaaacatagtaaaactcattgtaaggaacaagctccaatagcaaactcgatgtggggttacttgatcatggaataatttatcagtacaatttggcaatccacaattttctacttgtacgacgcagacatagctgagattgagctgcgattgttactgattaaactcctatcaggctgagatacaactgaacacacacgctgaggctttgaggctgaggcagatggagccaactgcaaggctactcatcaggaattccactcatcatgcgatggattgcaggagcagacgtggaggttgggttagtaatccatggtggcgcgttggagagaggaggtgaaatggtggccctgcagagaatcagtgatgcttgcagaagcgcctatggtcagaaaaagatgtggctctagcaaaaaacaaagagaagatcatcatttgtttggatcaaaagctgtagtgtatgctgctgttgctgcttgcgaaaggggctatatgcctcaaacttgtcttggactcttggtctacgtgtattgtgcttttggtgtgaaaccaccagggctgttagcccccattgctgctgctcttatcaaccagtgtaccctttgggtctgctgcaagcagcaagcctgatcatagtaccgggttgttgtgcctttgataaaagtatgttggg

SEQ ID NO: 5037 - DNA, 2059 bp, Brachypodium distachyon
gtcaccggggagcgaagtcacaggaactacgccagctagtctgagttctgagttctcccgtggcttataaaagcagctccaccaccacgctcgcccaccagctgctctcccaccaagagctgctcctgttgcctaaccatccatcccgttcccgtcagctctgctgcccgtagatctgccccgccccgccgcgccggcgttgctcttccaagatcagatggcgatcacggtgaagcggtcgacgatggtgcggccggcgggggagacgccgcgcgtgcggctctggaactccaaccttgacctcgtcgtgccgcgcttccacacgcccagcgtctacttctaccggcgggccgaggcgggaggggacgcgggcgcgacgggggtgttcttcgacggcgagcggatgcggcgcgcgctggcggaggcgctcgtgccgttctacccgatggcagggcgcctcgcgcgcgacgaggacgggagggttgagatcgactgcaacggggagggcgtgctcttcgtcgaggccgacgcgccggacgctgccgtcgacgactacggcgacttcgcgcccaccatggagctcaagcgcctcatcccggccgtcgactacaccgacgacatatcctccttcccgctcctcgtgctccaggtgacctacttcaagtgtggaggcgtctcccttggtgttggcatgcaacaccatgtcgctgatggcatgtctggtttacacttcattaactcatggtcggatctctgccgtggacttcaaattgcaatcatgcctttcatcgatcgtactctccttcgtgcccgtgatccaccgactccatcttaccctcatgttgagtaccagcctgccccagccatgctgtcctctgcgccccaggttctcactggaaagccaatgttgcctccaactgctgtggacatcttcaagcttacccgctcagaacttggccgcttgcgctcacagctcccctctggcgaaggtgcaccacggttcagcacgtatgcagtgctagctgcgcatgtctggcgctgtgtctcccttgctcgcagccttcctcctgaacagcccaccaagctgtattgtgccactgatgggcgacaaaggctgcagcccccgcttccagatggttacttcggaaatgtcatcttcactgccaccccactggccgaggcaggcaaggtgaccagtgggttagaagatggagccacagtcatccagggagcgctagataggatgtctgatgactactgccgctcagcattggatttcctggagctgcaaccggatttatcagcattggttcgaggagctcacacattcaggtgccctaacctcggtctcaccagctgggtgcgcctgccgatccacgatgctgattttggttggggacgaccggtgttcatgggtcctggaggcattgcatacgaggggctggcgttcgtcatcccgagctcgagtaaggatggcagcttatccatcgctatctcgttgcaggccgagcacatggagaagttccggaagctgatattcgaggtgtaaacaggccgcattgcttatttcagaactaagtcacagggcaagaagcttcagtttgtgctgaacaggcagtctcttctccggggtaaactgtctgaagtttcaggccgcattatttatttcagaaagaagttacagggcaagaagcttcaggttatgctgaactcttctccggggtaaactgtctgaagtttcaagtgaacatagtgtgtgttcttgctcttcttgagtacattcactctaatacttgtctccttggaggtcttttttgggagaacacctaaactgcacgtggtatacaaataagactatctattactgtaaagaaaagtatttcatagataaggagttctgttctttttttgaagatcaacaatgaatgggttgtgcactagactgtatagagtacaagagtatgttgaatcatgtatcgaaaaacagatggaaaaatctgattattttttaagaaaagagagattactttagaacctcatgtaaaatgtggtggttttg

SEQ ID NO: 5038 - DNA, 1683 bp, Avena sativa
cggcatcccgcctggatcgccggctataaaaaccgcgccacccccctctcgctcaccagctctccaccaagagctacctactagaactactttaatcataccaccgctgtgccgtccgtaccgcgcgtgtgaccgcggcttcttccacgtagagacgaccctttcgctttagtttcccctccgagtcccagatctgcagcgagaaggagaagatgaagatcacggtgcggagctcgacggtggtggtgccggcggcggagaccccgcgggtgcggctgtggaacgccaacccggacctggtggtgccgcggttccacacgcccagcgtctacttctaccgccgcggcggcggcgaggacggcggcgacgcgtgctacttcgacgcggggaggatgcggcgcgcgctggcggaggcgctggtgcccttctacccgatggcggggcggctggcccacgacgaggacgggcgcgtggagatcgactgcaacgcggagggggtgctcttcgtggaggccgacgcgcccgacggcgccgtcgacgacttcggcgacttcgcgcccaccatgggcctcaagcgcctcatccccaccgtcgacttcaccgggggcatctcctcctacccgctcctcgtggcccaggtgacccacttcaagtgcggaggcgtcgctctcggcataggcatgcaacaccacgtcgctgacggcttctccggcctgcacttcatcaactcatggtccgacatctgtcgcggtgtcccgatcgcggtcatgccgttcatcgaccgcaccctcctccgggcccgtgacccgccggtcccgacccacccgcacatcgagtaccagcccgcgcccgccatgctgggctcggaggagccgcaagcccttgccggcaagccggagtcgccgcccacagccgtggacatcttcaagctgtcccgctccgacctgggccggctccgtgcccagctccccacgggcgagggcgcgccacggttcagcacgtacgcggtgctcggggctcacgtgtggcggtgcgcgtccctggcgcgcgggctggccccggagcagccaaccaagctgtactgcgccacggacgggcggcagcggctgacgccgacgctccctgacgggtacttcggcaacgtcatcttcacggccacgccgctcgccgaggcgggcaaggtgaccggctcgctggcggacggggcgaccacgatccaggacgcgctggagaagatggacgacgagtactgccactcggcgctggactacctagagctgcagccggacctgtcggcgctggtccgcggcgcgcacacgttccggtgccccaacctcgggctcaccagctgggtgcgcctgccgatccacgacgccgacttcggctggggccggcccgtgttcatgggccccggcggcatcgcctacgaggggctcgccttcgtgctccccagcgccaaccgcgacggcagcctgtcggtggccatctcgctgcaggccgagcacatggagaagttccggaagatgatcttcgacttctgaaactgaaatgaacaaacagcacgcccgcaaccgcaacagtttgcataatgaaagacggaagtacctgagcgaaggggcagagggcgatcttgattacagcttactaggatgcagcaacgattctttgatttccagacgtagt

SEQ ID NO: 5039 - DNA, 1596 bp, Avena sativa
ctccaccaagagcttgctgctgctgctgccgcccaactcccgtctgcttccccgccgaagatccgtccccccttctaccaaggcagatggcgatcacggtgaggcggtccacgatggtgcgcccggcggcggagaggccgcgggagcggctctggaactccaacctcgacctcgtcgtcccgcgcttccacacgcccagcgtctacttctaccgccgccccgacgccggagccggggccggagcggcggaggggttcttcgacgccgagcggatgcggcgcgcgctggcggaggcgctcgtgcccttctacccgatggcgggccgcctggcgcgggacgaggacggcagggtcgagatcgactgcagcggtgagggggtgctcttcgtcgaggccgaggcccccggcgccgccgtcgacgactacggcgacttcgcgcccaccatggagctcaagcgcctcatccccgccgtcgactactccggcgacatctcctccttcccgctactcgtgcttcaggtgacctatttcaagtgtggaggcgtctcccttggcgttggcatgcaacatcatgtagctgacggcatgtctggacttcatttcatcaactcttggtctgacctctgccgtggagctcaaattgcagtaatgcccttcatcgaccgcactcttctccgtgcccgagatccaccaactccatcttacacacatgtcgagtaccagcctgccccagcaatgctgtcgtcggcgccccaagctctcactggcaagccaacgctggctccaactgcggtggacatcttcaagctcacccgctcggagcttggccgcttgcgctcgcagctccccacgggtgaaggtgcaccgcgtttcagcacgtacgctgttctagccgcacatgtctggcgctgtgtctcccttgcgcgtggcctgcctgccgaacagcccaccaagctgtactgtgccaccgacgggcgacatcggctgcagccccgttgccggagggttacttcggaaacgtcatcttcaccgcacccactcgctgaggcaggcaaggtgacgggcgctgtggcagatggagcagcggtcatccagggagcactggataggatgtccgacgactactgccgctcagcgttggactacctggagacgcagccggatttgtcagcattggtccgcggagcccacaccttccggtgccctaacctcggcctcaccagctgggtgcgcctgccgatccacaacgccgatttcggttgggggcggcccgtgttcatgggtcctggtggcattgcctatgaggggctggcgttcgtcctcccgagcgcgaacaaggacggcagcctgtccatcgccatctcgttgcaggccgagcacatggagaagttccggaagctgatcgccgacgtgtgagcaggctgcaactttcgtgttgtcagagaaaagatacagggcaaggacatgttcagggttcttttttgtcacatatgttaacaggtttttgtgctggtatctcttccggggtaaattgtacacttacaatatgtgatattccaatcaacaaagagtactgttttttaaatcaataaggatg

SEQ ID NO: 5040 - DNA, 1565 bp, Avena sativa
ccaagagcttgctgctgctgctgccgcccaactcccgtgtctacttccccgccgaagatccgtccccccttctaccaaggcagatggcgatcacggtgaggcggtccacgatggtgcgcccggcggcggagaggccgcgggagcggctctggaactccaacctcgacctcgtggtcccgcgcttccacacccccagcgtctacttctaccgccgccccgacgccggagccggagccggagcaggggaggggttctcgacgccgagcggatgcggcgcgcgctggcggaggcgctcgtgcccttctacccgatggcggggcgcctcgcccgggacgaggacggcagggtcgagatcgactgcagcggggagggggtcctcttcgtcgaggccgaggcccccggcgccgcagtcgacgactacggcgacttcgcgcccaccatggagctcaagcgcctcatccccgccgtagactactccggcgacatctcctccttcccgctactcgtgcttcaggtgacctatttcaagtgtggaggcgtctcccttggcgttggcatgcaacatcatgtagctgacggcatgtctggacttcacttcatcaactcatggtctgacctctgccgtggagctcaaattgcagtgatgcccttcatcgaccgcactcttctccgtgcccgcgatccaccaactccatcttacacacatgttgagtaccagcctgccccagcaatgctgtcgtcggcgccccaagctctcactggcaagccaacgttggctccaactgcggtggacatcttcaagctcacccgctcggagcttggccgcttgcgctcgcagctccccacgggtgaaggtgcaccgcgtttcagcacgtatgccgtgctagccgcacatgtctggcgctgtgtctcccttgcgcgtggcctgcctgctgaacagcccaccaagctgtactgtgccactgacgggcgacatcggctgcagcccccattgccagagggttacttcggaaacgtcatcttcaccgccaccccactcgccgaggcaggcaaggtgaccggcgccgtggcagatggagcagcggtcatccagggagcgctggataggatgtccgacgactactgccgctcagcgttggactacctggagacgcagccggatttatcagcattggtccgcggagcccacactttccggtgccctaacctcggcctcaccagctgggtgcgcctgccgatccacgatgcggatttcggttggggacggcccgtgttcatgggacctggtggcatcgcctacgaggggctggcgttcgtcctcccgagcgcgaacaaggacggcagcctgtccatcgccatctcgttgcaggccgagcacatggagaagttccggaagctgatcgccgacgtgtaagcggactgcaacttttacgctgtcagagaaaagatacagggcaagaatatgttcagggttcttttttgtcacaaacgttaaactggtttctgtgctggtatctcttccggggtaaattgtacttacagtatgtgatatttaatcaacaaag

SEQ ID NO: 5041 - DNA, 1440 bp, Avena sativa
tggcgatcacggtgaggcggtccacgatggtgcgcccggcggcggagaggccgcgggagaggctctggaactccaacctcgacctcgtggtgccacgcttccacacccccagcgtctacttctaccgccgccccgacgccggagccggggccggagcggcggaggggttcttcgacgccgagcggatgcggcgcgcgctggcggaggcgctcgtgcccttctacccgatggcggggcgcctggcccgggacgaggacggcagggtcgagatcgactgcagcggcgagggggtgctcttcgtcgaggccgaggcgcccggcgccgccgtcgacgactacggcgacttcgcgcccaccatggagctcaagcgcctcatccccgccgtcgactactccggcgacatctcctccttcccgctactcgtgcttcaggtgacctatttcaagtgtggaggcgtctcccttggcgttggcatgcaacatcatgtagctgacggcatgtctggacttcactttatcaactcatggtctgacctctgccgtggagctcaaattgcagtgatgcccttcatcgaccgcactcttctccgtgcccgcgatccaccaactccatcttacacacatgttgagtaccagcctgccccagcaatgctgtcgtcggcgccccaagctctcactggcaagccaacgctggctccaaccgcggtggacatcttcaagctcacccgctcggagcttggccgcttgcgctcgcagctccccacgggtgaaggtgcaccgcgtttcagcacgtatgccgtgctagctgcacatgtctggcgttgtgtctcccttgcgcgtggcctgcctgctgaacagcccaccaagctgtactgtgccactgacgggcgacatcggctgcagcccccgttgccggagggttacttcggaaacgtcatcttcaccgccaccccactcgctgaggcaggcaaggtgaccggcgccgtggcagacggagcagcggtcatccagggagcactggataggatgtccgatgactactgccgctcagcgttggactacctggagacgcagccggatttatcagcattggtccgcggagcccacacttccggtgcctaacctcggcctcaccagctgggtgcgcctgccgatccacgatgcggatttcggttggggacgccccgtcgttcatgggacctggtggcattgcctacgaggggctggcgttcgtcctcccgagcgcgaacaaggacggcagcctgtccatcgccatctcgttgcaggccgagcacatggagaagttccggaagctgatcgccgacgtgtaagcggactgcaacttttatgttgtcagagaaaagatacagggcaagaatatgttcagggttcttttttgtcacaaatgttaaacaggtttctgtgctggtatctcttccgg

SEQ ID NO: 5042 - DNA, 1723 bp, Hordeum vulgare
ctgctgtctcagaaggaaaaacccagtccagggcaaatgccagaatgaaccgagacatgatgcagtctcacgtttgggggcttcggttgccacgacaacaggccctcccacactccactgttaacttctccatacacaaaaaaacataaattcattattgatatcccacaagaataagattatgttctgtccactgtataaactccagtatgtgttaatttgaaactccaggcatatatatacccccccagaaaaacgttcggcgcaacctgaagctttgttgccctgtaaaacttctctctaaacggcggtctatctacacatcgaggatcagcttccggaacttctccatgtgctccgcctgcaacgagatggcgatggacaggctgccgtccttgctcgcgctcgggaggacgaacgccagcccctcgtacgcgatgccgccaggacccatgaacaccggcctcccccagccaaaatcggcgtcgtggatcggcaggcgcacccagctggtgaggccgaggttggggcaccggaaagtgtgtgctccacggaccaatgctgacaggtccggctgcatctccaggtagtccagggctgattggcagtagtcgccagtcatcctgtctagcgctccctggatgaccgctgctccttccgccagcccgctcgtaaccttgcctgcctcggcgagcggggtggcggtgaagatgacattcccaaagtaaccttctggcagcgggggctgcagccgttgtcgcccatcggtggcgcaatacagcttggtgggctgttccggagccaggttgcgcgcaagggagacgcagcgccagacatgtgcagctagcactgcatacgtgctgaaccgtggcgcaccttcacctgtggggagctgcgaacgcaggcggccaagctctgagcgggtgagcttgaagatgtccacagcagtgggaggcggcgctggcttgccaccgagagcctgaggcacggacgacagcatggctggggcaggctgatactcaacatgcgggtaagatggagtaggtggatcacgagcacggacgagagtgcggtcgatgaagggcatgactgcgattttaactccgcggcagaggtcagaccacgagttgatgaagtgcaaaccagacatgccatcagcaacatggtgttgcattcccacaccaagggagacgcccccacacttgaagtaggtcacctgaagcacgaggagcgggaaggaggatatgtcgtcggtgtagtccacgggcgggatgaggcgcttgaggtccatggtgggcgcgaagtcgccgtagtcgtcgacggtggcggtgggcgcgtcggcctcgacgaagagcaccccttccccgctgcagtcgatctcgaccctgccgtcctcgtcgcgcgcgaggcggccggccatcgggtagaagggcacgagcgcgtcggccagcgcgaggcgcatccggtcggcgtcgaagaagccgtcggcgcccgcctcggggcggcggtagaagtagacgctgggcgtgtggaagcgcgggaccacgaggtcgaggttggagttccagagccgctcccgcggcctctccaccgccgggcgcaccatcgtcgaccgcctcaccgtgatcgccatctgccgccgcattccggggaacaagcaaacagcccgtgagcgaaacggaaggggggaaacggaacaggcagacaaaaagcacgcgcgcgc

SEQ ID NO: 5043 - DNA, 1755 bp, Avena sativa
ctccaccaagagctacctactagaactactttaatcatagcaccgctgcgccgtccgtaccacgcgtgtgaccgcggcttcttcctcgtagagacgaccctttcgctttagtttcccctccgagtcccagatctgcagcgagaaggagaagatgaagatcacggtgcggagctcgacggtggtggtgccggcggcggagaccccgcgggtgcgtctgtggaacgccaacccggacctggtggtgccgcggttccacacgcccagcgtctacttctaccgccgcggcggcgaggacggcggcgacgcgtgctacttcgacgcggggaggatgcggcgcgcgctggcggaggcgctggtgcccttctacccgatggcggggcggctggcccacgacgaggacgggcgcgtggagatcgactgcaacgcggagggggtgctcttcgtggaggccgacgctcccgacggcgccgtcgacgacttcggcgacttcgtgcccaccatgggcctcaagcgcctcatccccaccgtcgacttcaccgggggcatctcctcctacccactcctcgtggtccaggtgacccacttcaagtgcggaggcgtcgccctcggcatagccatgcagcaccacgtcgccgacggcttctccggcctgcacttcatcaactcatggtccgacctctgtcgtggtgtcccgatcgctgtcatgccgttcatcgaccgcaccctcctacgggcccgtgacccgccggtcccaacccacccgcacatcgagtaccagcccgcccccgccatgctgggctctgaggagccacaagccctcgccggcaagccagagtcgccgcccacggccgtggacatcttcaagctgtcccgctccgacctgggccggctccgtgcccagctccccacgggcgagggcgcgccacggttcagcacgtacgcggtgctcggggctcacgtgtggcggtgcgcgtccctggcgcgcgggctggccccggagcagccaaccaagctgtactgcgccacggacgggcggcagcggctgacgccgacgcaccctgacgggtacttcggcaacgtcatcttcacggccacgccgctcgccgaggcgggcaaggtgaccggctcgctggcggacggggcgaccacgatccaggacgcgctggagaagatggacgacgagtactgccactcggcgctggactacctagagctgcagccggacctgtcggcgctggtccgcggcgcgcacacgttccggtgccccaacctcgggctcaccagctgggtgcgcctgccgatccacgacgccgacttcggctggggccggcccgtgttcatgggccccggcggcatcgcctacgaggggctcgccttcgtgctccccagcgccaaccgcgacggcagcctgtcggtggccatctcgctgcaggccgagcacatggagaagttccggaagatgatcttcgacttctgaaactgaaatgaacaaacagcacgcccgcaaccgcaacagtttgcataatgaaagacggaagtacctgagcgaaggggcagagggcgatcttgattacagcttactaggatgcagcaatgattctttgatttccagacgtagctactactgcaaaattcccccttctttcctgccactttgggcagggaatattttgtgcgtcttatcagacttcgacaaatgtatttgcataatgaacagttgatacgtgcaaaatacgtaataacattataaacgtt

SEQ ID NO: 5044 - DNA, 1759 bp, Avena sativa
ctccaccaagagctaccaactagtgtaccacttccgtttaattaccaccgctgcgccgtccgtaccacgcgtgtgcccgcgccttcttccacgtagagacgaccaaccctttcgctttcccgctgctcagtttcccctccggctccgagtcccagatctgcgagaagaagatgaagatcacggtgcgaagcacgacggtggtggtgccggcggcggagacgccgcggctgcggctgtggaacgccaacccggacctggtcgtgccgcggttccacacgcccagcgtctacttctaccgccgcggcggcggcgacggcgacgcgtgctacttcgacgcggggaggatgcggcgcgcgctggcggaggcgctggtgaccttctacccgatggcgggccggctggcccacgacgaggacgggcgcgtggagatcgactgcaacgccgagggagtgctcttcctcgaggccgacgcgcccgacggcaccgtcgacgatttcggggacttcgcgcccaccatgggcctcaagcgcctcatccccaccgtcgacttcaccgggggcatctcctcctacccgctcctcgtggcccaggtgacccacttcaagtgcggaggcgtcgctctcggcataggcatgcaacaccacgtcgctgacggcttctccggcctgcacttcatcaactcatggtccgacatctgtcgcggtgtcccgatcgcggtcatgccgttcatcgaccgcaccctcctccgggcccgtgacccgccggtcccgacccacccgcacatcgagtaccagcccgcgcccgccatgctgggctcggaggagccgcaagcccttgccggcaagccggagtcgccgcccacagccgtggacatcttcaagctgtcccgctctgacctgggccggctccgcgcccagctccccacgggcgagggtgcgccgcggttcagcacgtacgcggtgctcggggctcacgtgtggcggtgcgcgtccatggcacgcgggctggccccggagcagccaaccaagctgtactgcgcaacggacgggcggcagcggctgacgccgaccctccctgatggatacttcggcaatgtcatcttcaccgccacgccgctcgccgaggcgggcaaggtgaccggctcgctggcagacggcgcgaccacgatccaggaggcgctggagaagatggacgacgagtactgccactctgctctagactacctagaactgcagccagacctatcagctctggtccgcggcgcacacacgttccggtgccccaacctcgggctcaccagctgggtgcgcctgccgatccacgacgccgacttcggctggggccggcccgtgttcatgggccccggcggcatcgcctacgaggggctcgccttcgtgctccccagcgccaaccgcgacggcagcctgtcggtggccatctcgctgcaggccgagcacatggagaagttccggaagatgatcttcgacttctgaaacgaacaaacagcacgcgcgcaatcgcaactcgcagcggagaatgaaagaggaagcagctgagcgaaagggcagagggcgatcttgattacagcttactaggatgcagcaacgattctttgatttccagacgtagttactgcacatttccccttctttcctgccactttgggcagggaatattttgtgcgtcctattgaacttcgacaaatgtatttgcataatgaacagttaatacgtgcaaaatacgtaacattataaatgct

SEQ ID NO: 5045 - DNA, 1722 bp, Hordeum vulgare
gcgcgcgcgtgctttttgtctgcctgttccgtttccccccttccgtttcgctcacgggctgtttgcttgttccccggaatgcggcggcagatggcgatcacggtgaggcggtcgacgatggtgcgcccggcggtggagaggccgcgggagcggctctggaactccaacctcgacctcgtggtcccgcgcttccacacgcccagcgtctacttctaccgccgccccgaggcgggcgccgacggcttcttcgacgccgaccggatgcgcctcgcgctggccgacgcgctcgtgcccttctacccgatggccggccgcctcgcgcgcgacgaggacggcagggtcgagatcgactgcagcggggaaggggtgctcttcgtcgaggccgacgcgcccaccgccaccgtcgacgactacggcgacttcgcgcccaccatggacctcaagcgcctcatcccgcccgtggactacaccgacgacatatcctccttcccgctcctcgtgcttcaggtgacctacttcaagtgtgggggcgtctcccttggtgtgggaatgcaacaccatgttgctgacggcatgtctggtttgcacttcatcaactcgtggtctgacctctgccgtggagttaaaatcgcagtcatgcccttcatcgaccgcactctcgtccgtgctcgtgatccgccgactccatcttacccgcatgttgagtatcagcctgccccagccatgctgtcgtccgtgcctcaggctctcggtggcaagccagtgccgcctcctactgctgtggacatcttcaagctcacccgctcagagcttggccgcctgcgttcacagctccccacaggtgaaggtgcgccacggttcagcacgtatgcagtgctagctgcacatgtctggcgctgcgtctcccttgcgcgcaacctggctccggaacagcccaccaagctgtattgcgccaccgatgggcgacaacggctgcagcccccgctgccagaaggttactttgggaatgtcatcttcaccgccaccccgctcgccgaggcaggcaaggttacgagcgggctggcggaaggagcagcggtcatccagggagcgctagacaggatgactggcgactactgccaatcagccctggactacctggagatgcagccggacctgtcagcattggtccgtggagcacacactttccggtgccccaacctcggcctcaccagctgggtgcgcctgccgatccacgacgccgattttggctgggggaggccggtgttcatgggtcctggcggcatcgcgtacgaggggctggcgttcgtcctcccgagcgcgagcaaggacggcagcctgtccatcgccatctcgttgcaggcggagcacatggagaagttccggaagctgatcctcgatgtgtagatagaccgccgtttagagaaaagttttacagggcaacaaagcttcaggttgcgccgaacgtttttctggggggtatatatatgcctggagtttcagattaacacatactggagtttatacggtggacagaacataatcttattcttgtgggatatcaataatgaatttatgtttttttgtgtatggagaagttaacagtggagtgtgggagggcctgttgtcgtggcaaccgaagcccccaaacgtgagactgcatcatgtctcggttcattctggcatttgccctggactgggtttttccttctgagacagcag

SEQ ID NO: 5046 - DNA, 2516 bp, Setaria italica
ctgctctccaccaagagctgctgctaccaccaaaccgtcgctggattcgtccagagctttgcccgtttcggcgaccccagatccgatccacggcgccgcgtctccgccgagatggcgatcacggtgaggcggtcgacgatggtgcgcccggcgcgggagacgccgcggcagcggctgtggaattccaacctcgacctcgtcgtgccgcgcttccacacgcccagcgtctacttctaccgccgcggcggcggccccgaggcggagggattcttcgacggcgagcggatgcggcgcgcgctggcggaggcgctcgtgccgttctacccgatggcggggcgactcgcgcgggacgaggacgggagggtcgagatcgactgcaacggcgaaggggtgcttttcgtcgaggctgacgcgcccaacgccgccatcgacgactacggcgacttcgcccctaccatggagctcaagcgcctcatcccggcggtcgattacaccgacgacatctcggccttcccgctcctcgtgctccaggtgacttacttcaaatgtggaggcgtctcccttggtgtcggtatgcaacaccacgtagcagatggcatgtctggcttgcacttcattaactcatggtctgacctctgccgtggagctcaaatttctgtcatgcccttcattgaccgcactctccttcgcgcccgtgatccaccaactccatctttccaacatatcgagtaccagcctgccccagctatgttgtcctccacacctcagtccctcacttccatatcaaagccacctgccaccgccgtagacattttcaagctcactcgctcagaccttggtcggctgcgctcacagcttcccacaggtgaaggtgcaccccggttcaacacgtatgcagtgctagctgcgcatgtctggaaatgtgtctcccttgcacgtggcctgactcctgaacagcccaccaaattgtactgtgccaccgacgggcgccaacggctacagcccccacttccagatggttacttcggaaatgtcatcttcaccgccacaccacttgccgaggcaggcaaggtgaccagtgggctggcagaaggagcagcagtcatccaaggagcactagataggatggacaacgactactgccgctcagcgctggactacctggagctgcagccagatttgtcagcactggtgcgtggagcacacaccttccggtgcccgaacctaggactcaccagctgggtgcgcctgccgattcatgatgccaacttcggttggggccggcctgtgttcatggggccaggcggcattgcatatgagggtctggcgttcgtcctccctagtgccaatggagatggtagcctgtccatcgccatctcgttgcaggctgagcacatggtgaagttccgaaagctaatctatgagttataaatgggatgcattataccttttgaaggaggatgtaatagggctagaggctaaaggctgtatccagttctcatataaaatgcctgaagtttcaagtgaaccaagttgctgcgctttcacccttcaagatcagtgttcttttttaccctcggctggggatgttttgggtaacttctacttgtatggactaatatcaataatagagaaaggttagacatttttctaaagggacatggtgaaatcattgtaaccaagtgaacacactcatataccagagtaccagattatagatggggtttaattgaagtattgaacatgagcgtcagtggaaacgcctcacaatcttctgttttacgcttaagggaagaaatgttcttggtggatgcaggccttggtacccccaaaatttgtatgcaagatgagcttacaggactgccaatcaagcgagccaccaggtttgagaataaggtgggatccaagaatgtagtggctggtgaatcactgatcaaaaagcgaatttttgagagattcttcatcgatctggtggccggtgaatcactgatcaaagagcgagcaaccgccaggtttaatgattttgtgggatccctggatgtagcggctggcgaacatttgaagatccacaatttctacttgttcgtagacctagctctgattgagctgcaaccggtgatggtctatctggttggctgaggtttcatcaattggcaaatcttgatctatcatccagcgcgtggttcataaatcataacaggtgcagatcttggcaatcttgaaaacgacccctaacccgaagcctggaagaagaagaacctccagggctccaggcacaggaaggaaggctgaaacgtttgatcatgtaccattggtcctttgttctcgttacaatgggattcatacttcattacggtaattttgataaaattatgttcaaaattgcgagaaaggagacgacacatggattaatctatattgtagggaggaaggctgattttatcttatttttagggatagcgccctttctaggcgtctatattgtaagaattacaaacgcctgctggcggctccag

SEQ ID NO: 5047 - DNA, 1714 bp, Secale cereale
gactcccacccatcgccgcagagcgcgcccaaggcagcgcaatcacaggaaccccgccgctccgcccgaccacccgctcgcccggggcctatataagcacctccaccgcccactcgcccaccagctgctctccaccaagagctgctgctatttaccccaccatacataccgtcggctttgcctcgccgacgccgccgcagatctgacccgccgcgccgccgtccatccttcctccaagatggcgatcacggttaggcggtccacgatggtgcggccggcggtggagaggccgcgggagaggctctggaactccaacctcgacctcgtcgtcccgcgcttccacacgcccagcgtctacttctaccgccgccccgacgcgggcgcggacggcttcttcgacgccgaccggatgcgcctcgcgctcgccgacgcgctcgtgcccttctacccgatggccggccgcctcgcgcgcgacgaggacggcagggtcgagatcgactgcagcggggagggggtgctcttcgtcgaggccgacgcgcccggcgccgccgtcgacgactacggcgacttcgcgcccaccatggacctcaagcgcctcatcccgcccgtcgactacaccgacgatatatcctccttcccgctcctcgtgctgcaggtgacctacttcaagtgtggtggtgtctcccttggtgtcggaatgcaacaccatgttgctgacggcatgtctggcttgcatttcatcaactcgtggtctgacctctgccgtggagctaaaattgctgtcatgcccttcatcgaccgcactcttgtccgtgctcgtgatccaccgactccatcttacccacatattgagtatcagcctgccccagccatgctgtcgtctgtgcctcaggctctcagtggcaagccaacaccgcctcccactgctgtggacatcttcaagctcacccgctcagagcttggccgtctgcgttcacagctccccacaggtgaaggtgcaccaaagttcagcacgtatgcagtcttagctgcacatgtttggcgctgcgtctccatcgcgcgtggcctctctcctgagcaacccaccaagctgtattgcgccaccgatgggcgacagcggctgcagcccccgctgccagaaggttactttgggaatgtcatattcaccgccaccccgcttgccgaggcaggcaaggttacgagcggggtggcagaaggagcagcggtcatccagggagcgctagacaggatgaccggcgactactgccaatcagccctggactacctggagatgcagccggacctgtcagcattggtccgtggagcgcacactttccggtgccccaacctcggcctcaccagctgggtgcgcctgccgatccacgacgccgatttcggctgggggcggccggtgttcatgggtcctggcggcatcgcgtacgaggggctggcgttcgtcctcccgagcgcgaccaaggacggtagcctgtccatcgccatctcgttgcaggcggagcacatggagaagttccggaagctgatcctcgatgtgtagatagactgcattttagagaaaagtttacagggcaacaggcttcaggttgcgccgaatgtttttctggggtatatatgcctaagttccaaatgaacacacacctgagtttatacggtggatagaacataatcttattcttaatgtggcatcaataatgaa

SEQ ID NO: 5048 - DNA, 1628 bp, Hordeum vulgare
cgctcacgggctgtttgcttgttccccggaatgcggcggcagatggcgatcacggtgaggcggtcgacgatggtgcgcccggcggtggagaggccgcgggagcggctctggaactccaacctcgacctcgtggtcccgcgcttccacacgcccagcgtctacttctaccgccgccccgaggcgggcgccgacggcttcttcgacgccgaccggatgcgcctcgcgctggccgacgcgctcgtgcccttctacccgatggccggccgcctcgcgcgcgacgaggacggcagggtcgagatcgactgcagcggggaaggggtgctcttcgtcgaggccgacgcgcccaccgccaccgtcgacgactacggcgacttcgcgcccaccatggacctcaagcgcctcatcccgcccgtcgactacaccgacgacatatcctccttcccgctcctcgtgcttcaggtgacctacttcaagtgtgggggcgtctcccttggtgtcggaatgcaacaccacgttgctgatggcatgtctggcttgcacttcatcaactcgtggtctgacctctgccgcggagttaaaatcgcagtcatgcccttcatcgaccgcactctcgtccgtgctcgtgatccacctactccatcttacccgcatgttgagtatcagcctgccccagccatgctgtcgtccgtgcctcaggctctcggtggcaagccagcgccgcctcccactgctgtggacatcttcaagctcacccgctcagagcttggccgcctgcgttcgcagctccccacaggtgaaggtgcgccacggttcagcacgtatgcagtgctagctgcacatgtctggcgctgtgtctcccttgcgcgcaacctggctccggaacagcccaccaagctgtattgcgccaccgatgggcgacaacggctgcagcccccgctgccagaaggttactttgggaatgtcatcttcaccgccaccccgctcgctgaggcaggcaaggttacgagcgggctggcggaaggagcagcggtcatccagggagcgctagacaggatgactagcgactactgccaatcagccctggactacctggagatgcagccggacctgtcagcattggtccgtggagcacacactttccggtgccccaacctcggcctcaccagctgggtgcgcctgccgatccacgacgccgattttggctgggggaggccggtgttcatgggtcctggcggcatcgcgtacgaggggctggcgttcgtcctcccgagcgcgagcaaggacggcagcctgtccatcgccatctcgttgcaggcggagcacatggagaagttccggaagctgatcctcgatgtgtagatagaccgccgtttagagaaaagttttacagggcaacaaagcttcaggttgcgccgaacgtttttctggggggtatatatatgcctggagtttcagattaacacatactggagtttatacggtggacagaacataatcttattcttgtgggatatcaataatgaatttatgtttttttgtgtatggagaagttaacagtggagtgtgggagggcctgttgtcgtggcaaccgaagcccacaaacgtgagactgcatcatgtctcggttc

SEQ ID NO: 5049 - DNA, 2951 bp, Sorghum bicolor
caaaggagagtcagccaggcaggccaatggccaaaccccacctccaccaccaccccaccgtcctcctcctcctcctcccttttcctcgtgtcccctcccctcccctcccctcccctcctcgagcccctcgctccaaatcccatctcgcaccaccaccaaccttcccgatccattccagtgccgcacgcctccgcactccccgtccccgacaccacccatgacacgcaagaggcgcaagcagcacgccgccgccgccacctagggttccgatcccctccgcatggactcgctgccgcggaagcgcaagggcggcgcgcgcgccgtctgctccctgtccggatcccgccacgacgcgcctgccgccgcccgcaaccgcaagcgcacctgccgcgagcccaagccgcggcccgagaagaagaagccctccgcctccgcctccgcctccgcccggggcggcggcgtggtgatgacggcgccgcccgcgagcgggtcgcgggcggcgcccgacagccccgggcgcgggctcaagcgcaagctgggctgcatcgactccgccacgcggatggggcggaagaagcggctcgagagcgagtacgagctcggcgccgagatcgggcagggcaagttcggctccgtccggatctgccgcgccagggccggcggcggcggcgacgagttcgcctgcaaggcgctgcccaagaacggcgaggagacggtgcaccgcgaggtcgagatcatgcagcacctctcgggccacccgggcgtcgtcacgctcagggccgtcttcgaggacgccgacaggttctacctcgtcatggagctctgcggcgggggcaggctgctcgacgagatcgccagggagggcaagttctctgagcagcgtgctgccattgtgatcaaggatctcatgtccgtgctcaagtactgccacgagatgggtgttgtgcacagggacattaagccggagaatatcttgcttaccaaggctgggaaggtgaagcttgctgatttcggactcgctgcacgggtcactaatggtcagaaattgtttggtgtagcaggaagcccagcatatgtggcacctgaagttctttctggaagctattctgagaaagttgatatttggggtgccggtgtgctacttcatgtactactacttggttctcttccatttcaagggggctctctggatgccgtttttgagtccataaagactgttgaacttgattttagcagcagcccatggaaatcaatatcagttcttgggcgggatcttattggccgaatgttgaatcgagatgtctcttctagaatgactgctgatgaagttcttggtcacccatgggtcgtgttttacacagaatgccccctgaaggtggtagcagctaatttgtgtctcactaacaagattatagcacccaaaattccatgggacagacacaagccagaatgtgactcattgtcagattcgagccgaaggtcagaagatcaggatgaatgtggcttagttgacgcgctgacagcagcaataacacgtgttagaatatcagagccgaagagaagtcggctctgtagccctgcaattaccattcagcaggaatgctcttcaaacttgaagaataatctttgcacggctttctgacctgacccaatgtatagcacctgtgatcagaatggtgtccatttttctggctgagatggttgttctgatttaggtgttgtagagccgaggataataactcaggttttccggcaaagcaacaagccgttggtgtgtagtgtttctttcagtgtcgatgaaccccacagttgtagcttctgtaaattctgtaaatagcatgatcatttcccaagctgtgcatgggttgttaatttattacatcagaaccgtttcacgcaatgttcataattcatgaacgtaacgtgtaagacctgtcttcatttgccatgcccatgatcgtcttccaaaatgatatttggcacacgcatcatgaaggtgccccgatgtgtatgtgctaagctttgtactgttgtaaattgcaagtctttcaggcttttctagtatgtagtccacatgtatctacaaggtgtccagtatgttggcgtttgaatgaggatgggggacattgctttctcaagtgcaagtttgtcaagaaatgttggaggataattaatttggaggaaattcgcttgtgcctagctgatctgaactcagccaaacaggttgcctctaaaattctttctttggatgacgataggaaatctctagtggttagtcttctatgggcatggtgggatgcgggaaataaggcgaatgcaggggacaagatgctttccactgaggagataatttataaagccaaagccttgagatctgatataaacttgtatgcacagaagatgcaggataaggaaatcaaattgatatcagcttggattccaccacctagtgacatcctgaagatcaattttgatggggctttttcacaggaagagaggaaaggtggatggggtttcattgtgagggatcatgatggtttagcaatattagccggtgcagggagaataaattttctgcatgatgcccttagcgcagagatccatggttgccttgcagctctttccgtagcgtttgatcaaaggatgtctcattttatcctagaatcggactcaacagttcttgtacgggcgcttcagtctaatgactatgacttctcggctgctggcgttctcattagagagacaaaatttcttatttctatgaattttgtacatgtagatgtggtccatgcgccacgatcttgtaacagttgtgcttatgaacttgctcgtgttggcttgagttgggacccggatcaatcctatgtctggacggatccccttccagagtttgtaatcttctgggtaacttgggattcaaatgaacccgtgagaaggcaataaaatgattg

SEQ ID NO: 5050 - DNA, 1845 bp, Zea mays
ccaccgtcctcctcctcatctcactcactcccttttcctcacgccccctccccgcctcgagcccctcgctggctcgctcccattcccatctcgcaccaccaaccttccggatccagtgccgcacgcctcactccccgtccccgacacccatgacacgcaagaggcgcaagcacgccgccgccaccgccgcctagggttccgatcccttcctcatggattcgctgccgcgtaagcgcaagggcgcgcgcgccgcgtgctccatggccggatcccgccacgatgcgcctgccgcccgcaagcgcacctgccgcgagcccaagccgcggcccgagaagaagaagccctcttccgccgatgagggctccgcctccgcccgcggcggcgtggtgatgacggcgccgcccgccagcgggcgggcggcgcctgatagccccgggcgtgggctgaagcgcaagctgggctgcatcgactccgccactcggatggggcggaagaagcggctcgagagcgagtacgagctcggcgccgagatcggccagggcaagttcggctccgtccggatctgccgcgctaaggtcggcggcgacgagttcgcctgcaaggagctgcccaagaacggcgaggagacggtgcaccgcgaggtggagatcatgcagcacctctcgggccacccgggcgtcgtcacgctcagggccgtcttcgaggatgccgacaagttttacctcgtcatggagctctgcagcggggggaggttgctcgatgagatcgccagggaggggaagttttccgagcagcgtgctgccattgtgatcaaggatctcatggcagtgctcaagtactgccacgagatgggtgttgtgcacagggacgttaagccggagaatattttgcttaccaaggctgggaaagtgaagcttgctgatttcggactcgctgcacgggtcactaatggtcagaaaatgtttggtgttgctgggagccctgcatatgtggcacctgaagttctttctggaagctattcggagaaggttgatatatggggtgccggtgtgctactacatgtactactacttggttcacttccatttcaagggggctctctggacgccgttttcgagtccataaagacacttgaacttgatttcagcagcaccccatgggaatcaatatcagttcttggacgggatcttattgggcgaatgctaaatcgagatgtctcttgcagaatgactgctgatgaagttcttagtcacccatgggtcgtattttacacagaatgccccctgaaggtggtagctgctaatttgtgtctccctaacaaggttatagcacccaaaattccatgggacagacacaaatcagaatgtgactcagtgtcagacgcaagccaaaggtcagaggatcaggatgagtgtggcatagttgacgcattggcggcagcaataacacgtgttagaatatcagagccaaagagaagtcggctctgtagccccgcaattaccattcagcaggaatgctcgtcaaacttgaagaataatctttgcacggctttctgacctgacctagtttatagcacctgatcggaatggcgtccattcttctcgctgagaaggtcgttctgatttaggtgttgtagaggcgaggataataactcagcttttccagccagcaacaaacgtctggtatttagtgtttctttcagtgttcctgatgaaccccgcagttgtagctgctgtaaaattctgtaaatagcatggtcctttctcaagctgcgcctgggttgctaatttgtgccaccaaaaccgtttcacgcaatgttcataattcatgatcgagttgtgcaag

SEQ ID NO: 5051 - DNA, 1872 bp, Brachypodium distachyon
gcccccaacgtccttccctccttcctcctcgagccccccccctcccacatcctatctcgcccaccaaacctccccttctcgatccatcacccccccgatcctccccattcccccatgacccgcaagaggcgcaagcacgccgccgccgcctaaggttgccagtccctcctccgatggagtcgcttccgcggaagcgcaagggcgcgcggtccctcgccggctccctccacgacgcctccgccgaccggaagcgcacctgccgggagaggaagccgcggcccgacaagaagaagaagaacaaaccctccgcaggcgacgatgccgcctctacccgaggcggcgtggtgatgacggcgccgccgaccagcgggatggccgcgccggacagccccggccggggcctcaagcgtaaggtcggctgcatcgagtccgccacgcggatagggcgcaagaagaggctcgacagcgagtacgcgctgggcgacgagatcggccagggcaagttcgggtccgtccggatctgccgcgccaaggccgggggcgaggagttcgcatgcaaggcgctccccaagaacggcgaggagacggtccaccgagaggtggagatcatgcagcacctctcgggccaccccggcgtcgtcacgctcaaggccgtcttcgaggacaccgacaagttctacctcgtcatggagctctgcagcggcggccggctgctcgacgagatagcgagagatggcaagttctctgagcagcgcgccgccattgtcatcaaggatcttatgtcagtgctcaagtactgccacgagatgggcgtcatccacagggacattaagccagagaatattttgctcaccaagacagggaagatgaaactagcagattttggattggcagcacgagttaccaatggtcagaaattatctggcattgctgggagcccagcttatgtggcgcctgaggttctgtcaggaagctattcagagaaagtagatatatggggtgctggggtgctactccatgtactactgcttggttcacttccatttcaaggggactctctggaagctgtttttgacgctataaggacagttgagcttgatttccacagtggtccatggaaatcaatgtcagttcttggacgagatctgattagtcgaatgttggatcgagatgtctcctctaggataactgctgctggagttcttagtcacccatgggtcttattctacacggagtgtaccctgaaggccgtaactgctaatttgtgtgtcactaacaagatcgtagcgccctgttttccgtgggacagaattagatcacattgtgattcatcagcttcagattcgtcgagccagaggtctgaggaccaagatgaatgtggtatagttgatgccctgacagcagcaataacacatgttagaatatcagagccgaaaaggactcggctttgtagccctgccatttccatacaacaggagtgctcttcgaacttgaagagtaacctgtgcacggcgttttgacacaacccaatgtatagctcctgattggttggcctgtgtcattgattactccaccagttggtgtctctgggctgaggataataagtgggtttcctgtcagagcaaataagagtttgacatggtatgatgtagattgcagtgatgctgttaaacccgacgtgatgactggttctgtaaattttgtaaatatagaatgatctctagctaatttatctctttggaactacttcattcgatgttagtaaacatattttgttcgatctgcattctttgtatcctagtctattgatatagtataatattttggcatgggaagatatcaaaggactccaaagtcctgaaagtgttcagt

SEQ ID NO: 5052 - DNA, 1869 bp, Hordeum vulgare
accaaccttcccgatccccaacccccatgatccgcaggaggcgcgggcacgccgccgcctagggtttccaccccccgcccctccgatggagtcgcttccgcggaagcgcaagggcgcgcgctccctcgccggctccctccacgacgactcggcggaccgcaagcggacctgccgggagcggaagccgcggcccgagaagaagaaaaagaagccctccgccggcggcgatgacgccgccaccgcctccggccgcggcggcgtggtcatgacggcgccgccggccagcggccgggccaccccggacagccccgggagggggctcaagcgcaaggtcggctgcatcgagtccgccacgcggataggccgcaagaagcgcctcgagaccgagtacgagctcggcgacgagatcggccagggcaagttcggctccgtccggatctgccgcgccaaggccggcggcgaggagttcgcctgcaaggccctccccaagaacggcgaggagacggtccaccgcgaggtcgagatcatgcagcacctctccggccaccccggcgtcgtcacgctcaaggccgtcttcgaggacgccgacaagttttacctcgtcatggagctctgcagcggcggccgcttgctggacgagatggccagggacggcatcttctccgagcagcgagccgcccttgtcatcaaggatctaatgtcggtcgtcaagtactgccacgaaatgggcgtcatccacagggacattaagccggagaatattttgctcaccaagactggcaagatgaaactagcagattttggattggcagcacgagttactaacggtcagaaattgtctggcgttgctgggagcccagcctatgtggcgcctgaggtgttgtcaggaaggtattctgagaaagtagacatatggggtgctggggtgctactccatgtgctgctgcttggttcacttccatttcaagggggctctctagaagctgtctttgaagctataaagacagttgagcttgatttcaacagcggtccatgggaatcaatgtcagttcttggccgtgatcttataagtcgaatgttggatcgagatgtctcttctaggataactgctgatcaagttctttgtcatccatgggtgttgttctacacggaatgtaccctgaaggctgtaactcctaatgtcactaacaagattgtagcacccagaattgcatgggacagaattaggtcacattgtgagtcatccgcttcagattcgtcgagccagaggtcggaggaccaggatgaatgtggcatagtcgacgcattgacagcggcaataacacatgttagaatatcagagccgaaaaggacccgcctttgcagccccggcattcccatacagcaggagtgctcctcaaacttgaagagcaacctgtgcacggcgttctgacatgacaccaatgtatagcttccttgtgttctggtctgatgtcagtggtggctcggcctgctggttggttgtctctgtgctgaggataataacgggtttcctgccagagcaagcgagcgtttgacatggtgatgctgtagattgcggtgatggctgatgaacccgacatggtagctgatgctgtaaattttgtaaatagaatgatccatgtagctaatttatatcttgagagtgttgagaataatttcagtctatgctagtaaacatagtgtgtgccatcatccatgtagctaatttctttgtttcttccggttctattgagatcagagttttgcatagacttcctgcattttacctttttctcattttctccctgaaagtgttttacagcagctgtactcttaaatatgatactcgtcagtctggaccggttgtgc

SEQ ID NO: 5053 - DNA, 1819 bp, Hordeum vulgare
tcgcttccgcggaagcgcaagggcgcgcgctccctcgccggctccctccacgacgactcggcggaccgcaagcggacctgccgggagcggaagccgcggcccgagaagaagaaaaagaagccctccgccggcggcgatgacgccgccaccgcctccggccgcggcggcgtggtcatgacggcgccgccggccagcggccgggccaccccggacagccccgggagggggctcaagcgcaaggtcggctgcatcgagtccgccacgcggataggccgcaagaagcgcctcgagaccgagtacgagctcggcgacgagatcggccagggcaagttcggctccgtccggatctgccgcgccaaggccggcggcgaggagttcgcctgcaaggccctccccaagaacggcgaggagacggtccaccgcgaggtcgagatcatgcagcacctctccggccaccccggcgtcgtcacgctcaaggccgtcttcgaggacgccgacaagttttacctcgtcatggagctctgcagcggcggccgcttgctggacgagatggccagggacggcatcttctccgagcagcgagccgcccttgtcatcaaggatctaatgtcggtcgtcaagtactgccacgaaatgggcgtcatccacagggacattaagccggagaatattttgctcaccaagactggcaagatgaaactagcagattttggattggcagcacgagttactaacggtcagaaattgtctggcgttgctgggagcccagcctatgtggcgcctgaggtgttgtcaggaaggtattctgagaaagtagacatatggggtgctggggtgctactccatgtgctgctgcttggttcacttccatttcaagggggctctctagaagctgtctttgaagctataaagacagttgagcttgatttcaacagcggtccatgggaatcaatgtcagttcttggccgtgatcttataagtcgaatgttggatcgagatgtctcttctaggataactgctgatcaagttctttgtcatccatgggtgttgttctacacggaatgtaccctgaaggctgtaactcctaatgtcactaacaagattgtagcacccagaattgcatgggacagaattaggtcacattgtgagtcatccgcttcagattcgtcgagccagaggtcggaggaccaggatgaatgtggcatagtcgacgcattgacagcggcaataacacatgttagaatatcagagccgaaaaggacccgcctttgcagccccggcattcccatacagcaggagtgctcctcaaacttgaagagcaacctgtgcacggcgttctgacatgacaccaatgtatagcttccttgtgttctggtctgatgtcagtggtggctcggcctgctggttggttgtctctgtgctgaggataataacgggtttcctgccagagcaagcgagcgtttgacatggtgatgctgtagattgcggtgatggctgatgaacccgacatggtagctgatgctgtaaattttgtaaatagaatgatccatgtagctaatttatatcttgagagtgttgagaataatttcagtctatgctagtaaacatagtgtgtgccatcatccatgtagctaatttctttgtttcttccggttctattgagatcagagttttgcatagacttcctgcattttacctttttctcattttctccctgaaagtgttttacagcagctgtactcttaaatatgatactcgtcagtctggaccggttgtgcgttcgatcaagggtcatcatgtggctagaagcgagcgtgaa

SEQ ID NO: 5054 - DNA, 2119 bp, Oryza sativa
gtgctctccaagaagagacgcgacgcgaacgcacgcgacacgagtccaacaaaggcagggccaccaccccaccaccaccgcccccgtcctcctcctcctcatctcctctccgctccccaacgctttggctttctttcctccctttcctccctcgagcccctcccctcccccgccccaatccaccgccaccaaccctcccctcccctcccgatccgcatccccatgacccgcaagcggcgcaagcacgccgcctgatcgcccggggtggggggggggggtgggagtccatggagtcgtcgctgccgcggaagcgcaagggcgcgcgctccgcgtgctccctcgtcggatccttccacgagcccaccaccgtcgcccgcaagcgcgcctgccgcgagcccaagcctcgcccggagaagaagaagaaggatccctcctccgatgacgcctccggccggggcggaggcgggggcgtggtccagacggcgccccccgcgagcggccgggccgcgccggagagccccagcagggggctgaagcggaagctggggtgcatcgagtccgccacccggatggggcggaagaagcggctcgagagcgagtacgagctcggcgccgagatcggccagggcaagttcggctccgtccggatctgccgcgccaaggttggcggcgaggagttcgcctgcaaggcgctccccaagaacggggaggagaccgtccaccgggaggtggagatcatgcagcacctctcgggccaccccggcatcgtcacgctcaaggccgtcttcgaggacgccgacaagttctacctcgtcatggagctctgcggcggcggccgcctgctcgacgagatggcgagggagggcaagttctccgagcagcgcgccgccattgtgatcaaagatctaatgtccgtggtcaagtactgccacgagatgggcgtcgttcacagggacattaagccggagaatatactgctcaccaaggcaggaaagataaagctcgcagattttggacttgccgcacgagttgccgacggtcaaaaattgtctggcattgctggtagcccagcttatgtggcgcctgaggttttgtctggatgctactctgagaaagtagacgtatggggagctggtgtgctactccatgtactgctgcatggttcccttccatttcaagggggttcactagatgctgtctttgaggctataaagacagttgaacttgatttccacagtggaccatgggaatcaatatcatctcttgcacgggatcttattagtcgaatgttgaaccgagatgtaccatccagaattactgctgacgaagttcttagtcacccatgggtcgtgttctacacagagtgccctttgaaggctgtaactgctaatttgagtattactaacaatatcgtagcacccagaattacatgggacagaattaggttacattgcgagtcaatatcttcagattcatcaagtcagagatcagcagatcaggatgaatgtggtatagttgatgcactgacagcagcaataacgaatgttaggatatcagagccaaaaaggagtcggctgtgtaacccagccattcccatacagcaggaatgctcttcaaacttgaagagcaacctctgtacggcattctgacccgacctgatgtacagctcctgattggaatggtgcatatttttctcgcagaggttggtctgatgccagttaaaaggctccatcaggtggtgtctctgagctgaggataataacctgggtttctgtcaaatcaaataagcgtttgacatgggtatgatgtagtttttatctggtgatgctgataaaccggccattagaaggccggttctgtaaattttgtaaatatcatgatccccttagctcctgggttggtaatctatgcgtacgtagcaaattgtttcaattaatgttgataaaatatcgtgtgccatttccctgtgcatgattcatcttgtttctttccagtctattgagactaattttgttggcagaggttttcaacctcatatcacaaaattcacttctctaaacttttaacgtacttcatcatggatctatatgcccttgttgtaatgaaggtataatttgct

SEQ ID NO: 5055 - DNA, 1874 bp, Secale cereale
ctgatccgcaggaggcgcgggcacgccgcctagggtttcaaccaatcgcccccccgatggagtcgctgccgcggaagcgcaagggcgcgcgctccctcgccggctccctccacgacgcctccgcggaccgcaagcgcacctgccgggagcggaagcccgccccgacaagagaaaaagaagccctccaccgccggcgatgacgccgccatcgcctcaggccggggcggcgtggtcatgacggcgccgccggccagcggccgggccaccccggacagccccgggcggggcctcaagcgcaaggtcggctgcatcgagtccgccacgcgcataggccgcaagaagcgcctcgaggccgagtacgagctcggcgacgagatcggccagggcaagttcggctccgtccggatctgccgcgccaaggccggcggcgaggagttcgcctgcaaggcgctccccaagaacggcgaggagacggtccaccgcgaggtcgagatcatgcagcacctctccggccaccccggcgtcgtcacgctcaaggccgtcttcgaggacgccgacaagttctacctcgtcatggagctctgcagcggcggccgcttgctggacgacatggccagggacggcaccttctccgagcagcgagccgcccttgtcatcaaggatctaatgtcggtcgtcaagtactgccacgaaatgggcgtcatccacagggacattaagcccgagaatattttgctcaccaagactggcaagatgaaactagcagattttggattggcagctcgagttactaacaggtcagaaattgtgtggcgttgctgggagcccagcctatgtggcgcctgaggtgttgtcaggaagctattctgagaaagtagacatatggggtgctggggtgctcctccatgtactactgcttggttcacttccatttcaagggggctctctggaagctgtctttgaagctataaagacagttgagcttgatttcaacagcggtccatgggaatcaatgtcagttcttggacgggatcttataagtcgaatgttggatcgagatgtctcttctagaataactgctgatcaagttctttgtcatccatgggtgttgttctacacggaatgtaccctgaaggctgtaactcctaatgacactaacaagattgtagcacccaaaatttcatgggacagaattagatcacattgtgagtcgtcagcttcagattcgtcgagccagaggtcggaggaccaggatgaatgtgggatagtcgacgcactgacagcggcaataacacatgttagaatatcggagccgaaaaggacccggctttgcagccctggccttcccatacagcaggagtgctcctcaaacttgaagagcaacctgtgcacggcgttctgacatgaccccaatgtatagctccttgtgtgttggtctgatgtcagtgatggctcggcctgctggttgtctctctgctgaggataataactcgggttttcctgtcagagcaagcaagcgtttgaaatggtgatgctgtagattgcggtgatggctgatgaacccgacatggtagctgatgctgtaaattttgtaaatagaatgatccatgtagctaatttatatcttgagagagttgagaataatttcagtctatgttggtaaacatagtgtgcgccatcatccttgctccattctttgtttctcccggttcctcctagtctattgaggtcagatttttgcatggatttcctgcattcgattttttttactagatctttttgccctgaatgtattttccagaagctgtactcttaatttgatgcttgtgactaagatattacaccagagaaaaaaacaatatggtaaatgctaa

SEQ ID NO: 5056 - DNA, 2055 bp, Echinochloa colona
ggccggaccctttcccctctccccctcatctcgccggccactgctcccgaccagcagctagcacttccccatccagcgaatcgaaccatggcggggcgggagcaggcgctgctctcgacggagatcgtgaaccgcggcgtggagccgtcggggccggacgccgggtcgccgaccttctcggtgcgcgtgcgccgccgcctgccggacttcctgcagtcggtgaacctcaagtacgtgcgcctcgggtaccactacctcatcagccacggcgtgtacctggccaccatcccggtcatcgtgctggtgtgcggcgccgagctgggcagcctcagccgcgacgagctctgggacaaggtctggggggaggccacctacgacctcgccaccgtcctcgccttcctcgccgtcctcgccttcaccatctccgtctacatcatgtcaaggcccaggcccgtctacctcatcgacttcgcatgctacaagcccgcagacgagctcaaggtgtcgaaggcggagttcatcgacctggctcgcaagtctggcaagttcgacgaggacagcctggcgttccagtctcgcctgctcgccaagtccggcatcggcgacgagtcctacatgccccgctgcgtgttcgagcccaacgtcaactgcgccaccatgaaggagggccgcgccgaggcctccacggccatgttcgccgccctggacgagctcttcgacaagtgccgcgtccgccccaaggacgtgggcgttctggtggtgaactgcagcctcttcaacccgaccccgtcgctgtccgccatgatcgtgaaccactacaagatgcgcgggaacatcctgagctacaacctgggcggcatgggctgcagcgccggcgtgatcgccgtcgacctcgcccgcgacatgctccaggcgagcggcgccgggctcgccgtggtggtgagcacggaggcggtgtccttcacgtggtaccccgggaagcggcggtcgatgctgatcccgaacgccttcttccgcgccgggtgcgccgccgtgctgctctcgaaccggcgccgcgacttccaccgcgccaagtaccagctggagcacgtggtgcgcacgcacaagggcgccgacgaccgcgccttccggtcggtgtaccaggaggaggacgagcagcggatcaagggcctgtccatcagccgcgacctgctggaggtgggcgggcacgcgctcaagaccaacatcaccacgctggggcccctggtgctgcccttctcggagcagctcatgttcttcgccggggtgctgttccgccacctgttcccgtccaaggcctccaccccgccgccggcgaccacgccgggggacgcgtcggccgccgcgccctacatcccggacttcaagcgcgcgttcgagcacttctgcatgcacgcggcgagccgcgacgtgctggagcacctgcagagcaacctggggctccgcgacgccgacctggaggcgtcccgcgccgcgctgcaccgcttcggcaacacctccagcagcagcatctggtacgagctggcgtacctggaggccaaggggcgcgtccgcaggggagaccgcgtgtggcagctcgccttcgggtcagggttcaagtgcaacagcgccgtgtggcgcgccgtccgccgcgtgcgccgtccgtcgcgcagcccgtggctggactgcgtcgatcagtacccggagcgcatcaacgcctagggtaagttgcattgctttgcattggtgatcggccggatcgattgcattgcatgcacactgctgctgcctgtgctaccgacgacgatcgatggatgggatgttgttataggacgcgattgcgtgcatgaaactgcatgcgtgcactaagtgttgtgttgttgcttaattaaggtaacgtttgagatttggtttgtgttgcttgtttagcggtcagggagaaagagactagtataatgcaagtgcttgtgtgcgcaccgtggaagttgggctgtgtgtgaacttattaattatgtacgtgcaattttaatctatttataagacttggaagttaaaggt

SEQ ID NO: 5057 - DNA, 2095 bp, Zea mays
actcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagcctggcgttccagtcgcgtctgctggccaagtccggcatcggcgacgagtcgtacatgccgcgctgcgtgttcgagcccaacgccagctgcgccaccatgaaggagggccgcgccgaggcgtccacggccatgttcgcggcgctggacgagctgttcgacaagtgccgcgtccggcccaaggacgtgggcgtgctggtggtcaactgcagcctcttcaacccgacgccctccctgtccgccatgatcgtcaaccactacaagatgcgcggcaacatcctgagctacaacctggggggcatgggctgcagcgcgggcgtcatcgccatcgacctggcccgcgacatgctccaggccagcggcgctggcctggccgtggtggtcagcacggaggccgtctccttcacgtggtaccccgggaagcggcgctccatgctcatcccgaacgccttcttccgggccggctgcgcggcggtgctgctgtccaaccggcgccgcgacttccaccgcgccaagtaccagctggagcacgtggtgcgcacgcacaagggcgcggacgaccgcgccttccgctccgtgtaccaggaggaggacgagcagcggatcaagggcctgtccatcagccgcgacctgctggaggtgggcggccacgcgctcaagaccaacatcaccacgctggggcccctggtgctgcccttctccgagcagctgctcttcttcgcgggcgtgctgttccgccacctgttcccgtccaaggcctccacgccggcgccgccgaccaccccaggggacgcctcggccgccgcgccctacatcccggacttcaagcgcgcgttcgagcacttctgcatgcacgcggccagccgcgacgtgctggagcacctgcagagcaacctgggcctgcgcgacgccgacctggaggcctcccgcgccgcgctgcaccgcttcggcaacacctcaagcagcagcatctggtacgagctggcgtacctggaggccaagggccgcgtccgccgcggcgaccgcgtctggcagctcgccttcgggtcgggcttcaagtgcaacagcgcggtgtggcgcgccgtccgccgcgtgcgccgccccgcgcgcagcccctggctggactgcatcgaccagtacccggcgcgcatggacgcctagcacgtacctgcaatgcaatggctgctatctatctatcgctcgcttcgctatctaccagtgcagtgctgcacttcaccgatgcatgatggatcggatatgatatggtataggacgcagtcggtcgatttgcatgcatgcaccaagtgttactataccgttctgaaggtacgtttgaactttgttcgtttgtattgcactattgcttgttgtttaagtagcggttaagggagggagtcgtacgctgtgctaccataatggaagtactccggtccggtccggtcctgtgtgagccttatgtacgtgcaattttaatgtcttttgatattacaagactcgacggttggcaata

SEQ ID NO: 5058 - DNA, 2154 bp, Saccharum officinarum
ggtacgggtcacccacgcgtccgaatggcattaactgccgcctacccacccgccttctcctcccctaccccgctgccgctgctgcgactccttttctcctgctagtactactatatatcaatactagctggaccctttgcactcccctcgcctcactaccaccactgctccgatccatccaccgcgcgcgactgcgagggagggaaatcggccaccatggcgcgggaggagcaggcgctgctgtcgacggagatcgtgaaccgcggcgtggagccgtcgggcccggacgccgggtcgccgaccttctcggtgcgcgtgcgccgccgcctgccggacttcctgcagtcggtgaacctcaagtacgtgcgcctgggctaccactacctcatcagccacggcgtgtacctggccaccatccccgtcatcgtgctcgtctgcggcgccgaggtgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtctacctcatcgacttcgcatgctacaagccggccgacgagctcaaggtgtccaaggcggagttcatcgacctagcgcgcaagtccggcaagttcgacgaggacagcctggcgttccagtcgcgtctgttggccaagtccggcatcggcgacgagtcgtacatgccgcgctgcgtcttcgagcccaacgccaactgcgccaccatgaaggagggccgcgccgaggcgtccacggccatgttcgcggcgctggacgagctcttcgacaggtgccgcgtccgggccaaggacgtgggcgtgctggtggtcaactgcagcctcttcaacccgaccccgtcgctgtctgccatgatcgtgaaccactacaagatgcgcggcaacatcctgagctacaacctgggcggcatgggctgcagcgcaggcgtcatcgccatcgacctggcccgcgacatgctgcaggccagcggcgctggcctggccgtggtggtcagcacggaggccgtctccttcacgtggtaccccgggaagcggcgctccatgctcatcccgaacgccttcttccgggccgggtgcgccgcggtgctgctgtccaaccggcgccgcgacttccaccgcgccaagtaccagctggagcacgtggtgcgcacgcacaagggcgccgacgaccgcgccttccgctccgtgtaccaggaggaggacgagcagcggatcaagggcctgtccatcagccgcgacctgctggaggtgggcgggcacgcgctcaagaccaacatcaccaccctggggcccctggtgctgcccttctcggagcagctgctcttcttcgcgggggtgctgttccgccacctgttcccgtccaaggcctccaccccgccgccgccgaccacacccggggacgcctccgccgccgcgccctacatcccggacttcaagcgcgcgttcgagcacttctgcatgcacgcggcgagccgcgacgtgctggaccacctgcagagcaacctgggcctgcgcaacgccgacctggaggcctcccgcgccgcgctgcaccgcttcggcaacacctccagcagcagcatctggtacgagctggcgtacctggaggccaagggccgcgtccgccgcggcgaccgcgtctggcagctcgccttcgggtcaggcttcaagtgcaacagcgcggtgtggcgcgccgtccgccgcgtgcgccgccccgcgcgcagcccctggctcgactgcatcgaccagtacccgtcgcgcatggacgcctagtacctacgtagctgcaatggctgcttaattcagatctgtctattgctcgcttcgcttccggtgctacatgcaccgatggatgctggccgcttataatggtataggatgcgttcgatttgcatgcatgcatgtaactgatgatgcatgcatgcaccaagtgttgcgttgttaaggtacgtttgaactttggtttgtgttgcttgtttagcggttaaagacgtacgtacgctgctagcataatggaagtatccggtccggtcctgtgtgaacttatgtacgtgcaattttaatgtgttttaatattat

SEQ ID NO: 5059 - DNA, 2114 bp, Sorghum bicolor
tctcctcccctacccaacccatctcctcttcctcctcctccccagcgcccagctagtactactatatcaatactagctggaccctttccactcccctcacctctcactgccactgccgcgatccatcccggcagcgacctagggagcgagggagagtctcggccggccggggcaagctagctcggccgccaccatggcgcgggaggagcaggcgctgctgtcgacggagatcatgaaccgcggcgtggagccgtcgggcccggacgccgggtcgccgaccttctcggtgcgcgtgcgccgccgcctgccggacttcctgcagtcggtgaacctcaagtacgtgcgcctagggtaccactacctcatcagccacggcgtgtacctggccaccatccccgtcatcgtgctcgtctgcggcgccgaggtgggcagcctcagccgcgacgagctgtggcgcaaggtctggggggaggccacctacgacctcgccaccgtcctcgccttcctcgccgtcctcgccttcaccatctccgtctacatcatgtccaggcctaggcccgtctacctcatcgacttcgcatgctacaagccggccgacgagctcaaggtgtccaaggcggagttcatcgacctagcacgcaagtccggcaagttcgacgaggacagcctggcgttccagtcgcgtctgctggccaagtccggcatcggcgacgagtcgtacatgccgcgctgcgtgttcgagcccaacgccaactgcgcgaccatgaaggagggccgcgccgaggcgtcgacggccatgttcgcggcgctggacgagctcttcgacaagtgccgcgtccgtcccaaggacgtgggcgtgctggtggtcaactgcagcctcttcaacccgacgccgtcgctgtcggccatgatcgtgaaccactacaagatgcgcgggaacatcctgagctacaacctgggcggcatgggctgcagcgcgggcgtcatcgccatcgacctggcccgcgacatgctgcaggccagcggcgccggccttgccgtggtggtcagcacggaggccgtctccttcacgtggtaccccgggaagcgtcgctccatgctcatccccaacgccttcttccgcgccgggtgcgcggcggtgctgctgtccaaccggcgccgcgacttccaccgcgccaagtaccagctggagcacgtggtgcgcacgcacaagggcgccgacgaccgcgccttccgctccgtgtaccaggaggaggacgagcagcggatcaagggcctgtccatcagccgcgacctgctggaggtgggcgggcacgcgctcaagaccaacatcaccacgctggggcccctggtgctgccattctcggagcagctgctcttcttcgcgggcgtgctgttccgccacctgttcccgtccaaggcctccacgccgggggacgcctccgccgccgcgccatacatcccggacttcaagcgcgcgttcgagcacttctgcatgcacgcggccagccgcgacgtgctggagcacctgcagagcaacctgggcctgcgcaactccgacctggaggcctcccgcgccgcgctgcaccgattcggcaacacctccagcagcagcatctggtacgagctggcgtacctggaggccaagggccgggtccgccggggcgaccgcgtctggcagctcgccttcgggtcaggattcaagtgcaacagcgcggtgtggcgcgccgtgcgccgcgtgcgccgccccgcgcgcagcccctggctcgactgcgtcgaccagtacccggcgcgcatggacgcctagtaagtagctgcaatggctgcttataatgtatgatggtataggatgcgatcgatcgatttgcatgcatctaactgatgatgcatgcatgcaccaagtgttattacgttgttaaggtacgtttgaactttggtttgtgtattgttgtttagtggttaagaaggggtcaagggagagagggcatacgctgctagcataatggaagtactccggtccggtcctgtgtgaacttaattatgtacgtgcaattttaatgtgttttaatattataagatttgacgcttggcaatagatgttcgctgttgtcgat

SEQ ID NO: 5060 - DNA, 1992 bp, Oryza sativa
acttcactgccttctcatttactgcagaaggtgaaggtgaaggaggaggcggccatggcgagggagcaggcgctgctgtcgacggagatcgtgaaccgcggcgtggagccgtcggggccggacgccgggtcgccgacgttctcggtgcgggtgcggcggcggctgccggacttcctccagtcggtgaacctcaagtacgtgcggctcgggtaccactacctcatcagccacggcgtgtacctggccaccatcccggtcatcgtgctcgtctgcggcgccgaggtcggcagcctcagccgagacgagctgtggcgcaaggtctggggcgaggccacctacgacctcgccaccgtcctcgccttcctcgccgtcctcgccttcaccatctccgtctacatcatgtccaggcctaggcccgtctacctcatcgacttcgcctgctacaaaccagccgacgaactcaaggtgtcgaaggcggagttcatcgatctggcgaggaagtcgggcaagttcgacgaggatagcctggcgttccagtcgcggctgctggccaagtctggcatcggcgacgagtcctacatgccgcgctgcgtgttcgagccgggcaccaactgcgccaccatgaaggaaggccgcgccgaggcgtccgccgccatgttcgccgcgctggacgagctgttcgacaagtgccgcgtccgccccaaggacgtcggcgtgctcgtcgtcaactgcagcctcttcaacccgacgccgtcgctgtccgccatgatcgtcaaccactacaagatgcgcgggaacatcctcagctacaacctcggcggcatggggtgcagcgccggcgtcatcgcggtggacctcgcccgcgacatgctccaggccagcggcgcggggctcgccgtcgtcgtcagcacggaggccgtctccttcacctggtacgccgggaagcgccgctccatgctcatccccaacgccttcttccgcgccggctgcgccgccgtgctgctctccaaccgccgcagggacttccaccgcgccaagtaccagctcgagcacatcgtgcgcacccacaagggcgccgacgaccgcagcttccggtcggtgtaccaggaggaggacgagcagcggatcaagggcctgtccatcagccgcgacctcgtggaggtcggcggccacgcgctcaagaccaacatcaccaccctgggcccgctcgtgctcccgttctcggagcagatcctcttcttcgccggcgtgctcttccgccacctgttcccgtccaagacctccgccccgccgccgccgtccgccgacggcgacgcctccgccgccgctccctacatcccggacttcaagcgcgcgttcgagcacttctgcatgcacgcggcgagccgcgacgtgctggagcacctgcagggcaacctgggcctccgcgacggcgacctggaggcgtcgcgcgccgcgctccaccgcttcggcaacacgtcgagcagcagcatctggtacgagctggcgtacctggaggccaagggccgcgtccgccgcggcgaccgcgtgtggcagctcgccttcggctccgggttcaagtgcaacagcgccgtgtggcgcgccgtccgccgcgtgcgccgcccggcgcgcagcccgtggctggactgcgtcgagcagtacccggctcgcatgaacgcttaagctgcagtggtaagtatgcagaggctaatgaacggaaaattactgcaacgtcaaaagacgggatcggcatgcgatgccggttaaggttcaagcttgattaatttgtgttggtgtattagcaagtcggtttatgagccatagactaccataaaagttgtgcgagacatgtgtactgaaccagtgtacgcgagttcggtgatatgtgaacttatctacgtttgattctattatttatactgtcatatgctacttgaattaacctggtggctgtttattaagtgttgctgcaatggactgatagttgttcaa

SEQ ID NO: 5061 - DNA, 2369 bp, Oryza sativa
atgaattgtgttagcaggaagtaacatcacatggcggaccgtgtattcaatcagtcaagtgctactatcggcgcagctggtggttactggagtagttattactgctacaaagtcagtgatcagttaagccaaagctgtggccatgaatttgctatgctagcagtatgattccagtacttgcagttacaacatggtgcacaggctcacagcaaacagatgcatgtatatgcaagaacaccatgcattgaggcagacctttcctggcttgctctctaaatggcattaactgccatctacccacccacccacccaccaccatctcctcccccaacccctgcactgctctccctatatctaaagtctccgagatcatctcatcacttcactgccttctcatttactgcagaaggtgaaggtgaaggaggaggcggccatggcgagggagcaggcgctgctgttgacggagatcgtgaaccgcggcgtggagccgtcggggccggacgccgggtcgccgacgttctcggtgcgggtgcggcggcggctgccggacttcctccagtcggtgaacctcaagtacgtgcggctcgggtaccactacctcatcagccacggcgtgtacctggccaccatcccggtcatcgtgctcgtctgcggcgccgaggtcggcagcctcagccgagacgagctgtggcgcaaggtctggggcgaggccacctacgacctcgccaccgtcctcgccttcctcgccgtcctcgccttcaccatctccgtctacatcatgtccaggcctaggcccgtctacctcatcgacttcgcctgctacaaaccagccgacgaactcaaggtgtcgaaggcggagttcatcgatctggcgaggaagtcgggcaagttcgacgaggatagcctggcgttccagtcgcggctgctggccaagtctggcatcggcgacgagtcctacatgccgcgctgcgtgttcgagccgggcaccaactgcgccaccatgaaggaaggccgcgccgaggcgtccgccgccatgttcgccgcgctggacgagctgttcgacaagtgccgcgtccgccccaaggacgtcggcgtgctcgtcgtcaactgcagcctcttcaacccgacgccgtcgctgtccgccatgatcgtcaaccactacaagatgcgcgggaacatcctcagctacaacctcggcggcatggggtgcagcgccggcgtcatcgcggtggacctcgcccgcgacatgctccaggccagcggcgcggggctcgccgtcgtcgtcagcacggaggccgtctccttcacctggtacgccgggaagcgccgctccatgctcatccccaacgccttcttccgcgccggctgcgccgccgtgctgctctccaaccgccgcagggacttccaccgcgccaagtaccagctcgagcacatcgtgcgcacccacaagggcgccgacgaccgcagcttccggtcggtgtaccaggaggaggacgagcagcggatcaagggcctgtccatcagccgcgacctcgtggaggtcggcggccacgcgctcaagaccaacatcaccaccctgggcccgctcgtgcttccgttctcggagcagatcctcttcttcgccggcgtgctcttccgccacctgttcccgtccaagacctccgccccgccgccgccgtccgccgacggcgacgcctccgccgccgctccctacatcccggacttcaagcgcgcgttcgagcacttctgcatgcacgcggcgagccgcgacgtgctggagcacctgcagggcaacctgggcctccgcgacggcgacctggaggcgtcgcgcgccgcgctccaccgcttcggcaacacgtcgagcagcagcatctggtacgagctggcgtacctggaggccaagggccgcgtccgccgcggcgaccgcgtgtggcagctcgccttcggctccgggttcaagtgcaacagcgccgtgtggcgcgccgtccgccgcgtgcgccgcccggcgcgcagcccgtggctggactgcgtcgagcagtacccggctcgcatgaacgcttaagctgcagtggtaagtatgcagaggctaatgaacggaaaattactgcaacgtcaaaagacgggatcggcatgcgatgccggttaaggttcaagcttgattaatttgtgttggtgtattagcaagtcggtttatgagccatagactaccataaaagttgtgcgagacatgtgtactgaaccagtgtacgcgagttcggtgatatgtgaacttatctacgtttgattctattatttatactgtcatatgctacttgaattaacctggtggctgtttattaagtgttgctgcaatggactgatagttgttc

SEQ ID NO: 5062 - DNA, 1953 bp, Leymus cinereus x Leymus triticoides
gttggctcgccaccaccaatcccgcccgcccccacttgcgcccagccatggcgcgggaggagctgtcgacggagatcgtgaaccgcggcgtggagccgtcgggcccggacgccgggtcgccgaccttctcggtgcgcgtgcgccgccggctgccggacttcctgcagtcggtgaacctcaagtacgtgcggctcgggtaccactacctcctcagccacggcgtgtacctggccaccatcccggtcatcgtgctcgtgtgcggcgccgaggtgggcagcctcagccgcgacgagctgtggcgcaaggtgtgggacgaggccacctacgacctcgccaccgtgctcgccttcctcgccgtcctcgccttcaccatctccgtctacatcatgtcccgccccaggcccatctacctcatcgacttcgccacttacaagcccgccgacgaactcaaggtctccaaggcggagttcatcgatctggcgcgcaagtcgggcaagttcgacgaggagagcctggcgttccaggcgcggctgctggccaagtccggcatcggggacgagtcctacatgccgcgctgcgtcttccagcccgacgccaactgcgccaccatgaaggaaggccgcgctgaggcctccgccgccatgttcgccgcgctcgacgagctcttcgacaagtgccgcgtccgccccaaggacgtcggcgtcctcgtcgtcaactgcagcctcttcaaccccacgccctcgctctccgccatgatcgtcaaccactacaagatgcggggcaacatcctcagctacaacctcggcggcatgggctgcagcgccggcgtcatctccatcgacctcgcccgcgacatgctccaggccagcggcgccgggctcgccgtcgtcgtgagcaccgaggcggtgtcattcacctggtacgccgggaagcgccggtccatgctcatcccgaacgccttcttccgcgcgggcgcagccgccgtgctgctgtccaaccgccgcagggacttccgccgcgccaagtaccagctggagcacgtggtgcgcacgcacaagggcgccgacgaccgcgccttccggtccgtgtaccaggaggaggacgagcagcggatcaagggcctgtccatcagccgcgacctggtggaggtcggcggccacgcgctcaagaccaacatcaccaccctgggcccgctggtgctccccttctcggagcagctcctcttcttcgccggcgtgctgttccgccacctctacccgtccaagacgtccaccccgccgccaccggccgccaacggggacacctcggccgccgcgccctacatcccggacttcaagcgcgcgttcgagcacttctgcatgcacgcggcgagccgcgacgtgctggagcacctgcagcgcaacctggggctccgcgacgccgacctggaggcctcccgcgccgcgctgcaccgcttcggcaacacctccagcagcagcatctggtacgagctggcctacctggaggccaagggccgcgtccgccgcggtgaccgcgtgtggcagctcgccttcggctccggcttcaagtgcaacagcgccgtgtggcgcgccgtccgccgcgtgcgccgcccgtccaggagcccatggctggactgcgtcgaccagtacccggcgcgcatggacgcctgaccgatcgagctaagcgaagcaggcgcacgtgctaataattaagcgaggcaaaggaacacgtacgtcgtcgcacccgcgtgggtaagtgcaggctaatggaaatgatactatcgatttgcatgtaactgcatgcagtgccgctggttaaggtttgagctttggttaagttgtgctgatgttgttaaggggtttaatcatagactacgtaccataatgcgcaagtgtatgtgcgcgctcttgtgaaacttatgtgaactttgattatctacgtgcaatttcatta

SEQ ID NO: 5063 - DNA, 2060 bp, Triticum aestivum
gccatggcgcgggaggagctgtcgacggagatcgtgaaccgcggcgtggagccgtcgggcccggacgccgggtcgccgaccttctcggtgcgcgtgcgccgccggctgcccgacttcttgcagtcggtgaacctcaagtacgtgcggctcgggtaccactacctgctgagccacggcgtgtacctggccaccatcccggtgatcgtgctggtgtgcggcgccgaggtgggcagcctcagccgcgacgagctgtggcgcaaggtgtgggacgaggccacctacgacctcgccaccgtgctcgccttcctcgccgtcctcgccttcaccatctccgtctacatcatgtcccgccccaggcccatctacctcatcgacttcgccacctacaagcccgccgacgaactcaaggtgtccaaggcggagttcatcgacctggcgcgcaagtcgggcaagttcgacgaggagagcctggcgttccaggcgcggctgctggccaagtccggcatcggggacgagtcctacatgccgcgctgcgtcttccagcccgacgccaactgcgccaccatgaaggagggccgcgccgaggcctccgccgccatgttcgccgcgctcgacgagctcttcgacaagtgccgcgtccgccccaaggacgtcggcgtcctcgtcgtcaactgcagcctcttcaaccccaccccctccctctccgccatgatcgtcaaccactacaagatgcgcggcaacatcctcagctacaacctggggggcatgggctgcagcgcgggggtcatctccatcgacctcgcccgcgacatgctccaggccagcggcgccgggctcgccgtcgtggtgagcaccgaggccgtgtcgttcacctggtacgccgggaagcgccgctccatgctcatccccaacgccttcttccgcgcgggcgcggccgccgtgctgctgtccaaccgccgcagggacttccgccgcgccaagtaccagctggagcacgtggtgcgcacgcacaagggcgccgacgaccgcgccttccgctccgtgtaccaggaggaggacgagcagcggatcaagggcctgtccatcagccgcgacctggtggaggtcggcggccacgcgctcaagaccaacatcaccaccctcggcccgctggtgctccccttctcggagcagctcctcttcttcgccggcgtgctgttccgccacctctacccgtccaagacgtccaccccgccgccgccggccgccaacggggacacctcggccgccgcgccctacatcccggacttcaagcgcgcgttcgagcacttctgcatgcacgcggccagccgcgacgtgctggagcacctgcagcgcaacctgggcctccgcgacgccgacctggaggcctcccgcgccgcgctgcaccgcttcggcaacacctccagcagcagcatctggtacgagctggcctacctggaggccaagggccgcgtccgccgcggtgaccgcgtgtggcagctcgccttcggctccgggttcaagtgcaacagcgccgtgtggcgcgccgtccgccgcgtgcgccgcccgtccaggagcccgtggctggactgcgtcgaccagtacccggcgcgcatggacgcctgacccgatcgagcgagcgaagcaggcgcacgtgctaataattaagcgaggtaaaggaacacgtcctgcgtcgtcgcacccgcgtgggtaagtgcaggctaatggaaatgatgctatcgatttgcatgtaactgcatgcagtgccgctggtttaaggtttgagctttggttaatttgtgctggtgttgtagcggttatctattattaaggggtttaatcatagactacgtaccataatgcgcaagtgtatgtgcgcgctcttgtgaaacttatgtgaacttgattatctacgtgcaatttcattactttggactttggactactgttatctatgtgcaacttcataactttggacttttttatataagttgggtgtttcttatatggatgaaatactcctatgtaaatcatcttcttcctccgtcccataatgtaag

SEQ ID NO: 5064 - DNA, 2177 bp, Hordeum vulgare
gtgctccccctaatggcattaactgccacccaacaacccgctcacccaccacctcctccccaaccccagcacccagcagcaaccccctcctctatatctaaacactgagcactccactccctctcaccctcatcaccaccgcccaccagtctcgcccgccaggccgccacccagctgcgcccagccatggcgcgggaggagctgtcgacggagatcgtgaaccgcggcgtggagccgtcggtcccggacgccgggtcgccgaccttctcggtgcgcgtgcgccgccggctgccggacttcctgcagtcggtgaacctcaagtacgtgcggctcgggtaccactacctgctgagccacggcgtgtacctggccaccatcccggtgatcgtgctggtgtgcggcgccgaggtgggcagcctcagccgcgacgagctgtggcgcaaggtgtgggacgaggctacctacgacctcgccaccgtgctcgccttcctcgccgtcctcgccttcaccatctccgtctacatcatgtcccgccccaggcccatctacctcatcgacttcgccacttacaagcccgccgacgaactcaaggtctccaaggcggagttcatcgatctggcgcgcaagtcgggcaagttcgacgaggagagccttgcgttccaggcgcggctgctggccaagtccggcatcggggacgagtcctacatgccgcgctgcgtcttccagcccgacgccaactgcgccaccatgaaggaaggccgcgccgaggcctccgccgccatgttcgccgcgctcgacgagctcttcgacaagtgccgcgtccgccccaaggacgtcggcgtcctcgtcgtcaactgcagcctcttcaaccccacgccctcgctctccgccatgatcgtcaaccactacaagatgcgcggcaacatcctcagctacaacctcggcggcatgggctgcagcgccggggtcatctccatcgacctcgcccgcgacatgctccaggccagcggcgccgggctcgccgtcgtcgtcagcaccgaggcggtgtccttcacctggtacgccgggaagcgccgctccatgctcatccccaacgccttcttccgcgcgggcgcggccgccgtgctgctgtccaaccgccgcagggacttccgccgcgccaagtaccagctggagcacgtggtgcgcacgcacaagggcgccgacgaccgcgccttccggtccgtgtaccaggaggaggacgagcagcggatcaagggcctgtccatcagccgcgacctggtggaggtgggcggccacgcgctcaagaccaacatcaccaccctgggcccgctggtgctccccttctcggagcaactgctcttcttcgccggcgtgctgttccgccacctgtacccgtccaagacgtccaccccgccgccgccggccgccaacggggacacctcggccgccgcgccctacatcccggacttcaagcgcgcgttcgagcacttctgcatgcacgcggccagccgcgacgtgctggagcacctgcagcgcaacctggggctccgcgacgccgacctggaggcctcccgcgccgcgctgcaccgcttcggcaacacctccagcagcagcatctggtacgagctggcatacctggaggccaagggtcgcgtccgccgcggtgaccgcgtgtggcagctcgccttcggctccgggttcaagtgcaacagcgccgtgtggcgcgccgtcggacgcgtgcgccgcccgtccaggagcccctggctggactgcatcgaccagtacccggcgcgcatggacgcctgaggcctgaccgatcgagacaagcaggcgcatgcaccatgcaggtgctaataattaagcgagacacgtcgccgcatccgcgtgggtaagtgcaggctaatggatttgcatgtaactgcatgcagtgccgctggttaaggtttgagctttggttaatttgtgctggtgttgtagcagttgtcatcattattaagggttttaatcatagactacgtacgtacgtaccataatgcgcaagtgtatgtgcgcgctcttgtgtgaaacttatgtcaactttgattatctacgtgcaatttcattactttggactttgggctacggtttaagactttataattatataagttggatgtgccttatggatggtatac

SEQ ID NO: 5065 - DNA, 2165 bp, Secale cereale
cctagctatatctaaacgccgagcactccactccgtttccctcaccctcatcaccaccactgcccatcggttggctcgccgccaccagccccgcccgcccgcccgaccccagctgcccgccaggccatggcgcgggaggagctgtcgacggagatcgtgaaccgcggcgtggagccgtcgggcccggacgccgggtcgccgaccttctcggtgcgcgtgcgccgccggctgccggacttcctgcagtcggtgaacctcaagtacgtgcgcctcggctaccactacctgctgagccacggcgtgtacctggccaccatcccgctcatcgtgctcgtgtgcggcgccgaggtgggcagcctcagccgcgacgagctgtggcgcaaggtgtgggacgaggccacctacgacctcgccaccgtgctcgccttcctcgccgtcctcgccttcaccatctccgtctacatcatgtcccgccccaggcccatctacctcatcgacttcgccacgtacaagcccgccgacgaactcaaggtgtccaaggcggagttcatcgatctggcgcgcaagtcgggcaagttcgacgaggagagcctggcgttccaggcgcggctgctggccaagtccggcatcggggacgagtcctacatgccgcgctgcgtcttccagcccgacgccaactgcgccaccatgaaggagggccgcgccgaggcctccgccgccatgttcgccgcgctggacgagctcttcgaaaagtgccacgtccgccccaaggacgtcggcgtcctcgtcgtcaactgcagcctcttcaaccccaccccctcgctctccgccatgatcgtcaaccactacaagatgcgcggcaacatcctcagctacaacctcggcggcatgggctgcagcgccggggtcatctccatcgacctcgcccgggacatgctccaggccagcggcgccgggctcgcagtcgtggtgagcaccgaggcggtctccttcacctggtacgccgggaagcgccgctccatgctcatccccaacgccttcttccgcgcgggcgcggccgccgtgctgctgtccaaccgccgcagggacttccgccgcgccaagtaccagctggagcacgtggtgcgcacgcacaagggcgccgacgaccgcgccttccgctccgtgtaccaggaggaggacgagcagcggatcaagggcctgtccatcagccgcgacctggtggaggtcggcggccacgcgctcaagaccaacatcaccaccctcggcccgctggtgctccccttctcggagcagctcctcttcttcgccggcgtgctgttccgccacctctacccgtccaagacgtccaccccgccgccgccggccgccaacggggacacctcggccgccgcgccctacatcccggacttcaagcgcgccttcgagcacttctgcatgcacgcggccagccgcgacgtgctggagcacctgcagcgcaacctggggctccgcgacgccgacctggaggcctcccgcgccgcgctgcaccgcttcggcaacacctccagcagcagcatctggtacgagctggcctacctggaggccaagggccgcgtccgccgcggtgaccgcgtgtggcagctcgccttcggctccgggttcaagtgcaacagcgccgtgtggcgcgccgtccgccgcgtgcgccgcccgtccaggagcccatggctggactgcgtcgaccagtacccggcgcgcatggacgcctgaccgatcgagcgaagccaggcgcacgtgccaataattaagcgaggtaaaggaacacgtcgtcgtcgcacccgcgtgggtaagtgcaggctaatggaagtgatgctatcgatttgcatgtaactgcatgccgtgccgctggtttaaggtttgagctttggttaatttgtgctggtgttgtagcggttattattgaggggtttaatcatagactacgtaccataatgcgcaagtgtatgtgcgcgctcttgtgaaacttatgtgaacttgattatctacgtgcaatttcagtactttggactactgtttaagactttataattatgtaagttgggtgtctcttatggatgggatacttgtatgtaaatacaaacctaaaaaaaaaaaactaagaagactgcacgacgacacaggagggg

SEQ ID NO: 5066 - DNA, 1853 bp, Avena sativa
aggccatgctgtcgacggagatcgtgaaccgcggcgtggagccgtcggggccggacgccggctcgcccaccttctcggtgcgcgtgcgccgccgcctgccggacttcctgcagtcggtcaacctcaagtacgtcaagctgggctaccactacctcctcagccacggcgtgtacctggccaccatcccggtcatcgtgctcgtctgcggcgccgaggtcggcagcctcagccgcgacgagctctggcgcaaggtctgggacgaggccacatacgacctcgccaccgtgctcgccttcctcgccgtcctcgccttcaccatctccgtctacatcatgtccaggcccaggcccatctacctcatcgacttcgccacatacaagcccgcagacgaactcaaggtttccaaggcggagttcatcgatctggcgcgcaagtcgggcaagttcgacgaggagagcctggcgttccaggcgcggctgctggccaagtccggcatcggggacgagtcctacatgccgcgctgcgtcttccagcccgacgccaactgcgccaccatgaaggaaggccgcgccgaggcctccacggccatgttcgcggccctcgacgagctcttcgagaagtgccacgtccggcccaaggacgtcggcgtcctcgtcgtcaactgcagcctcttcaacccgacgccctcgctctctgccatgatcgtcaaccactacaagatgcgcggcaacatcctcagctacaacctgggcggcatgggctgcagcgcgggcgtcatctccatcgacctcgcccgcgacatgctgcaggccagcggcgcggggctggccgtggtggtgagtaccgaggcggtgtccttcacctggtacgccgggaagcgcaagtccatgctgatcccgaacgccttcttccgcgccgggtgcgccgccgtgctgctctccaaccgccgccgggactaccgccgcgccaagtaccagctggagcacgtggtgcgcacgcacaagggcgccgacgaccgcagcttccggtccgtgtaccaggaggaggacgagcagcggatcaagggcctgtccatcagccgcgatctggtggaggtcggggggcacgcgctcaagaccaacatcaccacccttggcccgctcgtgctccccttctccgagcagctgttcttcttcgccggcgtgctcttccgccacctctacccgtccaagacgtccacgccgcctccgccgacggccgaagggggcacctcggccgccgcgccctacatcccggacttcaagcgcgcgttcgagcacttctgcatgcacgcggcgagccgggacgtgctggagcacctgcagagcaacctgggcctccgccacaccgacctggaggcctcccgcgccgcgctgcacaggttcggcaacacctccagcagcagcatctggtacgagctggcctacctggaggccaagggccgcgtgcgccgcggtgaccgcgtctggcagctcgcattcggctccgggttcaagtgcaacagcgccgtgtggcgcgccgtccgccgcgtgcgccgcccgtcgaggagcccgtggctggactgcgtcgaccagtacccggcgcgcatggacgcgtgagctgcgagcgggtaagtgcgaggaagctaatgaagatgatgtcaatctctgcatgcaactggcatgcagtgccgctggttaaggtttgatgtttggtcaatttgtgtgggtgactttggtgttctagcagtttatttaaggagtttgattatagactacgtaccataatgtgtgcacaagtttatctgtgcgcgcgctctgtgaaacttgtgtgaaacttaagtgaagtattatcta

SEQ ID NO: 5067 - DNA, 2157 bp, Brachypodium distachyon
cctccccaaccccagcagccagcaccaacgcctctatatctaccacactgacccccttccactccctctcaccctcatcactgtccatcctccattccccagagatcgatctgccggccggccatggcgcgggaggcggaggagcaggcgctgctgtcgacggagatcgtgaaccgtggcgtggagccgtcaggcccggacgccggctccccgacgttctcggtgcgcgtgcgcaggaggctgccggacttcctgcagtcggtgaacctcaagtacgtgaggctgggttaccgctacatgctgagccacggcgtgtacctggccacgatcccggtgatcgtgctggtgtgcggcgccgaggtgggcagcctgagccgcgacgagctgtggcgcaaggtgtgggacgaggccacctacgacctcgccaccgtcctcgccttcctcgccgtcctcgccttcaccatctccgtctacatcatgtccaggcccaggcccatctacctcatcgacttcgccacctacaaacccccggaagaactcaaggtgtccaaggcggagttcatcgacctggcgcgcaagtcgggcaagttcgacgaggagagcctggcgttccagtcgcgtcttcttgccaagtctggcatcggggacgagtcctacatgccgcgctgcgtcttccagccggacgccaactgcgccaccatgaaggaaggccgggcggaggcgtcggccgccatgttcgcggccctggacgagctcttcgacaagtgccgcgtccggcccaaggacgtgggcgtccttgtcgtcaactgcagcctcttcaacccgacgccctccctctccgccatgatcgtcaaccactacaagatgcggggtaacatcctgagctacaacctgggcggcatgggctgcagcgcgggtgtgatctccatcgacctcgcccgcgacatgctgcaggccagcggcgccggtctggccgtcgtggtgagcaccgaggccgtgtcgttcacgtggtacgccgggaagcgccggtccatgctcatccccaacgccttcttccgcgccgggtgcgccgccgtgctgctctccaaccggcgccgggacttccaccgcgccaagtaccagctcgagcacatcgtccgcacgcacaagggcgccgacgacaggagcttcaggtcggtgtaccaggaagaagacgagcagcggatcaaggggctcgccatcagccgtgaccttgtcgaggtcggcgggcacgcgctcaagaccaacatcaccacgctggggccgctggtgctgccgttctcggagcagctgctgttcttcgctggcgtgctgttccgtcacctgtacccgtccaagacatcatccgcccaggtggcgggggaggcggacagcgcggcggcggcgccgtacatcccggacttcaagcgcgcgttcgagcacttctgcatgcacgcggcgagccgggacgtgctggagcacctgcagcggaacctgggcctccgggacgccgacctggaggcgtccagggcggcgctgcacaggttcgggaacacgtccagcagcagcatctggtacgagctggcgtacctggaggccaagggccgcgtccgccggggcgaccgcgtctggcagctcgcgttcggctccgggttcaagtgcaacagcgccgtgtggcgcgccgtccgccgcgtgcgacgcccgtccaggagcccctggctggactgcgtcgaccagtacccggcgcgcatggatgcctgagctgaacgagcaagacacgcggtaagtgtacgtacgtgcgtgcgtactgaagcctaatgaaatggtgatgaatacgtcaaggtttgagcttataatttggttaatttcgtgttggtgttgtactagcagatctcgttgtggagtttatttatagactattattactagtctactacgtacgtgacataatgcgcagagtgtacgtgcgcgctgtgtggaaactttgtgaaactcttaattatctaccagcaatttcattactttgaacttaaattgtactagtgtgttgtaagacttgtaagtttgagtgttgctgttatgcttgggatgcccaaatgtaaccatcgtgtaaggacacaaagagaaggactaaaacagagaaccgttacttgagttttc

SEQ ID NO: 5068 - DNA, 1782 bp, Secale cereale
ttctcggtgcgcgtgcgccgccggctgccggacttcctgcagtcggtgaacctcaagtacgtgcgcctcggctaccactacctgctgagccacggcgtgtacctggccaccatcccgctcatcgtgctggtgtgcggcgccgaggtgggcagcctcagccgcgacgagctgtggcgcaaggtgtgggacgaggccacctacgacctcgccaccgtgctcgccttcctcgccgtcctcgccttcaccatctccgtctacatcatgtcccgccccaggcccatctacctcatcgacttcgccacttacaagcccgccgacgaactcaaggtgtccaaggcggagttcatcgatctggcgcgcaagtcgggcaagttcgacgaggagagcctggcgttccaggcgcggctgctggccaagtccggcatcggggacgagtcctacatgccgcgctgcgtcttccagcccgacgccaactgcgccaccatgaaggagggccgcgccgaggcctccgccgccatgttcgccgcgctcgacgagctcttcgaaaagtgccacgtccgccccaaggacgtcggcgtcctcgtcgtcaactgcagcctcttcaaccccaccccctcgctctccgccatgatcgtcaaccactacaagatgcgcggcaacatcctcagctacaacctcggcggcatgggctgcagcgccggggtcatctccatcgacctcgcccgcgacatgctccaggccagcggcgccgggctcgccgtcgtcgtcagcaccgaggcggtctccttcacctggtacgccgggaagcgccgctccatgctcatccccaacgccttcttccgcgcgggcgcggccgccgtgctgctgtccaaccgccgcagggacttccgccgcgccaagtaccagctggagcacgtggtgcgcacgcacaagggcgccgacgaccgcgccttccgctccgtgtaccaggaggaggacgagcagcggatcaagggcctgtccatcagccgcgacctggtggaggtcggcggccacgcgctcaagaccaacatcaccaccctcggcccgctggtgctccccttctcggagcagctcctcttcttcgccggcgtgctgttccgccacctctacccgtccaagacgtccaccccgccgccgccggccgccaacggggacacctccgccgccgcgccctacatcccggacttcaagcgcgccttcgagcacttctgcatgcacgcggccagccgcgacgtgctggagcacctccagcgcaacctggggctccgcgacgccgacctggaggcctcccgcgccgcgctgcaccgcttcggcaacacctccagcagcagcatctggtacgagctggcctacctggaggccaagggccgcgtccgccgcggtgaccgcgtctggcagctcgccttcggctccggcttcaagtgcaacagcgccgtgtggcgcgccgtccgccgcgtgcgccgcccgtccaggagcccgtggctggactgcgtcgaccagtacccggcgcgcatggacgcctgaccgatcgagccaagcaggcgcacgtgctaataattaagcgaggtaatggaaatgatgctatcgatttgcatgtaactgcatgccgtgccgctggtttaaggtttgagctttggttaatttgtgctggtgttgtagcggttattattgaggggtttaatcatagactacgtaccataatgcgcaagtgtatgtgcgcgctcttgtgaaacttatgtgaacttgattatctacgtgcaa

SEQ ID NO: 5069 - DNA, 1439 bp, Avena sativa
gctgtcgacggagatcgtgaaccgcggcgtggagccgtcgggtccggacgccggctcgcccaccttctcggtgcgcgtgcgccgccgcctgccggacttcctgcagtcggtcaacctcaagtacgtcaagctgggctaccactacctcctcagccacggcgtgtacctggccaccatcccggtcatcgtgctcgtctgcggcgccgaggtcggcagcctcagccgcgacgagctctggcgcaaggtctgggacgaggccacgtacgacctcgccaccgtgctcgcattcctcgccgtcctcgccttcaccatctccgtatacatcatgtccaggcccaggcccatctacctcatcgacttcgcaacatacaagcccgccgacgaactcaaggtttccaaagcggagttcatcgatctggcgcgcaagtcgggcaagttcgacgaggagagcctggcgttccaggcgcggctgctggccaagtccggcatcggggacgagtcctacatgccgcgctgcgtcttccagcccgacgccaactgcgccaccatgaaggaaggccgcgccgaggcctccaccgccatgttcgccgccctcgacgagctcttcgagaagtgccacgtccgtcccaaggacgtcggcgtcctcgtcgtcaactgcagcctcttcaacccgacgccctcgctctccgccatgatcgtcaaccactacaagatgcgcggcaacatcctcagctacaacctgggcggcatgggctgcagcgcgggcgtcatctccatcgacctcgcccgcgacatgctgcaggccagcggcgcggggctggccgtggtggtgagtaccgaggcggtgtccttcacctggtacgccgggaagcgcaagtccatgctcatcccgaacgccttcttccgcgccgggtgcgccgccgtgctgctctccaaccgccgccgggactaccgccgcgcaaagtaccagctggagcacgtggtgcgcacgcacaagggcgcggacgaccgcagcttccggtccgtgtaccaggaggaggacgagcagcggatcaagggcctctccatcagccgcgacctggtggaggtcggcgggcacgcgctcaagaccaacatcaccaccctcggcccgctcgtgctccccttctccgagcagctcctcttcttcgccggcgtgctgttccgccatctctacccgtccaagacgtccactccgccgccacccacagctgaggggggcacctcggccgccgcgccatacatcccggacttcaagcgcgcgttcgagcacttctgcatgcacgcggcgagccgcgacgtgctggagcacctgcagagcaacctgggcctccgccacaccgacctggaggcctcccgcgctgcgctgcacaggttcggtaacacctccagcagcagtatctggtacgagctggcctaca

SEQ ID NO: 5070 - DNA, 1392 bp, Gossypium hirsutum
ttccatcattactcttcttgttgcattgcacccctacactacattaattccgtttctcacatctcacaaaagagaacaaaaagaaatatgtgtacctctaaggctaaggtgaccacaggcactactcatgttgaaataacaccacctgctgtcgcccggatcaatggccgtcctgtccttcaacctacttgtaatcgtgttcctagccttgatcgtcgtaattccttgaaaaaaataccacccatctctcctccaccacctgcatcactaccatttacgccgtcagccaccagtactacaactgttgccaatggtagcagggctagggcctcactcacactgcctttatcgccaagctcaaagttcaccaccaagcgagggagtgatcccaatgcgttgaactcaagttctgaaaaggttgccattcccagaaacaccacaaaaaccttggataggaagaaatccaaaagtttcaaagagggtatggggaataatggattatcttcttatattgagccatcattgagttactcttcttctctgctggttgaggctccaggaagcattgctgcagttagaagggaacaggtagctcttcaacaagcacaaagaaagatgaaaattgcacactatggaagatcaaaatcggccaaatttgaatctaaggttgttcctctcgacaataccaagcctgccgaggaaaagaagaggtgcagtttcattacgcccaactcagatcctatctatgtggcttaccatgacgaagaatggggagttccaatccataatgatagcatgctcttcgagttgttggttctaagtggtgctcaagtaggctcggattggacttcaatcctgaagaaacgtcaagatttcagggatgcattttcagggtttgatgcagaaactgtagccaacttcactgaaaaacaaatgaccacaattagctctgaatatgggattgacataagcagagttcgaggtgttgtggacaactccaaccgtattctcgaggttaagagggagtttggatcatttgacaaatatatatggggatttgtgaatcacaagccgatgtcgacgcaatacaaattcgatcacaagatcccagttaagacatcaaagtctgagagcataagcaaggacatggtgagaagggggtttaggtttgttggaccaacggtggtccattccttcatgcaagccgctggtctaaccaacgaccacctcatcacatgccacaggcaccttccttgcgccttgttagccatccaaaggccaccggtccactcactccctgatttgtagatgattatgaattgacatttagacatatccaggcaacaataatgcattgcatgggacgacatcaaagcagtagcccagatgcat

SEQ ID NO: 5071 - DNA, 1388 bp, Gossypium hirsutum
gtgtacctctaaggctaaggtgaccacaggcaccactcatgttgaaataacaccacctgctgtcgcccggatcaatgggcgtcctgtccttcagcctacttgtaatcgtgttcctagccttgatcgtcgtaattccttgaaaaaaataccacccatctctcctccaccacctgcatcactaccatttacgccatcagccaccagtactacaactgttgccaatggtagcagggctagggcctcactcacactgcctttatcgccaagctcaaagttcaccaccaagcgagggagtgatcccaatgcgttgaactcaagttctgaaaaggttgccattcccagaaacaccacaaaaaccttggataggaagaaatccaaaagtttcaaagagggtatggggaataatggattatcttcttatattgagccatcattgagttactcttcttctctgctggttgaggctccaggaagcattgctgcagttaggagggaacaggtagctcttcaacaagcacaaagaaagatgaaaattgcacactatggaagatcaaaatcggccaaatttgaatctaaggttgttcctctcgacaataccaagcctgccgaggaaaagaagaggtgcagtttcattacgcccaactcagatcctatctatgtggcttaccatgacgaagaatggggagttccaatccatgatgatagcatgctcttcgagttgttggttctaagtggtgctcaagtaggctcggattggacttcaatcctgaagaaacgtcaagatttcagggatgcattttcagggtttgatgcagaaactgtagccaacttcactgaaaaacaaatgaccacaattagctctgaatatgggattgacataagcagagttcgaggtgttgtggacaactccaaccgtattctcgaggttaagagggagtttggatcatttgacaaatatatatggggatttgtgaatcacaagccgatgtcgacgcaatacaaattcgatcacaagatcccagttaagacgtcaaagtctgagagcataagcaaggacatggtgagaagggggtttaggtttgttggaccgacggtggtctattccttcatgcaagccgctggtctaaccaacgaccacctcatcacatgccacaggcaccttccttgcgccttgttagccatccaaaggccaccggtccactcactccctgatttgtagatgattatgaattgacatttagacatatccaggcaacaataatgcattgcatgggacgacatcaaagcagtagcccagatgcatatacgtaactaaaacccaatttctaactaattaaaacctttttttcccctcttttcctcgtcttttgtgtgattatcatgaatga

SEQ ID NO: 5072 - DNA, 2231 bp, Sorghum bicolor
tccatcgcattcgcatcagagctcccagcggcccttcttctttctccagcaagcagcagcagcagcagcaggcccggccgcccagttggcaattgcattgccgtgatggtgatctgatttctgtagccacggcgacggtgacgccgtgtgtgacggtggagagcaaggagctggagctgggtgactgacgagcaaggcccacccaccgtaggtgaacggcaaaacccaataggcaatgcctgtagctgcaggcgcggctccagctccacacacgaggaccaacgcagccctcggccccccgctttcctactggggcggcgccgctgttggcgcagaggagcagaggtggcgtatcggcatggactccgccgccgccgctctcctcgactcctccgcctccgcctcttcctccgccgccgccaacggcaacgccaaggagatgcccgcccgactcctcgcccaccgcaccgcccacaacatgtcctcctcctcgctccgcaagaagtccgacctcgcgctcctccgcaaggtcccctgcgccacgctccgccgcctcctcgacaacttccaggaggtcctgctcgccaccaagctcgccctcctcttccccgccgtcctcctcgcgctcgccgcgcgaatcttccaattcggccaggaatgggtctttgtgcttagcttgatcggtctcgttcctcttgctgagcgacttagctttctgactgagcaggttgcgttttacacagggcctactgtgggtggactgttgaatgcaacatttggaaatgtaacagaggtcatcattgcaatctttgcgctgtatgaaggcaaggtagtggtggtgaaatgctccctactcggctcagtcttgtccaacttgttgcttgtgcttggaacctcccttttccttggtggcctggctaaccttggaactgagcagctatacgacagaatgcaagtagatgtcagcacaggacttctgattcttggtgtgctatgccactctctgccactgatgctgaggtatgctgtgagctccggggagcacgcggtatcttcttgggattcagaactggagctatcccgagcatgcagcattgtcatgctccttgcctatgtagcctaccttttcttccaactgaaaacccaccgccaactctttgagccccaagaggtcgaagatgatggtgatgattcagtctctcaagacgaggtggtactgggattttccagtgccatgatttggctgggggtcatgactctgatgacagcagtcctatcagagtttgttgtgagtacaattgaggcagcatcaaaatcatgggaactatctgtcagcttcattagcatcatcttaattccaatagttggtaatgcagcagagcatgccggtgcagtcatatttgcttttaaaaacaagctggacatcaccctcggagtatctttgggttctgctacacagatttccatgtttgtggtgccattgagtgtccttgtagcatggatcatgggagtcccgatggatcttgatttcaacttgcttgagactggttctttgtttcttgcagtattagtaacggccttcacgctccaggatggatcatcgcattatctgaagggactgctgctgctgttttgttacattgtcattgctgtatgcttttttgttttgagacagcgtggaaatggaagcaacaatgatgtccatcatcagctgggtgtagcaagcaagccatggaggatttagagtgccagagctgacagtagtttctcaatgaatagcatggactttggtttgcacaattttgcatggagcactggaggagccctgtgaagttctgactaaagtatgtagactgcgggaagatgctgtgcagctaatggtgaaagcagaaagcaatcaagcgagacaatatgtaagtacatacaaagactatagctgtaaactgatgcgtatgtcgtattatatagatgttgcttgagaaagtgtacattactgttgttttgttcttccaaccgaggtggtgttatgtggatttgttagcacttgagcagagataataggcaaagcaatgcaactagaattcggttgagctgttgaaatcgtctcctgtaaatcagtgacatatatatcttactatttccaactgggcttttaaaggagcctttatgttaatccttgccaggcactctaggaaaaagaaatgtacatcatcataagaattcaaacagaa

SEQ ID NO: 5073 - DNA, 2745 bp, Panicum virgatum
atgtgcatggcgctctctctctctctctcgcgtccgatcccttcatcatcatcatctttatcttgccacatcgccattgctctgagcatccaattccacaccacgacgttccggtccgacccggcggctctctttctacggcgcgaggcgtgccgccccagccgccgagtccagccaactggccaagccaaagccaggcgacgcccccaacatgcccgctggagcggcgcacacaaactccagcgcccccggcccccgctgccttgccgtggcggagccgccgtcgggagggaggagcagaggcggcgctggcttaccggcatggacgaccccgccgccacggccgccgcttccgcggggctcctcgagcccggcgccaaggagatcgccgcccgccacctcggccgcacggcccacaacatgtcctcctcctcgctccgcaagaagtccgacctcgccctcctccgcaaggtcccctgcgcgccgctgcggcggctcctcgacaacctccaggaggtcctgctcggcaccaagctcgtcctcctcttccccgccgtcatcctcgcgctcgccgcgcgcatcttccacttcggacaggagtgggtatttgttcttagcttaattggtctagttcctcttgctgagcgactaagcttcctgacggagcaggttgcattttacacaggacctactgtgggtggtctgttgaatgcaacatttgggaatgtaacagaggtcataatcgcaatctttgccctgtacgaaggcaaggtagtggtggtgaaatgctccctgcttggttccatcttgtccaacttgttgcttgtgcttggaacctcccttttcctcggtggtctggctaaccttggaaccgagcagccttacgacagaatgcaggcagatgtgagcacaggacttctgattctcggtgtgctttgtcattctctgccactgatgctgaggtatgctgagagctccgggaagcatgcagtggtctcttgggatgcaggattggagctatcccgagcatgcagcgttgtcatgctcctagcttatgttgcctaccttttcttccaattgaagacccatcgccaactttttgagccccaagaggtcgaagatgatggtgatgattcagtctcccaagatgaggccgtcttgggatttcctagtgcaatgatctggcttggagtcgtgactctgatgacagcggtattgtcagagtttgttgtgagcacaattgaggcggcatcaaaatcatgggaactatctgtgagcttcattagcatcatcttgattccaatagttggtaacgcggcagagcatgctggtgcagtcatatttgcttttaagaacaagctggacatcaccctcggagtatctttgggttctgccacgcagatttccatgtttgtggttccattgagtgtccttgtaggctggatcatgggagtcccaatggatcttgatttcaacttgctcgagactggttctttgtttcttgctatatttgtaaccacctttaccctccaggacggatcatcacattatctgaagggactgctgcttctgttttgctacgttgtcattgccatatgcttttttgttttgagacagtgcgcaaatggcggcaacgacggtgtcaatccgggtgtagcaagcaacacgtggaggatttagggcgcctgagctgacaagtcggactgcgtttcccagtgagttgttttggagtgaatggtgtggccttcatttgcaattttgcatggagcactggagggagccctgggtgggaggtccaaccgaagtaggctacatgtgtatgaaaggaagatgatgctttctgataattaatgtgacaaaagaagaagaaaaaaggacaccgcaatagcagttaatcgaatcattaggtatatatattatagcttaagttcagatgtactatattgtagatgcgagtgtacattgttggtgttccaaccaaggtaaatgtgtcgttctgtgcattaattaacttattaggacttgagcagagaggcaatcaagcaaaactggatgttcgtatcaagtagtactactaagttgttcgtgaatgaagggtgccatgtgtgtatactgtctgaagaaaagcatgcagttttaattaatcagttgcaacgcgagcccaactggatgctagctgctgcatttatgggtgggcaacgtacagcacgatcttgcgttgactcgtaacattcagtggctgactgctgaaagtgcagagtgattggaggcgttgctcagtcagcaatgcgtgcaggggcggcggcaaatcggaccagcctgccctgctgggccccttgcacctaactgggctttcaacggttggtaaacggcccggcctagcctcttcttctcccgacgactgaattttgaagcaaagctctcgccgattttaacctgatgatgacttggggacgggttccaagtcagaagtcacacagtacacgtccgtcctcgacttccttgtgccctagggcatgggcatgggctccagtcagtagcgacggctggccttcgcttctagaaagcctacgggataatagtagtaatagttgttgccgggcaatgggcatgccgagagctccttttcaaagctgtgtggtgtgggaaagaaagataaacggagtggagtgcatgtgtgcagtgacctggtggtgtctcggcgtgaaattgtcaactttgcgcccgtaagcgtagcctgcacgt

SEQ ID NO: 5074 - DNA, 1991 bp, Setaria italica
agccaagggataccctccccgcgaaccccgatgcctgcggcagccgcacacaccaccaccaccaccaccaccacctacagcgcctccaccaacgcgctcggcccgccgctgccttactgggccgtcggccgggaggagcacaggtggcacgtcggaatggactccgccgccgccgccacggggctcctcgagcccggcgccaaggagctggccgcgcgcagcctcggccgcaccgcccacaacatgtcctcctcctcgctccgcaagaagtccgatctcgccctcctccgcaaggtcccctgcgcgtcgctccgccggctgctcgacaacctccagcaggtcctgctcgccaccaagctcgtcctcctctttcccgccgtcatcctcgcgctcgccgcgcgcttcttccacttcggccaggagtggatatttgtccttagcttaattggtctaattcctcttgctgagcgactaagctttctgacggagcaggttgcattttacacgggacctactgtgggtggactattgaatgcaacatttggaaatgtaacagaggtcatcatcgcaatctttgccctgtatgaaggcaaggtactggtggtgaaatgctccctgctcggctccatcctgtccaacttgttgcttgtccttggaacttcccttttcttcggtggcctggctaaccttggaaaagagcagccttatgacagaatgcaagcagatgtcagcacaggacttctgattcttggtgcactatgccactctctgccactgatgctgaggtattctgtgagttccggggagcatatgatggtctcttgggatgcaggattggagctgtcccgagcatgcagtgttgtcatgctcctggcctatgtagcctaccttttcttccaactgaagacccatcgccaactctttgagccccaagaggctgaagatgatggtgatgattcggtctcccaagatgaggcggtcctgggattttctagtgcaataatttggctcggagtcatgactctgatgacagcggtattgtcagaatttgttgtgagcacaattgaggcggcatcaaaatcatgggaactatctgtgagtttcattagcatcatcttgatcccaatagttggtaatgcggcagagcatgctggtgcagtcatatttgcttttaagaacaagctggacatcaccctcggagtatctttgggttctgccacacagatttccatgtttgtggtaccattgagtgtccttgtggcttggatcatgggagtcccaatggatcttgatttcaacttgcttgagactggttgtttgtttcttgctatattagtgaccacctttaccctccaggacggatcatcgcattatctgaaggggctgctgcttctgttttgctacatcgtcatcggcatatgcttttttgttttgaggcagcgtggaagtggcggcaacgacggtgtggatctgggcataggaagcaaaacatggaggatttaggggtgcctgagctgacaggttggactgcatttcccattgagttgtttcggagttaatggtgtggccttcatatgcagttttgcatggagcactggaggagggcctgggtgttaagtctgactgaagtaggctacttactacatgggtatgaaagaaagatgctgcttttcatgcagctgggctatgcagaaaaaagaagcaggacatcgcaaaagcagttaagcaaatcattcggtacatatattatagctgaagtcgagatatgttgtagagtcaagtgtaaattattgctgttgttccaaccaaggcaaggtgtcgttctttgaattaattaacttgttattaggacttgagctgagaggcaagcaaacaaaactgggtgtaccaagtaagttgtccgtgaaaaagaagtggcatgtatgtaatgctatctgaagaggaacatgcagtttaatttggatgtgcagaactgtgttctgaacttctga

SEQ ID NO: 5075 - DNA, 1860 bp, Panicum virgatum
gaggcgtgccggcacgcaattgcggtgtggacgtgtacgaggaggaaggcatcacggtcaggaggaaagggcctcgctggctgactgacgagggaggcccaccgtcagcgcagccccagccgcctgagtccagccaatccaaagccaggcgacaccccccgtgctggagcggcgcacacaaactccagcgcccccggccccccgctgccttcctgtggcggagccgccgtcgggagggaggagcagaggtggcgctggcgcaccggcatggaccccgccgccacggccgccgcttccgcggggctcctcgagcccggcgccaaggagctggccgcccgccacctcggccgcacggcccacaacatgtcctcctcctcgctccgcaagaagtccgacctcgccctcctccgcaaggtcccctgcgcgccgctgcggcgactcctcgacaacctccaggaggtcctgctcggcaccaagctcgtcctcctcttccccgccgtcatcctcgcgctcgccgcgcgcatcttccacttcggacaggagtgggtatttgttcttagcttaattggtctagttcctcttgctgagcgattaagcttcctgacggagcaggttgcattttacacaggacctactgtgggtggtctgttgaatgcaacatttgggaatgtaaccgagatcataattgcaatctttgccctgtacaaaggcaaggtagtggtggtgaaatgctccctgctcggctccatcttgtccaacttgttgcttgtccttggaacctcccttttcctcggtggtctggccaaccttggaaccgagcagccttacgacagaatgcaggcagatgtgagcacaggacttctgattctcggtgtgctttgccattctctgccactgatgctgaggtatgctgagagctctggggagcatgcagtggtctcttgggatgcaggattggagctatcccgagcatgcagcgttgtcatgctcctggcttatgttgcctaccttttcttccaattgaagacccatcgccaacattttgagccccaagaggtcgaagatgatggtgatgattcagtctcccaagatgaggccgccttgggatttcctagtgcaatgatctggctcggagtcatgactctgatgacagcggtattgtcagagtttgtcgttagcacaattgaggcggcatcaaaatcatgggaactatctgtgagcttcattagcatcatcttgattccaatagttggtaatgcggcagagcatgctggtgcagtcatatttgcttttaagaacaagctggacatcaccctcggagtatctttgggttctgccacacagatttccatgtttgtggtgccattgagtgtccttgtaggctggatcatgggagtcccaatggatcttgatttcaacttgcttgggactggttctctgtttcttgctatatttgtaaccacctttaccctccaggacggatcatcgcattatctgaagggactgctgcttctgttttgctacgttgtcattgccatatgtttttttgtttcgagacagcgtggaaatggcggcaacgatggtgtcaatccgggtgtagcaagcaacacgtggaggatttagggctcctgagctgaaagttggactgtgttacccagtgagttgttttggagtgaatggtgtggccttcatttgcaattttgcatggagcactggagggagccctgccctgggtgggaagtctgactgaagtaggctacatgtgtatgaaaggaagatgatgctttcagataattaatgtgtcaaaagggaaaaaaaggcatcgcaattaggggtgggcattcggtttattcgggctaa

SEQ ID NO: 5076 - DNA, 1921 bp, Echinochloa colona
ccacggcattccggtgcagcccggcggtggttccattctaccgcgcgaggtgtatcgtgtcggcaggcaattacggtggaggaggagatcacatcacatcacatcatccaggagggaagggcctgaccggctgacggaggaggcccaccgccagtgacagtgaggcaccagcccccaggcaagcaaagccaacccaagccaacccgagcgatacccacaccaactccagctcgagcccgctcggcccagccgccgccgttggccgggaagaacagaggtggcgcgccggcatggactcctccgccgccgccaccgcggggctcctcgagtccggcgccaaggagatggccgcgcgcagcctcggccgcaccgcccacaacctgtcctcctcctcgctccgcaagaagtccgacctcgccctcctccgcaaggtcccctgcgcgccgctccgccgcctcctcgacaacctccagcaggtcctgctcgccaccaagctcgtcctcctcttccccgccgtcgtcctcgcgctcgccgcgcgcatcttccatttcggacaggagtgggtatttgtccttagcttaattggtctcgttcctcttgctgagcgactaagcttcctgacagagcaggttgcattttacacaggacctacagtgggtggactgttgaatgcaacatttggaaatgtaacagaggtcatcatcgcaatgtttgccctgtatgaaggcaaggtagtggtggtgaaatgctccctgctcggctccatcttgtccaacttgttgcttgtccttggaacctcccttttcctcggtggcctggctaaccttggaaccgagcagccatatgacaggatgcaagtagatgtcagcacagggcttctgattcttggtgtgctatgccactctctgccactgatcctgaggtatgctgtaagttccggggagcatgcagtggcctcttgggatgcaggattggagctctcgcgagcatgcagtgttgtcatgctcctggcctatgtagcctaccttttcttccaactgaagacccatcgccaactctttgagccccaagaggtcgaagatgatggtgatgattcggtctccgaagatgaggctgtcctgggatttcctagtgcaatgatttggcttggagtcatgactctaatgacagcggtattgtcagagtttgtggtgagcacaattgaggcggcatcaaaatcgtgggaactatctgtgagcttcattagcgtcatcttgattccaatagttggtaacgcggcagagcatgctggtgcagtcatatttgcttttaagaacaagctggacatcaccctcggagtatctttagggtcagctacacagatttccatgtttgtggtgccgttgagtgtccttgtagcttggatcatgggagtcccaatggatcttgatttcaacttggttgagactggttgtttgtttattgcaatactagtaacgaccttcacgctccaggacggatcgtcacattatctgaagggactacttcttctgttttgctacgttgtcattgccatatgcttttttgttttgagaaggcgtggaaatggtggcaatgacggcgttgatctgggtgtagcaagcaatacgtggaggatttagggtgcctgagctggcaggttggactgcatttcccagtgagttattttggaatgaatggcgtggccttcatttgcaattttgcatgaagcactggagggagtcctcggtgggaagtctgactgaagtaggctacatgtatcaaagaaagatgatgcttgtcctgcagctggcctatgcagataagtaacgtggtaaaaggggaaaaaagcagggcactgcaatgcagttaagcaaatcactaggtatatatattatagctgaaggtgagatatatataatgt

SEQ ID NO: 5077 - DNA, 956 bp, Sorghum bicolor
gccgtcccagctcagtccgtccaccacacccactgctccgtaccatccgtcgccgccggcgcaccgcgatggccgcctccgccacggccgcgaggcctctcgctggggccgccgccgtcccgctcccgctgccagcgcggccgcgaaccgccagggtggccttgctccccctgacccctgttccgggccagcgcctcgctctcgggcgggccgggcaggagcggctgccggcgcgcggccggtcggtgcggtgcctggcggcgctgagcccggagatgcgggcgacgctggacaaggtcgtggggtccagcaaggtggtgctgttcatgaagggcaccaaggacttcccgcagtgcggcttctcccacaccgtcgtgcagatcctgcgctcgctcgacgtgcccttcgacacgctcgacgtgctcgccaacgaggcgctccggcaggggctcaaggagtactccagctggcccaccttcccgcagctctacatcgacggcgagttcttcggcggatgtgacatcaccgttgaggcatacaagagtggagaactgcaggaaactcttgagaaagcaatgtgttcataggaaaaaaaaattgaacaaggaccacacaggatactgttgatcaaaatgttatagtatttgctgtacgattcagccatgttaagctggagatgctaagttgtagacaatttcgtgtccagatgttcagtgcacttcgaatacatttttctggaataagcaaccagctgatgttgatgctgatattgatttgttgtgagataagaacactattattttgctaaaatgatacagctgataagttcgagcgagggtgggcagcaaactgttgcacttgccgttacgacacacagaattaacattagatcgaatatggttgcataaagaaagaattgcatctgtattctttggtgggtgctcacagctatattc

SEQ ID NO: 5078 - DNA, 867 bp, Zea mays
ggagacgagggggaaatgggtttagggcttaactcatctgaccgtggcaccgtgcggcacgctgggtttccaggcccagacttgcggctcaagccaactgccatccatggcccatgggcctgtcgggtatcgactcggcctgctgccttgactcgcatcctcctccacgagccacggccaactggttagttattccgtgccgtcccaactcacccgcggctccgtaccatccgtcgccgccggcgcaccgcgatggccgcctccgccccggccgtgaggcctctcgcccgggccgcaatccctatcccgctctctgcgcgtccgcggaccgccagggtctccttgctccccctggctcctcttgctccggcccagcgcctcgctctcgggcggaccgggcaagcgcggctgccagcgcgcagccggtcggtgcggtgcctggcggcgctgagcccggagatgcgggagacgctggacaaggtcgtggggtccagcaaggtgttgctattcatgaagggcaccaaggactttccgcagtgcggcttctcccacaccgtcgtgcagatcctgcgctcgctcgacgtgcccttcgagacgctcgacgtgctcgctaacgaggcgctccggcaggggctcaaggagtactccagctggcccaccttcccgcagctctacatcgacggcgagttcttcggcggatgtgacatcaccgtcggtaaactcctatatgttttgtcacttcattcacagatgctcgagcctgtacgctttactgagctcacgatctcgtggtattgggactggcccatttgttttgtctgtctgcatctaatcactaacacgaccacgtttggagtccctcactaa

SEQ ID NO: 5079 - DNA, 659 bp, Zea mays
ggcctgctgccttgactcgcatcctcctccacgagccacggccaactggttagttattccgtgccgtcccaactcacccgcggctccgtgccatccgtcgccgccggcgcaccgcgatggccgcctccgccccggccgtgaggcctctcgcccgggccgcaatccctatcccgctctctgcgcggccgcggaccgccagggtctccttgctccccctggctcctcttgctccggcccagcgcctcgctctcgggcggaccgggcaagcgcggctgccagcgcgcagccggtcggtgcggtgcctggcggcgctgagcccagagatgcgggagacgctggacaaggtcgtggggtccagcaaggtgttgctattcatgaagggcaccaaggactttccgcagtgcggcttctcccacaccgtcgtgcagatcctgcgctcgctcgacgtgcccttcgagacgctcgacgtgctcgctaacgaggcgctccggcaggggctcaaggagtactccagctggcccaccttcccgcagctctacatcgacggcgagttcttcggcggatgtgacatcaccgtcggtaaactcctatatgttttgtcacttcattcacagatgctcgagcctgtacgctttactgagctcacgatctcgtggtat

SEQ ID NO: 5080 - DNA, 868 bp, Panicum virgatum
gaaaaaaaggagaagaaattactggtcgaataattaatttgtctcggtcgtccaccacacccaccggctccgtaccatccgtcgccgccggcgcgcgctctcaccagacgccagccaccgcgatggccgcctccgccacggccgcgaggcctctcgccggggcctccgtccctctccccctctccgctcggcggcagctcgctagggtcgccttgctcccacgggctcctgctgcgattcaacgcctcagcctcggccgtcccgcgcaggcgcagccctctgcgcgcggccggtcggtgcggtgcctggcggcgctgagcccggagatgcgggcgacgctggacaaggtggtggggtccagcaaggtggtgctcttcatgaaggggaccaaggacttcccgcagtgcggattttcccacaccgtggtgcagatcctgcgctcgcttgacgtgcccttcgagacgctcgacgtgctcgccaacgaggcgctccgccaggggctcaaggagtactccagctggcccaccttcccgcagctctacatcgacggcgagttcttcggcggatgcgacatcaccgttgaggcatacaagagtggagaactacaggaaactctagagaaagcaatgtgttcttagagactattgaatcaggaccacacgaaatacagttaaccaaaatgttgtagtatttgctgtacaattcaggcatgttaaagaactggagatggtaagctgtagacaattcattccaaatgctcagtgctctttgattggaataagatgaagattttctgcaatttgtgattttcataatggctcaagtttccaatgtcatgttaccggattggtgcatcttcaactccaag

SEQ ID NO: 5081 - DNA, 816 bp, Panicum virgatum
gtcttcctccgcggccacaagaacaaaaaaaaaggaagaaattactggtccaataattaattaatttctctcggtcgtccaccacacccaccggctccgtaccatccgtcgccgccggcgcgcgcactcaccagacgccagccaccgcgatggccgcctccgccacggccgcgaggcctctcgccggggcctccgcccctctccccttctccgcgcggccgcagcccgctagggtcgccttgctcccgcgggctcctgctgcgattcggggcctcagcctcggccgtcccgcgcaggcgcagccctccgcgcgcggccggtcggtgcggtgcctggcggcgctgagcccggagatgcgggcgacgctggacaaggtggtggggtccagcaaggtggtgctgttcatgaaggggaccaaggacttcccgcagtgcggattctcccacaccgtcgtgcagatcctgcgctcgctcgacgtgcccttcgagacgctcgacgtgctcgccaacgaggcgctccgccaggggctcaaggagtactccagctggcccaccttcccgcagctctacatcgacggcgagttcttcggcggatgcgacatcaccgttgaggcatacaagagtggagaactacaggaaactctagagaaagcgatgtgttcttagagaccattgaatcaagacgacacgatataaagttaatcaaaatgttgtagtatttgctgtacaattcaggcatgttaaagaactggagatgctaagctgtagacaattcattacaaatgcttcagttcccttgattggaataagataaaat

SEQ ID NO: 5082 - DNA, 751 bp, Saccharum officinarum
ctttgcggtctgcacaccctgccacaaagatggcttcctgttcctcatcgccaaggcggccacccatccctctcctcctcttgctcctcttcctcctccacttctcccccgtcctcgccgcatcagctcctccagcctcatcaccacaacaggctggtaccggcggcggcggcggcaatgtgacggagacggcggcgtggacgccgcggctgaggaagacgttcttggacggcggcggcatcgaccactggcgcgggcggcggctggtggggcggttccaggtgtgcgcggtgtgcacctgctgcgggggtccgcacgggatgtgcatcccggcgccctgctgctacgccatcaactgcaacatcccaaaccgccccttcggcgtctgctccttcaccccgcgcacctgcaactgcttcaactgccacctctagcctagcctaagccgccaaggatgcaggctgcagcaaaggaaccaaggtgtggcgaactgctgctgctggatccatggttctgattgtttctctttttgattgagttggttgccgatggaagggaagggattcgtggtgacagattcgttaatttggggaccggttggaagagttcatcgtcgcataatagcagtaccgtttgtagtatatacactcctgtcctacattgtagccatgactcaatagtaagtagcagtatggtgatgatggttggattaattcagcttttctgctcttgcttggtgctcttcaacttc

SEQ ID NO: 5083 - DNA, 1062 bp, Sorghum bicolor
cgcgaataaatgcgacgcctcaccacaaaacccacccccctacctttgcatcctgcacaccctgccacaaagatggcttcctgttcctcatcgccaaggcggccacccatccctctcctcctcctcttcctcttccacttctcctccgtcctcgccgcatcagctcctccagcctcatcacaacaggctggtaccggcggcggcggcggaaatgtgacggagccggcggcgtggacgccacggctgaggaagacgttcctggacggcggcggcatcgagcactggcgcgggcggcggctggtggggcggttccaggtgtgcgcggtatgcacctgctgcgggggccagcacgggatgtgcatcccggcgccctgctgctacgccatcaactgcaacatccccaaccgccccttcggcgtctgctccttcaccccgcgcacctgcaactgcttcaactgccatctctagcctagcctagcctagcctagccgccatggatgcagcaaaggaaccaaggtgtggccaactgctgctggagtgctggatccatccatggttttgattgtttctctttttgagttgagttcggttgccgatggaagggaagggaagggattcgtggtgacagattcgttaatttggggaaccgattggaagagttcatcatcatcgcataattaatactagtaccgttagtagtatatacactcctgtcctacattgtagccatgactcatagtaggcagcagtatggtgatgatggttggattaattcagctttttctgctcttgcttggtgatcttcaacttaaattgtggatataatcaagtcctagtatctttgtttctctgaagtatgctacttgtactgtattattttatttatttatttatttattgccttatggtttagtagtcatgaccttttgtttttggattttgggccttgtttagttcccaaaatttctggaaaatcgacgctgtagcatttttgtttgtatgacaaatattgtccaatcatggacaaattagacttaaaagattcgtctcgtcaatttcgac

SEQ ID NO: 5084 - DNA, 1327 bp, Zea mays
ggcgagtaaggctggtgaccaaacatgtaaatgcacggcacaccacaccacagcccccctactttcctctaccttgcagactgcacactgcctcaagatggtttcctgttcctcatctccacggccacccatccctctcctgctcctcttcctcctccacttctcctctgtcctcgccgtatcagctccttcagcctcacaacaggctggtaccgacggcggcggcggcaatgtgtcggagacggcggcatggacgccgcggctgaggaagacgttcttggacggcggcatcgagcactggcacgggcggcggctggtggggcggttccaggtgtgcgcggtgtgcacctgctgcgggggcccgcacgggatgtgcatcccggcgccgtgctgctacgccatcaactgcaacatccccaaccgtccattcggcgtctgctccttcaccccgcgcacctgcaactgcctcaattgccacctctagcctagccttgccgccaaggatgccaaggtgtggcgaactgctgctggatccatggttttgattgtttcgctttttaagttggttgccgatgcaagggattcgtggtgagagattcgttaatttagggaccaagtggaagattccatcattgcataatactagtattgttagtagtatatactcttgtcctgcattgtagttgtagccatgactcatagtaagtagcagtatggtgatggttggattaattcagcttttttgctcttgcttggtgttgttcaactgtggatagtatctatcattgcagtgtggtacttgtattatttttttcctcatggcagtaggcatgacctttgttcttggattttgtcagcggtgtgccaatttccagtcatctgaaatggatcaaccacaattctttttagacatttctgaattagaattcataaattcatttctgcggtcatcgagatggcgatgtggtatgtgtaccatggattaccattttaaatcctacgcgctttgtctggccatggttttgattgtttaggctgtgctcctattactgctgactcagacgatgactcagacgagaacacgagtatatctcatgaaactggtgggctgttctagtttcttgtagtctctggccatggttttgattgttttttttttgtttgcacttgtcacaattaatgtggatttcctgaatttgacatcctgatttagtaagattattcagatattttaataagcattgtggttaaaaattttgttcaagatttttttgtcagatacacgaatggaaatggtccactggcagccagcagcctgttcaagttg

SEQ ID NO: 5085 - DNA, 853 bp, Panicum virgatum
tccctctctgcctacacaccctggcacaagatggcttcctgttcctcatcaccatggccacccatccctcccctcctcctgctcctcttcttcctcctcgcctccccctcctccatcctcgctgcaccagcaacctcctcccaacagcaggctgagagcgccggcaatgcgacggcggcgtggacgccgcggctgcgtaagacgttcctggacggcggcgtggagcggtggcgcgggcggcggctggtggggcggttccaggtgtgcgcggtgtgcacctgctgcgggggcccccacgggatgtgcatcccggcgccctgctgctacgccatcaactgcaacatccccaaccgccctttcggcgtctgctccttcacaccgcgcacttgcaactgcctcaactgccacctctagccggatcctcctccaggctcgccgatggcgaccaagagaccgatggattcatggtgagggattctgtctgtttgaggtctcagcagattggtagtggtgctagtagtatatatactctcctacattgtagccattccatgactcgtaaagtagcaagtgtggtgatggttggggttcgttcagcctttttgtgcgatttgttggtccaaacttgaattgaactgtggatatagtcgaatcactagcatctttcttttgctttgcctcgcggtagtgatgagctctgtttgttcttgccttcttggaattcgtcagtggtggtacaataaggaagaaggacaaacatgtgcggtgctgatttccagtgaatttatattaggagaaatttggacacatttgtggattattgagttagtaaagatgaatgatttcttctggt

SEQ ID NO: 5086 - DNA, 804 bp, Panicum virgatum
caccctgccacaagatggcttcatgttcctcatcaccatggccacccatccctcccctcctgctcctcctcttcttcttcttcgtcctcctcgcctccccctccttcgtcctcaccgcaccagcggcctcctcccaacagccggctgagagcggcggcaatgcgactgcggcgtggacgccgcgtctgcgtaagacgttcctggacggcggcgtggagcgatggcgcgggcggcggctggtgggccggttccaggtgtgcgcggtgtgcacctgctgcggcggcgcccacgggatgtgcatcccggcgccctgctgctacgccatcaactgcaacatccccaaccgccccttcggcgtctgctccttcaccccgcgcacctgcaactgcctcaactgccacctctagccggatcctcctccaggctcgccgatggcgaccaagagacgtcaccgatggattcatggtgaggggttctgtctgtttgaggtctcagcagattggtagtggtgctagtaatatatatactctcctacattgtagccattccatgactcgtaaagtagcaagtgtggtgatggttggggttgattcagcctttttgtgcgatttgttggtccaaacttgaattgaactgtggatatagtcgaatcactagcatctttcttttgctttgcctcacagtagtgatgagctttgtttgttcttgccctcttggaatttgtcagtggtggtacaattaggaaggacaaacatgtgcggtgctgatttccagtgaatttatattaggagaaatttaggcaca

SEQ ID NO: 5087 - DNA, 849 bp, Setaria italica
caaaacccctccttcctctgcctgcacaccctgccacaagatggcttcctgctcctcaccaccatggccacccatccctctcctcctcctgctcttcttcctcctctcctcctccttctccttctccgtcctcaccgcatcagcagcacaagcctcctcccgacaggctgagagcggcggcaatgcgacggcaacggcggcgcagggaacggagacggcggcgtggacgccgcggctgcggaagactttcctggacggcggcgtggagcggtggcgcgggcggcggctggtggggcggttccaggtgtgcgcggtgtgcacctgctgcgggggcccgcacgggatgtgcatcccggcgccctgctgctacgccatcaactgcaacatccccaaccgccccttcggcgtctgctccttcaccccgcgcacctgcaactgcctcaactgccacctctaggcaggatctcctccttgctcggttcctggcgacgaagagatcgatcgattcatggtgagggatttgtttgtttggggtctcaggttggaagaactcatatagtggtagcagtaccagtagtatatatactcctacattgtagtagccatgactcgtaaagtagcggtatggcgatggttggattaattcagcttttttgtgcgatttgttcgtcctcttgaattgaactgtggatataaatcaagtcagtagtatctttctttgcagtaacttttattgaatgttttgcctctaggtagtgatgacctttgtttttggaatttgtcggaactagtagatgtaggactacatttgtggtgccaatttcgagtgaattaatattaggaggaact

SEQ ID NO: 5088 - DNA, 1759 bp, Setaria italica
cgcttcgccccgcccgcgcgccgccacgccatgtcctcctccgtctccgccgccgccaaggcctccgccgccttcgcccacaagaaggagctcgccgcggcggcgccggcgccgacgcagcaccgcgcgggctcgggccgccggagcaagccatgccgcgtgcgcgccgtcgcctcgcccgcgcgcgccccccgcgccccggcgtccaccggctcggtgaagaccgcgatgacgatgacggagaagatcctggcgcgcgcctcggagcgcgcggggctggagcccggggagaacgtgtgggtggacgtcgacgtgctcatgacgcacgacgtctgcggcccgggcaccatcggcatcttcaagaaggagttcggggaggacgccaaggtctgggaccgcgagaaggtcgtcatcatcccggaccactacatcttcaccaacgacgagagggccaaccgcaatgtcgatatcctcagggacttctgtatggagcagaacatcaagtacttctatgacattaaggacctcagcaatttcaaggctaatccagactacaaaggcgtctgtcacgttgcacttgctcaagaaggccactgccgaccaggcgaggttctccttggtactgattctcatacatgcaatgctggagcctttggtcaatttgcaactggaattggaaacactgatgcaggttttgtgttgggcactggaaaggctcttctcaaggtgccaccaactataagatttgtactggatggagaaatgccaccttatttactcgcaaaggatctgattttgcaaattattggtgagatttctgtatctggtgcaacctacaaatccatggagtttgttggatcaaccatcgaaagtctaaatatggaagagagaatgacattgtgcaacatggttgttgaagctggtggaaagaatggtgttgtgcctgctgatgagactacatttaaataccttgagggcaagacatcagttgattatgaacctgtctacagcgatgctcaggccagattttttagtgactatcggtttgatgtatccaaactggagccagtagtcgccaagccacattcacctgacaatcgtgctctagcaagagaatgcaaagatgtcaagattgaccgagtctatattggttcttgcactggtggtaagacagaggacttccttgctgctgcaaaggtgttcttagcttcgggcaagaaggtcaaagttcccacattccttgtccccgcgacacaaaaggtgtggatggacctatatagcctccctgtaccaggatctggtggcaaaacttgctcccagatatttgaagaggctggatgcgacacaccagctagtcctagttgtggtgcttgtttaggtggccctcgcgatacatatgcacgcatgaatgaaccaatggtctgtgtgtccacgacgaacaggaacttcccgggcaggatggggcacaaggaggggcagatctacctggcatccccctacactgcggccgcctcggccctgacggggtatgtcacagaccccagggacttcctcatgtaacgaccttgaaaccagagagttcatgatgtaaaagaacgcctgttttaccatttattcgtgttgaaccttagtttagacgtgtctctggatgaggaataagcagttttcccttgctaacgactgcaaatggtgaggttggcatgtatggttttgcatcattaccgagtgtagtatcaagaacaaacatgactgttgcaca

SEQ ID NO: 5089 - DNA, 1763 bp, Sorghum bicolor
gtgttcgacgcttcgccgccacgccatggcctcctccatctccgccgccgccaaggcctccacggccttcgcccacaagaaggagctcgccgcgccggcgcccgcgcagcaccgcgcgggctcgagccgccggaccaagccatgccgcgtgcgcgccgtcgcctcgcctgcgcgcgccccccgcgctccgtcgtccaccggctcggtgaagagcgcgatgacgatgacggagaagatcctggcgcgggcgtcggagcgcgcggcgctggagcccggggagaacgtgtgggtggacgtcgacgtgctcatgacgcacgacgtctgcggccccggcaccatcggcatcttcaagaaggagttcggggaggacgccaaggtctgggaccgcgagaaggtcgtcatcatcccggaccactacatcttcaccaccgacgagcgtgccaaccgcaatgtcgacatcctcagggacttctgtctcgagcagaacatcaagtacttctatgacatcaaggacctcagcaatttcaaggctaatccagactacaaaggtgtctgccacgttgcacttgctcaggaaggccactgccgaccaggcgaggttctcctgggcactgattctcatacgtgcaatgctggagcctttggtcaatttgctaccggaattggaaacaccgatgctggttttgtgttgggcactggaaaggctcttctcaaggtgccacctacaatcaggtttgtattagatggagaaatgccgccttatttacttgcgaaggatctgattttgcaaattattggtgagatttcagtatctggcgcaacctacaaatcaatggagtttgttggatcaactgtagagagtctaactatggaagagcgtatgacactatgcaacatggttattgaagctggtggaaagaacggtgttgtgcctgctgatgaaactacatttaaataccttgagggtaagacatcagttgattatgaacctgtctacagtgatgctcaggccagattttttagtgactaccgttttgatgtatcaaaactggagccagtagttgccaagccacattcgcctgacaaccgtgctctagcaagagaatgcaaagatgtcaaggttgaccgagtctatattggttcttgcactggtggtaagactgaggacttccttgctgctgcaaaggtgttcttagcctcgggaaagaaggttaaagttcccacatttcttgtccctgccacacaaaaggtgtggatggacgtatatagcctccctgtaccaggatctggtggcaaaacttgctcccagatatttgaggaggctggttgtgatacaccagcaagtcctagctgtggtgcttgtttgggtggtcctcgtgatacatatgcacggatgaatgaacctatggtctgcgtgtccactacgaacaggaacttcccgggcaggatggggcacaaggaagggcagatctacctggcgtctccctacactgcagctgcctcagccctgacggggtatgttacggaccccagggacttcctcatgtaattttgaaacaacagagttcatgatgtaacagattgcctgtagcctctgtttttcgtgttgaaccttagtttaggcgtgtctttcgttgaggaataagctgcatgtcgggaggttggcatgtatggttttgcattattacagtgtactaccaattaagaacatacttgagtgttacaagggaaatacattcttctgagtattgatggcagttcct

SEQ ID NO: 5090 - DNA, 1920 bp, Triticum aestivum
gtgctcgccacggccgcactaccccccaatccctctattgacctcaaggtgttcgaccgcgcgcgccgccatggcctccatctccgccgccgccaaggccacctccgccgccttcgcgcacaagaaggagctcgccgcggcggcgccgcagcagcagcgcttgagcgcgggcgccagtagccggcgcgcgcgggccgggcgcgtccgcgcggtcgcgacgccgacccgcgcgccgcgctcccccgcgtccaccggctcggtgaagagccccatgacgacgacggagaagatcctggcgcgggcgtcggagcgcgcgagcctcgagcccggggagaacgtgtgggtggacgtggacgtgctcatgacgcacgacgtctgcgggcccggcaccatcgggatcttcaagcaggagttcggggaggacgccaaggtgtgggaccgcgagaaggtcgtcatcatccccgaccactacatcttcaccagcgacgagcgggccaaccggaacgtcgacatcctcagggacttctgcgaggagcagaagattaagtacttttacgacatcaaggacctcagcgacttcagagcaaatccagactacaaaggtgtttgccacattgcgctcgcccaagaaggtcactgccgaccaggcgaggttctccttggtactgattctcatacctgcaatgctggagcctttggtcagtttgcaactggaatcggaaacactgatgcaggttttgtgatgggaactggaaaggctcttctcaaggtgcccccaaccatcaggttcgtattagatggagaaatgccaccttatttactcgctaaggatctgattttacaaattattggtgagatatctgtatctggtgcaacatacagatcgatggagtttgttggatcaacaatagaaagtctaactatggaagaacgaatgacactgtgcaacatggttatcgaagctggtggaaagaatggtgttgtgcctgctgatgaaactacatttaagtaccttgagggaaagacatctgttgaatatgaacctgtctatagtgatgctcaggccagattttacagtgactaccggtttgatgtatctaaattagagccagtagttgcaaagccacattctcctgacaaccgtgctctagcaagagaatgcaaagatgtcaagattgaccgagtctatattggttcttgcactggtggtaagaccgaggactttattgctgctgcaaaggtgttcttagcttcgggcaagaaggttaaggttcccacttttctcgtccctgcgacgcaaaaggtgtggatggatgtgtatagtctccccgtaccaggatctggtggcaaaacatgctcccagatatttgaagaggctggttgtgatacaccagctagtcctaattgtggtgcttgtttgggtggtcctcgtgatacatatgcacggatgaatgaacctacggtctgtgtatcaacgacgaacaggaacttcccgggcaggatgggccacaaggaagggcagatctacctggcttctcccttcaccgcggcggcctcagcgttgacgggatatgtcacggaccccagggacttcctgtcttagagatcttgaaaacaatgaatttgtgttgcggaccgtcctgtactgtactttttgttcgtgtttgaaactgtagtttagatgtgtcatctgtgcgtcctgctgagaaataagttactcaacgagtagcagttgtaactgagaaaggttctgttgtatgcttttttttccggcattactgagtgtgctatcaggaacaaacataactattacatctccacaggaaggacactattcaagaatgatactgtatcttagtagatgtcgaatggcgaacacatcagagtacccatttcatacgcttggacctgtgcttcacc

SEQ ID NO: 5091 - DNA, 1777 bp, Saccharum officinarum
cgcgcccgcagggtgttcgacgcttcgcccgcccgcccccgcgctgcaacgccatggcctcctccatctacggcgccgccaaggcctccgcggccttcgcccacaagaaggagctcgccgcgccggcgccggctcagcaccgcgcgggctccagccggcggaccaagccgtgccgcgtgcgcgccgtcgcctcgcccgcgcgggccccccgcgctccgtcgtccaccggctcggtgaagagcgcgatgacgatgacggagaagatcctggcgcgggcgtcggagcgcgcggcgctggagcccggggagaacgtgtgggtggacgtcgacgtgctcatgacgcacgacgtctgcgggcccggcaccatcggcatcttcaagaaggagttcggggaggacgccaaggtctgggaccgcgagaaggtcgtcatcatcccggaccactacatcttcaccagcgacgagcgcgccaaccgcaatgtcgatatcctcagggacttctgtttggagcagaacatcaagtacttctatgacatcaaggacctcagcaatttcaaggctaatccagactacaaaggcgtctgccacgttgcacttgctcaggaaggccactgccgacctggcgaggttctcctgggtactgattctcatacgtgcaatgctggagcctttggtcaatttgcaaccggaattggaaacactgatgcaggttttgtgttgggcactggaaaagctcttctcaaggtgccccctaccatcaggtttgtattagacggagaaatgccgccttatttacttgcgaaggatctgattttgcaaattattggtgagatttcagtatctggtgcaacctacaaatcaatggagtttgttggatcaactgtagaaagtctaactatggaagagcgtatgacactatgcaacatggttattgaagctggtggaaagaacggtgttgtgcctgctgatgaaactacatttaaataccttgagggtaagacatcagttgattatgaacctgtctacagtgatgctcaggccagattttttagtgactaccgttttgatgtatcaaaactggagccagtagttgccaagccacattcgcctgacaaccgtgctctagcaagagaatgcaaagatgtcaagatcgaccgagtctatattggttcttgcactggtggtaagactgaggacttccttgctgctgcaaaggtgttcttagcctcgggaaagaaggttaaagttcccacatttcttgtccctgctacacaaaaggtgtggatggacgtatatagcctccctgtaccaggatctggtggcaaaacttgctcccagatatttgaggaggctggttgtgatacaccagcaagtcctagctgcggtgcttgtttgggtggccctcgtgatacatatgcacggatgaatgaacctatggtctgcgtgtccactacgaacaggaacttcccgggcaggatggggcacaaggaagggcagatctacctagcgtctccctacactgcggctgcctcagccctgacagggtatgttacggaccccagggacttcctcatgtaacgatcttgaaacaacagagttcatgatgtaatagattgcctgtaggctgtactgctgttttttcgtgttgaaccttagtttaggcgtgtctttcgttgaggaataaactgcatgtcgggaggttggcatgtatggttttgcattattacagtgtactaccaagaacatacttgagtgttacaagggaaatacattcttct

SEQ ID NO: 5092 - DNA, 2075 bp, Panicum virgatum
cccgcgcgccgccacgccatggcctcctccgtctccgcccgccgccaaggccatccgccgccttcgcccacaagaaggagctcgccgccgcggcgccgtcgccggcgcagcaccgcgcgggctcgggccgccggagcaagtcatgccgcgtgcgcgccgtcgcctcacccgcgcgcgcgccccgcgccccggcgtccaccggctcggtgaagaccgcgatgacgatgacggagaagatcatggcgcgggcgtcggagcgcgcgggcctggaacccggggagaacgtgtgggtggacgtcgacgtgctaatgacgcacgacgtctgcggccccggcaccatcggcatcttcaagaaggagttcggggaggacgccaaggtctgggaccgcgagaaggtcgtcatcatcccggaccactacatcttcaccagcgacgagcgggccaaccgcaatgttgatatcctcagggacttctgtatggagcagaacatcaagtacttctatgacatcaaggatctcagcaatttcaaggctaatccagactacaaaggcgtctgccacgttgcacttgctcaagaaggccactgccgaccaggcgaggttctccttggtactgattctcatacgtgcaacgctggagcctttggccaatttgcaacaggaattggaaacaccgatgcaggttttgtactgggcactggaaaggctcttctcaaggtgccaccaactataaggtttgtactagatggagaaatgccaccttatttactcgcaaaagatctgattttgcaaattattggtgagatatctgtatctggtgcaacgtacaagtccatggagtttgttggatcaactgtggaaagtctaaatatggaagagcgaatgacattgtgcaacatggttattgaagctggtggaaagaatggtgttgtgcctgctgatgaaactacatttaagtaccttgagggcaagacatccgttgattatgaacctgtctacagtgatgctcaggccagattttttagtgactatcgatttgatgtatccaaactggagccagtagttgccaagccacattcacctgacaaccgtgctctagcaagagaatgcaaagatgtcaagattgaccgagtctatattggttcttgcactggtggtaagacggaggacttccttgctgctgcaaaggtgttcttagcttcggggaagaaggttaaagtccccacgttccttgtccctgcgacacaaaaggtgtggatggacgtatatagcctccctgtaccaggatctggtggcaaaacttgctcccagatatttgaggaggctggatgcgacacaccagctagccctagttgtggtgcttgtttaggtggccctcgcgatacatatgcacgcatgaatgaaccgatggtctgtgtgtccacgacgaacaggaacttcccgggcaggatgggacacaaggaggggcagatctacttggcgtccccgtacaccgctgctgcctcggccctgacggggtatgtcacagatcccagggacttcctcatgtaacgaccttgaaaccacagagttcatgatgtaacagaatgcctgtattagtactgttttttttatgttgaaccttaatttagacgtgtctctggatgagaaataagcagtttttcttgctagcgactgcaaatcgggatgcacatggttttgcattattacagtgtactaccaagaacaaacatgattgttacagaaggaaaatgcattcatctacataccagcagcagcagcttttctcccctatgtgtagtgctacctctagttctaaaacactacttatgcgttcaagtggacagggagaacgatcaccgtcacgagatttctctcggttgtttagttcaaaaattagtatgcactgtgcatggttcttactgtccacatcagcaactgttagtctcaaatcagtatgcatggttgttattgtgcacatcagcactcaagtagagttttcgcagaacttgtttgttagcagcttacaaacttactatatatacaatggatatatgtacaaagagtcctgattgg

SEQ ID NO: 5093 - DNA, 1889 bp, Brachypodium distachyon
ccagtcgcccctctattgacctcagcctgttcgacgcttcgcccgcccgaccatggcctccatctccgccgccgccaaggcctccgccgcctccttcgcccacaagaaggagctcgccgccgcggcgccgcaccagcatcagcagcagcagcgggcgggcgcggcgcaccagggccaccggagagctagggtcggggggcgggtccgcgcggtcgcgaccccggcccgcgcgccgcgggccccggcgtccacgggctcggtgaaggctcccatgacgacgacggagaagatcctggcgcgggcgtcggagcgggccagactcgagcccggggagaacgtgtgggtcgacgtggacgtgctcatgacgcacgacgtctgcgggcccggcaccatcgggatcttcaagcaggagttcggggacgacgccaaggtctgggaccgcgagaaggtcgtcatcatccccgaccactacatcttcaccagcgacgagcgggccaaccggaacgtcgacatcctcagggacttctgcaccgagcaggagattaagtacttctacgacatcagggacctgagcgatttcagagctaatccagactacaaaggtgtttgccacattgcgcttgcccaagaaggccactgccgaccaggcgaggttctccttggtactgattctcacacgtgcaatgctggagcctttggtcaattcgcgactggaatcggaaacaccgatgcgggttttgtcatgggaactgggaaggctcttctcaaggtgcctccaactatcaggttcgtattagatggagaaatgccaccttatttactagcgaaggatctgatcttacaaattattggtgagatatcggtatctggtgcgacatacaagtccatggagtttgttggatcaacagtagaaagtctaacaatggaagaacgaatgacactgtgcaacatggttattgaagctggtggaaagaatggtgttgtgcctgctgataaaactacatttaaataccttgagggtaagacatcggtcgaatatgagcctgtttacagtgatgcccaggccagattttttagtgactaccggtttgatgtatccaaattggagccagtagttgccaagccacattcgcctgacaaccgagctctagcaagagaatgcaaagatgtcaagattgaccgagtttatattgggtcttgcactggtggtaagactgaggatttccttgctgctgcgaaggtgttcttagcttcaggcaagaaggtcaaagttcccactttcctcgtccctgcaacgcaaaaggtgtggatggacgtgtatagcctgcccgtaccaggctctggtggcaaaacctgctcccagatatttgaagaggctggttgtgatacaccagctagccctaactgtggtgcttgtttgggtggtcctcgcgatacatatgctcgcatgaacgaacctacggtctgtgtgtcgacgacgaacaggaacttccctggcaggatggggcacaaggaagggcagatctacctggcttccccctacaccgcggccgcctcggccttgaccggttacgtcacggaccccagggacttcctgatgtagtgatgctgaggcactggattggagctccttaccgagagacgctgcgacgcggattgttctgtaccagtacagcactgtttttcatgctcaagaatgtagtttagttgtgttcattgtgtgtcccgctgagaaataagttactacaccttccctagtagcaactgtaactgtctgaggttatgttttttcgcaaacattagcgaaagtatactatcaggaagaaacggtactgttacagctgccacacaagtggcattcttcttccaggacgatatgtttcactacc

SEQ ID NO: 5094 - DNA, 1969 bp, Zea mays
gtcctgtcaaggcctcaacacacacacacactctctcgcttgacctacccccctccgccccccgccgggcctgcagggtgttcgacgcttcgcccgcccgcccgcccgagcgccgccacggcatggcttcctccatctccgccgccgctaaggcctccgcggccttcgcccacaagaaggagctggccgcgccggcgccgcaccgcgcgggctcgagccgtcggaccaagccgtgccgcgtgcgcgccgtcgcgtcgcccgcgcgcaccccccgcgccccgtcgtccaccggctcggtgaagaccgcgatgacgatgacggagaagatcctggcgagggcgtcggagcgcgcggcgctggagcccggggagaacgtgtgggtggacatcgacgtgctcatgacgcacgacgtctgcgggcccggcaccatcggcatcttcaagaaggagttcggggaggatgccaaggtctgggaccgcgagaaggtcgtcatcatccccgaccactacatcttcaccagcgacgagcgcgccaaccgcaacgtcgatatcctcagggacttctgtctggagcagaacatcaagtacttctatgatatcaaggacctcagcgatttcagggctaatccagactacaagggtgtctgccacattgcacttgctcaggaaggccactgccgaccaggcgaggttctcctgggtactgattctcatacgtgcaatgctggagcctttggtcaatttgcaaccggaattggaaacactgatgcaggttttgtgatgggcactggaaaggctcttctcaaggtgccacctactatcaggtttgtattagatggagaaatgccgccttatttacttgcgaaggatctgattttgcaaattattggtgagatttcagtatctggtgcaacctacaaatcgatggagtttgttggatcaactgtagaaagtctaaccatggaagaacgtatgacactatgcaacatggttgttgaagctggtggaaagaacggtgtcgtgcctgctgatgaaactacatttaaataccttgagggtaggacatcagttgattatcaacctgtctacagtgatgctgaggccagattttttagtgactaccggtttgatgtatcgaaactggagccagtagttgccaagccacattcgcctgacaaccgtgccctagcaagagaatgcaaagatgtcaagatcgaccgagtctatattggttcctgcactggtggcaagactgaggacttccttgctgccgcaaaggtgttcttagcctcgggaaagaaggttaaagttcccacattccttgtccctgccacacaaaaggtgtggatggacgtatatagccttcctgtaccaggatctggcggcaaaacttgcgcccagatattcgaggaggctggttgtgatacaccagcaagtcctaattgcggcgcttgtctgggtggccctcgcgatacgtatgcacggatgaatgaacctacggtctgcgtgtccaccacgaacaggaacttcccgggcaggatggggcacaaggaagggcagatctacctggcgtccccctacaccgctgcagcctcggccctgacggggtacgtcacggaccccagggacttcctcatgtgaacgatcttgaaacagccacagagtgcctgcaccgctgttttttgtgttgaaccttagtttaggcgtgtgcccttcgttgagaaataaactcccatgtcgggaggctgccattgccatttatgttttttgcgttatatttattacagtgactgccgataacgtagttgagcgttacaagggaaatacattcattctttccagtatcgatggcagtcactagactccgttcttacaaaaaaaaggcatgtcgagagatcttgtagttcatacacttgttaaaacacttttttgtacaatgtatgggaaagaagctcagtcgatctttcttg

SEQ ID NO: 5095 - DNA, 1951 bp, Avena sativa
acacgcccgcctcgtggtcgccacgcccgcacaaaccccaatccctgtattgacctcaaggtgttcgaccgcgcgcgccgccatggcctccatctccgccgccgccaaggcctccgccgccttcgcccataagcatgagttcgccacggcggcgccgccgccgcagcagcagcgcacgagcgcgaggagccggccggcgcgggacgggcgcgtccgagcggtcgctacgcccgcccgcgcgccgcgcgcccccgcgtccaccggctcggtgaagatccccatgacgacgacggagaagatcctggcgcgggcgtcggagcgcgcgagcctcgagcccggggagaacgtctgggtggacgtcgacgtgctgatgacgcacgacgtctgcggccccggcaccatcgggattttcaagcaggagttcggggaggacgccaaggtctgggaccgcgagaaggtcgtcatcatccccgaccactacatcttcaccagcgacgagcgggccaaccggaatgtcgatatcctcagggacttctgcaacgagcagaagattaagtacttttacgacatcaaggaccttagcgatttcagagcaaatccagactacaaaggtgtttgccacattgcactcgctcaagaaggccattgccgaccaggcgaggttctccttggtaccgattctcacacgtgcaatgctggagcctttggtcaatttgcaactggaattggaaacactgatgcaggatttgtgatgggaactgggaaggctcttctcaaggtgcctccaactatcaggttcatattagatggagaaatgccaccttatttacttgcaaaggatctgattttacaaattattggcgagatatctgtatctggtgcaacatacaaatcgatggagtttgctggatcaactatagaaagtctaactatggaagagcgaatgacactatgcaacatggtcattgaagctggtggaaagaacggtgtcgtgcctgctgatgcaactacatttaagtaccttgagggtaagacgtctgtcgaatacgaacctgtttacagtgatgctcaggccagatttgttagtgactaccggtttgatgtatccaaattggagccagtagttgcgaagccacactcacctgataaccgtgctctagcaagagaatgcaaagatgtcaagatcgaccgagtttatattggttcttgcactggtggtaagactgaggatttccttgctgctgcgaaggtgttcttagcttcaggcaagaaggttaaagttcccacttttcttgtccctgcaacacaaaaggtgtggatggatgtatatggcctcaccgtaccaggatcagacaaaacatgcgcccagatatttgaggaggctggttgtgatacaccagctagccctaactgtggtgcttgcttgggtggtcctcgtgatacatatgctcgcatgaatgaacctacggtctgcgtgtcgacgacgaacaggaacttccccggcaggatggggaacaaggaagggcagatctacctggcctcgccctacactgcggcggcatcagccttgacaggatatgtcgcggaccccagggacttcctggtgtagtgaagttgaaaccttggattggagctcctcaccgtgggttgcgaattgttctgtaccagtactctgttttttggtgttggaaagtgtagttttagatggtgagaataagttacttttcaagtagcagttgtaactgggagaggtttttggatgtatgcttttcctccgctggcattaacgagtgtactactgtcagtaacaaacattattgtcacaaatggctttattacaggatgatacagtatattactctatctaagatacagagtgcgctaggtgctgtgtcaatttccaatgtaggaatgcatatccatcagagtacgcatgttatgtgatcaaggt

SEQ ID NO: 5096 - DNA, 1903 bp, Zea mays
gttctaccaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatggcctcctccgtctccgccgccgccaaggccgccgcggcgttcgcgcacaaggtccagaaggagctggccgcgccggcgcagcgccgcgcgggcttgacccgccggaccaagccgtgcagcgtgcgcgccgtcgcttcgcccgcgcgcgccctgtcgtccaccggctcggtgaagagcgcgatgacgatgacggagaagatactggcgcgggcgtcggagcgcgcggcgctggagcccggggagaacgtgtgggtcgacgtcgacgtgctcatgacgcacgacgtctgcgggcccggcgccttcgacatcttcaagaaggagttcggggaggacgccagggtctgggaccgcgagaagctcgtcgtcatcccggaccactacatcttcaccagcgacgaccgcgccaaccgcaacgtcgacatcctcagggacttctgtgcggagcagaacatcaagtacttctatgacatcaaggacctcagcgatttcagggctaatccggactacaaaggcgtctgccacatcgcacttgctcaggaaggccactgccgaccaggcgaggttctcttgggcactgattctcatacatgcaatgctggagcttttggtcagtttgcaactggaatcggaaacactgatgcaggttttgtgttgggcactggaaaggctcttctcaaggtgccacctactatcaggtttatattagatggagagatgccgccttatttacttgcgaaggatctgattttgcaaattattggagagatttcagtatctggtgcgacctacaaatcaatggagtttgttggatcaactgtagaaagtctaaccatggaagagcgtatgacactatgcaacatggttattgaagctggtggaaagaacggtgttgtgcctgctgatgaaactacatttaaataccttgagggtaagacatcagtcgattatgaacctgtctacagtgatgctcaagccagattttttagcgactaccggtttgatgtatcaaaactggagccagtagttgccaagccacattcgcctgacaaccgtgctccagcaagagaatgcaaagatgtgaagatcgaccgagtctatattggttcttgcactggtggtaagaccgaggatttccttgctgctgcaaaggtgttcttagcctcgggaaagaaggttaaagttcccacatttcttgtccctgccacacaaaaggtgtggttggacatatatagcctccctgtaccaggatctggtggcaaaacttgctcccagatatttgaggaggctggttgtgacacaccagcaagtcctaattgtggtgcttgtttgggtggccctcgtgatacatatgcacggatgaatgaacctactgtctgcgtgtccaccacgaacaggaactttccgggcaggatggggcacaaggaagggcaaatctacctggcgtctccctacactgcggctgcctcagccctgacggggtatgttacggaccccagggacttcctcatgtaaccgtcttgaaacaacaacagatttcatgatgtaacagagtggttgtactgctgtttttcgtgctgaacttttgtctaggcatgtccttcgttgagaaataaactgcactagaataagcagcgacttctcgggagccatagcagatgtgacctcatatttatttgtgcaactttttttgtttttggctctgaagtcatgcaaggaaaccacataaaagagtgatttatgtatgtgtcagaatcaaacaat

SEQ ID NO: 5097 - DNA, 1732 bp, Pennisetum glaucum
cgacgcagcaccgcgcgggctcgggccgccgtaccaagccgtgccgcgtgcgcgccgtcgcctcgcccgcgcgcgcgccccgcgccccggcgtccaccggctcggtgaagacctcgatgacgatgacggagaagatcctggcgcgcgcgtcggagcgcgcggcgctggagcccggggagaacgtgtgggtgggcgtcgacgtgctcatgacgcacgacgtctgcggccccggaaccatcggcatcttcaagaaggagttcggggaggacgccaaggtctgggaccgcgagaaggtcgtcatcatcccggaccactacatcttcaccagcgacgagagggccaaccgcaatgtcgacatcctcagggacttctgcaaggagcagaacatcaagtacttctatgacataaaggacctcagcaatttcaaggctaatccggactacaaaggtgtctgccacgttgcacttgctcaagaaggccactgccgaccaggcgaggttctgcttggcactgattctcatacatgcaatgctggggcctttggtcaatttgcaactggaatcggaaacaccgatgcaggttttgtgttgggcactggaaaggctcttctcaaggtgccaccaactataagatttgtactggatggagaaatgccaccttatttactcgcaaaggatctgattttgcaaattattggtgagatttctgtatctggtgcaacctacaaatccatggagtttgttggatcaaccatcgaaagtctaaatatggaagagagaatgacattgtgcaacatggttgttgaagctggtggaaagaatggtgttgtgcctgctgatgtgactacatttaaataccttgagggcaagacgtcagttgaatatgaacctgtctacagtgatgctcaggccagattttttagtgactatcggtttgatgtatccaaactggagcctgtagttgctaagccacattcacctgacaaccgtgctctagcaagagaatgcaaagatgtcaagattgaccgggtctatattggttcttgcactggtggtaagacagaggacttcgttgctgctgcaaaggtgttcttagcttcgggcaagaaggtcaaagttcccacattccttgtccctgcgacacaaaaggtgtggatggatgtatatagcctccctgtgccaggatctggtggcaaaacttgctcccagatattcgaagaggctggttgtgacacaccagctagccctagttgtggtgcttgcttaggtggtcctcgcgatacatatgcacgcatgaatgaaccaatggtctgtgtgtctacgacgaacaggaacttcccaggcaggatggggcataaggaggggcagatctacctggcgtccccctacactgcggccgcctcggccctaacggggtatgtcacagaccccagggacttcctcatgtaacgaccttgaaatcacagagttcataatgtaacagaacgcctgtattaccccttttttcgtgttgaaccttagtttagacgtgtctctggttgagaaataagcagttttcccttaccggcgactgcaaatcgtgagttttggggtgtatggttttgcataattatcgagtgtggtatgaaggacaaacaagactgttgtgcaagggaaatgcattaatctaccagtccagcagctcctccacaaatcctgtgacttatgatctcctgcgtgtagttactcattgt

SEQ ID NO: 5098 - DNA, 1715 bp, Avena sativa
cataagcaggagttcgccgcgacggcggcgccgccaccgcagcaacagcgcgcgagcgcgaggagccggccggcgcgggacgggcgcgtccgagcggtcgctacgcccgcccgcgcgccgcgcgcccccgcgtccaccggctcggtgaagatccccatgacgacgacggagaagatcctggcgcgggcgtcggagcgcgcgagcctcgagcccggggagaacgtctgggtggacgtcgacgtgctgatgacgcacgacgtctgcggccccggcaccatcgggattttcaagcaggagttcggggaggacgccaaggtctgggaccgcgagaaggtcgtcatcatccccgaccactacatcttcaccagcgacgagcgggccaaccggaatgtcgatatcctcagggacttctgcaacgagcagaagattaagtacttttacgacatcaaggaccttagcgatttcagagcaaatccagactacaaaggtgtttgccacattgcactcgctcaagaaggccattgccgaccaggcgaggttctccttggtaccgattctcacacgtgcaatgctggagcctttggtcaatttgcaactggaattggaaacactgacgcaggatttgtgatgggaactgggaaggctcttctcaaggtgcctccaactatcaggttcatattagatggagaaatgccaccttatttacttgcaaaggatctgattttacaaattattggcgagatatctgtatctggtgcaacatacaaatcgatggagtttgctggatcaactatagaaagtctaactatggaagagcgaatgacactatgcaacatggtcattgaagctggtggaaagaacggtgttgtgcctgctgatgcaactacatttaagtaccttgagggtaagacgtctgtcgaatacgaacctgtttacagtgatgctcaggccagatttgttagtgactaccggtttgatgtatccaaattggagccagtagttgcgaagccacactcacctgataaccgtgctctagcaagagaatgcaaagatgtcaagatcgaccgagtttatattggttcttgcactggtggtaagactgaggatttccttgctgctgcgaaggtgttcttagcttcaggcaagaaggttaaagttcccacttttctcgtccctgcaacacaaaaggtgtggatggatgtatatggcctcaccgtaccaggatcagacaaaacttgcgcccagatatttgaggaggctggttgcgatacaccagctagccctaactgtggtgcttgcttgggtggtcctcgtgatacatatgctcgcatgaatgaacctacggtctgcgtgtcgacgacgaacaggaacttccccggcaggatggggaacaaggaagggcagatctacctggcctcgccctacactgcggcggcatcagccttgacaggatatgtcgcggaccccagggacttcctggtgtagtgtgaagttgaaaccttggattggagctcctcactgagaaaccgtgcgttgcgaattgttctgtaccagtactctgttttttggtgttggaaagtgtagttttagatggtgagaataagttacttttcaagtagcagttgtaactgggagggttttttggatgtatgcttttccgctggcattaacgagtgtactactatcagtaacaaacattactgtcacagagtcac

SEQ ID NO: 5099 - DNA, 1558 bp, Echinochloa colona
cccgcccgcgcgccgccactccagccatggccgcctccgtctccgccgccgccaaggcctccgccgccttcgcccacaagaaggagctcgccgcggcgccgcggcgacggcgcagcaccgcgcgggctcgggccgacggagcaagccatgccgcgtgcgcgccgtcgcatcgcccgcgcgtgcgccccgcgctccggcgtccaccggctcggtgaagagcgcgatgacgatgacggagaagatcctggcgcgggcgtcggagcgcgcggcgctggagcccggggagaacgtgtgggtggacgtcgacgtgctcatgacgcacgacgtctgcggccccggcaccatcggcatcttcaagaaggagttcggggaggacgccaaggtctgggaccgcgagaaggtcgtcatcatcccggaccattacatcttcaccagcgacgagcgggccaaccgcaatgtcgatatcctcagggacttctgtatggagcagaacatcaagtacttctatgacatcaaggacctcagcaatttcagggctaatccagactacaaaggcgtctgccatgttgcacttgctcaagaaggccactgccgaccaggcgaggttctccttggtactgattctcacacgtgtaatgctggagcctttggtcaatttgcaactggaattggaaacacggatgcaggttttgtgttgggcactggaaaggctcttctcaaggtgccaccaactattaggtttgtactagacggagagatgccaccttatttactcgcaaaggatctgattttgcaaattattggtgagatttctgtatctggtgcgacctacagatccatggagtttgttggatcaactgtggaaagtctaaatatggaagagcgaatgacattgtgcaacatggttattgaagccggtggaaagaatggtgttgtgcctgctgatgaaactacatttaaataccttgagggcaagacatcagttgattatgaacctgtctacagtgattctcaggccagattttttagtgactatcggtttgatgtatccaaactggagccagtagttgccaagccacattcacctgacaaccgtgctctagcaagggaatgcaaagatgtcaagattgaccgagtctatattggttcttgcactggtggtaagacagaggacttccttgctgctgcaaaggtgttcttagcttcgggcaagaaggttaaagttcccacgttccttgtcccagcgacacaaaaggtgtggatggacgtatatagcctccctgtaccaggatctggtggcaaaacttgctcccagatatttgaggaggctggatgcgacacaccagctagccctagttgtggtgcttgtttaggtggccctcgcgatacatatgcacgcatgaatgaacccatggtctgcgtgtccacaacgaacaggaacttcccgggcaggatggggcacaaagaggggcagatctacctggcgtccccctacaccgcggccgcctcagccctgacgggttatgtcacggaccccagggacttcctcatgtaacga

SEQ ID NO: 5100 - DNA, 1622 bp, Avena sativa
cgaggagccggccggcgcgggacgggcgcgtccgagcggtcgctacgcccgcccgcgcgccgcgcgcccccgcgtccaccggctcggtgaagatccccatgacgacgacggagaagatcctggcgcgggcgtcggagcgcgcgagcctcgagcccggggagaacgtctgggtggacgtcgacgtgctgatgacgcacgacgtctgcggccccggcaccatcggaattttcaagcaggagttcggggaggacgccaaggtctgggaccgcgagaaggtcgtcatcatccccgaccactacatcttcaccagcgacgagcgggccaaccggaatgtcgatatcctcagggacttctgcaacgagcagaagattaagtacttttacgacatcaaggaccttagcgatttcagagcaaatccagactacaaaggtgtttgccacattgcgctcgctcaagaaggccattgccgaccaggcgaggttctccttggtaccgattctcacacgtgcaatgctggagcctttggtcaatttgcaactggaattggaaacactgacgcaggatttgtgatgggaactgggaaggctcttctcaaggtgcccccaactatcaggtttgtattagaaggagaaatgccaccttatttactcgcgaaggatctgattttacaaattattggtgagatatctgtatctggtgcaacatacaaatcgatggagtttgttggatcaactatagaaagtctaactatggaagagcgaatgacactatgcaacatggttattgaagctggtggaaagaatggtgtcgtgcctgctgatgcaactacattcaagtaccttgagggtaagacttctgtcgaatacgaacctgtttacagtgatgctcaggccagatttgttagcgactaccggtttgatgtatccaaattggagccagtagttgcgaagccacactcacctgataaccgtgctctagcaagagaatgcaaagatgtcaagattgaccgagtttatattggttcttgcactggtggtaaaactgaggatttccttgctgctgcgaaggtgttcttagcttcaggcaagaaggttaaagttcccacttttctcgtccctgcaacacaaaaggtgtggatggatgtatatggcctcaccgtaccaggatcagacaaaacttgcgcccagatatttgaggaggctggttgtgatacaccagctagccctaactgtggtgcttgcttgggtggtcctcgtgatacatatgctcgcatgaatgaacctacggtctgcgtgtcgacgacgaacaggaacttccccggcaggatggggaacaaggaagggcagatctacctggcctcgccttacactgcggcggcatcagccttgacaggatatgtcgcggaccccagggacttcctggtgtagtgaagttgaaaccttggagtggagctcctcactgagaaaccgtgcgttgcgaattgttctgtaccagtactctgttttttggtgttggaaagtgtagttttagatggtgagaataagttacttttcaagtagcagttgtaactgggagaggtttttggatgtatgcttttccgctggcattaacgagtatactac

SEQ ID NO: 5101 - DNA, 2355 bp, Ananas comosus
gccctagataattttgaccgacgtcccccaaaaccactgagccatggtttcccgaagcacacacgtctctatcgttcccaaatttccacaacctcgtccataattttcgattcgatccctaaaacaaagatccaatttttcctaccccatcgtctccaaaatcgcaccttgttctcgtagaggtgaataacgagcaatccgagctcgaatccatggcttcgctcctcgcggcttcgaaatgctctttctttaaccctaagaaggaattcgatattggctcgtccttttccccctcaattagtgctcacagatgtcgcagacgtgcaatgagaaaggtccttgccgtcatggcaccgccggccccatcgccgcgttctccagctacaaccggttcggtaaagcattcgatgactatgacggagaagatcctggctagggcgtcggagcggtcgcagttggagccgggagagaatgtgtgggttaatgtggatgttttgatgactcatgatgtgtgtgggccggggacaatcgggatatttaagagagaattcgggcagaatgcgaaggtttgggaccgcgaaaagatcgtgattataccagaccactacatttttaccagtgatgagcgtgcaaacaggaatgtggatatcttgagggacttctgtagtgagcaaaatattaagtacttttacgatataaaggatctaagtaatttcaaggttaatccggattataaaggtgtatgccatgttgccctcgcccaagaaggtcactgtagacctggtgaggttttgcttggcactgattcccacacatgtaatgctggagctttcggccaatttgccacaggaattggcaatactgatgcaggtttcgtgatgggcactgggaaagttcttctaaaggtaccacctacaatgaagttcatactggatggagaaatgcctgattatttacttgccaaggatttaattttgcaaatcattggtgaaattactgttgccggtgcgacatacaaatctatggaattcgttggctcaactgttgagagcttaactatggaagagaggatgacattgtgcaatatggttgttgaagctgggggaaagaatggagtagtccctgcggatgaaactacatttaagtaccttgaggataagacatctgtgaaatatgaaactgtttatagcgatgacaatgccagatttatcagtgactacaagtttgatgtttccaagttggaaccactggtcgcgaagcctcattcacctgataatcgtgctctggcaagagaatgcaaagatgtcaaaatcgacagggtttacattggttcttgtactggtgggaagaccgaggattttctagctgctgcgagggttttcctagcttccgggaaaaaggtcaaagttcccacttttcttgtccctgcaacacaaaaggtatggatggacatatatagcctccccgttccggggtctggcggcaagacttgctctcaaatattcgaggaggtcggctgtgatgttccggctagccctagttgcggagcttgtttgggaggtccccgagacacttatgcacggatgaacgaaccgcaggtttgcgtgtcgaccacaaacaggaacttccccggcaggatgggccacaaagaagggcagatctatttggcttcgccgtacacggccgcggcttcagcgctgacgggctttgtcaccgacccaagggagttccttatgtagacaaaaaagctttcgcgttcatcgacactcgtccaccttaacttatatgcgcatgtagtgagatggaatgcatgttgataatgatttttctgctgttggttacagctcaatctgatcttctgtacaatggtcgagagtcatcctaaatacttcctgcaaatttttatctagctaaaaacgttttaatgatttttgatgccagtgcagttttctaagtggttgagaatggtgatctttcctctaagtaaggcctcatttgtatcattagttcttataaaaacataaattcaatgtgatagagtgcgccggcagatgctagattgtttgtaatttctaatctgcggagtttgtctggcaacagagaataagattgtgctagtaacttttctttttatatttttgcgacaatattatgtttcttgtgttaccttattaactttttctctcttaattttgtgtgctaattccaaatgaatatcttggaatgagttttagttttgcttcttgaaagatcttagtacttatgattgcacatgataacatatttcacctgtgagttataggccgtatattgtattgattttggaccactaatctatcaaatactgtatgtttt

SEQ ID NO: 5102 - DNA, 1932 bp, Chelidonium majus
ttcttcagtacctcaatcatggcttcttctgcaattgcttccagctccacatctttcattaaaaagaacgaaataggtctatcttcttttactccaacttcgtttcctattcaaagatgcaacagaagagctttgtcaaagaaagttgtttcagtcatggcgccaccacagtcggatcgccgaccttccaccactggttcagtgaaaactgcaatgacgatgacagagaagatcatggctagggcttctgagaggtcccatgtggttccaggtgagaatgtctgggtcaacgttgatgtgttgatgactcatgatgtttgtggacctggaacaattgggattttcaagaaagaattcggcgaaaatgctaaggtttgggaccgtgagaagattgtaattattcccgaccactatatattcacgagtgatgaacgtgcaaatcgtaatgtcgacatcttgagggatttttgcggggagcaaaatatcaagtacttttatgatatcaaggatcttggtaatttcagggctaacccagattataaaggtgtgtgccatgttgctctggcacaggaaggtcactgcaggcctggggaggttctgctgggtacagactcccacacatgcaatgctggagcatttggccagttcgctactggaattggtaacactgatgcaggctttgtaatgggcacggggaagtctcttcttaaggtgcccccaactttgagatttgtactggatggagagatgccaaatcacttgcttgccaaggatttgattttgcaaattattggtgagataactgtcgctggtgcaacatataaatctatggagtttgttggctctactgttgaaagtttaactatggaggaaagaatgacattatgcaacatggttgttgaagctgggggaaagaatggtgttgttcctgctgacagtactacatataaataccttgagggtaagacatcagtggagtttgaaccagtttatagtgatgataatgcaagattcattgctgagtacagatttgatgtctccaaactggaaccggtggtggcaaagccacattctcccgacaatcgtgctttggcaagagaatgcaaagatgtaaaaatagacagagtatatataggttcatgtactggtggaaagaccgaggattttctagctgcagcaaaagtgttccttgcatcgggcaagaaggttaaagtgccaactttccttgttcctgccactcaaaaggtttggatggatttatatggcatggaagttccaggatctggtggcaagacatgctcacagatatttgaagaagcaggctgtgatacacctgcaagtcccagttgtggagcttgtttaggtggtcctagagatacttatgcacgtatgaatgaacccaaggtctgtgtgtcaacaacaaacaggaacttccctggccgaatggggcacaaagaaggcgagatatatcttgcttccccttatacagcagcagcatctgctttgacaggtttcgtcaccgacccaagagatttcttgcagtaaccaccatacacccgtcactgggtatgttatcagttattactctgtactgctctaaattttatcaacatgctcaaggttttttgtattggtgactatatttttgaagtcggaactgaataaacttatagaccaaaagaagctattcctatcagagtgcagataggaagtctagtaagggacctctacggaaaccactatctatgccttaaaactcaaccatgtctggaaccctgtacacctgtttgtagtatttcgtttaacgttagtgaagaaggtacgaatttgttttgaactatcgagtttagtggattgaactgtgtaagagaaacatgatctgataaaaactaattgttggttttttatctacctttactgtaacttttgtgt

SEQ ID NO: 5103 - DNA, 1810 bp, Phaseolus vulgaris
tgttcatcactgcttcaacatcgataatccatggcttcctctcttctctctccatcattttcttccttcctccgcaccaagaaggatctccctctctacgctttctcctctcagagatgcttcaaagcggttccaaagcgaatccgttgttctgtggcggcgcctcagcgccagccttctaccactggatcagtgaggaccgcaatgaccatgactgagaagatattggccagagcttctgagaaggcccagttgagccctggggataatgtttgggtcaatattgatgttttgatgacacatgatgtttgtgggcccggttctattgggattttcaagagggagtttggtgaggatgccaaggtttgggatcgtgaaaaggttgtaataatacctgatcactatatattcacaagtgatgaacgtgccaatcgcaatgtggacatattaagagatttctgccaggagcaaaatataaaatatttttatgatattaaggatcttggtaattttaaggcgaatccagactataagggtgtttgccatgttgctcttgctcaggaaggtcattgtaggccaggagaggttctcttaggtactgattcccacacttgtactgctggagcatttggtcaatttgctactgggattggtaatactgatgctggttttgtgcttggaactgggaagcttctgctcaaggtgcccccaactttgagatttgtaatggatggagaaatgcccgattatttgctttcaaaggatttgattcttcaaattattggtgaaataagtgtggccggtgcaacatataaagctatggagtttgtcggtacaactgttgaaagtttaagtatggaagaacggatgacattgtgcaacatggttgtcgaagctggtggaaagaatggtgttgttcctgctgatagcactacatttaaatatattgagggcaagacatctctgccatatgagcctgtttatagtgaccagaaagcaagatttctatcagagtatagatttgatgtctcaaaattggagccagtggtggccaagcctcattctccagataaccgtgctttggcaagagagtgcaaggatgtgaaaattaacagagtatacataggatcttgtacaggtgggaaaacagaggatttcatggctgcagcaaaagtttttctggcatcaggtaaaaaggtcaaagttcccacatttcttgtgcctgctacccaaaaggtttggatggacgtatacaccattccagttcctggatctggtggtaagacttgctcacagatatttgaagaagctgggtgtgacacaccagctagtcctagttgtggtgcttgtttgggtggcccaaaagatacttatgcacgcatgaatgaacctcaggtttgtgtttcaactacgaacaggaacttcccaggccgaatgggacacaaggaaggtcaaatatatttggcttcgccatatacagctgctgcatctgcattgaccggttatgttactgatcctagagagttcttgcagtaggattttgttacaccccattctagtatacaagttggttagttgtgtattctctagccacgaggtagtaccattagtattttttgcctgaagaaattgtatggaacttctatgaaattgacactgttgtagatgttgaagaagaagattgattcatcttgtgcttgttgagtatagcatgatcattactgttgcagttacaagaatgactgatttcatatggattttcatgtcaatcaatccagcttttcatgtcaatcgattgctccatcatgaa

SEQ ID NO: 5104 - DNA, 1976 bp, Eucalyptus grandis
acgccgccccctcccttttttccttctctctctgtcgcgtcgccgtcgccacaaaaaaagggcgctgctttcatcgccgcatcacctccgcaccgccaccacaatccgccatggcgtcctccgccgcgttttctccggccgcggcgtccttcgccgccgtcaagaaggagtttggcctctcccggtccgtcgcctcccggccattcccctccgccgggaagtcgaggaaaccggcctcgaagaggatcgtctccgtcatggcgcctcagcagacggagcgcaagcccgccgccaccggctcggtgaaaaatgcgatgacgatgaccgagaagatattggctcgggcttctgagaagccagagttgagccccggggagaacgtttgggtcgatgtcgatgtcttgatgacgcacgacgtctgcggccccggttctttcggtatcttcaagaaggagtttggtgagaatgctaaggtctgggatcgcgaaaagattgtcatcattcctgatcattatattttcacaactgatgaacgtgcaaatcgcaacgtggatattttgagagatttttgcaaagagcagaatatcaaatacttctatgatatcaaagaccttagcgacttcaaggttaaccctgactacaagggtgtgtgtcatgttgctcttgcccaagaaggtcattgcagacctggtgaggttctgttaggtactgactctcacacctgtactgctggagcttttggccagtttgccactggtattggcaacacagatgctggctttgttttgggggctgggaagatcctgctcaaggtgcctcctactttgagatttgtgatggatggagaaatgcctgagtatttgctggcaaaagatttgattttgcaaattattggagaaatatcagtgtctggtgccacctataaatcaatggaatttgttggttctactgtcgaaagtttaaatatggaagagagaatgacattgtgcaatatggttgtggaagccgggggtaagaatggtgtggttcctgcagatagcacgacatttgagtaccttaaggataagacatcaaagccctatgaaccagtttacagtgacgagaaagccagatttctatctgagtaccgttttgacgtctcaaagttggagcccatggttgcaaagcctcattctccagataaccgcgccttagccagagaatgcaaagatgtgaagatagacagagtatacattggatcttgtacggggggtaaaactgaggatttcctagctgcagcaaaagtttttcttgcttcagggaagaaggtcaaagttcccactttccttgtacctgctacacaaaaggtgtggatggacatatatgccctgccagtacccggatctggtggcaaaacttgctcccagatatttgaagaggcaggttgtgacacacctacaagtcctagctgtggtgcttgtttaggtggccctagagatacttatgctcgtttgaatgaaccccaggtctgtgtatcaacgacaaacaggaacttccctgggcgtatgggccacaaggaaggccagatctatctagcctccccgttcactgcagctgcgtctgctttgaccggttacgttacagatcccagagatttcttgcagtaaacaatggcaagattaagatggctaatccatgcaccaccactctttataacttgaaggttagattcagtggtggatgatagctgttctgttgtgcattatgtggtgtttctaaataagcttttctaccgagagaggacacttttgagggattgatgttcatgagcagtaatgcctgcataatatggctcataggaagtacatggctgtgatgcagatgtattaggaggaaatgttatttggttttgaaatgaacaaaaagatcagaagaattaatctcgtgctgttattgctttctaactgctgggtttggtccaaaagcatcttcattca

SEQ ID NO: 5105 - DNA, 1922 bp, Theobroma cacao
tctgcgcttgcgccgcctctatttcagacagcatacagaaaatcaacagccctttcctccttttacatttctctgatcattaaatagtagggctgagtctaatggcatcctctttggtttctccttctccaacttcttccttcatcagcaacaagaaagatttgggcttctctgcttttccttcgacatctcaagttgctattcgcaaatgcaagaaacaagtttccaagcaaatcgtctcagtcatggcaccccagcaatcagagcgtaaaccagccaccaccggctctgtgaagactggaatgacaatgacagagaagattcttgccagggcctctgagaaaccacagttgagcccaggtgataatgtttgggttaatgttgatattctgatgacacacgatgtttgtggccccggttccattggtatctttaagaaagaatttggtgaaaatgctaaggtttgggaccgtgaaaagattgttattatacctgaccattatatattcacaagtgatgaacgtgcaaatcgtaatgtggatattttgagggatttttgcaaggaggaaaatatcaagtatttttatgatattaaagatcttagcaattttaaggctaaccctgattataaaggtgtatgccatgttgcacttgcccaagaaggtcactgcaggcctggggaggttttgttagggacagattctcacacctgtactgctggagcatttggtcaatttgctacaggaataggaaatacagatgcaggctttgtcttgggcactgggaagcttctgctcaaggtgccaccgactttgagatttgtgatggatggtgaaatgcctcactatttgcttgcaaaggatttgattttacagatcattggtgaaatatctgtagctggtgcaacatataaatccatggagtttgttggaacaactgttgaaagtttaaacatggaagaacgtatgactttatgcaatatggttgttgaagctggtggaaagaatggtgttgttcctgccgatagtactacatttaagtaccttgaggataaaacatctgtgccatatgaaccagtttatagtgatgcacaagcaagttttctttccgagtacagatttgatatctcaaaattggagcccttggtggctaagccacattctcctgataatcgtgctctggcaagagaatgcaaagatgttaaaattgacagagtgtatattggatcttgtactggtggaaaaacagaagattttcttgctgctgctaaagtgtttctagcttcaggtaagaaggtcaaagttcccacattccttgtccctgctacacaaaaggtttggttggacatatatactctccctgtaccaggagctggtgggaagacgtgctcccagatatttgaagaagctggctgtgatacacctgcaagccctagctgtggtgcttgtttgggtggccctaaagacacatatgcacgcatgaatgaacctaaggtttgtgtctccacaacaaacaggaacttccctggtcggatgggacacaaggaaggccagatatatcttgcttccccatatacagcagctgcatcagccttgactggttatgtcactgatccaagggagtttttgctgtagagactttgagtaacttgtataagtttaatgtataacaggagagaaaatggagctctagtgttggataccattgtgctaatgatgtaagattttgtttagtatctcctttcttcatttttggtgtatttatgccagaaatacaaaattggaacatctctttcttaagcttgaataataatgttatttggtagcatggtgaaggatgtttgtgcgagtatccgaacaggagattctggattattagtatttgttcacttggacgaaaaacacctataagaacaattttcc

SEQ ID NO: 5106 - DNA, 1945 bp, Manihot esculenta
atgcttgacaaagtatttaaaggtgggccccaaaaaagcaggcacgttaaggccacaagtcgaaggaggagctgtccttttacagccgcctcaaaaactttccgtgcatccaaacacgggttttggaattctggagatctcccaaccttaacccagccacccatcgttgtcatggcttcctccaccattctccctgcctcctattccttcttcgccaacaagaaggatctgagactctctgatttctcttcaacttcatcgccattgtctattcccaaatgcaggaaatcaatttccaagaaaattgtatctgtcatggctccccagcaatcagagcgcaagcctgcctctactggctcagtgaagaccgcaatgacaatgacggagaaaatattggcgaggtcctcagagaagcctcagttgagcccaggtgacaatgtctgggtcaatgttgataccttgatgacacacgacgtttgtggcccaggttccattggaatcttcaagagagagtttggagagaatgctaaggtatgggatcgtgagaaaatcatcattataccagatcattatatattcactagtgatgaacgtgcaaaccgaaatgttgatatattgagggatttctgcctggagcaaaatataaagtacttctatgatatcaaggatcttagtaactttaaggttaatcctgattataaaggtgtatgccatgttgcacttgcccaagaaggtcattgtaggccgggcgaggtcctgttaggtacagactctcatacctgcacttctggagcatttggccaatttgctactggaattggcaacaccgatgctggttttgtattaggcactgggaagctcctgctcaaggtccctccaaccctgagatttgtattggatggtgaaatgcctgattatttgcttgcaaaggatttgattttgcagattattggtgaaatatctgtgtctggtgcaacatataaatcaatggagtttgtgggcaccactgttgagagtttaaatatggaagaacggatgacattatgtaacatggttgttgaagctgggggcaagaatggggttgtccctgctgatagcactacattcaagtaccttgaggataagacatctgtgccctatgaaccagtttatagtgatgagcaagcaagatttctctctgagtacagatttgatatctcaaacttggaaccattggttgctaagcctcattctcctgataatcgcgctttagcaagagaatgcaaagatgtcaaaatagatagagtatacattggatcctgtactggggggaaaacagaggattttatggctgctgccaaagtttttctagcttcaggtaaaaaggtcaaggttcccacgtttcttgtccctgcaacccaaaaggtgtggatggatgtgtatagtctcccagtaccaggatctggtggcaaaacttgctcacagatttttgaagaagctggttgtgatacgcctgcaagtcctagttgtggtgcttgtttgggaggccctaaagacacttatgcaagaatgaatgaaccaatggtctgtgtgtcaaccacaaacagaaacttcccagggcggatgggacacaaagaaggccagatatatcttgcttccccatatacagctgcagcatctgctttgactggttatgtcactgatccgagggagttcttggagtaggttatttacgttgtatactcttaccattgttagaatacttcaaatggtggattagaaacaagataatacgagtctgttgtacgaggtcttacaaatatctgtgtgcgataattcttaggggttggtggttttaccacgcaagtgcagagttaatgtaaaccatttattttgaggctaattatatgcagtaacatggtaaaatgcttgcacaataaatggtgggacacgttgtcctggattt

SEQ ID NO: 5107 - DNA, 1684 bp, Glycine max
gccgccacctattcttttgttcatcacatattcaatggcttcctctcttctctctccatcatttacatccttcctccgcaccaaggatctctctctctctgctttcacttctcagcgatgcttcaaagcggtgccaaggaaaataatccgttgtgctattgcggcgcctcagcgccaaccttccaccactggatcagtgaggactgcaatgaccatgactgagaagatattggccagagcttctgagaaggcacagctgacccctggggataatgtttgggtcaatgttgatattttgatgacacatgatgtgtgtggccctggttctattgggattttcaagagggagtttggcgaggatgccaaggtttgggaccgtgaaaagcttgtaataatacctgaccactatattttcacaagtgatgaacgtgccaatcgcaatgtagacatattaagagatttctgccatgagcagaatatcaagtacttttatgatattaaggatcttagtaattttaaggtaaatccagactataagggtgtttgccatgttgctcttgctcaggaaggtcattgtaggccaggagaggttctcttaggtactgattctcacacttgtactgctggagcatttggtcaatttgctacagggattggtaatactgatgccggctttgtgctgggaactgggaaacttctgctcaaggtgcccccaactttgagatttgtaatggatggagaaatgcccgattatttgctttctaaggatttgattctgcaaattattggtgaaataactgtggctggggcaacatataaatcgatggagtttgttggtacaaccgttgaaagtttaactatggaagaacggatgacattgtgcaacatggttgttgaagctggtggaaagaatggtgttgttcctgctgacagcactacatttaaatatcttgagggcaagacatctctgccatatgaacctgtttatagtgacgatcaagcaagatttctcgcagagtatagatttgatgtctcaaaattggagccagtggtggccaagcctcattctccggataatcgtgctttggcaagagagtgcaaggatgtgaaaattgacagagtatacataggatcttgtacaggtggcaaaacagaggatttcatggctgcagcaaaagtttttctggcatcaggtaaacaggtcaaagttcctacatttcttgtgcctgcaacacaaaaggtttggatggacttgtactccctccctgtccctggatctggtggtaagacatgctcacagatatttgaagaagttgggtgtgacacaccagctagtcctagttgtggtgcttgtttgggtggcccaaaagatacttacgcacgcatgaatgaacctaaggtttgtgtttcaactacgaacaggaacttcccgggccgaatgggacacaaggaaggtcaaatctatttggcttccccttatacagctgctgcatctgcattgaccggttatgttactgatcctagagagttcttgtagtagaatgttgttacaatcatctcattgtgttgtactcgttgttggttatttgtgtattctctactctctactagtcataagttaaaactgacaactatttaagcttaaccaatcttttagtatttctaagttgatctttagaatcat

SEQ ID NO: 5108 - DNA, 1851 bp, Ananas comosus
atggaccaaacgctaaacccttttaaaaagtattttgacctgcgccacctaaaaccccctcccctggttccccgaagcacacgaacgcctccatcgtccccaaatttccacactttgtccaacattttctaaattcctataaaagatccaatttttcctactccgtggccttcaaaatcgcatatttttccccctagaggtgaataaccgagcaatccgagctcaaatccatggcttctcttttcacggcttcgaaatgcgccttctttagccctaaggaatttgatcttggctcatccttttccccttcgatcagcgcccatggatgtcgcaggcgtgctatgagaaaggtcctttccgtcatggcaccaccggcgccgtccccgcattctctggccaccaccggtttggtaaagcattcgatgactatgacagagaagatcttggccagggcgtcggagcggtcacggctggagccgggagagaatgtttgggtcaatgtggatgtgttgatgactcatgatgtctgcggaccggggacgttcgggatattcaagagagagttcggtcggaatgcgaaggtttgggacagggaaaagattgtggttataccagagcactacatttttaccagtgatgagcgtgcaaaccggaatgtggatatcttgagggactactgtattgagcaaaatattaagtatttctacgatataaaggatctaagtaatttcagggttaatccagattataaaggtgtatgccacattgctcttgcccaagaaggtcattgcaggcccggcgaggttctgctcggcaccgattcccacacatgtaatgctggggctttcggccaatttgctacgggaatcggcaatactgatgcaggttttgtgatgggcactgggaaagttcttcttaaggtaccccctacaatgaggtttgttctggatggagaaatgcctgattatttgcttgccaaggatttaattttgcaaatcattggtgaaattactgtttccggtgcgacatacaaatctatggaattcactggctcagctgttgagagtttaaccatggaagagaggatgacattgtgcaatatggttattgaagccgggggaaaaaatggagtagtccctccggatgaaactacatttaagtaccttgaggataagacatctgtaaaatatgaacctgtctatagcgatgataacgccagatttattagcgactacaagtttgatgtttccaagttggaacctacagttgcaaagcctcattcacctgataaccgtgctctggcacgagaatgcaaagacgtcaaaatcgacagggtttacatcggttcttgtactggtgggaagactgaggattttctggctgctgcgagggttttcctagcttccgggaaaaaggtgaaagttcccacttttctcgtccctgcgacgcaaaaggtttggatggacatatatagcctccccgtgccagggtccggcggcaagacttgctctcagatattcgaggaggccggctgtgatgttccagctagccctagttgcggagcctgtttgggcggtccccgagacacttacgcacgtatgaacgaacctcaggtttgcgtgtcgaccacgaacaggaacttccctggcaggatgggccacaaagaagggcagatctatttggcctcgccgtacacggcagcggcttcggcgttgacgggctttgttaccgacccgaggcagttcctcatgtagacgaaaagttttctgtgtttgtcgacactcgtccaccgtagcttactttgtacttttctatgtgcatgtaggagatggaatgcatgtagagaatgga

SEQ ID NO: 5109 - DNA, 1814 bp, Glycine max
acagcagacactacctgcggaagacgatccggagccgccacctattcttttgttcatcacatattcaatggcttcctctcttctctctccatcatttacatccttcctccgcaccaaggatctctctctctctgctttcacttctcagcgatgcttcaaagcggtgccaaggaaaataatccgttgtgctattgcggcgcctcagcgccaaccttccaccactggatcagtgaggactgcaatgaccatgactgagaagatattggccagagcttctgagaaggcacagctgacccctggggataatgtttgggtcaatgttgatattttgatgacacatgatgtgtgtggccctggttctattgggattttcaagagggagtttggcgaggatgccaaggtttgggaccgtgaaaagcttgtaataatacctgaccactatattttcacaagtgatgaacgtgccaatcgcaatgtagacatattaagagatttctgccatgagcagaatatcaagtacttttatgatattaaggatcttagtaattttaaggtaaatccagactataagggtgtttgccatgttgctcttgctcaggaaggtcattgtaggccaggagaggttctcttaggtactgattctcacacttgtactgctggagcatttggtcaatttgctacagggattggtaatactgatgccggctttgtgctgggaactgggaaacttctgctcaaggtgcccccaactttgagatttgtaatggatggagaaatgcccgattatttgctttctaaggatttgattctgcaaattattggtgaaataactgtggctggggcaacatataaatcgatggagtttgttggtacaaccgttgaaagtttaactatggaagaacggatgacattgtgcaacatggttgttgaagctggtggaaagaatggtgttgttcctgctgacagcactacatttaaatatcttgagggcaagacatctctgccatatgaacctgtttatagtgacgatcaagcaagatttctcgcagagtatagatttgatgtctcaaaattggagccagtggtggccaagcctcattctccggataatcgtgctttggcaagagagtgcaaggatgtgaaaattgacagagtatacataggatcttgtacaggtggcaaaacagaggatttcatggctgcagcaaaagtttttctggcatcaggtaaacaggtcaaagttcctacatttcttgtgcctgcaacacaaaaggtttggatggacttgtactccctccctgtccctggatctggtggtaagacatgctcacagatatttgaagaagttgggtgtgacacaccagctagtcctagttgtggtgcttgtttgggtggcccaaaagatacttacgcacgcatgaatgaacctaaggtttgtgtttcaactacgaacaggaacttcccgggccgaatgggacacaaggaaggtcaaatctatttggcttccccttatacagctgctgcatctgcattgaccggttatgttactgatcctagagagttcttgtagtagaatgttgttacaatcatctcattgtgttgtactcgttgttggttatttgtgtattctctactctctactagtcataagttaaaactgacaactatttaagcttaaccaatcttttagtatttctaagttgatctttagaatcattcatatatgtgggttaggtcaattcagatcaacatgaagttcaatttcaaatttagtagtgtttggtctttatatatatatatatatagcttctctt

SEQ ID NO: 5110 - DNA, 1785 bp, Musa acuminata
tcctccccgagtcatctcatctctcctagagggtggattcgtttcctcgatcgcaagtcgttaagaaagatttggtctttgctgatggcgtcgccgctcatggcttcgtgctcatcgatcttcggcgcaaagagcggatcgagcttcgcctcgtgtttttcgccttcgattagagcacatagcctccgaaagcatgctttgaacaaggtcctcgcagtcatggcgcccgcgcgatctccccgctctccgtcgtccactggatcagtgaagcatgcgatgacaatgacggagaagattcttgcacgagcatcagagaagtctcatctggaacctggagagaatatctgggtgaatgttgatgtcttgatgactcatgatgtctgtggccccgggactattgggatctttaagaaagagtttggccagaatgcaaaggtttgggatcatgagaagattgttataataccagatcactacatttttactagtgatgaacgtgcaaaccggaatgtggatattttgagagacttttgtttggagcagaacattaagtatttttatgatatcaaggatcttggtgatttcagggccaatccagattacaagggtgtatgccacattgcgctggcacaagaaggccattgcagacctggagaggttttacttggcacagactcacacacatgtactgctggtgcttttgggcaatttgctactggaattggcaacactgatgcaggttttgtaatgggaacagggaagcttttattgaaggttcctcctaccctaaggtttatactagatggagaaatgccgaactatttgcttgccaaagatttaattttgcaaattattggtgaaataactgttgctggtgcaacatataaatccatggaattcgttggctctactattgaaggactaaatatggaggagaggatgaccttatgcaacatggttgttgaagctgggggaaaaaatggggttgttcctgctgatgaaactacattcaagtaccttgaggataaaacttccaagaattttgagccagtgtatagtgatgataatgccagatttattcaagaatatagaattgatgtgtccaagttggaaccactggttgcaaagccacattctcctgataatcgtgctctagcaagagagtgcaaggatgtcaaaattgacagggtctacataggctcttgtactggcggaaagacggaggatttttttgctgctgcaaaggtgttcctagcttcggggaaaaaggttaaagttcccacttttcttgttcctgccacacaaaaggtatggatggatatatatagcctcccggtaccaggatcaggtgggaagacctgttctcagatattcgaggaggctggttgtgatgttccagctagccctagttgtggggcttgcttgggcggccctcgcgacacttatgcgcggatgaacgagccacaggtgtgtgtttccaccacaaacaggaactttcctggcagaatgggtcacagagaaggccaaatatatttggcttcaccatatactgcagctgcttcagctttgacaggatatgttgctgatcccagggactttctcctgtaaaaggaatgatatcgtttgtttgtttccatcatcatagagtctgtttgatgatatatcatgtggtgtctcatccagtatgtaacattagagaaacaagtattttgaacagagcaatcatggaagtcatgacagtcacctctatatttatgtgaagtcaatgattttgctatttatgcc

SEQ ID NO: 5111 - DNA, 1972 bp, Glycine max
tctcactcttctaaaccaacggtcatgattattctcgcaccgtgcaccacacacgcaagcacccgtcgacaacaccacatagttttaaagtcagaatcatacccagaacctccacttattactactctctttgttcatcacatattcaatggcttcctctcttctctctccatcattcacttccttcccccgcataaagaaggatgtctctctctctgctttcacttctcagcgatgcttcaaagcgcttccaaggagaataatccgttgtgctgtggcggcgcctcagcgccaaccttccaccactggatcagtgaggactgcaatgaccatgactgagaagatactggccagagcttctgagaaggtacagctgacccctggcgataatgtttgggtcaatgttgatattttgatgacacatgatgtgtgtggccctggttctattgggattttcaagagggagtttggtgacgatgccaaggtttgggaccgtgaaaagcttgtaataatacccgaccattatatattcacaagtgatgaacgtgccaatcgcaatgtagacatattaagagatttctgccatgagcagaatatcaagtacttttatgatattaaggatctcagtaattttaaggtaaatccagactataagggtgtttgccatgttgcccttgctcaggaaggtcattgtaggcctggagaggttctcttaggtactgattctcacacttgtactgctggagcatttggccaatttgctacagggattggtaatactgatgctggctttgtgctgggaactgggaaacttctgcttaaggtgcccccaactttgagatttgtaatggatggagaaatgcctgattatttgctttctaaggatttgattctgcaaattattggtgaaataactgtggctggtgcaacatataaatcgatggagtttgtcggtacaactgttgaaagtttaactatggaagaacggatgacattgtgcaacatggttgttgaagctggtggaaagaatggtgttgttcctgctgacagcactacatttaaatatcttgagggcaagacatctctgccatatgaacctgtttatagtgacgatcaagcaagatttcttgctgagtatagatttgatgtctcaaaattggagccagtggtggccaagcctcattctccagataatcgtgctttggcaagggagtgcaaggatgtaaaaattgacagagtatacataggatcttgtacaggtggcaaaacggaggatttcatggctgctgcaaaagtttttctggcatcaggtaaacaggtcaaagttcctacatttcttgtgcctgcaacacaaaaggtttggatggacttatactcccttccagtccctggatctggtggtaagacgtgctcccagatatttgaagaagctgggtgtgacacaccagctagtcctagttgcggtgcttgtttgggtggcccgaaagatacttacgcacgcatgaatgaacctaaggtttgtgtttcaactacgaacaggaacttcccgggccgaatgggacacaaggaaggtcaaatctatttggcttccccatatacagctgctgcatctgcattgaccggttatgttactgatcctagagagttcttgcagtagaatgttgttacagtcatcccattggtgttgtacacgttgttggttagttgtgtattctctagccataagttaaaactgatagctatttaagccgaccaatcttttggtattttttgtctgaagaaattttcggtgactattattcaattgacacagttttggttgttaaaaaagattggttcatttagtacttgttgagtatgacttggtcgttgctgttacagttgcaagtatgatttcatatggattttcttgtcaacccgtgttttattaactttgctttttgtttgttctaagttgatctttagaatcatt

SEQ ID NO: 5112 - DNA, 1862 bp, Castanea mollissima
gatcgagcgccgcctcctacttcctcagaagtgaaaaaagcactctattttagtatgttatattttccttagaaaaatacagaagatttttcacagcaatgaacagcatggcttcctctaccattgctccaaatctcgcatctttcatcgccaacaagaaagacttggggttcactgcattttcgacatcgtcacaattttctattcccaaatgcaacagaaggatttccaagaaaatttgttcagtcatggcaccgcaacaatcggaacgcaggccttctaccactggctcagtcaagacagcaatgacgatgactgagaagatattggctagggcttctgagaaaacccagttgagccctggtgagaatagttgggttaacattgacattttgatgacccatgatgtttgtggccctggttctttcggaatcttcaagaaagagtttggccagaacgccaaggtttgggaccgggaaaagattgtaataattcctgaccattacatcttcacaagtgatgaacgggcaaaccgtaatgtggatatattgagggatttctgcagggagcagaacatcaagtacttttatgatattaaggatcttagtgattttaaggcgaacccagattacaaaggagtatgccatattgctcttgcacaagaaggtcattgcaggcctggagaggtcctgctgggtacagattctcacacttgtacagctggagcatttggccaatttgccactggaattggcaacacggatgcaggctttgtgttgggcgccgggaagctcctgctcaaggtgcctccaactttgagatttgtaatggatggtgaaatgccaaattatttgcttgcaaaagatttgattttacaaataattggtgaaatatctgtgtctggtgctacatataaatctatggagtttgttggtacaactgttgaaagtctaactatggaagagaggatgacattatgcaacatggttgttgaagctggggggaaaaatggtgttgtccctgctgatagcactacatttaagtaccttgaggataagacttctgtggcctatgaaccagtttatagtgatgaacaagcaagatttctttctgagtacagatttgatgtctcaaaactggagcccctggtagcaaagccacattctccggataatcgggctttagcaagagaatgcaaagatgtgaaaattgacagggtatacattggatcttgtactggaggaaaaacagaggattttatggctgcagccaaagttttcctagcttcaggaaaaaaggtcaaagtccccacattccttgttcccgcaacccaaaaggtttggatggacgtatatggtctcccagtaccaggatctggtggcaagacttgctcccagatttttgaagaagctggttgtgatacacctgcaagtcctaattgtggtgcttgtctgggtggccctaaagacacttatgcacgcatgaatgagcctacggtctgtgtgtcaacaacaaacaggaacttcccaggccgaatgggacacaaagagggccagatatatcttgcatccccatatactgcagcagcatctgctttgactggttatgtgaccgatccaagggaattcttgcagtaggctataaataccataaatctgctcatgttgtatgtcatgggtgctttgtatcctaccactgtaggttaaaatgcccgagctgaaatacataatgggtttttctgtatggatattagtttatatattttgtgattactaagaggtttgtactaaagaagattggttagagccaccatgcaataataaacttattgcaagaaatgaaacaagtgacaagggaagatg

SEQ ID NO: 5113 - DNA, 1817 bp, Quercus alba
cagaagatttttcacaacaatgaacagcatggcttcctctaccattgctccaactcccgcatctttcatttccaacaagaaagatttggggttcactgcattttcgacatcgtcacaattttctattcccaaatgcaacagaaggatttccaagaaaatttgttcagtcatgactccgcaacaatcggaacgcaggccttctaccactggctcagtcaagacagcgatgacgatgactgagaagatattggctagggcttctgagaaaagccagttgagccctggtgagaatacttgggttaacattgacattttgatgacccatgatgtttgtggccctggttcgatcggcatcttcaagaaagagtttggccaggacgccaaggtttgggaccgagaaaagattgtaataattcctgaccattacatcttcacaagtgatgaacgggcaaaccgtaatgtggatatattgagggatttctgcatggagcaaaacatcaagtacttttatgatattaaggatcttagtgattttaaggcgaacccagattacaaaggagtatgccatattgctcttgcacaagaaggtcattgcaggcctggagaggtcctgctgggtacagattctcactcttgtacagctggagcatttggccaatttgccactggaattggcaacacggatgcaggctttgtgttgggtgctgggaagctcctgctcaaggtgcctccaactttgagatttgtaatggatggtgaaatgccaaattatttgcttgcaaaagatttgattttacaaataattggtgaaatatctgtgtctggtgcgacatataaatctatggagtttgttggtacaactgttgaaagtctaactatggaagaaaggatgacattatgcaacatggttgttgaagctggggggaaaaatggtgttgtccctgctgatagcactacatttaagtaccttgaggataagacttctgtggcctatgaaccagtttatagtgatgaacaagcaagatttctttctgagtacagatttgatgtctcaaaactggagccactggtagcaaagccacattctccggataatcgggctttagcaagagaatgcaaagatgtgaaaattgacagggtatacattggatcttgtactggaggaaaaacagaggattttatggctgcagccaaagttttcctagcttcgggcaaaaaggtcaaagtccccacattcctcgttcctgcaacccaaaaggtttggatggacgtatatggtctcccagtaccaggatctggtggcaagacttgctcccagatttttgaagaagctggttgtgatacacctgcaagtcctaattgtggtgcttgtctgggtggccctaaagacacttatgcacgcatgaatgagcctacggtctgtgtgtcaacaacaaacaggaacttcccagggcgaatgggacacaaagagggccagatatatcttgcatccccatatactgcagcagcatctgctttgactggttatgtgaccgatccaagagaattcttgcagtaggctataaataccataaatctgctcatgttgtatgtcatggttgctttgtatcctaccactgtagcttaaaatgcctgagccgaaatacataatgggtttttctgtatggatattagtttatatattttgtgatttctaagaggtttgtactaaagaagattggtaagatgccaccatgcaataataaacttattgcaagaaatgaagcaagtgacaagggaagatgaatgaaaactggtgatgactagactcatctttg

SEQ ID NO: 5114 - DNA, 1851 bp, Arachis hypogaea
agccttgtaaggaaaactttggtcgagtgaagaacgtggaagaagagaaagggagaaacgtgtggcggctcttcgttaaagagacttggaacaccgctactccaatcgcagcttccaacatcaatggcttcttcttcttccttccttgcgccatcatccacatccattcttcactctaagaaagatgtcggtctctctgctttgacttccacgtcttccatttcttctcagcgatgccagaaaaccggtttcaggagaatttgctgctccgttgcagcaccacagcaatctcaacgccagccttctacgactggatcagtgaagacggcgatgacgatgactgagaagatattggctagagcttctgagaaaccctatttgacccctggggataatgtttgggttaatgttgatattttgatgactcatgatgtttgtggccctggttctattggtattttcaagagggaatttggcgaggatgctaaggtttgggaccgtgaaaagcttgtgataatacctgatcactatatcttcaccagtgatgaaagagccaatcgcaatgttgacatactaagagatttctgccaagagcagaatatcaagtacttttacgatattaaggatcttagtaattttaaggcaaatccagactacaaaggtgtttgccatgttgctcttgctcaggaaggtcattgtaggcctggagaggttctcttgggcactgattctcacacttgtactgctggagcatttggtcaattcgctacggggattgggaatactgatgcaggttttgtgttgggaacagggaagcttctcctcaaggtgcctccaactctaagatttgttatggatggagaaatgcccagttatttacttgcaaaggatctgattctgcaaataattggtgaaataactatggctggtgcaacatataaagctatggagtttgttggcacaactgttgaaagtttaaatatggaggaaaggatgacgttgtgcaatatggttgttgaagctggaggaaagaatggcgttgttcctgctgatagcactacatataaatatctcgaggataagacatctgtgccatatcaaccagtttatagtgatcagcaagcaagatttctttctgaatatagatttgatgtctcaaagttggagccattggtagccaagcctcattctccggataaccgtgctttggctagagagtgcaaggacgtgaaaattgacagagtatacataggatcttgcacgggtggaaaaacagaggatttcatggctgcagcaaaagtttttctagcttcgggtaaaaaagttaaagtacccacatttcttgtgcctgcaacacagaaggtttggatggacttatatagcatcccagtacctggagctggtggtaagacttgctcccagatatttgaagaagctggatgtgacacacctgctagtcctagttgtggtgcttgtttgggtggcccaaaggatacttatgcacgcttgaatgaacctcaggtttgtgtttcaactacaaataggaacttcccgggccgaatgggacacaaggaaggccagatatatctggcttctccatatacagctgcggcatctgcattgactggttatgttactgatccaagagaattcttgcagtaaggttattgttttatgataataccctttccgatctatttgactggggaagttttgtatactatgtagccattaaaactgtaagttattgaagtttatagatctatctgtctgttttccccctttaagaagtcttgcgactgttaatcctttctggtgcttagtttcaataataaaataagattttatgta

SEQ ID NO: 5115 - DNA, 1962 bp, Platanus occidentalis
gttcgtacgaacacatactgataagcggaggtgagcgcaactgtgaagcgaagagcttctcggagaactataccatggcttcctctgcaattgccttaagctcatcaccattgatcaagaagaaatttgtgggtttctcttttttctcttcatctccatttcccattaaaaaatgcatgagaagaggttcaaagaaagtttctgcagtcatggcgccgccgcagtcgcagcgtcccccttcgacgaccggttctgtgagaaccgctatgacgatgacggagaagatcttggcgaaggcgtccgagaagtcccaattgaatccgggagataatgtttgggtgaatgttgatatcttgatgacccatgatgtttgtgggccggggacgattgggatcttcaagaaagagttcggcaaggatgcaaaggtttgggaccgtgaaaagattgtcattatacctgaccactatatattcacaagtgacgaacgtgcaaatcgtaatgtggatatcttgagggatttctgcatggagcaaaatatcaagtacttctacgatatcaaggatcttggtaatttcaaggctaacccagattataaaggtgtatgccatgtcgctcttgcccaagaaggtcactgcaggcctggggaggtcttgttggggacagactcccacacatgcaatgctggagcgtttgggcagtttgctactggaattggcaacactgatgctggttttgtaatgggcactggaaagcttctgcttaaggtacccccaaccttgaggtttgtaatggatggtgaaatgcccaattatttgcttgcgaaggatttgattttgcaaattattggagaaataaccgtctctggtgcaacatataagtccatggagttcattggctccacagttgaaagtttatctatggaagaaaggatgacattatgtaatatggttgttgaagctgggggtaagaatggcgttgtccctgctgacaataccacatataagtaccttgagggtaagacatcagcggcttttgaaccagtgtacagtgatgagaaagcaagatttctatctgaatacagattcgacgtctccaaactggaaccattggtggcaaagcctcattctcccgataaccgtgctttagccagagaatgcaaagatgtgaaaatagacagagtatatatagggtcgtgtacaggtggaaagactgaggattttcttgctgcagcggaagtttttctagcttcagggaaaaaggtcaaggtgccaacatttcttgtccctgctacccaaaaggtttggatggatatatatagtctcccagttccaggagctggtggcaagacttgctcccagattttcgaagaagctggttgtgatgtgcctgcaagtcctagttgtggagcttgtttaggtggccctagagatacttacgcacgcatgaatgaacctcaggtttgtgtgtcaacaacaaacaggaacttccccggccgaatgggacacaaagaagggcagatatatctggcttccccatatacagctgcagcatctgctttgactggttttgtcacagatccaagagagttcttgcagtaacaacccgaatccaacctatatgtgttaggattattctattccgctctaaattgtgttgagtaattggagagtgggtctgttagctgatcctgttcaaattctcacgtacttgtgattatttatttagaatggaatacggtctaggatagcatattttctttctaaattataacaatattcagtaatgttgtgaagtgagttactcggggtgattcttttgaactacttttatgaacagactacttttgtgaagtgagatgcttatacttggatatcataaaaaagacaaaatatttactattgtggtgcctattgttggcatatgaatatttgctattgaaacgagtatgacttcgctaagaga

SEQ ID NO: 5116 - DNA, 1909 bp, Gossypium raimondii
aggttttgccaaataagggcttgtggaatccgtttccatattcgcttgctggtgctaattcgtatgctggtgtagtctgcgcccgcgccgcttatattccctttttctttttctcgctaaacaaacagaaaatcagcaaccctcttcttttacattctgtggtaatttaactaagagctgaatcttatggcgtcttctttggcttctccgtccccaacttcttcctttatcaggaacaagaaagatttgggtttctctgctttcccttcaacatctcaaatcgcaattcagaaatgtaagaaacaagtttcgaagaaaatcgtctcagtcatggcacctcagcaatcagagcgtaaaccagcgaccacaggctctgtgaagactggaatgacaatgacagaaaagattcttgcaaaagcctctgagaaaccacagctgagtcctggtgataatgtttgggttaatgttgatatattgatgacacatgatgtttgtggtcctggttccattggtatcttcaagaaagaatttggtcaaaatgcaaaggtttgggaccgtgaaaagattgttattatacctgaccattacatatttacaagtgatgaacgcgcgaatcggaatgtagatattttgagggatttttgcacagagcaaaatatcaagtatttttatgatataaaagatcttagtaattttaaggcaaaccctgattataaaggtgtatgccatgttgcacttgcccaagaaggtcactgcaggcctggagaggttttgttagggacagattctcacacatgtactgctggagcattcggtcaatttgctacaggaattggaaatacagatgcaggctttgtcttaggcaccgggaagcttctactcaaggttccaccaacattgagatttgtgatggatggtgaaatgcctccttatctgcttgcaaaggatttgattttgcagatcattggtgaaatatctgtagccggtgcaacatataaagccatggagtttgtcggaacaacggttgaaagtctaaatatggaagaacggatgacgttatgcaacatggttgttgaagctgggggaaagaatggagtcgttcccgctgatagtactacatttaagtaccttgagggtaaaacatccctgccatatgaaccagtttacagtgatgcacaagcaagttatctttccgagtacagatttgacatctcaaagttggagcccttggtggctaagccacattctcctgataaccgtgctttggcaagagaatgcaaagatgttaagatagacagagtttatattggatcttgtactggtggtaaaactgaagattttcttgctgctgctaaagtctttctagcttcaggaaagaaggtcaaggttcctacattccttgtcccggctacacaaaaggtttggttggacttatatactctccctgtacccggatctggtgggaagacatgctcccagatatttgaagaagctggctgtgacacacccgcaagccctagctgtggtgcttgtttgggtggcccgaaagacacatatgcacgtatgaacgaaccaaaggtctgtgtctcaacaacaaaccggaacttccctggtcggatggggcacaaagaaggccagatatatcttgcttctccgtatacagcagctgcatcagctttgaccggttatgtcaccgatccaagagagtttttgcagtaagaaacttgagtaaatattttgtaggtttaaatgtatggctcatatgaataaaccataggttgaaaaaagaaccaaaaaaaagaactttttgttgtatcctatattccaatggattcatgcaaggaatgccaagaaaaacttgaatctctctttcgtaagctttcataaatgaaaattgttgtttggacaa

SEQ ID NO: 5117 - DNA, 1835 bp, Plantago ovata
gagccgcctctcctcaaattcattacaggtcacaagatagccatggcttcttcttcttcttccatcattactcctccgagctcctcgattttctccaaaaagaaggatgtgggcttgtcatctctttgcgcacagccttcatttatgggttcccagaagaagaaggcatccgggaaagtagtctgtgtgatggcacctcaacaatccgaacgcaaaccttcaacaactggagcggtgaaaactgggatgacgatgactgagaagatatttgcaagagcttcagagaaaacacagttaagccctggtgagaatgtatgggttaatgttgatgtcttgatgactcatgatgtatgtggccctggttcaattgggattttcaagaaagagtttggacaagatgccaaggtctgggacagggaaaaggtagtgattattccagatcactatatatttactgctgatgaaagagcaaatcgcaatgtggatatcttaagggatttctgtaccgagcaaaacatcaagtacttttatgacattaaagatcttggaaatttcaaggcaaatccagattataaaggtgtatgccatgttgctcttgcccaagaaggtcattgcagacctggagaggtcttgcttggtacagattcgcacacatgtactgctggtgcatttggtcaatttgccaccggtattggaaatactgatgcaggttttgtgctgggtgctggaaagctcttattgaaggtgcccccaacattgagatttgtgttggatggtgaaatgcctgactatctgctctcaaaagatttgattttgcaaattattggtgaaatttcggtggctggtgcgacatacaaagcaatggaatttgttggttcaactgttgaaagtttatcaatggaagagagaatgacattatgcaatatggtcgttgaagctgggggtaagaacggtattgtccctgctgacagtaccacatttaagtatctcgaggataagacgtccgtgccctatgaaccagtatacagtgatggacaagcaagattcttatcagagtacagatttgatgtgtcgaagttggagcccttggtagctaagccccactctcctgataatcgtgctctagcccgagaatgcaaagatgtgaaaattgatagagtatacattggctcctgtactggtggaaaaacagaagatttcatggcagctgccaaagttttccttgcttctgggaaaaaggtcaaggtgccaacatttcttgttcctgctacacaaaaggtctggatggatgtatacagccttccagtcccaggagctggtggaaaaacttgctctcagatatttgaggaagctggttgtgatacaccggcaagtcctagctgcggtgcttgtttgggaggacctagagacacatatgcgcgcatgaacgaagctcaggtctgtgtttcaaccacaaacaggaacttccctggccggatgggccacaaagaagggcagatatatctagcatctccatatacagctgcggcgtctgcattgactggattcgtcactgatccaagagagtttttgcagtaagattttcacaaactacgatttggttgtgtactctactttcttatgtgacttctgaagatcaaatgggctgcgtgtgagtctgtatgtttattagaatttgatcttgctacacagacaaattaacttaagttttcatgtaacgtataaactaaaaattttccggagttgtctatgtttatgctgtaacaatctcatttgggaatgaatgttaatggaataagccttgaggcatcaatatcatcatggatgttcctgta

SEQ ID NO: 5118 - DNA, 1765 bp, Gossypium hirsutum
gggatccgtttccatattcgctcgcttgtcctaattcgtatgctggtgtagtctgcgcccgcgccgcttatattccctttttctttttctcgctaaacaaacagaaaatcagcaaccctctccttttacattctgtggtaatttaactaagagctgaatcttatggcgtcttctttggcttctccgtccccaacttcttcctttatcaggaacaagaaagatttgggtgtctctgctttcccttcaacatctcaaatcgcaattcagaaatgtaagaaacaagtttcgaagaaaatcgtctcagtcatggcacctcagcaatcagagcgtaaaccagcgaccacaggctctgtgaagactggaatgacaatgacagaaaagattcttgcaaaagcctctgagaaaccacagctgagtcctggtgataatgtttgggttaatgttgatatattgatgacacatgatgtttgtggtcctggttccattggtatcttcaagaaagaatttggtcaaaatgcaaaggtttgggaccgtgaaaagattgttattatacctgaccattacatatttacaagtgatgaacgtgcgaatcggaatgtagatattttgagggatttttgcacagagcaaaatatcaagtatttttatgatataaaagatcttagtaattttaaggcaaaccctgattataaaggtgtatgccatgttgcacttgcccaagaaggtcactgcaggcctggagaggttttgttagggacagattctcacacctgtactgctggagcattcggtcaatttgctacaggaattggaaatacagatgcaggctttgtcttaggcaccgggaagcttctgctcaaggttccaccaacattgagatttgtgatggatggtgaaatgcctccttatctgcttgcaaaggatttgattttgcagatcattggtgaaatatctgtagccggtgcaacatataaagccatggagtttgtcggaacaacggttgaaagtctaaatatggaagaacggatgacgttatgcaacatggttgttgaagctgggggaaagaatggagtcgttcccgctgatagtactacatttaagtaccttgagggtaaaacatccctgccatatgaaccagtttacagtgatgcacaagcaagttatctttccgagtacagatttgacatctcaaagttggagcccttggtggctaagccacattctcctgataaccgtgctttggcaagagaatgcaaagatgttaagatagacagagtttatattggatcttgtactggtggtaaaactgaagattttcttgctgctgctaaagtctttctagcttcaggaaagaaggtcaaggttcctacattccttgtcccggctacacaaaaggtttggttggacttatatactctccctgtacccagatctggtgggaagacatgctcccagatatttgaagaagctggctgtgacacacccgcaagccctagctgtggtgcttgtttgggtggcccgaaagacacatatgcacgtatgaacgaaccaaaggtctgtgtctcaacaacaaatcggaacttccctggtcggatggggcacaaagaaggccagatatatcttgcttctccgtatacagcagctgcatcagctttgaccggttatgtcaccgatccaagagagtttttgcagtaagaaacttgagtaaattttttgtaggtttaaatgtatggctcatatgaataaaccataggttgaaaaaaga

SEQ ID NO: 5119 - DNA, 2070 bp, Allium cepa
gtccaggcccggttattgggctaggcgggctaggctacggaatagggcaacccaccctatcgggggcaaccaaaaaaccctagttcaaatttcaaaatcgcgcacagagatattgcaacactcactgacgaccgaacaaaaaaaacctacgctaacccacctgaccgcctccatcgcctccgcacggccgcacctcatccacggcaacggcgcttcacagctcctcctcctctggacatccactccaatcggaccagttcagcttcagcctttagtttcaattccaaggctggtatagcctgtagctcaaagatccggtggaaaccaacctatctaaacgctgatacggaatcgtttcgaacaaatatatctcagcatcctctccaaatttaagccctagtccacaatctcaatgtctacagtcatggcatcgaactctgcccttctgggcaaaaagattgaattgggatgtctagtaacaacaaataaatatccagtaaaatcttcaaccaagatttcatcggttatgacgccaactcagttgaagcgaactccttcagctactggttcagtgaaacatgccatgacaatgaccgagaaaattttagcaagagcatcagagagatcaagtttagagcctggagacaatatctgggtaaatattgatacactgatgactcatgatgtttgcgggcctgggactattggaattttcaagagagagtttggacaaaacgccaaggtttgggaccgtgaaaagattattataataccagatcactacatttttaccagtgatgagcgcgccaataggaatgtagacatcttgagggatttctgtcatgaacagaatataaaatatttttacgacatcaaagaccttggaaatttcaaggctaatccagattacaaaggagtatgccatgttgctctagcccaagaagggcactgcagaccaggggaggttttgctgggaacagattctcacacatgcaatgcaggagcatttggacaatttgctacggggattggtaacactgatgcaggttttgtcatgggtactggaaaacttctgctgaaggtaccccctacattgagatttgtattagatggagagatgcctgatcatctgctagccaaagatttgattttgcagattattggtgaaataagtgttgctggtgcaacatataaagctatggaatttgtgggttcaactattgagagtttaactatggaagaccgaatgactctttgcaatatggttgttgaggctggaggtaaaaatggagttatccctgcggatgcaactacatttaactaccttgagggcaagacgtccgtgggttatgaaccagtttatagtgatgaatatgcgaggttttttcaggattacaagttcgatgtctcaaaattggagccagtggttgcaaagccacactctcctgataaccgtgctttagcaagagaatgcaaggatgtgaaaatcgatcgagtttatataggttcatgtactggcgggaagactgaagattttcttgctgctgccaagctttttctagctgcagggaagaaggtcaaagttcctacgttcctcgtccctgctacgcagaaggtatggatggacatatatgcccttccagttccagggtctgggggaaaaacttgctctcaaatatttgaagaagcgggttgtgacactcctgctagcccaagttgtggagcttgtttgggaggcccacttgacacttatgctcgaatgaatgaacctctggtctgtgtatcaaccacaaatagaaattttcctggaaggatggggcacaaagaaggtcaaatatatcttgcttcaccgtacactgcagctgcatcggcattgactggctatgttaccgatccaagagagttcctgtaatgaaatattagtttctaccatactagtaatttttgcatatttcagttgaccactctttgtatcattatactctttgtaatttttgcattacaatctgatttgctttaaatccaaatgaactatttgctgtaaaatattgttatgttgtttaattctaa

SEQ ID NO: 5120 - DNA, 2006 bp, Gossypium hirsutum
cttgcagcatctcctccacgtatactttgctctgcattgccctgcttccattggtcttcacttttgtgtttcctttatccattttgttttatttttacatttctgctgtttatttacttgaagagctgaaatcttatggcatcgtctttggtttcctctcctacttcttctttcctcaagaagattgcttttcataaatgtaagaaacaagtttcgaagaaaatcgtctcagtcatggcaccccaccaatctgagcgtaaaacatataccactggctctgtgaagacaggaatgacaatgacggagaagattcttgcaagagcctctgagaaacaacagttgagtccaggtgataatgtttgggttaatgttgatatcttgatgactcatgatgtttgtggtccgggttccattggtatcttcaagaaagaatttggtgaaaaggcaaaggtttgggaccatgaaaagattgttatcatacctgaccattatatattcactagtgatgaacgtgcaaatcgtaatgtggatattttgagggatttttgtggcgagcaaaatataaagtacttttatgatattaaagatcttagtaatttcaaggcaaacccggattacaaaggtgtatgccatgttgcacttgcccaagaaggtcactgtaggcctggagaggttttgttgggaacagattctcacacatgtaccgcaggagcattcggtcaatttgctacaggaattggaaatacggatgcaggttttgtattgggcactgggaaggttcttctaaaggtgccatcgactttgagatttgtgatggatggtgaaatgcctcattatttgcttgcaaaggatttgattttgcagatcattggtgaaatatctgtatctggtgcaacatataaatcaatggagtttgtgggaacaactgtggaaagtttaaatatggaagaacggatgaccttatgcaatatggttgttgaagctggtggaaagaacggtgttgttcccgctgatagtactacatttaagtaccttgaggataaaacatcggtgccgtatgaaccagtttacagtgatgcgcaagcaagttttctttctgaatacagattcgatatctcgaaattggagcccttggtagctaagccacactctcctgataaccgagctttggctagggaatgcaaagatgttaaaatcgacagagtgtatatcggatcttgtactggtggaaaaacggaagattttcttgctgctgctaaagtctttctagcttcaggcaagaaggtcaaagttccgacattccttgtccctgcgacgcaaaaggtttggatggacatatatactcttccggtacctggatctggtgggaagacatgctcgcagatatttgaagaagccggttgtgatacacctgcaagccctagctgcggcgcttgtttgggtggtcctaaagacacatatgctcggatgaacgagcccaaggtctgtgtctcgacaactaacaggaacttcccgggtcgaatggggcacaaggaaggccagatatatcttgcttctccgtatacagcggctgcatcagctttgaccggttatgtcacagatcctagggagtttttgtgttgattgtgttaagattttgttttgtgtcttataatgtatccaatttgtgcgagaaatgcagaatttttgaacaactgtttcttaggtttcaaaaatgaaatcgttctttagtagcatgcaatagggaggactaggatgatagtgactagtgtaccggtatcagtcgtatggatgcgtacttaaagcgaatctgtactagtattataatagttttggatggttcggtttttatatggcttggaataacaatttctggatttccctttttaaatgaaataaggttacttgtagttttataaaatgtccaatgtggtatctgtactttgaaaatatccaatatgatccctaaactatcaatttatgtattatttggtacttgttctttt

SEQ ID NO: 5121 - DNA, 1980 bp, Gossypium raimondii
cttgcagcatctcttccacgtgtactttgctctgcattgccctgcttccattggtcttcacttttgtgtttcctttatccattttgttttttacatttctgctgttgatttacttgaagagctgaaatcttatggcatcctctttggtttcctctcctacttcttctttcctcaagaagattgcttttcataaatgtaagaaacaagtttcgaagaaaatcgtctcagtcatggcaccccagcaatctgagcgtaaaacatataccactggctctgtgaagacaggaatgacaatgacggagaagattcttgcaagagcctccgagaaacaacagttgaatccaggtgataatgtttgggttaatgttgatatcttgatgactcatgatgtttgtggtccgggttccattggtatcttcaagaaagaatttggtgaaaaggctaaggtttgggaccgtgaaaagattgttatcatacctgaccattatatattcactagtgatgaacgtgcaaatcgtaatgtggatattttgagggatttttgcggcgagcaaaatataaagtacttttatgatattaaagatcttagtaatttcaaggcaaacccggattacaaaggtgtatgccatgttgcacttgcccaagaaggtcactgtaggcctggagaggttttgttgggaaccgattctcacacatgtaccgcaggagcatttggtcaatttgctacaggaattggaaatacggatgcaggttttgtattgggcactgggaaggttcttctaaaggtgccaccgactttgagatttgtgatggatggtgaaatgcctcattatttgcttgcaaaggatttgattttgcagatcattggtgaaatatctgtagctggtgcaacgtataaatcaatggagtttgtgggaacaactgtggaaagtttaaatatggaagaacggatgaccttatgcaatatggttgttgaagctggtggaaagaacggtgttgttcccgctgatagtactacatttaagtaccttgaggataaaacatcggtgccgtatgaaccagtttacagtgatgcgcaagcaagttttctttctgaatacagattcgatatctcgaaattggagcccttggtagctaagccacactctcctgataaccgagctttggctagggaatgcaaagatgttaaaatcgacagagtgtatatcggatcttgtactggtggaaaaacggaagattttcttgctgctgctaaagtctttctagcttcaggcaagaaggtcaaagttccgacattccttgtccctgcgacgcaaaaggtttggatggacatatatactcttccggtacctggatctggtgggaagacatgctcgcagatatttgaagaagccggttgtgatacacctgcaagccctagctgcggcgcttgtttgggtggtcctaaagacacatatgctcggatgaacgagcccaaggtctgtgtctcgacaactaacaggaacttcccgggtcgaatggggcacaaggaaggccagatatatcttgcttctccgtatacagcggctgcatcagctttgaccagttatgtcacagatcctagggagtttttgtgttgattgtgtaaagattttgttttgtatcttataatgtatccaatttgtgccagaaatgcagaatttttgaaccactgtttcttatgtttcaaaaatgaaatcgttcttcagcagcatgcaatagtgaggactaggatcatagtgactagtgtaccggtatcagtcgtattgatgcgtacttaaagccaaactgtactagtattataatagtttcggatggttcagtttttatatggctcggaataacaatttctggatttccctttttaaatgaaataaggttacttgtagttttataaaatgtccaatgtggtatctgtactttgaaaatatccaatatgatacctaaactatcaatttatgt

SEQ ID NO: 5122 - DNA, 7156 bp, Medicago truncatula
tggacaatacttatatgtatacatgtgtaattttacacatagatacaaaaattaaatctcacatagaaaatggagaagagaagcaaatgaaaatgaaacattgggtcaaaaacaatcacagttcagagaataacaataaaataaaaacataaatcaaacaaaatctcagaaaactacaacaacagccgccacacacacaaacatcaatcaatcaatcaatggcttcctctcttgttccttccacctccttcttccacaccaagaaggatctgtctctctctgctttctcatcaccatcttctcaacgatgtcacaaacatgcttcaaagagaatcacttgttctgttgctgcacctcaacagacacagcgtcaaccttcttcaactggatcagtgaagacagctatgactatgactgagaagataatggcgaaagcttctgagaaggggcatgttacacctggggataatatttgggttgatgttgatgttttgatgactcatgatgtttgtggtcctggttctattgggatttttaagaaggagtttggtcaggatgctaaggtttgggatcgtgaaaaggttgtaataatacctgaccactatatattcacaagcgatgaacgtgcgaatcgcaatgttgacatactcagagatttctgccatgagcaagatatcaagtacttttatgatattaaagatcttagtaatttcaaggtgaatccagattacaaaggtgtttgtcacattgctcttgctcaggaaggtcattgcaggccaggagaggttctcttgggcactgattctcacacttgtactgctggagcatttggtcaatttgcaacagggattggtaatactgatgctggttttgtgttgggtgcagggaagcttttgcttaaggtgcctccaactttgagatttgtaatggatggagaaatgccgaattatttgcttgccaaagatttgattctgcaaattattggtgaaataagtgtggctggtgcaacttacaaatcaatggagttcgttggctcaactgttgaaagcctaaacatggaagaacgaatgacattgtgcaacatggttgttgaagctggaggaaagaatggtgttattcctcctgatagcattacatataaatatcttgagggcaagacatctgtgccatatgaaccagtatatagtgaccagcaagcaagatttctttctgagtatagatttgatgtttctaaattggagccactggttgccaagcctcattcaccagataaccgtgctttggcaagagagtgcaaggatgtgaaaattaacagagtatacataggatcttgtacaggtggaaaaacagaagatttcatggctgctgcaaaagtttttctagcatcaggtaaaaaggtcaaagttcccacatttcttgtccctgcaacacagaaggtttggatggacgtgtatagtcttcctgtccctggatccggtggtaagacttgctcgcagatatttgaagaagctggttgtgacacacctgctagtcctagttgtggtgcttgtttgggtggcccgaaagatacttatgcccgcatgaatgaacctcaggtttgtgtttcaaccacaaatagaaactttccagggcgaatgggacacagggaaggtgaaatatatttggcttctccgtatacagctgcagcatctgcattgaccggttatgttactgatccaagagagttcttgcagtaagctatattatccattttgtattgtattgtattgtattgtatacattggttagttttgtattctctagccaaacttagaacttaagctattaaagttttacaactccattggtatttcttttaagtggagaaattgtgactgttaatgaattggttgagttgtagtgactaaatcaatagtagttactttagtattatatgagtatcatatggtacttcatttcctttgtcatctttaattgtcatatgatctatacttagtaagtgatcatcaatcatacaccatcagttcttgaaaagcaacgataaacaaaggtttatgggtttggataacttttctaacaagtgtttatagaaatagaaaaattgaaatgatattcttatgtaattatcactattgtaactaatgatttctctttcaagtttaaaagttaaaaccatttgacaaacaaaatgctcaatacacaaaatatcaggtttttcaaaacgaatcaatttctaaatttccatctttttgttgcccccgagcactaacttaaaatctctctttaaccacacgtcacccaacttcatcatccccaacaaaatcaaactaccatgttttttgacacctctttcctccctcaatattatgtttatcaattcttgaattacatctctttcttctccctcgtattttaaccacaactattgccctgatggaacatgtgtgaaaattgagttaaaagattagacacaaatttctatcttaggtagaacaagtgttgtgtgaattgaaaaaagttgaagttccacatcggagggaatcaaacattagtatttttttttttttgcaggaaacgttggtagtgtttatatagggggtgtacctctaataggggtacataattatgtaaacgaagtaagcacttaaaaaaaaaagatattgatatatattttattatttgtaaatgataaattaaataattaattgggttaatagtgttttatccccctgtaatataggtcattttcaggtttacctcctataaaatatttttttttatttcccctgtaaaatattttttttccagaattcccccctaataggccaaacaaaaacgaatttttatttttttttacaaaattttttacttttgtatggcctattagggggtattctggaaaaaaaaaaaaaacttttacagggggataaataaaaaaaaatattttacagggggtaaagcaccattaaccctaattaatttaatcattattagaaagtgttttcttaatcctaagttttgctaaaatattttggaacgcaatctagaattttttggaatacaatctgaaatattttgataggcaatctaatatattttagtgcatgatcttgaatattttaatactcaatgatatatttttgtactaaataatatatttttgtactcaataagatatattttgatacacaatttgagatatttttgtattagaactaatatgtgaattacttgttcccaaagtttctcacttattagttgtgaactttctctataaatagagagctcacacagtacattcgatacaccgaaatttatagttgatgtttcctatgtttttcctctcttctccctccttcgacttgtgttaacgagtcattcttctttttctactccttatgttccttcggaattaagagtgttcttaagaccatagttccttttcggtttattgtcctttcggaactaagaatggtcttaacagcatagtcacttcaattatttgtctctttagaataaataatattttaagatcatagtccctattcggtataccatattagtttcagtattaaagtgttgtcttagcaccatatttgaaggtgttatttctcaaacgattatttacgtaatcaaacaggtgaactggactattttatcattgaggcgcattaaaaggtacttttctaaactcgatctacaacatcccccaacctctaaatagccttaggatcaattggagcttttttttcttttctttttttacaaaaacatgagcttgtattaagagacgaaggagtattatattctgattttaggaagaaaaaaattcctttactatttcttccatgtattagttaaaatttaatttccaggataatataattaatattaatatttctaattatttggtaaatcagatgttttattactttctccatttattaattaattaatatttaattttcaagatggtacaattaatactaatattcctaattatttggtgaatcagattagtaatatataaccgcttattaagctctaaattagtgtctaaaatctgaataccaaaacatagtctccttgtaaccaaaagaaacatactgtgttcttttgttttgatctttaaatatcactaagcaatgtgttgattttcattatcttttgttgtttcttccgctgattatgcaacagcacttacaaaaagtttgttgtttttttagggttaacgttcatgtgttttgcctaatagccaaagagtaacattgagaggtgattctgcacttaaagatggtcaagatgtattgttgggcttagctgagttatttaaggacttgaattgaaggaagagagccataatttgaagtttggtggtcaagccatccacacattgatatcagatagaggtatgttgttaaaaccatacatgatatatgttgtcattgtcttttttttttttttttaaggcatatattgtcattgtcttatttagtgttttagtgtaaaataactgatattgacctcgaagcaattataatgaattatccatgtcacaatccaaaatcaacatattgtcttaatcaataattgttgaaaccgtaaaactgtcacgaagtagatagtaacaaaacatgcagaaactgtaaaattgttttgaagtagatagtaacaaaacatataaaagcacctagtaacatggcatcataattcatcaaactttgaccaaagctctcattctcttttcttgattcatccaataacctgcagcctttgacaatactttattgaacaacatattgttcctagaatgccccaaatgaactgcaagtttcatccgtggctgtgacaacctggaaaaaaaaaagtaaaaattataaattcttccatgctagttataaaggataacttgtgaaataaataagatagtaacatgaaataaacttacatgctagttataagtgatattttgataatcacttatgaatgcacattcaatcatccatttggcaacccacacttcacaatcatttctgtggaaaattgaaataccttagtgacaccgacaacaatcataaattaaaaatagaaataaacaaagtttaatgaatgagaattcgatccattgcgttgtgttgtaagggaacttggttgaattatacagaagtttgatattgaattggatgagttcacatcaccaatagattcattattcaatatttcctcaatagaaatagcttgcaatcaattacaaacctttgtaatataagcataataataagttataatgtaaatagaatgtcggatagcttcaaaatcatatgacgttttaggtaatttctttcacgacaaggcaaggagtctaacagcaccaactttctttctaaaatatcgacgaccatgagataccagtgcaccccttgatcgttaacaggaatgaaaatatgtaagaattcaaaaaacataattcagttgatgctttaattttgatggtcgttttatgtgattatgattaaatgataattgccacatcaaaattaaagcatcaactgaattatgttttttgaattcttaaagattttcattccagttaacgatcaaggggtgcactggtatctcatggtcgtcgatattttagaaagaaagttgatgtggttagactccttgtcttgtcctgaaagaaattacctaagacgtcgtatggttttgaagttgtgtgtatcctacattctatttactttataacttattattatgcttatattactaaggtttgtaatttattgcaggctatttttattgaggaaatattgaataatgaatctattggtgatgtgaactcatccaattcaatatcaaacttttgtacaattcaaccaagttcccttccaacaaagcgcaatggattgaaattctcattcattatactttgtttattactatttttaatttatggttgttgtcggtgtcactaatgtacttcaattttcgacagaaatgattgtggagtgtgttggttgctaaatagatgattgaatgtgcattcagaagtgattatcaaaatatcaatgttgtcacagctactaggttgaaacttaaacttcatttggtgcattctagtaacaatatggtgttcaatgaagtaatgtcaaaggctgcaagttattggatgatggatcaggaaaaggaaaagagaaggagagctttggtttggaattttgaaaaggttgtaataatccctaaccactatatattcacaagtgatgaacgtgccaatcgcaatgtacacatactcagagatttcttaaatccatattacaaaggtgtttgtcacattgctcttgctcaggaaggtcattgtaggccaggagagtcacatcttaaatgtgtgcatatccctttgcatccaggaaggttttcaattgaatcccttagtgttgaagtaacattgtgcaacatggttgttgaatctggaggaaagaacggtgttattcctcctgatagcattacataaaaatatctcgaggtttgtacaattgagtagatttgctgaaattatataatgtttggatttttctcaacttttcctttcatctcattgttttgtttactaagttagcatataaacgttgttagaatatctagtaaacatcacactatatcttgaattcttgattgtatttttagaatagtttaggtagcgtttggtagacaagatttgttctatgtttggcaatgcaaagtaaaacatgattgaaaaaagtaggaaaagtgaaatgtgtttgtaaaacatggataatagaaaaaagtatgatgtgtcatgcttacttatgtttatgaagcacggacaccggacacggacactgacaaattggtcaggcgatgatcatcgctgctgtttcgctgagttatatttccagctaggttttatggagggctcttcactggtttgtgtttcaaccacaaatagaaacttttcggggcgaatgggacacaaggaaggtgaaatatatttggcttcaccatatacagctgcagcatctgcattgactggttatgttactgatccaagagagttcttgcagtaagctatattatccattttgtattctattgtattgtatacattggttagttttgtattctctagccaaac

SEQ ID NO: 5123 - DNA, 1909 bp, Phalaenopsis aphrodite
taacaccacaccagtctagctcggtgctttcactaatggcggcttcaactatcacggccaccggatcttctcttttcggtaaaaagtgcgatttgggccgtttaatctcctcttcttccacttcatttgtcgcgcatagatgcaggaaacactctttaaataagattctctcagtcatggcaccttcccgttctcctcagcgttctccatcaacctctggctcggtgaagcacgcgatgacgatgacggagaagattctagctagggcttctgaaaggtcgcatcttgaacccggagaaaatgtttgggtgaatgtggatgttctgatgacccatgatgtctgtggtcctggaaccatcggaatcttcaagagagaatttggagagaatgctaaggtttgggatcgtgaaaaaatagttataataccagatcactacattttcacaagcgatgagcgtgctaaccgaaatgttgatatcctgagggatttctgtatggagcaaaacatcaaatatttctatgatattaaagatcttgggaatttcaaggctaatccagattataaaggtgtttgccatgttgctcttgctcaagagggtcattgtagacccggcgaggttttgctcggtacagattcacacacttgtacggctggtgcttttggtcaattttcgagtggaattgggaacactgatgcaggctttgtcatgggcgctggcaagcttctacttaaggtgcctcctacattgagattcactttggatggagaaatgccaagttatttgctagctaaggatttgattttgcaaataattggcgaaataacagtagctggcgcgagatataagtctatggaattccttggttcgaccgttgaaagtttgagtatggaagagaggatgacgttatgcaacatggtcgtagaagctgggggaaagaatggggttgtccctgcagataaaactacgttcaaatatctcgaggataagacttctgtggaatatcaacctgtgtatagtgatgaaaatgccaggttcattcaagattacaaatttgatgtctcaaaattggaaccattggttgcaaagccgcattcacctgataatcgtggtctagcaagagaatgtagagatgttaaaattgatagggtgtacataggatcgtgcacgggaggaaagacggaggattttatggccgctgctaaggtttttctagcctcgggaaaaaaggtcaaagtccctacatttcttgttccagccactcagaaggtctggatggatctgtatggcctcccagttccaggatctggagggaagacctgctcccagatctttgaagaagctggctgtgatactcccacaagtcctagctgtggtgcttgtttgggtggccctcgagatacctatgctcgcatgaacgaacctcaggtttgcgtgtcgaccacgaaccggaattttcctggcagaatggggcacaaagaaggtcaaatttatcttgcttcgccgtatacggcggctgcatcggcattgactggctttgtaacggacccgagagagttcttgcagtaggaacagattcattgtaggctccgccgaccgtcttttggcgcgtgttatgggctttgctgtctgttgttgaggagctgtttgtgctcaatgtatgattggggttatagttaggagagatgggatctgagaagagtcttgcaatctgggtcaagaattagggattgttcattgcttgttacttgttaataacaagtatagtgtgtatttgatgggggactatttgtgagaagtaatatgtgaagttataaacaggagagttcattgcttcttattgaccatttgatttgtgtttttacttttacatgcatgccccacaattcttatgtatttacatatcaaac

SEQ ID NO: 5124 - DNA, 1777 bp, Papaver somniferum
agtatataaaacccaaggatgcgcatttcacaagtgtcgcagattaccaatttgatctcctaactcaacctacctccaccacacgccgccacaattcccaattgagttttctatcctcgtcaaatttgatcacatcacgtttctctttctatttagatacgtagagacgtgagagagctcaatcatggcgtcttctgcaattgctgcaggctcagctacatcgtctttcattaaaaagaatgaaattggtttatcgtcattcactccaacttcgtttcgtacacatagctgtaaaagagctttttctaagaaagttgtttcagtaatgtcacctccacagtctgagcgtagaccttcgacgactggttcagtgaaaactgctatggctatgactgagaagataatggcaagagcgtctgagaaatcccaagtggttccaggagagaatgtatgggtcaacgttgatgttttgatgactcatgatgtttgtggacctggaactattgggatattcaagaaagaatttggagaaaatgccaaggtttgggatcgtgaaaagattgtaattatacctgaccattatatattcacaagtgatgaacgtgcaaatcgtaatgtggacatcttgagggatttctgtgcagagcaagatatcaaatacttttatgatatcaaggatcttggaaatttcagggctaaccctgattacaagggtgtctgccatgttgctcttgcccaagaaggtcactgcaggcctggagaggttcttttgggtacagactctcacacgtgcaatgctggagcttttgggcagtttgctagtggaataggaaacactgatgctggttttgtaatgggaactggaaaatcccttctaaaggtgcctccgactttacgatttatattggatggggagatgccaagttacttgcttgctaaggatttgattttgcaaattattggtgaaataactgtcgctggggcaacatataaatcgatggagtttgttggctctgctgttgaaagtctaactatggaagaaagaatgacgttgtgtaacatggttgtggaagctgggggaaagaatggtgttgttcctgctgacagtactacatataaataccttgagggaaagacgtcggtggagtttaatccagtttatagtgatgataatgcaagattccttcaacaatacacaattaacgtctcaaagttggagccgttggttgccaagccacattctcccgacaatcgtgctatggcaagagaatgcaaggatgtaaaaattgacagggtatatataggctcatgtactggtggaaagaccgaggattttctatctgcagcaaaagttttccttgcttcgggcaaaaaggtcaaagtgccaacttttcttgttcctgccacccaaaaggtctggatggatttatatgccatggaagttcctggatcaggtggcaagacatgctcacagatatttgaagaggcaggttgtgatacccctgcaagtcctagttgtggagcttgtttaggtgggcctagagatacctatgcacgtatgaacgagcccaaggtatgtgtgtcgacaacaaacagaaacttccccggcagaatgggacacaaggaaggggagatatatttggcttccccttatactgcagcagcatctgctttgacaggttatgtcaccgacccaagagactacttgcagtaaaaccctatgtagcctttcatcactcgttgtatgtgtttcatcagatttatttgaagatttttg

SEQ ID NO: 5125 - DNA, 2006 bp, Sesamum indicum
gcataggttagattgaaaagactgtgagcagagcccaaagagtgaagtggattgaacagaacaagttcttgccttaacccacattcgtcatttgtcatcaaacagccgccacagacagagaagtgccagaaacataaaattggaaaagaaatgcaaaattgttaaaagagagaagtccacaatccatacatatattcttcctcttccctccacgcccaccttctcacttcagacaatatcatccgatggcttcatctgctatcactcccagctcctcgttccttgccgacaagaaagatgggattggcgggttttcagctttccgcaggcagcctccatttccacgttctgcgcaggtttccaagaggaaggtctccaagaaaatagcgtctgtaatggcacctcagcaatctgagagaaaaccgtcaacaacgggggcggtcaagactgggatgactatgactgagaagatactggcaagagcttcggagaaaacccagttggtacctggggagaatgtttgggtgaacgtggatattttgatgacacatgatgtttgtggccctggttccattgggatcttcaagagagagtttggagaaaatgcaaaggtctgggaccgtgagaaagttgtaataattccagatcattatatcttcaccactgatgaaagagcaaatcggaatgtagacatcttgagggatttctgtactgagcaaaatattaagtacttttatgacattaaagatctaggaaatttcaaggcaaatcccgattataaaggtgtgtgccatgtagctcttgcccaagaaggtcattgccgacctggagaggtcttgctggggaccgactctcacacatgtactgctggagcatttggtcaatttgccactggaattggaaatactgatgcaggttttgtgctgggtactggaaagcttttgctgaaggttcctccaactctgagattcgtgatggatggtgaaatgcctgattatctgcttgccaaagatttgattttgcaaattattggtgaaatttcagtggctggtgcaacatataaagccatggaatttgtcggctctacagttgaaagtttaacaatggaagaaagactgacattatgcaacatggttgtcgaagctggtggtaaaaatggtatcatccctgctgatagtaccacgtataaatatcttgaggataagacatctctgccatatgaaccagttgtcagtgatggagatgcaagatttctttcagagtacagatttgatatctcgaagttggagcctgtggtggctaagcctcattctccagataatcgtgctttagccagagaatgcaaagatgtgaaaattgacagagtatatattggatcttgcactggtggaaaaacagaggatttcatggcggctgctaaattatttcttgcttcggggaagaaggttaaagtcccaacattcctcgttcctgctacacagaaggtttggatggatatatatagccttccagtaccaggatctggtgggaaaacttgctcacagatatttgaggaagccggttgtgatacaccagcaagccctagttgcggtgcgtgcttgggaggtccaagagacacttatgcacgcatgaacgagcctcaggtctgtgtttcaacgacgaataggaatttccctggtcgtatgggccacaaagaagggcagatttatctagcttctccatatacagctgcagcatctgcattgactggttttgttactgatccacgagaatttttgcagtaagcagttgttttagcagttttctaccaccctactttctcaacatgaattttggagctgaagcacctcgactatttatgctgtttgtatcttgtgctatgtcggaaactttgttgcttacaacttgttcgtgtaacttgaaaaaagtcttttctttccgttgttgtaataatagactgagaatgtcaataaaatgagtcttgaagcggacacgtttaacctccc

SEQ ID NO: 5126 - DNA, 1774 bp, Trigonella foenum-graecum
aacaaacatcaatcaatcaatggcttcctctcttgttcctacaccttccacctccttcttccacaccaagaaggatctcaatctctctgctttctcatcatcttcttcttcttcacaacgatgtcacaaacatgcttcaaagagaatctcttgttcggttgctgcacctcaacaaacacagcgtcaaccttctgccactggatcagtgaagacagctatgactatgactgagaagataatggctagatcttctcagaaggagcatgttacacctggggataatatttgggttgatgttgatgttttgatgactcatgatgtttgtggtcctggttctattgggatttttaagaaggagtttggtcaggatgctaaggtttgggatcgtgaaaaggttgtaattatacctgaccactatatattcacaagtgacgaacgtgccaatcgcaatgtagacatactcagagatttctgcaatgagcaaaatatcaagtacttctatgatattaaagatctgagtaattttaaggtaaatccagattacaaaggtgtttgtcacgtcgctcttgctcaggaaggtcattgcaggccaggagaggttctcttgggcactgattctcacacttgtactgctggagcatttggtcaatttgcaacagggattggtaatactgatgccggttttgtgttgggagcagggaagcttttgcttaaggtgcctccaactttgagatttgtaatggatggagaaatgccgaattatttgcttgccaaagatttgattctgcaaattattggtgaaataagtgtggctggtgcaacttacaaatctatggagtttgttggctcaactgttgaaagtttaaatatggaagaacggatgacattgtgcaacatggttgttgaagctggagggaagaatggtgttattcctcctgatagcattacatataaatatctcgagggcaagacatctgtgccatatgaaccagtatatagtgaccagaaagcaagatttctttccgagtatagatttgatgtctcaaaattggagccactggttgccaagcctcattcaccggataaccgtgctttggcaagagagtgcaaggatgtgaaaattaacagagtatacataggatcttgtacgggtggaaaaacagaagatttcatggctgctgcaaaagttttcctagcatcaggtaaaaaggtcaaagttcccacatttcttgtccctgcaacccagaaggtttggatggacgtgtatagtctccctgtccctggatctggtggtaagacttgctcacagatatttgaagaagctggttgtgacacacctgctagtcctagttgtggtgcttgtttgggtggcccgaaagatacttatgctcgcatgaatgaacctcaggtttgtgtttcaaccacaaatagaaactttccggggagaatgggacacagagaaggtgaaatatatttggcttcaccatatacagctgcagcatctgcattgactggttatgttactgatccaagagagttcttgcaataagctagctatattatgattatcccttatctattctattgtattgtatacattggttagttttgtattctctagccaaacttagaacttaagccattaaagttttccactctatttgtatttctttagtggagaaattgtgactggtaatgaattggttgaggtttagtgacttaaacaataatggttattttagtactttatgagagtatcttatggtatttcatt

SEQ ID NO: 5127 - DNA, 1982 bp, Citrullus lanatus
attgtagttcacaatttgcaaagtgtggttaaccgaagccgccttcttcctatatccttcagccttcaggatcatttctccgccgctgaggaggaattttttttctccctttttctagctgaagatttgcgtccatggctgcttccaccggttcggccttgacatcaacggccttcttgagcaacaagaaggaattggacgtcgctgctttttcgtcgtcgttgccgttttcctatcggaggtgcgagagaactgtatcgaagaaaatatgttcggtcatgacaccacagcaatcggaacgcaagcccagcgccactggctcggtcaaaacagccatgactatgacagaaaagatatttgctaaagcttctaaaaaaactgagttgagcccaggtgaaaatgtttgggttgatgtggacgttttaatgactcacgatgtttgcggtcctggttctattggaatttttaaaaaggagttcggagagaacgcaaaggtttgggaccgagaaaaggtcgtgattatacctgaccattacatatttaccagtgatgaacgcgctaaccgtaatgtggacattctgagagacttctcaaaagaacagaatatcaagtacttttatgatattaaggatcttagtgattttagggtgaacccagattacaaaggtgtttgccatgttgcgttagctcaagaaggtcactgtaggcctggggaggtcctgcttggtacagactctcatacctgtacagctggtgcatttggtcaatttgccagcggaatcggaaatactgatgcaggatttgttctgggcactgggaaatcacttctcaaggttcctccaactctgaggtttgtcatggatggagaaatgcctgattatttacttgcgaaagacttaattttgcaaattattggtgaaatatcagtatctggtgcaacatataaagccatggaatttatcggcacaactgttgaaagtttaactatggaagaaagaatgacattgtgcaacatggtcgttgaagctggaggaaagaatggagttattcctcctgatagtactacgttcaagtaccttgagggtaagacttccaaagcctacgaaccagtgtacagtgatgagaacgcaagatttctttcagaatacagatttgatgtgtcaaaactggagcctgtggtagctaagccccattctccagataaccgtgctttagcaagggaatgtaaagatgtgaaaattgatagagtatacgttggatcttgtactgggggaaagacagaggattttctggccttggctaaagtttttcttgctgcaggaaagaaggttaaagttcctacgtttattgtccctgccactcaaaaggtttggatggatttatatagtatcccagtacctggagctggtggtaaaacttgctctcagatatttgaggaagctgggtgcgatacaccagcaagtcctggttgtgctgcttgtttaggtggccctagggatacttatgcacggatgaatgaaccacaggtctgtgtttcaacaacgaacaggaacttccctggtagaatgggacataaggagggacagatttaccttgcttctccatacacagctgcagcctcggctttgactggatacgtcacggacccaagagagttcttgcagtagatttaccgaattggagattactataatgtatgttttctgtattatttaagttgaaataaggcttcgtcatgtcatgtttgtatcttcttagggcttgattaagaggaaatgattatccctcttttccagtttcatgagattttggtctatttggatttggaaggaacggagtgtttaaattaattattattattaacatactatttgtatcattatatatgttatgttaggaagggaaaaaggaattgaaatgttgatcttttagaatttctatggaaagtagagaattaggggtgggaaggaatttgaactttt

SEQ ID NO: 5128 - DNA, 1823 bp, Carpinus betulus
gataatagagaaaacctcgcaataaacagcaccacaatccacccatggcttcttctaccattgctccaacccccatatctttcatcctcaacaagaaagatttggggttctctgcttcctcggcaccgtcactattttccattccgaaatgcaggagaacggtttccaagaaaatttgttccgtcatggcaccgctgcaatcggaacgcaggccttccaccactggctcagtcaagactgcgatgacgatgaccgagaagatattggccagggcttccgagaaaccccagttgagtcccggtgagaatgtgtgggtgaatgttgacattttgatgacccatgatgtttgtggcccaggctcgatcggaatcttcaagaaagaattcggagagaacgccaaggtttggaccgggaaaagattgtaataatacctgaccattacatattcacgagcgatgaacgtgcaaaccgtaacgtggatatattgagggatttctgcatggagcaaaatatcaagtacttttatgatattaaagatcttggtaattttaaggctaacccagattacaaaggtgtatgccatattgctcttgcgcaagaaggtcattgcaggcctggagaggtcctgctgggtacggactctcacacttgtacagctggagcgtttggccaatttgctactggaattggcaatactgatgcaggttttgtgttgggcgctgggaagctgctgctcaaggtgcccccaactcttagatttgtgatggatggtgaaatgccaagttatttgcttgcaaaagatttgattttacaaattattggtgaaatatctgtatctggtgcgacatataaatctatggagtttgttggcacaactgttgaaagtttaactatggaagaaaggatgacgttatgcaacatggttgttgaagctgggggaaagaatggtgttgttcctcccgatagcactacatataagtaccttgaggataagacctctttggcctatgaaccagtttatagtgatgaacaagcaaggtttctttctgagtacagatttgatgtctcaaagatggaaccgctggtagcaaagcctcattctcctgataatcgggctttagcacgagaatgcaaagatgtgaaaattgacagagtatatatcggatcttgtacaggaggaaaacagaggacttcatggctgcagccaaagtttcctagcttcaggcaaaaaggtcaaagttcccacattcctcgtccctgcgacccaaaaggtttggatggacgtatatggtctcgaagtaccagggtctggtggcaagacttgctcccagatatttgaagaagctggttgtgacacaccggcaagtcctagttgtggtgcttgtttgggtggccctaaagacacttatgcacgaatgaatgaacctatggtctgtgtgtcaacaacaaacagaaacttccctggccgaatgggacacaaggaaggccagatatatcttgcttccccatatactgcagcagcatctgctttgacaggttatgttaccgatcccagggagttcttgctgtaggctataaatatcataaaatctgtcggttactttgtgccctgtcaccggaggtcaaatggcagagctgaaaaacatcatggatcttgctgtttggatgtttgaagctgttgtgttttatgattactaggatcttagtgctactatttagcttttaagtgagttgtagcctctgcaataaactttgttcttagggcagtgctgtaacgacccatcaaagaaaccaaggaataagaggagatgaatgtcatgact

SEQ ID NO: 5129 - DNA, 2390 bp, Aristolochia fimbriata
gacgggattctgggaaacgggattattaaccaggacgcccgcctgatgagagggaatcaagagagaaaacgcaaggaaagtacccgcatccgcatgcatccattttgccttttagacaaaccgttgctccctctttttcctctctctttctctctcgttatatgaagctgcagacagggtatctatccgcctagccttccttttttgcagcttccagccggattgcgaagaccccatttcttcttttttgttttttttttttaatccgtttggcagtggggagaggtaactctgtctctgtcactctctcgttctcaatcaactgatatttcttgcttatattctgcctgctttattagtttctggcgttgggttttcattgcttggatggtgaggctctgttcctttagagcattcttttcttgattcttcgacttgcagtgcattaccggcggctgcctcgtagctgatctgggacactagggtttatcgaccatggcctcgtctgcaatatctcccatctcttctcctttcgtgaagggggaaaaaattcttcgttgttctacttacgtcttcttcactttttaatcaaagatgttgtaaaagcactcccaacgtagtggcttcggtcatggctccgccgcagactcaacggcctccttcgaccactggttcagtgaaaaacgctatgacgatgacggagaagattttggcacgggcgtctcagaagtcacggttgcaaccgggggagaatgtctgggtggacgtcgacgttttgatgactcacgacgtttgtgggccagggacgattggcatattcaagagagagtttggtcaggatgctaaggtctgggatcgtgaaaagataatcataattcccgatcattatatcttcaccagcgatgaacgtgcaaacagaaatgtggacatcttgagggatttttgtatggagcaaaaaatcaagtatttctatgatatcaaggacctcagtaattttaaggtcaatccagattacaaaggtgtatgccatgttgcacttgctcaagaaggtcattgtcgaccaggcgaggtgctgcttggtactgattcccatacatgcaatgctggagcgtttggccagtttgcaactggaattggcaatactgatgccggttttgttatgggagctggaaaacttctacttaaggtacccccaactttaaggttcatcatggaaggcgaaatgcccagctatttgcttgcaaaggatttaattttacaaattattggtgagataagtgtagctggtgcaacatacagatccatggaatttgttgggtctacagttgaaagtttaagtatggaggaaaggatgaccctgtgcaacatggttattgaagctggaggaaaaaatggtgtggtacccgttgacgaaacaacattcaaatatcttgagggaagacaccgttgagttatgaacccttgtacagtgacgaacaagccaaatttcttcaagagtacagattcgatgtgtcaaagttggaacctgtggtagcaaagcctcactctcctgataatcgagcattggctagagaatgcaaggatgttaaaattgatagagtatatataggttcgtgtactggtggaaaaacggaggattttatggctgcagctaagctctttttagcagcgggtaaaaaggtcaaagtgccaacatatttggtccctgcgacacaaaaggtatggatggatgtatatagcctcctcgttcctggttcagggggtaagacatgctcccaaatatttgaagaagctggttgtgatactccagcaagtcctagctgtgcagcatgtttgggtggtcctcgtgacacttatgcacgcatgaatgaaccacaggtctgcgtgtccaccactaatcggaactttcctggtcgaatggggcataaagaaggacagatttatctggcatctccatacaccgcagcagcttcagctttgacgggtttcgtgaccgacccacgagaattcctgcaatagataggctcgctcatccttctggaccgataacctgtgggtcttgccacgaataatcttaataagaattgtgaggccggctgagtcttgtggaatggtgtaagttgttactgtatgttttgatcgagtggaaaaaataggccgagtccattaattagaggaacagtcggtgctgcatttatatttactaccatgcagctgcttcccttctctcttgacctcatgaaaagtctttatcttatctattagttttcatttcagattcatttgtcgacttgaagattgacatttacatcgttaatgatctttcacaggccaccctcgtagttcttttacgtggtagagccaaatgacaaaattaaaactttcaattc

SEQ ID NO: 5130 - DNA, 1673 bp, Ricinus communis
ggaccgtgctttccgcagccgcctccatttctcaatcaataggagaaaaaacaaagaatagaggattttctcaaccttaactctgtttagtgtaaccctctttttctatcatggcttcctctgccattacttctccctcttcatcttttatcaccaagaagaaggatctgggtctctctgctttctcttcacagtcatcgccattttattctattcccaaatgcaagaaatcaatttccaagaaaattgtatcagttatggctccgcagcagtcagaacgcacgcctgccactactggctctgtgaagactgcaatgacaatgacagagaaaatcttggctagggcctccgagaaatcccagttgagccctggtgagaatgtttgggttaacgttgatgttttgatgactcatgatgtttgtggccctggttccattgggatcttcaagagagagttcggacagaatgccacggtttgggaccgcgagaaaattgtcattataccggatcattacatattcactactgatgaacgtgcaaaccgtaatgtggatatcttgagggatttctgccaggagcaaaacgttaagtatttctatgatatcaaggatcttagtaactttaaggttaaccctgattataaaggtgtatgccacgttgcacttgcccaagaaggccattgtaggccaggagaggtcctattaggtacagactcccacacctgcactgctggagcatttgggcaatttgctactggaattggcaatactgatgcaggttttgtattaggcactgggaagctcctccttaaggtgcccccaactctgagatttgtaatggatggtgaaatgcctgattatttgctagccaaggatttgattttgcaaattatcggtgaaatatctgtgtctggtgcaacatataaatcaatggagtttgtaggcacaactgtcgagagtttaaatatggaagaacggatgacactatgtaatatggttgttgaagctggggggaagaatggggtcatccccagtgatagcactacattcaagtaccttgaggataagacatctgttccctttgaaccagtttatagtgatgagaaagcaaggtttctttccgagtatagatttgatgtctcaaaattggaaccattggtcgcaaagcctcattctcctgataactgtgctttagcaagagaatgcaaagatgtcaaaattgacagagtatacattggatcttgcactggtgggaaaacagaggattttatggcagcagccaaagtctttttagcttcaggtaaaaaggtcaaggttccaacgtttcttgtccctgctacccaaaaggtttggatggacgtctatagtctccctgtaccaggatctggtggaaaaacttgctctcagatttttgaagaagctggttgtgacacgcctgcaagtcctagttgtggtgcttgtttgggaggccctaaagatacctatgcacgaatgaacgaaccaatggtctgtgtttcaacgacaaacagaaacttccctggtcggatgggacacaaagaaggccagatttatcttgcttcgccctatacagccgctgcatcagctttgactggttatgttactgatccaagagagttcttgcaataggctattgctgttttattgacacactac

SEQ ID NO: 5131 - DNA, 1812 bp, Carica papaya
gcattgtgtgaggctgctttgcgttaagattaccaacagcataaatccggctagcaaaaaccaaaatggcttcctctgttatttcaccgtctcctccttccatcatcaacagcaagaaggatttgggattttctgcctcctcatcctcgttaaaattatcaattcccagatgtcaaaagagatcagtttcgagaaaaattgtttcagttatggcaccacaacaatcagaacgcaagccagccgccacaggctcagtgaaaactgtgatgacaatgactgagaagatattggccagagcatcagagaaaccccatttgagcccaggtgataacgtttgggttaatgttgatatattaatgacccatgatgtctgtggccctggttctattggcatcttcaagaaagaattcggtgaaaatgctaaggtttgggaccgtgaaaagattgtaataattcctgaccattatatattcacaagtgatgagcgtgcgaatcgtaatgtggatattttgagggagttttgcgtggagcaaaatatcaaatacttttatgatattaaagatcttagtaatttcaaggttaaccctgactataaaggggtatgccatgttgcacttgcacaagaaggtcattgcaggcctggagaggtcctgttgggtactgactcacacacctgtactgctggagcatttggccaatttgccacaggaattggtaataccgatgcaggctttgtgttagggactggaaaagtcctactcaaggtgccccaaactttgagatttgtaatggatggtgaaatgcctgattatcttcttgcaaaggatttaattttgcaaattattggtgaaatatctgtagctggtgcaacatataaggcgatggaatttgttggcactaccgttgaaagtttaaatatggaagaacgaatgacattatgcaatatggttgttgaagctggtggaaagaatggtgttatccctgctgatagtactacatttaagtaccttgaggataagacggctctgccttatgaaccagtttacagtgatgatcaagcaagttttctttcagagtacagatttgatgtctcaaagttggagcctttggtggccaaacctcattctcctgataatcgtgccttggcaagagaatgtaaagatgtaaaaattgacagagtatatattggttcttgtactggtggaaaaacagaggattttctggctgcagccaaagtttttctggcttcaggaaaaaaggtgaaggttcccacattccttgtccctgctactcaaaaggtttggatggatctatatactcttccagttccaggatctggtggcaagacttgttcccagatatttgaagaagctggatgtgacacacctgcaagtcctagttgtggtgcttgtttgggtggccctaaggacacttatgcacgcatgaatgaacctaaggtttgcgtctccaccacaaataggaacttcccagggcggatggggcacaaggaaggccagatataccttgcttctccttacacagcagcagcatctgctttaacaggctatgtcacagatccaagagagttcttgatgtagggtggccatttctaagttgttactctgtactttatagtttccgtaatatgtttgtcgacctaacttttgagttgtaagtctggaagaaaaaaaaaacaaaaaaaaacttggaagttattggtagtcctgggttttgtagtgctaatcccagaagatgctgtctgttgtattctgagctaaaaaataattttcatattcagtggaaattgaataa

SEQ ID NO: 5132 - DNA, 1856 bp, Tabernaemontana elegans
agaaagaagagaaataaagggaagtaaatttttctctaggattccatttctgcatctccacatacttaaaagctatcaaagttcctacaagaatctgaagttcagattgcaatggcttcttcggcaattgcttcgccccatactcctttgattaagaagaaggatgtgggcctttcgtctttctcttcacaggcctcattttcaattaaaagctccaagaaaaaggtctccaagaaaatcgtttctgtaatggcaccccaacaatctgaacgcaagccgtccacgactggttcggtcaagactgggatgaccatgactgaaaagatattggcaaaggcctctgaaaaatcacagttgagccccggtgagaatgtttgggtcaatgttgatgttctaatgactcatgatgtttgcgggcctggtgctatcggcattttcaagaaagagtttggggaagatgcaaaggtctgggatcgtgaaaaggttgttatcatacctgaccactatatattcacggctgatgagcgagcaaaccgtaatgtggacatattgagggatttctgcactgagcaaaacatcaagtacttctatgacattaaagatctggggaactttaaggctaatcctgattataaaggtgtatgccatgttgctcttgcacaagaaggtcattgcagacctggagaggtcttgctgggtactgactctcacacatgtactgctggagcatttgggcagtttgctactggaattggcaatactgatgctggttttgtattaggcactggaaaacttttgctgaaggtgcctccaacattgagatttgttatggatggtgaaatgcccagttatttgcttgcaaaggatttaattttgcaaataattggcgagatatctgtggctggtgcaacatataaatcaatggagtttgttggcactactgttgaaagtttgactatggaggaaagaatgacattgtgcaacatggttgttgaagctgggggcaagaacggtgttgttcctgctgataataccacatataagtacctggaggataagacatctgtgccttatgaagcagtttacagtgatgaacaagcaagatttctttcggagtacagatttgacatctctaagttggaacctctggttgcaaagccacattctcctgataagcgtgctttggcgagagaatgcaaggatgtgaaaattgatagggtgtacattggatcttgtactggtggaaaaactgaggacttcatggctgctgcaaaagtttttcttgcgtcgggaaagaaggtcaaagttccaacattcctggtccctgcaactcaaaaggtatggatggatatatatgccctcccagtccctggctctggtggcaaaacttgctctcagatatttgaagaagctggttgtgatacacctgctagtcctagctgtggtgcttgtttgggtggccccagagatacctatgcacgcatgaatgaacctcaggtctgtgtctcaaccacgaatagaaactttcctggacggatgggccacaaagaaggccagatttatctagcttctccatatacagctgcggcatcagcattgactggttttgtcactgatccaagagagtttttgcagtaaatctcaggtttcgtaaccccatacctttacctacttgattaccggagatgcagtcctgaagatatgagctgaatccttgatccgttgtttgttgtgataaagtagaagtctattaatgaactagttttgcggaaagcaatattgtccaataactatgagacacgtttttgagctggctggtaacttgctgtaatatcaaactcagtgcattaatgtga

SEQ ID NO: 5133 - DNA, 1810 bp, Panax ginseng
attttttcctctccacttcgcatactgaaccacacaccatacacagaattcgttaatggcttcccctgctattgcttcaagcttcacgcctttcattaaccagaaagatgtgggtctttatgctttctcgggaaaatcctcattttaccttccgaaatggaagaagtatttttcccgggaagttgtttccgttatggcacctcagcaatccgaacgcaagccatccaccactggatcagtcaagactggaatgacgatgactgaaaagatattggccagggcttctgagaaaccccaattgagccccggtgaaaatgtttgggttaatgttgatatcttgatgactcatgacgtttgcgggcccggttctataggaattttcaagagagagtttggccagaatgccaaggtctgggaccgtgaaaagcttgttattatacctgatcactacatattcacaactgatgagcgagcaaatcgaaatgtggatattttgagggatttctgcgctgagcagaatattaagtatttctatgatattaaagatcttgggaatttcaaggctaacccagattataaaggtgtatgccatgttgctcttgctcaagaaggtcattgcagacctggggaggtcttgctaggcacagattctcacacatgtactgcaggagcattcggccagtttgcgacaggtattggcaatactgatgctggttttgtactgggcacaggaaagcttttgctcaaggtgcctccaactttgagatttgtaatggatggtgaaatgcctgactatttgcttgcaaaggatttgatcttacaaattattggtgaaatatctgtctctggagcaacatataagtcaatggagtttgttggctctactgtggaaagtttaactatggaagagaggatgacattatgcaacatggttgttgaagctggtggaaaaaatggtgttgtcccagctgatgctacaacctataagtaccttgaggacaaaacatctctgccctatgaaccagtttatagtgatgagcaagcaagatttctttctgaatacaggtttgatatctcaaagctggagccattggtggcaaagccgcattctcctgataatcgtgcgttagcaagagaatgcaaagatgtgaaaattgacagagtgtatattggatcttgtactggtggaaaaactgaggattttctagctgcagccaaagttttcctagcttcagggaagaaggtgaaagttcccaccttcctggtccctgctacccaaaaggtctggatggatgtatatagcctccctgtgccaggatctggtggaaagacttgttctcagatatttgaagaagcaggctgtgatacacctgcaagtcctagctgtggtgcttgtttgggtggtcctaaagacacttatgcacgcatgaatgaagctcaggtctgtgtctccaccacaaataggaactttcctggtcgcatggggcacaaagaaggccagatttatttagcttctccttatactgctgcagcatcggctttgactggctttgtaactgatccaagagagttcttgcagtaggctgctgatcatctcatgtcaggattactctgaatcttgtcctgcgtgtgctttgatttgcggagctgaagtatcaggttctgtatctgacacaaaagccttgtattatgttatgaaagttcagatagtagtagtttagctttgtgctttgaggcttatgtacacgtctgtctaagcaagagaatgagttggatttacttttcattataaataatttgaaggatcgct

SEQ ID NO: 5134 - DNA, 1958 bp, Papaver somniferum
aatttgatctcccaactcaacctacctccaccacacgccgccacaattcccaattgagatttctatcctcgtcaaatttgatcacatcaatcaactccgtttctctttctatttagatacgtagagacgtgagagagctcaatcatggcgtcttctacgattgctgcaggctcagctacatcgtctttcattaaaaagaatgaaatgggtttatcgtcattcactccaacttcgtttcgtacacatagctgtaaaagagctttttctaagaaagttgtttcagtaatgtcacctccacagtctgagcgtagaccttcgacgactggttcagtgaaaactgctatgactatgactgagaagataatggcaagagcgtctgagaaatcccaagtggttccaggagagaatgtatgggtcaacgttgatgttttgatgactcatgatgtttgtggacctggaactattgggatattcaagaaagaatttggagaaaatgccaaggtttgggatcgtgaaaagattgtaattatacctgatcattatatattcacaagtgatgaacgtgcaaatcgtaatgtggacatcttgagggatttctgtgcggagcaagatatcaaatacttttatgatatcaaggatcttggaaatttcagggctaaccctgattacaagggtgtctgccatgttgctcttgcccaagaaggtcactgcaggcctggagaggttcttttgggtacagactctcacacgtgcaatgctggagcttttgggcagtttgctagtggaataggaaacactgatgctggttttgtaatgggcactggaaaatcccttctaaaggtgcctccgactttacgatttatattggatggggagatgccaagttacttgcttgctaaggatttgattttgcaaattattggtgaaataactgttgctggggctacatataaatcgatggagtttgttggctctgctgttgaaagtctaactatggaagaaagaatgacgttgtgtaacatggttgtggaagctgggggaaagaatggtgttgttcctgctgacagtactacatataaataccttgagggaaagacgtcggtggagtttaatccagtttatagtgatgataatgcaagattccttcaacaatacgcaattaacgtctcaaagttggagccgttggttgccaagccacattctcccgacaatcgtgctatggcaagagaatgcaaggatgtaaaaattgacagggtatatataggctcatgtactggtggaaagaccgaggattttctatctgcagcaaaagttttccttgcttcgggcaaaaaggtcaaagtgccaacttttcttgttcctgccacccaaaaggtctggatggatttatatgccatggcagttcctggatcaggtggcaagacatgctcacagatatttgaagaggcaggttgtgataccccttcaagtcccagttgtggagcttgtttaggtgggcctagagatacctatgcacgtatgaacgagcccaagatatgtgtgtcgacaacaaacagaaacttccccggtagaatgggacacaaggaaggggagatatatttggcttccccttatactgcagcagcatctgctttgacaggttatgtcaccgacccaagagactacttgcagtaaaatcctatgtagcctttcatcacttgttgtatgagtttcatcagatttatttgaagatttttgtagttgtgatcatttcatggagatggatcttaaataaaacttaaaaagacaaatcaagttgttatctaggaatgcgtatgctagagtctccttttaagtgtcttcactctaaatctaaacagaataatctcatttgtgaaattatgaaatgttttgtctttcgtttcttgagctgaagtataactattgcctcaggtaggtatctcaaatctgaaaaaaaa

SEQ ID NO: 5135 - DNA, 1977 bp, Aquilegia formosa
acaaacaagcccaatcaaatcatagttaccttattaatcaaacgttaattaagaattaaacagattaaaaataacctcgttgaatcaagtttgtttcagtcatggcttcttctacaattgcttcaagttctactccctttattaaacagaatgatttggggcgttcttcgttcacttcaacttatctacccattcaaagatatagtagaaaagcttcttcttcttcttcttcttcaaggaaagttgtttcagttatggcgccaagtcaatcccaacgtccaccttccaccactggttcagttaaaactgggatgacaatgacagagaagatattggcgagggcgtccgagaggtctcaattggttcctggagagaatgtttgggttaatattgatgtgttgatgactcatgatgtttgtggtcctggtacaattgggatttttaagaaagaattcggcgaaaatgctaaggtatgggatcgtgagaagatcgtaataatacctgatcattatattttcacaagcgacgaacgtgcaaatcgtaatgtggatatcttgagggatttttgtatggagcaaaatatcaagtacttctacgacataaaagatcttggtgatttcagggctaacccagattataaaggagtttgtcatgttgctctagctcaagagggtcactgtaggcctggggaggtcttgctgggtactgactctcatacctgcaatgctggtgcatttggccagttcgctactggtattggtaacaccgacgcaggttttgtgatgggtgctggaaagctccttttgaaggtgcccccaacattgagattcgtaatggatggagaaatgccaaattacttattggccaaggatttaattctgcagattatcggtgaaatttctgtagctggtgcaacatacaggtcaatggagttcgttggctctacagttgaaagtttgtctatggaagaaaggatgaccttgtgcaacatggttgtcgaagctggagggaagaatggtgttgtccctgctgacagtaccacatataagtaccttgagggcaagacatcagttgaatttgaacccttatatagtgatgacaaggcaaggtttctttcggagtacagatttgatgtctccaaactagaaccattggtggctaagcctcattctcctgataatcgtgcattggcaagagaatgcaaagatgtgaaaatagacagagtatatataggctcatgtactgggggaaagacagaggattttctagctgctgccaaacttttccatgcttcggggagaaaggtcaaagtgccaacttttcttgtccctgctactcaaaaggtctggatggatatatatagcattcctgttccaggagctggtggaaagacttgctcgcaaatatttgaagaagcaggttgtgatacacctgcgagtcccagttgtggtgcttgtttgggtggtcctagagacacttacgctcgcatgaatgaacctaaggcaaagttgctaattgtgcaggtctgtgtctcaacgacgaataggaatttccctggtcgaatggggcacaaagagggccagatatatctagcttccccatacacagcggcagcatctgctttgactggttttgtcactgacccaagagatttcttgcagtaatcaaagaaggaagccagttgataggtcctgtttctaccatgacagaaatgccagcaagttttcactgaagatttccgtatgttgttattatattctatgaaattaaaaatgtataagctgaggctagcaatgtgtgcggaactaggattgatgaatactgagatcatagtggtactggtggatcttagttgtactaggtaaggttggtatttatttttgtaaacatgggaagttaatgagaatgaagcgtactagtaaatccaaagtttgcagctaacctgcaaggctgctaactctttgcacagttgcttgt

SEQ ID NO: 5136 - DNA, 1905 bp, Catharanthus roseus
tcgaaaatcggcttttgaattccatttctgcatcttcacacactctgtcctaacaaagttccatctctgacacagaagctgaagattcagattagaatggcttcttctgccattgcttcgaccagtacccctttgattaataagaaggacgtgggtctttcggctttatcttcacaggcttcattttccattaaaagctccaagaaaacggtctcaaagaaaattgtttctgtgatggctccgcaacaatctgaacgcaagccatccatgactggttcggtcaagactgggatgaccatgactgagaagatattggcaagggcctctgagaaatcacagttgagccccggtgagaatgtgtgggtcaatgttgatgttttgatgactcatgatgtttgtgggcctggtgcgattggcattttcaagaaagagtttggagaagatgccaaggtctgggaccgtgaaaaggttgttataatacctgaccactatatattcacagctgatgagcgagcaaaccgaaatgtggacatcttgagggatttctgcactgagcaaagcataaagtacttctatgacattaaagatcttgggaactttaaggctaatcctgattataaaggtgtatgccatgttgctcttgcacaagaaggtcactgtcgacctggagaggtattgctgggtactgattctcacacatgtactgctggagcatttggccagtttgctactggaattggcaatactgatgctggttttgttttgggcactggaaagcttttgcttaaggtgcctccgacattaagatttgttatggatggtgaaatgcccagttatttgcttgcgaaggatttaattttacaaataattggtgagatttctgtggctggcgcaacatataaagcaatggagtttgttggtacaactgttgaaagtttgactatggaagaaagaatgacattatgcaacatggttgttgaagctggaggcaagaatggcgttgttcctgctgatagtaccacttacaagtaccttgaggataagacatctatgccctttgagccactttacagtgatgaacaagcaagatttctttcagagtacagatttgatatctcaaagttggaaccgctagttgcaaagccccattctcctgataatcgtgctttagcgagagaatgcaaggatgtgaaaattgatagggtgtatatcggatcttgtactggtggaaaaactgaggactttatggctgctgcaaaagtttttcttgcttcgggaaagaaggttaaagttccaacattcctggtcccagcaacacaaaaggtatggatggatatatatgctctcccggtccctggctctggtggcaaaacttgttctcagatatttgaagaagctggctgtgatacacctactagtcctagttgtggtgcctgtctgggtggccccagagatacttatgcacgcatgaatgagcctcaggtgtgtgtatcaaccacaaataggaactttccgggacgaatgggccataaagaaggccagatatatctagcttctccatatacagctgcagcatcagcgttgactggttatgttactgacccgagagagtttttgcagtaactttgtgttatataaatgcctgggtacccttacccttatcgtcttgattattggagatgtattcctcaagatatgagctaaatacttgatcattattatatgttgtgataaaatagaagtatcttaacaagaactagttttgcagtaagtgatgtattgtccatttagctaagagaacaaactttttgtttaatctggctggctggttggtttcttcttgtaatattgagtccttgaactttggtattgaatagtcctcttggtgatgaaaaacttactatg

SEQ ID NO: 5137 - DNA, 1967 bp, Vinca minor
agttttagagtaacaatgtcttcttctaccatttctttaagccctacacctttaattcacaagaaagatgtgggtcagggtctttcagctttctcttcacaagcttcatttttctatttaagaaaagggtttctcagaaaatcgtttctgtaatggtaccacaacaatctgaacggaagccctccacaactggttcggtaaagactggaatgacaatgactgagaagatatttgcaagggcctctgagaaatcagagttgagccctggtgagaatgtttgggtaaatgttgatgttttgatgactcatgatgtttgtgggccacctgctattggtattttcaagaatgaatttggacaagatgctaaggtctgggaccgtgaaaaggttgttatcatacctgaccactatatattcacagctgatgagcgagcaaaccgcaatgtgggcatcttgagggatttctgtactgagcaaaaaataaagtacttctatgacattaaagatcttgggaactttaaggctaatcctgactataaaggtgtatgccatgttgctcttgcacaagaaggtcactgtagacctggagaggtgttgttgggtactgattctcacacatgtactgctggagcatttggccagttcgctactggaattggcaatactgatgctggtttcgttttgggaaccggaaagcttttgttgaaggtgcctccaacattgaggttcgttctggatggtcaaatgcctagttatttgcttgcaaaggatttaattttacaaataattggtgagatatctgtggctggcgcaacatacaaagcaatggaatttgtcggttctactgttgaaagtttgactatggaagaaaggatgacattatgcaacatggtcgttgaagctggaggcaaaaatggcattgttcctgctgatagtaccacatataagtaccttgaggatagaacatctgtgccttatgaaccagtttacagtgatgcacaagcaagatttgtttcagagtacagatttgacgtctcaaagttggaacctttagttgctaagccccattctcctgataaccgtgctttggcgagagaatgcaaggatgtgaaaattgatagggtgtacatcggatcttgtactggtggaaaaaccgaggactttatggctgctgcaaaagtttttcttgcttcaggaaagaaggtcaaagttccaaccttcctggtccctgcaacacaaaaggtatggatggatgtatatgctctcccggtccctggctctggtggcaaaacttgctctcagatattcgaagaagctggctgcgatacacctactagtcctagttgtggtgcctgtttgggtggccccagagatacatatgcacgcatgaatgaacctcaggtatgtgtgtcaaccacaaacaggaacttccccggacgaatgggtcataaagaaggccagatttatctagcttctccatatacagctgcagcatcagcattgaccggttatgtcactgatccaagagagttcttgcagtaacttttgtgttatataaacctgtactgaatctacccttatcggctttatttactggagatgcggtccttgagatatgagctaaaatccataatcagttgtgttgtgatgaaaataaaagtatcttaataagacttgagttctctgcagaaatgcctggtatcttgttgtaatgtcaaatacagttcattaatgtgatcttggagctttgatgttaaatcgtcttggttatgatcactgatgaagatacggtaatacaaaaatggtggtatatacttggggatggcaatggggccgggtgggggcggataccatgatctccagccccagccccacctcttccatcgcattcccatccccggcccagccccatcactggggatggatgggcatcccatccccaactcaggtggaggcccacccccaacc

SEQ ID NO: 5138 - DNA, 1875 bp, Malus domestica
cacaactctttcaatttttttgttcactttcttcttcttcttctccagcggaatcagatctccgccgcataagctcgcattctcacgccccacatggcttgctccaccgttactccgccgtccacctccttcatcggcaacaagaaggatttgaatctctctgctttctcctctgcgacgccgctttccagtcagaaatgcaagagaaaatccaagaaaatttgctctgtcatgtctccgcagcaatcggagcgcaagcccgccaccaccggctcggttaagaccgggatgacgatgactgagaaaatatttgctagagcttctgagaaaacccagctgagtccgggtgagaatgtttgggttgatgtcgatgttttgatgacccatgacgtctgtggcccggggtcaattggaatcttcaagaaagagttcggccagaacgcaaaggtttgggaccgtgaaaaggttgtaatcataccggaccattatatatttacaactgatgaacgtgcaaatcgtaatgtggatatcttgagagatttctgcatggagcaaaacatcaagtatttctatgatatcaaggatctaagtaatttcaaggccaaccctgattataagggcgtatgccatgttgcacttgctcaagaaggtcattgcaggccgggggaggtcctgctgggtacagattctcatacatgtactgctggagcttttggacaatttgctactggaattgggaacactgatgcaggatttgtattgggcactgggaagcttttgctcaaggtgcctccaacactgagatttgtgatggatggtgaaatgcctgactatttgcttgccaaagatttgattctgcaaattattggtgaaatatctgttgctggtggaacatataaagctatggagtttgttggcagcactgttgaaagcttatctatggaagaaaggatgacattatgcaacatggttgttgaggctgggggtaaaaatggtattgttcctgctgatagcactacatttaagtaccttgaggataagacttctgttccctatgaacctgtttacagtgatgctaaagcaagatttcttaaggagtacagatttgatatctcaaaactggagccgttggtggcaaagcctcattctccagataatcgtgctttagcaagagaatgcaaagatgtgaaaattgacagagtatatatcggttcttgtactggaggaaaaactgaggattttatggccgcagccagagtttttctagcatcagggaaaaaggtcaaagttcccacatttcttgtgcctgctacccaaaaggtttggatggacgtgtatagtcttccagtaccagggtctggtggcaagacttgctcacagatatttgaggaagctggatgtgacacacctgcaagtcccagttgcggcgcttgcttgggtggtccgaaagacacgtatgctcgcttaaatgaacctcaggtatgcgtctcaacaacaaacaggaacttcccaggccgaatgggtcacaaggaaggccagatatatctcgcttccccctatacggctgctgcatcagctttgactggtcacgtcaccgacccaagagagtttttgcagtaggcaatttgatcattacaatctgattagtgcgtgtcatctttgtatcctgcaactaaatgttgttagataagcagagattacggaataatgggtcataacatccgtcctaccatatgtcgtgtgattgtctggtcgctgccatatgtattgtatgtgtaattgctagagcatgttggaatgcatttatgaaacgatgaaataacgaggtgaatttcgccagacgattctgatttaaaagtcacgattttgttctac

SEQ ID NO: 5139 - DNA, 1941 bp, Cicer arietinum
gtaataaataaacaaaagtaaaaaaaaagaaatcacaactactcttactacctattttcatttcttcagccgccacacattgttgtgtagtgttgttgttgttatgcctcaaacatcaatggcttcttctcttgttgctccaccctccacttccttcttccacaccaagaaggatctgaatctatctgctttctcttcatcttcgtcttcttcatctcagcgatatcagaaacatgcttccaggaaaatctgttgttcggtttcggcgcctcagcaaacacagcgccagccttctaccactggatcagtgaagacagctatgactatgaccgagaagatattggctcgagcttctcagaaggaacaggttacacctggggataatatttgggtcaatgttgatattttgatgactcatgatgtttgtggccctggttctattgggatttttaagaacgagtttggtaaggatgctaaggtttgggatcgtgaaaaggttgtaataatacctgatcactatatcttcacaagtgatgaacgtgccaatcgtaatgtagacatactcagagatttctgcaatgagcaaaatatcaagtacttttatgatattaaagaccttagtaattttaaggtaaatccagattacaaaggtgtttgccacattgctcttgctcaagaaggtcattgtaggccaggagaggttctcttgggcactgattctcacacttgtactgctggagcatttggtcaatttgcaacaggaatcggaaatactgatgccggttttgtgttgggagcagggaagcttttgctaaaggtgcctccaactttgagatttgtaatggatggggaaatgcccaattatctgcttgcaaaggatttgattctgcaaattatcggtgaaatatccgtggctggtgcaacttacaaatctatggagtttgttggttcaactgttgaaagtttaaatatggaagaacggatgacattgtgcaacatggttgttgaagctggaggaaagaatggtgttattcctcctgatagcattacatataaatatctcgagggcaagacatctgtgccatatgaaccagtttatagtgaccaccaagcaagatttctttctgagtatagatttgatgtctcaaaattggagccactggttgccaagcctcattcaccagataaccgtgctttggcaagagagtgcaaggatgtgaaaattaacagagtatacataggttcttgtactggtggaaaaactgaagatttcatggctgctgcaaaagtttttcttgcatcaggtaaaaaggtcaaagttcccacatttcttgtccctgcaacacagaaggtttggatggacgtgtatagcctcccggtccctggatctggtggcaagacttgctcacagatatttgaagaagctggttgtgacacaccggctagtcctagttgtggtgcttgtttgggtggccctaaagatacttatgcccgaatgaatgaacctcaggtttgtgtttcaactacaaatagaaactttccagggcgaatgggacacagagaaggtgaaatatatttggcttcaccatatacagctgcagcatctgcattgactggttatgttactgatccaagagagttcttgcagtagttggatatatatatttatcccattctattgtattgtatttctatacatacattggttagttttgtattctctagccaaaacatagaactgagttaataaattttactgcaccactctattggttggtatttattttttcagcggatatatttgtgactcttagtgaattggttaatagttttagtgactaaaaaaatattgggtttttttagtacttgttcatcttcaattgttctatgcttagacgttagagatcatcaaataaatcatttcatcagttctagaaatgc

SEQ ID NO: 5140 - DNA, 1927 bp, Rosmarinus officinalis
aaaatctggcaaattaataggaagagaaatccacaagctgtgtgattcctcttcttccacactctgaggccgacttctgctagtcagacaacatcagatggcttcatctgcttcagctccgacctccttattcctcgccgacaagaaagatgtgggcttttcagccttctgcacccagccttcatttccatgttgcgcacagctttccaagaaagggcttccaacaaaatagtttctgtaatggcgccccagcaatctgagcgcaaaccatcgacgacgggggcggttaaaactgggatgacgatgactgagaagatattggcaagagcttcagagaaatcccaattggttcccggtgagaatgcatgggtcaatgtggatagtttgatgacacatgacgtttgtggccctggttccattgggattttcaagagggaattcggccaaaatgcaaaggtctgggaccgtgaaaaagttgttatcattcctgatcattatatcttcacaactgatgaacgagcaaatcgcaatgtagacatcttgagggatttctgtaatgagcaaaatattaagtacttctacgacattaaagatcttggaaatttcaaggctaatcctgattacaaaggtgtgtgccatgtggctcttgcccaagaaggtcattgccgacctggggaggtcctgctgggtaccgactctcacacgtatactgctggagcatttggtcagtttgctacaggaatcggaaacaccgatgccggtttcgtattgggtactggaaagcttttgcttaaggtgcctccaactttgagatttgtaatggatggtgaaatgcctgactatctgctcgcaaaagatttaattttgcaaattattggtgaaatttcagttgctggcgcaacatacaaagcaatggaatttgttggttctactgttgaaagtttgacgatggaagaacgaatgacgctgtgcaacatggtagttgaagccggagggaagaatggtgttgtccctgctgatagtaccacgtacaagtaccttgaggataagacatctttgccatttgaacctgtatttagtgatggaggagccaggtttcttcaggagtaccgatttgatatttcaaagctcgagcctttggtggctaagcctcattctcccgacaaccgtgctttagcccgagaatgcaaagatgtgaaaattgacagggtatatattggatcttgtactggtgggaaaacagaagatttcatggccgctgccaaagtatttcttgcttcgggtaaaaaggtcaaagtcccaaccttcctagttccagctacgcagaaggtgtggatggatgtatatagccttccggtcccaggatcgggcgggaaaacttgctcacagatatttgaggaagctggatgcgatacacctgcaagccccagttgcggtgcttgtttgggaggaccaagagacacgtatgcacgcatgaatgaagctcaggtctgtgtttccagcacaaacaggaatttccccggtcgtatggcccataaagaagggcagatttatctagcttctccatacaccgctgccgcatctgcattgactggtttcgtcacggatccacgagaatttcttcagtaagttcgggaatgagtaactttgtgctctacttttctgaatgctgctgctgagttgatccgccttgaattcttgccgttgctgattcacatgttgtgatgcgctagtaacttgtagtgttgatgtaacgagagaaacgaactttctcgagatctacttttgtttttgtaataaacgaagaatctcgataaaattagtcttgatgtgccttcggacagtcctttgttccgtcttcattttttgtagaacacggttgagattaacgatagatcatagttattttatgcagctgctgctgttt

SEQ ID NO: 5141 - DNA, 1990 bp, Lupinus angustifolius
tacaactcgttcttgtactgtgtggcagtcatggctttctctcttattgctccaacttctacaccttccctccaacacaagaatcttactgttccctctgatttctctttcacttctactatttccactcaccgatgccacaaaccttcttcaaggagaatctattgctccattgcaccaccacaacaattgcagcaccgtccatccaccactggatcagtgaagaaggcaatgacgatgaccgaaaagatatttgctagagcttctgagaaaacccatttgagccctggggataatgtttgggttaatgttgatattttgatgacacatgatgtttgtggccctggttctattggaatttttaagagggaatttggtgaggatgctaaggtctgggatcgcgaaaagattgtaataatacctgaccactatatattcacaagtgatgaacgtgccaatcgtaatgtagacatattaagagatttttgcaacgagcagaatatcaagtacttttatgatattaaggatcttagtaattttaaggcaaatccagactacaaaggtgtttgccatgttgctcttgctcaggaaggtcattgtaggcctggagaggttctcttaggtactgattctcacacttgtactgctggagcatttggtcaatttgctacgggaattggtaataccgatgcaggttttgtgttgggagcagggaagcttctgctcaaggtgcctccaactctgagatttgtaatggatggagaaatgcccccttacttgcttgcaaaggatttgattttgcaaattattggtgaaataaccgtggctggtgcaacatataaatctatggagtttgttggcacaaccgttgaaagtttaaatatggaagaacggatgacattgtgcaacatggctgttgaagctggaggaaagaatggtattgttcctgctgacagcacaacatataaatatcttgagggtaagacatctttgtcatatgaaccagtttacagtgaccagcaagcaagttttctttctgagtatagatttgatgtctcaaaattggagccactggtggccaagcctcactctccagataaccgtgctttggcaagagagtgcaaggatgtgaaaattgacagggtctacataggttcttgtacaggtggaaaaacagaggatttcatggctgcagcaaaagtttttttagcatcaggtaaacaggtcaaagttcccacatttcttgtgcctgcaacacagaaggtttggatggacatatatagcatcccagtccccggatcgggtggaaagacttgctcacagatatttgaagaagctgggtgtgacacacctgctagtcctagttgtgctgcttgtttgggtggcccaaaagatacttatgcgcgtttgaacaaacctgaggtttgtgtttcaaccacaaataggaacttccctggcagaatggggcacaaggaaggtgaaatatacttggcttccccatatactgctgcagcatctgcattgactggctttgttactgatccaagagagttcttgcagtagaaggatcttatgttcaatgaacctcttctaatgtattattctatagccacacgttaaaacttcaagccatccaaagtttaccaatgtatctgtatttttccctttagaagtcttaagtgacttggtgcttggttaaatttaccaagaaaacatcgaaccttgagcttttggtcagcctgagaatttagtagagtcttacactattagaccaacacttataaaactcacgtcaagttcaaatgtgagctcttacaagagatacatgacagaatcagggtggagaaatggtgccttcttacatgctccttttatacaaaaaattatgtatttgcaagatgggtgttatgggattgaaatttatacaaaactccaaccactcccatctcctcatttcactgttactttaatcataacatacacttgtgac

SEQ ID NO: 5142 - DNA, 1726 bp, Manihot esculenta
agttctacgaacacccactgttgccatggcttcccccaccatcgtccctgcctcctcttccttcatcgccaacaagaaggatctgggtctctctgctttctcttcttcgtcatcttcattttctattcccaaatgcaggaaatcaatttcaaagaaaattgtatctgtcatggctccccaacaatcagagcgcaaaactaccaccactggctcagtgaagacagcaatgacgatgacagaaaaaatattggctagggcctctgagaagcctcagttgagtccaggtgagaatgtttgggtcaacgttgatatcttgatgacacatgatatttgtggcccaggttccattggaatcttcaagagagagtttggagagaatgccaaggtttgggaccatgagaaaattgttattatacccgatcattatatattcactgctgatgaacgctcaaaccgtaatgtggatatattgagggatttctgcctggagcaaaatataaagtacttctatgatatcaaggatattagtaactttaaggttaatcctgattataaaggtgtatgccatgttgcacttgcccaagaaggtcattgtaggccaggcgaggtcctgttaggtacagactctcacacctgcactgctggagcatttggccagtttgctactggaattggcaacactgatgctggttttgtattaggcgctgggaagctgctgctcaaggtgcctccaactctgagatttgtaatggacggtgaaatgcctgattatttgcttgcaaaggatttgattttgcagattattggtgaaatatctgtggctggtgcaacatataaatcaatggagtttgtgggtaccacagttgaaagtttaagtatggaagagcggatgacattatgcaacatggtcgttgaagctggggggaagaatggtgttgtccctgcagatagcactacgttcaagtaccttgaggataagacatctgtgccctatgaaccagtttatagtgatgagcaagcaaggtttctttccgaatacagatttgatatctcaaaattggaaccattggttgcaaagcctcattctcctgataatcgtgctttagcaagagaatgcaaagatgtcaagatagacagagtgtacattggatcctgcactggtggaaaaacagaggattttatggctgctgccaaagtttttcttgcttcaggtaaaaaggtcaaggttcccacgtttcttgtccctgcaacccaaaaggtttggatggatgtgtacagtctcccagttcctggatctagtggcaaaacttgctcacagatttttgaagaagctggttgtgacacgcctgcgagtccgagttgtggtgcttgtttgggaggccctaaagacacttatgcgagaatgaatgagccaatggtctgtgtgtcaacaacaaacagaaacttcccaggcaggatgggacacaaggaaggccagatatatctggcttcgccctatacagcagcagcatctgctttgactggttatgtcaccgatccaagggagttcttgcaataagctttttatgttgtgtactctacccattgttaagagtaatttaaatggtggtttcaaaagtagatttctgagcctgttgtaccgagttgtggaaatttttgtatgtcatgaatgttaggttggtattatgtatttgtcgagttaatgtaatgccttatattttgatgc

SEQ ID NO: 5143 - DNA, 2157 bp, Humulus lupulus
cggccggggaagaaaaaaaaaccattgagaggcttacatgtgtatctgattcgacacaatttcagtcacataaatcaaagtaaaagaaaactcgaagcggaggctcgttctgtccacgcaccaagacgacgccgccgcctctgttagaagtgtttatgtttaagaaactagctcaggcataggcatatacacaccattactcttaactctatattctcttcactcaacacagttttgcaaatcatttctatcaactctcatggcttctgcaattgctccaacttcagctccttttctcaagaagaaagagttgggtctctcttctttctcgtcgtcaccggaattttctgttcagagatgcaagagaacggtctccaagaagatttgttcggtcatgacgccgcagcaatcagaacgcaagcccgccaccactggctcggtcaagacggcgatgacgatgaccgagaagattttcgccaagtcttctgagaaaagccatttgagcccgggtgagaatgtttgggttaatgttgatgttttgatgactcatgatgtctgtggccctggttcctttggcatattcaagaaagagttcggcgagaatgctaaggtttgggaccgtgaaaagattgtgatcatacctgatcattatatatttacaagtgatgaacgtgcaaatcgcaatgtggatatcttgagagatttctgcactgaacaaaacatcaagtacttttatgatataaaagatctgggtaactttaaggctaatcctgattacaaaggtgtatgccatgtagctcttgctcaagaaggtcattgcagacctggagaggtcctgctaggtacagactctcatacctgtactgctggagcttttggacaatttgctactggaattggaaacactgatgctggttttgtgttgggaactgggaagagtctgctgaaggtgccaccaaccctcaagttcgttatggatggtgaaatgccagattatattcttgctaaagatttgattttacaaattattggtgaaatatctgttgctggtgcaacatataaggctatggaatttgtcggctcaacagttgaaagtttaagtatggaagaaaggatgacattgtgcaacatggttgtggaagctgggggaaagaatggtatagttcctgcagataacactacatacaagtaccttgaggataagacatctgtaccctatgagcctgtgttcagtgatgctcaagcaaggtttctttctgagtacagatttgacatcacaaaattggagcctttggttgcaaagcctcattctcctgataatcgtgctttagcaagagagtgcagagacgtgaaaattgatagagtctatattggatcttgtactggtggtaaaacagaggatttccttgctgcggctaaagtttttgtagcttcgggcaaaaaggttaaagttcccacattccttgtcccagctacccaaaaggtgtggatggacttgtatagtcttccagtgccaggatccggtgggaagacttgctcccagatatttgaagaggctggttgtgatacgcctgctagccctagttgcggtgcttgtttgggtggtccaaaagacacttatgcacgcatgaatgaacctaaggtttgtgtgtcgacaacaaacagaaactttccaggccgaatgggacacaaggaaggcgagatatatcttgcttccccatacacagcagcagcatctgcattgactggctatgtcaccgacccaagagacttcttacagtaggatgttctcatagtcttcgatatgaacttgactaagtttgtgagtacttctggaccttatgttgttcttctgtggggactggggagggtaaagcttgacttaagtttctgcgtagaatcaatgtggagcaacgtctcctgaggtcttacaatgtcatatatccatatatgttttgtttaggacattgacttatgagtcttgggtgccttgaccttgtttgggtctgtagccaatgtttgctgaataaaagattacctcgttttgagttcttgtactaggagaattgctgtttattattactagtactataatagttcttatttcgggctcaattgtccttttatgggaactttgatcaggaactctgaggttca

SEQ ID NO: 5144 - DNA, 1900 bp, Triphysaria pusilla
aaataccgccattagtgccggagcaccaaaacattcttcttcttagttcttaccgtcctgccctttccacaactctgcttcagtcacaacagtaaacacacgaccagttgagccccatggcatcctctcatcttactccaagctcgtcgctgtttgtcgacaagaaagatgttggggtttcagccttttattcacaggcggcttcaatcccatttccccagccggcgttcaagaaaggggcttccaagaaaatagtgtctgtaatgacacctcagcaatcggagcgtagaccttcgacaaccggggcggtcaagactggtatgaccatgactgaaaagatacttgcaagagcttcggagaaaacccagttaagccctggtgagaatgtgtgggttaatgtggatattttgatgactcatgatgtttgtggccctggttctattgggatttttaagcgagagtttggggaaaatgcaaaggtctgggaccgtgaaaaacttgttatcattccagatcattatatattcacaagtgatgaacgagcgaatcgaaacgtggacattttgagagatttctgtaatgaacaaaatattaagtacttctacgacattaaagatcttgggaacttcaaggccaatcctgattacaaaggtgtgtgccatgtggctcttgcccaagaaggtcattgcagacctggagaggtattgctgggtacagactcacatacttgtacagcaggagcatttggtcaatttgctactggaattggaaatacggatgcaggttttgtgctcggtactggaaaacttttacttaagactcctccaactctgagatttgtgcttgatggtgaaatgccggattatttgctcgcaaaagacttgattttgcaaattatcggtgaaatatcagtggctggtgcgacatataaagcaatggaatttgtcggctccactgtcgaaagcttgacaatggaggagaggatgacattgtgcaacatggttgttgaagccggtggtaagaatggcgttgttcctgcagatagcaccacttttaagtatcttgaggacaagacatctttgccctatgaaccagtttacagtgatggacaagcaagattcctttcagagtacagatttgatgtctcaaagatggagcctttggtggctaagcctcattctcctgataaccgcgccttagctcgagaatgcaaagatgtgaaaatcgacagagtatatatcggatcttgtacgggaggaaaaacagaggatttcatggctgctgccaaagtctttctagcttcgggcaaaaaagtcaaagtcccgacattccttgttcctgcaacgcagaaggtgtggatggacgtatatagccttccagtcccaggttctggcggtaaaacatgctcgcaaattttcgaagaagctggctgtgatacacctacaagccctagctgcggtgcttgtttaggaggaccgagagacacttatgcacgcatgaacgaagctcaggtctgtgtttcgacaacaaacagaaacttcccaggtcgaatgggccataaagaagggcagatatatctagcttctccgtatactgctgcagcatcagcactgactggttttgttaccgatcccagggagtttctgcagtaagttttttttatcatgattttgtagactacttgtcgaaacatccggagttgttaaaatgctcgtaattatgaaacttgcgagcttgagtcgatttagtgtttcgtcttttactatgtttggcattggttcaagagcatgtttgttcattgtgtgatcaatgaatccttgatgaatatttacagttggttattttatagaataattgcccaaaccctgaaagattttcatggatggtctttctatttatt

SEQ ID NO: 5145 - DNA, 1833 bp, Amsonia hubrichtii
ggaagaaaatttgctctaggattccatttctgaatctttcacattttcgaaagctatcaaagttcgtagcggaagctgaattcagcttacaatggcttcttctgctattgcttcaacccatactcctctgattaacaagaaggatgtgagcctttctgctttatcttcacaagcctccttttcgattaaatgccccaagaaaagggtctccaagaaaatagtttctgtaatggcaccaaaacaatctgaacgcaggccgtccacgactggcgcagtcaagactgggatgaccatgaccgagaagatatttgcaaaggcctctgagaaatctcagctgagtcccggtgagaatgtatgggttaatgttgatgttctgatgactcatgatgtttgtggccctggttccattggcattttcaagaaagagtttggggaagatgctaaggtctgggaccgtgaaaaggttgttatcatacctgaccactatatattcacggctgatgagcgagcaaaccgtaatgtggacatcttgagggatttctgcactgagcaaaacataaagtatttctatgacattaaagatcttgggaacttcaaggctaatcctgattataaaggtgtatgccatattgcacttgcacaagaaggtcactgcagacctggagaggtgttgctgggtactgactctcacacatgtactgctggagcatttggtcagtttgctactggaattggcaatactgatgctggttttgtgttaggggctggaaagcttttgctgaaggtgcctccaacgttgagatttgttatggatggtgaaatgcctagttatttgcttgcaaaggatttaattttgcaaataattggtgagatatctgtggctggtgcaacatataaagcaatggagtttgttggcagtactgttgaaagtttgactatggaagaaagaatgacattatgcaacatggttgttgaagctggtggcaaaaatggtgttgttcctgctgatagtaccacatataaatacctggaggataagacatctgtgccttatgaaccagtttacagtgatgaacaagcaagatttctttcagagtacagatttgacatctcaaagttggaaccattagttgcaaagccccattctcctgataagcgtgctttggcgagagaatgcaaagatgtgaaaattgatagagtgtacattggttcttgtactggtggaaaaactgaggactttatggctgctgcaaaagtttttcttgcttcgggaaagaaggtcaaagttccaacattcctggtccctgcaactcaaaaggtatggatggatgtatatgctctcccggtccctggctctggtggcaaaacttgctctcagatatttgaagaagctggctgtgatacacctgctagtcctagttgtggtgcttgtttgggtggccccagagatacatatgcacgcatgaatgagcctcaggtctgtgtctcaaccacaaataggaactttcctggacggatgggccataaagaaggccagatttatctagcttccccatatacagctgcagcatcagcattgactggttttgtcactgacccgagagaatttttgcagtaactctcgtctttcacctccctgcatacttaccaacttgattactggagatgtggtccttaagatatgagctaaatacttgatcccttgtatgttgtgataaaataacagtctctttaatgtactggcttttgcagaaagcaatattgtctaataattaagagaacacaaggttttgagctggctactgtcttgttgtattatcaacttcagctatt

SEQ ID NO: 5146 - DNA, 1946 bp, Rosmarinus officinalis
aaaataaaaactacaaaactgcaacccacccccacgccgccggccaacccccctagccaaattcaatttctgcaaccctgctttctcgccgtctgtgctgttcagatggcttcatctgctgtagctccgatctcctcattcctcggcgataagaaagatgtgggcttttcagctttctgcacccaaccttcatttccatgttccgcgcagcagtccaagaaaagggcttccaagaaaatagtttctgttatggcgccccagcaatccgagcgcaaaccgtcgacgacgggggcggttaagactgggatgactatgactgagaagatactggcaagagcttcagagaaatcccaattggttcccggtgagaatgcgtgggtcaatgtggatattttgatgacacatgatgtttgtggccctggttccattggcattttcaagaaggaattcggccaaaatgcaaaggtctgggaccgtgaaaaagttgttatcattcctgatcattatatctttacaactgatgaacgagcaaatcgcaatgtagacatcctgagggatttctgtaatgagcaaaatatcaagtacttctacgacattaaagatcttggaaatttcaaggctaatcctgattacaaaggtgtgtgccatgtggctcttgcccaagaaggtcattgccgacctggggaggtcctgctgggtaccgactctcacacgtgtactgctggagcatttggtcagtttgctacaggaatcggaaacaccgatgccggtttcgtattgggtactggaaagcttttgcttaaggtgcctccaactttgagatttgtaatggatggtgaaatgcctgactatctgctcgcaaaagatttaattttgcaaattattggtgaaatttcagttgctggcgcaacatacaaagcaatggaatttgttggttctactgttgaaagtttgacgatggaagaacgaatgacgctgtgcaacatggtagttgaagccggagggaagaatggtgttgtccctgctgatagtaccacgtacaagtaccttgaggataagacatctttgccatttgaacctgtatttagcgatggaggagccaggtttcttcaagagtaccgatttgatatttcaaagctcgagcctttggtggctaagcctcattctcctgacaatcgtgctctagcccgagaatgcaaagatgtgaaaatagacagggtatatattggatcttgtactggtgggaaaacagaagatttcatggctgctgctaaagtatttcttgcttcgggtaaaaaggtcaaagtcccaaccttcctagttccagctacgcagaaggtgtggatggatgtatatagccttccggtcccaggatcgggcgggaaaacttgctcacagatatttgaggaagctggatgcgatacacctgcaagccccagttgcggtgcttgtttgggaggaccaagagacacgtatgcacgcatgaatgaagctcaggtctgtgtttccaccacaaacaggaatttccccggtcgtatgggccataaagaagggcagatttatctagcttctccatacaccgctgccgcatctgcattgactggtttcgtcacggatccacgagaatttcttcagtaagttcgggaatgagtaactttgtgctctacttttctgaatgctgctgctgagttgatccgccttgaattcttgccgttgctgattcacatgttgtgatgcgctagaacttgtagtgttgatgtaacgagagaaacgaactttctcgagtcttctacttttgtttttgtaataaacgaagaatctcgataaaattagtcttgatgtgccttcggacagtcctttgttccgtcttcattttttgtagaacacggttgagattaacgatagatcatagttattttatgcagctgctgctgtttagcaaattg

SEQ ID NO: 5147 - DNA, 1788 bp, Vigna unguiculata
acgcattctcctctcagagatgcttcaaagcggttccaaagggaatccgttgttctgtggcggcgcctcagcgccagccttctaccactggatcagtgagaaccgcaatgacgatgactgagaagatattggccagagcttctgagaaggcccaactgagccctggggataatgtttgggttaatgttgatattttgatgacgcatgatgtttgtggacccggttctattgggattttcaagaaggagtttggtgaggatgctaaggtttgggaccgtgaaaagcttgtaataatacctgatcactatatattcacaagtgatgaacgtgccaatcgcaatgtggacatactaagagatttttgccatgagcaaaatataaaatatttttatgatattaaggatcttagtaattttaaggcaaatccagactataagggtgtttgccatgttgctcttgcacaggaaggtcattgtaggccaggagaggttctcttaggtactgattcccacacatgtactgctggagcatttggtcaatttgctactgggattggaaatactgatgccggttttgtgctgggaactgggaagcttttgctcaaggtgcccccaactttgagatttgtaatggatggagaaatgcctgattatttgctttcaaaggatttgattctgcaaattattggtgaaataagtgttgctggtgctacatataaagctatggagtttgtcggtacaactgttgaaagtttaactatggaagaacggatgacattgtgcaacatggttgttgaagctggtggaaagaatggcgttgttcctgctgacagcactacatttaaatatcttgagggcaagacatctctgccatatgagcctgtttatagtgaccagaaagcaggattcctctcagagtatagatttgatgtctcgaagttggagcctgtggtggccaagcctcattctccagataaccgtgctttggcaagagagtgcaaggatgtgaaaattaacagagtatacataggatcttgtacaggtgggaaaacagaggatttcatggctgcagcaaaagtttttctggcatcaggtaaaaaggtcaaagtccccacgtttcttgtgcctgctacccaaaaggtttggatggacatatacagcatcccagttcctggatctggtggtaagacttgctcacagatatttgaagaagctgggtgtgacacaccagctagtcctagttgtggtgcttgtttgggtggcccaaaagatacttatgcacgcatgaatgaacctcaggtttgtgtttcaactacaaataggaacttccctggccgaatgggacacaaggaaggtcaaatatatttggcttcgccatatacagctgctgcatctgcattgactggttatgttactgatcctagggagtttttgcaatagaatgttgttacacctcattctattatacactttggttagttatgtattctctagccacgaggtaataccagccagatgacaaatccattagtattttttgcctgaagaaattttatgtaacttctatgaaattggcactgtgttagatgtcagaagattgactcatcttgtgcttgttgagtgagtatagcaatgacagttgttgttgcagctactagaatgactgatttcatatggattttcttgtcaatccagcttttagtaactcttttctgtttgttccaagtttatcttgatagccattcatatatataaacatacaagttcaaattttaaaaaaaaaaaaaaa

SEQ ID NO: 5148 - DNA, 1636 bp, Euphorbia peplus
aggatctagggttttcgtcaatctcatcatcgtcatcgtcgtcgttttgtattccgaaatgcaggaggaagtcgatttcgaagaaaataaagtcagttatgactcctcctcagcaactagaccgcaaacctgcctccactggttcagtcaaaactgccatgacaatgactgagaaaatattggctcgtgcctccgacaagtctcatttgagccccggtgagaatgtttgggtcaatattgatgtcttgatgactcatgatgtttgtggccctggttctattggaattttcaagagagagtttggacagaatgctaaggtttgggaccgtgagaaacttgtcatcataccagaccattatatattcactactgatgaacgcgcaaatcgaaatgtggatatattgagggatttctgccaagagcaaaatattaaatacttctatgacatcaaggatctcggtgactttaaggctaatcctgattacaaaggtgtatgccacgttgcacttgcccaagaaggacattgtcgtccaggagaggtcttgttaggtactgattctcacacctgcactgctggagcatttggccaatttgcaactggcattggaaacactgatgcaggttttgtattaggcactgggaagctcctgctgaaggttcccccaactctgagatttgtgatggatggtgaaatgcctgattatttgctagcgaaggatttgattttacagattattggtgaaatatcagtttctggtgcgacctacaagtcaatggaatttgtcggaacaactgttgagagtttaaatatggaagagcggatgacattatgtaatatggttgttgaagctgggggaaagaatggggttatccctgctgatagcactacgttcaagtatctcgaggataaaacatctgttccatatgaaccagtctatagtgatcagcaagcaagatttctctcagaatacagatttgatgtctcaaaattggaacccttagttgcaaagcctcattctcctgataatcgtgcattagcaagagaatgtaaagatgtcaaaattgaccgagtgtacattggatcttgcactggtggaaaaacagaggatttcatggcagctgccaaagtttttctagcttcaggtaaaaaggtcaaggtaccaacatttcttgtccctgctacacagaaggtttggatggatgtatatagtcttccagtaccaggatctggtggaaaaacttgctctcagatttttgaagaagccggttgtgacacacctgcaagccctagttgtggcgcttgtttgggaggccctaaagacacctatgcacgcatgaatgaaccaattgtgtgtgtgtcaacaacaaacagaaacttcccggggagaatgggacacagagaaggacagatatatcttgcttccccttatacagcagcagcatctgctttgactggttatgtcactgatccaagagagtttttgaactgaactaatgaaagttctattgtaataacaacatccaatactgagattttacgagtctgagatcgagtctattgtatgaagagtcctattttgttattttgcaaggtaatacttgatttagttaatgaaataagcttgttttgaggctt

SEQ ID NO: 5149 - DNA, 1962 bp, Panax ginseng
aagcagtggtatcaacgcagagtacatgggggaaccacacaccctccacagaattcgttaatggcttcctctgctactgcttcaagcttcacgcctttcatcaaccagaaagatgtgggtctttctgctttctcgggaaattcctcattttaccttccgaaatggaagaaatatttttcccgggaagttgtttccgttatggcacctcagcaatccgaacgcaagccatccaccactggatcagtcaagactggaatgacgatgactgaaaagatattggctagggcttctgagaaaccccaattgagccccggtgaaaatgtttgggttaatgttgatatcttgatgactcatgacgtttgcgggcccggttctataggaattttcaagagagagtttggccagaatgccaaggtctgggactgtgaaaagcttgttattatacctgatcactacatattcacaactgatgagcgagcaaatcgaaatgtggatattttgagggatttctgcactgagcagaatattaagtatttctatgatattaaagatcttgggaatttcaaggctaacccagattataaaggtgtatgccatgttgctcttgctcaagaaggtcattgcagacctggggaggtcctgctaggcacagattctcacacatgtactgcaggagcattcggccagtttgcgacaggtattggcaatactgatgctggttttgtactgggcacaggaaagcttttgctcaaggtgcctccaactttgagatttgtaatggatggtgaaatgcctgactatttgcttgcaaaggatttgatcttacaaattattggtgaaatatctgtctctggagcaacatataagtcaatggagtttgttggctctaccgtggaaagtttaactatggaagagaggatgacattatgcaacatggttgttgaagctggtggaaaaaatggtgttgtcccagctgatgctacaacctataagtaccttgaggacaaaacatctcttccctatgaaccagtttatagtgatgggcaagcaagatttctttctgaatacaggtttgatatctcaaagctggagccattggtggcaaagccgcattctcctgataatcgtgcgttagcaagagaatgcaaagatgtgaaaattgacagagtgtatattggatcttgtactggtggaaaaactgaggattttctagcttcagccaaagttttcctagcttcagggaagaaggtgaaagttcccaccttcctggtcccttctacccaaaaggtctggatggatgtatatagcctccctgtgccaggatctggtggaaagacttgttctcagatatttgaagaagcaggctgtgatacacctgcaagtcctagctgtggtgcttgtttgggtggtcctaaagacacttatgcacgcatgaatgaagctcaggtctgtgtctccaccacaaataggaactttcctggtcgcatggggcacaaagaaggccagatttatttagcttctccttatactgctgcagcatcggctttgactggctttgtaaccgatccaagagagttcttgcagtaggctgctgatcatctcatgtcatgattactctgaatcttgtcctgcttgtgctttgatttgcagagctgaagtatcaggttctgtatccgacacaaaagccttgtattatgttatgaaagttcagatagtagtagtttagctttgtgctttgaggcttatgtacgtctgtctacgcaagagaatgagttggatttacttttcattataaataatttgaaggatcagactgaactttcattccttaataactagagaattgagcagggctgcaccctggataaatgttgatactgaaacaagaataagcaaatggtgtggctacaactttctatccgaagactggtcaaatattttgcacaaggagataatattgaa

SEQ ID NO: 5150 - DNA, 1917 bp, Fragaria vesca
caaacacgtcttggcttcctcttctccacaacacacaaaacctgtcgacactcacttcctcttcaccgcagccatgtcttactccactcttgcttcaccctccacttccttcctcaacgacaccaccaccactaagaaggatttgggtctctctgctttttcttccacatttcagcgatgcaggagatcagtctccaagaaatcctgctccgtcatggccccatcggagcggaagccagccactactggctcggtcaagactggaatgacaatgaccgagaagatattggcaagggcttctgagagaacccatttgagccctggtgacaatgtttgggttaacattgatgttttgatgacccatgatgtgtgtggccctggttcgtttggaatcttcaagaaagagtttggccagaatgctaaggtttgggaccgagaaaagattgtgatcatacctgaccattatatattcactactgatgagcgtgcaaaccgtaatgtggatatattgagggatttctgcacggagcagaacattaagtacttttatgatatcaaggatcttggcaactttaaggctaacccggattacaagggggtatgccatgttgctcttgctcaagaaggtcattgcaggcctggagaggtgctactaggtacagattctcacacctgtaccgccggagcatttggacaattcgctactggaatcgggaacactgatgcaggtttcgtattgggcactggcaagcttttactcaaggtgcctccaactctgagattcgtgctggatggtgaaatgcctgactatttgcttgccaaagacttaattttgcaaattattggtgaaatctctgtagccggtgcaacatataaagctatggagtttgttggcagcactgttgaaagcttaagtatggaagagaggatgacattatgcaacatggttgttgaagctgggggtaaaaatggtatcgtccctgctgatagcactacatacaagtaccttgaggataaaacgtcagtaccgtatgaacctgtgtacagcgatgataaagcaagatttcttactgagtacagatttgatatctcaaaattggagccgttggtggcaaagcctcattctccagataaccgtgctttagcaagagaatgcaaagatgtgaaaattgacagagtgtatattggatcttgtactggtgggaaaacagaggattttatggctgctgctaaagtttttctggcttcaggcaagaaggtcaaagtacccacttttcttgtacctgctacacaaaaggtttggatggacgtgtacagccgtccggtgccaggatctggtggaaagacttgctcacagatatttgaggaagctggttgtgacacacctgcaagtcccagttgtggtgcttgcttgggtggtcccaaggacacatatgctcgcttgaatgaaccgcaggtatgtgtctctactacaaacagaaacttcccaggcagaatgggccacaaggaaggccagatatatcttgcttcaccatatacagctgcagcatcagccttgaccggttatgtgaccgacccaagagagtttttgcagtaagcgtgatgtcgtcaaagatcagttctagtttcttatgacttgtctggtgttagttaggtagcagaaattaaaaggaaataatgggtcatcacacccatcccgatggttatgtatgctgtgattatcaggtcagtaccatctgtattctgtgaattgtgagtgtgagtgcatagaatgatcttagtccagaaaatggggcatctatctatggaacataatttgacaaattttgtatgattttcattggatagaataacatccttgtttctcaacttatcctgctttcaaagtcattaaattttacgaaaaattctcgcatc

SEQ ID NO: 5151 - DNA, 1611 bp, Flaveria ramosissima
ccctttcttcacccagaaagatgtgggtgtgtccccaatcttcgcacacccttcgaattcgatcagagtatcgcaaaagaaagtgtcgacgaagatcgtatcggtgatgactccgcagcagtcggaacggaagccgtcggccactggctcagtaaagaccgggatgacaatgacagagaaaatattttctagggcgtccgagaaatcccagttgagcccaggtgagaatgtttgggtcaatgttgatgtcttgatgactcatgatgtttgtggcccgggttcaattggaatcttcaagaaagaattcgggaatgatgcaaaggtttgggaccgtgaaaaggttgtcatcatacctgaccactatattttcacaaccgatgaaagagcaaatagaaatgttgatatcctcagggatttctcgcacgagcaagggattaaatatttttatgatatcaaagatcttagcaacttcaaggctaatcctgattacaaaggtgtatgccatgttgctcttgcacaagaaggtcattgtagacctggagaggtattgcttggtacggattcccacacctgtactgctggagcatttggtcagtttgcaactggaattggaaacacggatgctggctttgtgttagggaccggaaaagctttgcttaaggtgcctccaaccttaagatttgttttggatggagaaatgcctgattatctgcttgcaaaggatttgattttacaaataattggtgagatatctgtatctggtgcaacttataaagcaatggagtttgttggttcgactattgagagtcttactatggaagaaagaatgacactatgcaacatggttgtcgaagctggagggaagaatggcattattccagctgatgctactacatttaagtaccttgaggacaaaacatctgtgccttatgaaccggtctacagtgatgatcaagcaaggtatcttgctgagtatagaatcgatgtctccaaattggagcccctagtagcaaagcctcattctcctgataatcgtgctttagcaagagaatgcaaagatgtcaaaatagacagagtatatatcggatcttgtaccggtggcaaaaccgaagattttctagcagctgccaaagttttcttagcttcaggcgaaaaggtcaaagtacccacttttcttgttcctgctactcaaaaggtgtggatggacatttataccctcccggtcccagggtctggtggaaagacttgttcccagatatttgaagctgctggatgtgatacacctactagtcctagttgtggtgcctgtttgggtggtccaaaagatacttatgcacgcattaacgaacctcaggtgtgtgtctcgactacaaataggaacttcccgggtcgtatgggccacaaagatggtcaaatctatctagcttctccttacactgctgcagcttccgcgttgactggttttgtaagcgatccaagagactttttgcgctgatttcgttgctgtttttgttagttcggcgacacaaccttgttgtatgggacttgttgcgcgatcacatctaaaataccatcttttatgttgcacttatgactctaaaataaacatcc

SEQ ID NO: 5152 - DNA, 1850 bp, Prunus persica
caaaaccaaaaccccaacttgcttttcattaggaaaactgtgttttgccgaataaccacacatttcacacccatggcggcttgctccactgttgctccaccatccacctctttcatcagcaacaagaaagatttgggtctctctgctttctcttccgcatcgccgctttccagtcagaaatgcaagagaacatccaagacaatctgttcggtcactgcaccaaaacaatcagagcgcaaacctgccactactggctcggtcaagacgggaatgacgatgactgagaagatatttgctagagcttctgagaaaacccagttgagccctggtgagaatgtttgggttaacgtcgatgttttgatgacacatgatgtttgtggccctggttcctttgggatcttcaagaaagagttcggccagaacgccaaggtttgggaccgtgaaaagattgtaattatacctgaccattatatatttacaagtgatgaacgtgcgaatcgtaatgtggatattttgagggatttctgcacagaacaaaacatcaagtacttctatgatatcaaggatctgagtaattttaaggctaacccagattataagggtgtgtgccatgttgctcttgctcaagaaggccattgcaggcctggagaggtcctactgggtacagattctcacacctgtactgcgggagcttttggacaatttgctactggaatcgggaacactgatgcaggttttgtgttgggcactgggaagctcctgctcaaggtacctccaacattgagatttgtgatggatggtgaaatgcctgactatttgcttgccaaagatttgattctgcaaattattggtgaaatatctgtttctggtgcaacatataaagctatggagtttgttggcagcactgttgaaagcttatctatggaagaaaggatgacattatgcaacatggttgttgaggctgggggtaaaaatggtattgttcctgctgatagcaccacatataagtaccttgaggataagacttctgtgccctatgaacctgtatacagtgatgacaaagcaagatttctgtctgagtacagatttgatatctcaaaactagagccattggtggcaaagcctcattctcctgataatcgtgctttggcaagagaatgcaaagatgtgaaaattgacagagtatatattggttcttgtactgggggaaaaacagaggattttatggctgcagctaaagtttttctagcatcaggcaaaaaggtcaaagtgccaacatttcttgtgcctgctacccaaaaggtttggatggacgtgtatagtcttccagtaccaggatctggtggcaagacttgctcacagatatttgaggaagctggatgtgacacgcctgcgagtcccagttgcggtgcttgcttaggtggtcctaaagacacctatgctcgcttgaatgaacctaaggcaagtatgtgtctcaacaacaaacaggaacttccctggcagaatgggccacaaggaaggcgagatatatcttgcttccccctacacagctgctgcatctgctttgaccggctatgtcaccgacccaagagagtttttgcagtaggcaattgatatcatcataaatttgatcagtgtgtttgctttgtattcttgccactataagttattaggtagcggagattaaggaataatgggaaaccattcccaaaggttttgtatgctgtgtgattaacaggtcagtgccatatgtatttatgtgtgtaattgttagtaagaatgctagaatgttttatgaccagaaaataaagggggtgtctcagtgaacatcactggacaacttttggtga

SEQ ID NO: 5153 - DNA, 1944 bp, Coffea canephora
cggccgggggggttttacactttggttccttcttcctcatccaccgttttcatatttccgtatacctaaaacagaaatctcagcagccaaacaaagaaaagtgaagataatttctcaatcatttccaatggcgtcttctaccattacctcaccccctacacctttgattaacaagaaagatgcgggcctttcagctttctcctcacaagcctcattttctgttcgaaaatcccagaaaagggcctgcaagaaaattgtgtctgtaatggcacctcagcagtctgaaagaaggcctgctaccactggttcagtcaagaccgggatgaccatgactgagaaaatattcgcaaaggcttctgagaaatcacagttgagccctggtgagaatgtctgggtcaatgttgatgttctgatgactcatgatgtttgtgggcctcctgctattggaattttcaagagagaatttggcgaaaatgcaaaggtctgggaccgtgaaaagcttgtcatcatacctgaccactacatattcacaactgatgaacgagcaaaccgtaatgtgggcatcttgagggatttctgtaacgagcaaaacatcaagtacttctatgacattcaagatcttggcaattttaaggctaaccctgattacaaaggtgtatgtcatgttgctcttgctcaagaaggtcactgcagacccggagaggtcttgctgggtacagactcgcacacatgtactgctggagcatttgggcagtttgctactggaattggtaatactgatgctggttttgtgttaggcacaggaaagcttttgcttaaggtgcctcccactttgagatttgttatggatggtgaaatgcccgattatttgctggcaaaagatttaattttgcaaattattggtgagatatctgttgctggtgcaacatataaatcaatggagtttgttggtactactgtggaaagtttgactatggaagaaagaatgacactgtgcaacatggttgtcgaagctgggggcaaaaatggtgttgttccagctgatagcaccacatataagtacctcgaggacaagacatctgtgccttatgagccagtttacagtgatgagcaagcaagatttctttcagaatatagatttgacatctcaaagttggaacctctagtggcaaagcctcattctcctgataatcgtgctttggcgagagaatgcaaagacgtgaaaattgacagagtgtacattggatcatgtactggtggaaaaactgaggattttatggctgctgccaaagtttttctagcttcaggaaagaaggtcaaggtaccgacattcttggtccctgcaacacaaaaggtttggatggatgtatatgcacttccagtcccaggatctggtggtaaaacttgtgctcagatattcgaggaagctggctgtgatacacctgcaagtcctagttgtggtgcttgtttgggaggccccaaagacacctatgcacgcatgaatgaacctcaggtctgtgtatcaaccacaaataggaactttcctggacgaatgggtcacaaagaaggccagatatatctagcttctccatatactgctgcagcatctgcattaactggctatgtcactgatccaagggagtttttgcagtaagtttttttgatcagtgtgtgccattgtacgctgacagcaacttgattcctggaactgtagcgtcaaaagaatccatctgaagccttgatagtttgtatgtttcactagtaattgtgaaaggttgttagtgtactagaaatgcaggaggacatgtatccgaaatcctcgacagcagaattttgagtttctactgtcatgttgtaagatcaaatttataatgtaattgtgatgatcaagcttgggtgaacctacatcaataagagcagcttaatactctctggtttggcagc

SEQ ID NO: 5154 - DNA, 2018 bp, Euonymus alatus
gcactgcgcagtgcagcttctattttcccaggaaacacaccacattccgccttctcccttttgtataacccacatcagagaacaaaaacggaatatcggaattgatagtaggcacgcccatggcgtcctcctctgtcgttgccccttttccttcctcatcattcatttccaacaatagagatgggagtctctcagctttttcttcaccagtgccattcgccatacccaaatgcaagaaacaagctttgaggaggatcgtgtcagttatggcgccgcaacaggctgagcgcaggcctgccaccagtggatcagttaagactgctatgaccatgactgagaagatcttcgcgaaggcctctgagaaaccccagttgagtccaggtgagaatgtttgggtcaacgtcgataccttgatgacccatgatgtttgcggccctggttccatcggaatcttcaaaaaggagtttggccagaatgctaaggtgtggaaccgagagaagattgtcattatacctgaccactatatatttacaagtgatgaacgtgcaaaccgtaatgtggatatcttgagggaattttgcatggagcaaaatataaagtacttttatgatattaaagatctgagcaatttcaaggctaaccctgactataaaggtgtatgccatattgcacttgcccaagaaggtcattgcaggccaggagaggtccttttgggtactgactcgcacacctgtactgctggagcatttggccagtttgctactggaattggcaacaccgacgcaggttttgtacttggaactgggaaacttctgctcaaggtccccccaactttaagatttgttatggatggtgaaatgcctgattatctgctggcaaaggatttgattttgcaaattattggtgaaatatctgtgtcaggtgcaacatacaaatccatggagtttgttggctctactgttgaaagtctaagtatggaagaacggatgacattatgcaacatggttgttgaagctgggggaaagaacggtgtggtccctgctgacagtactacatataagtacctggagaataggacaactgtgccatatgaaccagtttacagtgatagccaagcaagatttctttcggagtatcgatttgatatctcaaaattggagcccttggtggcaaagcctcattctcctgataagcgtgcattggcaagagaatgcaaagatgtaaagattgacagagtatatattggatcttgtactggtgggaaaacagaggatttcatggctgcagcgaaaatttttctagcttcgggaaaaagggttaaagttcccacattccttgtcccagccactcaaaaggtttggatggatgtatatagtctccctgtgccaggatcaggcggcaagacttgctcccagatttttgaagaggctggttgtgacacacctgctagccctagttgtggtgcttgtttgggtggccctaaagatacttatgcgcgcatgaatgaacctaaggtctgtgtctcaacaacgaataggaatttccctggccggatgggacataaggaaggccagatatatcttgcttcaccttacacagcagcagcttctgctttgacgggttatgttactgatcccagggaattccttcagtaagctgtcgctcaccattattgttgtaagaagagaattctgcaggctactataaagtttgttcctgtgtcatttcaagtgtctacgccttaagcagtcttccaagataattattccgtattctgtagtgcttaatatacttttgcactgtttggtgctaattatcgcccctttttagctgtaacttgaatggtggagttgaagtgaggatggttcttttgtaccgtttgaagaaagactgtgtactgttagttttagttggtagtaaagcttttgttttctgtaatatgtccgttttagtattttatctgagatggtattggaaaagtaactaactgcactaggattttgttgtagtatattggt

SEQ ID NO: 5155 - DNA, 1837 bp, Olea europaea
gcatctacctcacacctcctcaattcagtcacgcctctaacaagaacgctgtgcaatccaaactataatggcttccttgactatctttccaagctcttcagctttcatcaagaaagatgtgagtttgtcagccttctcttcacagccttcattttatgtaaagagttctaagaaaagggtctgcaagaaaattgcatctgtgatggcaccacaacaatctgaacgcaagccatccacaactggttcagtcaaaaccgggttgaccttgactgagaagatactagcaagggcttcagagaaaacccagttggtccctggtgagaatgtgtgggtgaatgttgatattttgatgacccatgatgtttgtggccctggtgcctttggaattttcaagaaagagttcggagaaaatgctaaggtctgggaccgtgaaaaggttgttatcattccagatcattatatattcaccactgatgaacgagcaaatcgtaatgtggatatcttgagggatttctgtactgaacaaaatattaaatacttttatgatatcaaagatcttgggaatttcaaggcaaatccagattataaaggcgtatgtcatgtagctcttgctcaggaaggtcattgcagacctggagaggtcttgctgggtacagactcacacacatgtactgctggagcatttggtcagtttgcaactggaattggcaatactgatgcaggttttgtgctgggtaccggaaagctcttgcttaaggtgcctccaactttgagatttgtcatggatggtgaaatgcctgattatttgcttgcaaaggatttgattttgcaaatcattggtgaaatatcagtggccggtgcaacatataaagctatggaatttgttggtactactgttgaaagtttaacaatggaagagagaatgacattatgcaacatggttgttgaggctgggggcaagaacggtgttgttccagctgataataccacatataagtatcttgaggaaaagacaaacttgccgtatgagccagtctatagtgatggacaagcaagattccttcaagagtacaaattcgatgtctcaaagttggagcctttggtggccaagcctcattctcctgataatcgtgctttggctagagaatgcaaagacgtgaaaattgacagagtatatattggatcttgcactggtggaaaaacagaggatttcatggctgctgccaaagttttccttgcttcagggaagaaggtcaaagttccaacattccttgtccctgctacacaaaaggtctggatggacgtatatagccttccagtcccaggatcgggtgggaaaacttgctcgcagatatttgaagaagctggatgtgacacacctgcaagtccgagttgcggtgcttgtttaggtggaccccgggatacttatgcacgcatgaatgaacctcaggtctgtgtttcaacgacaaataggaacttcccgggtcgtatgggtcataaagaaggacaggtttatctagcttctccatatacagctgcagcatcagcattgactggctttgtgacagacccaagagagtttttgcagtaaggtcttcaatgcatgtcatgattatgtatgttaccacctcggattttgatccttagctgaaacattggcttgtcatgatctgttaaatttgttactattactttgtgagtttgctcaactgatattctagaactttgacagaaacaagtcttagtcctctactactatgttgtaacgtgtaatacttcaataagaatgtcagtcgaacaagtcttgatgccatgaatgttaatttctagattatga

SEQ ID NO: 5156 - DNA, 1901 bp, Ocimum basilicum
gcacccgttaagggggctgggctggcaaatgaataaggaaagatcctaaacccaaacttgcagttcctcatctgctattgtcttacgccgacttctgctgttcggacatcatcagatggcttcatctgcggtagctccgacctcttcattcctctccgacaagaaagatgtgggcttttccaccttctgcacacagccttcatttccatgttcggcgcagctttcaaagagaagggcgtcgaagaaaatagtttctgtaatggcgccccagcaatctgagcgcaagccttcgatgacgggggcggttaagaatgcgatgacaatgactgagaaaatactggcaagagcttcagagaaatcccaattggttccgggagaaaatgcttgggtaaatgtggatattttgatgacccacgatgtttgtggccctggttccattgggattttcaagaaggaatttggccaaaatgccaaggtttgggaccgtgaaaaagttgttattattccggatcattatatcttcacaactgatgagcgagcaaatcgcaatgttgacatcttaagggatttctgcaatgagcaaaatattaagtacttctatgacattacggatcttgggaatttcaaggccaatcccgattacaaaggtgtatgccacgtagctcttgcccaagaaggtcattgccgacctggagaggtcttgctggggactgattctcacacatgtactgctggagcatttggtcaatttgccactggaattggaaacactgatgctggtttcgtattgggtactggaaagcttttgcttaaggtgcctccaactttgagatttgtaatggatggtgaaatgccggactatctgcttgctaaagatttaattttgcaaattattggtgaaatttcagtggctggtgcaacatacaaagccatggaatttgttggttctactgttgagagtttgacaatggaagaaaggatgacattatgcaacatggtagttgaagctggaggaaagaatggtgttgtccctgccgatagcaccacatacaagtaccttgagggcaagacatctctgccgtttgaaccagtgtttagcgacggacaagccaggtttcttcaagagtaccgatttgatatttcaaagctggagccgttggtagctaagccccattctccagataatcgtgctttagcacgagaatgcaaagatgtgaaaatcgacagggtatacattggatcttgtactggtgggaagacagaggatttcatggctgcagctaaagtatttcttgctgcggggaaaaaggtcaaagtcccaaccttcctagttccggctacacagaaggtatggatggacgtatatacccttccagtgccgggatctggtgggaaaacatgctcacagatatttgaggaagctgggtgtgatacgcctgcaagccccagctgcggagcttgtttgggaggaccaagagatacatacgctcgcatgaacgaacctcaggtgtgtgtttcgaccacaaacagaaatttcccaggtcgtatgggccataaagaagggcagatatatctagcttctccatatacggctgcagcatctgcactcaccggttttgtgaccgatccacgagaatttctgcagtaagacgggactgtatttttgactatctacctcaaattcttgtgtgtttgtaataacaaaaatctcaaccttttttatgtaatttgagacgacattgttgagattaatgattgattcaagatgttttgtgttgtttagcaaattactggattaagagtaagaaatagtggtgcatgaaatgcttgcggagaatttttgtagctgatggttaaaatatttctggctttgcatgggcggagatcgaaagagcacacgt

SEQ ID NO: 5157 - DNA, 1893 bp, Vaccinium corymbosum
tatagcttattactctgcaactcgcgttctcctctcaccaggtccacacaatacagacggctaatttcacaacctgaaaacccgcaatggcttcatctgctattgcaccgagctcctcacctttcatcagcaaggttcagaaagatgtgggcctctctgctttctcctcacaaccctcattttccatacgcaatgccaagaaaagagtttccaggaagatcacgtgcgtcatggcgccacaacaaactgaacgcaagcccgccacctctggttcagtcaagactgcaatgacgatgaccgagaagatcctggctagggcttcagagaaacagcagctgagcccaggcgagaatgtatgggtcaacgtggatgtcttgatgactcatgatgtttgtggacctggcacttttggaatcttcaagaaagagtttggacaaaatgctaaggtgtgggaccgtgaaaaggttgtgatcatacctgaccactatatattcactactgacgaccgagcgaatcgcaacgtggatatctgcagggaattttgcatggaacaaaatataaagtacttttatgatatcaaagatcttgggaatttcaaggctaaccctgattataaaggggtatgccatgttgctcttgcccaagaaggtcattgcaggcctggagaggtcttgctaggaacagactcccacacgtgtaccgcaggagcatttggccagtttgctactggaattggcaatactgatgcaggtttcgtgttaggcgccggaaaacttttacttaaggtgcctccaacattgagatttgtgatggatggtgaaatgcctgattacctgcttgcaaaggatttgattttgcagattattggtgagatttcggtgtctggtgcaacttacaaagctatggagtttgttggctctactgttgagagtctgagtatggaagaaaggatgactttatgcaacatggttgttgaagctggggggaagaatggcgttgtaccagctgatagtacaacatataagtatctcgagggtaagacagatacgccttacgaagcagtttacagtgatgatcaagcaagatttctttcacaatatagatttgacgtctcaaaactggagcctctagttgcaaagcctcattctcctgataagcgagctttagcaagggaatgcaaggatgtgaaaatcgatagagtctatattggatcctgtactggaggaaaaactgaagattttcttgcagcagccaaagttttccttgcttcaggaaagaaggtcaaagttcccactttccttgtcccagctacccaaaaggtgtggatggacgtatacagtctacccgttccaggatctggtggcaagacctgctcccagatatttgaggaagctggttgtgatacacctgcgagtcctagttgtggtgcttgcttgggtggtcccaaagacacttatgcccgcttgaatgaacctcaggtttgtgtgtcaacaacaaacagaaatttccccggacgaatggggcacaaagaaggccaaatttatcttgcttctccatacacggctgcagcttctgctttgaccggatttgtcactgatccaagagagtttctgcagtagaccattacctgtgattcctcttggaccttggaccgttcgaacttctatctgagtggctgaagagaaatatgaggttcagtttactgatactacaaaaacatatccgtgtgttgtggttgtgatgctagtatctaacatattgtggtgctgtaactctctgttgtagtatttttaagggaaaaggcttatctaataaatttcccgagggccgaggccataggttgttacagctgataatagatctgcttccattttaaaataaatatatctgctt

SEQ ID NO: 5158 - DNA, 1905 bp, Trifolium pratense
tcatcaatggcttcttctcttgttccttcaccatccacctccttcttccacactaagaaggatctgaatctctctgctttctcttcatcatcttcttctcaaatatgtcacaaacatgcttccaggaagatctgttgttctgttgcggcacctcaacaaacgcagcgtcaaccttctaccactggatcagtgaagacagctatgactatgactgagaagataatggctagagcttctgagaagcaacaggtcagacctggggataatatttggacaaatgttgatattttgatgactcatgatgtttgtggtcctggttcaattgggattttcaagaaggagtttggtgaggatgctaaggtttgggatcgtgaaaaggttgttataatacctgaccactatatattcacaagtgatgaacgtgccaatcgcaatgtagacatactcagggatttctgcaatgagcaagatatcaagtacttttatgatattaaggatctcagtaattttaaggcaaatccagattacaaaggtgtttgtcacatcgctcttgctcaggaaggtcattgcaggccaggagaggttctcttgggcaccgattctcacacttgtactgctggtgcatttggtcaatttgcaacagggattggtaatactgatgccggttttgtgttgggagcaggaaagcttttgcttaaggtgcctccaactctgagatttgtaatggatggagaaatgcccgattatttgcttgcaaaggatttgattttgcaaattattggtgaaataactgtggctggtgcaacttacaagtctatggagtttgttggctcaactgttgaaagtttaaatatggaagaacgaatgacattgtgcaacatggttgttgaagctggaggaaagaatggtgttattcctcctgacagcgttacatataaatatctcgagggcaagacatctgtgccatatgaaccagtttatagtgaccagcaagcaagatttctttcggagtatagatttgatgttacaaaattggagccactggtggccaagcctcactcaccggataaccgtgctttggcaagagagtgcaaggatgtgaaaattaacagagtatacataggatcttgtacgggtgggaaaacagaagatttcatggctgccgcgaaagtttttctagcatcaggtaaaaaggtcaaagttcccacgtttcttgttcctgcaacacagaaggtatggatggacgtatacagcctccctgtccctggatctggtggtaagacttgctcacagatattcgaagaagctggctgtgacacacctgctagtcctagctgtggtgcttgtttgggtggcccaaaagatacctatgctcgcatgaacgaaccacaggtttgtgtttcaactacaaatagaaactttccggggcgaatgggccacagggaaggtgaaatatatttggcgtctccatatacagctgcagcatccgcgttgaccggttatgttactgatccaagagagttcttgcagtaagatatatcatcccggaaaaggatcctctcctattctgccatctattatgctcttaatttaatggctgactgattttaaagagaaattaaaaacaaaaaagctgtcatgtagtgagattaatggctgagatgacagcaagacaaacggcagcagaggttctgcagtagaggatccgaatccatattatcctattgtattttatagtattgtatacattggttagttttgtattctctagccaaacttagaactgtaagctattaaataaagtttaaccactattggtatttgttttcagtggagaaattgtgactgataatgaattgattcttagttttagtaactaaaacaatattggttttttagtaaaaa

SEQ ID NO: 5159 - DNA, 1792 bp, Trifolium pratense
ccgccagagccacaccttattattgtattgtactgtctcattactcattgctgttctgttctgttctgtgttcctcaaatcatcatcatcaatggcttcttctcttgttccttcaccatccacctccttcttccacactaagaaggatctgaatctctctgctttctcttcatcatcttcttctcaaatatgtcacaaacatgcttccaggaagatctgttgttctgttgcggcacctcaacaaacgcagcgtcaaccttctaccactggatcagtgaagacagctatgactatgactgagaagataatggctagagcttctgagaagcaacaggtcagacctggggataatatttggacaaatgttgatattttgatgactcatgatgtttgtggtcctggttcaattgggattttcaagaaggagtttggtgaggatgctaaggtttgggatcgtgaaaaggttgttataatacctgaccactatatattcacaagtgatgaacgtgccaatcgcaatgtagacatactcagggatttctgcaatgagcaagatatcaagtacttttatgatattaaggatctcagtaattttaaggcaaatccagattacaaaggtgtttgtcacatcgctcttgctcaggaaggtcattgcaggccaggagaggttctcttgggcaccgattctcacacttgtactgctggtgcatttggtcaatttgcaacagggattggtaatactgatgccggttttgtgttgggagcaggaaagcttttgcttaaggtgcctccaactctgagatttgtaatggatggagaaatgcccgattatttgcttgcaaaggatttgattttgcaaattattggtgaaataactgtggctggtgcaacttacaagtctatggagtttgttggctcaactgttgaaagtttaaatatggaagaacgaatgacattgtgcaacatggttgttgaagctggaggaaagaatggtgttattcctcctgacagcgttacatataaatatctcgagggcaagacatctgtgccatatgaaccagtttatagtgaccagcaagcaagatttctttcggagtatagatttgatgttacaaaattggagccactggtggccaagcctcactcaccggataaccgtgctttggcaagagagtgcaaggatgtgaaaattaacagagtatacataggatcttgtacgggtgggaaaacagaagatttcatggctgccgcgaaagtttttctagcatcaggtaaaaaggtcaaagttcccacgtttcttgttcctgcaacacagaaggtatggatggacgtatacagcctccctgtccctggatctggtggtaagacttgctcacagatattcgaagaagctggctgtgacacacctgctagtcctagctgtggtgcttgtttgggtggcccaaaagatacctatgctcgcatgaacgaaccacaggtttgtgtttcaactacaaatagaaactttccggggcgaatgggccacagggaaggtgaaatatatttggcgtctccatatacagctgcagcatccgcgttgaccggttatgttactgatccaagagagttcttgcagtaagatatattatcccattgtactagtattgtatactttggttagttttgtattctctagccaaacttagaactgtaagctattaaataaagtttaaccactattgatatttgttttcaatggagaaattatgtgactattaatgaatgattcttagttttagtgactaaaacagta

SEQ ID NO: 5160 - DNA, 2021 bp, Mimulus guttatus
attttatcaatactcatcatcaagaaggagtagccgcctctcctttcacatcgatctcttctgcttcggacaacatctcccgatgggttcatctgctttgcctccgacctcatcgtttctctccgacaagaaagatgtgggattttcgtctttctgcacacagccttcgttcccatgttccgcacaggtttccaagaaaatggtgtccaagaaagttgtttctgtgatgacacctcagcaatctgagcgcaaaccctccacaaccggcgcggttaagactgggatgacaatgactgagaagatatttgcaagagcttcggagaaatcccaattgatacccggcgagaacgtgtgggtcaacgtcgatatcttgatgacccacgacgtttgtggcccgggttctatcgggattttcaagaaagagtttgggaaaaatgcaaaggtgtgggaccgtgaaaagattgttataattccagaccactatattttcacagccgacgaacgagcaaatcgaaatgtagacatcttgagggatttctgtaacgaacaagatatcaagtacttttacgacattaaagatctcgggaattttaaggcaaatccagattacaaaggcgtgtgccacgtggcgcttgctcaagaaggtcattgtcgtccaggagaggttttgttgggtacggactcgcacacatgtaccgctggagcatttggtcaatttgctaccgggatcggaaataccgatgcgggttttgttttgggtaccggaaagcttttgcttaaggtgcctccgactctgagatttgttatggatggcgaaatgcccgattatctgcttgcaaaagatttgattttgcaaattatcggcgagatttcagtagctggtgcaacgtacaaagcaatggagtttgtcggttctactgtcgaaagtttgacaatggaagaaagaatgacactgtgcaacatggttgttgaagctggtggaaagaacggtatcgtccctgctgatagtaccacatttaagtacctcgaggacaagacttctttgccgtatgagccagtttatagtgacggacaagcaagatttcttcaagagtacagaatcgacgtctcgaaattggagcccttggttgctaagcctcactctcccgataatcgtgctttagccagagaatgcaaagacgtgaaaatcgacagagtgtatatcggatcttgcaccggtggtaaaacagaggatttcatggctgctgccaaattatttcatgcctcggggaaaagggtgaaagttccgacattcctagtgccagctacgcaaaaggtgtggatggatgtatatagtctacctgtacctggagcgggcgggaaaacttgctcgcagatattcgaagaagctggttgtgatacgccagctagccctagttgcggtgcttgtttgggtgggccgagagacacttatgcgcgcatgaatgaagctcaggtatgtgtgtcgacgacaaacaggaatttccccggtcgaatggggcacaaagaagggcagatatatctagcttctccgtatacagctgcagcatctgcgttgactggcttcgttactgatccaagagactttctgcagtaagacttttcacgagaattattgtgattttttatgctcgccctttttttgttttttatttatgtaacttcgggagttgaaaaagcatcgaaaatatttatgcgctgaatttttagcttcttgatcggtgtttgcttaaaacttgtattgttcgtgtactcgacgtttgtaataagatcaaatgtcaatgagaataaagtcgctagtcgaatgtattgtggattataatatatgcgcgtacaagtatacggcatactgtataatttacactatgtctgcatatttttcactttcaatatagttgcatacaagtttattgaaaaaatgatgagaaatgaagagtgttgaattgagaaaagactatcaatttttttcttaataatattgttatacagttgtcacatttgag

SEQ ID NO: 5161 - DNA, 3018 bp, Petroselinum crispum
gcttcttccagttcctcatctttcatcaatcaggtttattaattcctaatttatacaataaaaatttaatctttgttatatttcttacaaaatctttgtatttgcttacgattacatggtattttgcataatttgtgtacacatacataactatacatacatacaaatacaggtcttcctaaaggatccattttgcctggctgattaaacccatcattatcaattaatggcttcagctgctattgcttcttccagttcctcatctttcatcaatcagagaaaagatgtgggtttgtctgcttttccaacaaactcttcattttacccctcaaattccaagaagaagttgttttccaagaacaatattgtctctgttatggccccacagtctcaaagaacaccttccaccactggctcagttaagactggtatgactatgacagagaagatactagcaagggcttctgagaaaccccagttgagtcctggtgaaaatgtttgggttaatgttgatatcttgatgacccatgatgtttgtggcccgggttctattggtattttcaagaaagagtttggccaggatgctaaggtttgggaccgtgagaagctcgtgattatacctgatcactatatattcaccaaagatgagcgagcaaatcgaaatgttgatattttgagagatttttgcaatgagcaaaatatcaagtacttctatgatattaatgatcttggcaatttcaaggccaatccagattataagggtgtatgtcatgttgctcttgctcaagaaggtcactgcaggcctggggaggtccttctaggaacagattctcacacatgtacagcgggtgcatttggtcagtttgcgacaggtataggtaatactgacgccggtttcgttttggggacaggaaagcttttactaaaggtgcctccaactttgagatttgttatggatggtgaaatgccggactacttgcttgccaaggatttgattttacaaattattggtgaaatttcagtctctggtgcgacatacaagtcgatggagtttgttgggtctactgtagaaagcttgagtatggaagagaggatgactttgtgcaacatggttgttgaagctggtgggaaaaatggtgttattccagctgatgctactacttataagtaccttgagggcaaaacatctctgccttatgaagcactatacagtgacgagaaagcaagatttctttctgagtacagatttgatatctcgaagctggagccactggtagcgaagcctcattcgcctgataatcgtgcattagcaagggaatgcaaagatgtcaaaatcgacagagtctatattggatcttgtactggtggaaaaactgaggattttctagctgcagccaaagtttttctagcttcaggtaaaaaggtgaaagttcccaccttcctggtccctgcaacccaaaaggtttggatggacgtgtatagccttccagtgccagggtccggcgggaagacttgttctcagatatttgaagaagcaggctgtgatacacctgcaagtcctagctgtggtgcttgtttaggtggtccaaaggacacttatgcacgcatgaatgaagcacaggtctgtgtctccacaaccaataggaacttccctggtcgtatgggtcacaaggacggccagatttatcttgcttctccatatactgctgcagcatcagctttgactggctacgtaactgacccaagagagtttttgcagtaggtggctgattgtgtacttgcaatggttactttggtacttgtgttgcttaaacttgatcatgggagctggaatatcaggttcaggatctgactttaccttgttttgttaagagttcagagtatagtagatcactgttgtaatttttgtgctatgagttatatagtacacgggacattgtaatgttcagctaaataattcacctaaaacatggacatgataatgcaatatacccgctataaagcttttgtattcgtctctgatgaggaatagcagggagttagtttttgtattagtggttgacacagaataattttgtatgatcaaatttactgctttttccttacattacagactaagaaaagttgctcctcattcatacgttgataccagaccatggaaatggaataaatttgatagcgagcaccttattcaatattaatttgtaaaaggtttgcaagtgtacaaataaactgaggcatatttacgttggacttgaattagatcgaagaatggaaattaaaatggccaataatagatcacctgaacactacgagtctctgacactttttgtggtaatcgagactcgatgtttttgtatatttctgattgacaccgtccacttgttacatgggaaaaatgtcacctcaatcagaagtaagaagaaaataggtgtaatggtttgtactttgagaaataagcaggatgttctcttttcctaaccatgttgctagctaactttggaggtcacactctcctgaggggcccttgccgcaaatagcacaaaattttcacctcaaaactttaggtggagtgggtcattccttgattgtatacgggggagcatccactcgataaccaaattcagtggcagggaaagtagtgaaatgttgattgctataacataatgattcaagatgtgttaattattgtcacagggaattattaaagataagataagatgataacttttacagtggaattatgcaaggggtggcatgcattcctagctactcatttttaatctgtaggatccatggaaaacaattatggaatacaacaaatttaatgtactcctggggacaccctttgtaaacatccctagcctaggtaaagcaaaatgaatgcatcataataattcaaaggggaggtcctcaaatatattggatcttaggcaaaatcagttttcggatccctaaacaatacatacgacgaatattttatatttatataataaaggcaaatagtatttatagctt

SEQ ID NO: 5162 - DNA, 1874 bp, Triphysaria pusilla
tcttcttcttagttcttaccgtcctgccctttccacaactctgcttcagtcacaacagtaaacacacgaccagttgagccccatggcatcctctcatcttactccaagctcgtcgctgtttgtcgacaagaaagatgttggggtttcaggcttttactcacaggcgtcttcaatcccatttccccagccggcgttcaagaaagaggcttgcaagaaaatagtgtctgtaatgacacctcagcaatcggagcgtagaccttcgacaaccggggcggtcaagactggtatgaccatgactgaaaagatacttgcaagagcctcggagaaaacccagttaagccctggtgagaatgtgtgggttaacgtggatattttgatgactcatgatgtttgtggccctggttctattggaatttttaagcgagagtttggggaaaatgcaaaggtctgggaccgtgaaaaacttgttatcattccagatcattatatattcacaagtgatgaacgagcgaatagaaacgtggacattttgagagatttctgtaatgaacaaaatattaagtacttctacgacattaaagatcttgggaacttcaaggccaatcctgattacaaaggtgtgtgccatgtggctcttgcccaagaaggtcattgcagacctggagaggtattgctgggtacagactcacatacttgtacagcaggagcatttggtcaatttgccactggaattggaaataccgatgcaggtttcgtgctcggtactggaaaacttttacttaagactcctccaactctgagatttgtgcttgatggtgaaatgccggattatttgctcgcaaaagacttgatcttgcaaattatcggtgaaatatcagtggctggtgcgacatataaagcaatggaatttgtcggctccactgtcgaaagcttgacaatggaggagaggatgacattgtgcaacatggttgttgaagccgggggtaagaatggcgttgttcctgctgatagcaccacttttaagtatcttgaggacaagacatctttgccatatgaaccagtttacagtgatggacaagcaagattcctttcggagtacagatttgatgtctcaaagatggagcctttggtggctaagcctcattctcctgataaccgcgccttagctcgagaatgcaaagatgtgaaaatcgacagagtatatatcggatcttgtacgggaggaaaaacagaggatttcatggctgctgccaaagtctttctagcttcgggcaaaaaagtcaaagtcccaacattcctcgtcccggctactcaaaaggtgtggatggacgtatatagccttccagtcccaggttctggcggtaaaacatgctcgcagattttcgaagaagctggttgtgatacacctacaagccctagctgcggtgcttgtttaggaggaccgagagacacttatgcacgcatgaacgaagctcaggtctgtgtttcgacaacaaacagaaatttcccaggtcgaatgggccataaagaagggcagatatatctagcttctccatacactgctgcagcatcagcactgactggttttgttaccgatcctagagagtttttgcagtaagtcttttttttatcacgagtgtgttaggactacttgtcgaaacatctggagttgttaaaatgctcgtaattatgaaacttgcgaagcttgagtcgatttagtgtttcgtcttttactatgtttggcattggttcgagagcatgtttgttcattgtctgatcaatgaatccttgctgaatattacagttggttatgttatagaataattgcccaaaccgtgaaggattttcatggatggtatttctatttatttgaa

SEQ ID NO: 5163 - DNA, 1897 bp, Prunus mume
cgccctcagccgccgcctcacagtttcaataacacaaacaaacacaaaaccaaaaccccaacttgcttttcattttcttcctttcagaaactgtgttttgccgaatagccacacatttcacatccatggcagcttgctccactgttgctccaccatccacctctttcatcagcaacaagaaagatttgggtctctctgctgtctcttccgcatcgccgctttccagtcagaaatgcaagagaacatccaagacaatctgttcggtcactgcaccaaaacaatcagagcgcaaacctgccactactggctcggtcaagacgggaatgacgatgactgagaagatatttgctagagcttctgagaaaacccagttgagccctggtgagaatgtttgggttaacgtcgatgttttgatgacacatgatgtttgtggccctggttcctttgggatcttcaagaaagagttcggccagaacgcgaaggtttgggaccgtgaaaagattgtaattatacctgaccattatatatttacaagtgatgaacgtgcgaatcgtaatgtggatattttgagggatttctgcacagaacaaaacatcaagtacttctatgatatcaaggatctgagtaattttaaggctaaccctgattataagggtgtgtgccatgttgctcttgctcaagaaggccattgcaggcctggagaggtcctactgggtacagattctcacacctgtactgcgggagcttttggacaatttgctactggaatcgggaacactgatgcaggttttgtgttgggcactgggaagctcctgctcaaggtacctccaacattgagatttgtgatggatggtgaaatgcctgactatttgcttgccaaagatttgattctgcaaattattggtgaaatatctgtttctggtgcaacatataaagctatggagtttgttggcagcactgttgaaagcttatctatggaagaaaggatgacattatgcaacatggttgttgaggctgggggtaaaaatggtattgttcctgctgccacatataagtaccttgaggataagacttctgtaccctatgaacctgtatacagtgatgacaaagcaagatttctgtctgagtacagatttgatatctcaaaactagagccattggtggcaaagcctcattctcctgataatcgtgctttggcaagagaatgcaaagatgtgaaaattgacagagtatatattggttcttgtactggtggaaaaacagaggattttatggctgcagctaaagtttttctagcatcaggcaaaaaggtcaaagtgccaacatttcttgtgcctgctacccaaaaggtttggatggacgtgtatagtcttccagtaccaggatctggtggcaagacttgctcacagatatttgaggaagctggatgtgacacgcctgcgagtcccagttgcggtgcttgcttaggtggtcctaaagacacctatgctcgcttgaatgaacctaaggcaagtatgtgtctcaacaacaaacaggaacttccctggccgaatgggccacaaggaaggcgagatatatcttgcttccccctacacggctgctgcatctgctttgaccggttatgtcactgacccgagagagtttttgcagtaggcaattgatatcatcataaatttgatcagtgtgtttgctttgtattcttgccactataagttattaggtagcggagattaaggaataatgggaaaccattcccaaaggttttgtatgctgtgtgattaacaggtcagtgccatatgtatttatgtgtgtaattgttagtacgaatgctagaatgttttatgaccagaaaataaagggggtgtccaagtgaacatcactggacaacttttggtga

SEQ ID NO: 5164 - DNA, 1826 bp, Ambrosia trifida
ttttgactttgcccaccaccgagaggacacatcttcgtgtggacacctcttgccattaacccatttccacacatatcagactcatcatcactcaccaaccacaaccacaacccatcaatggcggccgctgcttcatttgcactctcctcccctttcttgggccagaaagatgcaggtgtgtctccattcttttcacacccttcaagctcaatcaaagcattccacaaaaaagtttccacaaatattgtatctgtcatgactccacagaaatctgaaaggaaaccatctgccactggctcagttaagaccgcaatgacgatgaccgagaaaatattttctagggcttctgagaaatcccagttgagcccaggcgagaatgtgtgggtcaatgttgatgtcttgatgacacatgatgtttgtggcccgggttccatcggtattttcaagaaagaatttggaaatgatgccaaggtttgggaccgtgaaaaggttgtcatcatacccgatcactatattttcacaagtgatgaaagagcaaatagaaatgttgatatcattagggagttctcacatgagcaagggataaaatacttttatgatatcaaagatcttagcaacttcaaggctaatcctgattacaaaggtgtatgccatgttgctcttgcacaagaaggccattgcagacctggagaggtcttgcttggtacggattcccacacctgtactgctggagcatttggccagtttgctactggaattggaaacacggatgccggttttgtgttagggactggaaaagctttgctcaaggtgcctccaaccttaaggtttgtattggatggagaaatgcctgattatctgcttgcaaaggatttgatcttacaaataattggtgaaatatctgtatctggtgcaacttataaagcaatggagtttgttggtacgaccgttgaaagtcttactatggaagaaagaatgacattatgcaacatggttgtcgaagctggagggaagaatggtattgttccagctgatgctacgacatttaaataccttgaggacaaaacatctgtaccttatgaaccagtctacagtgatgatcaagcaaggtttctcgctgagtatagaatcgatgtctccaaactggagcccctagtggcaaagcctcattctcctgataatcgggctacagcaagggaatgcaaagatgtcaaaatagacagagtgtatatcggatcttgtactggtggcaaaaccgaagattttctagctgctgccaaagttcttcttgcttcaggcgaaaaggtcaaagtacccacttttcttgttccggctactcaaaaggtatggatggacatttataccctcccggtgcccggcgctggtggaaagacttgttctcagatatttgaagctgctggatgtgatacacctgctagtcctagttgcggtgcctgtttgggtggtccaaaagatacttatgcacgcattaacgaacctcaggtgtgtgtctcgaccacaaacaggaacttcccgggtcgtatgggccacaaagatggtcaaatctatctagcttctccttacactgctgcagcttcggctttgaccggttttgtaaccgatccaagagactttttgcattgatttcattgcagttttttgttagttcagtgacacaaccttgttgtatgggactttccgcttgtttgtttacgtctaaaataaaataccatcctttcatgtttgttgcacatcatgattctgaaataaacatccatgaggtttgcatttatgcacattgtcttctttcatattttcaaaaagaa

SEQ ID NO: 5165 - DNA, 1560 bp, Flaveria ramosissima
aaaacgattatcatttcaccaatggcggcttcatctgcaatctcctcatcatcttccctttcctcacccagaaagatgtgggtgtgtctccaatcttcgcacacccttcgaattcgatcagaatatcgcaaaagaaagtgtcgacgaagatcgtgtccgtgatgacaacgcagcaatcggaacggaagccatcggccactggctcagtaaagaccgggatgacaatgacagagaaaatattttctagggcgtccgagaaatcccagttgagcccgggcgagaatgtttgggtcaatgttgatgtgttgatgacacatgatgtttgtggccctggttcgattggaatattcaagaaagagttcgggaatgatgccaaggtttgggaccgtgaaaaggttgtcatcatacccgaccactatatattcacagccgatgaaagagcaaatagaaatgttgatatcctcagggatttctctcatgagcaaggcatcaaatacttttatgatattaaagatcttagcaacttcaaggctaatcctgattacaaaggtgtatgccatgttgcacttgcacaagaaggtcattgcagacctggagaggtcttgcttggtacggattcccacacctgcactgctggagcatttggtcagtttgcaactggaattggaaacacagatgctggttttgtgctagggactgggaaagctttgcttaaggtgcctccaaccttaagatttgtattggatggagaaatgcctgattatctgcttgcaaaggatctgatcttacaaataattggtgagatatctgtatctggtgcaacttataaagcaatggagtttgttggttcgaccattgaaagtcttaccatggaagaaagaatgacactatgcaacatggttgtcgaagctggagggaagaatggcattattccagctgatgctactacatttaaataccttgaggacaaaacatccgtgccttatgaaccagtctacagtgatgatcaagcaaggtatcttgctgagtatagaatcgatgtctccaaattggagcctttagtggcaaagcctcattctcctgataatcgtgctttagcaagggaatgcaaagatgtgaaaatagacagagtgtatatcggatcttgtactggtggcaaaactgaagattttctagcagctgccaaagttttcttagcttcaggcgaaaaggtcaaagtacccacttttcttgttcctgctactcaaaaggtgtggatggacatttataccctcccggtcccagggtctggtggaaagacttgttcccagatatttgaagctgctggatgtgatacacctaccagtcctagttgtggtgcctgtttgggtggtccaaaagatacttatgcacgcattaacgaacctcaggtgtgtgtctcgactacaaacaggaacttcccgggtcgtatgggccacaaagacggtcaaatctatctggcttctccttacactgctgcagcttccgctttgactggttttgtaagcgatccaagagactttttgcgctgatttcattgct

SEQ ID NO: 5166 - DNA, 1835 bp, Cajanus cajan
taaacaaaacctcaactcacactcgcttatgttattgctcaccacagcttcagcatcaatatcaatggcttcctctcttctttctccatcattcacttccttcctccgcaccaagaaggatctgtctctctccactttctcttatcaccgatgcctcaaaggggtgccgaggagaatccgttgtgccgtgtcgacgccgcagcgccaaccttccaccaccggatcagtaaggactgcaatgaccttgactgagaagatattggccaaagcttctgagaaggctcagttgagccctggggataatgtttgggtcaatgttgatgttttcatgacacatgatgtgtgtggccctggtagtattggagttttcaagagggagtttggtgaggatgctaaggtttgggaccgtgaaaaggttgtaatgatacctgaccactatatattcacaaatgatgaacgtgccaaccgtaatgtagacataataagagatttctgccatgagcaaaatatcaagtacttttatgatattacagatcgtagtaattttaaggcaaatccagactataagggtgtttgccacgttgcccttgctcaggaaggtcattgtaggccaggagaggttctcttaggtactgattctcacacttgtactgctggagcatttggtcaatttgctacagggattggtaccacggatggtggttttgtgctgggaactggaaagctactgctcaaggtgcccccaactttgagatttgtactggatggagaaatgcccaattatttgctctcaaaggatttgattttgcaaattattggtgaaataactgtggctggtgcaacgtataaatcgatggaatttgttggtacgactattgaaagtttaaatatggaagaacggatgactttgtgcaacatggcggttgaagcaggtggaaagaatggtgttattcctgctgatggcactacatttaaatatcttgaggacaagacatctgtaccatatgaacctgtttatagtgaccagcaagcaagttttctctctgagtatagatttgatgtctcgaaattggagccagtggtggccaagcctcattctcctgataaccgtgcattggcaagagagtgcaaggatgtgaaaattgacagagtatacataggatcttgtacaggtggcaaaaccgaggatttcatggctgcagcaaaagtttttctggcatcaggtaaaaaggtcaaagttcccacatatcttgtgcctgcaacacagaaggtttggatggacgtatacagcctcccggtccctggatctggtggcaagacttgctcacagatatttgaagaagcagggtgtgacacaccagctagtcctagttgcgctgcttgtttgggtggcccaaaagatacttacgcacgcatgaatgaacctcaggtatgcgtttcaactacaaacaggaacttcccagggcgaatggggcacaaggaaggtcaagtatatttggcttcgccatatacagctgctgcatctgcattgactggttatgttactgatcctagagagttcttgcagtaggatattgttgccactgtttcattgtgttgtatacgtatttttgttttgtattctctagccataagttaaaactggcagctattagaggtgactaatctattaggattttctgtccaaagaaattgtgtgaaaattattgaattggcacgctgttgtgagttccatgcatttttagtgactaaaaataagtttggttcattttttacttgttgagtatgacttggtcgtcgttgctgttacggttgcaagtatagtttcatatgga

SEQ ID NO: 5167 - DNA, 2359 bp, Amaranthus tuberculatus
agacaaaatagagttggagttgtcttcttcgaacatcaaacaaacagtacacgaacaatccttaaacttcccaaatttgacgacttaattccttcctaaatcctaacaatggcgatttcttcttctatctctccaccatcatcatctttccttcccaagaacgatgtgggtctttctgcttttccctcttctaccttcaattgcactcaatttgcaattgcagcttcaaaatacaagcaaatgtctttgaagaacattgtttctgttatggctcctcaccaaactcagcgcaaaccttctactactggctcggtgaaaaatgcaatgacaatgactgagaagatattggctagggcttctgagaaaacccaattaaatccaggtgataatgtttgggttaatgttgatgttttgatgactcatgatgtttgtggacctggttcttttggtatcttcaagaaggaatttggccagaatgctaaggtgtgggatcgtgaaaagattgtcattattcctgatcattatatttttactagtgatgaacgcgcaaatcgcaatgttgatattttgagggactttgtgaaggagcaaaatatcaaatacttctatgacataacggatctttctgactttaaggtcaatcctgactacaaaggagtttgccatgttgctctagctcaagagggtcattgtagacctggagaggtcttgttggggactgactctcatacttgtaatgctggagcatttggccaatttgccactggaataggcaatactgatgctggatttgtattaggcacaggaaaaatattgctgaaggttcctcctacattaagatttgtactggatggggaaatgcctgattatttgcttgcaaaggatttaattctgcaaataattggggaaatatcagtgtctggtgcaacatataaatcaatggaatttgttggatccactgtggagggtttgacaatggaagaaaggatgaccctttgcaacatggttgttgaagcaggaggaaagaatggggttgttcctgctgatactaccacatttaaataccttgaggataagacatctattccttatgaacctgtttatagtgatgatcaagcaaggtttttgtctgaatatcggtttgatgtttcaaagttggaacctcttgtcgcaaagcctcactccccggataatcgtgcattagcaagacagtgcaaagatgtcaaaattgatagagtctatattggatcttgtaccggtgggaaaatagaagacttcatggctgtagccaaagtgttcttagcggctggaaaaaaggtcaaagtcccgacttttctggtccctgccacccagaaggtttggttggatgtatacactcttcctgttcccggatctggaggtaagacctgtgcccagatatttgaagaagctggatgtgacacaccaggaagtccaggttgtggagcttgtcttggtggccctagagacacatatgcacggatgaatgagccaatggtgtgcgtttcaacaacaaataggaacttccctgggcgaatgggccacaaagaagggcaaatatatctggcatctccgtacacagcagcagcatcagccttgaccggttttgttactgatccaagagagttcttacaataagttggtgcgctttatgggtcagtaatcatctcattttccacatattttcacttgtagaaaaatcccttctgttgttttgaacaaacaaaaaacatttgacgcgaacagtgctctgttacagggttctgtcatgtttgaaaataagtgaaagcttctcttgttttcagctttcacgttttaataaatttacgtagaatatttatggatggatccttataattttctttgttttcaagattattatatggggagtggtacgtaaggtttgttcttaaactagattcgtgtaacaatcaactggatgtagagttaatgggagattatagtacaagtctcgttatcaatgtacaagttggttcattctttgagagaaggcatactaagatacactaacaaaactagattttcccctcattgagaagctaatagtactcacaaataagtagacatagaatctaaggaaggggcgcgggcaagatacttgcctttagcacgactgttatcgccctcatttctaccacaaacaatggagcactcatacccacatatattactaaagcaggagaattttcctccaccgtcggcagcagtgtgtcgtcgagtatggttagtcctcggaaaaatgctacttgtactactacttccgccatatgaacgaactataatcataagttgtgggtatatctgttctccacctctcgag

SEQ ID NO: 5168 - DNA, 1665 bp, Allium cepa
ggcatcgaactctgcccttttgggcaagaagattgaattgggatatctggtaacaacaaataaatacccagtgaaaatttcgaccaagatttcatcggttatgacgcctactcagttgaagcgaactccttcagctactggtgcagtgaaacatgccatgacaatgaccgagaaaattttagcaagagcatcagagagatcaagtttagagcctggagacaatatctgggtaaatattgatacactgatgactcatgatgtttgcgggcctgggactattggaattttcaagagagagtttggacaaaacgccaaggtttgggaccgtgaaaagattattataataccagatcactacatttttaccagtgatgagcgcgccaataggaatgtagacatcttgagggatttctgtcatgaacagaatataaaatatttttacgacatcaaagaccttggaaatttcaaggctaatccagattacaaaggagtatgccatgttgctctagcccaagaagggcactgcagaccaggggaggttttgctgggaacagattctcacacatgcaatgcaggagcatttggacaatttgctacgggtattggtaacactgatgcaggttttgtcatgggtactggaaaacttctgctgaaggtaccccctacattgagatttgtattagatggagatatgcctgattatctgctttccaaggatttgattttgcagattattggtgaaataagtgttgctggtgcaacatataaagctatggaatttgtgggttcaactattgagagtttaactatggaagaccgaatgactctttgcaatatggttgttgaggctggaggtaaaaatggagttatccctgcggatgcaactacatttaactaccttgagggcaagacgtccgtgggttatgaaccagtttatagtgatgaatatgcgaggttttttcaggattacaagtttgatgtctcaaaattggagccagtggttgcaaagccacactctcctgataaccgtgctttagcaagagaatgcaaggatgtgaaaatcgatcgagtttatataggttcatgtactggcgggaagactgaagattttcttgctgctgccaagctttttctagctgcagggaagaaggtcaaagttcctacgttcctcgtccctgctacgcagaaggtatggatggacatatatgcccttccagttccagggtctgggggaaaaacttgctctcaaatatttgaagaagcgggttgtgacactcctgctagcccaagttgtggagcttgtttgggaggcccacttgacacttatgctcgaatgaatgaacctctggtctgtgtatcaaccacaaatagaaattttcctggaaggatggggcacaaagaaggtcaaatatatcttgcttcaccgtacactgcagctgcatcggcattgactggctatgttaccgatccaagagagttcctgtaatgaaatattagtttctaccatactagtaatttttgcatatttcagttgaccactctttgtatcattatactctttgtaatttttgtcattacaatctgatttgctttaaatccaaatgaactatttgctgtaaaatattgttatgttgtttaattctaataaagctgacaattctaaac

SEQ ID NO: 5169 - DNA, 1979 bp, Amorphophallus konjac
ctctctctctctctctctttcgcggctgcaatggcttcgactgccatggcttcgagcgctgtgaccttcaccggaaagagggagattggcctgtattcttccttctctccgtcaatttccacgccgaacagatgcaagaagcaggcgacgaagaaggtcgtcgcggtcatggcgccgaccacgcagtcgcggcctccctccaccaccggctcggtgaagcacgcgttgacgatgacggaaaagatcctggccaaggcttcggagcggacgcacttggaacccggggagaacatctgggtgaacgtcgacgtactgatgacacacgacatatgtgggcctgggactattgggatattcaagaaggagtttggggagaatgccaaggtttgggatcgtgaaaagattgttataatacctgatcattatatcttcacaagtgatgaaagggcaaaccgtaatgtggacatattgagggacttctgcatggagcaaaatatcaaatatttttatgatattaaggatctcagtaatttcagggttaatccagattataaaggtgtttgtcacattgctcttgctcaagaaggtcattgcagacctggcgaggttttgctaggtacagattcccacacttgtaatgccggagcttttggacaatttgctactggaattggcaatacagatgctggttttgtgatgggaactggaaaagttctgcttaaggtgcccccaactctgaggtttatcttggatggacaaatgcccagttttttgcttgccaaggatttgattttgcaaatcattggtgagataactgtatctggtgcgacatatcgctccatggaatttgttggctctactgttgaaagtttaagtatggaagagaggatgacattatgcaacatggtcgtggaagctgggggtaagaatggtgttgtgccagctgatagtaccacttttaagtatcttgagggcaagacatcaggggactttgaaccagtttatagtgatgaaaatgccaggttcattcgtgattataaaattgacgtctccaagttggaacctttggtggcaaagccgcattcacctgacaatcgtgcattagcaagagagtgcaaagatgtaaacattgacagagtgtatataggttcctgtactggtgggaagactgaggattttatggctgcggccaaggtttttctggcttcgggagggaaggttaaagttccaacttttcttgttcctgctacccagaaggtttggatggacttgtatacccttccagttcctggatctgatggcaagacgtgctctcaaatattcgaggaagctggctgtgatgtgccagcaagccccagttgtggtgcttgtttgggcggacctcaggatacctatggaagaatgaatgagcctaaggtctgcgtgtccacaacaaatcggaatttccatggtagaatgggacacaaggaaggtcaaatctatttggcctctccatacactgctgcagcatctgctttgactggtttcgtcacagacccccgagatttcttgcaataggcgacccgatgtctgggtgatgttttctatttctcacctctagttcatgatgtggtcatcttcatttatcgttggctatcgggtgtggatgaatactgtgtttattacatcgcgacactgcaggacaactttcgataggcgccaattttgtgggaggtcatcattgactacggagtccactggtcgaaatggtagacttggagagtattgtttgtgagatggtgtggtggctttgtttgtatcattgtcctcagaaatttttggatgataaaaataattagaagattaaattggcaagtagtgttttgagtttatcttcatacaactcccgggaaattatattattatgtgcccatttaagggagctattggtatataaaacgtgttatctctcactgtaacgtgaaaggttacaaccgttg

SEQ ID NO: 5170 - DNA, 1743 bp, Fagus grandifolia
tgtagttttaatcaaagtcccctcagccaccgccgcctcctcctattttcgcaggaaacaaacactacttattactttcctcagaaaaatagagaggacctcacaacaatactcatggcttcctctaccatcgcttcaaatcccacatctttcatccccaccaagaaagatttggggttcactgctatttcgacaccgtcactattttctattccgaaatgcaagagaacgatttccacgaaaatttgttcggtcatggcgccgcaacaatcggaacgcaagcctgccaccactggctcagtcaagaccgcaatgacgatgaccgagaagatattcgctaggtcttctaagaaaacccagttgagccccggtgagaatgtttgggttaacgttgatactttgatgacccatgatgtttctggccccggttcgatcggaatcttcaagaaagagttcggcgagaacgccaaggtttgggacaaggaaaagattgtaataatacctgaccattacatcttcacaagagatgaacgtgcaaaccgtaatgtggatatattgagggatttctgcatggagcaaaacatcaagtacttttatgatattaaagaccttagtaattttaaggctaacccagattacaaaggtgtttgccatattgctcttgcacaaggtcattgcaggcctggagaggtcctgctgggtacggactctcacacttgtacagctggagcatttggccaatttgccactggaattggcaacacagatgcaggttttgtgttgggcaccgggaagctcctgctcaaggtgcctccgactttgagatttacaatggatggtgaaatgccaagctatttgcttgcaaaagatttgattttacaaataatcggtgaaatatctgtatctggtgcgacatataaagctatggagtttgatggcacaactgttgaaagtctaactatggaagaaaggatgacgttatgcaacatggttgttgaagctgggggaaagaatggtcttgtccctgctgatagcactacatataagtaccttgaggataagacttctgtggcctatgaaccagtttatagtgatgaacaagcaagatttctttctgagtacagatttgatgtctcaaaactggagccactggtagcaaagccgcattctccggataatcgggctttagcaagagagtgcaaagatgtgaaaattgacagagtatatattggatcttgtactggaggaaagactgaggattttatggctgcggccaaaattttcctagcttcaggcaaaaaggtcaaagtccccacattccttgttcctgcaactcaaaaggtttggatggacgtatatagtctcccagtaccaggatctggtggcaagacttgctcccagattttcgaagaagctggctgtgatacacctgcaagtcctagttgtggtgcttgtttgggtggccctaaagacacttatgcacgcatgaatgaacctatggtctgtgtgtcgacaacaaacaggaacttcccaggccgaatgggacacaaagagggccagatatatcttgcttccccatatactgcagcagcatctgctttgactggttatgttaccgatccaagggagttcttgcagtaggctataaatatcatataagtctgctcttgttgtatgtcatggttgctttgtaccgtatcaatgtaggtcaaatgactgctgaaatacctaatgggtttttct

SEQ ID NO: 5171 - DNA, 1951 bp, Vitis vinifera
ccgcaacttcagagtccgaatcaaacactcctctagttccagctttcccaggggctgcgaaagacccagttccaaaccccagacgttgccggaattaggagcagggttccttctctttcatggcttcctctgctattgcctccaactctcctgctttcatcaagaaagatgtggatctctctgcattttcatcatcggcatcatcattttccattcagaaaaccaataaaagaaattcccggaaaattgtttcagtcatggcaccccaacaatcgccacgttctccttccacctctggttcagtaaagactgcaatgaccatgaccgagaagatcttggccagggcttctgaaaaaccccagctgagcccaggtgagaatgtatgggtaaatgttgatctcttgatgacccatgatgtctgtggcccaggttcttttggaatcttcaagaaagagtttggtgagaatgcaaaggtttgggaccgtgaaaagattgttattatacctgaacactacatcttcacaaaggatgaacgggcaaatcgtaatgttgatatcctgagggaattttgcacagagcaaaatatcaagtacttctatgacataaaagatcttggtaatttcagggccaatccggattacaaaggtgtatgccatgttgcccttgcccaagaaggtcattgcaggcctggagaggtcctcttaggtactgactcccacacatgtactgctggggcatttggccagttcgctactggaataggtaacactgatgctgctttcgtattaggcactggaaagatcctgctgaaggtgcctccaactttgagatttgtaatggatggagaaatgcccaattatttgctcgcaaaagatttgattttgcaaattattggtgaaatatctgtttctggcgcgacatataaatctatggaatttgttggcactactgttgaaagtttaactatggaagaaagaatgacattatgcaacatggttattgaagctgggggaaagaatggtgttgtccctgctgatagtactacacataagtaccttgaggataagacaagtttgccatatgaaccagtttatagtgatgagcaagcaagatttctttctgagtacagatttgatatctcaaaactggaacctctggtggcaaagcctcattcacctgataaatgtgctttggcaagagaatgcaaagacgtgaaaattgacagggtgtatattggatcttgtactggtggaaaaactgaggattttctagctgcagccaaagtttttcatgcttcaggaaagaaggtcaaagttcccacatttcttgtccctgcaacccaaaaggtttggatggacgtatatagtctcccggtaccaggatgtggtggcaagacttgctctcagatatttgaggaagctggttgtgatacacctgcaagtcctacctgtggtgcttgtatgggtggtcctagagacacatatgcacgcatgaatgaacctcaggtatgtgtgtctacaacaaataggaacttccctgggcgaatggggcacaaagaaagccagatatatctagcttctccttacacagcagcagcatctgctttgaggggttatgtcactgatccaagagagttcttaatttgaacctgattctagtagtcttaaaccgccattccacaactctcatgtggattgatttatgtttttgcatgttgccattctcatggcttcgtgtactgaaattcctttcaacttgatttcaagtccctgctagctctaaagagatggtttttggttagaattatgaggtggactttcactcttatgtctcatgcttggtattcccgctgagataccatgtatggttgactggataatgtagaattggataccctaagtatcattttcaataggatatgttctgttatcctcatactatatattaatag

SEQ ID NO: 5172 - DNA, 1898 bp, Lippia dulcis
ttaatctcaaattgattgcccccaagagtctgtgggttattgtcaatttggatttgccaatcgtgctgacgccgccgccgcaggaaacgtacaacaattaaaacaagagtggggaaaccacaagccttcctcgcctcacaccgcctctttcagctcagacaacatccgatggcttcgtctgctatcgcctacagctcctccttcctcgtcgacaagaaagatgtgggttttgcggctttttgtaagcagccctcatttccatgttctgcacaggttaataagaaaagggtctctaggaaaatagtgtctgtaatggcaccccagcaatccgagcgcagcccttcaaccacaggaggggtgaagactgcgatgacgttgactgagaagatactggcgagagctgcagagaaaacccagttggtccctggtgagaatgcctgggtcaatgtggatattttgatgacccatgatgtttgtggccctggctccattgggattttcaagaaagaatttggcgaaaatgcaaaggtgtgggactgtgaaaaagtagttataattccagatcattatattttcactaccgatgaacgagcaaatcgcaatgtggacatcttgagggatttctgcaccgagcaaaatatcaagtacttctatgacattaaagatcttgggaacttcaaggccaatccagattacaaaggtgtgtgccatgtagctcttgcccaagaaggtcattgccgacctggagaggtcttgttgggtacagattcccatacgtgtactgctggagcatttggtcaatttgctactggaattggaaacactgatgcaggtttcgtactgggtactgggaagcttttgcttaaggtgcctccaactttaagatttgtgatggatggtgaaatgcctgattatttgcttgcgaaagatttgattttgcagattatcggtgaaatctcagtggctggtgcaacatataaagcaatggaatttgtcggatccactgttgaaagcttgacaatggaagaaagaatgaccttatgcaacatgattgttgaagctggaggaaagaatggtgtcgtccctgctgattctaccacttataagtatctcgagggcaagacatctttgccatacgaaccagtttatagtgacggacaagcaagatttcttaaagagtacagatttgatatttcaaaattggagcctttggtggctaagcctcattctcccgataatcgtgctttagcaagagaatgcaaagatgtgaaaattgacagagtatatattggatcttgtactggcgggaaaacagaggatttcatggctgctgctaaagtatttcttgcttcgggtaaaaaggtaaaagtcccaactttcctggttccagcgacacagaaggtctggatggatgtttatgcccttccggttcctggatcgggtgggaaaacttgctcacagatattcgaggaagccggttgtgatacacctgcaagcccaagttgtggtgcttgtttgggaggaccaagagacacttatgcgcgcatgaatgaagctcaggtttgtgtttcaacgacaaataggaatttcccgggtcgtatgggccacaaagaagggcagatttacctggcttccccatacactgctgctgcatctgcactgactggttttgttacggatcctcgagaatttttgcagtaagattttcaagagttgatggtacagtttttcgtgttccagtttctgagtacgtcttctggagttgaaccacctcgactttatacgtttacaagtctttgtatgtcgtgatttgttagaatctcattatcttttctgctaaaacttgtagcattcatgtaccctctaacttaagaagcaaaataaataatcttgcttat

SEQ ID NO: 5173 - DNA, 1972 bp, Daucus carota
gatatccacgagctgagtgttcaacaaaaccaagtcaagctttgccgccgcaattcctgcacacaccgctaaagatccatatcccatctgggtctaatcaaagcacataatcttcttccctaacaattaatcaatggcttcagctgctattgcttcaagctcctcatcttttatcaaccagagaaatgatgtgggtttgtcttctttctcgccaaacacttcattttacctttcaaatgccaagaaaaagatggtttccaagaatattgtgtctgttatggccccacagtctcaaagaactccttccaccactggctcagttaagactggaatgactatgacagagaagatactagctagggcttctgagaaaccccagttgagcccgggtgaaaatgtttgggttaacgttgatatcttgatgacccatgatgtttgtggccctggttctattgggattttcaaaaaagagtttgggcaaaatgctaaggtctgggaccgtgagaagcttgtcattatacctgatcactacatatttacaaaagatgagcgagcaaatcgaaatgttgatattctaagagatttttgcaatgagcaaaatatcaagtacttctatgatattaatgatcttggcaattttaaggccaacccagattataagggtgtatgccatgttgctcttgctcaggaaggtcactgcagacctggggaggtcctgttaggaacagattctcacacatgtacagctggtgcattcggtcagtttgcgacaggtataggtaacacggatgctggttttgtactgggcacaggaaagcttttgcttaaggtgcctccgactttgagatttgttatggatggtgaaatgccggactacttgcttgccaaggatttgattttacaaattattggtgaaatttcagtctctggtgcaacatacaagtcgatggagtttgttgggtctactgtagaaagcttaagtatggaggagaggatgactttgtgtaacatggttgttgaagctggtgggaaaaatggtgttatcccagctgatgctactacatataagtaccttgaggacaaaacatctctgccctatgaagcactttacagtgatgagaaagcaagatttctttcagagtacagatttgatatctcaaagctggagcccctggtcgcaaagcctcattcacctgataatcgtgcactagcaagagaatgcaaagatgtcaaaatcgacagagtgtatattggatcttgtactggtggaaaaactgaggattttctagctgcagccaaagtttttctagcttcaggtaaaaaggtgaaagttcccaccttcctggtccctgcaacccaaaaggtctggatggacgtgtatagccttccagtgccagggtctggtgggaagacttgttcgcagatatttgaagaagcgggctgtgatacacctgcaagtcctagctgtggtgcttgtttgggtggtccaaaagacacttatgcccgcatgaatgaagcacaggtctgtgtctccacaaccaataggaacttccctggtcgcatgggtcacaaggaaggccaaatttatcttgcctctccatatactgctgcagcatcagctttgactggctatgtaactgacccaagagagttcttgcagtaggtggctgagattgtacccgcaaaggtgactttggtacttgtgttaaacttgttcattggagctgagatagcaggttcaggatctgactcattaccttctaaagtcaagattttgagtatagtagtttactgttgtcgtttttgtatgctatgagttaatattacacagggcactgtaatgtcagctaaatatctaacctaaaacatggatatgataatacaatatacccatataaagcttctgtattcctttctgacgatgaagagcaaggagctggtgtttgcatttgcagttcactaagaataattt

SEQ ID NO: 5174 - DNA, 1940 bp, Daucus carota
gatatccacgagctgagtgttcaacaaaaccaagtcaagctttgccgccgcaattcctgcacacaccgctaaagatccatatcccatccgggtctaatcgaagcacatcatcttcttcactaacaattaatcaatggcttcagctgctattgcttcaagttcttcatcctttatcaaccagagaaatgatgtgggtttgtcttctttctcgccaaacacttcaatttacctttcaaatgccaagaaaaagacggtttccaagaatattgtgtctgttatggccccacagtctcaaagaactccttccaccactggctcagttaagactggaatgactatgacagagaagatactagctagggcttctgagaaaccccagttgagcccgggtgaaaatgtttgggttaacgttgatatcttgatgacccatgatgtttgtggccctggttctattgggattttcaaaaaagagtttgggcaaaatgctaaggtctgggaccgtgagaagcttgtcattatacctgatcactacatatttacaaaagatgagcgagcaaaccgaaatgtcgatattctaagagatttttgcaatgagcaaaatatcaagtacttctatgatattaacgatcttggcaatttcaaggccaacccagattataagggtgtatgccatgttgctcttgctcaggaaggtcactgcagacctggggaggtcctgttaggaacagattctcacacatgtacagctggtgcattcggtcagtttgcgacaggtataggtaacacggatgctggttttgtactgggcacaggaaagcttttgcttaaggtgcctccgactttgagatttgttatggatggtgaaatgccggactacttgcttgccaaggatttgattttacaaattattggtgaaatttcagtctctggtgcaacatacaagtcgatggagtttgttgggtctactgtagaaagcttaagtatggaggagaggatgactttgtgcaacatggttgttgaagctggtgggaaaaatggtgttatcccagctgatgctactacatataagtaccttgaggacaaaacatctctgccctatgaagcactttacagtgatgagaaagcaagatttctttcagagtacagatttgatatctcaaagctggagcccctggtcgcaaagcctcattcacctgataatcgtgcactagcaagagaatgcaaagatgtcaaaatcgacagagtgtatattggatcttgtactggtggaaaaactgaggattttctagctgcagccaaagtttttctagcttcaggtaaaaaggtgaaagttcccaccttcctggtccctgcaacccaaaaggtctggatggacgtgtatagccttccagtgccagggtctggtgggaagacttgttcgcagatatttgaagaagcgggctgtgatacacctgcaagtcctagctgtggtgcttgtttgggtggtccaaaagacacatatgcccgcatgaatgaagcacaggtctgtgtctccacaaccaataggaacttccctggtcgcatgggtcacaaggaaggccaaatttatcttgcctctccatatactgctgcagcatcagctttgactggctatgtaactgacccaagagagttcttgcagtaggtggctgagattgtacccgcaaaggtgactttggtacttgtgttaaacttgttcattggagctgagatagcaggttcaggatctgactcattaccttctaaagtcaagattttgagtatagtagtttactgttgtcgtttttgtatgctatgagttaatattacacagggcactgtaatgtcagctaaatatctaacctaaaacatggatatgataatacaatatacccatataaagcttttgtattcctttctgacgatgaaaagcaaggagccgg

SEQ ID NO: 5175 - DNA, 1863 bp, Daucus carota
gccgccgcaattcctgcacacaccgctaaagatccatatcccatctgggtctaatcaaagcacataatcttcttccctaacaattaatcaatggcttcagctgctattgcttcaagctcctcatcttttatcaaccagagaaatgatgtgggtttgtcttctttctcgccaaacacttcattttacctttcaaatgccaagaaaaagatggtttccaagaatattgtgtctgttatggccccacagtctgaaagaactccttccaccactggatcagttaagactggaatgactatgacagagaagatactagctagggcttctgagaaaccccagttgagcccgggtgaaaatgtttgggttaatgttgatatcttgatgacccacgatgtttgtggccctggttctattgggattttcaaaaaagagtttgggcaaaatgctaaggtctgggaccgtgagaagcttgtcattatacctgatcactacatatttacaaaagatgagcgagcaaaccgaaatgtcgatattctaagagacttttgcaacgagcaaaatatcaagtacttctatgatattaacgatcttggcaatttcaaggccaacccagattataagggtgtatgccatgttgctcttgctcaggaaggtcactgcagacctggggaggtcctgttaggtacagattctcacacatgtacagctggtgcattcggtcagtttgcgacaggtataggtaacacggatgctggttttgtactgggcacaggaaagcttttgcttaaggtaccgccaactttgagatttgttatggatggtgaaatgccggactacttgcttgccaaggatttgattttacaaattattggtgaaatttcagtctctggtgcaacatacaagtcgatggagtttgttgggtctactgtagaaagcttaagtatggaggagaggatgactttgtgcaacatggttgttgaagctggtgggaaaaatggtgttatcccagctgatgctactacatataagtaccttgaggacaaaacatctctgccctatgaagcactttacagtgatgagaaagcaagatttctttcagagtacagatttgatatctcaaagctggagcccctggtcgcaaagcctcattcacctgataatcgtgcactagcaagagaatgcaaagatgtcaaaatcgacagagtttacattggatcttgtactggtggaaaaactgaggattttctagctgcagccaaagtttttctagcttcaggtaaaaaggtgaaagttcccacatttttggtccctgctacccagaaggtctggatggacgtgtatagccttccagtgccagggtctggtgggaagacttgttcgcagatatttgaagaagcgggctgtgatacacctgcaagtcctagctgtggtgcttgtttgggtggtccaaaagacacttatgcccgcatgaatgaagcacaggtctgtgtctccacaaccaataggaacttccctggtcgcatgggtcacaaggaaggccaaatttatcttgcctctccttatactgccgcagcatcagctttgactggctatgtaactgacccaagagagttcttgcagtaggtggctgagattgtacccgcaaaggtgactttggtacttgtgttaaacttgttcattgcagctaagatagcaggttcaggatctgactcattaccttctaaagtcaagattttgagtatagtagtttactgttgtcgtttttgtatgctatgagttaatattacaccgggcattgtaatgtcagctaaatatctaacctaaaacatggatatgataatacaatatacccatataaagcttttg

SEQ ID NO: 5176 - DNA, 1623 bp, Flaveria ramosissima
tcttcgcacacccttcgaattcgatcagagtatcgcaaaagaaagtgtcgacgaagatcgtatcggtgatgacaccgcagcagtcggaacggaagccgtcggccactggctcagtaaagaccggaatgacaatgacagagaaaatattttctagggcgtccgagaaatcccagttgagcccaggtgagaatgtttgggtcaatgttgatgtcttgatgactcatgatgtttgtggcccgggttcaattggaatcttcaagaaagaattcgggaatgatgcaaaggtttgggaccgtgaaaaggttgtcatcatacctgaccactatattttcacaaccgatgaaagagcaaatagaaatgttgatatcctcagggatttctcgcacgagcaagggattaaatatttttatgatatcaaagatcttagcaacttcaaggctaatcctgattacaaaggtgtatgccatgttgctcttgcacaagaaggtcattgtagacctggagaggtattgcttggtacggattcccacacctgtactgctggagcatttggtcagtttgcaactggaattggaaacacggatgctggctttgtgttagggaccggaaaagctttgcttaaggtgcctccaaccttaagatttgtattggatggagaaatgcctgattatctgcttgcaaaggatttgatcttacaaataattggtgagatatctgtatctggtgcaacttataaagcaatggagtttgttggttcgactattgagagtcttactatggaagaaagaatgacactatgcaacatggttgtcgaagctggagggaagaatggcattattccagctgacgctactacatttaagtaccttgaggacaaaacatctgtgccttatgaaccggtctacagtgatgatcaagcaaggtatcttgctgagtatagaatcgatgtctccaaattggagcccctagtggcaaagcctcattctcctgataatcgtgctttagcaagggaatgcaaagatgtgaaaatagaccgtgtgtatatcggatcttgtactggtggcaaaaccgaagattttctagcagctgccaaagttttcttagcttcaggtgaaaaggtcaaagtacccacttttcttgttcctgctactcaaaaggtgtggatggacatttataccctcccggtcccagggtctggtggaaagacttgttcccagatatttgaagctgctggatgtgatacacctactagtcctagttgtggtgcctgtttgggtggtccaaaagatacttatgcacgcattaacgaacctcaggtttgtgtctcgactacaaataggaacttcccgggtcgtatgggccacaaagatggtcaaatctatctagcttctccttacactgctgcagcttccgctttgactggttttgtaagcgatccaagagactttttgcgctgatttcgttgctgtttttgttagttcggcgacacaaccttgttgtatgggacttgttgcgcgatcacatctaaaataccatcttttatgttgcacttatgactctaaaataacatccctggggtttgcatctaaacacattgtcttctttcatatgttgttttcagtc

SEQ ID NO: 5177 - DNA, 2059 bp, Trifolium pratense
aataataatcaaaccaaatcagaaaattacgtaattcgtactatttttcatttcatcagccgccagagccacaccttgttgtttgtactgtcattgctgttctgttctgttcctcaatcattcatcaatggcttcttctcttgttccttcaccatccacctccttcttccacaccaccaagaaagatctgaatctctcttctttctcttcatcttctcagagatgtcacaaacatgcttccaggaagatttattgttctgttgcggctcctcagcaaacacagcgcacaccttctaccactggatcagtgaaaacagctatgactatgacagagaagataatggctagagcttctgagaagcaacaggtcagacctggggataatatttggaccaatgttgatattttgatgactcatgatgtttgtggtcctggttcaattgggatttttaagaaggagtttggtgaggatgctaaggtttgggaccgtgaaaaggttgtgataatacctgaccactatatattcacaagtgatgaacgtgccaatcgcaatgtagacatactcagggatttctgcaacgagcaagatatcaagtacttttatgatatcaaggatcttagtaattttaaggcaaatccagattacaaaggtgtttgtcacatcgctcttgctcaggaaggtcattgcaggccaggagaggttctcttgggcaccgattctcacacttgtactgctggtgcatttggtcaatttgcaacagggattggtaatactgatgccggctttgtgttgggagcagggaagcttttgcttaaggtgcctccaactctgagatttgtaatggatggagaaatgcccgattatttacttgcaaaggatttgattttgcaaattattggtgaaataactgtggctggtgcaacttacaagtctatggagtttgttggctcaactgttgaaagtttaaatatggaagaacgaatgacattgtgcaacatggttgttgaagctggtggaaagaatggtgttattcctcctgacagcgttacatataaatacctcgagggcaagacatctgtgccatatgaatcagtttatagtgaccagcaagcaagatttctttccgagtatagatttgatgttacaaaattggagccacttgtggccaagcctcattcaccggataaccgtgctttggcaagagagtgcaaggatgtgaaaattaacagagtatacataggatcttgtacgggtggaaaaacagaagatttcatggctgccgcgaaagtttttctagcatcaggtggtaaaaaggtcaaagttcccacatttcttgtccctgcaacacagaaggtatggatggacgtatacagtctccctgtccctggatctggtggtaagacttgctcacagatatttgaagaagctggttgtgacacacctgctagtcctagttgtggtgcttgtttgggtggcccaaaagatacctatgctcgcatgaacgaacctcaggtttgtgtttcaactacaaatagaaactttccggggcgaatgggccacagggaaggtgaaatatatttggcttctccatatacagctgcagcatccgcattgaccggttatgttactgatccaagagagttcttgcagtaagatatattatcccggaaaaggatcctctcctattctgccatctattatgctcttaatttaatggctgactgattttaaagagaaattaaaaacaaaaaagctgtcatgtagtgagattaatggctgagatgacagcaagacaaacggcagcagaggttccgcagtagaggatccgaatccatattatcctattgtattttatagtattgtatacattggttagttttgtattctctagccaaacttagaactgtaagctattaaataaagtttaaccactattggtatttgttttcagtggagaaattgtgactgataatgaattgattcttagttttagtaactaaaacaatattggtttcttagtactttttgtgtattttatggtaattcatttcttcccta

SEQ ID NO: 5178 - DNA, 1877 bp, Fagopyrum esculentum
gatttacaagttgaggcttgagattcattaaccacgctcttctcttcctctcacgggatacctatcagcttctgaattttcacctgccatggcgtccgcggcttccgttgcttcttcttccacgagcttcctccccaagaacgatgtcggtctctcttccttcttctctttctcgacttcgtcagctcaaatttgcgcttccaagatgaccagaagagggcggtccactaaagttttatcccttatgaccagtcagcagaccgagcgcaagccttccgtcactggctcggtcaaaactgcaatgacaatgactgagaagatactggccaaggcttctgagaagtcacaccttgtacctggcgaaaatgtgtgggtgaatgtggatgtcttgatgacccacgatgtgtgtggccccggagctattggtattttcaagaaagagttcggacagaatgctaaggtttgggatcgtgaaaagattgtgatcattcctgaccactatatctttacaagtgatgaacgtgcaaaccggaatgttgacataataagagatttctccaaggaacaaaatctcgaaatatttctatgatatcacagaccgttcagatttcagggccaacccagattataaaggagtatgccatgtcgcccttgctcaggagggtcattgcaggcccggagaggtgctgttgggtacagattcccatacatgtaacgcaggagcttttggccagtttgctactggaataggcaatactgatgctggcttgttttggggactgggaagatgctgctaaaggtgcctcctactctgagatttgtaatggatggagaaatgcctgattatttgcttgcaaaggatttgatattgcagataattggagaaatatcagtttcaggtgcgacatataaatccatggaatttgttggatcaactgtcgaaagcttaacaatggaagagaggatgacactttgcaacatggttgttgaagctggtggaaagaatggtgttgtgcctgctgatagtactacatacaagtatcttgagggcaagacatcagtaccttttgaaccagtttacagtgataaccaagccagttttctcgctgaatatagatttgatgtctcaaagctggaaccagtggtagcaaagcctcattctcctgataatcgtggcttagcaagagaatgcaaagatgtgaaaattgacagagtttatattggatcttgtactggtgggaaaactgaagattttctcgcagcagcgaaagtttttgtagcttctgggaaaaaggtcaaagttccgacattcttagtgcctgcgacccagaaggtgtggctggacttgtataccctacctgttcctggatctggtggaaagacctgctctcaaatttttgaagaggctggctgtgatacaccagcaagtcctaattgtggtgcttgtttgggtggtcccaaagacacctatgctcgcatgaatgaagctcaggtttgtgtgtcaacaacaaacagaaacttcccaggacgaatgggcaacaaagagggtcagatataccttgcttctccattcacagcagcagcatctgctttgacagggtacgttaccgacccaagagacttcttgcagtaagctaatcgggttttcatatagagtcggtaattgtcttctttctgtctagaggtgattttgttgagagctgatatttggcaatagcctttgtgttgtaatttgtcgacgccttcttttgcgtaatttgcttacaagattgtgtacacctttcaataagctgattgatcagaaaaaacgaatgatcagctgtctatgtattgttaatctgttagccatcagattatttgtgatgcattatttagtt

SEQ ID NO: 5179 - DNA, 1714 bp, Trifolium pratense
tccacctccttcttccacaccaccaagaaagatctgaatctctctgctttctcttcatcttctcagagatctcacaaacatgcttccaggaagatttattgttctgttgcggcacctcagcaatcacagcgcacaccttctaccactggatcagtgaagacagctatgactatgactgagaagataatggctagagcttctgagaagcaacaggtcagaccaggggataatatttggacaaatgttgatattttgatgactcatgatgtttgtggtcctggttcaattgggattttcaagaaggagtttggtgaggatgctaaggtttgggatcgtgaaaaggttgttataatacctgaccactatatattcacaagtgatgaacgtgccaatcgcaatgtagacatactcagggatttctgcaatgagcaagatatcaagtacttttatgatattaaggatctcagtaattttaaggcaaatccagattacaaaggtgtttgtcacatcgctcttgctcaggaaggtcattgcaggccaggagaggttctcttgggcaccgattctcacacttgtactgctggtgcatttggtcaatttgcaacagggattggtaatactgatgccggttttgtgttgggagcaggaaagcttttgcttaaggtgcctccaactctgagatttgtaatggatggagaaatgcccgattatttgcttgcaaaggatttgattttgcaaattattggtgaaataactgtggctggtgcaacttacaagtctatggagtttgttggctcaactgttgaaagtttaaatatggaagaacgaatgacattgtgcaacatggttgttgaagctggaggaaagaatggtgttattcctcctgacagcgttacatataaatacctcgagggcaagacatctgtgccatatgaatcagtttatagtgaccagcaagcaagatttctttccgagtatagatttgatgttacaaaattggagccactggtggccaagcctcactcaccggataaccgtgctttggcaagagagtgcaaggatgtgaaaattaacagagtatacataggatcttgtacgggtggaaaaacagaagatttcatggctgccgcgaaagtttttctagcatcaggtaaaaaggtcaaagttcccacgtttcttgttcctgcaacacagaaggtatggatggacgtatacagcctccctgtccctggatctggtggtaagacttgctcacagatatttgaagaagctggttgtgacacacctgctagtcctagctgtggtgcttgcttgggtggcccaaaagatacctatgctcgcatgaacgaacctcaggtttgtgtttcaactacaaatagaaactttccggggcgaatgggccacagggaaggtgaaatatatttggcgtctccatatacagctgcagcatccgcattgaccggttatgttactgatccaagagagttcttgcagtaagatatattatcccggaaaaggatcctctcctattctgccatctattatgctcttaatctaatggctgactgattttaaagagaaaaattaaaaacaaaaatgctgtcatgtagtgagattaatggctgagatgacagcaagacaaacggcagcagaggttctgcagtagaggatccgaatccatattatcctattgtattttatagtattgtataca

SEQ ID NO: 5180 - DNA, 1691 bp, Flaveria ramosissima
ccccaaccccaaacgattatcatttcatcaatggcggcttcatctgcaatctcctcatcatcctcccctttcctcacccagaaagatgtgggtgtgtccccaatcttcgcacacccttcgaattcgatcagagtatcgcacaagaaagtgtcgacgaagatcgtatcggtgatgacaccgcagcagtcggaacggaagccgtcggccactggctcagtaaagaccggaatgacaatgacagagaaaatattttctagggcgtctgagaaatcccagttgagcccaggtgagaatgtttgggtcaatgttgatgtcttgatgactcatgatgtttgtggcccgggttcaattggaatcttcaagaaagaattcgggaatgatgcaaaggtttgggaccgtgaaaaggttgtcatcatacctgaccactatattttcacaaccgatgaaagagcaaatagaaatgttgatatcctccgggatttctcgcacgagcaagggattaaatatttttatgatatcaaagatctaagcaacttcaaggctaatcctgattacaaaggtgtatgtcatgttgctcttgcacaagaaggtcattgtagacctggagaggtattgcttggtacggattcccacacctgtactgctggagcatttggtcagtttgcaactggaattggaaacacggatgctggctttgtgttagggacaggaaaagctttacttaaggtgcctccaaccttaagatttgtattggatggagaaatgcctgattatctgcttgcaaaggatttgatcttacaaataattggtgagatatctgtatctggtgcaacttataaagcaatggagtttgttggttcgactattgagagtcttactatggaagaaagaatgacactatgcaacatggttgtcgaagctggagggaagaatggcattattccagctgacgctactacatttaagtaccttgaggacaaaacatctgtgccttatgaaccggtctacagtgatgatcaagcaaggtatcttgctgagtatagaatcgatgtctccaaattggagcccctagtagcaaagcctcattctcctgataatcgtgctttagcaagagaatgcaaagatgtcaaaatagacagagtatacatcggatcttgtactggtggcaaaaccgaagattttctagcagctgccaaagttttcttagcttcaggcgaaaaggtcaaagtacccacttttcttgttcctgctactcaaaaggtgtggatggacatttataccctcccggtcccagggtctggtggaaagacttgttcccagatatttgaagctgctggatgtgatacacctactagtcctagttgtggtgcctgtttgggtggtccaaaagatacttatgcacgcattaacgaacctcaggtgtgtgtctcgactacaaataggaacttcccgggtcgtatgggccacaaagatggtcaaatctatctagcttctccttacactgctgcagcttccgctttgactggttttgtaagcgatccaagagactttttgcgctgatttcattgcttttttttgttagtttggcgacacaaccttgttgtatgggacttgttgcgtgatcacttctaaaataccatcttttatgttgcacattatgactctaaaataaatatcactggggtttgcat

SEQ ID NO: 5181 - DNA, 1671 bp, Chrysanthemum coronarium
caacaccaaccaaactcatcaatggcggcttcatctgcaatctcatcccccttcatcatcccgaaagatggaggtgtgtcttcattatcagcacaatcttcgggttcgattaaagttatgcagaagaaagtatccaaaaagattgtttctgttatgacgcctcagcaatccgaaagaaaaccatccaccactggctcagtgaagaccgggatgacaatgacagagaagattttctctagggcttctgagaaatcgcagttggtcccaggtgaaaacgtttgggttaacattgacattttgatgacacatgatgtttgtggccccggttccattggaatcttcaagaaagaatttgggaatgatgccaagatctgggaccgtgaaaaggttgtcatcatacccgaccactatatcttcacaagcgatgaaagggcgaacagaaatgtcgacattataagggaattttcccatgagcaaggaattaaatacttctatgatattaaagaccttagcaacttcaaggctaatcctgattacaaaggtgtatgccatgtcgctcttgctcaagaaggtcactgcagacctggagaggtattgcttggtacggattcccacacttgtactgctggagcatttggccagtttgccacaggaattgggaacaccgatgctggttttgtgttagggaccggaaaacttttgcttaaggtgcctccgaccttaagatttgtgttggatggggaaatgccagattatctacttgcaaaggatctgatcttgcagataattggtgaaatatctgtatctggtgcaacatataaagcaatggagtttgttggttcgactgttgaaagcctaacgatggaagaaagaatgactttgtgcaacatggttgttgaagctggagggaagaacggtattgttcccgctgatgctactacctttaagtacctcgagggaaagacatctcttccgtatgaaccagtctacagtgacggtgaagcaaggtttctcgaggagtacagaatcgatgtctccaaattggagcccctagtcgcaaagcctcattctcctgataaccgtgctttagcaagggaatgtaaagatgtcaaaatagacagagtgtatatcggatcttgtaccggaggcaaaacagaggattttatggctgcggccagagttctcctagcttcaggcgaaaaggtcaaagtgcccacatttcttgttcccgctactcaaaaggtttggatggacatatattccctcccggtgcccggctctggtggcaagacttgttcccagatatttgaagctgctggctgcgatacacctactagtcctagttgtggggcttgtttaggtggcccaaaggatacttatgcacgcattaacgaacctcaggtctgtgtgtcgaccacaaataggaacttcccaggtcgtatgggccacaaagacggtcaaatctatctagcttctccttacactgctgcagcctcagctttgactggttttgtaaccgatccaagagactttttgcattaactttgttgcgctttctttccattcatcgactcaaccttgttgtatggtgttataaattgagaagtaccatctgttcatttttgttcttacgtcatgtatctcaaataaaatattcaagtgatgtttgcg

SEQ ID NO: 5182 - DNA, 1822 bp, Chrysanthemum coronarium
cagattccacagcagtagcttcaaacccatcaacaccaaccaaactcatcaatggcggcttcatctgcaatctcatcccccttcatcatcccgaaagatggaggtgtgtcttcattatcagcacaatcttcgggttcgattaaagttatgcagaagaaagtatccaagaagattgtttctgttatgacgcctcagcagtccgaaagaaaaccatccaccactggctcagtgaagaccgggatgacaatgacagagaagattttctctagggcttctgagaaatcgcagttggtcccaggtgaaaacgtttgggtcaacattgacattttgatgacacatgatgtttgtggccccggttccattggaatcttcaagaaagaatttggtaatgatgccaagatttgggaccgtgaaaaggttgtcatcatacccgaccactatatcttcacaagcgatgaaagggcaaacagaaatgtcgacattataagggatttctcccatgagcaaggaatcaaatacttctatgatattaaagaccttagcaacttcaaggctaatcctgattataaaggtgtatgccatgtcgctcttgctcaggaaggtcattgcagacctggagaggtattggttggtacggattcccacacttgtactgctggagcatttggccagtttgccacaggaattggcaacaccgatgctggttttgtgttagggactggaaaacttttgcttaaggtgcctccaaccttaagatttgtgttggatggggaaatgccagattatctacttgcaaaggatctgatcttgcagataattggtgaaatatctgtatctggtgcaacatataaagcaatggagtttgttggttcgactgttgaaagcctaacaatggaagaaagaatgactttgtgcaacatggttgttgaagctggagggaagaacggtattgttcccgctgatgctactacctttaagtacctcgagggcaagacatctcttccgtatgaaccagtctacagtgatggtgaagcaaggtttcttgaggagtacagaatcgatgtctccaaattggagcccctagtcgcaaagcctcattctcctgataaccgtgctttagcaagggaatgtaaagatgtcaaaatagacagagtgtatatcggatcttgtaccggaggcaaaacagaggattttatggctgctgccagggttctcctagcttcgggcgaaaaggtcaaagtgcccacatttcttgttcccgctactcaaaaggtttggatggacatatattccctcccggtgccaggctctggtggcaagacttgttcccagatatttgaagctgctggctgcgatacacctactagtcctagttgtggggcttgtttaggtggcccaaaggatacttatgcacgcattaacgaacctcaggtctgtgtgtcgaccacaaataggaacttcccaggtcgtatgggccacaaagacggtcaaatctatctagcttctccttacactgctgcagcctcagctttgactggttttgtaaccgatccaagagactttttgcattaactgcgttgctctttctttccattcatcgactcaaccttgttgtatggtgtgataaattgagaagtacaatctgttattttttgttcttacgccatgtatctcaaataaacatctataagggttacgtttgtgcatttgtctaatttcagaatttatgttatcgatgtccccagacttgctgcgaaaggtgatcttatactatatgttctgcagacaaacttattagaagattaagcttattctaggcttt

SEQ ID NO: 5183 - DNA, 2025 bp, Citrus clementina
cgagtttcctcctctctctctctctctctctctctctctcagagtagcgtgattttttttattgtttgtgatcaaactttctctcagccgccgccgccactttcttaggaaacaaactaaatttagacactcttaaatcttaatccctacagaacaaaccaaaccaaaaaaaaaacaggcctcttgtagcaaataaacatggcttcctctgtcatttccccagctccaacatcttctttcatcaacaacaagaaggatttgggtagcttttgtttttcgtcgacatcacaattttcagtcaacaaatgcaagaaattggcagtctccaagaaaattgtgtcggtcatggcacctcagcaatcagaacgccggcctgccaccactggctcggtaaaaaatgcgatgacgttgacggagaagatatttgccagggcttcagagaaaccccagttgagcccgggagacaatgtgtgggttaatgttgatatcttgatgacccacgatgtttgtggccccggctcctttggtatctttaaaaaagagtttggtgaaaatgctaaggtttgggaccgtgaaaagattgtcattatacctgatcattatatattcacaagtgatgaacgtgcaaatcgtaatgtggatatcctgagggatttctgcatggagcagaatatcaagtacttttatgatattaaagatcttggtaactttaaggctaacccggattataaaggcgtatgtcatattgcacttgcccaagaaggccattgcaggcctggagaggtcttgctaggtacagactcccacacatgtactgctggagcatttggccaatttgccactggcattggcaacactgatgcaggttttatattgggcacagggaaagtcttgctcaaggtgcccccaactctgagatttgtattggatggtgaaatgcctgattatttgcttgcgaaggatttgattttacaaataattggtgaaatatctgtggctggtgcaacatataaatctatggagtttgttggcacaactgttgaacgtttaagtatggaagaacgcatgacattatgcaacatggttgtcgaagctgggggaaagaacggtgtagtccctgctgatggtacaacatttaaatatcttgaggataagacatcgttgccctatgaaccagtttatagtgatgagaaagcaagtttcctgtccgaatacagatttgatatctcgaagctggagccactggtggcaaagcctcattctcctgacaatcgggctttagcaagagagtgcaaagatgtaaaaattgacagagtatacattggatcgtgcactggtggaaaaacagaagactttcttgctgcagcgaaagtcttcttagcttcaggcaaaaaggtcaaagttccaacatttcttgtccctgctacccaaaaggtatggatggacgtatacactcttccagtaccaggatctggtggcaagacttgctctcagatatttgaagaagctggttgcgacacacctgcgagtcctagttgcggtgcttgtttgggtggccctaaagacacttatgcacgcatgaatgaacctatggcaagctgtttatcattgcaggtctgtgtctccacgacaaataggaacttccctggacggatgggacacaaggaaggccaaatatatcttgcttctccatacacagctgcagcatctgctttgactggttatgtcactgatccaagggagttcttggagtagactgatcaaatactgaatcgatcacgtatgtacactatgtgatatcatattcttcttgccgagggacaagggctatgtggatgtgacttagatctgaagaactgttttcccttgcttcttcaagcatattttgtatgttatgacacattgtgactgttaattttgtactaataaaataggaataatgaggtatgtacaataattagtacaataaatagcataaaatttataagagaaaaaatttaaaaagtagattgcagtattttttat

SEQ ID NO: 5184 - DNA, 2287 bp, Cocos nucifera
cgggtatgcgttgccatccctgctcggagttgggagtccccgctctgaggcggcgggcgatctcgcctgagccatctcactctcctttggattgggctggcctgggttcgggtagctgccgcggtccgaccgtagacccggtggtcgacggttctatggaaaagatcacatcgaaacccgccgagctcgaaatctggtcggtttatagatctaataacaatcttgttttccctctgctctcgtggaccatacgatcccccgcttgcggcatcgacgagctccaatacggcaataccctactgcagagattgaaaagagttgtgcttttataccaagttataaagggaaaaatctgatctttaatcgatcactaatggcttcgccaatcatggctcccagctcttcaatctttggcagaaagatggatccagggctgatgtctcgttttaacccttcaatcagcgcccataggtgtaggaaacaagctatgaacagagttcttgcagttatggcgccgacgcaacctcagcgttctccagcaaccactggttcagtcaaacatgctatgtctatgacggagaagatcttggcaagggcatcagaacgggcacagttggcacccggtgagaatgtgtgggtgaatgtggatgtgctgatgacccatgatgtttgcgggccggggactatcgggatttttaagagagagtttggtcagaatgcaaaggtttgggaccgtgaaaaaattgttatcataccagatcactatatcttcactagtgatgaacgtgcaaaccgtaatgtggatatcttgagggacttctgtacagaacagaatattaaatattattatgatatcaaggatattggtaatttcagggctaatccagattacaagggtgtatgccacattgctcttgcccaagaaggtcattgcagacctagcgaggttttgcttggcacagattctcacacatgtaatgctggagcttttggtcaatttgctagcggaattggcaatactgatgcaggttttgtcatggggactgggaaaattctacttaaggtacccccaactatgaggttcatactggatggagaaatgcccaaatatttgcttgccaaggatttgattttgcaaattattggtgaaataaccgttgccggtgcaacatacaaatccatggaatttgttggctccactgttgaaagtttaaatatggaagagagaatgacactgtgcaacatggttgttgaggcagggggtaaaaatggggttgtccctgttgataaaaccacacttaaataccttgaggacaagacaaccttgacatttgagcccgtatatagtgatgattgtgccagatttattcaagaatacaaatttgatgtctccaagttggagcccttggttgcaaagccacattctcctgataatcgtgctttagcaagagaatgcaaggatgtcaaaattgacagggtatatattggctcttgcactggtggaaagacagaggactttctagctgctgcaaaggtttttctagcttcgggcaaaaaggttaaggtgcccacttttctcgtccctgctacacaaaaggtatggatggatatatacggccttccggtgccaggatctggtggcaagacttgctctcagatatttgaggaagctggttgtgaggttccggcaagtcctagttgtgcagcttgtttgggtggcccgcgagacacttatgcgcggatgaatgaacctcaggtctgtgtctctaccacaaataggaacttcccgggtagaatggggcacaaagagggccaggtctatcttgcttcaccatatacggctgcagcttcagctctgacaggctatgttacagatccaagagagttcctcctctagaagggacagcttgtggcctactgtgctattatcctaggctgttttatatttttgtgtttaccatctccaggcttggtgtcatttacggtgtactcttctgaatgtattaattatatcatgcagaaatatgtaggagccaacctacattgaggagagatgactttgagatacgattcatatttctataagggactcttattagaggtgggaactgtagggtccgtcaagagttttatttatactttattgacgattaaatgataattttgagtgcttagactcctttcagagtattaaaatatgtatcttttgcttttgtatctttgcttgtgttttcttggcaaaaagtctcatagcttgtaatttcgttggtgctatcatcaagcttgt

SEQ ID NO: 5185 - DNA, 2010 bp, Citrus sinensis
ctcctctctctctctctctctctctcagagtagcgtgattttttatattgtttgtgatcaaactttctctcagccgccgccgccactttcttaggaaacaaactaaatttagacactcttaaatcttaatccctacagaacaaaccaaaccaaaaaaaaacaggcctcttgtagcaaataaacatggcttcctctgtcatttccccagctccaacatcttctttcatcaacaacaagaaggatttgggtagcttttgtttttcgtcgacatcacaattttcagtcaacaaatgcaagaaattggcagtctccaagaaaattgtgtcggtcatggcacctcagcaatcagaacgccggcctgccaccactggctcggtaaaaaatgcgatgacgttgacggagaagatattttccagggcttcagagaaaccccagttgagcccgggagacaatgtgtgggttaatgttgatatcttgatgacccacgatgtttgtggccctggctcctttggtatctttaaaaaagagtttggcgaaaatgctaaggtttgggaccgtgaaaagattgtcattatacctgatcattatatattcacaagtgatgaacgtgcaaatcgtaatgtggatatcctgagggatttctgcatggagcagaatatcaagtacttttatgatattaaagatcttggtaactttaaggctaacccggattataaaggcgtatgtcatattgcacttgcccaagaaggccattgcaggcctggagaggtcttgttaggtacagactcccacacatgtactgctggagcatttggccaatttgccactggcattggcaacactgatgcaggttttgtattgggcacagggaaagtcttgctcaaggtgcccccaactctgagatttgtattggatggtgaaatgcctgattatttgcttgcgaaggatttgattttacaaataattggtgaaatctctgtggctggtgcaacatataaatctatggagtttgttggcacaactgttgaacgtttaagtatggaagagcgcatgacattatgcaacatggttgtcgaagctgggggaaagaacggtgtagtccctgctgatggtacaacatttaaatatcttgaggataagacatcgttgccctatgaaccagtttatagtgatgagaaagcaagtttcctgtccgaatacagatttgatatctcgaagctggagccactggtggcaaagcctcattctcctgacaatcgtgctttagcaagagagtgcaaagatgtaaaaattgacagagtatacattggatcttgcactggtggaaaaacagaagactttcttgctgcagcgaaagtcttcttagcttcaggcaaaaaggtcaaagttccaacatttcttgtccctgctacccaaaaggtatggatggacgtatacactcttccagtaccaggatctggtggcaagacttgctctcagatatttgaagaagctggttgcgacacacctgcgagtcctagttgcggtgcttgtttgggtggccctaaagacacttatgcacgcatgaatgaacctatggcaagctgtttatcattgcaggtctgtgtctccacgacaaataggaacttccctggacggatgggacacaaggaaggccaaatatatcttgcttctccatacacagctgcagcatctgctttgactggttatgtcactgatccaagggagttcttggagtagactgatcaaatactgaatcgatcacgtatgtacactatgtgatatcatattcttcttgccgagggacaagggctatgtggatgtgacttagatctgaagaactgttttcccttgcttcttcaagcatattttgtatgttatgacacattgtgactgttaattttgtactaataaaataggaataatgaggtatgtacaataattagtacaataaatagcataaaatttataagagaaaaaatttaaaaagtagattgcagtattttttat

SEQ ID NO: 5186 - DNA, 2034 bp, Populus trichocarpa
acaaaataaaccggactcatcagagccacaaatcgcatgcctgtattactagcagactcgtgtgtcgagcgtgctcttcttcttcttctctatagcagcctccattttttcttcctaaggacaagacaggacaggaaccaaacctgttgctaacttaaaacgctagcagagcagtggtttttatcatcaaacattgccagtcatggcttcctctactatttctccaaactccacgttcttcatcaccaaaaaggacccgggtttgtcggccttttcttcatcatcaccatcacccttttcgatccccaaatgcaagaaatcaatttcaaaaaaaatagtatcggtcatggctcctcagcaatcagagcgcaggcctgccacaactggctcggtcaagactgcgttgacaatgacagagaaaatctttgctagagcctctgagaagccccagttgatcccaggtgagaatgtttgggtcaacgttgatatcttgatgacccatgatgtttgtggccctggttctattgggatcttcaagaaagagtttggacaggatgctaaggtttgggatcgtgaaaaggttgttattataccagatcattatatattcactaaagacgaacgtgcaaatcgcaatgtggatatattgagagatttctgcaatgaacaaaatataaagtacttctatgatatcaaggatcttggtaacttcaaggctaaccccgactacaaaggtgtatgccatgttgcacttgcccaagaaggtcattgcaggcctggagaggtcctgttaggaacagactcacacacatgtactgctggagcatttggccaatttgcaactggaattggcaacactgatgctggttttgtattaggcactgggaagctcctgctcaaggtgcccccaactctgagatttgtaatggatggtgaaatgcctgattatttgcaagcgaaggacttgattttgcaaattattggtgaaatatctgttgctggtgccacatataaatcgatggagtttgttggctcaactgttgaaagtttaactatggaagagcggatgacattatgcaacatggttgttgaagctgggggaaagaatggtgttgtccctgctgatagcactacattcaagtaccttgaggataaaacgactctgccatatgaaccagtttatagtgatgcgcaagcaagatttctttcagagtacagattcgatatctcaaaattggagccattggttgcaaagcctcattctcctgacaatcgtgctttagcaagagaatgcagtgatgtcaaaattgacagagtatatatcggatcttgtactggtggaaaaacagaggattttatggctgtagccaaagtctttctagcttctggtaaaaaggtcaaagttcccacattccttgtccctgctacccaaaaggtttggatggacgtatacactctcccagtaccaggatctggtggcaagacttgcgcccagatttttgaagaagctgggtgtgacacgcctgcaagtcctagctgtggtgcctgtttgggaggccctaaagacactcatgctcgcatgaatgagcctatggtctgcgtctcgacaacaaataggaacttccctggccgtatgggacacaaggaaggccagatatatcttgcctctccttacacggctgcagcatctgctttgactggttttgttactgatccaagggagttcttgcagtaggcattggtgtgatgtttctttgcacccaaaactgtacccgtaatttagtagtaatgtgggaaaataaatagttggtgctattccgagtcctaaaatttctagcatgtctcaaccgtgatgctgcttgaatgtaacatgtttacttgaggtacaatatcgcactttaaccattttgaagtgttcatgtacaagggattgtggtacggatggaatatgttgcatataatggcactttaccctattttactatgagatcaggggtgtttgagttatgaagaagcagtagttgttttagtgta

SEQ ID NO: 5187 - DNA, 1811 bp, Solanum tuberosum
ttttttgtgaacaaatcttgctgggacctatcattcatagctcgaccatttgtaccttcatcagccgccatttatttgggatataacttcttcttcttcttctcgtcgaccccttaagatttagcagaacaaatctgtcagcaatggcggcgtcttcagctatagcttcaagttctacagctttcatcaataagaaaaatgtgggtctatctgctttctcttcacaatcttcattttccgttcaaactgctcggaaaaggatatccaagaaaattgtttctgtgatgacaccacagcagactgaaagaaaacctgctacaactggatcagtaaagactgggatgactatgactgagaagatattagctaaggcttctgataagcctgatgtgagccctggtgataatgtctgggtgaatgttgatgttctgatgactcatgatgtttgtggccctggctctattggaattttcaagaaagagtttggacagaatgctaaggtctgggatcgtgaaaagcttgtcattatacctgaccattacatattcacaactgacgaacgagcaaaccgtaacgtggatatcttgagggatttctgcaatgaacaaaatattaagtacttctatgacattaaagatctggggaacttccgcgctaatcctgattacaagggtgtctgccacgttgctcttgcacaagaaggtcactgcagacctggagaggttttgctgggtacagactcccacacatgtactgctggagcttttgggcaattcgccactggaattggcaatactgatgcaggttttgtgttgggtactggcaagattctgctcaaggtgcctccaactttgagatttgtaatggatggtgaaatgcccgattacttgcttgctaaggacttaattttgcaaattattggtgaaatttcagtggctggtgctacttataaagcaatggagtttgttggcacgacagttgaaagcttgactatggaagaaagaatgacattatgcaacatggttgttgaagctggtggaaagaatggtgtcatcccagctgataaaacgacatatgactatcttgagggaaggacttctgtgccctatgaacctgtttatagtgatgaaggagccagatatcttaaggagtacagattcgatgtttccaagttggagcccttagtggctaagcctcattctcctgataatcgtgctttggcaagagaatgcaaagatgtcaaaatcgacagagtatatattggatcttgtactggtggaaagacagaggacttcatggctgctgcaaaagtttttctagcttccggaaagaaggtaaaggttcccactttccttgttcctgctacccaaaaggtatggatggatgtatatagcctcccagttccaggatcaggtgggaaaacatgttcccagatttttgaggaggcaggttgcgatacacctgcaagtcctagttgtggtgcttgtttgggtggccctaaagacacttatgcacgcatgaatgaagctcaggtctgtgtatcaaccacgaataggaacttccctggtcgaatgggacacaaggaaggccaaatttatcttgcatccccgtacacagctgcagcatcagcattgaccggttatgtcactgatccccgagagtttttgcaatgaagttcctcgttttaggagtttggattatgttgtacactaacagatgagtgaatcttaagcttttagtgcttgtttattcctgaaaagggcaatgaatgctcttctgcaataaaatgagaactcctaatttctgtcttc

SEQ ID NO: 5188 - DNA, 1811 bp, Solanum phureja
ttttttgtgaacaaatcttgtgggaccttatcattcatagctcgaccatttttaccttcatcagccgccatttatttgggctataacttcttcttcttcttctcgtcgaccccttaagatttagcagaacaaatctgtcagcaatggcggcgtcttcagctatagcttcaagttctacagctttcatcaataagaaagatgtgggtctatctgctttctcttcacaatcttcattttcggttcaaactgctcggaaaaggatatccaagaaaattgtttctgtgatgacaccacagcagactgaaagaaaacctgccacaactggatcagtaaagactgggatgactatgactgagaagatattagctaaggcttcagataagcctgatgtgagccctggtgataatgtctgggtgaatgttgatgttctgatgactcatgatgtttgtggccctggctctattggaattttcaagaaagagtttggacagaatgctaaggtctgggatcgtgaaaagcttgtcattatacctgaccattacatattcacaactgacgaacgagcaaaccgtaacgtggatatcttgagggatttctgcaatgaacaaaatattaagtacttctatgacattaaagatttggggaacttccgcgctaatcctgattacaagggtgtctgccatgttgctcttgcacaagaaggtcactgcagacctggagaggttttgctgggtacagactcccacacatgtactgctggagcttttgggcaattcgccactggaattggcaatactgatgcaggttttgtgttgggtactggcaagattctgctcaaggtgcctccaactttgagatttgtaatggatggtgaaatgcctgattacttgcttgctaaggacttaattttgcaaattattggtgaaatttcagtggctggtgctacttacaaagcaatggagtttgttggcacgacagttgaaagcttgactatggaagaaagaatgacattatgcaacatggttgttgaagctggtggaaagaatggtgtcatcccagctgataaaacgacatatgactaccttgagggaaggacttctgtgccctatgaacctgtttatagtgatgaaggagccagatatcttaaggagtacagattcgatgtttccaagttggagcccttagtggctaagcctcattctcctgataatcgtgctttggcaagagaatgcaaagatgtcaaaatcgacagagtatatattggatcttgtactggtggaaagacagaggactttatggctgctgcaaaagtttttctagcttccggaaagaaggtaaaggttcccactttccttgttcctgctacccaaaaggtatggatggatgtatatagcctcccagttccaggatcaggtgggaaaacatgttcccagatttttgaggaggcaggttgcgatacacctgcaagtcctagttgtggtgcttgtttgggtggccctaaagacacttatgcacgcatgaatgaagctcaggtctgtgtatcaaccacgaataggaacttccctggtcgaatgggacacaaggaaggccaaatttatcttgcatccccgtatacagctgcagcatcagcattgaccggttatgtcactgatccccgagagtttttgcagtgaagttcctcgttttaggagtttggattatgttgtacactaacagatgagtgaatcttaagcttttaatgcttatttattcctgaaaagggcaatgaatgctcttctgcaataaaatgagaactcctaatttctgtcttc

SEQ ID NO: 5189 - DNA, 1934 bp, Solanum lycopersicum
gattcattttttttttgaacaaatcttgtgggaccttatcattcatagcacgaccattttttccttcatcagccgccatttatttgggctataacttcttcttctcttcgaccccttaagatttagcagaacaaatctgttagcaatggcggcgtcttcagctatagcttcaagttctacaactttcatcaataagaaagatgtgggtctatctgccttctcttcacaagcttcattttccgttcaaactgctcggaaaaggatatccaagagaattgtttctgtgatgacacctcagcagactgaaagaaaacctgccacaactggatcagtaaagactggtatgactatgactgagaagatattagctaaggcttctgataagcctgatgtgagccctggtgataatgtctgggtgaatgttgatgttctgatgactcatgatgtttgtggccctggctctattggaatttttaagaaagagtttggacagaatgctaaggtctgggatcgtgaaaagcttgtcattatacctgaccattacatattcacaactgacgaacgagcaaaccgtaacgtggatatcttgagggatttctgcaatgaacaaaatattaagtacttctatgacattaaagatttggggaacttccgtgctaatcctgattacaagggtgtctgccacgttgctcttgcacaagaaggtcactgcagacctggagaggttttgctgggtacagactcccacacatgtactgctggagctttcgggcaattcgccactggaattggcaatactgatgcaggttttgtgttgggtactggcaagattctgctcaaggtgcctccaactttgagatttgtaatggatggtgaaatgcctgattacttgcttgctaaggacttaattttgcaaattattggtgaaatttcagtggctggtgctacttacaaagcaatggagtttgttggcacgacagttgaaagcttgactatggaagaaagaatgacattatgcaacatggttgttgaagctggtggaaagaatggtgtcatcccagctgataaaacaacatatgactaccttgagggaaggacttctgtgccctatgaacctgtttatagtgatgaaggagccagatatcttaaggagtacagattcgatgtttccaagttggagcccttagtggctaagcctcattctcctgataatcgtgctttggcaagagagtgcaaagatgtcaaaatcgacagagtatatattggatcttgtactggtggaaagacagaggacttcatggctgctgcaaaagtttttctagcttccggaaagaaggtaaaggttcccactttccttgttcctgctacccaaaaggtatggatggatgtatatagcctcccagttccaggatcaggtggcaaaacatgttcccagatttttgaggaggcaggttgcgatacacctgcaagtcctagttgtggtgcttgcttgggtggccctaaagacacttatgcacgcatgaatgaagctcaggtctgtgtatcaaccacgaataggaacttccctggtcgaatgggacacaaggaaggccagatttatcttgcatctccgtatacagctgcagcatcagcattgaccggttatgtcactgatccccgagagtttttgcagtgaagttcctcgatgacctcgttttaggagtttggattatgttgtacactaacagatgagtgaatcttgagcttttgatgcttatatattcctgagaaggccgcgctcgatgtgtttctcttttttctctttactcccaagaaatgaatgctcttctgcattaaaatgagaactccttgattcctaatttctgtcttctttgttgtattcttggagtcttattgttaaaagcattgaaataagaatttgtttctggaaataa

SEQ ID NO: 5190 - DNA, 1881 bp, Cucumis sativus
gtagttcacaatttgcaaagctcaaccaactgacgccgccttctccatatccctcagcatcatttctccgccggtgaggagaaatcttctctccctttcttttttctagctcaacatttgtatccatggctgcttccaccgcagctgcgttgacctcaactgcgttcttaaccaacaagaaagatttggacgttgctgccttttcgtcgtcgttgccgttttcctatcggagatgtgagagaactgtgtcgaagaaaatatgttcggtcatgacgcctcaacaatcggaacgcaagcccagcgcctctggctctgtcaaaacagccatgactatgacagaaaagatatttgctaaagcttctcaaaaaactgagttgagcccaggtgaaaatgtttgggttgatgtcgacgttttgatgactcacgatgtttgcggccccggttctattggaatttttaaaaaggagttcggagagaacgctaaggtttgggaccgagaaaaggttgtgattatacctgaccattacatatttaccagtgatgaacgtgctaaccgcaatgtggacattctaagagacttctcaaaagaacaaaatatcaagtacttttatgatattaaggatcttagcgattttagggtgaacccggattacaaaggtgtttgccatgttgcattagctcaagaaggtcactgtaggcctggggaggtcctgcttggtacagactctcatacctgtacagctggtgcatttggtcaatttgccagtggaattggaaatactgatgcaggatttattttgggcaccggcaaatcacttcttaaggtccctccaactctgaggtttgtcatggatggagaaatgcccgattatttacttgcgaaggacttaattttgcaaattattggtgaaatatcagtgtctggtgcaacatacaaagccatggaatttatcggcacaactattgaaagtttaactatggaagaaagaatgacattgtgcaacatggttgttgaagctggaggaaagaatggagttattcctcctgacagtactacgttcaagtaccttgaggataagacaaccaaaccctttgaaccagtttacagtgatgcgaatgcaagatttctttcagaatacagatttgatgtgtcaaaactggagcctgtggtagctaagccccattctccagataaccgtgctttagcaagggaatgtaaagatgtgaaaattgatagagtatatgttggatcttgtactgggggaaagacagaggattttctggctttggctaaagtttttcatgctgcaggaaagaaggtcaaagttcctacatttattgtccctgccactcaaaaggtttggatggatttatatagtatcccagtacctggagctggtggcaaaacttgctctcagatatttgaggaagctgggtgtgatacaccagcaagtcctggttgtgctgcttgtttaggtggccctagggatacttatgcacggatgaatgaagcacaggtttgcgtttcaacaacgaacaggaacttccccggtagaatgggacacaaggagggacagatttaccttgcttctccatacacagctgcagcctcagctttgaccggatatgtcacggacccaagagagttcttgcagtagatctacccgaattggagattactatagtaatatgtatgccccctgtattaattaagttgaaataaggcttcgtcatgtcattgttttgtatcttcttagagtatgattaaaaggaaacggtcatatctcagtttctaagtttcatgagaatttggtctataattttaggatttcaaaggaacggagtgtttaaattaattattatcattaacaagttataggt

SEQ ID NO: 5191 - DNA, 1148 bp, Secale cereale
gactctgcaaaacgaaaggacgccgccggccctagttcctttcagtgcctgtctgcagtctccaccacacggacttgccaccatgacggcggctcctcttctatcgttgacggatgcggcgacggtgacggcggtgccggcccccggccgagcgcccaccagagcccgcattcaggccgcccctcgccaccccgccaccgtctcgctgagatgccaccgcgctcggcccctgaccccggccgccgccacgggcgactcgccgtcgtccgccgcgttccacggcgagtgcttcgtcgtcggggacaacatcgacaccgaccagatcatcccggccgagcacctgaccctggtgccgtccaagcccgacgagtaccgcaagctcggctccttcgccttcgtgggcctcccttccgcggcctacccgattccgttcgtggcccccggcgaggagtcgtcccgctacgccgtcatcatcggcggcgccaacttcgggtgcggctcctcccgcgagcacgcgcccgtcgcgctcggagccgccggcgcgcgcgccgttgtggccgagggctacgcccgcatcttcttccgcaattccgtggccaccggggaggtgtaccctctggagcttgcggacagcggtgccagcaaggagtgcaagaccggggacgtggtcacagtggacctcgataactcggtcttgattaaccacacatctggcaagcagtacaagctgaagcctattggtgatgcaggcccggtgatcgaggccggggggatcttcgcttatgctcggaagactggaatgatcgcgtccaaatccgcgtgaacaaaaagtaagctgtcagattagttgaggtcttgcggggtggcaagtaagactggtttatgaataagagtcgttgcacctctctttggaggtgtgatcgtccagcggttttgctactactttggcattggcatgtaacagtaattatgcgcaaaaactaggttcgagagtgctgctggtattgaatgttacacccatgtaatagttttcattgcacccgccatctcaagtgtactcaaggtctcgagcactagcttatgtttattgattacagtggtggtttgtattcagttactattcagtgaggaaaagaagataacacttg

SEQ ID NO: 5192 - DNA, 1907 bp, Zea mays
ttgaacgaccgatttccaaagctggatccgatgaaagaggtaaatcgagcagcgggcatagttggaggtggcccaaatgacttctttcctgctttacagttgagagcccaatcccatatggtagaggcccgcacgtttccccttgcgacgtcaacctcgttctacccaccagccaccagccggcacaaattctcccttcccacaagaacatcacacggcgatagcaaaaccttccgtcggaggatggcttccgccggcgctggagaagggaaggagacggctgccgggagcagcctccacagcaagactctcctcaagagccaaccactgtaccagtacatactggaatccaccgtcttcccacgcgagccggactgcctgcgggagctccgcgtcgccaccgccacccaccccatggcgggcatggctgcgtcgccggacgaggtgcagctgctgcagctcctgatcgagattcttggcgccaagaacgccatcgaggttggcgtcttcaccgggtactcgctgctcgccaccgccctcgccctccccgacgacggcaagattgtggccatcgacgttacccgcgagagctacgaccagatagggtcgccggtgatcgagaaggccggcgtggcgcacaagatcgacttccgcgtcgggctcgcgctgcccgtgctggaccagatggtggccgaggaggggaacaagggcaagttcgacttcgcgttcgtggacgcggacaaggtgaacttcctcaactaccacgagcggctgctgcagctgctcagggtcgggggcctcatcgcctacgacaacacgctgtggggcggctccgtggccgcgtcccccgacgagccgctctccgagcgggaccgcgcgctcgctgcggccaccagggagttcaacgcggccgtggccgccgatccccgcgttcacgtctgccaggtcgccatcgccgacgggctcacgctgtgccgccgcgtcgcctgatccgtatccggttatccgcctcgaaatacagcagagctgtgggctgtcgctgacactgctgtgagctctgtgcttgaaatggccatggtctgtaataacgaactgggcttgagcgaaaataaatccaccagcgcgctagcgtgtgtcagcgatcatcatgctcaatctattggccggttggctggggtaacggcagtccagctacgccagtgacgagccggcaccttcttcccggcggtgagggcctttggcggcttggcgcatggcggcatgggcgatgtgtatgcagtatgtgccgttccgtaccacaattaccgttgttcctgggccgtgaatgtacttgggcttcagaccgttccgtaccacaattaccgttgttcctgggccgtgaatgtacttgggcttcagagtgagcggagcgacggcgagcccaaccacttcttcgtgcggcctgatcgcggtaacagccgtcagcccgccgccggtgaggcggtgaccggtgaccggtgagcggtgaggtgatggcccgcattctgcatgacgccggctagtgtgtactttgtagcgcccgccagctaggacaagggtcccacacagaactggccacgtacagcgaacaccagtacaccacgagcacagataagagtaggcaaaaaaaaaaaaaacccagcattgtttactgacaccttctgtttcctctcaccttccactcctggatctccagctccaggcaaggcccgaactggggaattccgatcccaagagcccccaccaagcgctcccgccgatcccaaggactcctgcctccgatgcggcaactcatcccatccggcttctaaagccgcggcccctgtggtcaattccggtggccggcggcatggattccggcgccaacagcatcggcgagtcggtgggcg

SEQ ID NO: 5193 - DNA, 1049 bp, Panicum virgatum
ggaagtttaggcgaagcattcaagaattgagaactccccttgttgccagaagcaaacggcctgcagcctgctggcgacagcatcgccggtgagcaaaagcatggccgccaccggcgccggagaaggcaacaaggcggccgccgggtcggccagcctccacagcaagaccctcctcaagagcgagcccctgtaccagtacattctggaatccaccgtgttccctcgcgagcccgactgcctgcgggagctccgcctcgccaccgcctcccaccccatggctgccatggcggcgtcgccggacgaggtgcagctgttcgggctcctgctcgagatgctgggcgcccggaacgccatcgaggttggcgtgttcaccgggtactcgctgctcgccactgccctggcgctccccgacgacggcaagatcgtggccatcgacgtcacccgcgagagctacgaccggatcggatcgccggtgatcgagaaggccggcgtcgcgcacaagatcgacttccacgtcgggctcgcgctgccggtgctggatcagatggtcgccgatgaggggaacaagggcgcgttcgacttcgcgttcgtggacgcggacaaggtgaacttcctcaactaccacgagcggctgctgcagctggtccgggtcgggggcctcatcgcctacgacaacacgctgtggggcggctcggtggtcgcgacccccgacgagccgctcgcggccgccaccagggagttcaacgcggccatcgccgccgaccgccgcgtccgcgtctgccagctcgccatcgccgatgggctcacgctgtgccgccgcgtcgcctgatcaccagcgtccgctgccctgccctccccgacaccgagaagagctgtgcgccagtgcctgggatgacactggcctgtactggaaaatggctaattggcaatggtttggaataacgaactgatctcgtgtgaaaataaatcgcggatgctcttgcgtgcgtcgtcatgttcaatctgttcgtaggagtataatctctgttcagtctgttggccgctggtcg

SEQ ID NO: 5194 - DNA, 627 bp, Zea mays
gggtcgtgctcgtgcagctctaggctttttttgaggaagcggtaagcgcggagggaggacgggagagagagataggcgtgccttcgtcgtccgtgccggtgcgtggcgtggtggccgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgcagcggcgcaggcaccggcgcccgcgcccaccagcgacggcacatcaatcgacctggggatcgcgtacatccttatgctggtggccctggtgctcacctacctgatccacccgctggacgcgtcctccccctacaagctcttttaatctctgctccttttcgtttggtcatgcggttatgggtgctataggaattttaggtgcgcgagatgtttaggtgaggttgggaggtttagaatgatgatgattgcaatcatttgatcttggtatgtatccaaggctccaagccgttggtgttctgattggtttgtaattgtatcggattccattatctttgtgctcagtccctgatttgctcctgctga

SEQ ID NO: 5195 - DNA, 880 bp, Sorghum bicolor
ggctttttttgaggcgcgcggagagaggaggaggtccggacgggagagggaagaaagagagagaggcgcgtccgttcgtggtcggtgccggtgcgcgtggcttggtggtggccgtgccgtccgtccgtccgtccatcccgctctctcctcttccggcgccggcgacagcgggagggactccccggtgaggaatggctgggatgagggctccgctcggcgtggtggcggtggccgccctcgtcgtcgccatcttcatgcccgccgccgccgcggcgcaggcaccggcgcccgcgcccaccagtgacggcacatcaatcgacctggggatcgcgtacatccttatgctggtggccctggtgctcacctacctgatccacccgctggacgcgtcctctccctacaagctcttctaatccctgctccttttttcgtttggtcatgcggtttatgggtgcgatagaagttttagctgcacaagatgtttaggtgaggttgggaggtttagaatgatgattgcaatcatctgatcttggtatgtaccgaaggctcgaagccgttggtgttctgattggtctgtatcggattccatgatctttgtgctcagtctgtctctcagttgtgcttgctgatttgctggattttcggctggtgattgagagatggtaggagtatatgtgctcggctgtgattgccgttgcaagttgcagcagcaggcatgtgaagagggggtaggtgtgcctggcacagctgacacgatggtggtttcattgtggtcctattcccctgttcgtatattctttttccacatgcttgctggcaaactccgaaatgcaaggcacatgggaagttcgtccttcctgtcacgcatgcaaactttgat

SEQ ID NO: 5196 - DNA, 444 bp, Echinochloa colona
gtggtggccgtgccgtgccgttccgtcccctcgagactcttcctgtttccggcgccggcggggaggggaatggccgcggcgagggctcggctcggggcggtcgcggtggccgcgctcgtcgtcgccatcttcatgccggcggccgcggcgcaggcgccggcgcctgcgcccaccagcgacggcacatcaatcgacctggggatcgcgtacgtcttgatgctggtggccctggtgctcacctacctaatccacccgctggacgcgtcctctccatacaagctcttctaatccctgttcgttcattgatggtgttgtgggtctgctaggatttttagtgatgcaaagacgcttaggtgaggttgggaggtttagaatgatttgcatcatctatctgatgttggtatgtatggaagtttttggtggtttgaatgtctgattggttgt

SEQ ID NO: 5197 - DNA, 612 bp, Panicum virgatum
tctgcgtgcgtggtcggtgccggtgcgtggcgtggtggccgtgcggtcccctcttcctctcttcctctcggcgccggcggacgtgtcggggggaggaatggccgcgccgagggctccgctcggggcggtcgcggtggccgcgctcgtcgtcgccatcttcatgccggccgcggcggcgcaggggccggcgccggctcccaccagcgacggcacatcaatcgacctgggaatcgcgtacatcttgatgctggtggccctggtgctcacctacctgatccacccgctggacgcgtcctctccctacaagctcttctaatccctgttcgttttgtttgttcgtcgatgatgttatgggtctgataggatttttagccatgcaagacgtttaggtgaggtttggagatttagaatgaacgtcaacgtctgatctgatcttggcatgtatggtaagttttttggtggtctgaatgcctgattggttgtatcggattccatgatcttgtgcccagttgtgcttgctgttggccgttgctggattctatttccgctggtcccgcccgggtgctcattgacatgtgctctgccatggatgccgttgcaagttgcaacacc

SEQ ID NO: 5198 - DNA, 908 bp, Panicum virgatum
ccttggctttttctgaggagaagcagagcggagggagagacaagagaggcgcctgcgtggtcggtgcctgcgtggcgtggtggccgtgccgtgccgtcccctctccctctcttcctttcggcgccggcggacgtgtcgggggaggaatggccgcggcgagggctccgctcggggcggtcgcggtggccgcgctcgtcgtcgccatcttcatgccggccgcggcggcgcaagggccggcgccggctcccaccagcgacggcacatcaatcgacctgggaatcgcgtacgtcttgatgctggtggccctggtgctcacctacctgatccacccgctggacgcctcctctccctacaagctcttctaatccctgttcgtttcatttgttggacgatgatgttatggatctgataggatttttagccatgcaagacgtttaggtgaggtttggagatttagaatgaacgtcaacatctgatctgatgttggtatgtatggtaagtttttggtggtctgaatgcctgattggttgtatcggattccatgatcttgtgccctgttgtgcttgctgttggccgttgctggattctatttccggctttccgctggtcccgcccggggtcctcattgacatgtgctctgccatggatgccgttgcaagttgcaacaccaaacatgtgaaggactgggtcatggctgtgcctgtctctgctgacacgacgatggtttcattgtggtcctattcatctgttcattttattgctgttctccccgtgcatgctgagttgctgacaaacactgaaatacgaggcgtatggtaagttcgtccttactgtgccgcttgaaattttgacttgtcaatggatatgaaattacttagaatacagacactattatcgtgtgcagacat

SEQ ID NO: 5199 - DNA, 557 bp, Saccharum officinarum
gagaggtccggacgggagaggaagagagaggcccgtgcgttcgtggtcggtgccggtgcgcgtggcgtggtggccgtgcctgccgtccgtccatccccgtctctcctcttcaggcgccggcgacagcgggagggactcccggggaggaatggctggggtgagggctccgctcggcgcggtggcggtggccgctctcgtcgtcgccatcttcatgccggccgccgctgcggcgcaggcaccggcgcccgctcccaccagcgacggcacatcaatcgacctggggatcgcgtacatccttatgctggtggccctggtgctcacctacctgatccacccgctggacgcgtcctctccctacaagctcttctaatccctgctgctcctttgtttggtcacgctgttatgagtgcgataggaattttaggtacgcaagatgtgtttaggtgaggttgggaggtttagaatgatgattgcaatcatctgatcttggtatgtatcgaaggctcgaagccgttggtgttctgattggtttgtatcggattccatgatctttgtgc

SEQ ID NO: 5200 - DNA, 559 bp, Cenchrus ciliaris
gccggtgcgtggcgtggtggccgtgccgtgccgtccgtccgtctgtctagtcccctctccctcttcctttcctgcgccggcggcggacggaggaatggccgcggcggcgaggtcaaggctcggggcggtcgcggtggccgcgctcgtcgtcgccatcttcatgccggccgcggcggtggcgcaggcgcccgcgcccgcgcccaccagcgacggcacatcaatcgacctggggatcgcatatgtcttgatgctagtggccctggtgctcacctacctgatccaccctctggacgcgtcctccccctacaagctcttctaatcctggttcgttcgttaatgatgttaatgggtgtggtaggatttttagcgatgcaccatgcttaggtgatgttgggaggtttaggatggttgtcatcatctgataatctggtatgtatcgtatgcaagtttcttggtggtctgaatgtctgattggttgtatcggattccatgatcttgtgttcagttgtgctttctgttgctgcatttccgctggtcccgtacccccgtcctggccggc

SEQ ID NO: 5201 - DNA, 563 bp, Pennisetum glaucum
gagagaaacagagagaggcgtgtgcgcgtggtcggtgccggtgcgtggcgtggtggccgtgccgtgccgtccgtcccctctccctcttcctttcccgcgccggcggcggacggaggaatggccgcggcggcgaggtctcggctcggggcggtcgcggtggccgcgctcgtcgtcgccatcttcatgccggccgcggcggtggcgcaggcgcccgcgcccgcgcccaccagcgacggcacatcaatcgacctggggatcgcatatgtcttgatgctagtggccctggtgctcacctacctgatccaccctctggacgcgtcctccccctacaagctcttctaatcctggttcgttcgttaatgatgttaatgggtgtggtaggatttttagcgatgcaccatgcttaggtgatgttgggaggtttaggatggttgtcatcatctgataatctggtatgtatcgtatgcaagtttcttggtggtctgaatgtctgattggttgtatcggattccatgatcttgtgttcagttgtgctttctgttgctgcatttccgctggtcccg

SEQ ID NO: 5202 - DNA, 693 bp, Setaria italica
aggcgtgtgcgtggtcggtgccggtgcgtggcgtggtggccgtgccgttcgtccgttccctctcttcctctcccgcgccggcggcggacgtctcggggtggtggaatggccgcggcgaggtctccgctcggggcgatcgcggtggccgcgctcgtcgtcgccatcttcatgccggccgccgcggcggcggcgcaggcgccggcgcccgcgcccaccagcgacggcacatcaatcgacctggggatcgcatatgtcttgatgctggtggccctggtgctcacctacctgatccacccgctggacgcgtcctccccctacaagctcttctaatccctgttcgttcgttgatgatgctatgggtatggtagaattttttagcgatgcaagacgcttaggtgatgttgggaggtttagaatggttgtcatcatctgatgatctgatcttggtatgtatcgtaagttttttggtggtctgaatgtctgattggttgtatcggattccatgatcctgtgctcagctcagttgtgcttgctgtttctggattctgtttccgctggtcccgtcccgccggggtgctcatcggcatgtgctctgcatggatgccgttgcaagttgcaacaccaaacatgtgaaggactggctcattcatggctgtgcctgtcactgctgacacgacggtggtttcattgtgg

SEQ ID NO: 5203 - DNA, 950 bp, Zea mays
cattggaaagggaatctcaccaaggccctaaactggctccaccgtggttcccttgcacgacgccctgcggcgggtccgccgaacacagcgtcaaaatggacccacatgtcatcgaaggtacgtagcttgcaagcggcgttctcaataacattcagatgcgcagccacgtcgtagcaggcctaggcttttttgaggagcgcggactagggagtagggaggacgggacgggagagagagagagaggcgcgtgcgttcgtggtcggtgccggtgcgtgcgtggcgtggtggccgctgccgtacgtgatccgtccaccccctctcctcttccgacgccggcgacagcgggaggtactcccggggaggaatggccgtggcaagggctccgctcggcgcggttgctgcgatggcggtggccgctctcgtcttcgccatactcatgaccgccgccgctgcggcgcaggcaccggcgcccgcgcccaccagcgacggcacatcaatcgacctggggattgcgtacatccttatgctggttgccctagtgctcacctacctgatccacccgcttgacgcgtcctccccctacaagctcttctgatccctgcgcctttccgtttggtcatgcggttaagggcgcgataggattttgagttaggcaacgtgcttaggtgaggctgggaggtttaggatgatgattgcggtcatctggtcttgcttggtatgatgtattggaggctcgaagctgttggtgttctgattggttttgtatcggacggactccatgatctttgtgctcagtccctcagttctgctcggtgtatgcgctctgctctgcttgccgttgcaagttgcggcagcaggcacgtgaagagtggatgtgcctggcacagctgacaggcatgcttgtacttcctatcaagcatgcaacttttgatatccaatggacttctaaa

SEQ ID NO: 5204 - DNA, 358 bp, Echinochloa colona
gcgtggcgtggtggccgtgccgtgccgttccgttccctctcgactcttcctgtttccggcgccggcggggaggggaatggccgcgccgagggctcggcttggggcggtcgcggtggccgcgctcgtcgtcgccatcttcatgccggcggccgcggcgcaggtgcccgcgcccgcgcccaccagcgacggcacatcaatcgacctggggatcgcgtacgtcttgatgctggtggccctggtgctcacctacctaatccacccgctggacgcgtcctctccattgtttcatgagttttttaatggtattcatttttccaaaatatatgcagttcattttttgaaaaatcaatcgaccttg

SEQ ID NO: 5205 - DNA, 485 bp, Cenchrus ciliaris
gccgtccgtccgtcccctctcccacttcctttcccgcgccggcggcggacgtctctcgttgggggaggaggaggaggctagcaatggccgcagcggcgaggtctcggctcggggcggtcgcggaaaccacgctcgtcgtcgccatcttcatgccggccgcggcggtggcgcaggcgcaggctccggcccccgcgcccaccagcgacggcacatcgatcgacctggggatcgcatatgtcttgatgctagtggccctggtgctcacctacctgatccaccctctggatgcgtcctccccctacaagctcttctaatccctgttcgttaatgatgttaatgggtgtggtaggatttttagcgatgaaagacgcttaggtgaggttgggaggtttaggatggttgtcatcatctgataatctgatcttggtatgtatcgtacgtaagtttcttggtggtctgaatgtctgattggttgtatcggattc

SEQ ID NO: 5206 - DNA, 1698 bp, Oryza sativa
ccggcgaccaaaaccaccggaaaaagaaagtcagaaaaaaaaagtaaggctcaaatccaccgtcgccgcgcgccaccaccccgcgggcgcctccgtctccggatttcacccggtataaatctatgaccgagccgacgcgagctttcttgcgtgttgtagctggagtgttcgaaggaattactggctggcacgcacgcgcgcacgggcatggtggcggtggtgatgatggcgatgaggaagaggatgcgcggcgcgctgctggcgctcgcgctgctgctcaccgcgacggccgtcgtgccgctgctcctcctcggagaggccggggacgacggcgtcggggccgtcgccgccgcgccgccgttcaacgcgtcccgcgtcagggcggtgtcgtggaggcccagggtcttcgtctacaaggggttcctctccgacgacgagtgcgaccacctcgtcaagctggggaagaggaagatgcagaggtcgatggtggcggacaacaagtccggcaagagcgtcatgagcgaggtgcggaccagctccggcatgttcctcgacaagcgccaggatccagtggtgagcaggattgaaaaaagaattgcagcatggacctttcttcctgaagaaaatgctgagaacattcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgaggggtgggaaaatcagcccaaggatgacactttctctgaatgtgcacaaaaaggattggcagtgaaaccagttaaaggcgacgcggtgctcttctttagccttcatatcgatggcgtaccggacccgctcagcctccatgggagctgcccagtgatagaaggtgaaaaatggtctgcaccaaagtggatccgtatcaggtcctatgagcatcctcctgtctcaaaggtgacagaaggatgctccgacaacagtgcacgttgcgcgaaatgggctgaagctggagaatgcgagaagaacccggtatacatgacagtgaacagtagcatactatttcttcaaaaacaacggcttacatcctttgcacatggttttgaaatctcaagtttacttctagtggaggtgaagactgtgaagtttgccaggtcagcgaggcgggtatcagcgacaacattggccatcctatttggaggcctcattttggtgtcattgttggtggagacaagcgcgaaaccgccgtctccggggagtagtgttcttggtgttgggggtagaaggatgatgatcaatggaggactagttcacagtcacaggagcttggaagatttcaatgctggtgatgctttcagcagcatgaagaggagggtgccaaatggaccagatccaatccacaacaggctttcaattccttcctttatttactctggttttctaatggtcttcaccttgaattcttcagaggaactggagaatcaggaagatcaccaggccgagcgtagaaaagcacattgcaagtttgctatagaggaaaaggagtgtagctttgaacagccaaagttgcaccctgaatgtggcctaaaagcaaagcttgtgtgacagtgtgaggaagactgataagaaact

SEQ ID NO: 5207 - DNA, 1423 bp, Panicum virgatum
tgagccttgccggtggccgccgccggcagtagccactgatacgggcacactgtcttcgatcgagctctgttttgttttccccttctcctgcgaccattcgccgccatgaggctccgcctccgcctccgcggcgtgctgctggtcctggcgctcctcctggcggccaccgccgtggtgccggtgctcctcctgggcgacgccgacgacggggccgcggcgcgcgttgcgccggcgccgccgttcaactcgtcgcgcgtgaaggccgtctcgtggcagccgaggatcttcgtgtacaggggcttcctctccgacgccgagtgcaaccacctcgtggagctcgggaagaagaaggtccagcgctcgatggtggccgacaacgactccggcaagagcgtcatgagcgaggtgcgcaccagctccggcaccttcctcgacaagcgccaggacccggtggtaaccaggattgaagagaggattgcggcatggacgtttcttcctgaagagaacgccgagaacattcagatcctccgttacgagcagggtcagaagtacgagccgcacttcgattacttccacgacaaggtgaaccaggcccggggaggccaccgctacgccaccgtgctcatgtacctgtccaccgtcgacaagggaggcgagaccgtcttccccaacgccaagggttgggagtctcagcccaaggatgacactttctctgactgtgcacggaaaggactggcagtgaaaccggtgaaaggtgacgcggtgctcttcttcagcctccacgtcaatggagtgccggacccgctcagcctccatgggagctgcccggtcatcgaaggcgagaaatggtctgcgccaaagtggatccatgtcaggtcctacgagaattccccagtcctggcgacggagactgaaggatgcaccgacaagagtgagcattgcgcgcaatgggctgcagcgggcgaatgcgggaagaacccggtgtacatggtaggcaccgaggggttgcctggtcagtgccggaagagctgcaatgtctgtgattcataggctgttttacacttctttcgaaattcagtattgcaatcactttctggaactatacttgatgtgtacataactagagaaagttttcttcagataaaatgaggcagtattttagttttcagacagtgagcagtaatggtaatagaatcctcctttttcctatgttatttttaaaccatcaagcttactgggagtgcagatgaagcctttcaatgattactgcaagggaagatgaagtaacttctggcatttactgattcagaagaaatggaatcttccctaccactggcagtggcagcaatgcaactccatgttccactttaattttgttgcctttcataacagtggatttcaggacagccagccagtgtgtcag

SEQ ID NO: 5208 - DNA, 1349 bp, Sorghum bicolor
cggtggtggaggcgaaactgaagaaacacacgcagcttgacaggcaaggcaagcagcaaggcacagccaggcgggcgccagcagccagcaggcgaggggttggcgcccgcccccgcatccacccgtcgcgctccatcaccgccagcctggccttggccttggcctctgctgcgcgctccctctcgctcgctgtcgatgatgatgatcatatccgtgtacgtcaccgccccccctgctgcttgcttctccacggcgccggagagcccaacagaggcgggttcgtcgtcgccgactcagcttctgctcgccagcagctagctgtcgccgccgccgccgccgccaccgacgaggaggagatcggttggagtcggagaggaagatgagcttctttggccgcggcagcagaaaccagcaaagaaccttcaggccaaagaagagcgcgccgtccgggaacaaggggatgcagctgaaaaggcacatcgatgccaccctcggcagtggtaacctgcgagaggcggtccgtctgcccatcggggaggacctcaacgagtggctcgctgtcaacactgttgacttcttcaaccaagtgaacattctgtacggcaccctgatggagttttgcacgccagcgacatgcccgaccatgtcagccggaccaagttacgagtacaggtgggctgatggagccaagatcaagaggccaatcgaggtgtctgcaccgaagtacgtggagtacctcatggactggatagaaacccagctcgacgaagaaaccatattccctcaaaagctcggggctcctttccctcccaacttccgtgatgtcgtcaagacaatcttcaagcgcctcttcagggtgtacgcacacatataccactcccactttcagatgattgtgaagctcaaggaagaggcacatctcaacacttgcttcaagcacttcacactcttcacattggagttccggctgatcgatagggcagagctggctcccctcaacgagttgattgagcccataatacttggttattaaccagagagagactttgatttgccgagatttttttcccctctccttctaatttggtcatttcggatggaacatctccatctacattttggaagcataggctagtggtttcgctactctgccacggatgtatgtgttccttagcagtaggaggcagctgttgatcgcaactttttcagtgaaaatggagtgttgtttgatcagagtcagttgggtgcttccgttctatttttttttagcttcaccttttcttggtagttcgattttttttaaaaccataggacactcttaacaccggacgtagaacactcttactgtc

SEQ ID NO: 5209 - DNA, 1270 bp, Zea mays
agggtttgggggctcagaagaaccgaccgcgcgtcaattaacccagcagaaggtccgtcgtctcgtcgccgacgactcggcttctgctcatcaccaccagccactagctgtcgtcgccgacatcgacgcacgcggaggagatcgatcggcccggccgccggccgcaggagaagatgagcttctttggccgcggcagcagaaaccagagaaccttcaggccgaagaagagcgcgccgtccgggaacaaggggatgcagctgaaaaggcacatcgacgccaccctcggcagcggtaacctgcgagaggcggtgcgtctgcccatcggggaggacctcaacgagtggctcgctgtcaacaccgtcgacttcttcaaccaagtgaacattctctacggcaccctgatggagttctgcacgccagcgacatgcccgaccatgtcagccggaccaagctacgagtacagatgggctgacggagccaagatcaagaggccaatcgaggtgtctgcgcccaagtacgtggagtacctgatggactgggtggaggcccagctcgacgaagagaccatattcccccaaaagctcggggctccgttccctcccaacttccgcgacgtcgtcaagacgatcttcaagcgcctcttcagggtgtacgcgcacatataccactcgcacttccaggtgatcgtcaggctcaaggaagaggcgcatctcaacacctgcttcaagcacttcacgctcttcacactggaattccggctgatcgacagggcagagctggctcccctcaacgagttgatcgagcccataatacttggttattgactggagaggctttgtttaggccgactgtgccgagagaattttcccccctctccttttaattttgatcatttcgggtggaatatctccatctgcattttggaagcgtaggctagtggtttcgctactctgtcccggatgtatgtgttcccttccctagcagtagcagccagcggttggtctcaactttttcagtcaaatggagtgctgtttgatccgactcagctgggtgctttgtttctgttctgttctgttcttttttttttgtctaagatgggcgcctccgttctgtttattattttttagtttaaccttttcagctggagtttgaacttttctctacttctaaaaagcacgagtttggtgaccatctttctcctcttcctcactgttgaggacgtatatagtttttttattagttgttgccagagaaattgtgaaatattaag

SEQ ID NO: 5210 - DNA, 1631 bp, Panicum virgatum
acaggaggaaaccacccaggcaaaaggggcggcgggcgggcggtgagcggatcacagccgagccggggcttgctgcttgcatcatcagcacgcgcgggcgaagcggaaggaactcaactgaagcggcttgccaggcaaggcaagggggcggccagcaggcgagggctgtctctaaactctccggcggcggctcctcagtcctcacccggagggtcggaggagaagatgagcttcttcgcccgcggcagcaggaaccagaggaccttcaggcccaagaagagcgcgccctcgggaaacaagggtatgcagctgaaaaggcacatcgacgccactctcggcagcggcaacctgcgcgaggcggtacgtctgcccatcggggaggacctcaacgagtggctggccgtcaacactgttgacttcttcaaccaagtaaacattctgtacggcaccctgatggagttttgcacgccagctacctgcccgaccatgtcagccggaccaaaatatgagtacagatgggctgatggagtcaagatcaagaggcctatcgaggtctctgcaccaaagtacgttgagtacctgatggattggatagaagcccagctcgacgatgaaaacatattccctcagaagcttggggctcctttcccttccaacttccgtgacgtcgtcaagacgatcttcaagcgtctcttcagggtgtatgcgcacatataccactcgcactttcaggtgattatgaagctccaggaagaggcgcatctcaatacttgcttcaagcacttcacactcttcacattggaattccggctgatcgacagggcagagctggctcctctcagcgagttgattgaccccataatacttgggcgctaaaccagggagagagctttgatgacgccaagtgtggatagaatttttttttctctcctgattaattttttgatcaattcggatggaacgtctccatttacatttttggaagcatatattataggctagcagttcgcaagtcagatgtgttctgtagcagcctgatcgcaacgtcatcagtgaaaatggagtggttcttgatccgcatcagcagggtgcctcggttggttaatgtttctattgctcgtggctgctgctaaactgcagtgggccttcgtgaatcatgtatatagtttcagacgactgattcggaccgctattgggctaataacggtttgggcctgagttttgcccaattttggatgacagataagttgtttggtggcggctacacgtcgcatggcgtgatggcaaccagccggttttatagttgatagaaacttgagtgttgttactaagaactaggatcaaggatctactctggttaagagaaactgctacgtacacccaccgtaccagtcatgaaaaatatgattaattattatggacatgcgcacagtcgtccagtgttcactctgtaggttataataggcacaattgtagcatcttattggctatctagcttcatctatactagttaactactatatcatggtatattattggctctgacaaagctcttgatcttggatctggagctatatatataggtatgtcaagagtatttaaatagatcatcttgttcatagatttagata

SEQ ID NO: 5211 - DNA, 965 bp, Primula obconica
gctccattccttcgtccatcctacgcttctcactcctcccttctctctctatagcgtcatgagtctctttggcattggcaggaaccagaggacattccgcccaaaaaagagtgcaccttctgggagtaagggagcacaactaagaaagcatattgatgcgacgttaggtagtggaaaccttagggaagcagtcagacttcctcctggggaggatctcaacgagtggcttgctgtcaacactgtggacttcttcaatcaagtgaatttgctatatggaaccctcacagagttctgcactggtgaaacctgtccgacaatgactgcgggacccaaatatgaatacaggtgggcagatggggtcgtaataaaaaaaccaattgaggtttcagctccaaaatatgttgaatatctgatggactggatcgaatcacagttagacgacgaagccatattccctcaaagactcggagctccttttcctcccaattttagggaagttgtgaaaactatattcaagcgtctgttccgagtttatgcgcatatatatcattctcatttccagaagatcgtaagtctgaaggaggaggcccatttaaatacctgcttcaagcattttatactctttacctgtgagtttggactgatagacaagaaagagctagctccacttcaagagctcatagagtccattgtcccttactgaaactgatttatgctctacttacaagtttcaatcgattatctacagttattaaggtaaagtaattgttattgaaaaatgctaatttacagtttgtgtgaaatacttgatattattaactgtgcaagtgctggcttgactaattgttttcataatgacgaggattttacgtatgtatccataggcagcttgtgtaatggccaagaagcagcctgtgtaatgtcaatcgattatgtttgttgacaacatattcttgtattcatat

SEQ ID NO: 5212 - DNA, 2510 bp, Setaria italica
ctcgcgcccgccgcgtcctccgccctcgccgtcctcgcgaagcacctacgcgccccttttgcgctgccgtccggaaggttttcgcctaagggcatgtgggtctgttagtttgcctcctgtaagctagtgtagctacaaagatcacccttgcagaagtatgaatccttattttgttggcttccttgttcccgtcgcggtctccctgctgctccacaagaggagaaaggccgaaaggaagaggggagtgcaagttgaggtgggtggagagcctggatatgcagtccgcaactatcgatttgagcagcctgttgagacgcactgggaaggggtgtccacccttgctgagctgttcgagcggtcttgcaaggagtatgtctacatgccactccttggcaccaggaagctcatttctagggaaactgaatcagcacctggtggaagatcatttgagaagcttcatctgggcgagtatgagtggaagtgttacgctgaggccttcaagagcgtttgtaacttctcatctggactaattcgattaggccaccagaagaatgagcgtgttgccatttttgccgagacgagagctgaatggcaggttgctttgcaggcatgcttcagacaaaatattacagttgtcaccatctatgcctcattgggagaggaagcactatgccactcactaaatgagactgaggtcactactgtaatttgtggccagaaagaactaaaaaaattgattgatataagtgggcagcttgacactgtcacacgtgttgtttatatcaatgaggaaggcatctcagatgaagtttctttagctcgaaatagcacgagctggataatcgagtcatttgatgaagtgggtaggttaggaactgaagcacctgttgaagcaaacatgcctctcccatctgatgttgcagtgataatgtacacaagtggtagcaccggcttacccaagggagttatgatgacccactgcaatgtcctggctacactctcagcagttatgaccatcgtgcctgtacttggtagtaaagatatatacttggcctacctcccacttgcacacattcttgagttggcagctgaggcactaatggctgctgtcggggcctctatcggatacggatcacctttgactctgactgatacatcgagcaaaataaaaaagggaactctaggtgatgcttctgcactgaaaccaacattgatgactgccgtacctgctatacttgaccgtgttcgtgatggtgtgaggaaaaaggtggatggtacgggtggtgcagcaaagaaattgtttgacattggctataaccgccggcttgcagcaatcaatggaagctggcttggtgcctgggggttagagaaactcttgtgggatacgcttgtgttcggaaaggtgcgtgcaattttgggaggaaagattcggtttgtactctcaggcggagcacctctatctggagatactcagagatttatcaatatatgccttggggctccaataggtcaagggtatggtctgactgaaacttgtgctggagggacattttctgagtatgatgatacatctgttggccgtgttggtgctccactaccttgttcatatattaagttgattgattggcctgaaggtggatacttaacaactgattcacctatgcctcggggagaaatagtcatagggggtcctaatgtaaccaaaggctatttcaagaatgaagccaaaacaaatgaagtctacaaagatgatgaaaaaggtatgcggtggttctattctggtgatattggacgtttccacccagatggatgccttgaaatcattgaccgtaagaaagatattgtgaagcttcaacatggtgaatatgtatctctggggaaggtggaggctgctttgattgtgagcccatatgtggagaacatcatggttcacgctgatcctttccacaactactgtgttgcacttgtggtagctgcacataatgagctggagaactgggcttcgcagcaaggaattaaatatagtgatttctctgatttgtgccagaagcaagaggctgttaaagaagttcttgggtctatagcaaaggctggaaagcaagcgcgacttgagaagtttgagatcccagccaaaatcaagttgataccagagccatggacccctgagtcgggccttgtcactgctgccctcaagctcaagagggaggtgatcaggaagacgtacgagaatgatctggctcagttgtacgcctgacggactgccattctttttgacacgttcagctgtggagatgatatagagcgccaacatgtcgatgctaaaggggataattcaggtagttgatcatgaggattgtgtttttttttgtaaccttaaatttgaagttgtgggcttgtggcttctcttgaatcttgatgctgagaaggtatcctgccatttcaagagcacttctatgtagcctcatgtgatgcttcctgcatgtgtttataataaaatcgcattggattct

SEQ ID NO: 5213 - DNA, 2399 bp, Pennisetum glaucum
cttattttgttggcttccttgttcctgtcgcggtctccctgcttatccgcaagaggagaaaggctgaaaggaagaggggagtgcaagttgaggttggtggagagcctggatatgcagtacgcaactatcgatttgagcagcctgttgagacgcactgggaaggggtgtccacccttgctgagctgttcgagcggtcttgcaaggagtatgtctacatgccactctttggtaccaggaagctcatctcgagggaaactgaatcagcacctggcggaagatcatttgagaagcttcatctgggcgagtatgagtggaagtgttacgctgaagccttcaagagcgtttgtaacttttcatctggattaattcagttaggccatcagaagaatgagcgtgttgccatttttgctgagacaagagctgaatggcagattgctttgcaggcatgcttcagacaaaatattacagtagtcaccatctatgcctcactgggagaggaagcactatgccactcgctaaatgagactgaggtcactactgtaatttgtggccagaaggaactaaaaaaaatgattgatataagtgggcaacttgacactgtgacacgtgttgtatatatcaatgaggaaggcatctcagatgaagtttctttagcccgaaacagcacgagctggataattgagtcatttgatgaagtgggtaggttaggaactgaagcacctgttgaagcaaacatgcctctcccatctgatgttgcagtgataatgtacacaagtggtagcaccggcttacctaagggagttatgatgacccaccgcaatgtcctggctacactctcagcagttatgaccatcgtgcctgtacttggtagtaaagatatatacttggcctacctcccactcgcacacattcttgagttggcagctgaggcactaatggctgctgtcggggcctctatcggatatggatcacctttgactctgactgatacatcaaacaaaataaaaaaaggaactctaggtgatgcttctgcactgaaaccaacattgatgactgctgtgcctgctatacttgaccgtgttcgtgatggtgtgaggaaaaaggtggatggtacgggtggtgcagcaaagaagttgtttgacattggctataaccgccggcttgcagcaatcaatggaagctggcttggtgcttggggtttagagaaactcttgtgggataggcttgtgttccgaaaggtgcgtgcaattttgggaggaaagattcggtttgtactctcaggcggagcacctctatctggagatactcagagatttatcaatatatgccttggggctccaataggtcaagggtatggtctgactgaaacttgtgctggagggacattttctgagtatgatgatacatctgttggccgtgttggtgctccactaccttgttcatatattaagttgattgattggcctgaaggtggatacctaacaactgattcacctatgcctcggggagaaatagtcatagggggtcctaatgtaaccaaaggctatttcaagaatgaagccaaaacaaatgaagtctacaaagatgatgaaaaaggtatgcggtggttctattctggtgatattggacgtttccacccagatggttgccttgaaataattgaccgtaagaaagatattgtgaagcttcaacatggtgaatatgtatctctggggaaggtggaggctgctttgattgtgagcccatatgtggagaacatcatggttcacgctgatcctttccacaactactgtgttgcacttgtggtagctgcacataatgagctggagaactgggcttcacagcaaggaattaaatatagtgatttctctgatttgtgccagaagcaagaggctgttaaagaagtgcttgggtctatagcaaaggctgcaaagcaagcgcgacttgagaagtttgagatcccagccaaaattaaattgataccagagccatggacccctgagtcgggcctcgtcactgctgccctcaagctcaagagggaggtgatcaggaagacgtacgagaatgatctggctcaattgtatgcctgaaggatctgctctttttgacacgttcagctgtggagatgatatagggcgccaacatgtcgatgatgggataattctctaggtagttaatcatgaggatcgtgtgtttcttgtgtttttttttccggatagggaggtaaacttaattttaagttgtggcttctcttgaatcttgatgctaagacggcaccctgccgtttcaagagctatgtagcctcatgtggttcttcgtgcatgtgtttagaataaacttgcattggattctcgttgcttttattctcttaatcctgagattgatgttcttccgttcgt

SEQ ID NO: 5214 - DNA, 2464 bp, Panicum virgatum
aggttttcgcctcagggcatgtggctctgttagtttacctactgcagctacaagaaccacccttgcagaagtatgaatccttattttgttggcttacttgtccctgttgcggtctccctgctgctccgcaagaggagaaaggctgaaatgaagaggggagtgcgagtcgaggttggtggagatcctggatatgcagtccgtaactatcgatttgaacagcctgttgagacacactgggaaggggtgtccacccttgccgagcttttcgagcaatcatgcaaggagtatgtctacatgcccctccttggcaccaggaagctcatttcgagggaaatcgaatcagcacctggtggcagatcatttgagaagcttcatctgggagagtatgagtggaagtgttacgctgaggtcttcaagagcgtctgtaacttttcatctggcctaattcgattaggtcaccagaagaatgagcgtgttgccatttttgccgagacgaaagctgaatggcagattgctttgcaggcatgcttcagacaaaatattacagttgtcaccatctatgcctcattgggagaggaagcattgtgccactcactaaatgaggctgaggtcactactgtaatttgtgatcagaaagaactgaaaaagttgattcatataagtgggcagcttgacactgtcacacgtattgtatatatcaatgaggaaggcatctcggatgaagtttctttagctcgaaacagcactagctggataattgagacatttgatgaagtgggtaggttaggaactgaagcacctgttgaagcaaacatgcccctcccatctgatgttgcagtgataatgtacacaagtggtagcactggattacccaagggagttatgatgacccacggcaatgtcctggctacactttcagcagttatgaccatagtgcctgcacttggtagtaaagatatatacttggcgtacctcccacttgcacacattcttgagttggcagctgaggcactaatggctgctgtcggggcctccatcggatacggatcacctttgactctgactgatacgtcgagcaaaataaaaaagggaactctaggtgatgcttctgcactgaagccaacattgatgaccgctgtacctgctatacttgaccgcgttcgtgatggtgtgaggaaaaaggtggatgctacgggtggtgtggcaaagaaattgtttgacattggctataaccgccggcttgcagcaatcaatggaagctggcttggtgcctggggattagagaaactcttgtgggatacgcttgtttttggaaaggtgcgtgcaattttgggaggaaagattcggtttgttctctcaggtggagcacctctatctggggatactcagagatttatcaatatatgccttggggctccaatagggcaagggtatggtctgactgaaacttgtgctggaggtacattttctgagtatgatgatacatctgttggccgtgttggtgctccactaccttgttcgtatattaagttgattgactggcctgaaggtggatacttaacaactgattcacctatgcctcggggagaaatagtcatagggggtcctaatgtaaccaaaggttatttcaagaatgaagccaaaacaaatgaagtctacaaggatgatgaaaaaggtatgcggtggttctattctggtgacattggacgtttccatccagatggctgccttgaaatcattgaccgtaagaaagatattgtgaagcttcaacatggtgaatatgtatctctggggaaggtggaggctgctttgattgtgagcccatatgtggagaacatcatggtttacgctgatcctttccacaacttctgcgttgcacttgtggtagctgcacacaacgagctggagagctgggcttcacagcaaggaattaaatatagtgatttctcagatttgtgccagaaggaagaggctgtcaaggaagtgcttggatctttagcaaaggctgcaaagcaagctcgacttgagaagtttgaggtcccagccaaaatcaagttgatgccagagccatggacccccgagtcgggcctcatcactgctgcccttaagctcaagagggaggtgatcaggaagacgaacgagaatgatctggctcagttgtatgcctaagggttctgccactctttttgacacgttcagctgtggagatggtatagagggccaatttgtcgatgttaaaggggaccattctcgaggactgtgttttttgttccgatggaggaggtacccttgaattttaagttgtggcttctcttgatgccgagaagctatcccgccgtttcaagagcacttcgatgtagcctcatatgatgcttcctgcaagtgtttaaataaaatggcattggattcttgttgcttttgttctcttatcctgagataactgttggctgctggtttttatcta

SEQ ID NO: 5215 - DNA, 2787 bp, Panicum virgatum
acatgcgagcaggattgcatatgcagcccgtaatttcggcccaactttgtgaacgggagctgggcccggccccagcaggcttcaccggcggctataaggaagcgattggattcggtagggcccgcttgacggagcggagagagacacaagtggcgagagccaaaccagacgtagtacgaggcggaccccctctcctcctcgttgactcgctccgccgccgccgccccccgcgcccgccgccctcgcgaagcacctacctaggcgccccttttgcgctgccgtccggaaggttttcgcctcagggcatgtggctctgttagttcacctactttagctacaaggaccacccttgcagaagtatgaatccttattttgttggcttccttttccccgttgcggtctccctgctcctccgcaagaggagaaaggctgaaatgaagaggggagtgcaagtcgaggttggtggagaacctggatatgcagtccgtaactatcgatttgagcagcctgttgagacacactgggaaggggtgtccacccttgctgagcttttcgagcaatcttgcaaggagtatgtctacatgcccctccttggcaccaggaagctcatttcgagggaaatcgaatcagcacctggtggaagatcatttgagaagcttcatctgggcgagtatgaatggaagtgttacgctgaggccttcaagagcgtttgtaacttttcatctggcctaattcgattaggccaccagaagaatgagcgtgctgccatttttgccgagacaaaagctgaatggcaggttgctttgcaggcatgcttcagacaaaatattacagttgtcaccatctatgcctcattgggagcggaagcattgtgccactcactaaatgaggctgaggtcactactgtaatttgtgatcagcgagaactaaaaaagttgattgatataagtgggcagcttgacactgtcacacgtattgtatatatcaatgagaaaggcatcccggatgaagtttctttagctcgaaacagcactagctggataattgagtcatttgatgaagtggttaggttaggaactgaagcacctgttgaagcaaacatgcctctcccatctgatgttgcagtgataatgtacacaagtggtagcacaggattacccaagggagttatgatgacccatcgcaatgtcctggctacactttcagcagttatgaccatagtgcctgcacttggtagtaaagatatatacttggcgtacctcccacttgcacacattcttgagttggcagctgagacactaatggctgctgtcggggcctccatcggatacggatcacctttgaccctgactgatacgtcgaacaaaataaaaaagggaactctaggtgatgcttctgcactgaagccaacattgatgactgctgtacctgctatacttgaccgtgttcgtgatggtgtgaggaaaaaggtggatgctacaggtggtgtagcaaagaaattgtttgacattggctataaccgccggcttgcagcaatcaatggaagctggcttggtgcctggggattagagaaactcttgtgggatacgcttgttttcggaaaggttcgtgcaattttgggaggaaagattcggtttgttctctctggtggagcacctctatctggggatactcagagatttatcaatatatgccttggggctccaatagggcaagggtatggtctgactgaaacttgtgctggaggtacattttctgagtatgatgatacatctgttggccgtgttggtgctccactaccttgttcgtatgttaagttgattgactggcctgaaggtggatacttaacaactgattcaccaatgcctcggggagaaatagtcatagggggtcctaatgtaaccaaaggctatttcaagaatgaagccaaaacaaatgaagtctacaaggatgatgaaaaaggtatgcggtggttctattctggtgacattggacgtttccatccagatggctgccttgaaatcattgaccgtaagaaagatattgtgaagcttcagcatggtgaatatgtatctctggggaaggtggaggctgctttgattgtgagcccatatgtggagaacatcatggttcacgctgatcctttccacaacttctgcgttgcacttgtggtagctgcacacaatgagctggagagctgggcttcgcagcaaggaattaaatatagcgatttctcagatttatgccagaaggaagaggctgttaaagaagtacttggatctttagcaaaggctggaaagcaagctcgacttgagaagtttgagatcccagccaaaatcaagttgataccagagccatggacccccgagtcaggcctcgtcactgctgcccttaagctcaagagggaggtgatcaggaagatgtacgataatgatctggctcagttgtatgcctgacagttctgccactctttttgacatgttcagctgtggagatgatatagagggccaatttgtcgatgttaaaggggaccattctcgtagttgatcatgataattttgtttatttgttccgatggagtagggtacccttgaatttaaagttgtggcttctcttgatgctgagaagctatcccgccgtttcaacagcgcttcgatgtagcctcatatgatgcttcgtgcaaatgtttaaataaaatgcatcggattcttgttgcttttgttctattatcctgagataactgttggctgctggtttttatctagaatggtgcggtgcctctgttct

SEQ ID NO: 5216 - DNA, 2524 bp, Oryza sativa
cgcccacgccgacgcgaggagcactcgccgcccgccaccgcgctctccctctccccccaattccatccctccacgccacgatcgccttccgcaaggtttcttcttcagtgcacatgtgaaactgtacttcacctcccatatataattcagtgcagagagcattcttgaataagtatgaacccttattttgttggtcttctcgtcccaattgcggtatctcttctcctacggaagaggagaatggttgggaagatgagggcactgccagttgatgtgggtggagagcccgggtatgcaatccgcaactatcgattcaagcaaccggttgaaactcactgggaaggtgtcaccacgctcgccgagttgtttgagcagtcctgcaaggattatgtcaacatgccgctcctcggcaccaggaagctcatctccagggaacaggaatcatcactagatgggaggtcctttgagaagcttcatcttggagagtatgactggaagtgctacgctgaggtattcaagagtgtttgcaacttcgcatctggactaattcggctaggccatcagaagactgatcgtgttgctattttcgccgagacgcgggctgagtggcaaattgctctgcaggcatgcttcaggcaaaatattacagttgtcacaatctacgcctccttgggagaggaagcactgtgccactcactaaatgagacagaggttactactgttgtatgtggtcagaaagaactgaaaaaaatgattgatataagtgggcagcttgacacagtaaagcgagttatctatatcaatgaggaaggaatctcagctgaagtttctttagctcaaaaaagcactagctggataattgagccgtttgaggatgtaggtagattgggagatacagcacctgttgatgcaaacatgcctctcccatctgacgtagcagtgataatgtatacaagcggtagcaccggattgcctaagggagtaatgatgacccatcggaacgtcctggctacactttcagcagttatgaccattgtgcctgaaattggtaaaaaggatgtatacctggcctacctgccacttgcacacattcttgagttggcagctgaggcactcatagctgctgttggggcttccataggatatggatcacccttgaccctgactgatacatcaaacaaaataaaaaagggaacactgggtgatgcttctgcactcaagccaacactgatgaccgctgtacctgctatacttgatcgtgttcgtgatggtgtgagaaagaaggtggatacaaagggtggtgtagcaaagcagttatttgatgttgcctataatcgtcgacttgccgcagtcaatggaagttggctgggtgcatggggattagagaaactcttgtgggatatgcttgtcttcaaaaaggtgcgagcagttttgggaggaaaaattcgctttgtactttcaggtggagcacctctatcaggagatacccagagatttatcaatatatgccttggggttccaatagggcaagggtatggtcttactgagacatgtgctggaggaacattttctgagtatgatgacccatctgttggtcgcgttggtgctccactaccttgttcgtacattaagctgattgactggtcagaaggtggatacttaacaagtgactccccaatgcctcgaggagagattgtcattggtggtcccaatgtaactaaaggctatttcaagaatgaagctaaaacaaatgaagtctataaggatgacgaaaaaggtatgcgatggttctattctggtgacatcgggcgcttccacccagatggctgccttgaaatcattgaccgtaaaaaggatattgtgaagcttcaacatggtgaatatgtgtctctcgggaaggtggaggctgctctgattgtgagcccatatgtggagaacatcatgatccatgctgatcctttccacagttactgtgttgcacttgtggtagctgcacacaatgagctggaaaactgggcttcgcagcagggagttacatacaccgatttcgtagatttgtgccagaagccagaggctgttaaagaagtgcttggatctctatcaaaggctgcgaagcaagcgcgactggagaagtttgagatcccggccaagatcaagctgatatctgagccatggaccccggagtctggccttgtcactgctgccctcaagctcaagagggaagtgctcaggaagacatatgaggatgatcttgctaaactatacgcctgatgatcaatgctgaattgctgattaagcctactcgacgttttgacacaaccagctaccgtaggacagagctcttgtgagcaaactgaagatgctgataccggcaggaggtagcctgaaattttggagctgtggttgtttgatcttttggagctagcacaattatgtgtagcctcatttcacacttacttctgtgtctctgccatattctcttgtgaatttacattgttcaaaggaaaaaaaaaaggcattctac

SEQ ID NO: 5217 - DNA, 2599 bp, Oryza sativa
ctcgcaccacgcaacgccaactctccacgcgccgccgcccacgccgacgcgaggagcactcgccgcccgccaccgcgctctccctctccccccaattccatccctccacgccacgatcgccttccgcaaggtttcttcttcagtgcacatgtgaaactgtacttcacctcccatatataattcagtgcagagagcattcttgaataagtatgaacccttattttgttggtcttctcgtcccaattgcggtatctcttctcctacggaagaggagaatggttgggaagatgagggcactgccagttgatgtgggtggagagcccgggtatgcaatccgcaactatcgattcaagcaaccggttgaaactcactgggaaggtgtcaccacgctcgccgagctgtttgagcagtcctgcaaggattatgtcaacatgccgctcctcggcaccaggaagctcatctccagggaacaggaatcatcactagatgggaggtcctttgagaagcttcatcttggagagtatgactggaagtgctacgctgaggtattcaagagtgtttgcaacttcgcatctggactaattcggctaggccatcagaagactgatcgtgttgctattttcgccgagacgcgggctgagtggcaaattgctctgcaggcatgcttcaggcaaaatattacagttgtcacaatctacgcctccttgggagaggaagcactgtgccactcactaaatgagacagaggttactactgttgtatgtggtcagaaagaactgaaaaaaatgattgatataagtgggcagcttgacacagtaaagcgagttatctatatcaatgaggaaggaatctcagctgaagtttcttcagctcaaaaaagcactagctggataattgagccgtttgaggatgtaggtagattgggagatacagcacctgttgatgcaaacatgcctctcccatctgacgtagcagtgataatgtatacaagcggtagcaccggattgcctaagggagtaatgatgacccatcggaacgtcctggctacactttcagcagttatgaccattgtgcctgaaattggtaaaaaggatgtatacctggcctacctgccacttgcacacattcttgagttggcagctgaggcactcatagctgctgttggggcttccataggatatggatcacccttgaccctgactgatacatcaaacaaaataaaaaagggaacactgggtgatgcttctgcactcaagccaacactgatgaccgctgtacctgctatacttgatcgtgttcgtgatggtgtgagaaagaaggtggatacaaagggtggtgtagcaaagcagttatttgatgttgcctataatcgtcgacttgccgcagtcaatggaagttggctgggtgcatggggattagagaaactcttgtgggatatgcttgtcttcaaaaaggtgcgagcagttttgggaggaaaaattcgctttgtactttcaggtggagcacctctatcaggagatacccagagatttatcaatatatgccttggggttccaatagggcaagggtatggtcttactgagacatgtgctggaggaacattttctgagtatgatgacccatctgttggtcgcgttggtgctccactaccttgttcgtacattaagctgattgactggtcagaaggtggatacttaacaagtgactccccaatgcctcgaggagagattgtcattggtggtcccaatgtaactaaaggctatttcaagaatgaagctaaaacaaatgaagtctataaggatgacgaaaaaggtatgcgatggttctattctggtgacatcgggcgcttccacccagatggctgccttgaaatcattgaccgtaaaaaggatattgtgaagcttcaacatggtgaatatgtgtctctcgggaaggtggaggctgctctgattgtgagcccatatgtggagaacatcatgatccatgctgatcctttccacagttactgtgttgcacttgtggtagctgcacacaatgagctggaaaactgggcttcgcagcagggagttacatacaccgatttcgtagatttgtgccagaagccagaggctgttaaagaagtgcttggatctctatcaaaggctgcgaagcaagcgcgactggagaagtttgagatcccggccaagatcaagctgatatctgagccatggaccccggagtctggccttgtcactgctgccctcaagctcaagagggaagtgctcaggaagacatatgaggatgatcttgctaaactatacgcctgatgatcaatgctgaattgctgattaagcctactcgacgttttgacacaaccagctaccgtaggacagagctcttgtgagcaaactgaagatgttgataccggcaggaggtagcctgaaattttggagctgtggttgtttgatcttttggagctagcacaattatgtgtagcctcatttcacacttacttctgtgtctctgccatattctcttgtgaatttacattgttcaaaggaaaaaaaaaaggcattctacatattatggggctattatgatcacgaagataattactccc

SEQ ID NO: 5218 - DNA, 2446 bp, Hordeum vulgare
agggttctctcttcaaggcatctttaatctgtagccttcctcccataagctagtatatagctgtcaaatcgcccttgaacaagtatgaatccttattttgttggccttcttgtgcccatcgcggtctctcttctgctccagaaaaagagaaaggttgaaaagaagaggggtgtgccagttgatgttggtggagagcctggctatgcgatccgcaaccatcgatttgaacgccctgttgaaacacactgggaaggggtcaacacacttgctgagctgtttgagcatgcttgcaaagagtacgtctacatgcccctccttggcacaaggaagctcatttcaagggaaatagaatcatcacctgatgggaggtcctttgagaagcttcatctgggggactacgagtggaaatgttacgccgaggccttcaagagtgtttgcaacttctcttcaggattggtcaatttaggtcgccagaacaatgagcgtgttgctatttttgccgagacacaggccgagtggcagattgcactgcaggcatgcttcagacaaaacataacagttgtcaccatctatgcctcgttgggggaggaagcactatgccactcactaaatgagaccgaggtcactactgtagtatgtggtcggaaggaattcaagaagttgattgatataggttggcaacttgacactgtcaagcgtgtgatctacatcaatgaggacggcatctcggctgaagtttctatagctcaaaacagcactagctggtcagttaagtcatttgaggaagtaggtaaattgggagctgaagcgcctgttgatgcaaacatgcctctcccatctgatgttgcagtgataatgtacacaagtggtagcactggattgcccaagggagttatgatgacccaccgcaatgtcctggctacactttcagcagttatgaccattgtgcctgaacttggcagaaaggatatatacatggcctacctcccactggcccacattcttgagttagcagctgagacacttatggctgctgttggggcctccattggatatggatcagctttaaccctgactgatacatcaagcaaaataaagaaggggaccctaggcgatgcttctgcactgaggccgacactgatgactgctgtacctgctatacttgatcgtgtccgtgatggtgtgagaaaaaaggtggatgcaaagggtggtgttgcgaagaaattatttgacattggatatagccgccgacttgctgctatcagtggaagttggcttggtgcatggggagtagagaaactgttgtgggacaggcttgtcttcatgaaggtgcgtgcaatactgggaggaaacattcgctttgtactctcaggcggagcacctctgtctggagatactcagagatttatcaatatatgccttggggctccaataggccaagggtatggtctgactgaaacttgtgctggaggaacgttttctgagtacgatgatacatctgttggccgtgttggtgctccactaccttgttcatatatcaagttgattgactgggctgaagggggatacttaacaacggattcaccgatgcctcggggggagatagtcatcggaggtcccaatgtaactaaaggctattttaagaatgaagctaaaacaaatgaagtctataaggatgatgaaaaaggtctacgatggttctattctggtgacatagggcgtttccatccagatggttgccttgaaatcattgaccgcaagaaagatatcgtgaagcttcaacatggtgaatacgtatctctcgggaaggtggaagctgcattggccatgaacccatatgttgagaacatcatgatccatgccgatccttttcacagttactgtgttgcacttgtggtagcagcacagaacgagctggaaaagtgggcattgcagcaaggacttgcatacaccgatttcgctgatttgtgccagaagcaagaggctgttgtagaagtgcttggatctttaacaaaggctgcaaagcaagcacgactggagaagttcgagacaccagctaaagtcaagctgatgccagatccatggacccccgagtcgggcctcgtcacagctgcgctcaaactcaagagggaggtgatcaggaagacgtatgaagatgatctggctcagttgtacgcctgatggttctcttactctgactgataccctgagatgacataggacagtgctcttatgtcggcacatactatatttgatatattttgatgttgggatagattgaatcatcgagggagtcctggaattttggagcgtgtcctgtcttgcgcgattagaaccaattttgtgtttgatgtagcgtagttgtacacttcctacaatgtttctatcataatcacaccgtattttgattgcaatggtaatctctcatcgaaagatagctgttatc

SEQ ID NO: 5219 - DNA, 2680 bp, Secale cereale
agagcacacaccggcctcaagcgaatttagcggctgaagacttggagaagagggagagcagctccaccccctccctcatctcctctccccgccgcgccgatcgatcctcctccgcctgacgtcacgccttcgcctccttccttccagaagcttccacgcgccattgcccccccacccctccagaaggtttctctcttcaaggcatctttaatttgtggccttcctcccataagctagtatatagctgtcagatcgcccttgaagaagtatgaatccttattttgttggccttcttgtgcccatcgcggtctctcttctgcttcagaaaaggagaaaggttgaaaagaagaggggggtgccagttgatgttggtggagagcctggctatgcgatccgcaatcatcgatttgaacgccctgttgaaacacattgggaaggggtcaacacacttgctgagctgtttgagcatgcttgcaaagagtatgtctacatgcccctccttggcacaaggaagctcatttcaagggaaatagaatcatcacctgatgggaggtcctttgagaagcttcatctgggggactatgagtggaaatgttacgctgaggccttcaagagtgtttgcaacttttcttcaggattggtcaatttaggtcgccagaacaatgagcgcgttgctatttttgctgagacacaggccgagtggcagattgcactgcaggcatgcttcagacaaaacataacagttgtcaccatctatgcctcgttgggggaggaagcactatgccactcactaaatgagactgaggtcactactgtagtatgtggtcggaaggaattcaagaagttgattgatataggttggcaacttgacactgtcaagcgtgtgatctacatcaatgaggacggcatctcggctgaagtttctatagctcaaaacagcactagctggtcagttaagtcatttgaggaagtaggtaaattgggagctgaagcacctgttgatgcaaacatgcctctcccatctgatgttgcggtgataatgtacacaagtggtagcactggattgcccaagggagttatgatgacccaccgcaatgtcctggctacactttcagcagttatgaccattgtgcctgaacttggcagaaaggatatatacatggcctacctcccactggcgcacattcttgagttggcagccgagacgcttatggctgctgttggggcctccattggatatggatcagctttgaccctgactgatacatcaagcaaaataaagaaggggaccctaggcgatgcttctgcactgaggccgacactgatgactgctgtacctgctatacttgatcgtgtccgtgatggtgtcagaaaaaaggtggatgcaaagggtggtgtagcaaagaaattatttgatattggatatagccgccgacttgcggctatcagtggaagttggcttggtgcatggggagtagagaaattgttgtgggacaggcttgtcttcacgaaggtgcgtgcaatattgggaggaaacattcgctttgtactctcaggtggagcacctctgtccggagatactcagagatttatcaatatatgccttggggctccaataggccaagggtatggtctgactgaaacttgtgctggaggaacgttttctgagtacgatgatacatctgttggccgtgttggggctccactaccttgttcatatattaagttgattgactgggctgaagggggatacttaacaacagattcaccaatgcctcggggggagatagtcatcggaggtcccaatgtaactaaaggctatttcaagaatgaagcgaaaacaaatgaagtctataaggatgatggaagaggtctacgatggttctattctggtgacatagggcgtttccatccagatggctgccttgaaatcattgaccgcaagaaagatatcgtgaagcttcaacatggtgaatacgtatctctcgggaaggtggaagctgcgttggccatgagcccatatgttgagaacatcatgatccatgccgatccttttcacagttactgtgttgcacttgtggtagcagcacagaccgagctggaaaagtgggcgttgcagcaaggacttgcatacactgatttcgctgatttgtgccagaaggaagaggctgttgtagaggtgcttggatctttaacaaaggctgcgaagcaagcacgactggagaagttcgagacaccagccaaagtcaagctgataccagatccatggacccccgagtcgggcctcgtcacagctgcgctcaaactcaagagggaggtgatcaggaagacgtatgaagacgatctggcgcagttgtacgcctgatggttctcttctctgactgataccctgagatgacatgacagggctcttatgttgaagcattactatattgatatattttgatgtcggggtagatttgatcattgagggagtcctggaattttggagtgtcttgtcttacgcttagaagcaattttgtgtttggtgtagcgtagttgtacacttactaccaatgcatctatcataattgcaccgaattttgattgcattgtaatctctgatcgtaaagatagctattatcatcttttagagctggaatcttttctatctcttctacttataaagaagattggaatt

SEQ ID NO: 5220 - DNA, 2732 bp, Triticum aestivum
ccgaagagcacaccaccggcctcaagcgaatttagcggctgaagacttggagaagaggcagagcagctccaccccctcctcctctccccgccgcgccgatcgatccacctccgcctgacgtcacgccttcgcctcctcccttccagaagcttccacgcgccattgcgccccaccccccacaacgtccagaagggttctctcttcaaggcatctttaatctgtagccttcctcccataagctagtatatagctgtcaggtcgcccttgaacaagtatgaatccttattttgttggccttcttgtgcccatcgcggtctctcttctgctccagaaaaggagaaaggttgaaaagaagaggggtgtgccagttgatgttggtggagagcctggctatgcgatccgcaaccatcggtttgaacgccctgttgaaacacactgggaaggggtcaacacacttgctgagctgtttgagcatgcttgcaaagagtatctctacatgcccctccttggcacaaggaagctcatttcaagggaaatagaatcatcacctgatgggaggtcctttgagaagcttcatctgggggagtacgagtggaaatgttacgctgaggccttcaagagtgtttgcaacttttcttcaggattggtcaatttaggtcgccaggacaatgagcgtgttgctatttttgccgagacacaggctgagtggcagattgcactgcaggcatgcttcagacaaaacataacagttgtcaccatctattcctcgttgggggaggaagcactatgccactcactaaatgagactgaggtcactactgtaatatgtggtcggaaggaattaaagaagttgattgatataggttggcaacttgacactgtcaagcgtgtgatctacatcaatgaggaaggcatctcggctgaagtttctatagctcaaaacagcactagctggtcagttaagtcatttgaggaagtaggtaaattgggagctgaagcacctgttgatgcaaacatgcctctcccatctgatgttgcggtgataatgtacacaagtggtagcactggattgcccaagggagttatgatgacccaccgcaatgtcctggctacactttcagcagttatgaccattgtgcctgaacttggcaaaaaggatatatacatggcctacctcccactggcgcacattcttgagttggcagctgagacacttatggctgctgttggggcctccattggatatggatcagctttgaccctgactgatacatcaagcaaaataaagaaggggaccctaggcgatgcttctgcactgaggccgacactgatgactgctgtacctgctatacttgatcgtgtccgtgatggtgtgagaaaaaaggtggatgcaaagggtggtgtagcgaagaaattatttgacattggatatagccgccgacttgctgctatcaatggaagttggcttggtgcatggggagtagagaaactgttgtgggacaggcttgtcttcacgaaggtgcgtgcaatattgggaggaaatattcgctttgtactctcaggtggagcacctctgtccggagacactcagagatttatcaatatatgccttggggctccaataggccaagggtatggtctgactgaaacttgtgctggaggaacgttttctgagtatgatgatacatctgttggccgtgttggtgctccactaccttgttcatatattaagttgattgactgggctgaagggggatacttaacaacggattcaccaatgcctcggggggagatagtcatcggaggtcccaatgtaactaaaggctatttcaagaatgaagctaaaacaagtgaagtctataaggatgatgaaagaggtctacgatggttctattctggagacatagggcgtttccatccagatggctgccttgaaatcattgaccgcaagaaagatatcgtgaagcttcaacatggtgaatacgtatctcttgggaaggtggaagctgcgttggctatgagcccatatgttgagaacatcatgatccatgccgatccttttcacagttactgtgttgcacttgtggtagcagcacagaatgagcttgaaaggtgggcattgcagcaaggacttgcatacaccgattttgctgatttgtgccagaagcaagaggctgttgtagaagtgcttgaatctttaacaaaggctgcgaagcaagcacgactggagaagttcgagacaccagccaaagtcaagctgataccagatccatggacccctgagtcgggcctcgtcacggctgcgctcaaactcaagagggaggtgatcaggaagacgtttgaagacgatctggcgcagttgtacgcctgatggttctcttctgtgactgataccctgagatgacataggacaaggctcttatgtcaaaacatactatattgatatattttgatgtcggggtagattggatcattgagggagtcctggaattttggagtgtcttgtcttacacttagaagcaattttgtgtttgcgtagttgtacacttactaccaatgcatctatcataattgcaccgaattttgattgcattgtaatctctgatcgaaagatagcggttatcatcttctagagccgggatcttttctatctcttctacttataaagattcgagttggcggttcactctgttcttcctgtgtgtctattcttgaagtacattgttcttttt

SEQ ID NO: 5221 - DNA, 2356 bp, Avena sativa
cctcctcctccgcccttccagaagcttccgcgcccccttgcgccgcccctccagaaggtttccctcttcaaggcatctggaatcacccttgcacaagtatgaatccttattttattggccttcttgtgcccattgcggtctctcttctgctccagaaaaggagaaaggttgaaaagaagagaggggtgccagttgatgttggtggagagcctggctatgcgatccgcaaccatcgatttgaacatcccgttgaaacgcactgggaaggggtcaccacacttgctgagttatttgagcatgcttgcaaggagtatgtctacatgcccctccttggcaccaggaagctcatttcaagagaaatagaatcatcgcctgatgggaggtcctttgagaagcttcatctgggggaatatgagtggaaatgttacgctgaggcctttaagagtgttagcaacttttcatcaggattgattcaattaggtcaccagaagaatgagcgtgttgctatttttgctgagacacgggcggagtggcagattgcactccaggcatgcttcagacaaaacatatcagttgtcaccatctatgcctccttgggggaggaagcactatgccactcactaaatgagactgaggtcacaactgtggtgtgcggtcagaaggaatttaagaagttgattgatataggttggcaacttgacactgttaagcgtgtgatctacatcaatgaggaaggcatctcagctgaagtttctctagctaaaaacagcactagctggacagttgcgtcatttgaggaagtatgcaaattaggaattgaagcacctattgatgcaaacatgcctctcccatctgatgttgcagtgataatgtacacaagtggaagcaccggattgcccaagggagttatgatgacccatcgcaatgtcctggctacactttcagcagttatgacaattgtgcctgaactcggcaaaaaggatatatacatggcctaccttccacttgcgcacattcttgagttggcagctgagacgcttatggctgctgtcggggcctccattggatatgggtcagctttgaccttgactgatacatactaagtaaaataaaaagggactactaggtgatgcttctgcactgaagccaacactgatgactgctgtacctgctatacttgatcgtgtccgtgatggtgtgaggaaaaaggtggatgcaaatggtggtgtagccaagaaattgtttgacattggctatagtcgtcggcttgctgctatgaatggaagttggcttggtgcatggggagtagagaaactgttgtgggataggctagtcttcaccaaggtgcgtgcaatattgggaggaaagattcgttttgtactctcaggtggagcacctctgtccggagatacacagagatttatcaatatatgccttggggctccaataggccaagggtatggcctgactgaaacttgtgctggaggaacattttctgagtatgatgacacatctgttggtcgtgttggtgctccactaccttgttcatacattaagttgattgactgggctgaaggtggatacttaacaactgattcaccaatgcctcgaggggagatagtcataggaggccccaatgtaactaagggctatttcaagaatgaagctaaaacaagtgaagtctataaggatgacgaaagaggtctgcgatggttctattctggtgacatcggtcgttttcatccagatggctgccttgaaatcattgaccgcaagaaagacatcgtaaagcttcagcatggtgaatatgtatctcttgggaaggtggaagctgcgttggctatgagcccatatgttgagaacatcatgatccatgccgatcctttcaacagttactgcgttgcactggtggtagctgcacagagtgagctggaaaagtgggcatcccagcaacgacttacatacagtgacttctgtgatttgtgccagaagcaagaggctgttaaagaagtgcttggatctctagcaacggttgcgaagcaagcacgactggagaagtttgagacgccagccaaagtcaagctgataccagatccatggactcctgagtcaggccttgtcacggctgctctcaagctcaagagggaggtgatcaggaagaagtatgagaacgatctggctgagttgtacgcttgatagtcttggtactctttctgatggacatagataaaactggcatgccgacacctagtatattgataaattttgatgccggggtagattgatcattgagggagtatgattggcttccgtcggagaaatctgaattttggagctatcctttcgtattatgaga

SEQ ID NO: 5222 - DNA, 2693 bp, Hordeum vulgare
ggagattggtggggccagagcacacaccggcctcaagcgaatttagcggctgaagacttggagaagaggcagagcagctccaccccctccctcctctccccgccgcgccgatcgatcctcctccgcctgacgtcacgccctcgcctctccccttccagaagcttccacacgccattgcgcccccccccacccctccagaagggttctctcttcaaggcatctttaatctgtagccttcctcccataagctagtatatagctgtcaaatcgcccttgaacaagtatgaatccttattttgttggccttcttgtgcccatcgcggtctctcttctgctccagaaaaagagaaaggttgaaaagaagaggggtgtgccagttgatgttggtggagagcctggctatgcgatccgcaaccatcgatttgaacgccctgttgaaacacactgggaaggggtcaacacacttgctgagctgtttgagcatgcttgcaaagagtacgtctacatgcccctccttggcacaaggaagctcatttcaagggaaatagaatcatcacctgatgggaggtcctttgagaagcttcatctgggggactacgagtggaaatgttacgccgaggccttcaagagtgtttgcaacttctcttcaggattggtcaatttaggtcgccagaacaatgagcgtgttgctatttttgccgagacacaggccgagtggcagattgcactgcaggcatgcttcagacaaaacataacagttgtcaccatctatgcctcgttgggggaggaagcactatgccactcactaaatgagaccgaggtcactactgtagtatgtggtcggaaggaattcaagaagttgattgatataggttggcaacttgacactgtcaagcgtgtgatctacatcaatgaggacggcatctcggctgaagtttctatagctcaaaacagcactagctggtcagttaagtcatttgaggaagtaggtaaattgggagctgaagcgcctgttgatgcaaacatgcctctcccatctgatgttgcagtgataatgtacacaagtggtagcactggattgcccaagggagttatgatgacccaccgcaatgtcctggctacactttcagcagttatgaccattgtgcctgaacttggcagaaaggatatatacatggcctacctcccactggcccacattcttgagttagcagctgagacacttatggctgctgttggggcctccattggatatggatcagctttaaccctgactgatacatcaagcaaaataaagaaggggaccctaggcgatgcttctgcactgaggccgacactgatgactgctgtacctgctatacttgatcgtgtccgtgatggtgtgagaaaaaaggtggatgcaaagggtggtgttgcgaagaaattatttgacattggatatagccgccgacttgctgctatcagtggaagttggcttggtgcatggggagtagagaaactgttgtgggacaggcttgtcttcatgaaggtgcgtgcaatactgggaggaaacattcgctttgtactctcaggcggagcacctctgtctggagatactcagagatttatcaatatatgccttggggctccaataggccaagggtatggtctgactgaaacttgtgctggaggaacgttttctgagtacgatgatacatctgttggccgtgttggtgctccactaccttgttcatatatcaagttgattgactgggctgaagggggatacttaacaacggattcaccgatgcctcggggggagatagtcatcggaggtcccaatgtaactaaaggctattttaagaatgaagctaaaacaaatgaagtctataaggatgatgaaaaaggtctacgatggttctattctggtgacatagggcgtttccatccagatggttgccttgaaatcattgaccgcaagaaagatatcgtgaagcttcaacatggtgaatacgtatctctcgggaaggtggaagctgcattggccatgaacccatatgttgagaacatcatgatccatgccgatccttttcacagttactgtgttgcacttgtggtagcagcacagaacgagctggaaaagtgggcattgcagcaaggacttgcatacaccgatttcgctgatttgtgccagaagcaagaggctgttgtagaagtgcttggatctttaacaaaggctgcaaagcaaggacgactggagaagttcgagacaccagctaaagtcaagctgatgccagatccatggacccccgagtcgggcctcgtcacagctgcgctcaaactcaagagggaggtgatcaggaagacgtatgaagatgatctggctcagttgtacgcctgatggttctcttactctgactgataccctgagatgacataggacagtgctcttatgtcggcacatactatatttgatatattttgatgttgggatagattgaatcatcgagggagtcctggaattttggagcgtgtcctgtcttgcgcgattagaaccaattttgtgtttgatgtagcgtagttgtacacttcctacaatgtttctatcataatcacaccgtattttgattgcaatggtaatctctcatcgaaagatagctgttatcatcatctagagctgcaatcttttctatctacttataaagattggagtt

SEQ ID NO: 5223 - DNA, 2256 bp, Avena sativa
ggccttcttgtgcccatcgcggtctctcttctgctccagaaaaggagaaaggttgaaaagaaaagaggggtgccagttgatgttggtggagagcctggctatgcgatccgcaaccatcgatttgaacatcccgttgaaacgcactgggaaggggtaaccacacttgctgagttatttgagcatgcttgcaaggagtatgtctacatgcccctccttggcaccaggaagctcatttcaagagaaatagaatcatcgcctgatgggaggtcctttgagaagcttcatctgggggaatatgagtggaaatgttacgctgaggcctttaagagtgttagcaacttttcatcaggattgattcaattaggtcaccagaaggatgagcgtgttgctatttttgctgagacacgggcggagtggcagattgcactccaggcatgcttcagacaaaacatatcagttgtcaccatctatgcctccttgggggaggaagcactatgccactcactaaatgagactgaggtcacaactgtggtgtgtggtcagaaggaatttaagaagttgattgatataggttggcaacttgacactgttaagcgtgtgatctacatcaatgaggaaggcatctcagctgaagtttctctagctaaaaacagcactagctggacagttgcgtcatttgaggaagtatgcaaattaggaattgaagcacctattgatgcaaacatgcctctcccatctgatgttgcagtgataatgtacacaagtggaagcaccggattgcccaagggagttatgatgacccaccgcaatgtcctggctacactttcagcagttatgacaattgtgcctgaactcggcaaaaaggatatatacatggcctaccttccacttgcgcacattcttgagttggcagctgagacgcttatggctgctgtcggggcctccattggatatgggtcagctttgaccttgactgatacatcaagtaaaattaaaaaagggactctaggtgatgcttctgcactgaagccaacactgatgactgctgtacctgctatacttgatcgtgtccgtgatggtgtgaggaaaaaggtggatgcaaatggtggtgtagccaagaaattgtttgacattggctatagtcgtcggcttgctgccatgaatggaagttggcttggtgcatggggagtagagaaactgttgtgggataggctagtcttcaccaaggtgcgtgcaatattgggaggaaagattcgctttgtactgtcaggtggagcacctctgtccggagatacacagagatttatcaatatatgccttggggctccaataggccaagggtatggcctgactgaaacttgtgctggaggaacattttctgagtatgatgacacatctgttggtcgtgttggtgctccactaccttgttcatacattaagttgattgactgggctgaaggtggatacttaacaactgattcaccaatgcctcgcggggagatagtcataggaggccccaatgtaactaagggctatttcaagaatgaagctaaaacaagtgaagtctataaggatgacgaaagaggtctgcgatggttctattctggtgacatcggtcgttttcatccagatggctgccttgaaatcattgaccgcaagaaagacatcgtaaagcttcagcatggtgaatatgtatctcttgggaaggtggaagctgcgttggctatgagcccgtatgttgagaacatcatgatccatgccgatcctttcaacagttactgtgttgcactggtggtagctgcgcagagcgagctggaaaagtgggcatcgcagcaacgacttgcatacagtgacttctgtgatttgtgccagaagcaagaggctgttaaagaagtgcttggatctctagcaacggttgcgaagcaagcacgactggagaagtttgagacgccagccaaagtcaagctgataccagatccatggactcctgagtcaggccttgtcacggctgctctcaagctcaagagggaggtgatcaggaagaagtatgagaacgatctggctgagttgtacgcttgatagtcttggtactctttctgatggacatagataaaactgttttgccgacacctagtatattgataaattttgatgtcggggtagattgatcattgagggagtatgattggcttccgtgggagaaatctgaattttgaagttgtcttttcgtattctgagaagcaattttgtgtttgg

SEQ ID NO: 5224 - DNA, 2518 bp, Brachypodium distachyon
agggaccagacggagccgcccgagagcacagcaacagcctctctctctcttcctcctcctccatccttctccctctccgatcgctcctcctcctcctccgcgtgggcgtcgcgcctccgcccccgccgccgcccccgcgcaccctcgctccacaaaggtttctcgctttaaggcatctgcaatctgtggcacacctttcataagctagtatatatagctgccagatcacccttccacaagtatgaatccttatttcgttggctttcttgtgcccatcgtggtatctcttctgctccagaaaaggagaaaggtcggaaataagagaggggtgccagttgatgtcggtggagagcctggctatgctatccgcaaccatcgatttgaacatcccgttgaaacgcattgggaagggatcaccacacttgctgagctgtttgagaagtcctgcaatgaatatctccacatgcccctccttggcaccaggaagctcatttcaaaggaaatggaatcatcgcctgatgggaggtcctttgagaagcttcatctgggggagtacgaatggaaatgctatgctgaggccttcaagagcgtttgtaacttttcatctggactgattcggtcaggtcaccagaacaatgagcgtgttgctgtttttgctgagacacgggccgaatggcagattgcactgcaggcatgcttcagacaaaacataacagttgtcaccatctatgcctccttgggggaggaagcactatgccactcactaaatgagacagaggtcactactgttgtatgtggtcagaaggaattgaagaagttgattgatataagttggcaacttgacactgtcaagcgtgtgatctacatcaatgaggaaggcatctcagctgaactttctctagctcgaaatagcactagctgggcacttgagtcatttgatgaaatagatagattaggaagtgaagcacctgttgatgcaagcatgcctctcccatctgatgttgcagtgataatgtacacaagtggtagcactggattgcccaagggagttatgatgacacaccgcaatgtcctggctactctttcagctgttatgaccgttgtgcctgaactaggcagaaaggatatttacatggcctacctcccacttgcacacattcttgagttggcagctgaggcacttatggctgctgttggggcctccataggatatggatcagctttgaccctgactgacacatcaagcaaaataaaaaagggaactctaggtgatgcttctgcactaaagccaacactgatgactgctgtacctgctatacttgatcgtgtccgtgatggtgtgagaaaaaaggtagatgcaaagggtggtgtggtgaagaaattatttaacattggttataaccgtcggctttctgctatcaacggaagttggctgggtgcatggggagtagagaaattgctgtgggataggctcatcttcacaaatgtgcgtgcaatattgggaggaaagattcgttttgtactctcaggtggagcacccctgtccggagatactcagagatttatcaatatatgtcttggggctccaataggccaagggtatgggctgactgaaacttgtgctggagcaacattttccgagtatgatgacacatctgttggacgtgttggtgctccactgccttgttcatatattaagttgatcgactgggctgaaggtggatacttaacaactgattcaccaatgcctcggggggaaatagtcattggaggtcccaatgtaactaagggttatttcaagaatgaagctaaaacgaatgaagtctataaggaggacgaaagaggtctgcgatggttctattctggtgacatcgggcgtttccacccagatggctgccttgaaatcattgaccgtaagaaagatatcgtgaagcttcagaatggtgaatatgtatctcttggaaaggtggaagctgcgctggctatgagcccgtatgttgagaacatcatggtccatgctgatcctttccacagttactgtgttgcacttgtggtagctgcacgtaatgagctagaaaagtgggcactccagcaaggagttacatacactgatttcacagaattgtgccagaataaagaggctgttcaagaagtgcttggatctttagcgcaggctgcgaagcaaacacgactggagaagttcgagatgccagccaaagtcaagctgatatccgacccatggacccccgagtcgggcctcgtcacagctgccctcaagctcaagagggaggtacttaggaagaaatacgaggacgatctggctcagttgtacgcctgatggttctgcctgattccctcatctaagtgacgtagaacagagctcggtattgataaattgtgatgtcgaggtaaattgatcatctgagagagtagatttgctgtctaggggatgtttcccttacgctgagaagcaattttgttcttaaagtgcctagttttgcacttcacttcccaccag

SEQ ID NO: 5225 - DNA, 2546 bp, Oryza sativa
cgcctcccccccgtatttctctccgccccccacccgccacctacctgccattgcactctcctcctcctctgcctctcccggaggccgcctcctccgccggtgagtgacacagatcagtgccgacactccgcggactagtagctttgtgtaaggctgggaaatatgaatccttatttcatcggcttcgctatcccttttctggcatctctgctgttcaccaagaggaagggtgaaaagaaaaggggagtgccggttgatgtgggcggagagcccggctatgtgatccgtaaccacaagttcgagcggcccgttgaaacgcactgggaaggggtttccacgcttgcggagctgtttgagcagtcctgcgagcagtatgtctacatgccactccttggcaccagaaagctcatttcgagggaaatggaggcagcccgcgatgggaggtcctttgagaagcttcatttggggcagtatgagtggaaaagctatgctgatgcattcaagactgtctgcaacttctcatctggtttagtgcgaattgggcaccagagggatgagcgtgttgctattttcgccgatacacgggccgagtggcagattgcattgcaggcatgcttcagacaaagtattacggttgtcaccatttattcctccttgggcgagggagcgttatgtcactcactaaacgagactgaggtaactactgtgatatgtggaaggaaagaactgaaaaaacttcttgacataagtgggcaacttgatactgtgaaacatgtcatctacgtaaacgaggaaggcgtctctagtgaagtatccttagctcaaaaatgcaccagctggagggttgagtcatttgaggaggtagagaggttaggattggaaacacctgtagaagcaaagctgcctcttccgtcagatactgcggtgataatgtatacaagtggcagcactggaatgcccaagggagtcatgatgagccatcgcaatgtcctggctgttgtatcagctgttatgaccattgtgcctgcacttggcaagaaggatgtctacttggcatacctcccattagcacacattcttgaattagcagctgagacagttatgtctgctgttggggcttctatagggtatggatcaccactgaccctgactgatacatcaaataaaataaagaaggggactcagggcgatgcttcagctctgaagccaacacttatgactgcagtacctgctatacttgatcgtgttcgtgatggtgttagaaaaaatgttgatgcaaagggtggtgcagcaaagaaactatttgatattgcctatagccgtcggttagctgctatcaatggaagttggtttggtgcatggggattagagaagcatttgtgggatatgcttgtctttcagaaggtgcgtgcgatcttgggaggaaggattcgatttatactttcaggtggagcacctctgtctggagatactcagagatttatcaatatatgccttggggctccaatagggcaaggatatggtcttactgaaacatgtgctggcgggacattttccgagtatgatgacaattctgttggccgtgttggtgctccattgccttgctcatacattaagttgatagattgggctgaaggtggatatttaactaatgattcaccaatgcctcggggtgaaatagttattggaggtccaaacgtgacaaaaggctactttaagaatgaggcaaaaacaaatgaagtctacaaggatgatgaaagaggcatgcggtggttctattctggtgacattggacgtttgcatccagatggttgccttgaaattattgaccgtaagaaggacatagtcaagcttcaacatggtgaatatgtatctttaggaaaggtggaggctgctttgagtgtgtgcccatatgttgacaacatcatgatccatgctgaccccttccacaactactgcgttgcacttgttgtagttgcacacagtgaactgaaaagctgggcctcacaacaaggcatcacgtattcggatgtttcagatttgtgtgagaagcaagagactgtcaaagaagtccttcaatgtttagcaaaggctgccaagcaagcgcggctggagaagtttgagatcccagccaaagtcaagctggtgccggagccatggaccccagagtcaggactcgtcacggctgccctcaagctcaagagggaggccatcaagaaggcgtacgaggatgaccttgcggcgttatacagctaaagttgccgctgcattctgtttttctgatactgaagaaaaatcaacagcacgagttctgtctcgtggcaataacaaaattttctttcctagtttcgaaacatccaaaaaccactgtttttgcaatggcatcagtgggtagcgatgaaacagatgtaggtcaatgcatttggaagaagcattcctgaaatggggaacaggtagatttggaattctgtggtattggccttgtttcttgtaaattacctgagattttcttagctctttgagaggttatctgagattttcggtac

SEQ ID NO: 5226 - DNA, 2469 bp, Oryza sativa
gaaaagtcaattgcagatcagtgccgacactccgcggactagtagctttgtgtaaggctgggaaatatgaatccttattttatcggcttcgctatcccttttctggcatctctgctgttcaccaagaggaagggtgaaaagaaaaggggagtgccggttgatgtgggcggagagcccggctatgcgatccgtaaccacaagttcgagcggcccgtcgaaacgcactgggaaggggtttccacgcttgcggagctgtttgagcagtcctgcgagcagtatgtctacatgccactccttggcaccagaaagctcatttcgagggaaatggaggcagcccgcgatgggaggtcctttgagaagcttcatttggggcagtatgagtggaaaagctatgctgatgcattcaagactgtctgcaacttctcatctggtttagtgcgaattgggcaccagagggatgagcgtgttgctattttcgccgatacacgggccgagtggcagattgcattgcaggcatgcttcagacaaagtattacggttgtcaccatttattcctccttgggcgagggagcgttatgtcactcactaaacgagactgaggtaactactgtgatatgtggaaggaaagaactgaaaaaacttgttgacataagtgagcaacttgatactgtgaaacatgtcatctacgtaaacgaggaaggcgtctctagtgaagtatccttagctcaaaaatgcaccagctggagggttgagtcatttgaggaggtagagaggttaggattggaaacacctgtagaagcaaagctgcctcttccgtcagatactgcggtgataatgtatacaagtggcagcactggaatgcccaagggagtcatgatgagccatcgcaatgtcctggctgttgtatcagctgttatgaccattgtgcctgcacttggcaagaaggatgtctacttggcatacctcccattagcacacattcttgaattagcagctgagacagttatgtctgctgttggggcttctatagggtatggatcaccactgaccctgactgatacatcaaataaaataaagaaggggactcagggcgatgcttcagctctgaagccaacacttatgactgcagtacctgctatacttgatcgtgttcgtgatggtgttagaaaaaatgttgatgcaaagggtggtgcagcaaagaaactatttgatattgcctatagccgtcggttagctgctatcaatggaagttggtttggtgcatggggattagagaagcatttgtgggatatgcttgtctttcagaaggtgcgtgcgatcttgggaggaaggattcgatttatactttcaggtggagcacctctgtctggagatactcagagatttatcaatatatgccttggggctccaatagggcaaggatatggtcttactgaaacatgtgctggcgggacattttccgagtatgatgacaattctgttggccgtgttggtgctccattgccttgctcatacattaagttgatagattgggctgaaggtggatatttaactaatgattcaccaatgcctcggggtgaaatagttattggaggtccaaacgtgacaaaaggctactttaagaatgaggcaaaaacaaatgaagtctacaaggatgatgaaagaggcatgcggtggttctattctggtgacattggacgtttgcatccagatggttgccttgaaattattgaccgtaagaaggacatagtcaagcttcaacatggtgaatatgtatctctaggaaaggtggaggctgctttgagtgtgtgcccatatgttgacaacatcatgatccatgctgaccccttccacaactactgcgttgcacttgttgtagttgcacacagtgaactgaaaagctgggcctcacaacaaggcatcacgtattcggatgtttcagatttgtgtgagaagcaagagactgtcaaagaagtccttcaatgtttagcaaaggctgccaagcaagcgcggctggagaagtttgagatcccagccaaagtcaagctggtgccggagccatggaccccagagtcaggactcgtcacggctgccctcaagctcaagagggaggccatcaagaaggcgtacgaggatgaccttgcggcgttatacagctaaagttgccgctgcattctgtttttctgatactgaagaaaaatcaacagcacgagttctgtctcgtggcaataacaaaattttctttcctagtttcgaaacatccaaaaaccactgtttttgcaatggcatcagtgggtagcgatgaaacagatgtaggtcaatgcatttggaagaagcattcctgaaatggggaacaggtagatttggaattctgtggtattggccttgtttcttgtaaattacctgagattttcttagctctttgagaggttatctgagattttcggtacaagagatgctgcaataggg

SEQ ID NO: 5227 - DNA, 2440 bp, Secale cereale
gcctcgccccaggtttaccctttcaaggcctctgagaatcagcatcgacgcgccttgagctacaatactattataagcctgtatttcaagaaacatgaatccttattttatcggttttgtcatcccgtttgtggcgtctctgatgcttaccaagaggaaggctgagaagaaaaggggcctgcccgtcgatgtgggtggtgagcctggctatgccatccgtaactacaggtccgaacagcctgtcgaaacgcactgggaagggattttcacgctcgcggagcttttcgaacagtcctgcaagcagtatgcctacatgcccctgcacggcaccaggaagctcatttcaagggagacagaggtagctgctgatggaagatcattcgagaagctccatttgggggagtatgagtggaaaagttacattgaagcattcaaggctgtatgcaacttctcatccggtctgatgcaaattgggcacctgaaggatgagcgtgttgctatctttgctgatacgcgggctgagtggcagattgcgttgcaggcatgcttcagacaaagcattacagtggtcaccatttatgcctccttgggggagggagcactttgtcactcactaaatgagactgaggtaactactgtgatctgtgggcggaaagaactaaaaaagcttattgatataaatgggcaacttgatactttgaaacatgttgtctacataaatgaggaaggtgtctcaagtgaagtatccttggctaaacaatgtaccagctggagagtcgagtcatttgaggaggtagagagactagggttggaaacacctattgaagcaaatttgcctctcccatctgatacagcagtgataatgtacacaagtggaagcactggaatgcccaagggtgtcatgatgagccaccgtaatgtcctggctactgtatcagctgttatgactattgtgcctgcacttggcaagaaggatgtctacctggcatacctcccgcttgcacacattcttgagttggcagctgagacgattatatctgctgtcggggcttctataggatatggatcacctttgaccctgactgatacatcaaataaaatcaaaagggggactcaaggtgatgcctctgcgctgaagccaacacttatgactgcggtacctgctatacttgaccgtgtccgtgatggcgtacgaaaaaatgtagatgcaaagggtggtgcagccaagaaattatttgatatcgcctacagccgtcggctagctgctgtcaatggaagttggtttggtgcatggggattagagaagctagtgtgggatatgcttgtcttccagaaggtgcgtgcaatcttgggaggacggattcgctttatactctcaggcggagcacctctgtctggtgaaactcagagatttatcaatatatgccttggcgctccaatagggcaaggatatggtctgactgaaacgtgtgctggcgggacattttctgagtataacgacacatctgttggtcgtgttggtgctccactgtcgtgttcgttcatcaagttgatagactgggtcgaaggtggatacttaacatctgattcaccaatgcctcgcggagaaatcgtcattggaggcccaaatgtaaccaaaggctatttcaaaaatgaggccaaaacaaatgaggtctacaaggatgatgagagaggcatgaggtggttctactccggtgacatcggtcgtttgcacccagatggctgcctcgaaatcattgacaggaagaaggatatagttaagcttcaacatggtgaatatgtatcactaggaaaggtggaggctactttgagtgtgagcccgtatgttgacaacatcatggtccacgccgacccctcccaaaactactgtgttgcacttgttgtagctgcgcacggtgagctagaaaactgggcctcaaaacaagggattgcatactctgatttcgccaatctgtgccagaagcaagagactatcaaagaagttctacagtcgttggcaaaggctggtaagcaatcgcggctggagaagtttgagatccctgccaggatcaagctgataccggagccatggacccccgaatcgggtctcgtcactgctgccctcaagctcaagagggaagtcatcaagaagggttatcaggacgatcttgctaagctgtacagatagtgtccctttgttagggagaacaaattcctcatatgtgttgtgtttcagacagtggacagatagtatcccgttgttggcaagaacaaaacttctcatatgtgttgtgtttcaagcagtggatcgaaacagacagtatattcaactctagtatgtgtattatgatttaccattgcatttcagctactaacgatcctgttctcctcagtttaacttctcatggaacatccctgaatcttagtgtcaaaaaaagtc

SEQ ID NO: 5228 - DNA, 2701 bp, Secale cereale
gctagtactactggcagcagatcgccgcggagatccctaaacccccgcagtcctgcaccgccagaacagctccaccctccagccacccaccatcctccgacggcgccacctccttgggtcctccgccccgccgtccttgccgtcgccgtcacttccatctccccctctctccgcctgctcccctcctccccctactactcctcgccacccgcattgcaacatttgcacccttcctcaacctctccagagccttcccctgctccccggccggccgagcctcgccccaggtttaccctttcaaggcctctgagaatcagcatcgacgcgccttgagctacaatactattataagcctgtatttcaagaaacatgaatccttatttcatcggttttgtcatcccgtttgtggcgtctctgatgctcaccaagaggaagactgagaagaaaaggggcctgccagtcgatgtgggtggtgagcctggctatgccatccgtaactacaggtccgaacagcctgtcgaaacgcactgggaagggattttcacgcttgccgagcttttcgaacagtcctgcaagcagtatgcctacatgcccctgcatggtaccaggaagctcatttcaagggaaacagaggtggctgctgatggaagatcattcgagaagctccatctgggggagtatgagtggaaaagttatattgaagcattcaaggccgtatgcaacttctcatccggtctgatgcaaattgggcacctgaaggatgagcgtgttgctatctttgctgatacacgggctgagtggcagattgcgctgcaggcatgcttcagacaaagcattacagtggtcaccatttatgcctccttgggggagggagcactttgtcactcactaaatgagactgaggtaactactgtgatctgtgggcggaaagaactaaaaaagcttattgatataaatgggcaacttgatactttgaaacatgttgtctacataaatgaggaaggtgtctcaagtgaagtatccttggctaaacaatgtaccagctggagagtcgagtcatttgaggaggtagagagactagggttggaaacacctattgaagcaaatttgcctctcccatctgatacagcagtgataatgtacacaagtggaagcactggaatgcccaagggtgtcatgatgagccaccgtaatgtcctggctactgtatcagctgttatgactattgtgcctgcacttggcaagaaggatgtctacctggcatacctcccgcttgcacacattcttgagttggcagctgagacgattatatctgctgtcggggcttctataggatatggatcacctttgaccctgactgatacatcaaataaaatcaaaagggggactcaaggtgatgcctctgcgctgaagccaacacttatgactgcggtacctgctatacttgaccgtgttcgtgatggcgtacggaaaaatgtagatgcaaagggtggtgcagccaagaaactatttgatatcgcctacagccgtcggctagctgctgtcaatggaagttggtttggtgcatggggattagagaagctcgtgtgggatatgcttgtcttccagaaggtgcgtgcaatcttgggagggcggattcgctttatactctcaggcggagcacctctgtctggtgaaactcagagatttatcaatatatgtcttggcgctccaatagggcaaggatatggtctgactgaaacgtgtgctggcgggacattttctgagtataatgacacatctgttggtcgtgttggtgctccactgtcgtgttcgttcatcaagttgatagactgggtcgaaggtggatacttaacatctgattcaccaatgcctcgcggagaaatcgtcattggaggcccaaatgtaaccaaaggctatttcaaaaatgaggccaaaacaaatgaggtctacaaggatgatgagagaggcatgaggtggttctactccggtgacatcggtcgtttgcacccagatggctgcctcgaaatcattgacaggaagaaggatatagttaagcttcaacatggtgaatatgtatcactaggaaaggtggaggctactttgagtgtgagcccgtatgttgacaacatcatggtccacgccgacccctcccaaaactactgtgttgcacttgttgtagctgcgcacggtgagctagaaaactgggcctcaaaacaagggattgcatactctgatttcgccgatctgtgccagaagcaagagactatcaaagaagttctacagtcgttggcaaaggctggtaagcaatcgcggctggagaagtttgagatccctgccaggatcaagctgataccggagccatggacccccgaatcgggtctcgtcactgctgccctcaagctcaagagggaagtcatcaagaagggttatcaggacgatcttgctaagctgtatagatagtgtccctttgttagggagaacaaattcctcatatgtgttgtgtttcagacagtggacagatagtatcccgttgttagcaagaacaaaacttctcatatgtgttgtgtttcaagcagtggatcgaaacagacagtatattcaactctagtatgtgtattatgatttaccattgcatttcagctactaacgatcctgttctcctcagtttaacttctcatggaacatccccaaaaaaaaa

SEQ ID NO: 5229 - DNA, 2842 bp, Brachypodium distachyon
agactactgcattgacccggccggccggcagctcagctcagctcagctcaaggtgttgttcgtccgcgagcaaaatcgcggagatcccaaaaccctccaggccccagcgtgcgccgtaggttaccccgccccgccccgtcgctgccgccgccgccaatttcctttcttttcctcgtccccgccgcctgcattacttctctgcattaccggtgccgaccattgccctcacgcagctccccccaaagcttccaccgggtacagtggtttgtcatttcaagacctctgcgaatcaatatcgatattccttgagctgcagatagtattaaggctgtatttcgagaaacatgaatccttacttcatcggttttgttgtcccttttgtggcatctcttctgtttaccaagagaaaggctgaaaggaaaaggggagtgccagttgatgtgggtggagagcctggccatgctatccgtaactatcgattcgaacagcctgtcgaaacacactgggatgggattttcacactcgcggagctattcgagcaatcctgcaagcagtatgtccacatgcccctgcttggcacaaggaaactgatttcaagggaatcagaggtagcttctgatggaagatcctttgagaagctccatttggggcagtatgagtggaaaagttacagtaaagcattcaaggctgtctgcaacttttcatctggtcttgtgcgaattggtcacctgcgggatgagcgtgttgctatctttgctgatactcaggctgagtggcagatggcgctgcaggcatgcttccgacaaaatattacagttgtcaccatttatgcctccttgggggaaggagcactttgtcactcactaaatgagactgaagtaaccacggtgatctgtggacggaaagagttgaaaaagcttattgatataaatggtcaacttgatactttgaaacatgttgtctacataaatgaggaaggtgtctcaagcgaagtatccttggctaaacaatgcactagatggagagtggagtcatttgaggaggtagagaggttaggattggaaacacctgtccaagcaaatttgcctctcccatctgatacagcggtaataatgtatacaagtggcagcactggaatgcccaagggtgtcatgatgagccaccgcaatgtcctggctacagtatcagctgttatgactattgtgcctggacttggcaagaaggatgtctacttggcgtacctcccactagcacacatccttgagttggccgccgagacggttatattggctgttggggcttctataggatatgggtcacctttgaccctgaatgatacatcaaataaaattaaaaggggaactcagggtgatgcttctgcactgaagccaacacttatgactgctgtacctgctatacttgaccgtgttcgtgacggcgtaagaaaaaatgtagatgcaaagggtggtctagcaaagagactatttgatatcgcgtacagccgtcggctcgctgctgttaacggaagttggtttggtgcatggggattagagaagctcttgtgggatgtgctcgtcttccagaaggtgcgtgcaatattgggaggacagattcgctttatactttcaggtggagctcctctgtctggagatactcagagatttatcaacatatgccttggggctccaatagggcagggatatggtctgactgaaacatgtgctggtgggacattctctgaatacgatgacacatctgttggtcgcgttggtgctccactatcttgctcatacattaagttgatagactgggtcgaaggtggatacttaacaactgattcaccaatgcctcgtggagaaatagttattggaggcccaaatgtgaccaaaggctacttcaaaaatgagacaaaaacaaacgaagtctacaaggatgacgaaagaggcatgaggtggttctactccggtgacattgggcgtttgcatccagatggctgtctcgagatcattgaccgtaagaaggatatagtaaagcttcaacatggtgaatatgtgtctctaggaaaggtggaggcttctttgagtctgagtccatatgttgacaacatcatggttcatgctgacccctcccagaactactgtgttgcacttgtcgtagctgcgcacagcgagttggaaaactgggcctcgaaacaagggatcacatacaccgatctttccgatttgtgccagaagcaagtggctgtcaaggaagttcttcagtcgctagtaaaggctggtaagcagtcgcgactggagaagtttgagattccagccaggatcaagctgataccggagccatggaccccagaatcgggcctcgtcacggcggccctcaagctcaagagggaggtcatcaagaagggctacgggacggatcttgcccagctgtacagctagtgttccttgttggcaagaacgaaatccgcccctttcattcgacgtttcgtaccgcaggttctgtgaatacaacagtggacagttatgaaacagacagtatgtgagatggccaagcttgtgtgctccatgcacatttgatactggaacctgaaatgtggaattagtgatttcttgcgtttcagcaagcataccttgatacctgttctcagctcagcgtcagctttgatggaatatctctgaatcttgctgtcaggagtcacatatgacttgctactaaataaaatacactggatatgtaggtttcggatatttgttatttctgagtaggttatctccagatgtgtttcgtaacagttaacagaggaaaaacaaatcttgatttgattggtttgctgcctaaaaaa

SEQ ID NO: 5230 - DNA, 2593 bp, Triticum aestivum
ccctcctactactccccgccacccgcactgcaacatttgcacccttcctcaacctctccgtagccctcccctgcttcccggccggccgagcctcaccccaggtttatcctttcaaggcctctgagaatcagcatcgacgcgccttgagctacaaaaatattataagcctgtatttcaagaaacatgaatccttattttatcggttttgtcatcccgtttgtggcatctctgatgcttaccaagaggaaggctgagaagaaaaggggcctgccagtcgatgtgggtggcgagcctggctatgccatccgtaactacaggtccgaacagcctgtcgaaacgcactgggaaggggttttcacgctcgccgagctattcgaacagtcctgcaagcagtatgcctacatgcccctgcatggcaccaggaagctcatttcaagggaaacagaggtagcagctgatggaagatcattcgagaagctccatctgggggagtatgagtggaaaagttacattgaagcattcaaggctgtatgcaacttctcatccggtctgatccaaattgggcaccagaaggatgagcgtgttgccatctttgctgatacgcgggccgagtggcagattgcgttgcaggcatgcttcagacaaaacattacagttgtcaccatttatgcctccttgggggaaggagcactttgtcactcactaaatgagactgaggcaactactgtgatctgtgggcggaaagaactaaaaaagcttattgatataaatgggcaacttgatactttgaaacatgttgtctacataaatgaggaaggtgtctcaagtgaagtatccttggctaaacaatgcactaactggagagtcgagtcatttgaggaggtagagaggctagggttggaaacacctattgaagcaaatttgcctctcccatctgacacagcagtgataatgtacacaagtggaagcactggaatgcccaagggtgtcatgatgagccaccgcaatgtcctggctacagcatcagctgttatgactattgtgcctgcacttggcaagaaggatgtctacttggcatacctcccgcttgcacacattcttgagttggcagctgagacgattatatctgctgtcggggcttctataggatatggatcacctttgaccctgactgatacatcaaataaaatcaaaagggggactcaaggtgatgcctctgcgctgaagccaacacttctgactgcggtacctgctatacttgaccgtgttcgtgatggcgtacgaaaaaatgtagatgcaaagggtggtgcagcgaagaagctatttgatatcgcctacagtcgtcggctagctgctgtcaatggaagttggtttggtgcatggggattagagaagctcgtgtgggatatgcttgtcttccagaaggtgcgtgcaatcttgggaggacggattcgctttatactctcaggcggagcacctctgtctggtgaaactcagagatttatcaatatatgccttggcgctccaatagggcaaggatatggtctgaccgaaacatgtgctggcgggacattttctgagtataatgactcgtctgttggtcgtgttggtgctccactgtcttgttcattcattaagttgatagactgggtcgaaggtggatacttgacatctgattcaccaatgcctcggggagaaatagttattggaggcccaaatgtaaccaaaggctatttcaaaaatgaggccaaaacaaatgaggtctacaaggatgatgagagaggcatgaggtggttctactccggtgacattgggcgtttgcacgcagatggctgcctcgaaatcatcgaccggaagaaggatatagttaagcttcaacatggtgaatatgtatcgctaggaaaggtagaggccactttgagtgtgagcccgtatgttgacaacatcatggtccacgccgacccctcccaaaactactgtgttgcacttgttgtagctgcacacggtgagctggaaaactgggcctcaaaacaagggattgtatactctgatttcgccgatctgtgccagaagcaagagactgtcaaagaagttctgcagtcgttggtgaaggctggtaagcaatcgcggctggagaagtttgagatccctgccaggatcaagctgataccggagccatggacccccgagtcgggtcttgtcaccgctgccctcaagctcaagagggaggtcatcaagaagggttatcaggacgatcttgctaagctgtacagatagtgtcccttttgttagggagaacaaaattcctcatctgtgttctgtttcagacagtggaacagatagtgtcccttcgttagcaagaacaaaacttctcatatgtgttgtgtttcaaacagtgaaacagtggatcggaacagacagtatattgaacactgtgtacttgatgatttaccattgcatttcagctagcgatcctgttctcctcagttaaacttctcatggaagttccctgaatcttgctgtcatgattcacatacgagttactgctacacaaggatgtgtaggttctgggtattagttatctctgtaaatt

SEQ ID NO: 5231 - DNA, 2564 bp, Setaria italica
gaaaagaaaaggccgccagccctcggcggcgccggcgtctttggaacctccgcccgccgcaccctcgccttatttccctctcctgcctctctctgcctctccgcctgctcctgcctgccaccctgcattgcgcgcgcgcaggtttcagactcccgagacctctgcctatcagtttcgagtattgacactcgataagctggaagcaacataaggctattcttttgagaaatatgaatccctatttctttggtttcattctcccttttgttgcgtctctgctgctcaccaagaggaaatctgagaagaagaggggagtgccggtcgatgtgggtggagagcctgggtgcgccgtccgcaaccacagatttgaacggcccgtcgaatcgcactgggaaggggtttccacgcttgctgagctatttgagcaatcatgcgagcagttcgcctacatgcccctatatggcaccaggaagctcattgcaagggagttggaggtggctcctgacgggaggtcctttgagaagcttcatttggggaactatgagtggaaaagctatgctgatgcattcaagactgtgtgcaactttgcttctggcctactgagagttgggcatctgaaggatgagcgtgttgctatttttgctgatactcgggctgagtggcagattgcgttgcaggcgtgcttcagacaaaacattgcagttgtcacaatctattcctctttgggggagggagcgctatgtcactcactaaatgagactgaggtaactactgttgtctgcggacggaaggaactgaaaaagctggttgatataagtgggcaacttgacactgtgaaacatgtcatctacattaatgaagaaggtgtatcaactgaagtatccttggctgaaaaatgcactagctggaccattaagtcatttgaggaggtagagagcttaggactggaaaggcctgttgaagcaaacttgcctcttccatcagatactgcagtgattatgtatacaagtggcagcacaggaatgcctaagggagtcatgatgagccaccgcaatgtcttggctgtagtttcagctgttatgaccattgtgccttatcttggcaagaaggatgtgtatctggcataccttccactagcacatatccttgaattggcagctgaggcaatcataactggtgttggggcttcaataggatatggatcacctttgaccctgactgatacatccaataaaataaaaaaggggactcgaggtgatgcttctgcactgaagccaacactaatgactgctgtacctgctatacttgatcgtgttcgtgacggtgtacgaaaaaatgtagatgcaaagggtgggttagcaaagaaattatttaatatcgcctacagccgtcgtctagctgctgttaatggaagctggttgggtgcatggggactagagaagctcttgtgggatatgcttgtctttcagaaagttcgtgcaatcttgggaggaaggattcgctttatccttgcagggggggcacctttgtcaggggacactcagagatttatcaatatatgtcttggggctccaatatcgcaaggatatggtctgactgaaacttgtgctggtgggacattttcagagtatgatgaaacgtccgttggccgtgttggtcctcctctgccttgttcatacattaagttgatagactgggctgaaggtggatacttaacaactgattcaccaatgcctcggggtgaaatagttattggaggtccaaatgtaactaaaggctacttcaaaaatgaagcaaaaacaaatgaagtctacaaggatgatgaaagaggcatgcggtggttctactctggtgacattgggcgcttgcacccagatggctgtattgaaatcatcgaccgtaagaaggacattgtcaagcttcaacacggtgaatatgtatctctaggaaaggtggaggcagctttgagtgtgtgcccatatgttgaccagatcatgatccatgctgaccccttccacagctactgtgtcgcccttgttgtagctgcacacagcgagctgaaaggctgggcctcaaaacaaggaatcacgtatcgtgattttgcagatttgtgccagaagcaacagattgtcaaagaagtcctccaatctttggcaaaggctgctaaacaagcgcgactggagaagtttgagatcccagccaaaatcaagctcataccggaaccatggacgccagagtcaggcctcgttacggctgccctcaagctcaagagggagataattaagaaggcatacgagaaggaccttgcccagttgtacagctagtggcgctcccactagcttttctcaagaatttcgtgtttgttccagttgtagtatgttttgaacagctgtttttgtgaagagaatagctgaggttgtaagaagtgagatcgacgcaggtgattcagtcgccaataatgtgcagtgtattcccagaaagccactaactggtggaattaaggattcctttcacacctaagagcaaccgtgttcttagcaggctatctgcacattttggttgaa

SEQ ID NO: 5232 - DNA, 2565 bp, Pennisetum glaucum
caaaagaaaaggccggccaacctcggcggcgccggcgtctttggaacctccgcccgccgccaccctcgccttatttccctctcctccctccctctgcctctccgcctgctgcctgccagtctgccacctgcattgcacgctcgcaggtttcagactcccaagaactctgctagttagtatctgcgtattgacacttcataagctggaagcaatataaggttgtttttgaggaatatgaatccgtatttctttggtttcatcctcccttttgtcgcgtctctgctgctcaccaagaggaaatctgagaagaagaggggagtgccggtcggtgtgggcggagagcctggctgcaccatccggaaccacagatttgaacggcccgtcgaatctcactgggaaggggtttccacgcttgctgagctatttgagcaatcatgtgagcagttcgcctacatgcccctgtatggcaccaggaagctcattgcaagggaattggaggtagcccctgatggaagatcctttgagaagctccatttaggaaattatgagtggaaaagctatgccgatgcgttcaagactgtgtgcaactttgcttctggcctactgcgagttgggcatctgaaggatgagcgtgttgctatttttgctgatactcgggctgagtggcagattgcgttgcaggcatgcttcagacaaaacattgcagttgtcacaatctatgcctctttgggggagggagctctatgtcactcactaaacgagactgaggtaactactgttgtctgcggacggaaagaactgaaaaagctggttgatataagtgggcaacttgacactgtgaaacatgtcatctacattaatgaggaaggtgtctcaactgaagtatccttggctgaaaaatgcactagctggactgttaagtcatttgacgaggtagagagcttaggattggaaaggccagttgaattaaatttgcctctcccatcagatactgcagtgattatgtatacaagtggaagcacaggaatgcctaagggagtcatgatgagccaccgcaatgtcttggctgtagtttcagctgttatgaccattgtgcctgatcttggcaagaaggataagtacctggcataccttccgctagcacatatccttgaattggcagctgaggcaatcataactggtgttggagcttcaatagggtatggatcacctttgaccctgactgatacatccaataaaattaaaaagggtacacaaggtgatgcttctgcactgaagcccacactaatgactgctgtacctgctatacttgatcgtgttcgtgatggtgtacgaaaaaatgtagatgcaaagggcggtttagcaaagaagttatttgatattgcctacagccgccgtctagctgctgttaatggaagctggttgggtgcatggggactagagaagctcttgtgggatatgcttgtctttcagaaggttcgtgcaatcttgggaggaaggatccgttttatccttgcagggggggcacctttgtcaggggacactcagagatttatcaatatatgtcttggggctccaatatcacaaggatatggcctgactgaaacctgtgctggtgggacattttcagagtatgatgaaacgtctgttggccgtgttggtcctcctctgccttgttcgtacattaagttgatagattgggccgaaggtggatacttaacaactgattcaccaatgcctcggggtgaaatagttattggaggtccaaatgtaactaaaggctacttcaaaaatgaagcaaaaactaatgaagtctacaaggatgatgaaagaggcatgcggtggttctactcgggtgacattgggcgcttgcacccagatggctgtattgaaattatcgaccgtaagaaggatattgtcaagcttcaacatggtgaatatgtatctctaggaaaggtggaggcagctttgagtgtgtgcccatatgttgatcagatcatgatccatgctgaccccttccacagctactgtgtcgcccttgttgtagcagcacacagtgagctgaaaggctgggcctcaaaacaaggaatcgcatatagtgattttgcagatttatgccagaagcaacagattgtcaaagaagtcctccaatctttggcaaaggctgctaaacaagcgagactggagaagtttgagatcccagccaaaatcaagctcataccggagccatggacgccggagtcaggcctcgttacagctgccctcaagctgaagagggagataattagaaaggcatacgacaaggaccttgcccagttgtacagctagtggcgctcccactagcttttctcaagaatttcatgtttgtttcagttgtagtatgttttgaatcgctgatttggttaagagaacagctgacgttgtaagaagtgagatcgacgcaggttaagcctcgtcatgcaggtgattcagtcgccaataatgtgcagtgtattcccagaaagccactaaacttgtggaattaaggattccttttcacacctaagagcaagtgtgttctagtac

SEQ ID NO: 5233 - DNA, 2468 bp, Triticum aestivum
aaatattataaggctgtatttcaagaaacatgaatccttattttatcggttttgtcatcccgtttgtggcgtctctgatgcttaccaagaggaaggctgagaagaaaaggggcctgccagtcgatgtgggtggtgagcctggctatgccatccgtaactacaggtccgaacagcctgtcgaaacgcactgggaagggattttcacgctcgccgagcttttcgaacagtcctgcaagcagtatgcctacatgcccctgcacggcaccaggaagctcatttcaagggaaacagaggtagctgctgatggaagatccttcgagaagctccatatgggggagtatgagtggaaaacttacattgaagcattcaaggctgtatgcaacttctcatcaggcctgatccaaattgggcaccagaaggatgagcgtgttgctatctttgctgatacgcgagctgagtggcagattgcgttgcaggcatgcttcagacaaaacattaccgtggtcaccatttatgcctccttgggagagggagcactttgtcactcactaaatgagactgaggtaactactgtgatctgtggacggaaagaactaaaaaagcttattgatatcaatgggcaacttgatactttgaaacatgtcgtctacataagtgaggacgatgtctcaagtgaagtatccttggctaaacaatgcactaactggagagttgagtcatttgaagaggtagagaggctagggttggaaacacctatcgaagcaaatttacctctcccatctgatacagcagtgataatgtatacaagtgggagcactggaatgcccaagggtgtcatgatgagccatcggaatgtcttggccacagcatcagctgttatgactattgtgcctgcacttggtaagaaggatgtctacttggcgtaccttccgcttgcgcacattcttgagttggcagctgagacgattatatctgctgttggggcttctataggatatggatcaccattgaccctgactgatacatcaaataaaattaaaagggggaccaaaggtgatgcctctgcactgaggccaacacttatgactgcggtacctgctatacttgaccgtgttcgtgatggcgtgagaaaaaatgttgatgcaaagggtggtgtagccaagaaactatttgatatcgcctacagccgtcggctagctgctgtcaatggaagttggtttggtgcatggggattagagaagcttgtgtgggacatgcttgtcttccagaaagtgcgtgcaatcttgggaggccggattcgatttatactttcaggcggagcgcctctgtctggagaaactcagagatttatcaatatatgccttggggctccaatagggcaaggatatggtctaactgaaacgtgtgctggcgggacattctctgagtataatgacacatctgttggtcgtgttggtgctccactgtcttgttcgttcattaagttgatagattgggttgaaggtggatacttgacatctgattcaccaatgcctcggggagaaatcgttattggaggcccaaatgtaaccaaaggctatttcaaaaacgaggccaaaacaaatgaggtctacaaggatgatgagagaggcatgaggtggttctactccggtgacattggtcgtttgcacccagatggttgcctcgaaatcatcgaccggaagaaggatatagtgaagcttcaacatggtgaatatgtatcactaggaaaggtggaggctactttgagcgtgagcccgtatgttgacaacatcatggtccacgccgacccctcccaaaactactgtgttgcactcgttgtaaccgcgcacggtgagctagaaaactgggcctcaaaacaagggattgcatactccgatttcgccgatctgtgccagaagcaagagactgtcaaagaagttctacagtcgttggcaaaggctggtaagcaatcgcggctggagaagtttgagatccctgccaggatcaagctgataccggagccatggacccccgagtcgggtctcgtcaccgctgccctcaagctcaagagggaggtcatcaagaagggttatcaggacgatcttgctaagctgtacagatagtgtcccttttgttagggagaacaaaattcctcatctgtgttctgtttcagacagtggaacagatagtgtcccttcgttagcaagaacaaaacttctcatatgtgttgtgtttcaaacagtgaaacagtggatcggaacagacagtatattgaacactgtgtacttgatgatttaccattgcatttcagctagcgatcctgttctcctcagttaaaacttctcatggaacatccctgaatctagctgtcatgattcacatatgagttgcagctacacaaggatgtgtaggttctgggtattagttatctctgtaaattctttgaaacatcagcttttagaatgtac

SEQ ID NO: 5234 - DNA, 2395 bp, Sorghum bicolor
ggccttttgagaactgaagtttcactgtttcagatatcactctgaacttattaccaaacaatccttagtggaattctgtaacatgttttgtacaggtttctgactccaagacctctgcccaaaaaagtgttgcatattgatactcgataaggcagaagcaatatgaatccctatttcttgggtttcattctcccttttgtggcgtctctgctgctcaccaagaggaagtctgagaagaagaggggtgtgccagtcaatgtgggtggagagcctggctgcgccattcgtaaccacagatttgagaggcctgtcgagacgcgctgggaggggatttccacgcttgctgagctatttgagcagtcatgcaaacagtttgcctgcatgcccctgcttggtaccaggaagctcatcgcaagggaaatggtggtggccgccgacggaagatcctttgagaagctccatttgggaaattatgagtggaagagctatgctgatgcgttcaaaactgtctgcaacttcgcttctggtcttctgcggattgggcacctgaaagatgagcgtgttgctatttttgctgatacacgggctgagtggcagattgcgttgcaggcgtgcttcaggcaaaacattgcagttgtcacaatctatgcctctttgggggagggagcgctatgtcactcactaaatgagactgaggtaactactgttgtgtgcgggcggaaagaacttaaaaagctgattgatataagtgggcaacttgacactgtgaaacatgtcatctacattaatgaggaaggtgtctcggctgaagtatccttggctcaaaactgtactagctggaccgtcatgtcatttgaggaggtagagagcataggattgcaaagacctgtcgaagaaaacttgcctctcgcatcagatactgcagtgattatgtatacgagcgggagcacaggaatgcctaagggagtcatgatgagccaccgaaatgttttggctgtagtttcagctgttatgaccattgtgcctggtcttggcaagaaggatgtgtacctggcatatcttcccctagcacatatccttgaattggcagctgaggcaatcataactggtgttggggcttcaattggatatgggtcacctttgaccctgactgatacatcaaataaaataaaaaaagggacgcagggtgatgcttctgtactaaagccaacactaatgactgctgtacctgctatacttgatcgtgttcgtgatggtgtacgaaaaaatgtagatgcaaaaggtgggttagcgaagagattatttgatattgcctacagccgccgtctagctgctgttaatggaagctggttgggggcatggggactagagaagctcttgtgggatatgcttgtgttccaaaaggttcgtgcaatcttaggaggacggattcgctttattcttgcaggtggagcacctctgtcaggggacactcagagatttatcaatatatgtcttggggctccaatatctcaaggatatggcctgactgaaacttgtgccggtgggacattttcagagtacgatgaaacatctgttggccgtgttggtccccctctgccttgttcatacattaagttggtagactgggctgaaggtggatacttaacaactgattcaccaatgcctcgtggtgaaatagttattggaggtccaagtgtaactaaaggctacttcaaaaatgaagcaaaaacaaatgaggtgtacaaggttgatgaaagaggcatgcggtggttctactctggtgacattgggcgcttgcaccctgacgggtgtcttgaaattattgaccgtaagaaggacatagtcaagcttcaacatggtgaatatgtttctctaggaaaggtggaggctgctttgagtgtgtgctcatacgttgaccagatcatgatccatgctgaccccttccacaactactgtgtcgcgcttattgtagctgcacagagtgagttgaaaaactgggcctcaaaacaaggaatgacatatagtgatttctcagatttgtgccagaagcaagggacagtcaaagaagtcctccaatctttggtgaaggctgctaagcaagcacgactggagaaatttgagatcccagccaaaattaagttgataccagagccatggacgccggagtcaggcctcgttacggctgccctaaagctcaagagggaggtcatcaagaaggcatacgagatagaccttgcccagttgtacagctaatgacgctgccgctacaaggtgttccttggtagcaactggcagcaacagaagttgtttttgtagtacttcgtactagtatgtttgaaagcaccccttttttctttgaagacaacagttgactgttaagatgagagaatgg

SEQ ID NO: 5235 - DNA, 2402 bp, Zea mays
ccgcgccgtcctgccaccctgcgtttcatcacgctcgcaggtttctaacaccaaggcacctgccaataaattttgcctactggcactccatatattagaagcaatatgaatccgtatttcttgggattcattctcccttttgtggcatctctgctgcttaccaagagaaagtccgagaagaagaggggggtgccagtcaatgtgggtggagagcctggctgcgccatccgtaaccacagatttgaaagacctgtcaagacgcgctgggaggggatttccacgcttgctgagctatttgagcaatcgtgcaagcagtttgcctctacacccctgtttggcaccaggaagctcattgcaagagaaatggtagtggctgctgatggaagatcctttgagaagctccatttgggaaactatgagtggagaagctatgctgatgcattcaaaactgtctgcaatttcgcttctggtctactgcggattggacacctcaaggatgagcgtgttgctatttttgctgacacacgggctgagtggcagattgcgttgcaggcatgcttcagacaaaatattgcagttgtcacaatctatgcctctttgggggagggagcgctatgtcactcactaaatgagaccgaggtaactactgttgtatgtggacgaaaagaatttaaaaagctgattgatataagtgggcaacttgacactgtgaaacatgtcatctacattgatgaggaaggcatctcagttgaagtgtccttggctgaaaactgtactagctggacagtcaagtcatttgaagaggtagagagtataggcttgcaaagacctgttgaagcaaacttgcctctcccatcagatactgcagtgattatgtatacgagtggaagcacaggaatgcctaagggagtcatgatgagccaccaaaatgtcttggctgtagtttcagctgttatgacgattgtgcctggtcttggcaagaaggatgtgtacctggcatatcttcccctagcacatatccttgaattggcagctgaggcaatcataactggtgttggggcttcaataggttacgggtcacctttgaccctgactgatacatcaaataaaataaaaaaggggacgcaaggtgatgcttctgtactgaagccaacgctaatgactgctgtacctgctatacttgatcgtgttcgtgatggtgtacgaaaaaatgtagatgcaaaaggtgggttagcgaagagattatttgatattgcctatagccgtcgtctagctgctgtcaatggaagctggttgggtgcgtggggactagagaagcttttgtgggatatgctcgtcttccgaaaggttcgtgcaatcttgggaggacggattcgctttattcttgcaggtggagcacctctgtcaggggaaacacagagatttatcaatatatgtcttggggctccaatatctcaaggatatggcttgactgaaacctgtgctggtgggacattttcagagtatgatgaaacatctgttggtcgcgttggtccccctttgccttgttcatacattaagttgatagactgggccgaaggtggatacttaacaaccgattcaccaatgcctcggggtgaaatagttattggaggtccaaatgtaactaaaggctacttcaaaaatgaagcaaaaacaaatgaggtgtacaaggttgatgaaagaggcatgcgatggttctactctggcgacattgggcgcttgcacccagatggatgtcttgaaattatcgaccgcaagaaggatatagtcaagcttcaacacggtgaatatgtttctctaggaaaggtggaggctactttgagtgtgtgctcatacgttgaccagatcatgatccatgctgaccccttccacagctactgtgtcgcacttgttgtagctgcacagagtgagctgaaatcctgggcctcaaaacaaggaatgacatatagtgatttctcagatttgtgccacaagcaagggacagtcaaagaagtcctccaatctttggtgaaggctggtaagcaagcacggttggagaagtttgagatccctgccaaaatcaagctgataccggagccgtggacgccggagtcaggcctcgtcacggctgccctcaagctcaagagggaggtgatcaagaaggcatacgagatggaccttgcccagttgtacagtcagtgacctgccgctacagtttctcaacgataggggtgatcctggtagctaccggcaacaacagttttttttatttgtacctcgtactatgttcctgtctttcttttaagacaatagttgactggtaaatcagttgccgataatgtgtagccttccattgcccgcccaaagagaactataattagcccttatttatttggctatta

SEQ ID NO: 5236 - DNA, 2335 bp, Triticum aestivum
gctgagaagaaaaggggtctgcccgtcgatgtgggtggtgagcctggctatgccatccgtaactacaggtccgaacagcccgtcgagacgcactgggaagggattttcacgctcgccgagctattcgaacagtcctgcaagcagtatgcctacatgcccctgcacggcaccaggaagctcatttcaagggaaacagaggtggctgctgatggaagatcattcgagaagctccatctgggggagtatgagtggaaaacttacatcgaagcattcaaggctgtatgcaacttctcatccggtctgatccaaattgggcaccagaaggacgagcgtgttgctatctttgctgatacgcgagctgagtggcagattgcgttgcaggcatgcttcagacaaaacattacagtggtcaccatttatgcctccttgggagagggagcactttgtcactcactaaatgagactgaggcaactactgtgatctgtggacggaaagaactaaaaaacttattgatataaatgggcaacttgatactttgaaacatgtcgtctacataagtgaggacggtgtctcaagtgaagtatccttggctaaacaatgcactaactggagagtcgagtcatttgaagaggtagagaggctagggttggaaacacctatcgaagcaaatttacctctcccatctgatacagcagtgataatgtatacaagtgggagcaccggaatgcccaagggtgtcatgatgagccatcgcaatgtcttggctacagcatcagctgttatgactattgtgcctgcacttggtaagaaggatgtctacttggcgtacctcccgcttgcacacattcttgagttggcagctgagacgattatatctgctgttggggcttctataggatatggatcaccattgaccctgactgatacatcaaataaaattaaaaaggggaccaaaggtgatgcctctgcactgaggccaacacttatgactgcggtacctgctatacttgaccgtgttcgtgatggcgtgagaaaaaatgttgatgcaaagggtggtgtagccaagaaactatttgatatcgcctacagccgtcggctagctgctgtcaatggaagttggtttggtgcatggggattagagaagcttgtgtgggacatgcttgtcttccagaaagtgcatgcaatcttgggaggccggattcgctttatactttcaggcggagcgcctctgtctggagaaactcagagatttatcaatatatgccttggggctccaatagggcaaggatatggtctaactgaaacgtgtgctggcgggacattctctgagtacaatgacacatctgttggtcgtgttggtgctccattgtcttgttcgttcattaagttgatagattgggttgaaggtggatacttgacatctgattcaccaatgcctcggggagaaatcattattggaggcccaaatgtaaccaaaggctatttcaaaaatgaggccaaaacaaatgaggtctacaaggatgatgagagaggaatgaggtggttctactctggtgacattgggcgtttgcacccagatggctgcctcgaaatcattgacaggaagaaggatatagttaagcttcaacatggtgaatatgtatcgctaggaaaggtggaggctactttgagtgtgagcccgtatgttgacaacatcatggtccacgcggatccctcccaaaactactgtgttgcactcgttgtagctgcgcacggtgagctagaaaactgggcctcaaaacaagggattgcatattctgatttccccgatctgtgccagaagcaagagactgtcaaagaagttctacagtcgttggcaaaggctggtaagcaatcgcggctggagaagtttgagatccctgccaggatcaagctgataccggagccatggacccccgagtcgggtctcgtcaccgctgccctcaagctcaagagggaggtcatcaagaagggttatcaggacgatcttgctaagctgtacagatagtgtccctttgttagggagaacaacattcctcatctgtgttgtgtttcagacagtggacagatagtgtccctttgttagcaagaacaaaacttctcatatgtgttgtgtttcaaacagtggatcgagacagacagtatattgaactctagtatgtgtacttgatgatttaccgttgtatttcagctagagatcatgttctcctcagttaaacttctcatggaacatctctgaatcttgctgtcatgattcacacatgagttactgctacacaaggatgtgtaggttctgggtattagttatctccgtaa

SEQ ID NO: 5237 - DNA, 2085 bp, Avena sativa
gaggagtgccagttaacgtgggtggtgaggctggctatgccatccgtaactatagattcgagcagcctgtcgaaacacactgggaagggattttcacactcgcagagctgtttgagcaatcctgcaagcagtatgcccatatgcctctgcatggcaccaggaagctcatttcaagggaaacagaggtagcttctgacggaagatcttttgagaagctccatttggggcagtatgaatggaaaagctacattgaagcattcaaggctgtctgcaacttttcatctggtctagtgcaaatcgggcaccagaaggatgagcgtgttgctatttttgctgatacacgggccgagtggcagattgcgttgcaggcatgcttcagacaaaatattacagtcgtcacaatttatgcctccttgggggagggagctctttgtcactcactaaatgagactgaggtaactacggtgatctgtggacggaaagaactgaaaaagcttattgatataaatgggcaacttgatactttgaaacatgtcatctacataaatgaggaaggtgtatcaagtgaagtatccatggctaaacaatgcactagctggagagttgagtcatttgaggaggtagagaggttaggactggaaacacctgtcgaagcaaatttgccactcccatccgatacagctgtgataatgtatacaagtggaagcactggaatgcccaagggcgttatgatgagccaccgcaatgtcctggctactgtatcagctgttatgactattgttcctgcacttggcaagaaggatgtctacttggcgtacctcccacttgcacacattcttgagttggcagctgagacgattatatctgctgttggggcttctataggatatggaacacctttgaccctgactgatacatcaaataaaattaaaaaagggactcaaggtgatgcttctgcactgaagccaacacttatgactgcggtacctgcgatacttgaccgtgttcgtgatggcgtaagaaaaaatgtagatgcaaagggtggtgtagcaaagaaactatttgatattgcctacagccgtcggctagctgctgtcaacggaagttggtttggtgcatggggattagagaagctcatgtgggaaaagcttgtcttccagaaggtgcgtgcaatcttgggaggacggattcgctttatactttcaggcggagcacctctgtctggagatactcaaagatttatcaatatatgccttggggccccgatagggcaaggatatggtcttactgaaacgtgcgctggtgggacattttctgagtatgatgacacatctgttggccgtgttggtgctgcactgtcttgttcatacattaagttgatagactgggttgaaggtggatacttgacaactgattcaccaatgcctcggggtgaaatagttattggaggcccaaatgtaaccaaaggctatttcaaaaatgaggccaagacaaatgaggtctacaaggacgacgaaagaggcatgcgttggttctactccggcgacattgggcgtttgcacccagatggctgcctggaaatcattgaccgtaagaaggatatagttaagcttcaacatggtgaatatgtatctctaggaaaggtggaggccactttgagcgtgagcccctatgttgacaacatcatggtccatgctgacccctcccagaactactgcgttgcgcttgttgtagccgcacctggtgaactggaaaactgggcctcaaaacaaggtctcgcatacacggatatgtctgatttgtgccagaagcaagaggctgtcagagaagttcttcagtcgttaaccaaggctggtaagcaagcacacctggagaagttcgagatacctgccagaatcaaactgataccagagccatggacccctgagtcgggccttgtcactgctgccctcaagctcaagagggaggtcatcaagaagggttatgagagcgagctcgctaagctgtacagatagtttctttgttagcaagaacataatttccctttcatgcaatgtttcaaaatgctgttactgtgaagacaaa

SEQ ID NO: 5238 - DNA, 3487 bp, Zea mays
gtttggtttcggatttgcatctggatttggaagagcaaaaggactttctcctgcgacgcgtgcatgaaacagacacgcagtcgtaatttaaatttaaccgactccacgggcgcgtaaaatggcaaaccaacccagaacccagccccgaaaatgcaccgcgccgccgccgccaccgtggcggcgccgcaggcgaccgacgcgcagctcctggcgggcgcggtggaggcggcgatcgccacccgatccgcgcggctcggccgagcggcccacgcgcgcgcgctcaggctgctgtccccggcgctcccgcccttcctctgcgcgcacctcgtcaacctctactccaagctcgacctcccgggcgccgccgccgcgtcgctggccgccgaccccagccccaccgtggtgtcctacacggccttcatctcgggcgcggcgcagcacgcgcgcccgctccaggcgctctcggcgttcgccgccatgctccggctcggcctccgccccaacgacttcacgttcccttccgccttcaaggccgccgcctccgcgccgccgcgcagcgccgccggaacgcagctgcacgccctcgcgctcaggttcggatacctccccgacgacgccttcgtctcgtgcgcggcgctggacatgtacttcaagacgggctgcctcgcgctggcgcgccgcctgttcgacgaaatgcccaacaggaacgtggtcgcctggaacgcggtcatgaccaatgcggtgctcgacggccgcccccttgagacggtcgaggcctactttgggctccggggtgctggtgggatgccgaacgtggtctcggtctgtgcgttcttcaacgcgtgcgctggtatgacgaacctgtcccttggggagcagttctatggttttgtggccaagtgcggctttggcaaggatgtctccgtgtccaattctgtggtggatttttatgggaagtgccgttgcgtggggaaggccagggcggtgtttgatgggatgggagttcggaacaacgtgtcctggtgttctatggttgttgcatatgcgcagaatggggcagaggaggaggctttctttgtctacttgggtgcaaggagagctggggaagagccgactgacttcatggtttccagtgtgctcaccacatgtgcaggcctgctaggacttgaccttgggcgtgctctgcatgcagttgctgtccgttcctgcattgattcaaacatttttgttgcaagtgccttggttgacatgtatgggaagtgtggcggaatcgaagatgctgagcaggtctttttcgagatgccacagcggaatcttgtcacatggaatgcgatgataggaggttatgctcatattggtgatgctcacaatgcactttctgtgtttgataaaatgataatgggtcaagaaacagcacctaactacatcacacttgtcaatgttctcacggcatgcagcagaggaggtttgacaaaggaagggtatgagttgttccagacaatgaagtggaggtttgggattgaaccaagaattgagcattatgcttgtgtggtggacttgctttgccgtgcaggaatggaagagcgagcttataagatcatacaggggatgccaatgagaccttccatttctgtctggggagcactacttggggggtgcaagatgcatgggaagacagaactaggaaggattgctgctgagaagttgtttgaacttgatcctcaggattcaggcaatcatgttttgctctcaaacatgcttgcatctgctggcaggtgggcagaagcaacggatgtgagaaaggagatgaagaatgttgggatcaagaaggacccagggcgcagttggatcacttggaaaaatgttgtccatgttttccaggctaaggatacaacacatgatatgaatagggagatccaggcattgttggccaagctcaaagggcaaatgcaagctgctggatacatgccagacacacaatatgctctctatgatcttgaggaagaagagaaagaatcagaagtgtttcaacacagtgaaaagcttgctctggcttttggattgatatgtataccacctggcatacctataaggatcatgaagaatctgcgaatttgtgtagattgccaccgggcttttaaattcatatctggtattgctggtagggagataattgtgcgggacaacaatatgtttcatcacttcaaaaattatgagtgttcatgcaaggattattggtgaaagttgtatccacaagatatactgatgcatgttttgttggcatctctagaagcacctctgcagatatagaaggtatctattttagttcctttacatgatttgtattctatcatgctccaacatagattttgttttagttgaattctttagccattgtgttagtgaaaaccattgtcttcatcttccaaattctgaactatcgtaactgatatgaatatataatagattattgcagcagaagctatgtgatgtttattctcaaaacacaccatatcagtagtgacaaattattttgtgtatttcatttactaggtgatggcatgtgggttgttacatcaaataacaagtatttattctaaaaacatcattgatgaaccaatcacagtggatacaaatgccaaagcaagatgctagccactaaggccgtgctcagtagagcatgcatatggccgtgcaaaataatgtatcctactgtagactgcattgtttacagagtgaaatttgaaatagtgagtgtgatatgatgtgagataaggaggctgttggagatagcctaaggctaaaactgcactaggcaaaaacagtgcaacttgcacaatatttgttcatactgtaagtagagggattctaactctcatcaagaggatgacactatgagttggggcaattttctgtttatttcctcaaacactacacaatgccatacccatctaagggttgtagacccatatttatagccctagaggctgcactaccacaccttctcacacacactacacaacaggattgtcctctagatgctaaagagactacagaggacagtcaaaaaacgactgctgtcctctagatgctaaagagactacagagggcagtcaaactgtcctctagatgctaaaggactacaaaggacagtcaaaagcgactgctgtcctctagatgctcaagacttattccatcattctccccctaagtcttgggcgtcgtcttgtgggaaagttgggccatcccggacctggagcaaagctcaacaaatttgatcttcccaaggggcttggtgagcaggtctgcaagctgatccttggtgttgatgtagcgcgccttgatgctcccttctgccaagcagtctcggatgaaatggtatctcagccggatgtgcttgctccgttcatggaacacggggttcgtggccaatgccagagcggactggctgtccaccctgagttccaccgctccagtgtctctcccg

SEQ ID NO: 5239 - DNA, 2375 bp, Panicum virgatum
tgcatgtcaagtccaggattagtcagaaccagcccggcccgctttccgtgtacacgtggcctcgattaaaccgtttccgcggtcgcgccaaaaatcgcaaatcaacccagcccaaatgcgccgcgccgccgccgctgtggcggcgccgctggcgacggacccgcagctcctggcggcggcagtcgagacggcgatcgcttcccggtctccgcgactcgggcgcgcggcgcacgcgcgcgccctcaggctgctcgccccggccatcccgcccttcatctgcgcccacctcgtcaacctctactccaagctcgacctcccggggcccgccgccgcagcgctggcctccgacacgagccccaccgtcgtgtcgtacacggcgttcatatctggcgcggcgcagcacgggcgcccggccctggcgctctcggccttcgccgccatgctccggctcggcctccgccccaacgacttcaccttcccatccgcattcaaggccgccgcgtccgcgccgccgcggtccaccatcgggccccaggtacacgccctcgcgctcaggttcgggtacctccccgacgacgccttcgtggcgtgcgcggcgctggacatgtacttcaagactggccgcctcgcgctggcacgccgcctgttcgaggaaatgccctacaggaacgtggtcgcctggaacgcggtgatgactaacgcagtgcttgacgggaggtcccttgagacagtggaggcgtattttgggctccgagaggctggtgggatgccgaatgtggtctcagtttgtgcgttcttcaacgcgtgtgctggggcgacatatctatcccttggggagcagttccatggcttcgtggtgaaatgcgggtttgagatggatgtctccgtctccaattccatggtcgatttttatgggaagtgtcgatgtgtggagaaggccaaggcggtgtttgatggcatgggagttcggaacagcgtatcctggtgctgtatggttgttgcatatgcacagaacggtggagaggaggaagctttctctgtctacctgggtgcaagaagagctggggaagagccaacggatttcatggtttccagtgtgctcaccacgtgcgcaggactgctaggccttgaccaagggcgcgctctgcatgcagttgctgtccgttcttgcattgatgcaaacatttttgttgcaagtgcgttggttgacatgtatgggaaatgtgggggtatagaagatgctgaacaggtctttctggatatgccacagagaaatcttgttacatggaatgcaatggtaggaggttatgcccacattggtgacgcttggaatgcatttgcagtgtttaatgatatgataaagtgtggagaaacagcacccaattacatcacacttgtcaatgtactcgcagcatgcagcagaggaggtttgacaaatgaaggatatgagctgttcaagacaatgaatgataggtttgggatcaagccacgaatagagcattatgcttgtgtggtggacttgcttggtcgtgcaggaatggaagaacaagcttatgagattatacaggggatgccaatgaggccttctatttctgtctggggagcactacttggggcatgcaagatgcatggtaaaacagaactaggaaagattgctgctgagaagttgtttgaacttgatcctcaggactctggcaatcatgttttgctctctaacatgttagcatctgctggcagatgggcagaagcaacagatgtgaggaaggagatgaaaaatgttggaatcaagaaagacccagggcgcagctggattacctggaaaaatgctgtacatgttttccaggctaaggatacaaaacatgagatgaataatgagatccaggcattactggccaagctcaaaagtcaaatgcaagctgctgggtacatgccagacacacaatatgctctctacgatcttgaggaagaagagaaggaatcagaggtgtttcaacacagtgaaaagcttgctctggcttttggattgatctgtataccaaatggtgtacctataaggatcatgaagaatttgcgaatttgtgtagattgtcaccgagcttttaaattcatatctggtattgttggtagggagataattgtgcgagacaacaataggtttcatcacttcaaagattatgagtgctcatgcaaggattattggtgaaagctttatctgcaggatcttgtgatgcatacttctttgggcttttctggaaccacttctgcaaatatagaagaaggtatctattttagttcctgtgtatgatttgtactattcgatatgccagcatggattttgttttagttgacttctttaactgttgtgaccaatgacc

SEQ ID NO: 5240 - DNA, 2857 bp, Setaria italica
ccaaaattcgcaaaccaacccaagcctcaaatgcgcagcgccgccgctgccgctgcccccgtggcggcgactgacccgcagctcctggcggcggcggtcgaggcggcgatcgcctcccgctcgccgcgcctgggtcgcgcggcgcacgcgcgcgccatcaggctgctcgccccggccatcccgcccttcatccgcgcccacctcgtcaacctctactccaagctcgacctcccggggcccgccgccgcggcgctagcctccgacccgagccccaccgtcgtgtcgtacacggcgttcatctctggcgcggcgaagcacgggcgcccggccccggcgctctcggccttcgccgccatgctccggctcggcctccgccccaacgacttcaccttcccctccgcattcaaggctgcggccatcgcgccgccgagctccgccatcggtccccaggtacactccctcgcgctcaggttcgggtacctccccgacgacgccttcgtctcgtgcgcggcgctggacatgtacttcaagactggccgccttgcgctggcacgccgcctgttcgaggaaatgcccaacaggaacgtggtcgcctggaacgcggtgatgaccaacgcgctgcttgatggacggccccttgagacggtggaggcgtactttgggctccgggaggctggtgggatgccgaatgtggtctcggtctgtgcattcttcaatgcatgcgctggagcgacatacctgtcccttggggagcagttccatggcttcgtggtgaagtgtgggcttgagagagatgtctccgtatccaactctatggttgatttttatgggaagtgtcgatgtgtggggaaggccaaggtagtgtttgatgggatgggagttcggaacagcgtgtcctggtgttgcatggttgttgcatatgcgcagaacggtggagaggaggaagctttctcggtctacctgcgcgcaaggagagctggggaagagccaacggatttcatggtttccagtgtactcaccacttgtgcgggactgctaggccttgaccttgggcgtgctctgcatgcagttgctgtccgctcttgcattgatgcaaacatttttgtcgcaagtgcattggttgacatgtatgggaagtgtgggggtattgaagatgctgaacaggtcttttttgagatgccacagaggaatcttgttacatggaatgcaatggtaggaggttatgcccacattggtgatgctcggaatgcacttgcagtgtttgatgatatgataaagtgtggagaaacagcacccaattacatcacacttgtcaatgtcctcgcagcatgcagcaggggaggtttgacaaaggaagggtatgagctgttcaagacaatgaatgataggtttgggatcaagccacaaattgagcattatgcttgtgtggtggacttgcttggtcgtgcaggaatggaagagcaagcttatgagatcatacaagggatgccgatgaggccttctatttctgtctggggagcgctacttggggcatgcaagatgcatggtaaaacagagctaggaaagattgctgctgagaagttgtttgaacttgatcctcaggattctggcaatcatgttttgctctctaacatgtttgcatctgctggcaggtgggcagaagcaacagatgtgagaaaggagatgaaaaatgttgggatcaagaaagaaccagggcgcagttggatcacctggaaaaatgttgtacatgttttccaggctaaggacacaaaacatgagatgaataatgagatccaagcattactggcaaagctcaaaagtcaactgcaagctgctgggtacatgccagacacacaatatgctctctatgatcttgaggaagaagagaaagaatcagaggtgtttcaacacagtgaaaagcttgccttggcttttggattgatctgtataccacctggtgtacctataaggatcatgaagaatttgcgaatttgtgtagattgtcaccgagcttttaaattcatatctggtattgttggtagggagataattgtgcgagacaacaataggtttcatcacttcaaaagttataagtgctcatgcaaggattattggtgaaaattttatccacaggatctactgaggcatgcttctttgggcatctctagaaccacttctacaaatatataagaagtacgtgcagagtgcgacatcaagcatggaaaatgcagaatcacatggaaatagacgagctggccaaattcattcagtgttccgttcctgctgtggttggtgattgctagcatgatgggaaataggatgcacaaaaattagactggcaaatcagaacaagggactagtaatatcttcagttggttccagcatttggcatggtggaaggaggagatgcaagcattggctgtggggcacaaacgacaagcatatttggtccagccttgcaggtatgtacatgtactctgggagaagaggtgtggtactggctcagctctgcaatccatgatgttcctccagtgttgaaatgctgattggtactatctcagctcagccatccatgacatttctccagtgttcaaatgatgtgtggtactatctcagcacaaccatccatgatgtttctcccgtctggtcttgaagtgctgacgactgaggatactaggtgtagaaacactgatgactgagggtgctgggcggcatagttctaacccggagaaatggtaatacaaaatgcactgattcttaaagcttgtaaatgcacaatgtactacagggacacagtatgttaggaagtacgactgtatggctccgatcatcagctggtgaatttctggcaaattta

SEQ ID NO: 5241 - DNA, 2944 bp, Setaria italica
cgccaaaaatcgcaaacccaagcctcccaaatgcgccgcgccgcagcgccgctggcgaccgagccgcagctcctggcggcggcggtcgaggaggcgatcgcctcccgctcgccgcgcctcggccgcgctgcgcacgcgcgcgctctcaggctgctcgccccggccatcccgcccttcatctgcgcccacctcgtcaacctctattccaagctcgacctcccggggcccgccgccgccgcgctggcctccgacccgagccccaccgtcgtgtcgtacacggcgttcatctctggcgcggcgcagcacgggcgcccggccacggcgctctcggccttcgcggccatgctccggctcggcctccgccccaacgactttaccttcccctccgcattcaaggccgccgcgtccgcgccgtcgtggtccaccatcgggccccaggttcacgccctcgcgctcaggttcgggtacctccccgacgacccattcgtcgcgtgcgcggcgctggacatgtgcttcaagactgaccgcctcgcgctggcacgccgcctgtttgaggaaatgcccaacaggaatgtggtcgcctggaacgcagtgatgaccaacgcggtgcttgatggacggccccttgagacagtggaggcgtactttgggctccggaaggctggtgggatgccgaatgtggtctcagtctgtgcgttcttcaatgcatgtgctggggcgacatacctatcccttggggagcagttccatggattcgtggtgaagtgcgggtttgagatggatgtctctgtctccaattctatggttgatttttatgggaagtgtcgatgcgtcgggaaggccaaggcggtgtttgatgggatgagagttcggaatagcgtgtcctggtgttgtatggttgttgcatatgcgcagaatggtggagaggaggaagctttctcactctatcttggtgcaaggagagctggggaagagccaacggatttcatggtttccagtgtgcttaccacgtgcgcaggactgctaggccttgaccttgggcgtgctctgcatgcagttgctgtccgctcttgcattgatgcaaacatttttgttgcaagtgcgttggttgacatgtatgggaagtgtggggatattgaaaatgctgaacaggtcttttttgagatgccacagaggaatcttgttacatggaatgcaatggtaggaggttatgcacacattggtgatgctcggaatgcacttgcagtgtttgatggtatgatgaagtgtggagaaacagcacctaattatatcacacttgtcaatgtgctcacagcatgcagcaggggaggtttgacaaaggaagggtatgagctgttcaagacaatgcatgagaggttcgggattaagccgcgcattgagcattatgcttgtgtggtggacttgcttggtcgtgcaggaatggaagagcaagcttatgagatcatacaggggatgccgatgaggccgtccatttctgtctggggagcgctacttggggcatgcaagatgcatggcaaaacagagctaggaaagattgctgctgagaagttgtttgaacttgatcctcaggactccggcaatcatgttttgctctataacatgtttgcatctgccagcaggtgggcagaagcaacagatgtgagaaaggagatgaaaaatgttggaatcaagaaagacccggggcgcagttggatcacctggaaaaatgctgtacatgttttccacgctaaggacacaaaacatgagatgaataatgagatccaggcgttactggccaagctcaaaagtcaaatgcaagctgctgggtacatgccagacacacaatatgctctctacgatcttgaggaagaagagaaagaatcagaggtgtttcaacacagtgaaaagcttgctctggcttttggattgatctgcataccacctggtgtacctataaggatcatgaagaatttgcgaatttgtgtagattgtcaccgagcttttaaattcatatctgctattgttggtagagagataattgtgcgagataacaataggtttcatcacttcaaaaattatgagtgctcatgcaaggactattggtgaatgttttatccacaggatctactgacgcatgcttctttgggcacctctagaaccacttctgcaaatgtagaagcaggatgaaatcatcaggtggttgaaagctttatttcttcaagtccctcatcaagatcactgcaacatgttgctgaactgataattgcaagtgctgattttgagacagatcttgactcctggcaagtgagtaaggagcattcacgaacacggttgaacggatgctagatgtgctacactgctgagttaaagacattctcaagtcatgggcagcatatctaaccataagaagtacaagcttgtcagcaatacacaagctaaccagaatacgaggctcatgagaatccttgaagaaacaagagaggctgatggtgaaagtgacaatacgagagaggatgcaggctgtctgccttcagatattggactgcatccacaatctgcacgagatcctggactatatctttgcattggagatgcaaaagctgctgggcaacgatcctccaggacaaggacctggatccaccagtgatcaacgaccgctccatcctttgcaaaggcgtgtggcaagtgttggaagtgttggggggactgaattaacgcgggttgcttcagcaaaaggctagttttggtgttggtgttggtgttggttgtgtttattttttgttgttcagattatatacggtttcagacgaccaattctttctgttcatagtgtggtgttgattgttcagaaagaataaacaaagacacaagttgtcactggtaagcaggtatttctttccaaaagaagacaacgtgtgcgcgcgcttgcgcttgcgcttgcttc

SEQ ID NO: 5242 - DNA, 3311 bp, Panicum virgatum
ccaccattgcttaatgtggatacaaaatatccatggaaccatggtctttggggacaagcttgatccagtaccaaagcttgaatgatcctacgcagcatcttttcttttttaatgacacagtacaactatgaaaatttacacacactcacttctatgaatactctacctatatgagcatcttcgaagattgagagattgagctggtaaattctcgagatacctagagcatcttcgaagattgagctgataaatctttgaaattgacaaagttatgggaacatctgctatgcatgtgagcaactgggctttaaaaggtcgcagatcaagcccaggattagtcaatacaagcccggcccgctttccgtggcctcgattaaaccgtttccgcggtcgcgccaaaaatcgcaaatcaacccagcccaaatgcgccgggccgccgccgccgtggcggcgtcgctggcgacggacccggagctcctggcggcggcggtcgagacggcgatcgcctcccgctctccgcgactcggacgcgcggcgcacgcgcgtgccctcaggctgctcgccccggccatcccgcccttcatccgcgcccacctcgtcaacctctactccaagctcgacctcccggggcccgctgcagccgcgctggcttccgatccgagccccaccgtcgtgtcgtacacggcgttcatatctggcgcatcgcagcacgggcgcccggcccaggcgctctcggccttcgccgccatgctccagctcggcctccgccccaacgacttcaccttcccatccgcattcaaggccgccgcgtccgcgccgtcgcggtccaccatcgggccccaggtgcacgccctcgcgctcaggttcgggtacctccctgacgacgccttcgtggcgtgcgcggcgctggacatgtacttcaagactggccgcctcgcgttagcacgccggctgttcgaggaaatgccctacaggaacgtggtcgcctggaacgcggtgatgactaacgcggtgcttgatgggaggccccttgagacagtggaggcgtactttgggctccgggaggctggtgggatgccgaatgtggtctcagtttgtgcattcttcaatgcgtgtgctggggcgacatatctatcccttggggagcagttccatggcttcgtggtgaagtgtgggtttgagacggatgtctccgtctccaattccatggttgatttttatgggaagtgtcgatgtgtggagaaggccaaggcagtgtttgatggcatgggaatacggaacaacgtgtcctggtgttgtatggttgttgcatatgcgcagaatggtggagaggaggaagctttatctgtctacctgggtgcaagaagagctggggaagagccaacggatttcatggtttccagtgtgctcaccacgtgtgcgggattgctaggccttgaccaagggcgtgctctgcatgcagttgctgtccgttcttgcattgatgcaaacatttttgttgcaagtgcgttggttgacatgtatgggaaatgtgggggcatagaagatgctgaacaggtctttctggatatgccacagagaaatcttgttacatggaatgtgatggtaggaggttatgcccacattggtgacgcttggaatgcacttgcagtgtttgatgatatgatagagtgtggagaaacagcacccaattacatcacacttgtcaatgtactcgcagcatgcagcagaggaggtttgacaaaggaaggatatgagctgttcaagacaatgaatgataggtttgggattaagccacgaattgagcattatgcttgtctggtggacctgcttggtcgtgcaggaatggaagagcaagcttatgagatcatacaggggatgccgatgaggccttccatttctgtctggggagcgctacttggggcatgcaagatgcatggtaaaacagagctaggaaagatagctgctgagaagttgtttgaacttgatcctcaggactctggcaatcatgttttgctctctaacatgttagcatctgctggcagatgggcagaagcaacagatgtaaggaaggagatgaaaaatgttggaatcaagaaagatccagggcgcagctggattacctggaaaaatgttgtgcatgtttttcaggctaaggacacaaaacatgagatgagtaatgagatccaggcgttactggccaagctcaaaagtcaaatgcaagctgctgggtacatgccagacacacaatatgctctctacgatctcgaggaagaagagaaggaatcagaggtgtttcaacatagtgaaaagcttgctctggcttttggattgatctgtataccacctggtgtacctataaggatcatgaagaatttgcgaatttgtgtagattgtcaccgagcttttaagttcatatctggtattgttggtagggagataattgtgcgggacaacaataggtttcatcacttcaaaaattatgagtgctcatgcaaggattattggtgaaagttttatctacaggatcaagtgatgcatgcttctttgggcatttctggaaccatttctgcaaatatagaagaagagtgtgacatcaaacatgtaaactgcagaatcagatggaaatggaccggctggccaaatttattcaggtttcagctccagctgtggttggcgaatgctatcaagatgggaaataggaacaaacaacaacaacaacaacaacaacaacaacatagccttttttcccaagcaagttggggtaggccaagatgggaaataggaccacagaaaaatagactggcaaatcagaacaagggactagcaatatcctcagttggttccaacatttggcatggtgcaggaagtgcaatcattggctgtggagcactaacgcccagcatgtttcttgcagccttgcaggtatcttggagagcggtctcgaagaaatgaagcgcacatcatgctcagtgtattccgagctctgtgatgtcggtaaatgtagtctaggagaagaggtgtgctactggctcagctcagcaatccatgatgttccttcgatgttgaaacactgtgtggtactttctcagctctgccttccatgatgttccacggtgttggaatgctgctggtacattgatagtgtctcatctctcagccacccatgatattccatggtgttggaatgctgcatggtacattggtataatggtatttggtagtgtctcatctcagccacccatgatgtaccttgggtcttgaaacactgacgactgagagtgctaggtgttgaaacactgatgattgcg

SEQ ID NO: 5243 - DNA, 3115 bp, Oryza sativa
tacgcgccaaaaagaatttgcaaaccccaaatgcgccgagccgccgccgccgcggcggtggcgcccgccgacccgcagctgctggcggcggcgttcgagtcggccatcgcgtcgcgctcgccgcgcctcggccgggccgcgcacgcgcgagcgctgaggctgatcgccccggcactctcgcccttcatctgcgcgcacctcgtcaacctctactccaagctcgacctccccgcggcggcggcggcggctctcgcctccgacccacaccccaccgtggtttcgtacaccgctttcatatccggcgcggcgcagcacggccgccctctcccggcgctctccgcgttcgccggcatgctccgcctcggcctgcgccccaacgacttcaccttcccgtcggccttcaaggccgccgcttccgcacctccgcgctccaccatcgggccccagatacactccctcgccatcaggtttggttacctccccgtcgaccccttcgtgtcctgcgcggcgctggacatgtacttcaagaccggacgcctcaagctggcccgccacctgtttggtgaaatgccgaacaggaacgtggttgcgtggaacgctgtcatgacgaatgctgtgctcgacgggaggcccctggagacaattgaggcttattttgggctccgggaggctggtgggcttccgaatgtggtctcggcctgtgcattcttcaacgcgtgtgctggggcgatgtacttgtcactcggggaacagttccatggcttcgttgtgaagtgtgggtttgagatggatgtctctgtgttgaattcaatggttgatttctatgggaagtgccgatgtgcagggaaggcaagggcggtatttgatggcatgggagttaggaatagcgtgtcctggtgttcaatggttgctgcatatgctcagaacggcgcagaagaggaggcttttgcagcatacctgggtgcaaggcgttctggggaagagccaacggatttcatggtttccagtgcgctcactacatgtgcagggctgctaggccttcaccttggacgcgctctgcatgcggttgctgtccgttcttgtattgatgcaaacatttttgttgcgagtgcattggttgacatgtatgggaagtgcggctgtgttgaagatgccgaacagattttttatgagacaccacagaggaatcttgtcacttggaatgcaatgatcggtggttatgctcacattggtgatgctcagaatgcacttctggtatttgatgatatgataaggagtggggagacagcacctaattacatcacccttgtcaatgtgatcacttcatgcagcagaggaggtttaacaaaggacggctatgaattgtttgagacaatgagggagaggttcgggatagagccacggactgagcattatgcttgtgtggttgacttgcttggtcgtgcaggaatggaagaacaggcttacgaggtcatacaggggatgcctatgagaccttccatttctgtatggggagctctacttggggcgtgcaaaatgcatgggaagacagaattgggaaggattgcagctgagaagttgtttgaacttgacccccaggactctggcaatcatgtactgctctcaaatatgtttgcttcagctggcaggtgggcagaagcaacagatataaggaaggagatgaagaatgttggaataaagaaggacccgggttgcagctgggttacctggaaaaatgttgttcatgttttccgagcaaaggacaccaaacatgaaatgtataatgagatccaggcgttactaagcaagctcagaaagcaaatgcaagctgctggatacatgccagacacacaatattccctttatgatcttgaggaagaagagaaagaatcagaggtgttccaacacagtgagaagcttgctctggcctttggacttatttgcataccacctggtgtacctataagaatcatgaagaacctgagaatatgtgtggattgtcatcgcgcattcaagttcatatctggtatcgttggtagagagataattgtgagggacaataataggtttcatcacttcaaacaataccaatgctcatgtggagattattggtgacttctatctatgtgcctattgatgaatattatctgcaaaaagaaaaaaaaaacacttcttcaaagccaaaaggaaaaggatttggcattaaacatggaacatatgtcctggtttacctaattaccttgctccattactgaagaaggcatactgataaatcaaaagaagagaccagctggaacaaaatttggggttgatgagcagaagcatacactgcctgtttgatgtgccacccatgttagctcaggttgcacatagcctggatttaggggcatcaagggcagaatatgtactattcaagagaagctcagggatatcaatatatgattgctgggtgcaccgtgcacgtaggctgtaatgctggctcaaggatctaaattcctgctatccttttttgggggtgtgaataatatttcttattggtcatgctagattgagcctattactgtttctaccctgaagcgctaatgtttgcaggcctgaagtgtctcgtattcagcttggaggtgttggtgaattacttaaagcgacgaatgcagaaatctgcacggaagcgatgcatcccatttttgccatttggttaagtaggttttggttattcttatacgttgagaggatacttatcatgggtttggtggattagacgtggtataatccagttctcattttggttttcctttttgtttgctagctgaccttaattacttggtgccatttcctgctttgatttttaggtgttactgtaaatgaagagatgatttattatatatactacagaatatagttcacgcgtattacaaagaaaaccggtgttttgtttctgttgggcactttagttagcaaaagagtaaaatagcctttccaactggggctcttcccatccatttgtttgtgatcataattttccgaaccatatgtttcattttttcttctaagcttatcttagttaaaacattcaacacactttcagtttcagttttcagtctttgagcaaggttgc

SEQ ID NO: 5244 - DNA, 2922 bp, Oryza sativa
aggagtacgcgccaaaaagaatttgcaaaccccaaatgcgccgagccgccgccgccgcggcggtggcgcccgccgacccgcagctgctggcggcggcgttcgagtcggccatcgcgtcgcgctcgccgcgcctcggccgggccgcgcacgcgcgagcgctgaggctgatcgccccggcactctcgcccttcatctgcgcgcacctcgtcaacctctactccaagctcgacctccccgcggcggcggcggcggctctcgcctccgacccacaccccaccgtggtttcgtacaccgctttcatatccggcgcggcgcagcacggccgccctctcccggcgctctccgcgttcgccggcatgctccgcctcggcctgcgccccaacgacttcaccttcccgtcggccttcaaggccgccgcttccgcacctccgcgctccaccatcgggccccagatacactccctcgccatcaggtttggttacctccccgtcgaccccttcgtgtcctgcgcggcgctggacatgtacttcaagaccggacgcctcaagctggcccgccacctgtttggtgaaatgccgaacaggaacgtggttgcgtggaacgctgtcatgacgaatgctgtgctcgacgggaggcccctggagacaattgaggcttattttgggctccgggaggctggtgggcttccgaatgtggtctcggcctgtgcattcttcaacgcgtgtgctggggcgatgtacttgtcactcggggaacagttccatggcttcgttgtgaagtgtgggtttgagatggatgtctctgtgttgaattcaatggttgatttctatgggaagtgccgatgtgcagggaaggcaagggcggtatttgatggcatgggagttaggaatagcgtgtcctggtgttcaatggttgctgcatatgctcagaacggcgcagaagaggaggcttttgcagcatacctgggtgcaaggcgttctggggaagagccaacggatttcatggtttccagtgcgctcactacatgtgcagggctgctaggccttcaccttggacgcgctctgcatgcggttgctgtccgttcttgtattgatgcaaacatttttgttgcgagtgcattggttgacatgtatgggaagtgcggctgtgttgaagatgccgaacagattttttatgagacaccacagaggaatcttgtcacttggaatgcaatgatcggtggttatgctcacattggtgatgctcagaatgcacttctggtatttgatgatatgataaggagtggggagacagcacctaattacatcacccttgtcaatgtgatcacttcatgcagcagaggaggtttaacaaaggacggctatgaattgtttgagacaatgagggagaggttcgggatagagccacggactgagcattatgcttgtgtggttgacttgcttggtcgtgcaggaatggaagaacaggcttacgaggtcatacaggggatgcctatgagaccttccatttctgtatggggagctctacttggggcgtgcaaaatgcatgggaagacagaattgggaaggattgcagctgagaagttgtttgaacttgacccccaggactctggcaatcatgtactgctctcaaatatgtttgcttcagctggcaggtgggcagaagcaacagatataaggaaggagatgaagaatgttggaataaagaaggacccgggttgcagctgggttacctggaaaaatgttgttcatgttttccgagcaaaggacaccaaacatgaaatgtataatgagatccaggcgttactaagcaagctcagaaagcaaatgcaagctgctggatacatgccagacacacaatattccctttatgatcttgaggaagaagagaaagaatcagaggtgttccaacacagtgagaagcttgctctggcctttggacttatttgcataccacctggtgtacctataagaatcatgaagaacctgagaatatgtgtggattgtcatcgcgcattcaagttcatatctggtatcgttggtagagagataattgtgagggacaataataggtttcatcacttcaaacaataccaatgctcatgtggagattattggtgacttctatctatgtgcctattgatgaatattatctgcaaaaagaaaaaaaaaacacttcttcaaagccaaaaggaaaaggatttggcattaaacatggaacatatgtcctggtttacctaattaccttgctccattactgaagaaggcatactgataaatcaaaagaagagaccagctggaacaaaatttggggttgatgagcagaagcatacactgcctgtttgatgtgccacccatgttagctcaggttgcacatagcctggatttaggggcatcaagggcagaatatgtactattcaagagaagctcagggatatcaatatatgattgctgggtgcaccgtgcacgtaggttgtgatgctggctcaaggatctaaattcctgctatccttttttgggggtgtgaataatatttcttattggtcatgctagattgagcctattactgtttctaccctgaagcgctaatgtttgcaggcctgaagtgtctcgtattcagcttggaggtgttggtgaattacttaaagcgacgaatgcagaaatctgcacggaagcgatgcatcccatttttgccatttggttaagtaggttttggttattcttatacgttgagaggatacttatcatgggtttggtggattagacgtggtataatccagttctcattttggttttcctttttgtttgctagctgaccttaattacttggtgccatttcctgctttgatttttaggtgttactgtaaatgaagagatgatttattatatatactacagaatatagttcacgcgtattacaaag

SEQ ID NO: 5245 - DNA, 2271 bp, Hordeum vulgare
gtttgaaaagaaacccaattcaacaaccaaatgcgcgcgggcgcggcaatgtcggccgacccccagcgccttgcggcggcggtggaggccgcgatcgcgtcgcgctgcccgttgctcggccgtgccgcgcacgcgcgcgcgctcagggtgctctcgccgagcatcccacccttcatctacgcgcacctcgtcaacctctactccaagctcgacctccccgcggccgccgcctccgcgctcgcctccgaccccaaccccaccgtcgtgtcattcacggccttcatctccggcgccgcgcagcacgcgcgcccgctccccgcactctctgccttcgccgccatgctccgcctcggcctccgccccaacgacttcaccttcccctccgcgttcaaggccgccgcctccgcaccccctcgctccgccgtcggcccgcagatacacgcgctcgccatcaggttcggctacctccccgccgatgccttcgtctcatgcgccgcgctggatatgtacttcaagaccggccgcctcggcctggctcgccgcctgttcgaggaaatgcccaacagaaacgtggtagcctggaacgcagtgatgaccaacgccgtgctcgacggccggcccctcgagacggtccaggcttacttcgggctccgagaggctggcgggatgccgaatgtcgtctccgtctgtgcgttcttcaacgcgtgtgccggggcgatgctcctgttgcctggggcccagttccatgggttcgttgtgaagtgcggttttgacatggatgtctcggtgtccaatgcgatggttgatttctatggaaagtgccgatgcgcggagaaggcaaagatggtgtttgatgcgatgagggtcaggaacagtgtatcatggtgttccatggttgttgcatatgcacagaacggggcagaggaggatgcttttgctgtgtacctgggcgcgaggagtgctggggaagagccgactgacttcatggtctccagcgtgctcactacatgcgcaggcctgctaggccttgaccttgggcgtgctctgcatgccgttgctgttcgctcttgcatcgatgcaaacatctttgttgcaagtgctctggttgacatgtatgggaagtgcggaggcattgaagatgctcaacatgtctttttcgatatgccacagcggaaccttgtcacatggaatgcgatgattggagggcatgctaacatcggtgatgctataaacgcacttgcggtgttcagtgatatgatagcgagtggagagacagcacctaactacatcacacttgtaaatgtgatcacagcctgcagtagaggaggtttgaccaaggaaggctatgagctgtttgagacaatgaaggagaggtttgggatagaaccacggactgagcactatgcttgcgtggttgacttgcttgcgcgtgcaggaatggaagagcgagcttatgagattatacagaggatgccaatgagaccttccatttctctctggggagcactacttggggcatgcaagatgcatgggaagacagagctgggaaggattgcagctgagaagttgtttgaacttgaccctcaggactctggcaatcacgtgctactctcgaacatgcttgcatcagctggccggtgggcagaagcaacttatgtaaggaaggagatgaaagacgtcggaatcaagaaagacccagggtgtagctggatcacttggaaaaatggtgtgcatgttttccatgccaaggacaccaaacatgagatgaatagcgagattcgggcattactggccaggcttaaaaaacaaatgctagcttctgggtacatgccagacacacaatattcactttatgatcttgaggaagaagagaaagaatcagaagtgtttcaacatagtgagaagcttgccctggcctatggactcattcacattccgcctggtgtacctataaggatcacaaagaacttgagaatatgtgtggattgtcaccgagctttcaagtttatatctggtattgttgatagggagataattgtgagggacaataataggtttcatcacttcaaacaatatgagtgttcatgcaaggattactggtgaaaactgtccatgtggtgcagaaaaggtatgcaacatcagttcctgtaggaaagttgcatgagattataaattatctctccagaaggatgatgtttgacctcacttctgtatgtcttggtatattactgtctttgtttgaactttcaaagaagtagaagtatagaggtc

SEQ ID NO: 5246 - DNA, 2112 bp, Hordeum vulgare
aaaagaaacccaattcaacaaccaaatgcgcgcgggcgcggcaatgtcggccgacccccagcgccttgcggcggcggtggaggccgcgatcgcgtcgcgctgcccgttgctcggccgtgccgcgcacgcgcgcgcgctcagggtgctctcgccgagcatcccacccttcatctacgcgcacctcgtcaacctctactccaagctcgacctccccgcggccgccgcctccgcgctcgcctccgaccccaaccccaccgtcgtgtcattcacggccttcatctccggcgccgcgcagcacgcgcgcccgctccccgcactctctgccttcgccgccatgctccgcctcggcctccgccccaacgacttcaccttcccctccgcgttcaaggccgccgcctccgcaccccctcgctccgccgtcggcccgcagatacacgcgctcgccatcaggttcggctacctccccgccgatgccttcgtctcatgcgccgcgctggatatgtacttcaagaccggccgcctcggcctggctcgccgcctgttcgaggaaatgcccaacagaaacgtggtagcctggaacgcagtgatgaccaacgccgtgctcgacggccggcccctcgagacggtccaggcttacttcgggctccgagaggctggcgggatgccgaatgtcgtctccgtctgtgcgttcttcaacgcgtgtgccggggcgatgctcctgttgcctggggcccagttccatgggttcgttgtgaagtgcggttttgacatggatgtctcggtgtccaatgcgatggttgatttctatggaaagtgccgatgcgcggagaaggcaaagatggtgtttgatgcgatgagggtcaggaacagtgtatcatggtgttccatggttgttgcatatgcacagaacggggcagaggaggatgcttttgctgtgtacctgggcgcgaggagtgctggggaagagccgactgacttcatggtctccagcgtgctcactacatgcgcaggcctgctaggccttgaccttgggcgtgctctgcatgccgttgctgttcgctcttgcatcgatgcaaacatctttgttgcaagtgctctggttgacatgtatgggaagtgcggaggcattgaagatgctcaacatgtctttttcgatatgccacagcggaaccttgtcacatggaatgcgatgattggagggcatgctaacatcggtgatgctataaacgcacttgcggtgttcagtgatatgatagcgagtggagagacagcacctaactacatcacacttgtaaatgtgatcacagcctgcagtagaggaggtttgaccaaggaaggctatgagctgtttgagacaatgaaggagaggtttgggatagaaccacggactgagcactatgcttgcgtggttgacttgcttgcgcgtgcaggaatggaagagcgagcttatgagattatacagaggatgccaatgagaccttccatttctctctggggagcactacttggggcatgcaagatgcatgggaagacagagctgggaaggattgcagctgagaagttgtttgaacttgaccctcaggactctggcaatcacgtgctactctcgaacatgcttgcatcagctggccggtgggcagaagcaacttatgtaaggaaggagatgaaagacgtcggaatcaagaaagacccagggtgtagctggatcacttggaaaaatggtgtgcatgttttccatgccaaggacaccaaacatgagatgaatagcgagattcgggcattactggccaggcttaaaaaacaaatgctagcttctgggtacatgccagacacacaatattcactttatgatcttgaggaagaagagaaagaatcagaagtgtttcaacatagtgagaagcttgccctggcctatggactcattcacattccgcctggtgtacctataaggatcacaaagaacttgagaatatgtgtggattgtcaccgagctttcaagtttatatctggtattgttgatagggagataattgtgagggacaataataggtttcatcacttcaaacaatatgagtgttcatgcaaggattactggtgaaaactgtccatgtg

SEQ ID NO: 5247 - DNA, 2712 bp, Brachypodium distachyon
gccaaaatctcaacccaaatcaaacaccccatgcgccccgccgccgcggccgacccgcagctcctgggagcggcgttcgaggcagcgatctcgtcgcgctccccgcggctcggccgcgccgcgcacgcgcgcgccctcaggctgctctccccgggcctcccgcccttcatctgcgcgcacctcgtcaacctctactccaagctcgacctcccggcggccgccgcctcggcgctcgcctccgaccccaaccccacggtggtctccttcaccgccttcatctccggcgcggcgcagcacgcgcgcccgctcgccgcactctccgccttcgccgccatgctccgcgtgggcctccgccccaacgacttcaccttcccctccgccttcaaggccgccgcgtgcgcgccgcctcgctgctccactgtcggcccgcagatacacgcgctcgccctcaggttcggctacctccccggcgacccctttgtctcgtgcgccgcgatggacatgtatttcaagacaggctgcctcgggttggctcgccgcctgttcgaagaaatgcctaatagaaacgtcatagcgtggaacgcagtgatgacgaacgcagtgatcgacggccggcccctcgagacgttcaaggcgtactttgggctccgagaggctggcgggatgcctaatgtggtctcggtctgtgcattcttcaacgcatgtgccggggcgatgttcctctcgcttggagagcaattccatgggtttgtggtaacttgcgggtttgacatggatgtctcagtctcgaatgcaatggttgatttctatggaaagtgccgatgtgcagggaaggcaagggcggtgtttgatgggatgagagtcaggaacagcgtgtcatggtgttctatgattgttgcatacgcacagcacggggcagaggaggatgctttggcagtgtacatgggtgcaaggaacactggggaagagccaactgacttcatggtctctagcgttctcactacatgcgctggcctgctaggccttaattttgggcgtgctcttcatgcagttgctgtacgctcttgcattgatgcaaacatttttgttgcaagtgcgttggtcgacatgtacgggaagtgcgggggcgttgaagatgctgaacaagtctttttagatatgccagaacggaatcttgtcacatggaacgcaatgattggagggtatgctcacattggtgatgctcagaatgcacttgcagtgtttgatgctatgataaggagcggagggacatcacctaatcacatcacacttgtaaacgtgatcacagcatgcagtagaggaggtttgacgaaggacgggtatgagttgtttgatacaatgagggagaggtttggggttgaaccacggactgagcactatgcttgtgtggttgacttgcttgggcgtgcaggaatggaagagcgagcctatgagattatacagaggatgccaatgaggccttccatttctgtctggggagcactacttggggcatgcaagatgcatgggaagacagagttgggaaggattgcctctgagaagttgtttgaacttgaccctcaggactccggcaatcacgtgctgctctcaaatatgcttgcatcagctggcaggtgggcagaagcaacagatgtaaggaaggagatgaagaatgtcggaatcaagaaagagccagggtgcagctggatcacttggaaaaatgttgttcatgttttctatgccaaggacaccaaacatgacaggaatagtgagatccaggcattattggccaagctcaaaaaacaaatgcaggcgtctgggtacatgccagacacacagtattcactttatgatgtcgaggaagaagagaaagaaacggaggtttttcaacacagtgagaagcttgctctggcttttggactcattcatatacctcctagtgtacctataaggatcacaaagaacttgagaatatgcgtggattgtcatcgagctttcaagttcgtatctggtattgttggtagggagataattgtgagggacaataataggtttcattacttcaaacaatttgagtgttcatgcaaggattactggtgaaagttatatctatgtgatactcattcttttggcatctctagaatcacttctacaaagatagaaggaaaaggccaccgacaccaccataccagcagccacggtgatgaacatgagggtcgtctgttctgacggaccatgaccactaacccactacaggtggttggtggcggtgctggtggggagtcaacaatggtggttctactgatcctgctgtgcagatcaaatcaaagctctgtcagctatcagttccagtggatgtgctgtgcctatactcataagaagaaatgagtatttgaaaagatggtgaacaaaatgaagatggcgaagtagagataagtggtacaaaagacaagtttcaaagcaaggtaatatgcacaagggcctcaatagcctgtgctactacaatggttagttatttcactgagttaatgatccttttttgtgtcaaactgaaattttttttagggtaagcaggaggtcaattgacctactgcattttattaaaatgaatatatacagtgtaagttacgaaagagtaaaaagaaaattctatctaaagttgccaatccatcccggaatgcatggtatttctttctcttggccctatggaat

SEQ ID NO: 5248 - DNA, 1678 bp, Glycine max
aatgcataatcattaaactcattttcacctatgttgaagactgaaagaaacttgtacatgccgcatggttgggtaacggctagtacgaatcacaagttgcaccgcgacatcaccgtctcaaattcgcttttcatcctttctttttatgttcagtgttggctgtgctgtcgcccccacctatattcagattcaattcaatttttctttcttcttcttcagattcgcgtaagatggagggctcaaaggaaaaccgtgtgcctccgcttccgctcataccctcttcgaatcttcaacaaggcggtggtccaagaatgaagcgcctactccatcaccatcaccggctgcctctcggcaacatcagtcagaatgttatgcctcattctcatgtcaacaaactagatcttgcccgcaagtttacgccacacacagttcagcaccacttccctcagccacatccacagcctcaagaaaataagaaacagaaccttttggccccgaccccgagttaccagttagattgtgatatcgtagatattgatgacgacgatggggatggcagtgatgatgccgttccggtatttgtcaagcacactgaagccatgcttgacgaaattgacaagatagaggaagttgaaatggaagatgtagaggaggaacctgttttggacatcgatgcctgtgataggaaagatacactggcagtggttgagtacatagatgatatatacagtttctacaaggatattgagaattcgagccgtgtctctccaaattacatgaatagtcaatttgacattaatgaaaggatgagggctattcttattgactggcttgttgaggttcactacaaatttgagcttttggaggagacgttgttccttactgtcaatctcatagacaggttcttggagcgtcaggcagtgatcagaaagaaacttcagttagttggtgtaacagccatgctaatagcttgtaagtatgaggaggtctcagttcctaccgttgaggattttattctcataacagacaaggcatatacaagaaatgaagttttagatatggagaaattaatgatgaacatcttgcaattcaagttgtctgtgcctactccatacatgttcatgagaagatttcttaaggcagctcattctgataaaaagctggagctcttgtccttcttcttggtcgagctttgcttggtagaatgcaaaatgctgaagttttcaccatctttgctggctgctgcagccatttacacagctcaatgtagtctgtaccagtttaagcaatggactaagactaccgagtggtacactgattactcagaagagaaacttcttgaatgctcaaggctgatggttactttccatcagaaagctggatcggggaaactcacaggtgtatatagaaagtacaatacatggaagtatggctgtgccgcgaaaatagaaccagccctgtttctactggataattaagggaatgcaagtaaacttctagtttctaatgcattgctttggttgttttgagagtttgcttgtactagaagtttgttttgagagcttcacaagaccaacctatcgacagaagttggcttcagtagtgtttgtctttttctttcaagtaccgtgtctttttctttgcactcaatcttacctttcaggattgtatggaccaa

SEQ ID NO: 5249 - DNA, 1815 bp, Glycine max
atgttgaagactgaaagaaacttgtacatgccgcatggttgggtaacggctagtacgaatcacaagttgcaccgcgacatcaccgtctcaaattcgcttttcatcctttctttttatgttcagtgttggctgtgctgtcgcccccacctatattcagattcaattcaatttttctttcttcttcttcagattcgcatggagggctcaaaggaaaaccgtgtgcctccgcttccgctcataccctcttcgaatcttcaacaaggcggtggtccaagaatgaagcgcctactccatcaccatcaccggctgcctctcggcaacatcagtcagaatgttatgcctcattctcatgtcaacaaactagatcttgcccgcaagtttacgccacacacagttcagcaccacttccctcagccacatccacagcctcaagaaaataagaaacagaaccttttggccccgaccccgagttaccagttagattgtgatatcgtagatattgatgacgacgatggggatggcagtgatgatgccgttccggtatttgtcaagcacactgaagccatgcttgacgaaattgacaagatagaggaagttgaaatggaagatgtagaggaggaacctgttttggacatcgatgcctgtgataggaaagatacactggcagtggttgagtacatagatgatatatacagtttctacaaggatattgagaattcgagccgtgtctctccaaattacatgaatagtcaatttgacattaatgaaaggatgagggctattcttattgactggcttgttgaggttcactacaaatttgagcttttggaggagacgttgttccttactgtcaatctcatagacaggttcttggagcgtcaggcagtgatcagaaagaaacttcagttagttggtgtaacagccatgctaatagcttgtaagtatgaggaggtctcagttcctaccgttgaggattttattctcataacagacaaggcatatacaagaaatgaagttttagatatggagaaattaatgatgaacatcttgcaattcaagttgtctgtgcctactccatacatgttcatgagaagatttcttaaggcagctcattctgataaaaagctggagctcttgtccttcttcttggtcgagctttgcttggtagaatgcaaaatgctgaagttttcaccatctttgctggctgctgcagccatttacacagctcaatgtagtctgtaccagtttaagcaatggactaagactaccgagtggtacactgattactcagaagagaaacttcttgaatgctcaaggctgatggttactttccatcagaaagctggatcggggaaactcacaggtgtatatagaaagtacaatacatggaagtatggctgtgccgcgaaaatagaaccagccctgtttctactggataattaagggaatgcaagtaaacttctagtttctaatgcattgctttggttgttttgagagtttgcttgtactagaagtttgttttgagagcttcacaagaccaacctatcgacagaagttggcttcagtagtgtttgtctttttctttcaagtaccgtgtctttttctttgcactcaatcttacctttcaggattgtatggaccaagtgaattagcacattaattgcttttactaatcactgaaagatgcatgtcatagttcttgaattaacgaaattgtatattcttcaatatgtctacactccctaatggcaataatgattacggtaacataaggataggaaagatttgtgtgtgcacgcacaccacaccaaggga

SEQ ID NO: 5250 - DNA, 1483 bp, Cajanus cajan
aaggcggttcaagaatggagagtaagaagcccattcatcaccggctgcctcttggcaacatcaatctcaatgttatgccaaacaaaaacccttctcatgtcaacaaaccagatctttcccgcaagtgtacagcacacccagttctgcatcaccaccctctgccccaagaaactaagaaacagaacctgttggccccgacaccgagttaccagttagatcatgacatcatagatatcgatgatgatgaggatgccggtgacaatgcagttccagtatttgtgaagcatactgaagcaatgctcgacgaaattgacaggattgaggaagttgaaatggaagacgtggaggaacctgttatggacatcgatgcctgtgataggaaagatccacttgctgttgttgagtacatagatgatctctaccgtttctacaaggataccgagaattctagctgcgtctctccaaattatatgattagtcaacttgacattaatgagaggatgagggccattcttattgactggcttattgaggttcactacaaatttgaacttttggaggagacattgttccttaccgtcaatctcatagacaggttcttggagcttcaggcagtgatcagaaagaaacttcagttagttggggtaacagctatgctaatagcttgtaagtacgaggaggtctcagtccctaccgttgaggattttattctgataacagacaaggcgtatacaagaaatgaagttttagatatggagaaattaatgatgaacatcctgcaattcaagttgtctgtgccaactccatacgtgttcatgagaagatatctcaaggcagctcattctgataaaaagctggagctcttgtccttcttcttggtcgagctttgcttggtggaatgcaaaatgctgaagttttcaccatctttgctagctgctgcagccatatacacagctcaatgtagtctgtaccagtttaagcaatggactaagaccagcgagtggtatactgcttactcggaagagcagcttctagaatgctcaaggctgatggttactttccatcgaaaagctggatcaggtaaactcactggtgtatatagaaagtacagtacatggaagtatggctgtgccgctagaatagaaccagccctgtttctactggaacattaaggaaatgcacatgaacacaccaatagaagttgtggcttcagtactgtctttacactataaggacccttcagaaagttgtataaaactcctattcctattacgagtgcttgtctttcaggataatggtgtatagaaacaggcctgtttctactggataattaagggaatgcaagtgaactttagtttctaatacatttattcgcagactgctttggttgttttcggagtttgcttgtactagaagtttgcctatcaacagaagttggcctcactagtgtgtctctttctttacactcaatatagtctttcgg

SEQ ID NO: 5251 - DNA, 1741 bp, Glycine max
tctgagtctcccctgcttctgtcaactgcaatggttcctcaacctctgctaacccttttcctctttctctcccttctctcaattgtcaactcctctccttcccaacaccttcagatcgccaatgctgaacgcaggattgacttgacttctcacattattaaggtgtacttgacgttgaaggttgaaaatttggggacatctcctacttcagaagtacatattgccttttcacccactgaagtagaacatctagcaatagtcagagctgctgcaacttctgggaagaggaagaagaaaacttatgttcctctagatgtcaaatctgccgagctacctgatggaccaaatggaactaagtttttctctataactttgttaactccattaagtaaaggtgaaaccacaacactagaggtgctttacatattgacacattctctggaacctttcccagtagaaataagtcaatcagagtcacagttggtttatttccgtgatagtgcaatattattgtctccctatcatgtcaagcaacagacaacttttattaagactccaagcactcgggtagaatcattcacagtgatggaccccactaaacgtgctggtacagagttgaaatacgggccatatgaaaatcatcccccgtattcatattctcctgtacttattcattttgaaaataacaatgcctttgctgttgttgaggagctagaacgggaaattgaaatatctcactggggaagcgttcaagtcactgagcgatatagcttggtccatgctggtgctcgacataaaggtgttttttcaagggttgaatatcaaactaaaccaggtggtactggtgtctcttcatttaaacatcttttagcgaaactaccccctagggttcactcagtatactacagggatggaataggaaatatttcgtcgtcacatctacgtacagattcttggaagtcagaacttgaaattgaacctcggtatcctctatttggaggctggaaatcaacctttgtcattggttatgggctaccattgcaagactttctttttgagtctccagatggcagaagatacctcaattttacttttggttgccctcttgttgagacagtggttgacaagttgattgtaaaagttgtgctgccagagggatccaaagatcccactgttgagattccttttgaagtgaagcaacatctagagatcaagtattcataccttgatgttgtcggcagaactgtggtggttctagaaaaaagaaatgcagttcctgagcataatactcctttccaggtatactacaggtttaaccccatattcatgcttgctgagccattgatgctggtatctgcatttttcttgttttttgtggcttccgtggcatatcttcacattgatctttccatacgcaagtgatgaacacctagctagtttcttgaaaggcagtgactgagcagatccaagggttccttattttggaaggtcatattgcattgtggcaattttgtgtggagttaagaggactaattgcagttatagatatacttgtttgtacaatttttcccaggcaatttgatcttgtgccattcatccaaactaactttgaaccattccttctatttaagaaacataggatatgttagttaaagaccaacatcctaaaggcacgtaatgggaacaaacttgtaagatcttactagctatgagaaatatttatgtgatacttagcaatcaa

SEQ ID NO: 5252 - DNA, 1795 bp, Glycine max
attaataaaaccgaaagtgtagactagagtgtctgagtctcccctgcttctgtcaactgcaatggttcctcaacctctgctaacccttttcctctttctctcccttctctcaattgtcaactcctctccttcccaacaccttcagatcgccaatgctgaacgcaggattgacttgacttctcacattattaaggtgtacttgacgttgaaggttgaaaatttggggacatctcctacttcagaagtacatattgccttttcacccactgaagtagaacatctagcaatagtcagagctgctgcaacttctgggaagaggaagaagaaaacttatgttcctctagatgtcaaatctgccgagctacctgatggaccaaatggaactaagtttttctctataactttgttaactccattaagtaaaggtgaaaccacaacactagaggtgctttacatattgacacattctctggaacctttcccagtagaaataagtcaatcagagtcacagttggtttatttccgtgatagtgcaatattattgtctccctatcatgtcaagcaacagacaacttttattaagactccaagcactcgggtagaatcattcacagtgatggaccccactaaacgtgctggtacagagttgaaatacgggccatatgaaaatcatcccccgtattcatattctcctgtacttattcattttgaaaataacaatgcctttgctgttgttgaggagctagaacgggaaattgaaatatctcactggggaagcgttcaagtcactgagcgatatagcttggtccatgctggtgctcgacataaaggtgttttttcaagggttgaatatcaaactaaaccaggtggtactggtgtctcttcatttaaacatcttttagcgaaactaccccctagggttcactcagtatactacagggatggaataggaaatatttcgtcgtcacatctacgtacagattcttggaagtcagaacttgaaattgaacctcggtatcctctatttggaggctggaaatcaacctttgtcattggttatgggctaccattgcaagactttctttttgagtctccagatggcagaagatacctcaattttacttttggttgccctcttgttgagacagtggttgacaagttgattgtaaaagttgtgctgccagagggatccaaagatcccactgttgagattccttttgaagtgaagcaacatctagagatcaagtattcataccttgatgttgtcggcagaactgtggtggttctagaaaaaagaaatgcagttcctgagcataatactcctttccaggtatactacaggtttaaccccatattcatgcttgctgagccattgatgctggtatctgcatttttcttgttttttgtggcttccgtggcatatcttcacattgatctttccatacgcaagtgatgaacacctagctagtttcttgaaaggcagtgactgagcagatccaagggttccttattttggaaggtcatattgcattgtggcaattttgtgtggagttaagaggactaattgcagttatagatatacttgtttgtacaatttttcccaggcaatttgatcttgtgccattcatccaaactaactttgaaccattccttctatttaagaaacataggatatgttagttaaagaccaacatcctaaaggcacgtaatgggaacaaacttgtaagatcttactagctatgagaaatatttatgtgatacttagcaatcaatatacaaactttaaatgaaattt

SEQ ID NO: 5253 - DNA, 1846 bp, Cajanus cajan
taataaacgaaacccaaagtgtagtgtagtgtgtagacttgagtctgagtctctcctctgtttcgtcaactgcaattggcaatggcaatggcaatggcaatgcaacctctgctaacccttctcctctttctctcccttctctcagttgccaattcctctccttcccaacaccttcagatcgccaatgccgaacgcaggattgacttggcttctcacataattaaggtgtatttgacattgaaggttgaaaatttggggacatctcctgcttcagaagtacatctcgccttgtcacccactgaagttgaacatctagcaatagtcaaagctgctgcaacttctgggaagaggaagaagaaaacttatgttcctcttgacgtcaaatctgctgagctacctgatggaccaaatggaactaagtttttctctataactttgttaactccactaagtaaaggtgaaaccacaacactagaggtgctttacatattgactcattctctggaacctttcccagtagagataagtcaatcagagccacagttagtttatttccgtgatagtgcaatattattgtctccttatcatgttaagcaacagacaactttcattaagacaccaagcactcgggtagaatcattcacagtggtggaccccactaaacatgctggtacagagctgaaatatggaccatatgacaatcatcccccatattcatattctcctgtacttgttcattttgaaaacaacaatccatttgctgttgttgaggagctggaacgtgaaattgaaatatctcactggggaaacctacaagtcacagagcgatatagcttggtccatgctggtgctcgacataaaggtgctttttcaagggttgagtatcaaactagaccaggtggtacaggtgtttcttcatttaaacatcttttagcgaaactaccccctagggttcactcagtatactaccgggatggaataggaaatatttcctcttcacatcttagaacagattctcgcaagtcagaacttgaaattgaacctcggtatcctctatttggaggctggaaagcaacctttgtaattggttatgggctacccttgcaagacttcctttttgagtctccagatggcagaagatacctcaattttacttttgggtgccctcttgctgagacagtggttgacaagttgattgtaaaagttgtgctgccggagggatccaaagatcccacagctgttattccttttgaagtagagcaacatctagagatcaagtattcatatcttgatgttgtcggcaggactgtggtggttctagaaaaaaggaatgtagttcctgagcataatactcctttccaggtatactacacttttaaccccatattcatgcttgctgagccactgatgctggtatctgcatttttcttgctttttgcgacttctgtggcatatcttcacattgatctttccatacgcaagtgatgaacatctagctagtttcttgaaaggcagtgactgagcagatccaaggattccttagtttggaaggtcatattgcattttggcaatattttgtggagttaacaggactaattgcaattatagatttgcttgtttgtacaattttcccctggcaatttgatcttatgccattcatccaaactagcattaaaccatttaagaaacataggatatgttagataaggcaatcatccgaaaggtacatggtcgtaagaaactagtattatcgtcctttataggctttagacatattaatgtgatacttagcgatcaatatacgaattaaatgaaatttaaaaaaaaaaaaaagagcatattcaat

SEQ ID NO: 5254 - DNA, 1782 bp, Phaseolus vulgaris
actcgaatctaattaacccaaaattgcagtgtagacttcagagtcttcctctgcttccgtcaacaactgcaatggcaatggtccctcaacctctgttaatccttctcttctctctttcccttctttcaattgtcaactcctctccttcccaacatcttcagatcgtcgatgccgaacgcaggattgacttgacctctcacattattaaggtgtacttgacattgaaggttgaaaatttggggacatctgctgcttccgaagtacatctggccttttcacccactgaagttgaacatctagcaacgcttaaagctgctgcaacttctgggaagaggaagaagaaaacttatgttcctcttgatgtcaaatctgctgaggtacctgatggaccaaatggaactaagttattctctataactttgttgactccactaagtaaaggtggaaccacgacactagaggtgctttacatattgacacgttctctggaacctttcccagttgaaatcagtcaatcagagtcacagttggtttatttccgtgatagtgcgatattactgtctccctatcatgtcaagcaacagacaacttttatcaagacaccaagcactcgggtagaatcattcacggtggtggaccccaccaaacgtgctggtaccgagttgaaatatgggccatatgaaaatcatcccccgtattcatattctcctgtacttgttcattttgaaaataacaatccatttgctgttgttgaggagctagaacgtgaaatagaaatatctcactggggaagcattcaagtcactgagcgatatagcttggtccatgctggtgctcaacataaaggtgttttttcaagggttgactatcaaactagatcgggtcgttctggtgtttcttcatttaaatatcttttagcgaaactaccccctagggtccactcagtatactacagggatggaataggaaatatttcctcttcacatctacgtacagattctcggaagtcagaacttgaaattgaacctcggtatcctctatttggaggctggaaagcaacctttgtcattggctacggactaccattgcaagacttcctttttgaatctccagatggcagaagatacctcaattttacttttggttgccctcttgtcgagacagtggttgataagttgattgtaaaagttgtgttgccggagggatccaaagatcccacagctcagattccttttgaagtgaagcagcatctagagatcaagtattcatatcttgatgttgtcggcaggaccgttgtggttctagaaaaaagaaatgtagttcctgagcataatactcctttccaggtatactatggttttaaccctatattcatgcttgctgagccattgatgctggtatctgcatttttcttgctttttgttgcttctgtggcatatcttcacattgatctttccatacgcaagtgaagagcatccagccagtctcttgaaaggcagtgactgagcatatccaagggttccatgtttttggaaggtgatattgcattttggcaatattgtgtggagttaagagtactaattgcaattatacattttacttgtttgtacaattttgccgtggtaattttatcttaggcacttaatggtgagaaacctgtaagattttaccttgtaggtattagaaatattgaaaaaaaaaaaaacgtattcaatcatctatgttataataatttcgttaaaaggtaatccgcacttaaatgaatacctttctggagaggaa

SEQ ID NO: 5255 - DNA, 1730 bp, Vigna unguiculata
ggaatctaataaacccaaaattgcagtgtagacttcagagtcttcctctgcatctgtcaacaactgcaatggcaacggtccctcaacctctgttaatccttctattctttctctcccttctttcaattgtcaactcctctccttctcaacacattcagatcgtcgatgccgaacgcaggattgacttgacctctcacattattaaggtgtacttgacattgaaggttgaaaatttggggacatctgctgcttctgaagtacttttggccttttcgcccactgaagttgaacatcttgcattactcaaagccgctgcaacttctggtaagaggaagaagaaaacttatgttcctcttgatgtcaagtctgctaagcagcctgatggaccaaatggaactaagtttttctctataactttgttaactccactaagtaaagatgaaaccacgacattagaggttctttacatgttgacacggtctttggaacctttcccagttgaaataagtcaatcagagtcacaattggtttatttccgtgatagtgcaatattattatctccctatcatgtcaaacaacagacaacttttctcaagacaccaagcactagggtagaatcattcacggtggtggaccccactaaacgtgctggtacagagttgaaatatgggccatatgaaaatcatcccccgtattcatattctcctgtacttgttcattttgaaaataacaatccatttgcggttgttgaggagctagaacgtgaaatagaaatatctcactggggaagcattcaagtcactgagcgatatagcttggtccatgccggtgctcaacataaaggtgttttttcaagggttgaatatcaaactagaccagctggtactggtgtttcatcatttaaacatcttttagcaaaactacccccaagggtccactcagtatactacagggatggaataggaaatatttcctcttcacatcttcgtacagattctcggaagtcagaacttgaaattgaacctcggtatcctctatttggaggctggaaagcaacatttgtcattggctatggactaccattgcaagacttcctttttgaatcaccagatggcagaagatacctcaattttacttttggttgccctcttgtcgagacagtggttgataagttgattgtaaaagttgtgctgccggagggatccaaagatcccacagctgagattccttttgaagtaaagcagcatctagagatcaagtattcatatcttgatgttgtcggcaggactgtggtggttctagaaaaaagaaatgtggttcctgagcataatattcgtttgcaggtatactatggttttaaccctatattcatgcttgctgagccattgatgctggtatctgcatttttcttgctttttgttgcttctgtggcatatcttcacattgatctttccatacgcaagtgaagaacatctaaccagtttcttgaaaggcagtgactgagcagatccaaggtttccttagttttggaatttcctattgcatttttggaaatattgtgtggagttaagaggactgattgcaattatagagtttacttgcttgtacaattttccaatggcaatttgatcttaggcacttaattgtaagaaacctgtaagattttactatgtaggtattagaaatatttatgtgaaacttagcaatcaatatacaaacttgaattaaat

SEQ ID NO: 5256 - DNA, 2038 bp, Cicer arietinum
gaaaaacgggaggtgagagtagtaattctgacggaaaatatagagttgagattgagcccaagaagtgtatatagagaaagagttgagttgggagagtcttccttcgtcaactgcatcaattgtcatggaacctctcctcagaattgcacttctctttctcttctttcatctctccattcttgttaactcatctccttcccaacatcttcagatcatcaatgccgaacgcagaattgacctgaattctcacattattaaggtgtacttgacattgaaggttgaaaactcaggcacttctcctacttcagaagtacatcttgctttttcccctgccgaagccgaacatctagcagtagtcaaagctgccgcaactactgggaagaggaagaagaagacttatgtcccacttgatgttaaatctgctgagctacccgagggaccaaatggaactaaatttttctctataaccttgttaactccattgagtaaaggtgaaacgataacacttgaggtgctttacatattgacacattctctggaaccattcccagtagaaataagtcaatcagagtcgcagttggtctatttccgtgatagtgcaatattactttccccttatcatgtcaagcaacagacaacgttcattaagacaccaagcgcccgagtagaatcgcacacagtagtggaccccactaaacgtgttggtacagagctgaaatacgggccatatgaaaatcattccccatattcgtattctcctgtacttgtacattttgaaaataacaatccatttgctgttgttgaggagctcgaacgtgaaattgaaatatcccactggggaagcctacaaattacagagcgatataagctggttcatgctggcgctaaacacaaaggtgtcttttcaagggttgaatatcaaactagatcaggtgctagtggtgtttcttcatttaaacatcttcttgcaaaactaccccctagggttcactcagtatactaccgggatgaaatcgggaatatttcctcttcacatttacgtacagattttctaaagtcagaacttgaatttgaacctcggtatcctttatttggaggctggaaatccacctttctcattggttatggactaccattgcaagacttcctttttgagtctcctgatggcagaagatacctcaattttacttttggttgccctcttgctgagacagtggttgacaagttgattctaaaagttgtgcttccagagggatccaaagatcctgcagccgtgattccttttcaagtagagcaacatctagagaccaagtattcataccttgacattgtaggaaggactgtggtggttctagaaaagagaaatgttgttcctgagcataacatccctttccaggtatactacaattttaaccccatattcatgcttgctgagccattgatgctggcatctgtatttttcctgctttttgcggcttctgtggcatatttacatatggatatttccattcgcaagtgatgaacatctagctagttttctgaaagcgaaggactgagcagattaagcattttggcaatattgtatggagttgagcagttatattttctgcttgtttgtagaatttttccccggcaatttgatcttatgtcacgattctaaattagcattgaactattactttcatttaagaaacataggatgtttttagttggggtctcttcctagaggtacgtaatggtaagaaacttaaaaacatcttcctttccaggtattagatatatttcaactttatacgtagtaatcaatatacaaactgaaatttaaaaaaacatagcaaattcaatagttaattatgtttgtattgagtttaattgtgttatcatttggttaattaagttataatattcctgtgagaatgacatatgaaaaccaagggtcaccatagaaatcgattcaagaataaataatattcctgcgaccaaccttgtaatttgtaaactatttaaaaaccatggagaaatgagaatgacatataac

SEQ ID NO: 5257 - DNA, 1808 bp, Lotus japonicus
gtaatagagttgggagagtcttccatctctcttcttcttcgtcgtcttcgtcaactgcacccaatggaacctctcctcagagttccacttctcttcatcttcatctccctcttcatcaatctcgcaaattcatcatcttcacaagatgttcacatcgtcaatgccgaacgcagaatcgacttgacttctcacattgtaaaggtgtacttgacattgaaggttgaaaacttgggaacatctcctgtttcagaagtacatcttgctttttcacctactgaaagtgaacatctagcaatagtcaaagctgctgcaacttctgggaagaggaagaagaaaacttatgttcctcttgatgttaaatctgctgagctacctgatggaccaaacggaactaaatttttctctatagctttattaactccactgagtaaaggtgaaaccacgacacttgaggtgctttacagattgacacattctctggaacctttcccagtagaaataagtcaatcagagtcacagttggtctatttccgtgatagcgcaatattattgtctccctatcatgtcaagcaacagacaactttcatcaagacaccaagcacccgggtagaatcgttcaccgtggtggagcccactaagcgtgctggtacggagctgaaatatgggccatatgacagttattccccatattcatattctccagtacttgttcattttgaaaataacaatccatttgctgtggttgaggagcttgaacgtgaaattgaaatatctcactggggaagcgttcaagtcacagagcgatataggctggttcatgctggtgctcgacacaaaggtgttttttcaagggttgaatatcaaactagatctggtggtagtggtgtttcttcatttaaaaatcttctattgaaactaccccctagagttcactcagtatattaccgggatgaaatagggaatatttcctcttcacatttgcgaacagattttctgaagtcagaacttgaaattgaaccacggtatcctctatttggaggctggaaatcaacttttgtcattggttatggggtaccactacaagacttcctttttgagtctccagatggcagaagatacctcaattttacttttggttgccctgctgaggcagtggtagacaagttgatagtaaaagtcgtgctgccagagggatccaaagaccccgcagctgtgattccgtttgaagtagagcaacatctagagaccaagtattcgtatcttgatgttgtcggcaggactgtggtggctctagaaaagagaaatgtagttcctgagcataacactcctttccaggtgtactacaatttcaaccccattttcatgcttgctgagccattgatgctggtatctgtatttttctttctattcatgtctgctgtggcatatctacatatggacatctccatccgcaagtgatgaacatcttgctagctttatgaaaggcagtggctgagcaacaaaggttccatatagcatttttgcaaaatttagtggagttaaatggaccaaatgcaattagagttttgcttgtttgtatggttatccccatccttcaatcattacttccatttaagaaacattggatacgtttgttagatatatgacaagatactcagaagatgttcctttccaggtattagaaatatacaaactgaatttgacaaaaaaaagcatattcaacggttaaattatgtttgtattgagtttaattatgttggcattttgttaaaaagttatcctaactgaaatgaagtttttggggagat

SEQ ID NO: 5258 - DNA, 1788 bp, Trifolium pratense
aattgaaaatgtgaaattgagcccataaagtgtatatagtgagagttgagttctgagtcttctcttcgtcaactgcaccaatggccatggaacctctgctcagaatcggagtgcttttcctcttcctttatttctccattcttgttaactcatctcctgctcaacatcttcagatcatcaatgccgaacgcagaattgacctgacttctcacattattaaggtgtacttgacattgaaggttgaaaacttaggcacttctcctacttcagaagtacgtcttgctttttcacctgctgaagccgaacatctagcagtagtcaaagctgccataacaactggaaagaggaagaagaagacttatgttcctcttgatgttaaatctgctgggccacccgatggaccaaatggatctaaatttttctctgtaaccttgttaaatccacttggtaaaggtgaaacgacaacacttgaggtgctttacatattgacaaattctctggaacctttcccagtagaaataagtcagtcagagtcgcagttggtctatttccgtgatagtgcaatattattgtctccctatcatgtcaagcaacaaacaactttcatcaagacaccaagcgcccgggttgaatcattcacagtagtggagcctactaaacgtgctggtacagagctgaaatacgggccatacgacaatcatgctccctattcatattctcctgtacttgttcattttgagaataacaatcccttcgctgttgttgaggagctagaacgtgaaattgaaatatctcactggggaagcatacaagtcatagaacgatataggctgactcatgctggtgctagacacaaaggtgtcttttcaagggttgaatatcaaactagatcaggtgttagcggcgtttcttcatttaagcatctccttgcaagactaccccctagggttcactcagtctactaccgggatgaaataggcaatatttcctcttcacatttacgtaaagattttctaaagtcagaacttgaatttgaacctcggtatcctctatttggaggctggaaatccacctttctcatcggttatgggctaccattgcaagacttcctttttgagtctccggatggcaaaagatacctcaacttcacttatggttgccctctttctgacacagtggttgacaaattgattattaaagttgtgcttccagagggatccaaagatcctgcagccgtgattccttttcaagtagatcaacatctagagactaagtattcataccttgacattgtgggaaggactgtagtggttctagaaaagaaaaatgttgttcctgagcataacatccctttccaggtatactacaatttcaaccccatattcatgctcgctgagccattgatgctagcatctgtatttttcctgctttttgcggcttcggtggcatatttacatgtggatctttccatacgcaagtctagctagttttctgaaaggcatcgaagaactgagcagatcgatcattttggcaatattaatgtatggagttgagcagttatagttttgcttttttgtatgattttccccaggcagtttaatcttatgttgttattcatataaactagcattaaaccatgacttccatgtaagaaacataggatattttagttgatgttaagatttgccattcaatggttgtggatataggggaaatttagtgtcatgccatgccatggcattggcttagtaaatcaccaaccttcatatttctaaattaccacatttg

SEQ ID NO: 5259 - DNA, 1857 bp, Lupinus angustifolius
aaaataaaattgaagggtaaaaattgagacccaaaaataatgtaaaagtgagcagtgtagtgagtcattccctccttccttcttcaactgcaatgggatcatcattttcacaaccccttttcttcttcttcttcttcttccttcatcttttccttttcgcccattcttcctcttcttccttccaacaccttcagatcatcaatgccgaacgcagaattgatttgaattctcacattattaaggtgtacttgacattaaaggttgaaaactcggggacatctcctgcttcggaagtacatcttgctttttcgcctactgaggttgaacatctagcaatagtcaaagctgctgcaacctctgggaagcagaagaagaaaacttacactcgtcttggtgttaaatctgctgagctaccggatggaccaaatggaactaagtttttctcaataactttgttaactccactaagtaaaggtgaaaccataacattggaggtgctttaccaattgacacattctctggaacctttcccagtagaaataagtcaatcagaatcacagttggtctatttccgtgatagtgcaatattattgtctccctatcatgtcaaggaacagacaactttcattaagacaccaagtacacgggtggaatcattcacagtggtagaccccattaaacgttctggaacagagctgaaatatgggccatatgacgatcagctcccatattcatattctccggttcttgttcattttgaaaataacaatccattcactgttgttgaggagctagaacgtgaaattgaagtatctcactggggaagcgtacaggtcacagagagatataggctggttcatggaggtgctcgacacaaaggtgttttttcaagggttgaatatcaaagtagacaaggtagttctggtgcatcttcatttaaatatcttctagcaagactacccgctaaggttcactcagtatactaccgggatggaatagggaatatttcatcttcacatttacgtacaggttttgtgaagtcagaacttgaatttgaacctcggtaccctctatttggaggctggaaatcaacatttgtcatcggttatggggtaccattgcaggacttccttttcgagtctccagatggcagaagatacctcaattttacttttggttgtcctcttgctgaggcagtggttgacaagttgactgtaaaagttgtgcttccagagggatccagagatcctacagctgtggttccttttcaagtagagcaacgcctagagatcaagcattcatatcttgatgttgtcggaaggactgtggtggttctagaaaagagaaatgcagttcctgagcacaacactcctttccaggtatactacagtttcaaccctatattcatgcttgctgagccattgatgctggtaactgcatttttcttgttttttgtgggatctgtggcatacctacacattgatctttccatacgcaagtcttgaacatctagctagcttttaagatgggcaatgggtgagaagatccaaagctgttaaggttaggaatatgacccatagggtatgtgattttttgttagtcaagatttatgtttaacttggatgtttttaatctctcaaaacatagcacttcttaatgtccttgttattatttatttttcccaagctttttaaatattttgcttttagcttttgcaatttgggagtttcagttacaaacagcaaatataattgctattgctagcatgagtaatataactgtaacacgatgcagcaccttctaagatgaattattaatacactttgaaggtttcaacattttgttaactattgataa

SEQ ID NO: 5260 - DNA, 1759 bp, Trigonella foenum-graecum
gtgagagtcttgtcttcgtcaacttcatcatcatcatcaatggtcatggaacaacctctgctcagaatcgcactgttttttctcttccttcacttctccattctcgttaactcttctccttctcaacatcttcagatcatcaatgccgaacgcagaattgacctgaattctcacattattaaggtctacttgacattgaaggttgaaaactcaggcactactcctgcttcagaagtacatcttgctttttcaccttttgaagccgagcatctagcagtactcaaagctgccgcaactactgggaaaaggaagaagaagacttatgttcctcttgatgttaaatctgctgagatacctgatggaccaaatggagctaaatttttccctataaccttgttaactccactgagtaaaggtgacacgacaacacttgaggtgctttacatattgacacattctctggaacctttcccagtagaaataagtcaatcagagtcgcagttggtttatttccgtgatagtgcaatattattgtctccctatcatgtcaaacaacagacaactttcattaagacaccaactgctcgggtagaatcattcacagtagtggatccctctaaacgtgctggtacagagctgaaatacgggccatatgacgatcagaccccgtattcatattctcctgtacttgttcattttgagaataacaatccctttgctgtcgttgaggagctagaacgtgaaattgaaatatctcactggggaagcatacaaatcacagagcgatataagctagttcatgctggtgctagacacaaaggtgttttttcaagggttgaatatcaaactagatcaggtgccagtggtgtttcttcatttaaacatcttcttgcaaaactacctcctagggttcactcagtatactatcgggatgaaataggcaatatttccacttcacatttacgtacagattttctaaagtcagaacttgaatttgaacctcggtatcctctatttggaggctggaaatctacctttctccttggttatggactaccattgcaagatttcctttttgagtctccggatggcagaagatacctcaactttacttatggttgccctcttgctcagacagtggttgacaagttgattattaaagttgtgcttccagagggatccaaagatcctgcagccgtgattccttttcaagtagatcaacatctagagacaaagtattcataccttgacattgtgggaaggcccgtggtggttctagaaaagagaaatgttgttcctgagcataatatccctttccaggtgtactacaattttaaccctatattcatgcttgctgagccattgatgctagcatctgtatttttcctgctttttgcggcttctgtggcatatttacacgtggatctttcgatacgcaagtcatgaacaactagctagttttctgaaaggcaacgctgaactgagcagatcgaacattttggcaaaatattgtatggagtttagcagctataattttgcttgtttgtatgattttcccctggcaatttaatcttatgtcatgattctaaactaacattgaaccattacttccatttaagaaacaacataggatatgatagttgggttatcattataaaggtagattatggtaagaaacttatgaagtcttcctttcgaagtattagaaatttttttttttttgtttgtacttgataatcaatatacaaatttcaataga

SEQ ID NO: 5261 - DNA, 1908 bp, Trifolium pratense
aggagaaaaattgaaaatgtgaaattgagcccataaagtgtatatagtgagagtttgagttctgagtcttctcttcgtcaactgtatcaatggccatggaacctctgctcagaatcggagtgcttttcctcttccttcacctctccgttcttgttaactcatctccttctcatcatcttcagatcatcaatgccgaacgcagaattgacctgacttctcacattattaaggtgtacttgacattgaaggttgaaaacttaggcacttctcctacttcagaagtacgccttgctttttcacctgctgaagccgaacatctagcagtagtcaaagctgccataacaactggaaagaggaagaagaagacttatgttcctcttgatgttaaacctgttgggccacccgatggaccgaatggaactaaatttttctctgtaaccttgttaactccacttggtaaaggtgaaacgacaacacttgaggtgctttacatcttgacacattctctggaacctttcccagtagaaataagtcagtcagagtcgcagttggtctatttccgtgatagtgcaatattattgtctccctatcatgtcaagcaacaaacaactttcatcaagacaccaagctctcgggttgaatcattcacagtagtggagcccactaaacgtgctggtacagagctgaaatacgggccatatgacaatcatgctccgtattcatattctcctgtacttgttcattttgagaataacaatcccttcgctgttgttgaggagctagaacgtgaaattgaaatatctcactggggaagcatacaagtcatagaacgatataggctgactcatgctggtgctagacacaaaggtgtcttttcaagggttgaatatcaaactagatcaggtgttagcggcgtttcttcatttaagcatctccttgcaaaactaccccctagggttcactcagtatactaccgggatgaaataggcaatatttcctcttcacatttacgtaaagattttctaaagtcagaacttgaatttgaacctcggtatcctctatttggaggctggaaatccacctttctcatcggttatgggctaccattgcaagacttcctttttgagtctccggatggcaaaagatacctcaacttcacttatggttgccctctttctgacacagtggttgacaaattgattattaaagttgtgcttccagagggatccaaagatcctgcagccgtgattccttttcaagtagatcaacatctagagactaagtattcataccttgacattgtgggaaggactgtagtggttctagaaaagaaaaatgttgttcctgagcataacatccctttccaggtatactacaatttcaaccccatattcatgctcgctgagccattgatgctagcatctgtatttttcctgctttttgcggcttcggtggcatatttacatgtggatctttccatacgcaagtctagctagttttctgaaaggcatcgagggactgagcagatcgatcattttggcaatattgtatggagttgagaagttatagttttgcttttttgtatgattttccccaggcagtttaatcttatgttgttattcatataaactaagcattaaaccatgacttccatgtaagaaacataggatattttagttgatggtaagatttgccaattcaatggttgtggctataggggaaatttagtgtcatgccatggcattggcttagtaaatcaccaaccttcagatttctaaattaccacatttgattctagaagtacacatctaaacgacataaaccttctacatttgttcataagttaaaggccgggaaacggtctcatgtagaagtgtattattaggtgcacgtgcacttattaggtgc

SEQ ID NO: 5262 - DNA, 2349 bp, Medicago truncatula
agaagtgtatatagagagattagagagagttgagttcttcttttaacagagtcttctcttcgtcaacttcaccatcaatggtcgccatggaacaacctctgctcagaatcgcactgctctttctcttcctccacttctccattctcgttaactcatttccttctcaacaccttcagatcatcaatgccgaacgaagaattgatctgaattctcacataattaaggtctacttgacattgaaggttgaaaactcgggcactactcctgcttcagaagtacatcttgctttttcaccggctgaagccgaacatctagcagtactcaaagctgccgcaactaccgggaagaggaagaagaagacttatgttccgcttgatgttaaatctgctgagatacccgatggaccaaatggatctaaatttttccctgtaaccttgttaactccactgagtaaaggtgagacgacaacacttgaggtgctttacatattaacacattccctggaacctttcccggtagaaataagtcaatcagagtcgcagttggtttatttccgtgatagtgcaatattattgtctccctatcatgtcaagcaacaaacaactttcattaagacaccaaccgctcgggtagaatcattcacagtagtggagcccactaaacgtgctggtacagagctgaaatatgggccatatgatgagcagacaccgtattcatattctcctgtacttgttcattttgagaataacaatccctttgccgttgttgaggagctagaacgtgaaattgaaatatctcattggggaagcctacaaatcacagagcgatataagctggttcatgctggtgctagacacaaaggtgttttttcaagggttgaatatcaaactagatcaggtgctagtggtgttgcttcatttaaacatcttcttgcaaaactaccccctagggttcactcagtatactatcgggatgaaataggcaatatttcttcatcacatttacgcacagattttctaaagtcagagcttgaatttgaacctcggtatcctctatttggaggctggaaatccacctttcttcttggttatggactaccattacaagacttcctttttgagtctccagatggcagaagatacctcaactttacttatggttgccctcttgctcagacggtggttgacaagttgattataaaagttgttcttccagagggatccaaagatcctgcagccgtgattccttttcaagtagatcaacatctagagaccaagtattcataccttgacattgtgggaaggactgtggtggttttggaaaagagaaatgttgttcctgagcataacatccctttccaggtgtactacaattttaaccccatattcatgcttgctgagccattgatgctagcatctgtattttttctgctttttgcggcttctgtgacatatttacatatggatctttccatacgcaagtcatgaacaactagctagttttcttaaaggcgacacgggactgagcagatcgaatattttggcaatattgtatggagtttagcacagctatagttttgcttgtttgtatgatttccccctggcaaattaatcttatgtcatgattctaaactagaattgaagcattacttgcatttaagaaacataggatgtgttagttgggttatcattataaaggcaggtgatggtaagaagattacaggatcttcctttcgaggtattagaaatgttttaattttatacttggtaatcaatatacaatctaaaataaaaaagaaagaaaagaaaaacatctcttttatggagaaatacttggttaggcacaacaccccttttatgatcttctctctttgtcacgctgctgtcctgactcccacttagtcacacagcttggccatcgacaaagaggaatagttgcggctaggaacaatttagtgccatggcattggaattggtaccttagcatcttctatgtctcattcattagccattagtaaatcacccacttccatatttctgaaaaaccacatgatagaagttcttgattttgatatgttcagaagtgattagggggtgagaaacattctcccatatcatgaatatagaagtgtttgtagatctaataatttttcaatgtattgggtgcagtagtagtaacaagaaaaggaatttcatattttcattcagtgattgcaatatcactgcactcaatgtgtgcacatgttgtgtataaggtcgaaggagaaaattcttgtgttgttttgcaacatcagttttcatattattgttattctgctttcattttttttttctttcttttctctttaac

SEQ ID NO: 5263 - DNA, 1675 bp, Trifolium pratense
cttcgtcaactgtaacaatggccatggaacctctgctcagaatcgcagtggtttttctcttcctttacctctccgttcttgttaactcatctcctgctcaacatcttcagatcatcaatgccgaacgcagaattgacctgacttctcacattattaaggtgtacttgacaatgaaggttgaaaactcaggcacttctcctacttcagaagtacgtcttgctttttcacctgctgaagccgaacatctagcagtagtcaaagctgccataacaactggaaagaggaagaagaagacttatgttcctcttgatgttaaatctactgggccacccgatggaccaaatggatctaaatttttctctgtaaccttgttaaatccacttggtaaaggtgaaacgacaacacttgaggtgctttacatattgacaaattctctggaacctttcccagtagaaataagtcagtcagagtcgcagttggtctatttccgtgatagtgcaatattattgtctccctatcatgtcaagcaacaaacaactttcatcaagacaccaagcgctcgggttgaatcattcacagtagtggaacctactaaacgtgctggtacagagctgaaatacgggccatatgacaatcatgctccgtattcatattctcctgtacttgttcattttgagaataacaatcccttcgctgttgttgaggagctagaacgtgaaattgaaatatctcactggggaagcatacaagtcatagaacgatataggctgactcatgctggtgctagacacaaaggtgtcttttcaagggttgaatatcaaactagatcaggtgctagcggcgtttcttcatttaaacatctccttgcaaaactaccccctagggttcactcagtctactaccgggatgaaatagggaatatttcctcttcacatttacgtaaagattttctaaagtcagaacttgaatttgaacctcggtatcctctatttggaggctggaaatccacctttctcatcggttatgggctaccattgcaagacttcctttttgagtctccggatggcaaaagatacctcaacttcacttatggttgccctctttctgacacagtggttgacaaattgattataaaagttgtgcttccagagggatccaaagatcctgcagccgtgattccttttcaagtagatcaacatctagagactaagtattcataccttgacattgtgggaaggactgtagtggttctagaaaagaaaaatgttgttcctgagcataacatccctttccaggtatactacaatttcaaccccatattcatgcttgctgagccattgatgctagcatctgtatttttcctgctttttgcggcttcggtggcatatttacatgtggatctttccatacgcaagtcatgaacatctagttagttttctgaaaggcatcgagggactgagcagatcgatcattttggcaatattgtatggagttgagcagttatagtttttcttttttgtatgattttcccagcagtttaatcttatgttgttattcatataaactagcattaaaccatgacttccatgtaagaaacataggatatgttagttgatggtaagatttgccattaaaaaaaaagtgatggtaagatttttctttccgggtattagga

SEQ ID NO: 5264 - DNA, 2027 bp, Lupinus angustifolius
aaaataaaaaattgaagtatttgtatctgaggagagtagtgttatagtgtagtgattttctctttcattttcttcgtcaactacaatggaagctgctcaacgaaaaccctttttcttcttcatttccctctttcatctcttccttttcgccaattccttatctaatttccaagaccttcatatcatcaatgctgaacgcaggattgatttatcctctcacattattaaggtgtacttgacattgaaggttgaaaacttggggacatctcctgcttcagaagtacatcttgctttttcacctactgaggttgaacatctagcaatagtaaaagcagctgcaacatccgggaagcggaagaagaaaacttacactcctcttggtgttaaatctgctgatctacctgatggaccaaatgaaactaaatttttctcgatagctttgttaactccactaagcaaaggtgaaaccataacactagaggtgctttaccagctgacacattctctggaacctttcccagtagaaataagtcaatcagaatcgcaattggtctatttccgcgacagtgcaatattattgtctccctatcatgtcaaacaacagacaactttcattaagacaccaagtacacgggtagaatcattcacagtggtagatcccattaaacgttctggtacagagctgaaatatgggccatatgacaatcagctcccatattcatattctcctgtccttgttcatttcgaaaataacaatccattcactgttgttgaggagctagagcgtgaaattgaagtatctcactggggaagtgtgcaggtcacagagcgatataggcttgttcatggaggtgctcgacacaaaggtgttttttcaagggttgaatatcaaactagacaaggtggtggtgctggtgcgtcttcatttaaacatcttcttgcaagactacccgctaaggttcactctgtatactaccgggatcaaatagggaatatttccacttcacatttacgcacaggttttgtgaagtcagaacttgaatttgaaccccgatatcctctatttggaggctggaaatcaacatttgtcatcggttatggggtaccattgcaggacttcctttttgagtcttcagatggcagaagatacctcaactttacttttggttgtcctcttcttgaggcagtggttgacaagttgacgttaaaagttgtgctgcccgagggatctaaaaatgctactgctgtggttccttttcaagtagagcaaagactagagaccaagcatacatatcttgatgttgttggaaggactgtggtggttctagaaaagaggaatgcagttcctgatcacagcattcctttccaggtatactacagtttcaaccctatattcatgcttgctgagccattgatgctggtatttgcatttttcttgttttttgtggcatctgtggcatacctacacatcgatctttcgatacggaagtgatgacaatctagctatcttgaaaaagggcagggagcaagaagatccaaagatggtgctggtgttactttgatgagaagttgatataacattttgacaatattgtactaaatgcaattatagatttgcttctttgtaggattttaccccttggattttgatcttgtgtcattcatctaaactagcactcaaccattacttctatttaagaaatatagaacttgttagttagggccatcaccctaaatgtgtaatggcaagaaacctataagatcttccttttaggtttgacaaatatttcaatctgagcatgagattttaagcctcttattcagctaatcacacaagctaaggaagcttaaatatatagtttcacctttagaaaaagttggaaaaatgacctataggtaaacaatgaataaaaaagggtaaaacaatgattggcaagaacattctatattacatgcttataagtccaactatatcaaactattattatcatcatcatcccatgatctatacaaaataacaataaaaa

SEQ ID NO: 5265 - DNA, 2396 bp, Flaveria ramosissima
gccaccgacactttctcattccggcagccccctcatctcttcccttaataatactaataataatagtctccagccgccaccaccacatccttcacaccgactttctcaaatttcaatttccttcataatcggtggcctcaaaacttaaaactccaaatcaacatttcatcacaaactcaatgcccttttaaaatcaacgctaccttggtttccaattggtcgattgaaagtttgtgaaagctgtttcttttccggcagacaagtgtttcattaaattctggttggatcggtgttaattgtgttccctacgtaatctggatcttgattggttctaattacgtgttaatcgctcaccggttcaccgattggcgacaattccgcggtttttgtttgtgaatctcgtgaatctagatcgggtttttggtaattagggttttgagttgttgatgtatggtggagaaatgtgtagggtagaggagagggataagaagaagaagaggaggtttgcgattggagaaatggggttgaagacgttgggggaaattagggttgagaagctgaagagttctatggcgaatgcaaggtctccgaggatgaagatctggttgattagggctacgacgacggtgttgttgtggacttgtgtggtgcagttgactgcattagggggttcatggggacctagggttttgaaaggctggccttcttgttttactcaagattcacattctgctgctgcgttggatattaagttgttgcctagtgttcctgctagagttcttccacccaagagggtttacaagaacaatggttacttggtggtttcgtgtaacggagggctcaatcaaatgcgttctgctatttgtgatatggttgcaattgctagatatttgaatgttactcttatagttcctgagctggataaaacttccttctgggctgatccaagtgagtttgaggacatttttgatgtcgatcatttcattacgtccttgagagatgaagtccggatacttaaacagcttcctcccaggcttaaaaaaagagttgaattaggaattgtgcataccatgcctcctgttagttggtctgatatttcttactatcataatcagattcttcctctgattcaaaaatacaaagttgtgcacttgaatagaacagatgctcggcttgccaacaatggtcaacccctcgaacttcaaaaacttaggtgccgagtaaacttcagtgctctgagatttactactcagatagaagaattgggtagacgtgttgttaagcttttgagacaaaacggaccttttctggtgcttcatctcagatacgagatggatatgttagcattttctggctgtacacaaggatgcaatgatgaagaggttgaagagttgaccagaatgagatatgcttacccatggtggaaggaaaagattataaactctgatttgaaacggaaagacgggttatgccctttgacccctgaagaaactgctctcacactaaaagcacttgatattgaccgtgacatccagatttacattgctgctggtgaaatatatggtggaaaaagaagaatggatagtcttgcagatgcctacccgaaactggtaagaaaggagactctgttagggccagctgaccttcaatattttcaaaatcactcgtcacaaatggcagcattggattatcttgtgtcacttgagagcgatatttttgttcctacttatgatggaaacatggccaaagttgtagaaggccaccgcagatttttgggttttaagaagacaattctattggacaggagggttttggttgaattaatagacaaatatacaagcggggttttgagttgggatgaattctcgagtgctgttaaggatacacatgcacaacgcatgggggcccctacgaaaagattggttattgcagatagacccaaagaagaagattacttctatgcaaatccagaagagtgcctgcagccatcagatgatgaacctgtaagcatcctatgaccaaggatttgtcggttagtttggcccgttgggatctatgaactgtctgaaccacaagattaagattctcggcccctgaatcagtcgaatcagtcggtgtgtgaatgaatatttgttcattatgagggtgcaacacattttggtgggaccaatggcgagagatgcacgaagacaagaatgtttccacgaatagtaatatggcgtttattattgatgtcctgtttttattatttcatatgtgtggttttatgtcaataattctcattcatgtatagaaaactatcctgacatttctagggttattactaaaactagtgtattgtacacagagacgaaaccataggcgtgcctactttttctatttccttatttgtagtc

SEQ ID NO: 5266 - DNA, 1927 bp, Flaveria ramosissima
gttgcatttcactgagagttaatttctccgaaaatctcgtttaaagtgttgaattccggttggatcgggcgtaattgtgtcccgatctttgattacttcaatcacgtgttgtttcgcgagaattctgcgggtttcttcgtgaatcgagatcagttagagaattagggttttgagaattagagaaatgtgtagggtggatgatagaggtaagaagaggaggaggtttgcgatcgggacaatggggttggagaaattgggggaaattagggttgagaagttgaagaactctgtggcgaatgtaaggtctcctaagatgatgatggtgttgattagggctacgacgatggtgttattgtggacttgctttgttcagttgacagcatttgggggagattggggacctagggttttgaaagggtggccttcttgttttactcaagattctcatgctgcagctgtgttagatgataaattgttgcctaatgctcctgcaagagttcttccacccaagagggtttacaagaacaatggttacttggtggtttcatgtaatggaggactcaatcaaatgcgttcggctatttgtgatatggtcgcgattgctagatatttaaacgttactcttatagttcctgagctggataagacttccttctgggctgatccaagtgatttcgaggacatttttgatgttgatcatttcattacatccttgagagatgaagtccggatacttaaacaacttcctcctaggcttaaaaggagagttgaattaggaattgtgcataccatgcctcccgttagctggtctgatatttcttattatcataaccagattcttcctctgattcaaaaatacaaagttgtgcatttgaacagaactgatgctcggcttgccaataatggtcaaccccttgaacttcaaaaacttaggtgtcgagtaaatttcaatgctctgagattcactcatcaaatagaagaattgggtagacgtgttgttcaacttttaagacaaaacgggccttttctagtgcttcatctcagatatgaaatggatatgttagcattttctggctgtacacaaggatgcaatgctgaagaggttgaagagttgaccagaatgagatatgcttacccatggtggaaggaaaagataataaattctgatttgaaacggaaagacggtttatgccctttgacccctgaagaaactgcccttacacttaaggcacttgatattgaccgtgacatccagatctatattgccgctggtgaaatatatggtggaaaaaggagaatggatagtcttgctgaggcctacccgaagctggttagaaaggagactttgttaggggcagatgaccttcagtatttccaaaaccactcatcacaaatggcagcattggattatctcgtgtcgctagagagtgatatttttgtacctacttatgatggaaacatggccaaagttgtagaaggccatcgcaggttcttgggtttcaagaagacaatactgttggacagaagggtgttgactgaattaatagacaaatatacaagtgggtcgttgagttgggatgaattctcaagtgcggttaaggatacacatgcacagcgcatggggaacccttcaaaacgaacagttattccagatagacccaaagaagaagattacttctatgcaaatccagaagaatgcttgcagccatcagctgatgatgaacctgtgaacatcctatgattaaggatttgttggttaatttggcctgttgagcttgataaagtgtctgaattacacgattagaatttttggtcttcgactctgttggtgtacaatgagtatttgtccaaaatacgaggatgccacacattttggtgagacgtatggtacatgatgcacacagacaacaaagcttccacgaatgag

SEQ ID NO: 5267 - DNA, 2665 bp, Cichorium intybus
aagaaaaagagtatggaatttagcgagtgtacataagttcgcatggatccttgtgcacccagttgtatcatatcacaaatccctttgtgttctctctactctttccatctcatctttctaatttgccggccaccgacacattatcattccggcaatcttctcatctattgccgcagagatcgccgccccactacaacttcatcgtgttgacctccggttgaaaccggaagtgacctctttcaaattctatttttgtcggtagattctaaaatctggatgaagatttaagaaaaatttaatgcggttttgagttcaacgctacttttctatctatatttcgccataaatggtttgctgaaaacatagtagttatgtacaattagagggagagaaataacggtgcatttggctgagaattaatttcaccgaaaaacttgtgaaagttgcttatttcatggtagacaagtctgccattaaattgtagttggatccgctataactgcgttccctacaaaattcggatctcgataaattcgttacatcttattcatccatcggttcggcggcgacaatttagtagttttctaagcgaatccagatccttcatttcgtttcttcttcaggtactagagaattagggttttagttgtggatgtatgatagggaaatgtgcagggtagaggatagagataagaagaagtcgaagaggttttcaatcggaactatggggttgaagaccttaggagtaagcagagttgaaaagttaaaaatcatggcgaatacaaggtctccgaggatgaagttgtggttaattagggctacgacgacggtgttgctgtggacatgcttcattcaactgacagcgttaggtggttcatgggggcctagggttttgaaaggctggccttcttgctttactcaagattcacattctgctactgctttagatataaagttattgccctctgttcctgccagagtccttccacccaagagggtttacaagaacaatggttacttaatggtttcatgtaatggaggactcaatcaaatgcgttctgctatttgtgatatggtggcaattgctagatatttaaatgttacacttatagtccctgaactcgataaaacttccttctggtctgatccaagtgaatttgaggacatttttgatgttgatcatttcattacatcattgagagatgaagtccgtgtgcttaaacaacttcctcctaggcttaaaaagagggtcgaattaggaattgtacataccatgcctcccgttagctggtctgatatttcttactatcataaccagattcttccattgattcaaaaatacaaagttgtgcatttgaatagaaccgatgctcgattagccaacaacggtcaaccccttgacctccaaaaactcaggtgcagagtaaacttcggtgccttaagattcacaactcaaatagaagaattgggaaaacgcgttgttaatcttttaagaaaaaacgggccatttttggtacttcatttgagatacgaaatggacatgttggcattttctggatgtacacaaggttgcaataccgaagaaatagaagagttaacaagaatgagatacgcgtacccatggtggaaagaaaaaataataaactccgatttaaaaagaaaagacgggttatgccctttgacccctgaagaaaccgcccttacacttcaagcacttgatattgaccgtgacatacaaatttacattgctgctggtgaaatatatggcgggaaaagaagaatggatagccttcaaaacgcctacccaaaactagtacgaaaggagactcttttagggcccaatgatcttcaatattttcaaaatcactcatcacaaatggcggctttggattatcttgtctcattggaaagtgatatttttgttcctacttatgatggtaacatggcaaaagttgtggaaggtcaccgcaggtttttgggattcaagaagacaatattgttggataggagacttttggttgacttaatagacaaatacacaagtggggttttaaattgggatcaattttcaatttctgtaaaagaagttcatcaagaaagaatggggaatcctacaaaaagattggttattcccgatagaccgaaagaagaagattacttttatgcaaatccagaagagtgtttgcagccgtcggatgatgagacttttgtggattgacttttggagagttttatgaagtgtttgaattcaatgattatgattctgtgaccttgaatcggttggtttataaagagggatttgtgacaatgtgaaagggcatagatgaatgaacgcgttttgattggagatggatgaagatgagagagtgtttccacgggtagaaatgaagtttattatttattattattgtgttgtcttacattttatatgcaatgttattgttaataattcttgttcatatatagaaaggaccctgacattgcagggttatattatatcttcgagtttataagtgtcgatttgtgcacatataggcgttcgattatttctaggtaaaggtattatttgtcgcgtaacaaaaggtttttatggtaagtgttaaatttgagattgtaaatcgaaaggttaaatacaataaatagtaacaaatttaaagttagttcc

SEQ ID NO: 5268 - DNA, 1980 bp, Helianthus annuus
aaaccctagaggttttataaacgcgactacatttcactgagaattaattacttgtgaaagttgtttcctttattgaattctgattcggatctgtaattattgatcagtagatcttgattttggagaattagggttttgagttgtggatgtatggtagagaaatgtgtagggtagaggagagagataataataataagaagaagaagatgaggaggtttgcaattggaagtatgggattgaagaaatttggggaaatcagggttgaaaaattgaagaattctatggtgaatgtaaggtccactaaaatgaagatgtggttaattagggcaaccactatggtgttattgtggacttgtttggttcagttgactgctttaggtggtggttcatggggacctagggttttgaaaggttggccttcttgttttactcaagattctgcattggatgttaagttgttgcctactgttcctgttagagttcttccacacaagagggtttataagaacaatgggtacttggttgtttcgtgtaacggtggacttaatcaaatgcggtctgcgatttgtgatatggttgcgattgctagagatttgaatgttactcttatagttcctgagctggataaaacttccttctgggctgatccaagtgagtttgaggacatttttgatgtcgatcatttcattacgtctttgagagatgaagtccggatacttaaagagcttcctccgaggcttaaacagagagttgaattaggaattgtgcataccatgcctcctgttagttggtctgatatctcttactatcataatcagattcttccgctgattaaaaagtacaaagttgtgcacttgaacagaaccgatgctcggctagccaataacggtcaaccccttgaacttcaaaagcttaggtgccgagtaaatttcgatgctctgagatttactcctcaaatagaagaattgggtagacgtgtagtgaagcttctgagacaaaacgggccttttctagtgcttcatcttagatacgaaatggatatgttagcattttccggctgtacacaaggatgcaatgatgaagagattgaagagttgaccagaatgagatatgcttacccatggtggaaggaaaagattataaattctgatttgaaacgaaaagacggtttatgccctttgacccctgaagaaaccgctcttacacttaaagcacttgatattgaccgcgatatccagatttacattgctgctggtgaaatatacggtggaaaaaggagaatggatagtcttgcagatgcctacccgagactggtaagaaaggagacacttttagggccggctgaccttcaatattttcaaaatcactcgtcacaaatggcggcattggattatcttgtgtcactagagagcgacatttttgttcctacgtatgatggaaacatggccaaagttgttgaaggccaccgcagatttttgggtttcaagaagacgattctattggacaggaagattttggttgatttaatagacaaatatacaagtggagttttgagctgggatgaattctctggtgcggttaaggatacacacgcgcaacgtatgggggcccctacgaaaagattggttatgcctgatagacccaaagaagaagattatttctatgcaaatccagaagagtgcctgcagccatcagatgatgaacctttgagcatcctgtgagtagggatttgttgcttaggttggcccgttgggatctatgaactgtctgaaccacaggattatgattctcggccctcgaatcagtcggtgtactatgctaacacattttggtgggaccgatggtgagagatgcatgaagacaagaatgttcccatgaacgaatatattgtgccgtttattattgatgtcttttatttttatttcatatgtatggttattgtcaataattctcattcatgtatagaaaagaacacccccc

SEQ ID NO: 5269 - DNA, 1831 bp, Ambrosia trifida
ctgtagacaaagcctgtcattaatttcttgttggatcagatctggtattattattaattcggtaattgcgttattgttgatgtatggtagagaaatgtgtaaggtagaggagagagataataatgataataataacaatatgaagaagaagaagaaaaggtttgtgattggaaagattagggttgagaaattgaagagttgtaatataatgaatggaaggtcatgtaagatgaagatgtggttggttagggctacaaccatggtgttgttttggacttgtttggttcagttgactgctttaggtggtgggtcatggggtcctagggttttgaaaggttggccttcttgttttactcaagatcctcatactgcttctgctttggatattaagttattgcctagtgttcctgctagggttcttccacataagagggtttacaagaataatggttatttggttgtttcgtgtaatggaggacttaatcaaatgcgttctgcgatttgtgatatggtcgcgattgctagatatttaaatgttactcttatagtacctgagctggataaaacttccttctgggctgatccaagtgagtttgaggacatttttgacgttgatcatttcattacgtccttgagggatgaagtccggatacttaaacagcttcctcctaggcttaaaaagagagtcgaattagggattgtgcatacgatgcctcctgttagttggtcggatatttcttactatcataatcagattcttcctttgattcaaaagtacaaagttgtgcacttgaacagaaccgatgctcggcttgcaaataatggtcaaccccttgaacttcaaaaacttaggtgccgagtgaattttaatgctctgagatttaccactcaaatagaagaattgggcagacgtgtagtgaagcttctgagacaaaacgggccttttctagtacttcatctcagatatgaaatggatatgttagcattttctggctgtacacaaggatgcaacgatgaagagattgaagagttgacaagaatgaggtatgcttacccctggtggaaggaaaagattataaattctgatttgaaacgaaaagacggtttatgccctttgacccctgaagaaactgctcttacacttaaagcacttgatattgaccgcgacatccagatttacattgctgctggtgaaatatatggtgggcaaaggagaatggatagtcttgcagatgcctacccaagactggtaagaaaggagactctgttagggccagccgaccttcaatattttcaaaatcattcgtcacaaatggcagcattggattatcttgtgtcactagagagtgacatttttgttcctacttatgatggaaacatggccaaagttgtagaaggccaccgaagatttttgggtttcaagaagacgattctattggacagaaagattttggttgatttaatagacagatatacgagcggagctttgagctgggatgaattctctgatgcggttaaggagacacacgcgcaacgtatgggggcccctaccaaaagattggttatgctcgatagacccaaagaagaagattacttctatgcaaatccagaagagtgcttgcagccatcagatgatgaacctgtgagcatcctatgagtaggatttgtcggttaggctgttgcccgttggggtttatgaactgtctgcaccacaggattatgattcttggccctcgaatcagtcgatgtactatgctaacacattttggtgggaccgatggtgagagatgcatgaagacaaggatgtttccatgaacagtattatggggtt

SEQ ID NO: 5270 - DNA, 2072 bp, Artemisia annua
tctctctactcttctcttcaccgacactttctttattccggtcaccgtcacacttttccggccaccgtcattttttccggccactttatccaatttccttccgaccctttatacaaaatcaaaaacccattttataccactaaaatttcccattttcatccattaaataaccgtgcattttaatctttacccagtactaaagtcaccaaaaaagttaattttttttgtgggttattgataatttggatcaaatttattacataattcagatctcacagtttttatatatttttttggtatttttttaatatatttttatagatctttagggttttaagggctattgaatgtatgaatcaaatatgtgtaggttagaagataagaataggaataaaattaaggctagatttgtgataggtacaatggggttaaagaaaagattaagtgaaattagagttgataaatttagaaactccatgaggtcgtcttcgaaaatgaagatgtggttaattagggctacaactactgtcttgttatggacttgtgttgttcagttaactgctttaggtggtacttggggtcctagggtgttaaaaggttggccttcgtgttttagcgttgatgatcatgttgctaagtcgttagatatcgcggttccggctaaggttttgcccccgaaaagagtgtataagaataatggttacttggttgtttcgtgtaatggaggtcttaatcaaatgcgttccgctatatgtgatatggttgcgattgctagatatttaaatgtgactcttatagttcctgaattggataagacgtcgttttgggctgatccaagtgagtttcaagatatatttgatgttgatcattttattacgtcattgagagacgaggttcgagtgcttaaacagcttcctcctaggcttaaaacgagagtcgaattaggacatgtgcatactatgcctcctgttagttggtctgatatttcttactatcataatcagattctcccattgattcaaaaattcaaagttgtgcatttgaatagaaccgatgctaggcttgctaataattttcaaccccttgaacttcaaaagcttagatgccgagcaaattttgatgctttgagatttacacctcagatagaagatttgggtaaacgtgttgttagacttttgagacaaaacgggccatttttagtgcttcacctcagatatgaaatggatatgctagcgttttctggctgcacgcaaggatgcaatactgaagaggttgaagagttgacgagaatgagatatgcttacccatggtggaaagagaagataataaattctgagttgaaaaggaaagacggattatgccctttgactcccgaggaaactgctcttacactcaaggcactggatattgaccgtgatattcaaatttacattgctgctggtgaaatatatggcgggaaaagaagaatggatagtcttgcagaggccttcccaaaactggtaagaaaggagactctgttagggccagatgaccttcagtattttcagaatcactcgtcacaaatggcagctttggactatcttgtgtcactagagagtgatatttttgttcctacttatgatggaaacatggccaaagttgttgaaggccatcgcagattcttgggtttcaagaagacgatactattggacaggaggcttctggttgaattaatagacaaatacactagtgggtccttgaactgggatgaattctcgagtggcgtcaaggaagcacatgcacaacgtatggggaaccctacaaaaagattggttatcccagatagacctaaggaagaagattatttttatgctaatcctgaagagtgcttgcagccatcagatgacgaacctctgagcatcatgtgacaaatggtggattattttggtcaaattttttgtcgttggcctctactgcagttttgtgatctgtcacaattagaagaattatggttctctgctattggaccagtcggtgtagaaggaagatctttccaaaatgtgaggatgcgacagcatagaccaaaatacatt

SEQ ID NO: 5271 - DNA, 2455 bp, Lactuca sativa
aaaagagtatggattttagcgagtgtacataagttcccatggatacctgtgcatcatcacaaatctcaatacaagctacaaaccccactttgtgttctctctactctttccatctcatctttttctcatttgccggccaccgacacatcatcattccggcgaacttctcatctattgccggagaaccgccgccccactaccattcggcttatatttccatctctccggttgaaaccagaatcgacttctttcaaattctctttgtcggtagattctaaaatctggttgaggattgtagaaaaattcaatgcgcttgtgaaataaacgctgttttttttttcttctgtataattttgtccataaatggttccctgaaaacctagtaattatgtgcaattagatgagagaaaaaacggtgcattttgctgagaattaatatcaccgaaaaacttgcaaaacttgcttctttcatggtagacaagtctgccattaaattgtagttggatccgccataattgcgttccctacaaaattcggatctcgatattacatcttattcataccgttccggcggcgacaatttagcggttatcatcatcaatccagatccttcttttggtactaaaataatcagtgtctgagttgtggatgtatgagagagatgtgcaaggtagacgatagagataagatgaagcagaagaagaggttttcaatcggtacaatggggttgaagagcttgggagtttgtagagttgaaaagttaaaaagttcaatggtgaatgctaggtctccgagaatgaagctgtggttaattagggcaacgacgactgtgttgttgtggacatgcttcgttcagcttacagcattagggggtacatggggacctagggttttgaaaggttggccttcttgctttactcaagattcacattctgcttctgcgttagatctaaagttgttgcccactgttccagccagagtccttccacccaagatcatgaatttgacattttctttttatgtaggggtctacaagaacaatggttacttagtcgtttcatgtaatggaggactcaatcaaatgcgttctgctatttgcgacatggtagcaattgctagatatttaaatgttacacttatagtccctgagcttgataaaacttctttctggtctgatccaagtgagtttgaggacatttttgatgttgatcatttcatcacatctttgagagatgaagtacgtattcttaaagagcttccaccaaggcttaaaaagagggtcgaattgggaattgtgcacaccatgcctcctgttagctggtctgatatttcctactaccataaccagattcttccattgattcaaaaatacaaagttgtgcatttgaatagaacagatgctcgattagccaacaacaatcaacccttagaactccaaaagctgaggtgtcgagtaaactttggtgctttaagattcacaactcaaatagaagaattgggaaaacgtgtagtcaatcttttgagaaaaaacggaccttttttagtgcttcatttgagatatgaaatggacatgttggctttctctgggtgtacacaaggatgcaataatgaagagatagaagagttaacacgaatgagatatgcatacccatggtggaaagaaaagattataaattctgatttaaaaagaaaagacgggttatgccctttgactcctgaagaaactgcccttacacttagggcacttgatattgatcatgatatccagatttacattgctgctggtgaaatatatggagggaaaagaagaatggatagtcttcaagatgcattcccaaaactggtgagaaaggagacacttttaggggcagatgatcttcagtattttcagaatcattcttctcaaatggcagcattggattatcttgtggcacttgagagtgatatttttgtgcctacttatgatggaaacatggctaaagttgtggaagggcatcgaagatttttgggattcaagaagacaattctattggataggagagttttggtggatttaatagacaaatacacaaatgggattttaaattgggatgaattttccatttctgtaaaacaagttcatcaagaaagaatgggaaatcccacaaaaagattggttatttcagataaacccaaagaagaagattacttttatgccaatccagaagagtgtttgcatttgcagacatcagatgatcaaactgtcagcatcctatgacaagtctttcgggggtattttggtaatttcccatgaagaagaagaagaagattatatgattctgtgcccttgagaggatctgtgaaaaatgtgtggatgcaagggcataagatgaaacatggattgatgagagagagagagagttgcatgaagatgagagtggttacacgaacagaaatggtgtttattattattatt

SEQ ID NO: 5272 - DNA, 2268 bp, Vitis vinifera
cactcctctttatattgtactcgcgctcccatcttcgccggtggcccaatcttcattttccggcgatttcttggcggaatcctcatctcatcttcggaaatttccgacttcttggttcgaatgacggaaagcttgcagcatatagagtcaattcggatcttcgagattctggaccgttgggagctatttttgaccaagcattgattaaatctgttttcggaaaatctagggtttgtgttgtgaatgcatggggggagaagatcggaatgtgtaggttagaaaggagtgagaaaaagggggttgtgattgggatggggttgaaggcattgagtgcgagtagggtggagaagctaaagagttcgatggtgacatcaaggtcccgaatgaagctatggatgatcagggctacgacctcggttttgctatggacatgtattgttcagttaacggcgttgggagatatgtggggccctagggttttgaagggttggccttcttgttttacacaagattcttccgccgcggcgtcggcgttggacgacaaattggggtggtccgctccgccgcgagtccttccgcccaagagggtttataagaacaatggttacttgatggtctcatgcaatggaggacttaatcaaatgcgagcggcgatatgtgacatggttgcaattgctagatacttaaatgtcactcttattgtccctgagctggataaaacctccttttgggctgacccaagtgagtttgaagatatatttgatgttgatcatttcattacatcattgagagatgaggttcgtgtattaaaagagctaccaccgaggctaaagaagagggtggagcaaggagtgttctattccatgcctcccattagttggtcagatatttcttactatcgtaatcagattcttccactaatacagaagtacaaagttgtgcacttaaatagaaccgatgcccggcttgccaataatgggcaacctttagagattcagaagttgcgttgccgagtaaatttcagtgctttgagatttacttctcagatagaggagttgggtaggagagttatcaggcttctgaggcaaaatggtccattcctagtgcttcatctgagatatgaaatggacatgttagcattttcgggatgtacacaaggctgcaatgaagatgaggtggaagagttgacaagaatgagatatgcttatccctggtggaaagaaaaaattataaattctgacttgaaaaggaaagatggtttatgccccttgactcctgaggaaactgctctgacactgagggcactggacattgatcgaaatatccagatctatattgctgctggagaaatatatggtggagaaaggagaatggcaactcttgcagcagcctatccaaaattggtcagaaaggagacactattggaatcctcggaccttagatttttccagaatcattcgtctcagatggcagcattggattatctcgtctcattggagagtgatatttttgttcctacatatgacggaaacatggccaaggttgttgaaggtcatcgcagatttcttgggttcaagaagaccattcttttggacagaaggcttctagttgatttgatagaccagtacaccaaaggatctctgagttgggatgaattctcctctgctgtaaaggagtctcatggagatcgcatggggaacccgatcaaaaggctagtgattccagacagacctaaagaagaagattatttctatgccaatccgcaggagtgtttgcaaccattaaatgagccgttgagtagtagttcatgatctttactggtagaaggcagttaaagtttgatcatattctcccagtatgctgttctatcgcatataaaaggtagctctttcccccaacaaatacaaaaaccatgaagggtttcaatctgaaggggcaaaccacgaagatcgtttggggagagtaaacaagagaaaacctgagaggattcctggaagcagctggagttacagctatatctttatatatgccaataatcccaagtcatgtatagaagctaaccctgccattacagggtgatatgagagcccttgcattgcacactgggggatgcaaatatagatctggtgtggtggaaaatgtggatccatggaaggttaatcctcctccttcctttgtatttttttttttttattgtttcttttgttaaaaatccatgcccttgtgattttctagcatatattaaattctaaaatttatctgttcttt

SEQ ID NO: 5273 - DNA, 2488 bp, Valeriana officinalis
atcctcgccggccaccgttcgccgtttgccctcctcctcggctggcgactcaattctatccagatcttctcgccactccctcattccttccaatccctttactcctatttatccgtacaatttgtcggtggaatattttatttagggcttgctcatcgtcgggatttccctagaatttgttccgtggaagttgagggaataggttgctgttaggagaaggaatctcgtagtctggcctgtaaaagtggctctaaataataattgacttgtaatgctgcatatgttgataatgtcgtcctacactttactctaattccagatcgactctcaccatctatacaatctcacgtcaacaacatccttgtttcctccatttctggatctgtatcgtgtgaattaacccgtttgatcctgatccagcagaatttgggagaggcgaatctgtaaattgagggagggactgtgattgaatgtatggggggacatgtgcaaagtagagagagaaaaaagtgaggagacgaaaataagttggggaatgggactcaagacattgggagagggtagagttgagaagctgaagacttcaatggtttcaaggtctagaatgaagttgtggatgattagggctatgactacaattttgttatggacttgtctggttcagttgatggctttaggtgaatcctggggtcctagggttttgaaaggctggccttcttgtttttctcaggattctcttgcgatggacatcaaattgccaccgcctcttcccgtcagagttctccctcccaagagggtatataagaacaatggttacctgatggtttcttgtaatggaggtctaaatcagatgcgtgcagcgatttgcgatatggttgcaattgcacgacagctgaatgtgacacttatagttcccgagttggataaaacttccttttgggctgatcctagtgagttcaaagacattttcgacgtggatcatttcataacatccttaagagacgaagttcgcgttttaaaagagctgccacctaggctcaagaggagagttgaactaggaagggtatatactatggcacccattagttggtccgacatatcctattatcaaaatcagattcttcctctcatacagaagtataaaattgtgcacttgaatagaacggacgctcgacttgccaacaacggtcaacttcttgaaattcaaaaactccgttgcagagtaaacttcagcgctctaaagttcacaactcagatagaggaattgggcaaacgtgtgatcaagcttttaaggcgaaacggtccgtttttagtacttcatctcagatatgaaatggatatgttggctttctctggatgtactcaaggttgcaacagcgaagaagtagaagatttaacaagactaagatatgcttatccttggtggaaagagaagatcataaattctgatttaaaaagaaaagacggtctttgccctttgacacctgaagaaactgcccttacattaagggcactggatattgatagtaatatacagatttatattgctgctggagaaatatatggaggagaaagaagaatggctagtcttgccgctgcttatcccaaactggtgagaaaagagacgttgttggagccgtcggatctgcaatattttcagaatcactcatcacagatggcagcattggattatctcgtctctttggagagtgatattttcgttcctacatatgacggaaacatggcgaaagttgttgaagggcacagaagatacctagggttcaagaagacgatactattagacagaaagttgctagttgatttaatagaccagtacacgaatggatcgcttaactggcctgaattttcttcagctgtgaaagaaatacacgaagaacgaatgggaaaccctactagaagggtggttatacctgacagacctaaagaagaagattatttttatgcaaatccagaggagtgcttacagccgtcggatgaaacattaagcagtatgttatgaacggtgtgagatttgtcagtgtttttggtcatagatgccttaaacagcgcaaaacatatcaagaagtgctcgaccgagagggagaaaatgagaatttcgttcttgaggaggcaaatagtgcgaatacctggcgagagatgaaaatggggaaaggccgtcttgtgtttattactctctctctctatatatatatatatattcttttttgtttcataaatatataatttaaaataattcaaattcttgtatagaagcttcaccctgccattacagggttgtatcgaaggagaagtcgaatatcacggtctacacggtgggatgcagatatagaattttgattttacttttagacccctccattttgttttacttgattaatttccatgcattttgatccctccctctttcgtgtttctgtcctacacttttattgtatcttcagtaagtatacacatagtttacttactt

SEQ ID NO: 5274 - DNA, 1433 bp, Flaveria ramosissima
acctttgagcgttggtgcctcctgttgcaaaattgcatatagtaaaaatgatggcagttggtgcttctgccctgcaaataactgcagcgaggccgtctgtttttcttacacaaagaagtcttggggctactatggcaagttttgtacatgaatccgagagaagtttgtcatctaagcttaccagctcttctcatatgtcatcagtgctgaactttaagcataaattcacaacgagtcgtcctaggtttcaaaagtttgttacaaggtcaatgtcggaagcttctggaagcaagtctgtttcccagctgtccattgatttaaaaggtaaaagggcatttattgctggtgttgctgatgacaatggatatggttgggccattgcaaaatctttagctgctgcaggtgctgaaattcttgttggaacatgggtgcctgccttaaacatattcgaaatgagtctacgcaggggcaaatttgatgaatcacgggtgttgccagatggttctttgatggagattactaaagtttatccactggatgctgtctttgatagccctgaggatgtacctgaagatattaaagccaataaacgttatgctggagcaagtaattggacagtgcaggaagttgcagaatcagtaaagcaagattttggtagtattgatattttggtgcactcacttgccaatgggccagaggtcacaaagccactgctggagacatccaggaaaggctatttagctgccgtatctgcatcaagctattcctatgtttctttgctcaaacatttccttccaattatgaaccctggtggttcctcaatatctcttacatatattgcttcagagaggataatccctgggtacggtggcggcatgagttcagcaaaagccgcacttgagagtgacacaagagtgcttgctttcgaagcaggaagaaaacataaaattagggtcaacactatatctgcaggtccactaggaagccgagctgctaaagcaattggattcatagatacaatgattgactactcttttgcaaatgcccctctacagaaagaactagctgcagaggaggtggggaacacagcagcattcctggcatcaccattggcctctgccattacaggcgcgcttatatatgtagacaacgggctgaatgcaatgggcgtgggggtcgacagcccgttgtttaaagatcttaatgttccatcagacaaacattagcaaaatttacagttggcaggcatgtgctgagaataaagtttttgaagtatcggctagtagatttatatctaagttgtctgtaagttaaacgatgattatgacaacttaatcgtgtgaaatcttaaaatgtacgtcgtaaacctgccccaaattgttggacggtttttgctcgaaaaacctcgaggataaactactcgtggggaggtt

SEQ ID NO: 5275 - DNA, 1395 bp, Ambrosia trifida
aaacaataaccgacacaacagatccactttattggcgcctcctgttgctaaattgcatatactgaaaatgatggcagttggtgcttcggccctgcaaataactgcagcgaggccgtcagtttttcttacgcaaagaagtcttggggctactatggcaagttttgtacatgaatctgatagaattttgtcatctaagctcaccagctcttctcatctgtcatcagtgctaaattttaagcataaatgcacaacaaggtatcctcggtttcgaaagtttgttacaaagtcaatgtcagaagcttctggaagcaagtctgtttcccagctgtccattgatttaaaaggtaaaagggcatttattgctggtgttgctgacgacaacggatatggttgggctattgcaaaatctttagcggctgcaggtgctgaaattcttgttggaacatgggtgcctgccttaaacatatttgaaatgagtttacgcaggggcaaatttgatgaatcacgggtgctgccagatggttctttgatggaaattactaaagtttatccactggatgctgtctttgataaccctgaggatgtacctgaagatattaaagccaataaacgttatgctggagcaagtaaatggacagttcaggaagttgcagaatcagtaaagcaggattttggtagtattgatattttggtgcactcacttgccaatgggccagaggtcacaaagccgctgttggagacatccaggaaaggttatttggctgcagtatctgcatcaagctattcctatgtttctttgctcaaacatttccttccaattatgaaccctggtggttcctcaatatcccttacatatattgcttctgaaaggataattcccgggtacggtggggcatgagttcagcaaaagccgcacttgagagtgacacaaaagttcttgctttcgaagcaggaagaaaacataaaattagggtcaacactatatctgcaggtccattgggaagccgtgctgctaaagcaattggattcatagacacaatgattgactactcttttgcaaatgcccctctacagaaagaactatctgcagatgaggtggggaacacagcagcattcctggcatcaccattggcttctgctattacgggtgctcttatatatgtagacaacggactgaatgcaatgggtgtgggggtcgacagcccgttgtttaaagatcttaatattccaacagacaaacattagcaaaatgtacagttggcaggtatgtggtgagaatattgtttttgaagttccggctagtagatttttatcttagttctttgtaacttaagcgaggatgttgacgacttaatcatgtaaaattttaaactgcaagtcgtaaatcttgaccaa

SEQ ID NO: 5276 - DNA, 1524 bp, Ambrosia trifida
acaacagatccactttattggcgcctcctgttgctacattgcacatactgaaaatgatggcaattggtgcttcggccctgcaaataactgcagcaaggccgtccgtttttcttacgcaaagaagtcttggggctactatggctagttttgtacatgaatctgatagaattttgtcatctaagctcaccagctcttctcatctgtcatcagtgctaaattttaagcataaaagcacaacaaggtatcctaggtttcgaaagtttgttacgaagtcaatgtcagaagcttctggaagcaagtctggttcccagctgtccattgatttaaaaggtaaaagggcatttattgctggtgttgctgatgacaacggatatggttgggccattgcaaaatctttagcggctgcaggtgctgaaattcttgttggaacatgggtgcctgccttaaacatatttgaaatgagtctacgcaggggcaaatttgatgaatcacgggtgctgccggatggttctttgatggagattactaaagtttatccactggatgctgtctttgataaccctgaggatgtacccgaagatattaaagccaataaacgttatgctggagcaagtaaatggacagttcaggaagttgcagaatcagtaaagcaagattttggtagtattgatattttggtgcactcacttgccaatgggccagaggtcacaaagccgctgttggagacatccaggaaaggttatttagctgcagtatctgcatcaagctattcctatgtttctttgctcaaacatttccttccaattatgaaccctggtggttcgtcaatatcccttacatatattgcttctgaaaggataattcccgggtacggtgggggcatgagttcagcaaaagccgcacttgagagtgacacaaaagttcttgctttcgaagcaggaagaaaacataaaattagggtcaacactatatctgcaggtccattgggaagccgtgcggctaaagcaattggattcatagacacaatgattgactactctttcgcaaatgcccctctacagaaagaactatctgcagatgaggtgggaaacacagcagcattcctggcatcaccattagcttcggccattacaggtgctcttatatatgtagacaacggactgaatgcaatgggtgtgggggttgacagcccgttgtttaaagatcttaatattccaacagacaaacattagcaaaatgtacagttggcaggtatgtggtgagaataagtttttgaagttccggctagtagatttttatcttagttgtttgtaagttaagcgaagatgttgacgacttaataatgtaaaattttaaactgtaagtcgtaaatcttgaccaagttgctggatagtttcgagtgaaaagccgttttgatcaatggtctactcaaacatatgatggataatgtacatgttgactctaatcaatggttaaatgttgtcgggctaaatttgattttagggaatcaagtacttttattgt

SEQ ID NO: 5277 - DNA, 1583 bp, Echinacea purpurea
cggccgggggcggtaaaagatcttcaaaagcccaatcaatggcccaattcggttgcaaaaagcaaccctttcttctatctcacccgcactgcacacagatccacctttgagctctggcctcctgttgcaaaattgcatatactgaaaatgatggcaattggtgcttcggccctgcaaataactgcagcaaggccgcccgtttttcttacacaaagaagtcttggggctactatggcaagttttgtacatgaatctgatagaattttgtcatctaagctcaccagcccttctcatctgtcatcagtgctaaaatataagcatgaatgcacaagtcgtcctaggtttcaaaagtttgttacaaggtcaatgtcagaagctgctggaagcaagtccgtgtcccagctgtccattgatttaagaggtaaaagggcatttattgctggtgtggctgatgccaatggatatggttgggcaattgcaaaatctttagctgccgctggtgctgaaattcttgttggaacatgggtgcctgccttaaacatatttgaaatgagtctacgcaggggcaaatttgatgactcacgggtgctgccagatggttctttgatggagattgctaaagtttatccactggatgctgtctttgataaccctgaggatgtacctgaagatattaaagccaataaacgctatgctggagcaagtaattggacagtgcaggaagttgcagaatctgtaaagcaagattttggtagtatagatattttggtgcactcgcttgccaacgggccagaggtcacaaagccgctattggagacatcaaggaaaggctatttagctgcagtatctgcatcaagctattcctatgtttctttgctcaaacatttccttccaattatgaaccctggtggttcctcaatatctcttacatatattgcttctgagaggataattcctgggtatggtgggggtatgagttcagcgaaagccgcacttgagagtgacacaagagtgcttgcttttgaagcaggaagaaaacataaaattagggtcaacacaatatctgcaggtccacttggaagccgtgctgctaaggcaattggattcatagacacaatgattgactactctttcgcaaatgcccctctacagaaagaactatctgcagatgaggtggggaacacagcagcattcctggcatcaccattggcttctgccattacgggtgctcttatatatgtagacaacgggttgaatgcaatgggcgtgggggttgacagccccttgtttaaagatcttaatgttccaacagacaaacattagcaaattgtatagttggcaggtatgtggtgagactaaagtttttgaagttccggctagtagatttatatcatagttgtctgtaagttaaacgatgattataacatgcaaactttcaaaatgtaagtagtaaatctccaccaagttgctggaccgtttttaggcgaaaaacatgaggataaactacttgtcatttcgatcatcgtgtctactcaaacatgtgttggatttgttacttggatttgagttatatttggttttgc

SEQ ID NO: 5278 - DNA, 1460 bp, Ambrosia trifida
actgaaaatgatgtcaattggtgcttggccctgcaattactgcagcaaggccgtccgttttttttactacaaagaagtcttggggctactatggtcgagttttgtacatgaatctgataggattttgtcatctaagctcaccagctcttctcatctgtcatcagtgctaaattttaagcataaatgcacaacaagtcatcctaggtttcgaaagtttgttacgaagtcaatgtcagaagcttctggaagcaagtctgtttcccagctgtccattgatttaaaggtaaaagggcatttattgctggtgttgctgatgacaacggatatggttgggccattgcaaaatctttagcggctgcaggtgctgaaattcttgttggaacatgggtgcctgccttaaacatatttgaaatgagtttacgcaggggcaaatttgatgaatcacgggtgctgccggatggttctttgatggagattactaaagtttatccactggatgctgtctttgataaccctgaggatgtacccgaagatattaaagccaataaacgttatgctggagcaagtaaatggacagttcaggaagttgcagaatcagtaaagcaagattttggtagtattgatattttggtgcactcgcttgccaacgggccagaggtcacaaagccgctgttggagacatccaggaaaggttatttagctgcagtatctgcatcaagctattcctatgtttctttgctcaaacatttccttccaattatgaaccctggtggttcctcaatatcccttacatatattgcttctgaaaggataattcccgggtacggtgggggcatgagttcagcaaaagccgcacttgagagtgacacaagagttcttgctttcgaagcaggaagaaaacataaaattagggtcaacactatatctgcaggtccattgggaagccgtgctgctaaagcaattggattcatagacacaatgattgactactcttttgcaaatgcccctctacagaaagaactatctgcagatgaggtggggaacacagcagcattcctggcatcaccattagcttcggccattacgggtgctcttatatatgtagacaatgggctgaatgcaatgggcgtgggggttgacagcccgttgtttaaagatcttaatattccaacagacaaacattagcaaaatgtacagttggcaggtatgtggtgagaataagtttttgaagttccggctagtagatttttatatagttgtttgtaagttaagcgaagatgttgacgacttaatcatgtaaaactttaaactgtaagtggtaaatcttgatcaagttgctggatagttttcaagtgaaaagccgttttgaattttgatcacggtctactcaaacatatgatggatatgtcttgtgactctatcatggttaatgttgtggcaatttgatttaggaaaaagaa

SEQ ID NO: 5279 - DNA, 1338 bp, Flaveria ramosissima
cgacagatacacagatccacctttgagcattggcgcctcctgttccaaaattgcatatactgaaaatgatttcagttggtgcttctgccctgcaaataactgcggcaaggccgtctgtttttcttacacaaagaagtctcggggctactatggcaagttttgtacatgaatccgagagaagtttgtcatctaggcttaccggctcttctcctttgtcatcagtgctaaactttaagcataaattcacaagaagtcgtcctaggcttcaaaggtttgtcacaagctcaatgtccgaagcttctggaagcaagtctgcttcgcagctttccattgatttaagaggtaaaagggcatttatcgctggtgttgctgatgacaatggatatggttgggctattgcaaaatctttagctgctgcaggtgctgaaattcttgttggaacatgggtgcctgccttaaacatatttgaaatgagtctacgcaggggcaaatttgatgaatcacgggtgttgccagatggttctttaatggagattactaaagtttatccactggatgctgtctttgattgccctgaggatgtacctgaagatattaaagccaataaacgctatgctggggcaagtaattggacagtgcaggaagttgcagaatcagtaaagcaagattttggtagtattgatattttggtgcactcgcttgccaatgggcccgaggtcacaaagccactgttggagacatccaggaaaggttatttagctgctgtatctgcatcaagctattcttatgtttctttgctcaaacatttccttccaattatgaaccctggtggttcctcaatatctcttacatatattgcttctgagaggataatccctgggtacggtggcggcatgagttcagcaaaagccgcacttgagagtgacacaagagtccttgctttcgaagcaggaagaaaacataaaattagggtcaacactatatctgcaggtccactaggaagccgagctgctaaagcaattggattcatagatacaatgattgactactcttttgcaaatgcccctctacagaaagaactagctgcagaggaggtggggaacacagcagcattcctggcatcaccattggcctctgccattacaggcgcgcttatatatgtagacaacgggctgaatgcgatgggcgtgggggtcgacagcccgttgtttaaagatcttaatgttccaacagacaaacattagcaaaatgtatagtttgtcaggcatgtggtgagaataaagtttttgaagtatcggctagtagatttatatctaagttgtctgtaagttaaacgat

SEQ ID NO: 5280 - DNA, 1338 bp, Cirsium arvense
caacacacacacacacatcgacagacatagatccacgttttggcgcctcctgttgcaaaattgcatataccgaaaatgatggcaattggtgcttctgcactgcaaataactgcagcaaggccgtccatttttcttactcaaagaagtcttggggttactatggcaagtgttgtacatgaatctgatagaactttgtcatctaagcttaccagctcttctcatatgtcatatgtgctaaagtttaagaaaagtttcacaactagtagaccaagatttgaaaagtttgttacaaggtcaatgtctgaagcttctgaaagcaaatcttcatcccagctgtccattgatttgaaaggcaaaagggcatttattgccggtgtggctgatgacaatggatatggttgggctattgcaaagtctttagctgctgcaggtgcagaaattcttgttggaacatgggtgcctgctttaaacatatttgaaatgagcttacggagagggaaatttgatggatcacgagtgttgccagatggttctttgatggagattactaaagtttatcctctggatgctgtctttgataaccctgaggatgtacccgaagatataaaagcaaacaaacgttatgcaggatcaagtaattggactgtgcaggaagttgcagaatcagtaaagcaagactttggtagcattgatattctggtgcattcgcttgccaatggaccagaggttacgaagcctctattggagacatccaggaaaggttatctagcggcagtatctgcatcaagctattcttatgtttctttgctcaagcattttcttccaattatgaaccctggtggttcctcaatctctcttacatacattgcttccgagaggataattcctggatatggtgggggtatgagttcagcaaaagccgcacttgagagtgacaccagagtacttgcttttgaagcaggaagaaaacgtaaaatcagggtcaacactatatctgcaggtccactgggaagtcgggctgctaaagcaatcggcttcatagacacaatgattgattactcttttgcaaattcccctctacagaaaactctatctgcagatgaagtgggaaacactgcggcatttctggcatcaccattggcttctgccattacgggtgctcttatatacgtagacaacgggctgaatgcaatgggtgtgggagttgatagtccgttgtttaaagatcttgatattccaacggacaaacattagcagcatacagcaggcaggtttgtgtagagaataaagttttgaagttccggctggtagatttagtttttgtggtctgtaactcaa

SEQ ID NO: 5281 - DNA, 1461 bp, Artemisia annua
gatcacagacagagatcaaaaccctttaagcattggtgcttactgttgcaatattgcatataccggaaatgatggcgattggtgcttctgcactgcaaataactgcagcaaggccgtcaatgtttcttacacaaaggagtctcggggttactatggcgagttttgtaaatgaaaccgatagaattttgtcatctaagcttaccagctcctctcatttgtcgtcggtgctaaatgttaagcgaagttttacaactagtcgtccaaagtatgaaaagtttgttactaagtcaatgtctgaagcttctgaaagcaagcctgtatcccagctgtcgattgatttgaaaggtaaaagagcgtttattgctggtgttgcggatgacaatggatatggttgggctattgcaaaatctttagctgctgcaggtgctgaaattcttgttggaacatgggtgcctgccttaaacatatttgaaatgagtttacgacgagggaagtttgatggatcacgagtgttgccagatggttcgttgatggaaattactaaagtttatccactggatgctgtctttgataaccctgacgatgtacctgaagatattaaagcaaataaacggtatgcgggagcaagtaattggacagtgcaggaagttgcagaatcagtaaagcaagactttggtagtattgatattttggtgcactcacttgccaatgggccagaggtgacgaaacctctgttggaaacatcaaggaaaggttatctagccgcagtatctgcatcaagctattcctatgtttctttgctcaagcatttcctcccaattatgaaccctggtggttcatcaatctctcttacatatattgcttctgagaggatcattcctgggtacggtgggggcatgagttcagcaaaagccgcacttgagagtgacacaagagtgcttgcttttgaagcaggaagaaaaaagaaaattagggtcaacactatatctgcaggtccactgggaagccgtgcggctaaagcaattggcttcatagatacaatgatcgactactcttacgcaaatgcccctatacagaaagaactatttgcagatgaggtggggaacactgcagcattcctggcatcaccattggcttctgccattacgggtgctctcatatatgtagacaatgggctgaatgcaatgggtgtgggagttgatagtccgttgtttaaggatcttaacattccaacagacaaacattagcaacatgcaataggcaggttggtgttgagaataaagttttggttccggctagtagattatgttcttagttgtctagaagatgtttatgacaactttttgatgtaaaaagttgatgtattgaatgaaatttgcacaaagttggccttaacttttgagcaattcgagttgtacaactaaaatatatattcttgtattgatatttcaccatttgggc

SEQ ID NO: 5282 - DNA, 1329 bp, Chrysanthemum coronarium
tcaaaccctttaagcattggtgcttactgttgcaatattgtgaataccaaaaatgatggcgattggtgcttctgcactgcaaataactgcagcaaggccgtcaatgtttcttacacaaaggagtctcggagttactatggcaagttttgtaaatgaaaccgatagaattttgtcatctaagcttaccagctcctctcatgtgtcgtcggtgctaaatggtaagcgaagttttacaactagtcgtccaaagtttgaaaagtttgttactaagtcaatgtctgaagcttctgaaagcaagcctgtatcccagctgtcgattgatttgaaaggtaaaagagcgtttattgctggtgttgctgatgacaatggatatggttgggctattgcaaaatctttagctgctgctggtgctgaaattcttgttggaacatgggtgcctgccttaaacatatttgaaatgagtctacgacgagggaaatttgatgcatcacgagtgttgccagatggttctttgatggaaattactaaagtttatccactggatgctgtctttgataaccctgacgatgtacctgaagatattaaagccaataaacgttatgcgggagcaagtaattggacagtgcaggaagttgcagaatcagtaaagcaagactttggtagtattgatattttggtgcactcacttgccaatgggccagaggtgacgaaacctctgttagaaacatcaaggaaaggttatctagccgcagtatctgcatcaagctattcttatgtgtctttgctcaagcatttccttccaattatgaaccccggtggttcatctatctctcttacatatattgcttctgaaaggatcattcctgggtatggtgggggcatgagttcagcaaaagccgcacttgagagcgacacaagagtgcttgctttcgaagcaggaagaaaaaagaaaattagggtcaacactatatctgcaggtccactaggaagccgtgcggctaaagcaattggcttcatagatacaatgatcaactactcttacgcaaatgcccctctacagaaagaactatttgcagatgaggtggggaacactgcagcattcctggcatcaccattggcttctgccattacaggcgctcttatatatgtagacaatggactaaatgcaatgggtgtgggagttgatagtccgttgtttaaagatcttaacattccaacagacaaacattagcaacatgcgataggcaggttggtgttgagaataaagttttgaagttccggctagtagattatgctcttagttgtctgtaagatgtttatgacaactta

SEQ ID NO: 5283 - DNA, 1356 bp, Chrysanthemum coronarium
accctttaagcattggtggttactgttgcaatattgtggataccaaaaatgatggcgattggtgcttcagctctgcaaataactgcagcaaggccatcaatgtttcttacacaaaggagtctcggagttactatggcaagttttgtaaatgaaaccgatagaattttgtcatctaagcttaccagctcctctcatgtgtcgtcggtgctaaatgttaaacgaagttttacaactagtcgtccaaagtttgaaaagtttgttactaagtcaatgtctgaagcttctgaaagcaagcctgtatcccagctgtcgattgatttgaaaggtaaaagagcgtttattgctggtgttgctgatgacaatggatatggttgggctattgcaaaatctttagctgctgctggtgctgaaattcttgttggaacatgggtgcctgccttaaacatatttgaaatgagtttacgacgagggaagtttgatggatcacgagtgttgccagatggttctttgatggagattactaaagtttatccactggatgctgtctttgataaccctgacgatgtacctgaagatattaaagccaataaacgttatgcgggagcaagtaattggacagtgcaggaagttgcagaatcagtaaagcaagactttggtagtattgatattttggtgcactcacttgccaatgggccagaggtgacgaaacctctgttagaaacatcaaggaaaggttatctagccgcagtatctgcatcaagctattcttatgtgtctttgctcaagcatttccttccaattatgaaccccggtggttcatctatctctcttacatatattgcttctgaaaggatcattcctgggtatggtgggggcatgagttcagcaaaagccgcacttgagagcgacacaagagtgcttgctttcgaagcaggaagaaaaaagaaaattagggtcaacactatatctgcaggtccactgggaagccgtgcggctaaagcaattggcttcatagatacaatgatcgactactcttacgcaaatgcccctatacagaaagaactatttgcagatgaggtggggaacactgcagcattcctggcatcaccattggcttctgccattacgggtgctctcatatatgtagacaatggactaaatgcaatgggtgtgggagttgatagtccgttgtttaaagatcttaacattccaacagacaaacattagcaacatgcgataggcaggttggtgttgagaataaagttttgaagttccggctagtagattatgctcttagttgtctgtaagatgtttatgacaacttattgatgtaaaaaagttgatgtattgaaatga

SEQ ID NO: 5284 - DNA, 1459 bp, Flaveria ramosissima
gatccacctttgagcgttggtgcctcctgttgcaaaattgcatatagtaaaaatgatggcagttggtgcttctgccctgcaaataactgcagcgaggccgtctgtttttcttacacaaagaagtcttggggctactatggcaagttttgtacatgaatccgagagaagtttgtcatctaagcttaccagctcttctcatatgtcatcagtgctgaactttaagcataaattcacaacgagtcgtcctaggtttcaaagtttgttacaaggtcaatgtcggaagcttctggaagcaagtctgcttcccagtctttccattgacttaaaaggtaaaagggcgtttattgctggtgttgctgatgacaatggatatggttgggccattgcaaaatctttagctgctgcaggtgctgaaattcttgttggaacatgggtgcctgccttaaacatatttgaaatgagtctacgcagaggcaaatttgatgaatcgcgggtgctgccagatggttctttgatggagattactaaagtttatccactggatgctgtctttgatagccctgaggatgtacctgaagatattaaagccaataaacgttacgctggagcaagtaattggacagtgcaggaagttgcagaatcagtaaagcaagattttggtagtattgatattttggtgcactcgcttgccaatgggccagaggtcacaaagccactattggagacatccaggaaaggttatttagctgcagtatctgcatcaagctattcttatgtttctttgctcaaacatttccttccaattatgaaccctggtggttcctcgatatctcttacatatattgcttctgagaggataattccagggtatggtgggggcatgagttcagcaaaagccgcacttgagagtgacacaagagtgcttgcttttgaagcaggaagaaaacataaaattagggttaacactatatctgcaggtccactgggaagccgagctgctaaagcaattggattcatagatacaatgattgactactcttttgcaaatgcccctctacagaaagaactatctgcagatgaggtgggaaacacagcagcattcctggcatcaccattggcttctgccattacgggcgctcttatatatgtagacaacgggctgaatgcaatgggcgtagggattgacagcccgttgtttaaagatcttaatgttccaacagacaaacattagcaaaatgtatagcttggcaggtatgtggtgagaataaagtttttgaagtatcggctggtagatttatatcttagttgtctgtaagttaaatgatggttatgacaacttaatcgtgtgaaatcttaaaatgtacgtcgtaaagctgccccaaattgttggacggtttttgctcgaaaaacctcgaggataaactactcgtggggagagcccggattcaaactttgtttc

SEQ ID NO: 5285 - DNA, 1351 bp, Chrysanthemum coronarium
tcaaaccctttaagcattggtgcttactgttgcaatattgtgaataccaaaaatgatggcgattggtgcttctgcactgcaaataactgcagcaaggccgtcaatgtttcttacacaaaggagtctcggggttgctatggcaagttttgtaaatgaatccgatagaatattttcatctaagcttaccagctcctctaatgtgtcgtcggtgctaaatgttaagcgaagttttacaactagtcgtccaaagtatgaaaagtttgttactaagtcaatgtctgaagcttctgaaagcaagcctgtatcccagctgtcgattgatttgaaaggtaaaagagcgtttattgctggtgttgctgatgacaatggatatggttgggctattgcaaaatctttagctgctgctggtgctgaaattcttgttggaacatgggtgcctgccttaaacatatttgaaatgagtttacgacgagggaagtttgatggatcacgagtgttgccagatggttctttgatggaaattactaaagtttatccactggatgctgtctttgataaccctgacgatgtacctgaagatattaaagccaataaacgttatgcgggagcaagtaattggacagtgcaggaagttgcagaatcagtaaagcaagactttggtagtattgatattttggtgcactcacttgccaatgggccagaggtgacgaaacctctgttagaaacatcaaggaaaggttatctagccgcagtatctgcatcaagctattcttatgtgtctttgctcaagcatttccttccaattatgaaccccggtggttcatctatctctcttacatatattgcttctgaaaggatcattcctgggtatggtgggggcatgagttcagcaaaagccgcacttgagagtgacacaagggtgcttgctttcgaagctggaagaaaaaagaaaattagggtcaacactatatctgcaggtccactgggaagccgtgcggctaaagcaattggcttcatagatacaatgatcgactactcttacgcaaatgcccctatacagaaagaactatttgcagatgaggtggggaacactgcagcattcctggcatcaccattggcttctgccattacaggcgctcttatatatgtagacaatggactaaatgcaatgggtgtgggagttgatagtccgttgtttaaagatcttaacattccaacagacaaacattagcgaaatacgataggcaggttggtattgagaataaagttttgaagttccggctagtagattatgctcttagttgtctgtaagatgtttatgacaacttaatgaaattcacacaaagttggc

SEQ ID NO: 5286 - DNA, 1414 bp, Chrysanthemum coronarium
atttagcacagacagacagacagagatcgaccctttaagcatttctgcttcctgttgcaatattgtgaataccgaaaatgatggcgattggtgcttctgcaatgccaataactgcagcaagaccgtcaatgtttcttacacaaagaagtctcagggttactatggcaagttttgtaaatgcaactgatagaattttgtcatctaagcttaccagctcctctcatttgtcgtctgtgctaaatgttaagcgaagttttacaactagtcgtccaaagtttgaaaagtttgttaccaagtcaatgtctgaagcttctgaaagcaagcctgtatcccagctgtcaattgatttgaaaggtaaaagagcgtttattgctggtgttgcggatgacaatggatatggttgggctattgcaaaatctttagctgctgctggtgctgaaatacttgtcggaacatgggtgcctgccttaaacatatttgaaatgagtctacgtcgagggaaatttgatggatctcgagtgttgccagatggttctttgatggaaattactaaagtttatccactggacgctgtctttgataaccctgacgatgtacctgaagatattaaagccaataaacgttatgcgggtgcaagtaattggacagtgcaggaagttgcagaatcagtaaagcaagactttggtagtattgatattttggtgcactcacttgccaatgggccagaggtgacaaaacctctgttggaaacatcaaggaaaggttatctagccgcagtatctgcatcaagctattcttatgtgtctttgctcaagcatttccttccaattatgaaccccggtggttcatctatctctcttacatatattgcttctgagaggatcattcctgggtatggtgggggcatgagctcagcaaaagccgcacttgagagtgacacaagagtgcttgctttcgaagcgggaagaaaaaagaaaattagggtcaacactatatctgcaggtccactgggaagccgtgcggctaaagcaattggcttcatagacacaatgatcgactactcttacgcaaatgcccctctacagaaagaactttttgcagatgaggtgggccacactgcagcattcctggcatcaccattggcttctgccattacgggtgctcttatatatgtagacaatgggctgaatgcaatgggtgtgggcgttgatagtccgttgtttaaagatcttaacattccaacagagaagcattagcaacatgtgatacacaggttggcgttgagaataaagttttgaagttccggctagtagaatatgctcttagttttctgtaagatgtttatgacaacttattgatgtaaaaaagttgatgtattgaaatgaaatttgcacaaagttggccttaaattttg

SEQ ID NO: 5287 - DNA, 1376 bp, Chrysanthemum coronarium
atttagcacagacagacagacagagatcgaccctttaagcatttctgcttcctgttgcaatattgtgaataccgaaaatgatggcgattggtgcttctgcaatgccaataactgcagcaagaccgtcaatgtttcttacacaaagaagtctcagggttactatggcaagttttgtaaatgcaactgatagaattttgtcatctaagcttaccagctcctctcatatgtcgtctgtgctaaatgttaagcgaagttttacaactagtcgtccaaagtttgaaaagtttgttactaagtcaatgtctgaagcttctgaaagcaagcctgtatcccagctgtcaattgatttgaaaggtaaaagagcgtttattgctggtgttgcggatgacaatggatatggttgggctattgcaaaatctttagctgctgctggtgctgaaattcttgttggaacatgggtgcctgccttaaacatatttgaaatgagtttacgacgagggaagttcgatggatcacgagtgttgccagatggttctttgatggaaattactaaagtttatccactggatgctgtctttgataaccctgatgatgtacctgaagatattaaagccaataaacgttatgcgggtgcaagtaattggacagtgcaggaagttgcagaatcagtaaagcaagactttggtagtattgatattttggtgcactcacttgccaatgggccagaggtgacgaaacctctgttggaaacatcaaggaaaggttatctagccgcagtatctgcatcaagctattcttatgtgtctttgctcaagcatttcctcccaattatgaacccaggtggttcatctatctctcttacatatattgcttctgaacggatcattcctgggtatggtgggggcatgagttcagcaaaagctgcacttgagagcgacacaagagtgcttgctttcgaagcaggaagaaaaaagaaaattagggtcaacactatatctgcaggtccactgggaagccgtgcggctaaagcaattggcttcatagatacaatgatcgactactcttacgcaaatgcccctatacagaaagaactatttgctgatgaggtggggaacaccgcagcattcctggcatcgccattggcttctgccattacaggtgctcttatatatgtagacaatgggctgaatgcaatgggtgtgggagttgatagtccgttgtttaaagatcttaacattccaacagacaaacattagcaacatacgataggcaaattggtattgagaataaagttttgaagttccggctagtagattatgctcttagttgtctgtaagatgtttatgacaactgaatgaaattcacacaaagttggc

SEQ ID NO: 5288 - DNA, 1633 bp, Cirsium arvense
ttcaatctcacactagtatctcaccaatacacacaccataacagcaacagacagacagagagatccatccacctttttggttgcaaaattgcatatacggaaaaatgatgtcgattggtgcttctgtactgcacgtaactgcagcaaggccgtctatttttcttacacaaagaagtcttggggttactatggcgagtgttgtacatgaatctgatagaactttgtcatctaagcttaccagctcttctcacgtgtcaactgtgctaaagtttaagcaaaatttcacaaccagtagaccgaagtttgaaaagttcgttacaaggtcaatgtctgaagcttctgaaagcaagtctacctcccagctggccattgatttgaaaggcaaaagggcgtttattgctggtgtcgcggatgacaatggatacggttgggctattgcaaaatctttagcggctgcaggtgcagaaattcttgttgggacatgggtgcccgctttaaatatattcgaaatgagcttacgacgagggaaatttgatggttcacgtgtgctgccagatggttctttgatggagattactaaagtttatcctctggatgctgtctttgataaccctgaggatgtacctgaagatataaaagcaaacaaacgttatgcgggagcaagtaattggactgtacaggaagttgctgaatcagtaaagcaagactttggtagtattgatattttggtgcactcgcttgccaatgggccagaggttacaaagcctctattggagacatccaggaaaggttatctagctgcagtatctgcatcaagctattcttatgtttctttgctcaagcatttccttccaattatgaaccctggtggttcctcaatctctcttacatatattgcttctgagaggatcattccagggtatggtggaggtatgagttcagcaaaagccgcacttgagagtgacaccagagtgctagctttcgaagcaggaagaaaacataaaatcagggtcaacactatatccgcaggtccattgggaagccgtgctgctaaagcaatcggtttcatagatacgatgatcgattactcttatgcgaattccccaatacagaaagaactatctgcagatgaagtggggaacaccgcggctttcctggcatcaccgttggcttctgccattactggtgctcttatatacgtagacaacgggctgaatgccatgggtgtgggagtcgacagtccgttgtttaaagatctcaacattccaacggacaaacattagcagcatacagcaggcaggtttgtgtagagaataaagttttgaagtttcggctggtagatttagttctttgtggtctgtaacttgatcgacgattatgacaacttaatcatgtaaaatttgcacaaaaaacttatcttaaaattcgaacaattcgagtttcaaggaacacgaagtacatgctgcagagtccagttggacccgatcggttacgatccagttacaaccggtccggtccctactttacaggttgaggtctccatctgaagctgaagtccatggcatcttagctcgagtatgcagatcaatatcaaacctttgacatatgttgtccaaaataaaaaaagtaatta

SEQ ID NO: 5289 - DNA, 1357 bp, Centaurea maculosa
agatccatccacctttttggttgtaaaattgcatatacggaaaaatgatgtcgattggtgcttctgtactgcacgtaactgcagcaaggccgtctatttttcttacacaaagaagtcttggggttactatggcgagtgttgtacatgagtctgatagaactttgtcatctaagcttaccagctcttctcatgtatcgtctgtgctaaagtttaagagaagtttcacaaccagtcaaccaagatttgaaaagttcgttacaaggtcaatgtctgaagcttctgaaagcaagcctacctcccagctggccattgatttgaaaggcaaaagggcgtttattgctggtgtcgctgatgacaatggatacggttgggctattgcaaaatctttagcggctgcaggtgcagaaattcttgtagggacatgggtgcccgctttaaatatattcgagatgagcttacgacgagggaaatttgatggttcacgcgtgttgccagatggttctttgatggagattactaaagtttatcctctggatgctgtctttgataaccctgaggatgtacctgaagatataaaagcaaacaaacgttatgcaggagcaagtaattggactgtacaggaagttgctgaatcagtaaagcaagactttggtagtattgatattttggtgcactcacttgccaatgggccagaggttacaaagcctctattggagacatccaggaaaggttatctagctgctgtatctgcatcaagctattcttatgtttctttgctcaagcatttccttccaattatgaaccccggtggttcctcaatatctcttacatatattgcttctgagaggatcattccagggtatggtggaggtatgagttcagcaaaagccgcacttgagagtgacaccagagtgctagcttttgaagcaggaagaaaacataaaatcagggtcaacactatatccgcaggtccactgggaagccgtgctgctaaagcaatcggcttcatagatacgatgatcgattactcttatgcaaattccccaatacagaaagaactatccgcagacgaagtggggaacaccgcggctttcctggcatcaccgttggcttctgccattactggtgctcttatatacgtagacaacgggctgaatgcaatgggtgtgggagtcgacagtccgttgtttaaagatctcaacattccatcagaaaaacattagcagcatacagcaggcaggtttgtgtagagaataaagttttgaagtttcggctggtagatttagttctttgtggtctgtaacttgatcgacgattatgacaacttaatcatgtaaaatttgcacaaaaacttatc

SEQ ID NO: 5290 - DNA, 1396 bp, Centaurea maculosa
tctcagtagtatctcaccaattcacaccataacagcaacacacagagagagatccatccacctttttggttgcaaaattgcatatacggaaaaatgatgtcgattggtgcttctgtactgcacgtaactgcagcaaggccgtctatttttcttacacaaagaagtctcggggttactatggcaagcgttgtacatgaatctgatagagctttctcatctaagcttaccagctcttctcatgtgtcatctgtgctaaagcttaagcaaagtttcacaaccagtcaaccaagatttgaaaagtttgttacaaggtcaatgtctgaagcttctgaaagcaagtctacctcccagctggccattgatttgaaaggcaaaagggcgtttattgctggtgttgctgatgacaatggatacggttgggctattgcaaaatctttagcggctgcaggtgcagaaattcttgttgggacatgggtgcctgctttaaatatatttgaaatgagcttacgacgagggaaatttgatggttcacgtgtgttgccagatggttctttgatggagattactaaagtttatcctctggatgctgtctttgataaccctgaggatgtacctgaagatataaaagcaaacaaacgttatgcgggagcaagtaattggactgtacaggaagttgctgaatcagtaaagcaagactttggtagtattgatattttggtgcactcacttgccaatgggccagaggttacaaagcctctattggagacatccaggaaaggttatctagctgcagtatctgcatcaagctattcttatgtttctttgctcaagcatttccttccaattatgaaccccggcggttcctcaatctctcttacatatattgcttctgagaggatcattccagggtatggtggaggtatgagttcagcaaaagccgcacttgagagtgacaccagagtgctagcttttgaagcaggaagaaaacgtaaaatcagggtcaacactatatccgcaggtccattgggaagccgtgctgctaaagcaatcggtttcatagatacgatgatcgattactcttatgcgaattccccaatacagaaagaactatccgcagatgaagtggggaacaccgcggcttttctggcatcaccgttggcttcagccattacgggtgctcttatatacgtagacaacgggctgaatgcaatgggtgtgggagtcgacagtccgttgtttaaagatctcaacattccaacggacaaacattagcagcttacagcaggcaggtttgtgtagagaataaagttttgaaagtttcggctggtagatttagttctttgtggtctgtataacttaatcgacgattatgacagcttaatcatgtaaaatttgc

SEQ ID NO: 5291 - DNA, 1396 bp, Chrysanthemum coronarium
atttagcacagacagacagacagagatcgaccctttaagcatttctgcttcctgttgcaatattgtgaataccgaaaatgatggcgattggtgcttctgcaatgccaataactgcagcaagaccgtcaatgtttcttacacaaagaagtctcagggttactatggcaagttttgtaaatgcaactgatagaattttgtcatctaagcttaccagctcctctcatatgtcgtctgtgctaaatgttaagcgaagttttacaactagtcgtccaaagtttgaaaagtttgttaccaagtcaatgtctgaagcttctgaaagcaagcctgtatcccagctgtcaattgatttgaaaggtaaaagagcgtttattgctggtgttgctgatgacaatggatatggttgggctattgcaaaatctttagctgctgctggtgctgaaatacttgtcggaacatgggtgcctgccttaaacatatttgaaatgagtctacgacgagggaaatttgatggatcccgagtgttgccagatggttctttgatggaaattactaaagtttatccactggacgctgtctttgataaccctgacgatgtacctgaagatattaaagccaataaacgttatgcgggagcaagtaattggacagtgcaggaagttgcagaatcagtaaagcaagactttggcagtattgatattttggtgcactcacttgctaatgggccagaggtgacgaaacctttgttggaaacatcaaggaaaggttatctagcggcagtttctgcatcaagctattcctatgtttctttgctcaagcatttccttccaattatgaaccccggtggttcatcaatctctcttacatatattgcttctgagaggatcattcctgggtatggtgggggcatgagctcagcaaaagccgcacttgagagtgacacacgagtgcttgctttcgaagcaggcagaaaaaagaaaattagggtcaacactatatctgcaggtccactgggaagccgtgcggctaaagcaattggcttcatagacacaatgatcgactactcttacgcaaatgcccctctacagaaagaactttttgcagatgaggtgggccacactgcagcattcctggcatcaccattggcttctgccattacgggtgctcttatatatgtagacaatgggctgaatgcaatgggtgtgggcgttgatagtccgttgtttaaagatcttaacattccaacagagaaacattagcaacatgcgataggcaggttggtgttgagaataaagttttgaagttccggctagtagattatgcccttggttttctgtaacatgtttatgacaacttattgatgtaaaaagttgatgtattgaaatgaaatttgcacaaa

SEQ ID NO: 5292 - DNA, 1539 bp, Chrysanthemum coronarium
gcacagacagacacacagagatcgatccttttagcatttctgcttactgttgcaatattgtgattaccgaaaatgatggcgattggtgcttctgctctgccaataactgcagcaaaaccgtcaatgtttcttacacaaagaagtctcggggttactatgacatgttttgtaaatgcaactgatagaattttgtcatctaagcttaccagctcctctcatttgtcgtctgtgctaaatgttaagcgaagttttacaactagtcgtccaaagtttgaaaagtttgttaccaagtcaatgtctgaagcttctgaaagcaagcctgtatcccagctgtcaattgatttgaaaggtaaaagagcgtttattgctggtgttgcggatgacaatggatatggttgggctattgcaaaatctttagctgctgctggtgctgaaattcttgttggaacatgggtgcctgccttaaacatatttgaaatgagtttacgacgagggaagtttgatggatcacgagtgttgccagatggttctttgatggaaattactaaagtttatccactggatgctgtctttgataaccctgacgatgtacctgaagatattaaagccaataaacgttatgcgggagcaagtaattggacagtgcaggaagttgcagaatcagtaaagcaagactttggtagtattgatattttggtgcactcacttgccaatgggccagaggtgacaaaacctctgttggaaacatcaaggaaaggttatctagccgcagtatctgcatcaagctattcttatgtgtctttgctcaagcatttccttccaattatgaaccccggtggttcatctatctctcttacatatattgcttctgaaaggatcattcctgggtatggtgggggcatgagttcagcaaaagccgcacttgagagtgacacaagagtacttgctttcgaagcaggaagaaaaaagaaaattagggtcaacactatatctgcaggtccactgggaagccgtgcggctaaagcaattggcttcatagacacaatgatcgactactcttacgcaaatgcccctctacagaaagaactttttgcagatgaggtgggccacactgcagcattcctggcatcgccattggcttctgccattacgggtgctcttatatatgtagacaatgggctgaacgcaatgggtgtggccgttgatagtccgttgtttaaagatcttaacattccaacagagaagcattagcaacatgtgatacacaggttggcgttgagaataaagttttgaagttccggctagtagaatatgctcttagttttctgtaagatgtttatgacaacttattgatgtaaaaaagttgatgtattgaaatgaaatttgcacaaagttggccttaacttttgagcaattcgagttgtacaactacactatatattcttgtgttgatatttcaccatttgagcaggggtcttctcatattgctagagatctggtacaatgagggaggagatgatcccttgtttccgtttaaag

SEQ ID NO: 5293 - DNA, 1528 bp, Lactuca sativa
cctttccagttccactatctctcttgtcacgactcacccacacagcaagcgacagacacagatccacctttgagctttggcgcctcctgtcgcataatttccatttcatacactaaaaatgatggcgattggtgcttctgccctacaaataactttcacgagaccctctgttcttcttactcaaagaaatcttggggttaccatggcaagttttgtgcaagaatccgatagagctttatcatccaagcttacaagctcttctcatctttcatccatgttaaattctaatcaaagcttcacaattaatcgtccaaggtttcgtaagtttgttacaagatcaatgtctgaagcttctgaaaccaaatccacatcccagctatcgattgatttgaaaggtaaaagggcattcattgctggtgttgctgatgacaatggatatggttgggctattgcaaaatctttagctgcagcaggtgctgaaattcttgttggaacatgggtgcctgctttaaacatatttgaaatgagtctaagacgagggaaattcgatgcatcacgtgttttgccagatggcactttgatggagattactaaagtttatccattagatgctgtgtttgataacccagaagatgtacctgaagatattaaagcaaataaacgttatgcaggtgcaagtaattggactgtacaggaagttgcagaattagtaaagaaagattttggtagtattgatattttggtgcattctcttgctaatggaccagaggttactaagcctctattggagacatcaagaaaaggttatctagcagcagtatctgcatcaagctattcatatgtttctttactcaagcatttccttccaatcatgaaccctggtggttcttcaatttctcttacatacattgcttctgagagaatcattccaggatatggtggagggatgagttcagcaaaagctgcacttgagagtgacacaaaagttcttgcttttgaagccggaagaaaacataaaattagagtcaacactatctccgcaggtccacttggaagtcgtgctgctaaagcaattggttttatagatacaatgataagctactcttttgcaaatgctcctctacaaaaagagctatctgcggatgaggtggggaacacggcggcttttcttgcatcaccattggcgtctgccatcacgggtgctcttatatatgttgataatgggttgaatgcaatgggtgtgggggttgatagtccattgtttaaagatcttaatattccaacaagtgagcattagtattggcaattgtattatgtatatgtgttgagaataaagttttgaagattcggcttgtagatttaatgacaatttaattattatgtaaaagatgtggaatatgaacaaaacttgtgtaaaagtttgaagaatttgagtcttaagtaagagagatgtacatgttcttgtgttcctagttgattaggtcgttcattgtgcataaagtgcaaatcttgttgatgtaatgaaaat

SEQ ID NO: 5294 - DNA, 1880 bp, Conyza canadensis
atggtgtttaattgtaaatctcgattagtggaaggggttttagtgttaattagtttcatgtataaatagccccttccttcacatttgtaattaactctttcatatatgcaaaattcatttacatcttttctctcaaaacacacacagatccacctcctgctggctgctactgcttctgctgctgcaaatattgttgttgatagattgcatatatagtgaaaatgatggcaatgggtgcttctgcactgcaaataactacggtcagaccatccgtgtttcttacacaaagaagtattgggattaaagtagcaagttttgtgcaagaatccgatagaattttgtcgtctagtcttactagctcctctcacgtgtcgtctgtgttaaagactagaagacgtttcacagatagtcgtacgaggtttgaaacgtttgttacaagggcaatgtcagaagttgctgaaagcaagtctgtatcccagctttcgattaatttgaaaggtaaaagggcgtttattgccggtgttgctgatgacaatggatatggttgggctattgcaaagtctttagctgctgcaggtgctgaaattcttgttgggacatgggttcctgcgttgaacatatttgaaatgagtctacgacgtgggaaatttgatgaatcacgtgtgttgccagatggttctttgatggagattgctaaagtttatcctctggatgctgtctttgataaccctgaggatgtacccgaagatattaaaacaaataaacgttatgctggagcaagtaattggacagtgcaggaatgtgcagaaacagtaaagcaagactttggtagcattgatattttggtgcactctcttgccaatgggccagaggtgacaaaacctctgttggagacatccaggaaaggttatttggccgcagtatctgcatcaagctattcctatgtttctttgcttaagcatttccttccaattatgaaccctggtggttcctcaatctctcttacatacattgcttctgagaggatcattccagggtatggtgggggtatgagctcagcaaaagccgcgcttgagagtgacacaagagttcttgcttttgaagcaggaagaaaacataaaattagggtcaacactatatctgcaggtccgctgggaagtcgtgctgctaaagcaattggtttcatagatacaatgatcgactactctttcgcaaatgcccctctacagaaagaactatctgcagatgaggtggggaacaccgcagcattcctggcatcaccattagcttctgccattacgggtgctcttatatatgtagacaatgggctgaacgcaatgggcgttggagttgacagtccattattcacagatcttaacattccaaaggacaagcattagcaatagttattatgcaggtatatgttgagaataaagttttgaacttccggctagtagaattagtttttaattgtcagctagtccgccaatgattatgtcaacgtaatcatgtaaaacttgcacaaaattgttcattaattaagtcgccagagagcatatgtctactgagcctaatcttgcgcaaaccgctgtaatgttgctggatattttaccatctaagtaagtagtttatccaaattgcttgagcggtgaacggtgatgtccccaaattgaattacaatcatcacctagttatataatatttggaaaaaattatctcactcatggaactttggggtcaaagaattgcagcagaattgattatgtaattgtaccataaatttctcattttaaggggcgagggtgtagtcggcaagttttatcggcaaaaagcatcggcaagcatcggttatttggcaagcctatagcatgtgaatcggc

SEQ ID NO: 5295 - DNA, 1487 bp, Cichorium intybus
accactatcttactcacactgacagcgagcgacacagatcgacatttgagctttggcgcctcctgtcgcaaaaaattgcatttaccaaaatgatggcaattggtgcttctgcacttcaaacaactttcacaaggccgcccatttttctcacccaaagaactcttggggttaccatggcaacttttatacatgaatccgatagagctttctcatctaagcttacaagctcttctcatgtttcatccatgtcaaatttcaatcaaagtttcacaactagtcgtcaaaggtttcaaaaatttgttacaaaatcaatgtctaaagaagcttctgaaagcaagtctgtatcccaactatcgattgatttaaaaggtaaaagggcatttattgctggtgttgctgatgacaatggatacggttgggctattgcaaaatctttagctgctgcaggtgctgaaattcttgttgggacatgggtgcctgctttaaatatatttgaaatgagtctaagacgtgggaaatttgacacatcgcgtgttttgccagatggttctttaatggagattactaaagtttatccattagatgctgtctttgataaccctgaggatgtacctgaagatattaaagcaaataaacgttatgcaggtgcaagtaattggactgtacaggaagttgcagaattagtaaagaaagattttggtagtattgatattttggtgcattcacttgctaatgggcccgaggtaactaagcctttattggaaacatcaagaaaaggttatttagcagcagtatctgcatcaagctattcttatgtttctttactcaagcattttcttccaattatgaaccctggtggttcttcaatctcacttacatacattgcttctgagaggatcattccagggtacggtgggggcatgagttcagcaaaagccgcactagaaagtgacacaagagttcttgcttttgaagctggaagaaaacataaaatcagagtcaacactatatctgcaggtccattgggaagtcgtgctgcaaaagcaattggttttatagatacgatgattgactactcttatgcaaatgcgcctctacagaaagaattatttgcggatgaggtgggtaacacggcggcatttttggcatcaccattggcttctgcgattacgggtgctcttgtatatgtggacaacgggttgaatgcaatgggtgtgggggttgatagtccgttgtttaaagatcttaatattccaaaaagtgagcattaatggaggacattgttgagaataaagttttgaggtttcggcttgtagatttaggtgttaatttgatgattatgaattatgataacttaattatgtaagcatgtaaatcgggttaaaagttgtcttgaactttaaacaatgtaatggtgatgatcgattactttgtgaatggtccgttagaatttcgtgaaaagaaaagggatttggtaaaattaaagc

SEQ ID NO: 5296 - DNA, 1468 bp, Cichorium intybus
acactgacagcgagcgacacagatcgacgtttgagctttggcgcttcttgtcgcaaaaaatcacatttaccaaaatgatggcaattggtgcttctgcacttcaaacaactttcacaaggccgcccgtttttctcactcaaagaagtcttggggttaccatggcaacctttatacatgaatccgatagagctttctcatctaagcttacaagctcttctcatgtttcatccatgtcaaattttagtcaaagtttcacaactagtcgtcaaaggtttcaaaattttgttacaaaatcaatgtctaaagaagcttctgaaagcaagtctggatcccaattgtcgattgatttaaaaggtaaaagggcatttattgctggtgttgctgatgacaatggatacggttgggctattgcaaaatctttagctgctgcaggtgctgaaattcttgttgggacatgggtgcctgctttaaatatatttgaaatgagtctaagacgcgggaaatttgacacatcacgtgttttgccagatggttctttaatggagattactaaagtttatccattagatgctgtctttgataaccctgaggatgtacctgaagatattaaagcaaataaacgttatgcaggtgcaagtaattggactgtacaggaagttgcagaattagtaaagaaagattttggtagtattgatattttggtgcattcacttgctaatgggcccgaggtgactaagcctttattggaaacatcaagaaaaggttatctagcagcagtatctgcatcaagctattcttatgtttctttactcaagcattttcttccaattatgaaccctggtggttcttcaatctcacttacatacattgcttctgaaaggatcattccagggtacggtggtggcatgagttcagcaaaagccgcacttgaaagtgacacaagagttcttgcttttgaagctggaagaaaacataaaatcagagtcaacactatatctgcaggtccattgggaagtcgtgctgcaaaagcaattggttttatagatacaatgattgactactcttatgcaaatgcgcctctacagaaagaattatttgcggatgaggtgggtaacacggcggcgtttttggcatcaccgttggcttctgcgattacgggtgctcttgtatatgttgataatgggttgaatgcaatgggtgtgggggttgatagtccgttgtttaaagatcttaatattcctaaaagtgagcattaatggaggatattgttgagaataaagttttgaagtttcggcttgtagatttaggtgttgattttatgattgtggtaacttaattatgtaagcatgtaaatcgggttaaaagttgtcttgaattttgaacaatgtaatggtgatgatcgaaattactttgtgaatggtccattagaatttcgtgaaaagaaaaggaatttggtaaattaaagtag

SEQ ID NO: 5297 - DNA, 1425 bp, Cichorium intybus
gcgacacagatcgacatttgagctttggcgcctcctgtcgcaaaaaattcatcgcattcaccaaaatgatggcaattggtgcttctgcacttcaaacaactttcacaaggccgcccatttttctcacccaaagaactcttggggttaccatggcaacttttatacatgaatccgatagagctttctcatctaagcttacaagctcttctcatgtttcatccatgtcaaattttagtcaaaatttcacgactaatcgtcaaaggtttcaaaaatttgttacaaaatcaatgtctaaagaagcttctgaaagcaagtctgtatcccaactatcgattgatttaaaaggtaaaagagcatttattgctggtgttgctgatgacaatggatacggttgggctattgcaaaatctttagctgctgcaggtgctgaaattcttgtagggacatgggtgcctgctttaaatatatttgaaatgagtctaagacgcgggaaatttgacacatcacgagttttgccagatggttctttaatggagattactaaagtttatccattagatgctgtctttgataaccctgaggatgtacctgaagatattaaagcgaataaacgttatgcaggtgcaagtaattggactgtacaggaagttgcagaattagtaaagaaagattttggtagtattgatattttggtgcattcacttgctaatgggcccgaggtgactaagcctttattggaaacatcaagaaaaggttatctagcagcagtatctgcatcaagctattcttatgtttctttactcaaacattttcttccaattatgaaccctggtggttcttcaatctcacttacatacattgcttctgaaaggatcattcctgggtacggtgggggcatgagttcagcaaaagccgcacttgaaagtgacacaagagttcttgcttttgaagctggaagaaaacttaaaatcagagtcaacactatatctgcaggtccattgggaagtcgtgctgcaaaagcaattggttttatagatacgatgattgactactcttatgcaaatgcgcctctacagaaagaattatttgcggatgaggtgggtaacacggcggcgtttttggcatcaccgttggcttctgcgattacaggtgctcttgtatatgttgataatgggttgaatgcaatgggtgtgggggttgatagtccgttgtttaaagatcttaatattcctaaaagtgagcattaatggaggacattgttgagaataaagttttgaagtttcgggttgtagatttaggtgttgatttgatgattatgataacttaattatgtaaacatgtaaatcgggttaaaagttgtcttgaattttgaacaatgtaatggtgatgatcgaaattacgtgaatggtccattagaatttcgtg

SEQ ID NO: 5298 - DNA, 1163 bp, Ambrosia trifida
ccacaaacaataaccgacacaacagatccactttattggcgcctcctgttgctaaattgcatatactgaaaatgatggcaattggtgcttcggccttgcaaataactgcagcgaggccgtccgtttttcttacgcaaagaagtcttggggctactatggcaagttttgtacatgaatctgataggattttgtcatctaagcttaccagctcgtctcatctgtcatcagtgttaaattttaagcataaatgtacaacaagtcgtcctaggtttcaaaagttcgttacgaggtcaatgtcagaagcctctggaagcaagtctgtttcccagctgtccattgatttaaaaggtaaaagggcatttattgctggtgttgctgacgacaacggatatggttgggccattgcaaaatctttagcggctgcaggtgctgaaattcttgttggaacatgggtgcctgccttaaacatatttgaaatgagtctacgcaggggcaaatttgatgaatcacgggtgctgccggacggttctttgatggagattactaaagtttatccactggatgctgtctttgataaccctgaggatgtacctgaagatattaaagccaataaacgttatgctggagcaagtaaatggacagttcaggaagttgcagaatcagtaaagcaggattttggaagtattgatattttggtgcactcacttgccaatgggccagaggtcacaaagccgctgttggagacatccaggaaaggttatttggctgcagtatctgcatcaagctattcctatgtttctttgctcaaacatttccttccaattatgaaccctggtggttcctcaatatcccttacatacattgcttctgaaaggataattcccgggtacgtggggcatgagttcagcaaaagccgcacttgagagtgacacaagagttcttgctttcgaagcaggaagaaaacataaaattagggtcaacactatatctgcaggtccattgggaagccgtgctgctaaagcaattggattcatagacacaatgattgactactctttcgcaaatgcccctctacagaaagaactatctgcagatgaggtgggaaacacggcagcattcctggcatcaccattagcttcggcctattacaggtgctcttatat

SEQ ID NO: 5299 - DNA, 1328 bp, Flaveria ramosissima
gacacacagatccacctttgagcgttggtgcctcctgttgcaaaattgcatatagtaaaaatgatggcagttggtgcttctgccctgcaaataactgcagcgaggccgtctgttttcttacacaaagaagtcttggggctactatggcaagttttgtacatgaatctgagagaagtttgtcatctaagcttaccagctcttctcatatgtcatcagtgctgaactttaagcataaattcacaacgactcgtcctaggtttcaaaagtttgttacaaggtcaatgtcggaagcttctggaagcaagtctgcttcccagctttccattgatttaaaaggtaaaagggcatttattgctggtgttgctgatgacaatggttatggttgggccattgcaaaatctttagctgctgcaggtgctgaaattcttgttggaacatgggtgcctgccttaaacatattcgaaatgagtctacgcaggggcaaatttgatgaatcacgggtgttgccagatggttctttgatggagattactaaagtttatccactggatgctgtctttgatagccctgaggatgtacctgaagatattaaagccaataaacgttatgctggagctagtaattggacagtgcaggaagttgcagaatcagtaaagcaagattttggtagtattgatattttggtgcactcacttgccaatgggccagaggtcacaaagccactgctggagacatccaggaaaggctatttagctgcagtatctgcatcaagctattcctatgtttctttgcttaaacatttccttccaattatgaaccctggtggttcctcaatatctcttacatatattgcttctgagaggataatccctgggtacggtggcggcatgagttcagcaaaagccgcacttgagagtgacacaagagtgcttgctttcgaagcaggaagaaaacataaaattagggtcaacactatatctgcaggtccactaggaagccgagctgctaaagcaattggattcatagatacaatgattgactactcttttgcaaatgcccctctacagaaagaactagctgcagaggaggtggggaacacagcagcattcctggcatcaccattggcctctgccattacaggcgcgcttatatatgtagacaacgggctgaatgcaatgggcgtgggggttgacagcccgttgtttaaagatcttaatgttccaacagacaaacattagcaaaatgtatagtttgtcaggcatgtggtgagaataaagtttttgaagtatcggctagtagatttatatctaagttgtctgtaagttaaa

SEQ ID NO: 5300 - DNA, 1458 bp, Cichorium intybus
ggttacatcatcatatgaatttggtattttgactactatgaatctatgaacagtcgtaagattgcatttaccaaaatgatggcaattggtgcttctgcacttcaaacaactttcacaaggccgcccatttttctcactcaaagaagtcttggggttaccatggcaacttttatacatgaatccgatagagctttctcatctaagcttacaagctcttctcatgtttcatccatgtcaaattttagtcaaagtttcacaactagtcgtcaaaggtttcaaaattttgttacaaaatcaatgtctaaagaagcttctgaaagcaagtctggatcccaactgtcgattgatttaaaaggtaaaagggcatttattgctggtgttgctgatgacaatggatacggttgggctattgcaaaatctttagctgctgcaggtgctgaaattcttgttgggacatgggtgcctgctttaaatatatttgaaatgagtctaagacgcgggaaatttgacacatcacgtgttttgccagatggttctttaatggagattactaaagtttatccattagatgctgtctttgataaccctgaggatgtacctgaagatattaaagcaaataaacgttatgcaggtgcaagtaattggactgtacaggaagttgcagaattagtaaagaaagattttggtagtattgatattttggtgcattcacttgctaatgggcccgaggtgactaagcctttattggaaacatcaagaaaaggttatctagcagcagtatctgcatcaagctattcttatgtttctttactcaagcattttcttccaattatgaaccctggtggttcttcaatttcacttacatacattgcttctgaaaggatcattccagggtacggtgggggcatgagttcagcaaaagccgcacttgaaagtgacacaagagttcttgcttttgaagctggaagaaaacttaaaatcagagtcaacactatatctgcaggtccattgggaagtcgtgctgcaaaagcaattggttttatagatacgatgattgactactcttatgcaaatgcgcctctacagaaagaattatttgcggatgaggtgggtaacacggcggcgtttttggcatcaccgttggcttctgcgattacaggtgctcttgtatatgttgataatgggttgaatgcaatgggtgtgggggttgatagtccgttgtttaaagatcttaatattcctaaaagtgagcattaatggaggatattgttgagaataaagttttgaagtttcgggttgtagatttaggtgttgattttatgattgtggtaacttaattatgtaagcatgtaaatcgggttaaaagttgtcttgaattttaaacaatgtaatggtgatgatcgattactttgtgaatggtccgttagaatttcgtgaaaagaaaagggatttggtaaa

SEQ ID NO: 5301 - DNA, 1423 bp, Cichorium intybus
ggttacatcatcatatgaatttggtattttgactactatgaatctatgaacagtcgtaagattgcatttaccaaaatgatggcaattggtgcttctgcacttcaaacaactttcacaaggccgcccatttttctcactcaaagaagtcttggggttaccatggcaacctttatacatgaatccgatagagctttctcatctaagcttacaagctcttctcatgtttcatccatgtcaaattttagtcaaagtttcacaactaatcgtcaaaggtttcaaaattttgttacaaaatcaatgtctaatgaagcttctgaaagcaagtctgtatcccaactatcgattgatttgaaaggtaaaagggcatttattgctggtgttgctgatgacaatggatacggttgggctattgcaaaatctttagctgctgcaggtgctgaaattcttgttgggacatgggtgcctgctttaaatatatttgaaatgagtctaagacgcgggaaatttgacacatcacgtgttttgccagatggttctttaatggagattactaaagtttatccattagatgctgtctttgataaccctgaggatgtacctgaagatattaaagcaaataaacgttatgcaggtgcaagtaattggactgtacaggaagttgcagaattagtaaagaaagattttggtagtattgatattttggtgcattcacttgctaatgggcccgaggtgactaagcctttattggaaacatcaagaaaaggttatctagcagcagtatctgcatcaagctattcttatgtttctttactcaagcattttcttccaattatgaaccctggtggttcttcaatctcacttacatacattgcttctgaaaggatcattcctgggtacggtgggggcatgagttcagcaaaagccgcacttgaaagtgacacaagagttcttgcttttgaagctggaagaaaacttaaaatcagagtcaacactatatctgcaggtccattgggaagtcgtgctgcaaaagcaattggttttatagatacgatgattgactactcttatgcaaatgcgcctctacagaaagaattatttgcggatgaggtgggtaacacggcggcgtttttggcatcaccgttggcttctgcgattacgggtgctcttgtgtatgttgacaacgggttgaatgcaatgggtgtgggggttgatagtccgttgtttaaagatcttaatattcctaaaagtgagcattaatggaggacattgttgagaataaagttttgaagtttcgggttgtagatttaggtgttgatttgatgattatgataacttaattatgtaaacatgtaaattgggttaaaagttgtcttgaattttgaaaaatgtaatggtgatgatcgaaattactttgtgaatggtc

SEQ ID NO: 5302 - DNA, 1042 bp, Arnica chamissonis
gtgctaaactttaagcataaattcacaacgagtcgtcctaggtttcaaaagtttgtcaccaggtcaatgtcagaagcttcgggaagcaagtctgtttcccagctgtccattgatttaaaaggtaaaagggcgtttattgctggtgttgctgatgacaatgggtatggttgggctattgcaaaatctttagctgctgcaggtgctgaaattcttgttggaacatgggtgcctgccttaaacatatttgaaatgagtctacgcaggggcaaatttgatgaatcacgggtgctgccagatggttctttgatggagattactaaagtttatccactggatgctgtctttgacaaccttgaggatgtacctgaagatattaaagcgaataaacgttatgctggagcaagtaaatggacagtgcaggaagttgcagaatcagtaaagcaagattttggtagtattgatattttggtgcactcacttgccaatgggccagaggtcacaaagccactgttggagacatccaggaaaggttatttagctgcagtatctgcatccagctattcctatgtttctttgctgaaacatttccttccaattatgaaccctggtggttcctcaatatctcttacatatattgcttctgagaggataattccagggtacggtgggggtatgagttcagcaaaagccgcacttgagagtgacacgagagtgcttgctttcgaagcaggaagaaaacataaaattagggtcaacactatatctgcaggtccactgggaagccgagctgctaaagcaattggattcatagatacaatgattgactactcttttgccaatgcccctctacagaaagaactctctgcagatgaggtggggaacacagcagcattcttggcatcacctttggcttctgccattacgggtgctcttatatatgtagacaacgggctgaatgcaatgggcgtgggggtcgacagcccgttgtttaaagatcttaacgttccaacagacaaacattagtaaaatatacagttgcagg

SEQ ID NO: 5303 - DNA, 1500 bp, Echinacea purpurea
gggtttggaagagagtcagaattcagaaaccatcgatgatcgatcgatctcaccttcttcacggttattactcataacagatccctatttacgcacaccaaccgggactttagggtttgcccgatcagatagatcagtattgtgatagactgttagtgaaatggcaactgcaaatttgagcgcgcatattgctttagcaaaacccttgacttatgcttcatgtgaagtatcgaagacgagcgttgcggttgttagcagcggtgttaaagagacatcatggatgaagctcaagagttcttggcacatctcttcaagatatgtgaatgctacaacatccaaaaatgtgaaatttagtaaactggtgacaaaagctatgtcagaatccaatgacataaagcccctcccagggttgcctgttgatctgagaggcaagagggcattcattgctgggattgctgatgataatggatatggatgggcaatagcaaaatctctagctgctgctggtgctgaaattcttgttggaacatgggtgcctgccttaaacatatttgaaatgagtctacgcaggggcaaatttgatgaatcacgggtgctgccagatggttctttgatggagattgctaaagtttatccactggatgctgtctttgataaccctgaggatgtacctgaagatattaaagccaataaacgctatgctggagcaagtaattggacagtgcaggaagttgcagaatctgtaaagcaagattttggtagtatagatattttggtgcactcgcttgccaacgggccagaggtcacaaaaccgctattggagacatcgaggaaaggttatttagctgcagtatctgcatcaagctattcctatgtttctttgctcaaacatttccttccaattatgaaccctggtggttcctcaatatctcttacatatattgcttctgagaggataattcctgggtatggtgggggtatgagttcagcgaaagccgcacttgagagtgacacaagagtgcttgcttttgaagcaggaagaaaacataaaattagggtcaacacaatatctgcaggtccgcttggaagccgtgctgctaaggcaattggattcatagacacaatgattgactactcttttgcaaatgcccctctacagaaagaactatctgcagatgaggtggggaacacagcagcattcctggcatcaccattggcttctgccattacgggtgctcttatatacgtagacaatgggctgaatgcaatgggcgtgggggttgacagcccgttgtttaaagatcttaatgttccaacagacaaacattagcaaattgtatagttggcaggtatgtggtgagactaaagtttttgaagttccggctagtagatttatatcatagttgtctgtaagttaaacgatgattataacatgcaaactttcaaaatgtaagtagtaaatctccaccaagttgctggaccgtttttaggcgaaaaaca

SEQ ID NO: 5304 - DNA, 1624 bp, Tabernaemontana elegans
aactgctacttctgaaaaccctttgaacacagtaactaccaaacaccttcgatttcttaaaagctcccatttctctttaatctttcccacacggagtagaggaaagtccgcagcattggctttttccatcgttttaaggtctccattttattgtgcaagattcgatttattaaaaatggcagtaactgcagcttccagcttgcaaattactgcagctaggccttcttttttctctgctcagaaaatgcttgggccagctgtttctactgttgtcgcagaatcaaataaggcaccatgggttaaactttcaagtggttgtcacatatcctccatacagcgatttcaacgtagcttcatgtcatctcctccaaaatttgacagagtggttaccaaggcaatgtctgaagctggagaaaagcagccttcctcaggattatcaattaatttaaaaggtaaaagagcttttatagctggagtggcagatgacaatggatatggctgggctattgcaaaatctctagctgctgcaggtgctgaaattcttgttggtacctgggtgcctgctttaaacatctttgaaacaagtctacggcgcgggaaatttgatgaatcacgcgtgttgccagatggttctttgatggagatcacgaaagtctatcccctggatgctgtttttgacagtcctgaggatgtacctgaagatataaaaacaaacaagcgatatgcaggatcaagtaattggactgtcaaggaagttgcagaatctgtaaaacaggactttggcaccattgatattcttgtgcactcgcttgctaatgggccagaggtaactaaacctttactggagacttcaaggaatggatatcttgcggcaatctcagcatctagttactcctatgtttctttgctcaagcatttcattccaattatgaacccagggggttcttccatttctcttacatatattgcttcggagaggatcattccagggtatggaggaggcatgagctcggcaaaggctgcacttgagagtgatacaagagtgcttgcctttgaagcaggaaggaaacataaaattagggtgaacacgatatctgctggtccactaagaagccgtgctgccaaagctattggattcattgatatgatgattgattactctttagccaatgcaccccttcagaaagaactatctgcagatgaggtaggaaataccgctgccttcttagcttcccctctggcttctgccattaccggtgctgttatatatgcagacaacggtctaaatgcaatgggtgtgggagtcgacagtcctatattcgaaaagcttgacatcccaaaggacaaatgattgaggtgaaatcatgacaaaaagcaggttttgtagacggtgcagctggaagagttagaatggcttgttttggcctcatttgtacattctgtggtcaaagcagaaaatggccagcggctttctttgaaattgagatttttatctatttcgcggattgtaatttcacatttagtgattcaaatattcatttctcctgagaattggaaaaactcaaaagacaaaagaaggattacattcatagcctacatctttgtgttgtactttacgctctaa

SEQ ID NO: 5305 - DNA, 1536 bp, Amsonia hubrichtii
ctggaaaccctctgaacacataaactacaaaagaccttcgatttcttcgacacctaccatttttgtttatttttctcacaaggagcagagataagtttgcagcattggctttcccaatcgtttcaaggtctccatcaagattctatttactgaaaatggcagtaactgcggcttccagcttgcaaattactgcagctaggccttctattttctcagctcggaaaatgctaggggcagctgttactaatgttggctcagaatcatgggttaaactttcaagtgcttgccatatatcctctgtacaacaatttcaacgtagcatcatgtcatctcctccaaaatttgacagagtggctcccaaggcaatgtctgaagctggagaaaagcagccttcatcaggattatcaattgatttaaaaggtaaaagagcttttatagctggagtggcagatgacaatggatatggctgggctattgcaaaatctctagctgctgcaggtgctgaaattcttgttggtacctgggtgcctgctttaaacatctttgaaacaagtctgcgacgtgggaaatttgatgaatcacgcgtgttgccagatggttctttgatggagattacaaaagtctatcccctggatgctgtttttgacagccctgaggatgtacctgaagatataaaagcaaacaagcgatatgcaggatcaagtaattggactgtcaaggaagttgcagaatctataaaacaggactttggcaccattgatattcttgtgcactcgctagctaatgggccagaggtaactaaacctttgctggagacttcaaggaacggatatcttgcagcaatctcggcatctagttattcctatgtttctttgctaaagcatttcgttccaattatgaacccaggcggttcttccatttctcttacatatattgcttctgagaggattataccagggtatggaggaggcatgagctcggcaaaggcagcacttgagagtgatacaagagtacttgcttttgaagctggaaggaaacataaaattagggtgaatacaatatctgcaggtccattaagaagccgtgctgccaaagctattggattcattgatatgatgattgattactccttagccaatgcaccccttcagaaagaactatctgcagatgaggtggggaacactgctgccttcctagcatcccctctggcttctgccattactggtgccgttatatatgtagacaacggtctaaatgcaatgggtgtgggagttgacagtcctatattcgaaaaacttgacattccaaaggacaaatgattaaggtgaaatcaggacaaaaagcaggttttgtagacggtgcagcttgaagagttagaatggtttgttttggccttttggcctcatttgtacatttatgtggtcaaaccaaaatggtttgtccagcggcttaagttgaaattgagatttttatctactttagcatattgtaacttcacattaaagattcaaatattcattccaaagagttggaaaa

SEQ ID NO: 5306 - DNA, 1670 bp, Theobroma cacao
gaaaaacacaacaaaacaaattcctttgtgaaaacacctcgatctcattgaactccctcaagattttcttctcctcgtgttctctctcttcttcttcagtctccgcattggctctgtctgcctctcgaagaattttgctttctgctgtgaaatataactttttgaggatggcagcaacagcagcttccagccttcaaatagcagcagcaagaccctgcatttcatcccctcacaggtttgttgaggctggtgtttccattctaggtgccaattctaaaagtgtgtcatggactaagctcacaagtgcttgcaatatatcatctttagagcctttccgacgcagttttacatcatctccagcaaagttcaaaaaggttgtgacaaaggcaatgtctgaatctagtgaaaagaagcctgtttctgggttggcaattgacttgaaaggtaagagggcatttattgctggtgtagctgatgataatggatatggctgggcaatagcaaaatctcttgctgctgcaggagctgaaattctagtgggaacatgggtgcctgctttgaacatatttgaaaccagcttgagacgtggaaagtttgatgaatcacgcgtattgccagatggctctttaatggagattaccaaagtatatcccctagatgcagtctttgacaaccttgatgctgtccctgaagatataaaaacaaataagcgctatgcaggatcctcaaattggactgttcaggaagttgctgaatctgttaaacaggattttggcagcattgacatccttgtgcattccctagctaatgggccagaggtcagtaaacccctgctggagacatcccggaatggatatcttgctgctttatctgcttcaagttactcctatgtttctttactcaagcattttctcccattaatgaaaccaggaggctcttcaatttctcttacatacattgcttctgagcgaataattccaggatatggtggaggtatgagttctgctaaagctgctctagaaagtgatacaagagtacttgcttttgaagcaggaagaaaaaacaaaattagggtcaacacaatatctgcgggtcctctaagaagtcgtgctgcaaaggcaattggatttattgatacaatgattgaatattcaatggctaatgcacctctccagaaagaactatctgcagatgaggtggggaacaccgctgctttcttggcatcacctttggcttcagctatcacaggtgctgtcatatatgtagacaacggtctgaatgcaatgggtgttggaattgacagtcctatatttaaagacctcaacattccaagcgacaagcattaggagtagctaccaggaggttcatagcaaatgccatgcctgaatgtttagtttagctctttattgttggtactgcatcttaggatgtttgatcggcagcccctttatacctgcgagattttgtcttgcctgttttaatttcttctaatttttaagttttctggatagagactgtcttagcatgactgagttttctcacagtagtgttctgccaaatcctgattaagcttttttgagtggacaatttccattaatggatcgattgctgcattgctgataaaacagctgctcatgtttgaacttgaacttgattcaactgaagtcaat

SEQ ID NO: 5307 - DNA, 1651 bp, Vitis vinifera
aaaacgacgtcgtttttaccttgggttggaataaaacccctttctcatctgggttttgcgcagttggaaggcctccaacagctgagctagtagcttttcagttttcactacctttgatttcttcagaacccaattttcaaatcccccttaaccaccagaccctaaattactttcccctgttttcatatcacagcgaagttttccatcccaatagatttctgttttcctctgcaagattcaagttgccgaaaatggcagcaactgcagtttctggcctgcaaatggcaacagcaaggtcccatatttcttcctctcatagaattttcaaggcaggggctgctgtgcttggcaccaattctaaagggagatcttgggctaagcttgctagtgcttgtcatatatcatatttccaccacttccagcatagtttttcatcatctcctataagatttgataaggttgttacaagggccatgtctgaagctagtgaaaaaaagcctacttcagggttgccaattgacttgaagggtaagagagcctttattgctggtgttgctgatgacaatggatatggttgggcaatagccaaatctcttgcagctgcaggtgctgaaattcttgttggcacatgggttcctgcattgaacatttttgaaaccagcctacggcgtgggaagtttgatgaatcacgcgtgttgccagatggttctttgatggagatcaccaaaatatatcctttggatgcagtttatgacacccttgaggatgtacctgaagatgtaaaagcaaataagcgttatgctggatcctctaattggactgttcaggaagtggccgaatccgtgaaacaggattttggcagcatcgatatccttgtgcactcacttgccaatgggccggaggtgaccaagcctctgttggagacatccagaaaaggttatcttgcggcaatatctgcatcaagttactcctacgtttctttactcaagtgtttcattcctataatgaacccaggtggatcttcaatttctctaacatacattgcttctgagaggatcattccaggatatgggggaggcatgagttcagccaaagccgctctagaaagtgatacacgagtgcttgcttttgaagcaggaaggaaacacaaaatcagagtcaatacgatatctgctggcccactaagaagccgtgctgcaaaagcaattggatttattgatacaatgatcgagtattcgctggctaatgcacctctgcagaaagaactaagtgcagatgaggtggggaacactgctgccttcttggcatcacctctggcatctgccatcactggtgctgtcatatacgtcgataacggtctgaatgcaatgggtgttggagtcgatagcccaatgttcgcagacctcaacattccaaaggacaagcactagaggttttaatgcatcacctctggcatctgctgtcaccagcactctttgtttgcatattatgggcatcatcaatggatagctctgtcggcatcacccattttttccatgaggatttgtatttttttctgtaggaagtctcttctatgataggactgggaaggaggtagatacataatcttaattccccgttgcattcaatgaaaacctctcaggatttcagt

SEQ ID NO: 5308 - DNA, 1507 bp, Panax ginseng
agttctcatatttaaaatggcgggagttgctgcttctggcctgcaaatcactgcagccagaccctccattttctttacccatagcatattcaagtcagctgtagccaatgttcttgttaaatctaatgaatcatcatgggttaagcttgccaattcccgtcatgtatcgtcagtgaagcattttcagaagaatttcaaatcaaattctgcaaggtttaaaaactttgccaccaaggcaaagactgaagttagtgataacaagcctgcatcagttttgcccattgatttgagaggtaaacgggcatttattgctggtgtagctgatgacaacggatatggttgggctatagcaaaatctctagctgctgcaggtgctgaaattctcgttggtacatgggtgcctgctctaaatatttttgaaatgagcctacgacgtgggaagtttgatgaatcacgtgtgttgccagatggttctttgatggacattactaaagtataccccctagatgctgtttttgacaaccttgaggatgtacctgaagatataaaagcgaataagcgttatgcaggatctactaagtggaccgttcaggaagttgcagaatctgtgaaacaggactttggcagcattgatgttcttgtgcactcacttgctaatggaccagaggtgactaaacctctgttggagacatccaggaaaggatatcttgcagcaatatctgcatcaagttattcctatgtttctttgttaaagcattttcttccgattatgaacccaggtggctcttcaatttctcttacatatattgcatctgagaggataattcctggttacggtggaggcatgagttcagctaaagctgctttagagagtgatacaagagtgcttgcttttgaagccggaagaaaacgcaaaatcagggtcaatactatatctgctggcccattaagaagccgtgctgcaaaagcaattggattcatagacatgatgattgactactccctcgaaaacgcacctctacagaaggaattatctgctgatgaagtggggaacactgcggctttcttggcttcaccattggcttctgcgataactggtgctgttatttatgtagacaatggtctgaatacaatgggggtgggagttgatagtcccttatttaaagatcttgacattccaaaggataagcactagagacagcaatagacaggttcttaggagctttttaagtatgggaattattgtagtttttgctgatcttgagcccctcttttacccttaatagttattgtcaggaatggcttggctagcggcaccaattggtagtgagagtaggtattcattttgtaggcatgtgtaacttttatggtgtgtcctctttgtgcaatttaaacaatcaattttaaggcctcagatggcttattcctttcgtgtaattctatgtgcaaaaactgtgtacaaattatagttataatcagattatagcttaacatattatgatccaaa

SEQ ID NO: 5309 - DNA, 1948 bp, Panax ginseng
aagcagtggtatcaacgcagagtacatggggtacaatacaataacctatctaacccttcactgcattctcgccttctgttgcttaaaagttctcatatttaaaatggtgggagttgctgcttctggcctgcaaatcactgcagccagaccctccattttctttacccatagcatattcaagtcagctgtagccaatgttcttgttaaatctaatgaatcatcatgggttaagcttgccaattcccgtcatgtatcgtcagtgaagcattttcagaagaatttcaaatcaaattctgcaaggtttaaaaactttgccaccaaggcaaagactgaagttagtgataacaagcctgcatcagttttgcccattgatttgagaggtaaacgggcatttattgctggtgtagctgatgacaacggatatggttgggctatagcaaaatctctagctgctgcaggtgctgaaattctcgttggtacatgggtgcctgctctaaatatttttgaaatgagcctacgacgtgggaagtttgatgaatcacgtgtgttgccagatggttctttgatggacattactaaagtataccccctagatgctgtttttgacaaccttgaggatgtacctgaagatataaaagcgaataagcgttatgcaggatctactaagtggaccgttcaggaagttgcagaatctgtgaaacaggactttggcagcattgatgttcttgtgcactcacttgctaatggaccagaggtgactaaacctctattggagacatccaggaaaggatatcttgcagcaatatctgcttcaagttattcctatgtttctttgttaaagcattttcttccgattatgaacccaggtggctcttcaatttctcttacatatattgcatctgagaggataattcctggttacggtggaggcatgagttcagctaaagctgctttagagagtgatacaagagtgcttgcttttgaagccggaagaaaacgcaaaatcagggtcaatactatatctgctggcccattaagaagccgtgctgcaaaagcaattggattcatagacatgatgattgactactccctcgaaaacgcacctctacagaaggaattatctgctgacgaagtggggaacactgcggctttcttggcttcaccattggcttctgcaataactggtgctgttatttatgtagacaatggtctgaatacaatgggggtgggagttgatagtcccttatttaaagatcttgacattccaaaggataagcactagagacagcaatagacaggttcttaggagctttttaagtatgggaattattgtagtttttgctgtttttgagtccctcttttacccttaatagttatcgtcaggaatggcttggctagcggcaccaattggtagtgagagtaggtattcattttgtaggcatgtgtaacttttacggtgtgtcctctttgtgcaatttaaacaatcaattttaaggtcttagatggcttattcctttcgtgtaattctatgtgcaaaaactgtgtacaaattatagttataatcagattatagcttaacatattatgatccacaagttgtttagaggatgtttatctatttctcattacaaattataatgtgtagttatttaaagagtttcggaactttacataatagtttgaaacaaatttactaggactctggatacctttatataatttaattgtcactagtgagtcattctcaaggttgcaatttattgggttgtgtttgtagccgtaaataagcttcgtttgaaataaattgcttgtaagcaaacaagattctcaactacgttcaccaaacacagcagtagcgttggtggtctaaacgcaccgcaccacttttggtgagttaaataagctgcgtttgaaataaattgcttgtaaataaacaagattctaaact

SEQ ID NO: 5310 - DNA, 1563 bp, Panax ginseng
acaatgcaataacctatctaacccttcaccgcattcttgccttctgttgcttaaaaagttctcatatttaaaatggtgggagttgctgcttctggccttcaaatcactgcagccagaccctccattttctttacccatagcatattcaagtcagctgtagtcaatgttcttgttaaatctaatgaatcatcatgggttaagcttgccaattcccgtcatgtatcgtcagtgaagcattttcagaagaatttcaaatcaaattctgcaaggtttaaaaactttgccaccaaggcaaagactgaagttagtgataacaagcctgcatcagttttgcccattgatttgagaggtaaacgggcatttattgctggtgtagctgatgacaacggatatggttgggctatagcaaaatctttagctgctgcaggtgcagaaattctcgttggtacatgggtgcctgctctaaatatttttgaaatgagcctacgacgtgggaagtttgatgaatcacgtgtgttgccagatggttctttgatggacattactaaagtataccccctagatgctgtttttgacaaccttgaggatgtacctgaagatataaaagcgaataagcgttatgcaggatctactaagtggaccgttcaggaagttgcagaatctgtgaaacaggactttggcagcattgatgttcttgtgcactcacttgctaatggaccagaggtgactaaacctctattggagacatccaggaaaggatatcttgcagcaatatctgcatcaagttattcctatgtttctttgttaaagcattttcttccgattatgaacccaggtggctcttcaatttctcttacatatattgcatctgagaggataattcctggttacggtggaggcatgagttcagctaaagctgctttagagagtgatacaagagtgcttgcttttgaagccggaagaaaatgcaaaatcagggtcaatactatatctgctggcccattaagaagccgtgctgcaaaagcaattggattcatagacatgatgattgactactccctcgaaaacgcacctctacagaaggaattatctgctgacgaagtggggaacactgcggctttcttggcttcaccattggcttctgcgataactggtgctgttatttatgtagacaatggtctgaatacaatgggggtgggagttgatagtcccttatttaaagatcttgacattccaaaggataagcactagagacagcaatagacaggttcttaggaactttttaagtatgggaattattgtagtttttgctgtttttgagcccctcttttacccttaatagttatcgtcaggaatggcttggctagcggcaccaattggtagtgagagtaggtattcattttgtaggcatgtgtaacttttacggtgtgtcctctttgtgcaatttaaacaatcaattttaaggccttagatggcttattcctttcgtgtaattctatgtgcaaaaactgtgtacaaattatagttataatcagattatagcttaacatattatgatccaaa

SEQ ID NO: 5311 - DNA, 1771 bp, Citrullus lanatus
tttcctatttgattcttcttcctgcctctctggaaaaccctgctttttaattgctccaaaattccatctctctcgacattggcgttctctgtcgcaaagatatctcgattctcctctgcgagataccagttcctgaagatggcagcagcagcttctaaccttcagatagcaacactaagacactgccaattgccctctaggaaaggcttcaagccatgtggaacgatccttagcggcagttctaaagtatcatcatgggctaagctttcgagttctagcaatatatcatctgcactatttttccagaggaagtttgtctcatcttctgtgaaaaatgagataactgtaaccaaagcaatggctgaagctaatgatagtaagcctgtctctgggctgtcaattgatctaaaaggtaagagagcatttatcgctggtgtagctgacgataatggatatgggtgggcaattgctaaatctcttgcagcggctggtgctgaaattcttgtcggcacgtgggtgcctgccttgaacatttttgaatccagcttgagacgtggaaagttcgatgaatcacgagtactacctgatggatctcttatggagatcacaaaagtatatcctctagatgcagtttttgacagccctgaagatgttcccgaagatataaaaacaaacaaacgctatgctgggtcctcaaattggactgtaaaggaagttgctgagtctgtgaagcaagactttggcagcattgacattcttgtgcactcccttgctaatggaccggaggtaacgaaacctctgttggagacatctcggaatggttatctagcagctttatccgcatcaagctactcttatatatctctactgaagcattttattccaatcattaatccaggtggttcttcattatccctaacgtacatagcatctgaaaggatcattccagggtatggaggtggcatgagttctgccaaagctgctttggagagtgatacacgagtacttgcttttgaagctggaagaaaacacaaaatcagagtgaacacaatatctgctggtccactaagaagtcgagctgcaaaagctattgggtttattgacatgatgattgactattcaacagccaatgcacctttgcagaaagaactatctgctgaggaggtggggaatgcagctgcctttttggcatcacctctggcttctgccattaccggagctgttatttatgttgataatggtttgaacgcaatgggcgtaggagtcgatagcccagtatttaaggatctagatattccaacagacaagcattagatttgcttgcagattggttggttgttgagatcttgccaaccctcagctagtttggtactcttttttttccagtcgatggaatcggtactatgagaaaggcttggccaagctgcctcgattttggttttttatttctaattatactctttgtattcgcgacaggtgtagtttaaaatcgttcacatctggatgctagcatttttatagtacgttacgtttgagagtcgtacatcctcaacgtttcttttaggtatcctagacattcgatgaccaattagcaaaacttgttttataacttttggattgatttggctacaaatcgaaatgggtatccgtggatttcatcaaagtatcttcgaaatctgaaatggtttctaattagccaaaagccttttagcatattgagaaagttactccagaagaatgtacggttctacgacagattactacaaaatca

SEQ ID NO: 5312 - DNA, 1645 bp, Euonymus alatus
gctgattataaacacaaaagcctccccctcttatctctctggctaccctcctctgcatctccgcattggcagctccgcttcacgaaagtcaatattgtcttctgctagatttaatttattgaaaatggcggcaacaactgcctctggtctgcaaatggcagcagctaggccttgcatttcatcctctcacagagtttccaaggcgagtgctgctacttttggtgcgaattctaaggggccatcatgggctaaccagcttacaagtgcttctcatatatcatctgtacaaccctttcaatggaattctagatcacgttctattaagttcaataagtttgtcacaaaggcaatgtctgaatccactgagaacaagccagcctctgggctaccaatcgacctgagaggtaagagagcatttattgctggtgttgctgatgataatggatatggttgggcgatagccaaatcccttgctgctgcaggagctgaaattcttctgggaacatgggtgcctgctttaaacatttttgaaagtagcttgcggcgaggaaagtttgacgaatcacgcgtgttgcctgatggttctttgatggagatcaccaaagtatatcctcttgatgccgtgtttgacagccctgaggatgtgcctgaagatgtgaaatcaaataagcgctatgctggatcatctaaatggactgtgcaggaagttgccgaatctgtgaaacaggactttggtagcattgacatccttgtgcactcacttgccaatggaccagaggtgaccaaacctctattggagacatccaggaaaggatatctcgctgctatatcagcatctagttactcctatgtttccttactcaagcattttgctccaataatgaacccaggtggttcctcaatttcactcacatacattgcttctgagaggattatacctggatatggtggaggaatgagctctgcaaaagctgcacttgagagcgacacaaaagtgcttgcttttgaggcgggaaggaaacacagaattagagtcaacactatatcagctggaccactaagtagccgtgctgcaaaagccattggatttattgatatgatgattgactattcatctgcgaatgcacccctgcaaaaggagttatctgcagatgaggtgggaaacacagctgccttcttggcgtcacccttggcctctgccattaccggtggtgttatatatgttgacaatggtctgaacgcaatgggtgttggagtcgacagtccaatattcaaggacctagacattccaactgacaagcactaaggacaaccggcattagatttgtagcaaacagcaatcacaaaaggatcttgtggctgagtggccatattttgtcatcgagtttacttttcttctccggaaaggaatttagtatagcttatggacataataaactctttcagtgtttggactttccatcttgtgatcaatgtgattggcaagaataactgatttcttcttagatgtcaatgtgcaatgttcacaatgaagcagataattgccaaactgtgcttggccggcttctattctagatgtatttttttttcttatcctaaaattgatacaggaattgctggcctgccccggagcagtcacttggac

SEQ ID NO: 5313 - DNA, 1630 bp, Castanea mollissima
ctctcacacaaagatcttttttctctagtgtgagatatcatttactggagatggcaacaacagccgcttccagcctgcaaattgcaacagcaagaccctgcatttcttcttctcgtagaattttcaaggcaggtgctgcaatttttggtggaaattccaaggcggtatcatggaataagcttacaagtgcatgccatatatcatctgtacaacctttccagcggagctttacatcatcatctgttaaatttgataaggttgttacaaaagcaatgtctgaaactactgaaaacaagcctatctcagggttgccaattgatttgagaggtaagagggcatttattgctggtgttgctgatgacaatggatatggttgggcaatagctaaatccctcgctgctgcaggggctgagattctcttaggcacatgggtgcctgctttgaacatttttgaatccagcctgcgacgtggaaaatttgacgaatcacgtgtgttgccagatggctctttaatggagattactaaagtatatcctttggatgcagtctttgacaaccttgaggatgtacctgaagatataaaagcaaataaacgctatgcaggatccagtaagtggactgttcaggaagttgctgaatctgtgaagaatgattttggcagcattgacattcttgttcactcacttgcaaatgggccagaggtcactaaacctctgttggagacatccaggaatggatatcttgcagctatatctgcatcaagttactcctatgtttctttactcaaacatttcattccaataatgaatccaggtggttcttcaatttctcttacatatattgcttctgaaaggataattcctgggtatggtggaggtatgagttcagcaaaggctgctctggagagtgacacacgagtgcttgcttttgaagcgggtagaaaacacaaagtcagagtcaacgcaatatctgctggtccactaagaagccgtgctgcaaaagcaattggatttattgacatgatgattgactattcaatagtcaatgcacctttgcaaaaagaactatccgcagatgaagtggggaacacagctgcctttctagcatcgcctttggcttctgccatcaccggtgctgttatatatgttgacaatggcctgaacgcaatgggtgtcggagttgacagtccaatatttaaggatcttgacattccaacagataagcactaggacaaccacaaattggttaatagtaagccagactctgaacttcaagtttagctttaatgctgctagttttctgctcctttttttccccaatcggcttcaacctaggatggtttggctagtggccccattttgttgtgagaatttttctttgcctttcttagggactacaatattttcttgggggcaggtgttgcagaggccccatgtgaaagtcttggacctgtgaaacactaataagattcatgtttcttagactcttcaatttttctttttaattaataagtcaagtgttgaacgtagtctataagctccattccattcttgtaggagaagaggtcatttgaactggaagtcaattttactgttccttttcaaaataaataatgtctattcatggttaa

SEQ ID NO: 5314 - DNA, 1634 bp, Quercus alba
cccaaatatttataattttatacctgattcctgaacctcagaacctgatacggtgaggtgagcagttgagacttgagagaggcggagagcagagaatcagagagaggctgaggcggttcagctggagactagagagaggcggagagcagagactagagagaaagtcttttctctagtgtgagatatcatttactggagatggcaacaacagccgcttccagcctgcaaattgcaacagcaagaccctgcatttcttcttctcgcagacttttcaaggcaggtgctgcaattcttggtggcaattccaaggcggtatcatggaataagcttacaagtgcatgccatatatcatctgtacaacctttccagcggagttttacatcatcgtctattaaatttgataaggttgttacaaaagcaatgtctgaagctactgaaaacaagcctatctcagggttgccaattgatttgagaggtaagagggcatttattgctggtgttgctgatgacaacggatatggttgggcaatagctaaatcccttgctgctgcaggggctgagattctcttaggcacatgggtgcctgctttgaacatttttgaatccagcctgcgacgtggaaaatttgacgaatcacgtgtgttgccagatggctctttaatggagattactaaagtatatcctttggatgcagtctttgacaaccttgaggatgtacctgaagatataaaagcaaataaacgctatgcaggatccagtaattggactgttcaggaagttgctgaatctgtgaagaatgattttggcagcatcgacattcttgttcactcacttgcaaatgggccagaggtcactaaacctctgttggagacatccaggaatggatatcttgcagctatatctgcatcaagttactcctatgtttctttactcaaacatttcattccaataatgaatccaggtggttcttcaatttctcttacatatattgcttctgaaaggataattcctgggtatggtggaggtatgagttcagcaaaggctgctctggagagtgacacacgagtgcttgcttttgaagcgggtagaaaacacaaagtcagagtcaacacaatatctgctggtccactaaggagccgtgctgcaaaagcaattgggcttttgacatgatgattgactattcaatagtcaatgcacctttgcaaaaagaactatccgcagatgaagtggggaacacagctgcctttctagcatcacctttggcttctgccatcaccggtgctgttatatatgttgacaatggcctgaacgcaatgggtgtcggagttgacagtccaatattcaaggatcttgacattccaacagataagcactaggacaaccacaaattggtttatagtaagccagactccgaacttcaagtttagctttaatgctgctagttttctgctcctttttttcccaatcggcttcaacctaggatggtttggctagtggccccattttgttgtgagaatttttctttgcctttcttagggacattttcttgggggcaggtgttgcaaaggccccatgtggaagtcctggacctttgaaacactaataagattcatgtttcttagactcttcaattt

SEQ ID NO: 5315 - DNA, 2847 bp, Echinacea purpurea
aaaaaatacacgcgtcacctttttccacctataaatacccctctcgagttttcacaaccagcttccctaaatcactgtgatttgattttctgttcatcttccgttactctcgattcgtgtgattcaatcagaaacgatgaccgttggagcaggtatatcggtgactgatcggaagctcaatgtgttcgggaatcgtgtgttgacggacgtacatgacaatgttttcgtcacttcatcaacgggggacgggatgatcaatggcgccttcattggcattcgatcggaccaaaccggtagtcgtatggtgtttccagtcggaaaactcgagggattgaggtttatgtgtgtgttccgtttcaaactatggtggatgacacagagaatggggaattgcggtcaggatatacccactgaaactcagtttcttattgttgaaacaagtgaaggttcaaatttcggagaagataatgaaattgatgatggctcgcaccaatctgctctatatacagtcttcttgcctattcttgagggtgattttagagcggtaatacaaggaaattctaataatgaattggagatttgcttggaaagtggagatcctgctgtaaaagattttgaaggtagtcatctggtttttgtggctgctggacccgacccgtttgatgttatcaccaatgcggtcaagagtgtagagagacatttacagacattctctcatcgcgaaagaaagaagatgccagacatgttaaattggtttggctggtgcacatgggatgctttttacactgatgttacttctgaaggtgtcaaacaaggtcttgaaagtttccagaaaggaggtatttcaccaaaatttgttatcattgatgatggatggcaatcagttgatatggatcccactagtgttgaagctaaagcagataatacggcaaattatgcaaataggctaactcatattaaagaaaatcacaaattccagaaagatggtaaagaaggtcatagagttgaggacccatccatggggcttcgttatgttgttacagacatcaaagatcatcacaacgtcaaatatgtttatgtttggcacgcgttaactggatactggggcggagtgagacccggaaccgaggactatgattccaagttatcattcccgatttcatctccaggaattttatccattgaaaattgtgatgcatttatagccattgccaagaatgggctcggtcttgttgaccctgaaaaagtcttcaacttttacaatgatttgcattcttaccttgcgtttgccggtgttgatggtgtgaaggtagatgtacaaaacattctagaaacacttggagcaggccatggtggtcgggtcaaacttacaaggaagtatcatcaggctttggaagcttcggttgctagaaacttccctgataacggaatcatctcgtgcatgtgtcacaacacagatggtttgtacagtgctaagaggacagctgttatgagggcttccgatgatttttggccaagggttacagcttcacacacagtccatgttgcttctgttgcttataatacaatctttcttggagaattcatgcagccggattgggatatgtttcatagcttgcatcccatggctgaataccacggtgctgctcgtgctgtgggcggctgtgctatttatgttagtgacaagccagggcatcatgattttaatttattaaaaaagcttgtgcttcccgatggatcaatactgagggccaaacttccagggagaccaacaagagattgcttgtttactgatcccaccagagatggaaaaagtctcttaaagatctggaatctaaacaatttcactggagtggttggagtattcaactgccaaggagcagggtggtgcaaagatggaaaaaagattctcacccacgatgaacaaccaagcaccatcaccggtgtcatcagagctaaagatgtaaattacttgcctaaagttgctgattctaaatgggatggtgatgcagttgtgtacagtcatctaggtggtagattggtttaccttccaaagaatgcatctatcccagtaacattgaaaccgagagaatacgaggtttttacagtggttcccatttcaaaactatcatgtggtgtcacttttgctcctataggtttgatggaaatgttcaactctggaggggcgatttcggaattacgctatgagacggagaaagaaggaaatgtagagttgaaagttagagggagtggtgtgtttggcgcctattcatctagaaaaccaagtagagtgattattgattcgaaagagactgaatttgggtatgaagaaagaagtgggcttattagtattaaactgagtgttcctgaaaaggaaatgtatttgtgggatatcatcattcaagtgtgaagtagttctagtgtcattttgcaactcagaatgacttcaagaacttgcagggctataagtatcaagagggaaatatttatgagggtttatctaccctgttatttgatattcatctgaaccaagtcgactgtcatcgagacgagactttattcaacatggtgtgtagcaaagttttatcaagttgtataatgagataaataataaatgtcatcataatcaatagatgttgtcgtctcaataagagctattcctcttgtacttcaacaagaacaatgtatcctagctttgacattatattaatgtatttaataactatatatctaagaaagatccattctctggtccagtgtacaaccttcttttgcacaagagcttatcaattgaacaaaaacggttagactggtcctaccgctggatcaaaaagtatgttatcaacg

SEQ ID NO: 5316 - DNA, 2460 bp, Flaveria ramosissima
atgggggtaacaatcatattccctaaatcattgtcatctgtttgatttcttcacaaaatcatcagagatttttgttgctgttgattcgtgtgattcaatcggagaagatgacggtgggagcaggtatatcggtggctgatcggaagctcaatgtgttcggaaacgctgtgttaacggacgtaagtgacaatgtttgcgtcacttcgtcggccgacgatgggatgatcaatggcgcattcattggagttcgatcggaggaaagcggtagtcgattggtgtttcctgttggaaaactcgagggtttgaggtttatgtgtgtgttccgtttcaaattatggtggatgacgcagagaatggggaattgcggtcaggatatacctactgaaacacagtttcttatagttgaaacgagtcaaggttcgcattttggagaagataatgagattgatgatggatctcaccaatctgctctgtatacagtcttcttgcccattcttgagggtgattttagagcggttatacaaggaaattccaataatgaattggagatttgtttggaaagtggagatcctgctgtaaaagattttgaaggtagtcatctggtttttgtggctgctggacccgacccgtttgatgctatcaccaacgcggtcaagagtgtagagagacatttacagacattctctcatcgcgaaagaaagaaaatgccagatatgttaaactggtttggctggtgcacatgggatgcattttacactgatgttacttctgaaggtgtcaaacaaggcctggaaagttttcagaaaggaggtatttcaccaaaatttgttatcattgatgatggatggcagtcagttggtatggatcccactagcattgaagctaaagctgataatacggctaattatgcaaataggttaactcatatcaaagaaaaccacaaattccagaaagatggtaaagaaggtcacagagttgaggacccgtccatgggacttagtcatgttgttacagacataaaggatcatcataacgtcaagtatgtttatgtttggcatgcattaactggatactggggcggagtgagacctggaacgggtgattatgattccaagttatcattcccggtttcatctcctggaatcaattccaatgaaaactgtgatgctttaattgccattaccaagaatgggctcggtcttgttgaccctgaaaaagtcttcaagttttacgatgagttgcattcttaccttgcgtctgctggtgttgatggtgtgaaggtagatgtacaaaacattctagaaacacttggagcaggccatggtggacgggttaaactcgcaaggaagtaccatcaggctttggaagcttctgtctcaagaaacttccctgataatggaatcatttcttgcatgagtcacaacacagatggtttgtacagtgccaagaagacagctgttataagggcatccgatgatttttggccaagggttacagcttcacacacagtccatattgcttctgttgcttataatacaatctttcttggagaattcatgcagcctgattgggatatgtttcatagcttgcatcccatggctgaataccatggtgctgctcgtgctgtgggcggctgtgctatttatgtcagtgacaagcctgggcatcatgattttaatttattaaaaaagcttgtgcttcctgatggatcaatattaagggccaaacttccagggagaccaacaagagattgcttgtttactgatcccactagagatggaaaaagtcttttgaagatctggaatttaaacaatttctcgggagtggtgggagtttttaactgtcagggagcagggtggtgtaaagatggaaaaaagatcctcacccatgatgagcaacctagcaccataactggcgtcatcagggctaaagatgtgaattacttgcctaaagttgctgattctacatgggatggagatgtagttgcatacagtcacgtaggaggtggagtggtttaccttccgaaggatgcgtctatcccagtaacactaaaaccgagagaatacgaggttttcacagtagttcctgtttcaaaactgtcatgtggtgtcagttttgctcccataggtttaaccgaaatgttcaactccggaggggcgatttcggaactacgatttgagacgcagaaacaaggaaaggtggagttgaaagttagaggttgtggtgtgtttggagcatattcaacaagaaaaccgattagagtaactgttgactcgaaagaaactgaatttgggtatgaagaaagaagtggatttattagtatcaaactgagtgttcctgaaaaggaaatgtatttatgggatatcatcattcaagtgtgaggaagtagtgcaagtgtcatttttgcaacatagcatgtaacaaagtgttatcttgttgtataataagatacataacaag

SEQ ID NO: 5317 - DNA, 2452 bp, Chrysanthemum coronarium
ccgggatcaatcatattcctcaaataaatcatttgttacaaaaacatttaaaagatgactgtgggagcaggggtatctgtgactgaccgaaaactaaatgtgtttggaactcctgttttgacaaatgtgcatgacaatgttgttgtcacgacatcaagtgatgatggcatgattaatggcgcgtttcttggctttcgctctgatcagaccgctagcgatcgtatggtctttcctgttggaaaacttgagggattgaggtttatgtgtgtgttccggttcaaattatggtggatgacacaaagaatggggacatgtggtcaagatataccaaccgagactcagttccttatagttgaaaccattgatggttcacattttggtgaagacgttgaagtcaacgatggatgtcaccaatctgctctatacactgtcttcttgcccattctcgagggcgattttagagcggttttacaaggaaattcaaataatgaactggaaattgttttggaaagtggagatcctgctgtgaaagatttcgaagggagtcatttggttttcgtggctgctggatcagaccctttcgacgctatcaccaacgctgtcaagagcgtggagagacatcttcagacgtttgcacaccgtgaaagaaagaagatgcccgacatgttaaattggttcggttggtgcacatgggatgctttttatactgaggtgacttctgaaggtgtcaaacaaggccttgagagtttcgagaaaggaggagtttcaccaaaatttgttataatagatgatggatggcaatcagttggtatggatcccactagttttgaagctaaagctgataatacagcaaattttacaaataggctaactcacataaaagagaaccataaattccaaaaagacggaaaagaaggtcagagagtggatgatccagccatgggacttcgtggcgttgttacagacattaaagaccattataatctcaagtatgtttatgtttggcacgcgataactggttactggggtggcgtgagacctggagtagctgaaatggaccactataattccaagctgtcattcccggtttcatctccaggagctgaatctaatgaaaactgtgatgctttgaaagccattaccaaaaatgggcttggtcttgtggatcctgagaaagtattcaacttttataacgaattgcattcttaccttgcgtctgctggtgtcgatggtgttaaggttgatgtacaaaacattcttgaaacacttggagcgggtcatggtggtcgggtcaaacttactaggaagtaccatcaggcattggaagcttctatttctaggaattttcatgataatgggatcatttcttgcatgagtcacaatactgatggtctgtacagtgcaaagaggacagcggttataagggcatcggacgatttctggccacatgtcacaccttcacataccgtccatattgcttctgttgcttataataccatctttctgggagagttcatgcagcctgattgggatatgtttcatagcttgcatcccatggctgaataccatgctgccgctcgtgctgtgggtggctgtgctatttacgtcagtgacaagcctggaaatcatgactttaatctgttaaggaagcttgtgcttcctgatggatcaatattaagggccaaactacccggaggccaacaagagactgcctgtttactgatccctcaagagacggaaaaagtcttttgaagatatggaatctaaacagttttaccggagtggtaggagtattcaattgtcaaggagccgggtggtgtaaagatgggaagacgatcctcacccacgatgagcaaccacccaccatcaccggtttcatccgagctaaagatgtacattacttgcctaaagttgcagattctacttggagtggagatgccattgtatacagtcacatttgcggaggattagtttaccttccaaagaatgcatctatcccagtaactttgaaatcaagagaatatgaggttttcacggttgttcctgcaaaaaagttgtcgggtgaggttacttttgctccaataggtttgaccaaaatgtttaactctggaggggcgattgttgaactgaactatgagatggagaaacaaggaaatgtggagttaaaagttcgaggttgtggcacgtttggagcatattcaagtaaaagaccgataagagtgattattgattcaaaagaaaccgtatttgggtatgaagagggaactggacttattagcatcgaattgagtgttcccgagaaagaaatgtacttatgggacattatcattgaagtgtgaagaactactgaactagtgttagtgtcatcgcaacttcaaaagcttcaaatgtgtcaaagaggcctagatcaagagtttacaagtctcgaatgtttaatgattaagaagtgtgg

SEQ ID NO: 5318 - DNA, 2434 bp, Chrysanthemum coronarium
ttcatattccttatatcattgttatctattctattctattttttacagcatttgtatcttgttgtgtttcaaaagatgactattggagcagggatatctgtgactgatgataggaatcttaatgtgtttggaactcctgtcttaacaaacgtgcatgaaaatattgttgtcacttcatctagtgacgacggaatgattaatggcgcgtttattggtgttcggtctgatcagacgggtagtcgtatggtgtttcctgtaggaaaacttgagggattgaggtttatgtgtgtgtttaagttcaaattatggtggatgacacaaagaatggggacatgtggtcaagatataccaaccgagactcagttccttatagttgaaaccattgatggttcacattttggtgaagacgttgaagtcaacgatggatgtcaccaatctgctctatacactgtcttcttgcccattctcgagggcaattttagagcggttttacaaggaaattcaaataatgaactggaaattgttttggaaagtggagatcctgctgtgaaagattttgaagggagtcatttggttttcgtggctgctggatcagacccttttgatgctatcaccaacgctgtcaagagcgtggagagacatcttcagacatttgcacatcgtgaaggaaagaagatgcccgacatgttaaactggttcggttggtgcacatgggatgctttttatactgaggtgacttctgaaggtgtcaaacaaggccttgagagttttgagaaaggagaagtttcaccaaaatttgttataatcgatgatggatggcaatcagttggtatggatcccaccagttttgaagctaaagctgataatacagcaaattttacaaataggctaactcatataaaagagaaccataaattccaaaaagacggtaaagaaggtcacagagtggaggatccagccatgggacttcgtcacgttgttacagacattaaagaccatcataacctcaagtatgtttatgtttggcatgcaataactggctattggggtggcgtgagacctggagtagctgaaatggaccactataattccaagttgtcattcccggtttcatctcccggagctgaatctaatgaaaactgtgatgctttgaaagctattatcaaaaatgggcttggtcttgtggatcctgagaaagtattaaacttttataacgaattgcattcttaccttgcttctgctggtatcgatggtgttaaggttgatgtacaaaacattcttgaaacactcggagcgggtcatggtggtcgggtcaaacttacgaggaagtaccatcaggcattggaagcttctatttctaggaattttcatgataatgggatcatttcttgcatgagtcacaatacagatggtctgtacagtacaaagaggacagcggttataagggcatcggacgatttctggccacatgtcacaccttcacataccgtccatattgcttctgttgcttataataccatctttctgggagagttcatgcagcccgattgggatatgtttcatagcttgcatcccatggctgaataccatgctgccgctcgtgctgtgggtggctgtgctatttacgtcagtgacaagcctggacatcatgactttaatctgttaaagaagcttgtgcttcctgatggatcaatattaagggctaaacttcccgggaggccaacaagagattgcctgtttactgatccctcaagagacggaaaaagtcttttgaagatatggaatctaaacagttttaccggagtggtaggagtattcaattgtcaaggagccgggtggtgtaaagatggaaagacgatcctcacccacgatgagcaaccacccaccatcaccggcttcatccgagctaaagatgtaaattacttgcctaaagttgcagattctacttggggtggagatgccatcgtatacagtcacattggcggagaattagtttaccttccaaagaatgcatctatcccggtaactttgaaatcaagagaatatgaggttttcacggttgttcctgcaaaaaaattgtcgggtggggttacttttgctccaataggtttgaccaaaatgtttaactctggaggggcgattgttgaattgaactatgagatggagaaacaagggaatgtggagttaaaagttcgaggttgtggcacgtttggatcttattcaagtaaaagaccgataagagtgattattgattcaaaagaaaccgtatttgggtatgaagagggaactggattgattagcatcgaattgagtgttcccgagatagagatgtatgtatgggatattatcattgaagtgtgaagaactacttttactgtcattgcaacttcaaaatcttcaagagcaacgccgtctaaatgtgtcaacgagatca

SEQ ID NO: 5319 - DNA, 2340 bp, Cirsium arvense
ctgggaaagatgacggttggagcaggcatatcgatcactgatcggaacctcaatgtgttcggaaagcctctattgaccgacttacatgacaatgtttttgtcacttcatcaaccggcgacgggatcatcaatggcgccttcatcggcgttcgatcggatcagattggtagccgtagggtctttcccgtcggaaaactcgagggattgaggtttatgtgtgtgtttcgattcaaattatggtggatgacacagagaatggggacatctggtcaggaaattcccactgagactcaatttcttatagttgaaaccaatgatggttcacattttggggaagataatgaaattgatgatggatctcaccaatctgctctatacactgtcttcttgcccattcttgagggtgattttagagctgttatacaaggaaatgccaataatgagttggagatttgtttggagagtggagatcctgctgtgaaagattttgaagggagtcatttggtttttatggctgctggatcagacccctttgatgttatcaccaatgcagtcaagactgtggagagacatttgcagacattctctcatctcgatagaaagaagatgccagatatgttaaattggtttggctggtgtacatgggatgctttctacactgaggttacttctgaaggtgtcaaactaggccttgagagtttcgaaaaaggaggaatttccccaatttcttatcattgatgatggatggcaaacggttggtatggatcccactagtgttgaagctaaaactgataattcagctaattttgcaaataggttaactcatatcaaagagaatcataaattccagaacggtggtaaagaaggtcacagagtggaggatccatccatgggacttggtcatattgttacagacattaaagacaatcataacatgaggtatgtttatgtttggcatgcaataactggatactggggtggagtgagacctggagtggctgaaatggagcattatgattccaagttgtctttcccagtttcatctccaggaatcaaatccaatgaaaactgtgatgctttgaaagccattactgaaaacgggctcggccttgtggaccctgagaaagttttcaattgctataatgaattgcattcttatctcacatcttctggtattgatggtgtaaaggtagatgttcaaaacattcttgaaacacttggcgccggccatggtggtcgggtgaaacttgccagaaagtaccatcaggcattggaagcttccgtttctagaaacttccctgataatggcatcatttcttgcatgagtcacaacacagatggtttgtacagtgcaaagaagacagcagttataagggcatcagatgatttctggccaagggttacagcttcacacacagtccatattgcttctgttgcttataatacaatctttctcggggagttcatgcagcccgattgggatatgtttcatagcttacatccaatggcggaataccatggtgctgctcgtgctgtgggcggctgtgctatttacgttagtgataagcctggacatcatgacttcaatttgttaaagaaacttgtacttcctgatggatcgatattaagagccaaacttccagggagaccatcaagagattgtttgtttactgatcccactagagatggaacaagtcttttgaagatctggaatctaaacgatttcagtggggtggtgggagttttcaactgccagggagcagggtggtgtaaagatggaaagaagattctcacccacgatgaacgaccagccaccgtcactggcttcatccgagctaaagatgtcaattacttgcctagagttgcagattctacttggggtggagatgccattgtatacggtcatcttggcggagaattggtttaccttccaaagaatgcatctattccaataacattgaaatcaagagaatatgaggtgtttacggttgttcctatcaagaaattatcgggtggggttagttttgctcctataggtttaaccgaaatgtttaactctgggggcgcaatcatggaagtaaactacgagatggagaaagaaggaagcgtgaggatgaaggttcgagggtgtggtgtttttggtgcatattcgacgaaaagaccgaaacgagtgacaatcgactcgaaagaaatcgaatttggatatgaagagaaaagtgggttgattagtgtaaaattgagtgttccagagaaagagttgtatttatgggacatcaacattgaagtgtgattgattgttgttgtaggtgttggaccttattcgaattaaagattcttata

SEQ ID NO: 5320 - DNA, 2077 bp, Flaveria ramosissima
cgttcgatcggaggattccggtagtcgattggtgtttccggttggaaaactcgagggtttgaggtttatgtgtgtgttccgtttcaaattatggtggatgacgcagagaatggggaattgcggtcaggatatacctactgaaacacagtttcttatagttgaaacgagcgaaggtcgcattttggagaagataacgagattgatgatggatcacaccaatctgctctgtatacagtcttcttgcccattcttgagggtgattttagagcggttatacaaggaaattccaataatgaattggagatttgtttggaaagtggagatcctgctgtaaaagattttgaaggtagtcatctagtttttgtggctgctggacccgacccgtttgatgctatcaccaacgcggtcaagagtgtagagagacatttacagacattctctcatcgcgaaagaaagaagatgccagatatgttaaattggtttggctggtgcacatgggatgctttttacactgatgttacttctgaaggtgtcaaacaaggcctggaaagttttcagaaaggaggtatttcaccaaaatttgttatcattgatgatggatggcagtcagttggtatggatcccactagcgttgaagctaaggctgataatacggctaattatgcaaataggctaactcatatcaaagaaaaccacaaattccagaaagatggtaaagaaggtcacagagttgaggacccgtccatgggacttagtcatgttgttacagacataaaggatcatcataacgtcaagtatgtttatgtttggcatgcattaactggatactggggcggagtgagacctggaacgggtgattatgattccaagttatcattcccggtttcatctcctggaatcaattccaatgaaaactgtgatgctttaattgccattaccaagaatgggctcggtcttgttgaccctgaaaaagtcttcaagttttacgatgaattgcattcttaccttgcgtctgctggtgttgatggtgtgaaggtagatgtacaaaacattctagaaacacttggagcaggccacggtggacgggttaaacttgcaaggaagtaccatcaggctttggaagcttctgtctcaagaaatttccctgataatggaatcatttcttgcatgagtcacaacacagatggtttgtacagtgccaagaagacagctgttataagggcatccgatgatttttggccaagggttacagcttcacacacagtccatattgcttctgttgcttataatacaatctttcttggagaattcatgcagcctgattgggatatgtttcatagcttgcatcccatggctgaataccatggtgctgctcgtgctgtgggcggctgtgctatttatgtcagtgacaagcctgggcatcatgattttaatttattaaaaaagcttgtgcttcctgatggatcaatattaagggccaaacttccagggagaccaacaagagattgcttgtttactgatcccactagagatggacaaagtcttttgaagatctggaatttaaacaatttctcgggagtggtgggagtttttaactgtcagggagcagggtggtgtaaagatggaaaaaagatcctcacccatgatgagcaacctagcaccataactggcgtcatcagggctaaagatgtgaattacttgcctaaagttgctgattctacatgggatggagatgtagttgcatacagtcacgtaggaggtggagtggtttaccttccgaaggatgcatctatcccagtaacactaaaaccgagagaatacgaggttttcacagtagttcctgtttcaaaactgtcatgtggtgtcagttttgctcccataggtttaaccgaaatgttcaactccggaggggcgatttcggaactacgatatgagacggagaaacaaggaaatgtggagttgaaagttagaggttgtggtgtgtttggagcatattcaacaagaaaaccgattagagtaactgttgattctaaagaaaccgaatttgggtatgaagaaagaagtggatttattagta

SEQ ID NO: 5321 - DNA, 2608 bp, Chrysanthemum coronarium
atcttgtgtttcaaaagatgactattggagcagggatatctgtgactgatgataggaatcttaatgtgtttggaactcctgtcttaacaaatgtgcatgacaatattgttgtcacttcatctagtgatgatgggatgattaatggcgcgtttattggtgttcggtctgatcagactggtagtcgtatggtgtttcctgttggaaaacttgagggattgaggtttatgtgtgtgtttaagttcaaattatggtggatgacacaaagaatggggacatgtggtcaagatatacctaccgagactcagtttcttatagtcgaagcaagggaaggttcacatcttggtgaagataatgaagttgaggatggatgtcaccaatctgcactatacaccatcttcttgcctattcttgagggcgattttagagcggttctacaaggaaattcaaataatgaattggagattgttttggaaagtggagatcctgatgtgaaaattttcaaagggagtcatttggtttttgtggctgctggatcagacccttttgatactattaccaacgctgtcaagagcctggagagacatcttcagacatttgctcatcgcgaaagtaagaagatgcccgacatgttaaattggttcggctggtgcacgtgggatgctttttacaccgaggttagctctgaaggtgtcaaacaaggccttgagagttttaagaaaggaggagtttcaccaaaatttgttataatcgatgatggatggcaatcagttggtatggatcccaacagttttgaagctaaagctgataatacagcaaattatacaagcaggctaactcatataaaagagaaccataaattccaaaaagacggtaaagaaggtcacagagtggaggatccagccatgggacttcgtcatgttgttagagacattaaagaccattataacctcaagtatgtttatgtttggcacgcactaactggttactggggcggcgtgagacctggtgtagctgaaatggaccactataattcgaagctgtcattcccggtttcatctccaggagctgaatatgaaaactgtgatgctgtgaaagctattaccaaaaatgggcttggtcttgtgaaccctgagaaagtattcaacttttataacgaattgcattcttaccttgcgtctgctggcatcgatggtgttaaggttgatgcacaaaacattcttgaaacacttggagcaggtcatggtggtcgagtcaaacttacgaggaagtaccatcaggcattggaagcttctatttctaggaattttcatgataatgggatcatttcttgcatgagtcacaacacagatggtctttacagtataaagaggacagcggttataagggcatcggacgatttctggccacatgtcacaccttcacacactgtccatattgcttctgttgcttataatactatctttcttggagagttcatgcagcccgactgggatatgtttcatagcttgcatcccatggctgaataccatggtgccgctcgtgctgtgggtggctgtgctatttatgtcagtgacaagcctggacatcatgactttaatttgttaaagaagcttgtgcttcctgatggatcaacattaagggccaaacttcccgggaggccaacaagagattgcttgtttactgatcctactagcgacggaaaaagtcttttgaagatatggaatctaaacaatttcaccggagtggtaggagtattcaactgtcaaggagccgggtggtgtaaagatggaaagacgatactcacccacgatgagcaaccaccgaccatcactggcttcatccaagctaaagatgtaaattacctgcctaaagttgcagactctacttggagtggagatgccgttgtatacagtcacattggcggagaattagtttaccttcaaaaagatgcatctatcccggttacattgaaatcaagagaatatgaagtttttacggttgttcctgtcaagaaactgtcgagtggggttagttttgctcccataggtttgaccgaaatgtttaattctggaggggctattgttgagctgaactatgacgtggagaaacaaggaactgtggagttgaaagctcgagggtgtggcacatttggagcatattcaagtaaaagacctgtaagagtgaccatagattcaaaagaaactggatttaggtatgaagagggaactggattgattagcatcgaattgagtgttcccgagaaggaaatgtacttgtgggacgttatcattgaagtgtgaagaactagtttaagtgtcatcgcaactctaaaagcttctaaatgtgtcagagtcctagatcaagagtttacaagtctcgaatgtttaatggatgtattctactatgcacatctgtactattgtatctgatatctagcagattatattgtggaatataagtcaaatatcatgccgagtcaaatgtcataaaataacaatgtaaacgacaatttcttgatgattatcgtggaacagtgagataagtatcattattgattgattattcagatgaggctaacatgatattatatgactgtaagcgaaagcac

SEQ ID NO: 5322 - DNA, 2470 bp, Chrysanthemum coronarium
ttgttgtgtttctaaagatgactattggagcagggatatctgtgactgatgataggaatcttaatgtgtttggaactcctgtcttaacaaacgtgcatgaaaatattgttgtcacttcatctagtgacgacggaatgattaatggcgcgtttattggtgttcggtctgatcagactggtagtcgtatggtgtttcctgttggaaaacttgagggattgaggtttatgtgtgtgtttaagttcaaattatggtggatgacacaaagaatggggacatgtggtcaagatatacctactcagactcaatttcttatagtcgaaacaagggaaggttcacatcttggtgaagataatgaagttgaggatggatgtcaccaatctgcactatacaccgtcttcttgcctattcttgagggcgattttagagcggttctacaaggaaattcaaataatgaattggagattgttttggaaagtggagatcctgatgtgaaagatttagaagggagtcatttggtttttgtggctgctggatcagacccttttgatactattaccaacgctgtcaagagcctggagagacatcttcagacatttgctcatcgcgaaagtaagaagatgcccgacctgttaaattggttcggctggtgcacgtgggatgctttttacaccgaggttacttctgaaggtgtcaaacaaggccttgagagttttaagaaaggaggagtttcaccaaaatttgttataatcgatgatggatggcaatcagttggtatggatcccaacagttttgaagctaaagctgataatacagcaaattatacaagcaggctaactcatataaaagagaaccataaattccaaaaagacggtaaagaaggtcacagagtggaggatccagccatgggacttcgacatgttgttacagacattaaagaccattataacctcaagtatgtttatgtttggcacgcactaactggttactggggtggcgtgagacctggtgtagctgaaatggaccactataattcaaaactgtcattcccggtttcatctcaaggagctgaatataatgaaaactgtgatgctgtaaaggccattaccaaaaatgggcttggtcttgtggaccctgagaaagtattcaacttttataacgaattgcattcttaccttgcgtctgctggcatcgatggtgttaaggttgatgcacaaaacattcttgaaacacttggagcaggtcatggtggtcgagtcaaacttacgaggaagtaccatcaggcattggaagcttctatttctaggaattttcatgataatgggatcatttcttgcatgagtcacaacacagatggtctttacagtataaagaggacagcggttataagggcatcggacgatttctggccacatgtcacaccttcacacactgtccatattgcttctgttgcttataatactgtctttcttggagagttcatgcagcccgattgggatatgtttcatagcttgcatcctatggctgaataccatggtgccgctcgtgctgtgggtggctgtgctatttatgtcagtgacaagcctggaaatcatgactttaatttgttaaagaagcttgtgcttcctgatggatcaacattaagggccaaacttcccgggaggccaacaagagattgcttgtttactgatcctactagcgacggaaaaagtcttttgaagatatggaatctaaacaatttcaccggagtggtaggagtattcaactgtcaaggagccgggtggtgtaaagatggaaagacgatactcacccacgatgagcaaccaccgaccatcactggcttcatccaagctaaagatgtaaattacctgcctaaagttgcagactctacttggagtggagatgccgtagtatacagtcacattggcggagaattagtttaccttcaaaaagatgcatctatcccggttacattgaaatcaagagaatatgaagtttttacggttgttcctgtcaagaaactgtcgagtggggttagttttgctcccataggtttgaccgaaatgtttaattctggaggggctattgttgagctgaactatgacgtggagaaacaaggaactgtggagttgaaagctcgagggtgtggcacatttggagcatatgcaagtaaaagacctgtaagagtgaccatagattcaaaagaaactggatttaggtatgaagagggaactggattgattagcattgaattgagtgttcccgagaaagaaatgtacttatgggacattacgattgaagtgtgaagaactagttttagtgtcatcgcaacttcaaaagcttctaaatgtgtcaaagaggcctagatcaagagtttacaagtctcgaatgtttaatggatgtattctactatgcacatctgtactattgtatctgatatctagcagattatattgtggaatttaagtcaaat

SEQ ID NO: 5323 - DNA, 2626 bp, Ambrosia trifida
ctactgaaactcagtttcttatagttgaaacgagagtaggttcacattttggagaagataatgaaattgaagatggatcgcaccaatctgctctatatacagtcttcttgcctattcttgagggtgattttagagcagttatacaaggaagttccaataatgaattggagatttgtttggaaagtggagatcctgctgttaaagagtttgaaggtagtcatctggtttttgtggctgctggacccgacccgtttgacgttatcaccaacgctgtcaagagtgtggagagacatttacaaacattctctcatcgcgaaagaaagaagatgccagacatgttaaattggtttgggtggtgcacatgggatgctttttacactgatgttacttctgaaggtgtcaaacaaggccttgaaagtttccaaaaaggaggtatttcaccaaaattcgttatcattgatgatggatggcaatcagttgatatggatcccactagtgttgaagctaaagcggataatacggctaactttgcaaataggctaactcatattaaagaaaatcacaaattccagaaagatgggaaagaaggtcacagagttgaggacccatccatgggacttcgtcatgttgttacagacattaaagatcatcacgacgtcaagtatgtttatgtttggcatgcgttaactggatactggggcggagtgagacctggaacagggcaatatgattccaagttatcattcccgatttcatctccaggacttgaatgcaacgaaaactgtgatgcttttatagccatttccaagaatgggcttggtcttgttgaccctgaaaaagtgttcaacttttacaatgaattgcattcttaccttgcatctgctggtgttgatggtgtgaaggtggatgtacaaaacattctagaaacacttggagcgggccacggtggtcgggttaaacttacaaggaagtaccatcaggctttggaggcttcagttgctagaaacttccctgataatggaatcatttcgtgcatgagtcacaacactgatggtttgtacagtgccaagaggacagctgttatgagggcatctgatgatttttggccaagggttactgcttcacacacagttcatattgcttctgttgcttataatacagtttttcttggagaattcatgcagcctgattgggatatgtttcatagcttgcatcccatggctgaataccatggtgctgctcgtgctgtgggtggctgtgctatttatgtcagtgacaagcctggacatcatgattttaatttattaaaaaagcttgtgcttcctgatggctcaatattaagggcgaaacttccaggtagaccaacaagagattgcttgtttactgatcccacccgagacggaaaaagtcttttgaagatctggaatctaaataatttcacgggagtggtgggagttttcaactgccagggagcagggtggtgcaaagatggaaaaagattctcactcacgatgaaaaaccaagcaccatcactggcgtcatcagggctagagatgtaaattacttgcctaaagttgctgattctacgtgggatggcgatgcagttgtatacagtcacctaggcggtgcactgagttacctaccgaagaattcatctatcccagtaacactgaaaccaagagaatacgaggttttcacagtagttcctatttcaaaactgtcatgtggtgtcggctttgctcccataggtctgacagaaatgttcaactctggaggggcaatttcggaattacactatgagaaggagaaagaaggaactgtggagttgaaagtcagaggttgtggtgtgtttggcgcatattcaactagaaaaccgagtcgagtaataattgattcgaaagaaaccgaatttgagtatgaagaaaaaagtggtcttattagtattatactcgatgttcctgaaacggaaatgtatttatgggatatcatcattcaagtgtgaagaagcggtttaagtgtcatttcgtaactcagaacggcttcacgaggttgcagggctatcagtacctaaagtggaatattcatgagggtttttgtaccctgttatttgatatttatctgatctgagtcagctgtcattaaggcaagacctattccttcaaatattcaacatggtatgtagcagtgttatcatgtatttatgttgtatagtgagatgcataacaaaagtcattatgattaagatgttgtggtctgtataagaattagtattcatcttgtactataacaagaacaatatattttagcttgatattattatataaatcataaatgtatttgggtcctgttctgatagaatgattgctcgcttttgttttcagtttgcactcagcaatccgctcctcaaacctcagttttctcaggctacgccctgtactacgtgttctagctgagccaatcggtagctaaaccagctaaggctacgccctgtgctatgtgttctagctgagccaatcggtagctaaaccaggtcgaactgtgcatatcagagggttcggtttgtgtttttactaaaccgtattaggggctcgtagagaactcatcgatgatgagacgtaaggggtgc

SEQ ID NO: 5324 - DNA, 2347 bp, Chrysanthemum coronarium
atgggatgattaatggcgcgtttattggtgttcggtctgatgagaccggtagtcgcatggtgtttcctgttggaaaacttgagggattgaggtttatgtgtgtgtttaagttcaaattatggtggatgacacaaagaatggggacatgtggtcaagatatacctactcagactcaatttcttatagtcgaaacaagggagggttcacatcttggtgaagataatgaagttgaggatggatgtcaccaatctgcactatacaccatcttcttgcctattcttgagggcgattttagagcggttctacaaggaaattcaaataatgaattggagattgttttggaaagtggagatcctgatgtgaaagatttcgaagggagtcatttggtttttgtggctgctggatcagacccttttgatgctatcaccaacgctgtcaagagcgtggagagacatcttcagacatttgctcatcgcgaaagtaagaagatgcccgacatgttaaattggttcggctggtgcacgtgggatgctttttacaccgaggttagtactgaaggtgtcaaacaaggcctggagagttttaagaaaggaggagtttcaccaaaatttgttataatcgatgatggatggcaatcagttggtatggatcccaacagttttgaagctaaagctgataatacagcaaattatacaagcaggctaactcatataaaagagaaccataaattccaaaaagacggtaaagaaggtcacagagtggaggatccagccatgggacttcgtcatgttgttagagacattaaagaccattataacctcaagtatgtttatgtttggcacgcactaactggttactggggtggcgtgagacctggtgtagctgaaatggaccactataattcaaaactgtcattcccggtttcatctccaggagctgaatataatgaaaactgtgatgctgtgaaggccattaccaaaaatgggcttggtcttgtggaccctgagaaagtattcaacttttataacgaattgcattcttaccttgcgtctgctggcatcgatggtgttaaggttgatgcacaaaacattcttgaaacacttggagcaggtcatggtggtcgagtcaaacttacgaggaagtaccatcaggcattggaagcttctatttctaggaattttcatgataatgggatcatttcttgcatgagtcacaacacagatggtctttacagtataaagaggacagcggttataagggcatcggacgatttctggccacatgtcacaccttcacacactgtccatattgcttctgttgcttataatactgtctttcttggagagttcatgcagcccgattgggatatgtttcatagcttgcatcccatggctgaataccatggtgccgctcgtgctgtgggtggctgtgctatttatgtcagtgacaagcctggacatcatgactttaatttgttaaagaagcttgtgcttcctgatggatcaacgttaagggccaaacttccgggaggccaacaagagattgtttgtttactgatcctactagcgacggaaaaagtcttttgaagatatggaatctaaacaatttcaccggagtggtaggagtattcaactgtcaaggagccgggtggtgtaaagatggaaagacgatactcacccacgatgagcaaccaccgaccatcactggcttcatccaagctaaagatgtaaattacctgcctaaagttgcagactctacttggagtggagatgccgttgtatacagtcacattggtggagaattagtttaccttcaaaaagatgcatctatcccggttacattgaaatcaagagaatatgaagtttttacggttgttcctgtcaagaaactgtcgagtggggttagttttgctcccataggtttgaccgaaatgtttaattctggaggggctattgttgagctgaactatgacgtggagaaacaaggaactgtggagttgaaagctcgagggtgtggcacatttggagcatatgcaagtaaaagacctgcaaaagtgaccatagattcaaaagaaaccggatttaggtatgaagagggaactggattgattagcatcgaattgagtgttcccgagaaagaaatgtacttatgggacattatcattgaagtgtgaagaactagtttaagtgtcatcgcaactctaaaagcttctaaatgtgtcagagtcctagatcaagagtttacaagtctcgaatgtttaatggatgtattctactatgcacatctgtactattgtatctgatatctagcagattatattgtggaatttaagtcaaatatcatgccg

SEQ ID NO: 5325 - DNA, 2367 bp, Chrysanthemum coronarium
ggtgttcggtctgatcagactggtagtcgcatggtgtttcctgttggaaaacttgagggattgaggtttatgtgtgtgtttaagttcaaattatggtggatgacacaaagaatggggacatgtggtcaagatatacctactcagactcagtttcttatagtcgaaacaagggaaggttcacatcttggtgaagataatgaagttgaggatggatgtcaccaatctgcactatacaccgtcttcttgcctattcttgagggcgattttagagcggttctacaaggaaattcaaataatgaattggagattgttttggaaagtggagatcctgatgtgaaagatttcgaagggagtcatttggtttttgtggctgctggatcagacccttttgatgctatcaccaacgctgtcaagagcgtggagagacatcttcagacatttgctcatcgcgaaagtaagaagatgcccgacatgttaaattggttcggctggtgcacgtgggatgctttttacaccgaggttagctctgaaggtgtcaaacaaggccttgagagttttaagaaaggaggagtttcaccaaaatttgttataatcgatgatggatggcaatcagttggtatggatcccaacagttttgaagctaaagctgataatacagcaaattatacaagcaggctaactcatataaaagagaaccataaattccaaaaagacggtaaagaaggtcacagagtggaggatccagccatgggacttcgtcatgttgttagagacattaaagaccattataacctcaagtatgtttatgtttggcacgcgctaactggttactggggtggcgtgagacctggtgtagctgaaatggaccactataattcgaagctatcattcccggtttcatctccaggagctgaatattatgagaactgtgatgctgtgaaagctattaccaaaaacgggcttggtcttgtggaccctgagaaagtattcaacttttataacgaattgcattcttaccttgcgtctgctggcatcgatggtgttaaggttgatgcacaaaacattcttgaaacacttggagcaggtcatggtggtcgagtcaaacttacgaggaagtaccatcaggcattggaagcttctatttctaggaattttcatgataatgggatcatttcttgcatgagtcacaacacagatggtctttacagtataaagaggacagcggttataagggcatcggacgatttctggccacatgtcacaccttcacacactgtccatattgcttctgttgcttataatactatctttcttggagagttcatgcagcccgactgggatatgtttcatagcttgcatcccatggctgaataccatggtgccgctcgtgctgtgggtggctgtgctatttatgtcagtgataagcctggacatcatgactttaatttgttaaagaagcttgtgcttcctgatggatcaacattaagggccaaacttcccgggaggccaacaagagattgcttgtttactgatcctactagcgacggaaaaagtcttttgaagatatggaatctaaacaatttcaccggagtggtaggagtattcaactgtcaaggagccgggtggtgtaaagatggaaagacgatactcacccacgatgagcaaccacccaccatcactggcttcatccgagctaaagatgtcaattacttgcctaaagttgcagattctacttggagtggagatgccgttgtatacggtcacattggcggagaattagtttaccttcaaaagaatgtatctatcccggtaacattgaaatcaagagaatatgaagttttcacggtagttcctgtcaagaaactgtcgagtggggttagttttgctcccataggtttgaccgaaatgtttaattctggaggggctattgttgagctgaactatgacgtggagaaacaaggaactgtggagttgaaagctcgagggtgtggcacatttggagcatattcaagtaaaagacctgtaagagtgaccatagattcaaaagaaactggatttaggtatgaagagggaactggattgattagcatcgaattgagtgttcccgagaaagaaatgtacttgtgggacattatcattgaagtgtgaagaactagtttaagtgtcatcgcaactctaaaagcttctaaatgtgtcaagagtctagaactctagatcaagagtttacaagtctcgaatggttaatggatgtattctactatgcacatttgtacaattgtatctgatatctagcagattatattgtggaatgtaagtcaaatatcatgccgagtcaaatttcaataacaaagtaaacgacagtttctt

SEQ ID NO: 5326 - DNA, 2161 bp, Chrysanthemum coronarium
ccgggatcaatcatattcctcaaataaatcatttgttacaaaaacatttaaaagatgactgtgggagcagggatatctgtgactgaccaaaaactaaatgtttttggaactcctgttttaacaaatgtccatgacaatgttgttgtcacgacatcaagtgatgatggcatgattaatggcgcgtttcttggcgttcgctctgatcagaccgctagcattcgtatggtctttcctgttggaaaacttgagggattgaggtttatgtgtgtgtttcggttcaaattatggtggatgacacaaagaatggggacatttggtcaagatataccaaccgaaactcagttccttatagttgaaaccattggtggttcagattttggtgaagacgatggatgtcaccaatctgctctatacactgtcttcttgcccattcttgagggtgattttagagcggttttacaaggcaattcaaataatgaactggaaattgttctggaaagtggagatcctgctgtgaaagattttgaagggagtcatttggttttcgtggctgctggatcagacccttttgacgctatcaccaacgctgtcaagagcgtggaaagacatcttcagacatttgctcaccgtgaaagaaagaagatgcctgacatgttaaattggttcggttggtgcacgtgggatgctttttatactgaggtgacttctgaaggtgtcaaacaaggccttgaaagttttgagaaaggaggagtttcaccaaaatttgttataatcgatgatggatggcaatcagttggtatggatcccaccagttttgaagctaaagctgacaatacagcaaattttacaaataggctaactcatataaaagagaaccataaattccaaaaagacggtaaagaaggtcacagaatggaggatccagccatgggacttcgtcacgttgttacagacattaaagaccgtcataacctcaagtatgtttatgtttggcacgcgataactggttactggggtggcgtgagacctggagtacctgaaatggaccactataattccaagctgtcattcccggtttcatctccaggagctgaatctaatgaaatctgtgatgctttgaaagccatgaccaaaaatgggcttggtcttgtggatcctgagaaagtattcaacttttataacgaattgcattcttaccttgcgtctgctggtgtcgatggtgttaaggttgatgtacaaaacattcttgaaacacttggagcgggtcatggtggtcgggtcaaacttactaggaaataccatcaggcattggaagcttctatttctaggaattttcatgataatgggattatttcttgcatgagtcacaatacagatggtctgtacagtacaaagaagacagcagttataagggcatcggacgatttctggccacatgtcacaccttcacataccgtccatattgcttctgttgcttataataccatctttctgggagagttcatgcagcctgattgggatatgtttcatagcttgcatcccatggctgaataccatgctgccgctcgtgctgtgggtggctgtgctatttacgtcagtgacaagcctggacatcacgactttaatctgttaaagaagcttgtgcttcctgatggatcaatattaagggccaaacttcccgggaggccaacaagagattgcctgtttactgatccctcaagagacggaaaaagtcttttgaagatatggaatctaaacagtttcaccggagtggtaggagtattcaactgtcaaggagctgggtggtgtaaagatggaaagatgaccctcacccacgatgagcaaccacccaccatcaccggcttcatcggagctaaagatgtaaattacttgcctaaagttgcagattctacttggggtggagatgccattgtatacagtcacatttgcggagaattagtttaccttccaaagaatgcatctatcccggtaactttgaaatcaagagaatatgaggttttcacggttgttcctgcaaaaaggttgtcgggtggggttagttttgccccaataggtttgaccaaaatgtttaactctggaggggcgattgttaaattgaactatgagatggagaaacaaggaaatgtggagttaaaagttc

SEQ ID NO: 5327 - DNA, 2684 bp, Solanum phureja
ttcaactccaaaagcttcagctggccgttaatggcggcctcttcagataccgtaacgccgtcgagcctacgtttggctttcggcaatgtgttctcgttgttcattctcattctgattggagttctcgctttctcgatccgtatcttctccgtgattaagtatgagagtgttattcacgagttcgatccttatttcaactatagagtcactcagtttctgacaaagaatggaatttacgacttctggaattggtttgatgatcggacgtggtatccacttggacgagtgattggtggaactgtttaccctggactgacattgactgctggcactttgtggtggatacttaattccttgaatattcctctttctgtggaaactgtttgtgtgtttactgctcctacattctctgcctttgctgcttgggcaacataccttctgacaaaggaagttaaaggggctggggctggactaactgctgcagctcttttggccatggttccatcatatatatctcgatcagtggccggcagctatgacaatgaagctgtggccatatttgcgttgatcttcactttctatctctatataaagacactgaacacagggtccctcttttatgctactctaaatgccttgtcatacttttacatggtttgctcctggggaggatatacctttattatcaaccttattccaatgcatgccctactttgcatcgtaactgggcgttattcttcacggctttatattgcctatgctccattggttatcttgggaacattattggctgctttggtgcctgttgtaggttttaatgcagtaatgacatcagaacattttgcctcatttctggtgttcctaattctcaatgttgtggggcttgtctattacatcaaagggatgctcacaccaaaaatgttcaaagtagctgtgactcttgttgtatctgcaggcttgattgtttgctgcgctatggtagctgtgctagttgcgcttgttgcctctagcccaacaaagggatggagtggacgaagccttagtctgcttgatccaacttatgcgagcaagtatataccaattattgccagtgttagtgaacatcaaccacctacttggccttcttactttatggacataaatgtattagcatttttggtccccgcaggcattattgcatgctttttgcccctgactgatgctagctcctttgtgattctttatttagtgacttcagtgtacttttctggtgttatggtccgcctaatgcttgtactggccccagcggcatgtataatgtctggaattgctctatcatcagcttttggtgtgtttactcgatcaatcaaatttgcatcaattggaaaacaggctgatgcaggggataatgttgatggggttacacagaatgatgtggtgaagcctgatagaaatgaagaactcccaaaggaaaaaacttcgagaaaaaagaagaaagaaaaggagaatgttgaaaaagctcccattgctactaaaaaaagtgagaagaggcttttgatgttacccatggaggcttctgttgttgctattctattacttatattgctgggtgccttttatgtggttcattgtgtctgggcagctgcggaagcttactcagctccttctattgtactaacatcacagtcgcatgatggacttcatgtttttgatgacttcagagaggcttatgcctggttgagccacaatactgatgtagatgataaagtggcatcatggtgggactatggctatcagactactgccatggccaatcgcactgttattgttgataataacacctggaacaatacacatattgcaacagttggtacagccatgtcctctcctgaaaaagcagcctgggagatcttcaactctttggatgtaaaatatgttcttgttgtctttggaggtcttgttgggtatcccagtgatgatatcaacaagttcctctggatggttagaattggtggaggtgtcttccctcatatcaaggaacctgattatctgagagatggccagtaccggattgactctatggctactccaaccatgctgaactccctcatgtacaaactatcttattacaggtttgtggagacagatggcaaggggtacgatagagtaaggcggactgaaattggaaagaaacattttaagctcacccactttgaggaggtatttaccactcaccactggatggttcggttatacaaattaaaacctcccaagaacagaatccgtggaaagacaaagaagtctaaatcgaaagctacttctactagttcgaaaagaagtgcaactcaaaagaagaatccctggcaataaagggctactcataacaagtaacttctatttatcagcttcatgataggaaacttcatacgatgagtagcttcatgtgaaaggattatgctttaaacgcagtcctcttaggttttccttcaagttttgaattgcgttgatattatacagagaagacgattgtcccggagctccttttttgatagacttagcaaggaatcacatgtatctattgctcgcatcaaattagtctacattttgctcatctgagtctcaacaccctatagttgtaactgagacttttgaagtgttaaaactatcagctgatattagtgttatacatgttttttcactttgct

SEQ ID NO: 5328 - DNA, 2813 bp, Nicotiana benthamiana
tggccgttaatggcggcctcttcagataccgtagtaacgccgtcaagcctccgtcaggctttcggcaatgtcttctcattattcattctcattctcatcggcgttctcgctttctcgatccgtcttttctccgtgattaagtatgaaagtgttattcacgagttcgatccttatttcaattacagagttactcagtttctgacaaagaatggaatttacgacttctggaattggtttgatgatcggacctggtatccacttggacgagtgattggtggaactgtttaccctggactgacattgaccgctggcaccttgtggtggatacttaattctctgaatattcctctttctgtggaaactgtttgtgtatttactgctcctacattctctgcgtttgctgcttgggcaacataccttctgacaaaggaagttaaagggcctggggctggactaactgctgcagctctattagccatggttccgtcctatatatctcgatcagtggccggaagctacgacaatgaagctgtggccatatttgccttgatcttcactttctacctctatataaagacactgaacacgggttccctcttttatgctactctaaatgccttggcatacttttacatggtttgctcatggggaggatatacctttattatcaaccttattccaatgcacgccctactttgcattgtaacagggcgctattcttcacggctttacattgcctacgctccattggttatcttgggaacgctattggctgctttggtccctgttgtaggttttaatgcagtcatgacatcagaacattttgcttcatttctggtgttcataattctcaatgttgtgggccttgtctattacatcaaagggattctcacaccaaaaatgttcaaagtagctgtgacacttgttatatctgcaggcttgattgtttgctgtgctgtggtagctgtgctaattgcacttgttgcctctagccccacaaagggatggagtggacgaagccttagcctgcttgacccaacttatgcgagcaagtatataccaattattgccagtgttagcgaacatcaaccacctacttggccttcttactttatggacataaatgtattagcattcctggtccccgcaggcattattgcatgctttttgccgctgactgatgctagctcctttgtgattctttatttagtgacttcagtatacttttctggcgttatggtccgcctaatgcttgtactggccccagcggcatgtataatgtctgggattgctctgtcatcagcttttggtgtttttactcaatcaatcaaatttgcatcaattggtaaacaagttgatgcaggggatactggtaatggtgttacacagaatgatgtggtgaagcctgataaaactgaagaagcaccaaaggaaaaggcttcaagaaaaaagaagaaagaaaaggagaatgtggaaaaaactcctattgttgctaaaagtgagaggaggcttttgatgttacccatggaggcttctgttgtagctattcttttactaatgttgctgggtgccttttatgtggttcattgtgtctgggcagctgcagaagcttattcagctccatctattgtcctaacatcacattcacatgatggacttcatgtatttgatgacttcagagaggcttatgcatggttgagccacaatactgatgtagatgataaagtggcatcatggtgggactatggctatcagacgactgccatggcaaatcgcactgttattgttgataataacacctggaataatacacacatagcaacagttggtacagctatgtcctctcctgaaaaagcagcctgggaaatcttcaattctttggatgtaaaatatgttcttgttgtctttggaggtcttgttgggtaccccagtgatgatatcaacaagttcctctggatggttagaataggtgggggcgtcttccctcatatcaaggagcctgattatttgagagacggtcagtaccggattgattctatggctactccaaccatgctgaactgccttatgtacaaactatcttattacaggtttgtggagactgatgggaagggtttcgatagagtaaggcggactgaaattggaaagaaacatttcaagctcacccactttgacgaggtgtttactactcaccactggatggtccggatatacaaactaaaaccccctaagaacagaatacgtggaaagacaaaaaagtctaaatcgaaatctaactcagctagctcgaaaagaagtgcaacacgaaagaaaaatccctggcattaaagggctactcataacgagcaacttttatttatcagcttcatgataggaatacttatacgatgagctttcatgtgaaaaggattgtgctgtaaatgctgcatcttttttcctctagtgtacgcgaaattatcccatattctgtagtcatcttaccttttccttcaagttttgaattgccttgatattatattagagaagacatttttccggagctccttcctgatatacttgcaaggaatcacatgtatcgattgctcactgcaccaattagtttacattccaaaacgctcatctgagtccatcacctttagttgtaattgagacttttgaagcgttaaaactattcgggtgatattagtgatggacattttttatctctgctactctcaatttgaagtactaaatttttccaattttcccaggctttagaagctgtgctttttttttcttttcaaaatacaattggtgtcctagtttacacgcac

SEQ ID NO: 5329 - DNA, 2701 bp, Nicotiana benthamiana
aactccaaagctttcagttggccgttaatggcagcctcttcagatacagtaacgccgtcaagcctccgtcaagctttcggcaatgtcttctcattattcattctcattctcatcggcgttctcgctttctcgatccgtcttttctccgtgattaagtatgaaagtgttattcacgagttcgatccttatttcaattacagagttactcagtttctgacaaagaatggaatttacgacttctggaattggtttgatgaccggacctggtatccacttggacgagtgattggtggaactgtttaccctggactgacattgaccgctggcaccttgtggtggatacttaattctctgaatattcctctttctgtggaaactgtttgtgtatttactgctcctacattctctgcctttgctgcttgggcaacataccttctgacaaaggaagttaaagggcctggggctggactaactgctgcagctctattagccatggttccgtcctatatatctcgatcagtggccggaagctacgacaatgaagctgtggccatatttgccttgatcttcactttctacctctatataaagacactgaacacgggttccctcttttatgctactctaaatgccttggcatacttttacatggtttgctcatggggaggatatacctttattatcaaccttattccaatgcacgccctactttgcatcgtaacagggcgctattcttcgcggctttacattgcctacgctccattggttatcttgggaacgctattggctgctttggtccctgttgtaggttttaatgcagtcatgacatcagaacattttgcttcatttctggtgttcataattctcaatgttgtgggccttgtctattacatcaaggggattctcacaccaaaaatgttcaaagtagctgtgactcttgttatatctgcaggcttggttgtttgctgcgctgtggtaactgtgctaattgcacttgttgcctctagcccaacaaagggatggagtggacgaagccttagcctgcttgacccaacttatgcgagcaagtatataccaattattgccagtgttagcgaacatcaaccacctacttggccttcttactttatggacataaatgtattagcattcttggtccccgcaggcattattgcatgctttttgccgctgactgatgctagctcctttgtgattctttatttagtgacttcagtatacttttctggcgttatggttcgcctaatgcttgtactggctccagcggcatgtatagtgtctgggattgctctgtcatcagcttttggtgtttttactcgatcaatcaaatttgcatcaattggtaaacaagtttatgcaggggatactagtaatggtgttacacagaatgatgtggtgaagcctgataaaactgaagaaccaccaaaggaaaaggcttcaagaaaaaagaagaaagaaaaggagaatgtggaaaaaactcctattgttgctaaaagtgagaggaggcttttgatgttacccatggaggcttctgttgttgctattcttttactaatgttgctgggtgccttttatgtggttcattgtgtctgggcagctgcagaagcttattcagctccatctattgtcctaacatcacattcgcatgatggacttcatgtatttgatgacttcagagaggcttatgcatggttgagccacaatactgatgtagatgataaagtggcatcatggtgggactatggctatcagacgactgccatggcaaatcgcaccgttattgttgataataacacctggaataatacacacatagcaacagttggtacagctatgtcctctcctgaaaaagcagcctgggaaatcttcaattctttggatgtaaaatatgttcttgttgtctttggaggtcttgttgggtaccccagtgatgatatcaacaagttcctctggatggttagaataggtgggggcgtcttccctcagatcaaggagcctgattatctgagagacggtcagtaccggattgattctatggctactccaaccatgctgaactgccttatgtacaaactatcttattacaggtttgtggagactgatgggaagggtttcgatagagtaaggcggactgaaattggaaagaaacattttaaactcacccactttgacgaggtgtttactactcaccactggatggtccggatatacaaactaaaaccccctaagaacagaatacgtggaaagacaaaaaagtctaaatcgaaatctaactcagctagctcgaaaagaagtccaactcgaaagaagaatccctggcattaagggctactcataatgagcaacttttatttatcagcttcatgataggaatacttatacgatgagctttcatgtgaaaaggattgtgctgtaaatgcagtcctcttaccttttccttcaagttttgaattgccttgattttatatagagatgacatttttccggagctcctccctgatatacttgcaaggaatcacatgtatatattgctcactgcaccaattagtttactttccaaaatgctcatctaaggccatcacctatagttgtaattgagacttttgaagtgttaaaactattccggtgatgttagtgttatacatttttggtctctgctactctcaagtcgaagtattaattt

SEQ ID NO: 5330 - DNA, 2746 bp, Sesamum indicum
cctgcctaacgtaaagtcttgtcctgaagtctactcctgctacaaaacccctcccctccagtcccattctcacactcactgcgtgtgtttatgcgcgaaattctcaaatttcctacagaataagagagcttgaaccacggcggtcgatggcggcgcctgagaccccacaaccggatactcttcgccacgcattcgggaatgtgctctccttcttcgttcttttactcatcggtgttctcgctttctcgatccgtctcttttccgtgattaagtacgagagtgtaattcatgaattcgatccttacttcaattatagagtgacgcagtatcttacaaaaagtggagtatatgacttttggaattggtttgatgaccgcacatggtacccacttggacgtgtgattggtggaacagtttaccctggacttacgctgactgcgggtactttatggaggatattgaacttcttaaatattcctctgtccgtggaaactgtttgtgtgtttacggctcctattttttcagcttttgcttcttgggcaacatatcttctgacaaaggaagtcaaaggtgctggtgctgggttgactgctgcagctcttctggccatggttccgtcatatatttctcgatctgttgctggaagttatgacaatgaagcagtggctatttttgctttgatcttcactttctatctctatataaagacattgaacacaggatcccttttttatgctactctaaatgcaatagcatacttctacatggtttgctcttggggagggtacacctttatcataaatcttattccgatgcatgtgctgctatgcattgtaactggtcgctattcttcacgcctctacattgcttatgctccacttgttgtcttgggaacattgttagcatctttggtacctgttgtgggttttaatgctgtcatgacgtccgagcattttgcatcatttctagtctttattattatacatgtggtggctcttgtttattatatcaaaggaattctcactcctcaaatgttcaaagtagcagttactcttgttgtgtcagttgggctgatagtttgcggtgctgttttagcagtactaatagcattggtagcttccagcccaaccaaaggatggagtggacgaagtctaagcctgctcgatccaacttatgcgagcaagtatataccaattattgcaagtgttagtgaacatcaacctccgacatggccgtcatactttatggacattaatgttttggcatttttggttccagctggcattattgcatgctttttgccactttctgatgcaagctcctttgcggtcctttatattgttacatcagtatatttttctggtgttatggtccgcctaatgcttgtacttgctccagcagcttgtataatgtctggaattgctctttcagaagcttttgatgtttttactagatcaattaaatttcagttgtttggtgcaacaaaagacccccaggtcaatgcaggggataccaatgttacacaaaatgaggtggtgaagcctgagaaaagtgaggactcactgaaggaacgatcttcaagaaaaagtaagaagaaggaaaaggagaacgtagaaacagttccgcttgtatcccggattgaaaagaagcttctggtcttaccgttggaggcttccctgattgctattttcttgcttgtgttgctgggtgcattttacgtggtccattgtgtctgggcggcagcggaggcttattctgctccatccatcgtgctaacctctcgttctcatgacggccttcacgtctttgatgacttcagagaggcatatgcttggttgcgccataacaccgacgtagatgataaggttgcatcttggtgggactatggctaccaaacaactgctatggctaaccgtactgttattgttgacaacaatacctggaacaacacacatattgcaactgttggaactgccatgtcctctcctgaaaaagcagcttgggagattttcaactcgttagatgtaaaatatgttttagttgtttttggaggtcttgttggatatcccagtgatgacattaacaagtttctgtggatggttcggataggtggaggtgtatttcctcacattaaagaacctgattatttgagagatggtcaataccgaattgattctcaagcaactccaacgatgcttaactgcctcatgtacaaactctcgtattacagatttgtggagacagatggtagaggctttgacagggtgaggcacaccgaaatcgggaaaaaatatttcaaacttacccactttgaggaggtattcaccactcatcattggatggttcggatatacaaattgaaatctccaaggaacagagtccgtgggaagaccaagaaatccaaatcgaaatctacctcgacatctatctcaagaagaagcggagcaagaaagaagaatccttggcattagctggactcggatcttttatataagagcgaaatagaaaaagaaagctcgctatagattttgcaatctcctctatggttgttaatttaacgtccggatattgataggcgggtagcagagaagtgttgaacaatttttgacttgctgtttaggctgtgacagtagactgtacaagatatctcatacagagtcccctgtttttaagggctaggtttcagttagaactgttcccgaatcatcttacaatcatccacatagtaatgcattttggtctgacc

SEQ ID NO: 5331 - DNA, 2760 bp, Panax ginseng
tcttctcttggtcttcacataactggaactggagacctacaaagagactcactctctatctaattccagagcttcggttggccgtcaatggcggccttagagaacgcaaaagattcagctctaagatatgcgttcggaaatgttctatcattcttcatcctcctcctgatcggtgtgctcgcattttcgatccgtcttttctcggttattaaatacgagagcgttattcatgagtttgatccttatttcaattacagagtaactcagtttctcacaaagaatggaatatatgacttttggaactggtttgatgaccggacctggtatcctcttggtcgtgtgattggtggaactgtttaccctggattaacattgacagcaggaaccttatggtggatattgaattctttgaatattcctctatctgtggaaactgtttgtgtctttactgctcccatattctccgctaacgctgcatgggcaaccttccttttgacgaaggaggttaagggcacaggtgcaggactcactgcagcagctctattggccatggttccatcctatatatcccgatctgtggctggtagctatgataatgaagctgtagctatattcgctttgatattcactttctatctttatataaagacattgaacactggatctctcttctatgctacattgaatgccattgcatacttttacatggtctgttcttggggaggatacacctttattatcaacctcataccgatgcatgcacttctttgtattgtaactggtcgctattcttctcggttatacatagcatatgctccacttgttgttttgggaacactgttagccgcattggttcctgttgttggtttcaatgcagtcctaacatcagaacactttgcatcatttttggttttcattattatccatgtggtggctcttgcgtattacatcaaaggaattctctctccaaaaatgttcaaagtagcagttacacttgttgtatctgttggactggttgtatgttgtgctgtgatagctgtacttgtggcattggtagcttctagtccaacaaagggttggagtggacgaagtttaagcttacttgatccaacttatgcaagcaagtacataccaatcattgccagtgttagtgaacatcaaccacctacttggccgtcttactttatggacattaatgttttggcattcttggttccagctggcattattgcatgctttttgccactatctgatgcaagctcctttgtggtcctttacattgtcacatcagtatatttctctggtgtgatggtgcgtctaatgcttgtacttgctccagcagcatgcataatgtctggtattgctctctctgaagcattcagtgtttttacacgatcaatcaaatttcagttacctggagtgtcacaaactcaccagattgatacaggagatcttggttctggagatgatgctatccaaaaagatgttgtgaaaactgataaaagtgatgagccagcaaaggaacggtcttcaaagaggaacaagaagaaggaaaaggagaatgtggaaaaggcttctaagccttctatcaagtcaaaaattgagaagaggctcctggttttacctctggagtcttctatcattgctcttctcttactggtgttgctgggtgccttttatgtagtccactgcgtctgggcagcagcagaagcatattcagcaccttctattgtgctaacgtctcattcacatgatggtcttcatgtgtttgatgattttagagaggcttatgcatggctaagccacaacactgaggtggatgataaggttgcatcttggtgggactatggttaccaaactactgctatggcaaatcgcactgttattgttgacaataatacctggaacaacacacacattgcaactgttggtactgctatgtcttctcctgaaaaggcagcttgggaaatttttaactctttggatgtaaaatatgttcttgttgtttttggaggtcttgttggctatcctagtgatgatataaataagttcctatggatggttcgtataggaggtggtgtattccctcatatcaaggaacctgattatctgagagatggtcagtaccgaattgactctcaggccactccgaccatgttaaactgtctcatgtacaaactatcatatttcaggtttgtggatacagatggcggtaaagggtatgacagagtaaggcagactgaaattggaaagaaatatttcaagctaacccattttgaggaggtattcacaactcaccattggatggttcgaatatacaaactaaaacctccaaggaacaggatccgatcgaagacaaagaaaacgaaatcgaaaactagtggctccacaacaagctcaaaaagaagtggagcaataaagaaaaatccttggcaataaatatataatttataggcatggcattacctgaggtcagttatctgtaatagatatagattttgtatgcatgagtctcttgagaggtattatgtgggagaagaagttagtcacctttcttacagaaatgaaaagattaatccaagattttgcagtttgttctgatatgtaatttctcttgcaattttgaaccagttacttgctctgaaactaagagtttaataatttaattccatgtgttctgcatgctcaacttaacttatgacctgcaaaatatacaggcttattttcaaataaaaaaaaaaaaaaaaaaaaaaaaaaaaa

SEQ ID NO: 5332 - DNA, 2724 bp, Vitis vinifera
ctcatttcctcactgcaattcggagcttgactcggccgtcgatggcggcttcggaggactccaaccaatcgaagattcgggctgtctttgggagtgttctctcgttctttattctcattctgatcggagttctcgcattctcgatccgtctattctccgttataaagtatgagagtgttattcacgagttcgatccttatttcaattatagagtcactcagtttctcacaaagaacggaatatatgacttttggaactggtttgatgatcgaacctggtatcctcttggtcgtgtgattggtggcactgtttacccaggattgaccttaacagcaggctccatatggtggttattgaattccttgaatattcctctatctgttgaaactgtctgtgtgtttactgcacctatattttctgctaatgctgcatgggcaacttatcttctgaccaaggaagttaagggcactggtgctggactcacagctgcagctcttctggccatggtaccatcatacatatcccgatctgtggctggtagctatgataatgaagctgtggctatatttgctctgatcttcactttctatctttatattaagacgctaaatacaggatccctcttttatgctactttgaatgccataacatacttctacatggtttgctcttggggaggatacacttttattatcaaccttattccaatgcatgtgcttctttgcatagtaactggtcgctattcttctcgactttacattgcgtatgctcctcttgttgtgttgggaacattgttagcagctttggtgcctgttgttggtttcaatgcagtaatgacatcagaacattttgcatcgtttctggttttcattatcatccatgtggtagctcttgtgtattatatcaaaggaattctatctccaaaaatgtttaaagtagctgttacgcttgttgtatccgttggcctggtggtgtgttgtgctgtggtagcagtacttatagcactggtagcttccagcccaacaaagggatggagtggacgaagtctgagtctccttgatccaacttatgcaagcaagtatataccaattattgccagtgttagtgaacatcaaccacctacttggccatcttactttatggacattaatgttttggcatttttggttccagctggcattgttgcatgctttttgccactatctgatgcaagctcctttgttgttctttacatagtgacatctgtatatttttctggagtcatggtgcgccttatgcttgtactagctcctgcagcatgcatattatctggaattgctctttctgaagcatttgatgttcttactcgatcgatcaaatttcagttacctggattatcagaaaattcccagattgatgcaggggatactacctctagtagtgttgtgacacaaaatgatgcagccaagaccaataaaaatgaggacacactaaaggagcgaccctcgagaaagaacaggaagaaggaaaaggaacatgtggaaaagacttccattaagtctcaaattaaaaagaggcttctggttttacctctggaggcatctgttgctgctattttcttgcttgtattgctgggtgccttctatgtggttcattgtgtttgggcagctgcggaagcttactcagccccttctattgttttaacatctcattctcatgatggccttcacgtttttgatgattttagagaggcttatgcatggttacgacacaatactgaggtggatgataaagttgcatcttggtgggactatggttaccaaactactgctatggctaaccggactgttattgtggacaataatacctggaataacactcatattgcaactgttggcactgccatgtcttctcctgaaaaggcagcttgggaaatttttaactccttggatgtaaaatatgttcttgttgtcttcggaggtcttgttggatatccgagtgatgacattaataagttcctgtggatggttcgcataggagggggggtattcccccacatcagggaacctgattatctgagagatggacagtaccggattgattctcaagccactcctaccatgctaaattgcctcatgtacaaactgtcatatttcagatttgtggagacagatggtaaaggctttgatcgagtaaggcggactgaaattgggaagaaatatttcaaactcacccattttgaggaggtgttcactactcaccattggatggttcggatatacaaactaaaacctccgaagaacaggatccgtgtaaaaacaaagaaatcaaaatcgaaagcaagctccacaaccagctcaaaaagaagtggaaaaagaaagaagaatccctggcaatgaaaggcactttcagaagctgctgtctccaattagttacttggaacccacatatttaatatgcttgagcccctagagagctagtgcaccagcattattagccatttttcttatagaaaagcaaacgtatcaatcaaagattttgtagtcttttcccatcgtgtacttttttggctcgcacccttaacatatgacgaaagaatgcattgatcaattttggaacagttcctttggcttggttccacgtgtaacgatgagtgggcatattatatacagcctattgagagagagcttgtgcctgaaaatgcatggtaagtaattgcatcaatagtgagttaagattccataa

SEQ ID NO: 5333 - DNA, 2622 bp, Panax ginseng
gaactggagacctacaaagagactcgtactatctaattccagagcttcggttggccgtcaatggcggccttagagaacgcaaaagattcagctctaagatatgcgttcggaaatgttctatcattcttcatcctcctcctgatcggtgtgctcgcattttcgatccgtcttttctcggttattaaatacgagagcgttattcatgagtttgatccttatttcaattacagagtaactcagtttctcacaaagaatggaatatatgacttttggaactggtttgatgaccggacctggtatcctcttggtcgtgtgattggtggaactgtttaccctggattaacattgacagcaggaaccttatggtggatattgaattctttgaatattcctctatctgtggaaactgtttgtgtctttactgctcccatattctccgctaacgctgcatgggcaaccttccttttgacgaaggaggttaagggcacaggtgcaggactcactgcagcagctctattggccatggttccatcctatatatcccgatctgtggctggtagctatgataatgaagctgtagctatattcgctttgatattcactttctatctttatataaagacattgaacactggatctctcttctatgctacattgaatgccattgcatacttttacatggtctgttcttggggaggatacacctttattatcaacctcataccgatgcatgcacttctttgtattgtaactggtcgctattcttctcggttatacatagcatatgctccacttgttgttttgggaacactgttagccgcattggttcctgttgttggtttcaatgcagtcctaacatcagaacactttgcatcatttttggttttcattattatccatgtggtggctcttgcgtattacatcaaaggaattctctctccaaaaatgttcaaagtagcagttacacttgttgtatctgttggactggttgtatgttgtgctgtgatagctgtacttgtggcattggtagcttctagtccaacaaagggttggagtggacgaagtttaagcttacttgatccaacttatgcaagcaagtacataccaatcattgccagtgttagtgaacatcaaccacctacttggccgtcttactttatggacattaatgttttggcattcttggttccagctggcattattgcatgctttttgccactatctgatgcaagctcctttgtggtcctttacattgtcacatcagtatatttctctggtgtgatggtgcgtctaatgcttgtacttgctccagcagcatgcataatgtctggtattgctctctctgaagcattcagtgtttttacacgatcaatcaaatttcagttacctggagtgtcacaaactcaccagattgatacaggagatcttggttctggagatgatgctatccaaaaggatgttgtgaaaactgataaaagtgatgagccagcaaaggaacggtcttcaaagaggaacaagaagaaggaaaaggagaatgtggaaaaggcttctaagccttctattaagtcaaaaattgagaagaggctcctggttttacctctggagtcttctatcattgctcttctcttactggtgttgctgggtgccttttatgtagtccactgcgtctgggcagcagcagaagcatattcagcaccttctattgtgctaacgtctcattcacatgatggtcttcacgtgtttgatgattttagagaggcttatgcatggctaagccacaacactgaggtggatgataaggttgcatcttggtgggactatggttaccaaactactgctatggcaaatcgcactgttattgttgacaataatacctggaacaacacacatattgcaactgttggtactgctatgtcttctcctgaaaaggcagcttgggaaatttttaactctttggatgtaaaatatgttcttgttgtttttggaggtcttgttggctatcctagtgatgatataaataagttcctatggatggttcgtataggaggtggtgtattccctcatatcaaggaacctgattatctgagagatggtcagtaccgaattgactctcaggccactccgaccatgttaaactgtctcatgtacaaactatcatatttcaggtttgtggatacagatggtggtaaagggtatgacagagtaaggcagactgaaattggaaagaaatatttcaagctaacccattttgaggaggtattcacaactcaccattggatggttcgaatatacaaactaaaacctccaaggaacaggatccgatcgaggacaaagaaaacgaaatcgaaaactagtggctccacaacaagctcaaaaagaagtggagcaataaagaaaaatccttggcaataaatatataatttataggcaaggcattacctgaggtcagttatctgtaatagatatagattttgtatgcatgagtctcttgagaggtattatgcgggagaagaagttagtcacctttcttacagaaatgaaaagattaatccaagatattgcagtttgttctgatatgtaatttctcttgcaattttgaaccagttacttgctctgaaacta

SEQ ID NO: 5334 - DNA, 2640 bp, Prunus persica
atggaagtaaatatagaggccgaagaggtctccgaccaccatgtcactgcccgcaaaacccttcatcagacctcagtctcctccatctttctctctctttcgaaagcccggagctcgatttggccgtcaatggcggcctcggagacctctaatggcacatccttgaggcatgcttttggaaatgtcctctccttcttcatcctcatcctgatcggtgttctcgcattttcgatccgtctcttctctgtcataaaatacgagagtgtaattcacgagtttgatccttatttcaattacagagtcactcagtttctgacaaagaatggaatatatgatttttggaactggtttgatgatcgaacctggtatcctcttggtcgtgtgattggtggaactgtttaccctggattgaccttgacagcaggaacactatggtggttgttgaattcattaaacattcctctttctgtggaaactatttgtgtatttactgcgcctatattctctgctttcacatcatgggcaacttaccttctgactcgggaagttaagggtgctggtgctggactaacagctgcagctcttatagccatggtcccatcgtatatttctcgctcagtggctggaagctatgacaatgaagccgtggctatttttgctttgatcttcactttctatctttatataaagacactgaatacaggatccctcttttatgcaactcttaacgccatagcatacttttacatggtttgctcttggggaggctacacatttattattaaccttattccaatgcatgtgcttctctgcattgtaacgggtcgctactcttctcgtctgtacattgcatatgctcctcttgttgtgttgggaacattgttagctgctttggtgccggtagttggatttaatgctgtcatgacatcagaacattttgcgtccttcttggtttttattattatacatgtggtcgcttttgtgtactatatcaaagggattctctctccaaaaatgttcaaagtggctgttacgcttgttctatccattggcctgataatatgtattgctgtgatagcagtacttgtagctttggtggcttcaagcccaacaaagggatggagtgggcgaagccttagtctacttgatccaacttatgcaagcaagtacataccgattattgctagtgttagtgagcatcaacctcctacttggccctcttacttcatggacattaatgtgttggcattcttggttccagctggcattattgcttgcttttcacccttatcagatgcaagctcttttgtgatcctttacattgtaacttctgtatatttctctggagtcatggtgcggcttatgctagtacttgctccagcagcctgcatcatgtctgggattgctctatctgaagcttttgatgttttcacacgatcaatcaagtttcagttacctggtttaccaggattttctgaagttgatgctggggataccagttctgagagcactgtaccgcagactgaagtgccaaagacagataaaagtggagagacattgaaggagagaccctcaagaaagaacaggaagaaggaaaaggaaccagttgaaaagccttccattaaatctcaaattgaaaagagacttctggttttaccatttgagggatctgttcttgctatttttctacttgtgttgcttggagccttctatgtggttcattgtgtctgggcagcagctgaagcttattcagccccatctattgttctaacatcttattcaaatgatggtctccatgtttttgatgattttagagaggcttatgcatggttaagccacaacactgaggtggatgataaagttgcatcttggtgggattatgggtaccaaactactgccatggctaaccgcactgtcattgttgacaataatacatggaacaacacacatattgcaactgtcggtactgccatgtcttcaccggaaaaggcggcttgggaaatttttaactcgttggacgtaaaatatgttcttgttgtttttggaggtcttgttggctaccccagtgatgatattaataagttcctgtggatggtccgtatcggagggggtgtattccctcatatcaaggaacctgattacttgagggatggtcagtatcggattgactctcaggccacccccaccatgctcaattctctcatgtacaaactctcttattacaggtttgtggacaccgatggtaaaggctttgatagggtgaggcgaacagaaattggaaagaaatatttcaaactcacccattttgaagaggtattcacaacccaccattggatggttcggatttacaaactaaaaccaccaaggaacaggatccgcggaaagacaaagaagtcaaaatcgaaatcaagctcatcgagtagcagcacaaaaagaagtagcacacgaaagaatccttggcactgaaagtgatttattaagtgttggaagtagggagagatgtgtggtcaattatctgtaatttgatataatatacgaaggaatgcgagggcctcaggagagtggattgagcgaggaagcatagttttagttgatcatttcttacgaaatgcaaatgacgatcagtcaaagattttgtag

SEQ ID NO: 5335 - DNA, 2838 bp, Quercus alba
ccacacgacctgcaaaaccaacctcactctctctctttctctttctctttctctcgcacttaactcagagctcgatttggccgtcaatggcggcctcggagacctcaaacggaaccgccttaagatacgctttcggaaatgttctctccttcttcatcctcctcctgatcggcgttctcgcattctcgatccgacttttctccgttataaagtacgagagtgttattcacgagtttgatccttatttcaattatagagtcactcagtacctgacaaagaatggaatatatgacttttggaactggtttgacgatcggacttggtatcctcttggtcgtgttattggcggaactgtttaccccggattgacattgaccgcaggcaccttatattggattttgaattcgttgaacattcctctgtctgtggagactgtgtgtgtatttactgcacctatattttctgcttttgcgtcatgggctacttatcttctgactaaggaagttaagggtgctggtgctggactgacagcagcggttcttttggccatggttccatcatatatatcccgatctgtggctggcagctatgacaatgaagccgtagctatatttgccttgatcttcacctttttcctttatataaagacattgaatacaggatccctcttctatgccactttaaatgccatagcatacttttacatggtttgctcttggggaggatacacctttattattaaccttataccgatgcacgttcttctgtgcattgtaactggtcgctattcttctcgactgtacattgcatatgctccccttgttgtcttgggaacgttgttagcttcattggtgcctgttgttggattcaatgcagtcttgacatcagaacattttggatcatttttggttttcattattatccatgtggtggctcttgtgtattatatcaaagggattctctctccaaaaatgttcaaagttgctgttacccttgttgtatctattggcctggtagtgtgttgtgctgtgatagcagtacttgtagcactggtagcttcaagtccgacaaagggatggagtggacgaagtttgagtctgcttgatccaacatatgcaagcaagtacattccaattattgctagtgttagtgagcatcaacctcctacttggccttcttattttatggacattaatgtcttggcattcttggttcctgctggcattattgcatgcttctcgcccctgtctgatgcaagctcctttgtgatcctttatattgtgacatcagtttatttttctggagtcatggtgcggcttatgcttgtacttgctccagcagcatgcatcatgtctgggattgctctctcagcatcttttgatgtttttacacgatcaatcaaatttcagttacctggagtaaaaggaaattcccaagttgatgcaggggatactagttctgaaggtgttgtagcgcaaaatgaggttgcaaagactgacaaaaatgaagaggcattgaaggaacgaccctcaaaaaagaataggaagaaggaaaaggagcatgtggaaaagccttctgttaaggcccaaattaagaagaggctactggttttaccttttgaggcatctatcattgccattctcttgctaattttgctgggtgccttctatgtggttcactctgtctgggcggctgctgaagcttattctgctccttctattgttctaacatcttattcgcatgatggtcttcatgtttttgatgattttcgagaggcttattcatggttgagccataacactgaggtggatgacaaagttgcatcttggtgggactatgggtaccaaactactgctatggctaatcgtactgtcattgttgacaataatacctggaataacacacatattgcaactgttggtactgccatgtcttctcctgagaaggcagcttgggaaatttttgactccttagatgtgaaatatgttcttgttgtctttggaggtcttgttggctacccgagtgatgatatcaataagttcctgtggatggttcgaataggaggcggtgtatttcctcatatcaaggaacctgattaccttagagatggtcagtatcggattgattctcaggccactccaaccatgcttaattgcctcatgtataaactctcatattacagatttgtggagacagatggtaaagcctttgatagggtcaggcgaacagaaattggaaagaaacatttcaaactcacccattttgaagaggtattcacaactcatcattggatggttcgcatatacaaactgaaacctcagaagaacaggatccggggaaaggccaagaaatcaagatcgaaagcaagctcaacaactagcacgaaacgaagcgaaacacaaaggaagaatccttggcactgaagatctcatttatcttatctgataggcattttctaaattcagttactgtagttgataaatgtatgtcggagccgatggagaaggattgagctgtcatggttagtactattacagaaatgcaaatgaccggtcaaggattttgcagcctcatatatcctgtaatttctcatctttaacattcgggtggagcagatggaagagaacaattttgcattagttgtttgagcatggcgcttagtgatacatttttatttttccctctttttgagaatgcttagtgatatatttgagcttgtggcttttgtggcccattaaaggacggtttcattttagacacgtgtttattccttttcctagctaactgaatagattcttgacacgcgtgtatactaatactatataagaataagaattg

SEQ ID NO: 5336 - DNA, 2834 bp, Prunus mume
gtcttctctcccacttcgtagtcactgcccgcaaaacccttcatcagacctcagtctccttcatctctctctctctttcgaaagctcggagatcgatttggccgtcaatggcggcctcggagacctccaatggcacatccttgaggcatgcttttggaaatgtcctctccttcttcatcctcatcctgatcggtgttctcgcattttcgatccgtctcttctctgtcataaaatacgagagtgtaattcacgagtttgatccttatttcaattacagagtcactcagtttctgaccaagaatggaatatacgatttttggaactggtttgatgatcgaacctggtatcctcttggtcgtgtgattggtggaactgtttaccctggattgaccttgacagcaggaaccctatggtggttgttgaattcattaaacattcctctttctgtggaaactatttgtgtatttactgcgcctatattctctgctttcacatcatgggcaacttaccttctgactcgggaagttaagggtgctggtgctggactaacagctgcagctcttatagccatggtcccatcttatatttctcgctcagtggctggaagctatgataatgaagccgtggctatttttgctttgatcttcactttctatctttatataaagacactgaatacaggatccctcttttatgcaactcttaatgccatagcatacttttacatggtttgctcttggggaggctacacatttattattaaccttattccaatgcatgtgcttctctgcattgtaacgggtcgctactcttctcgtctatacattgcatatgctcctcttgttgtgttgggaacattgttagctgctttggtgccggtagttggatttaatgctgtcatgacatcagaacattttgcatccttcttggtttttattattatacatgtggtcgcttttgtgtactatatcaaagggattctctctccaaaaatgttcaaagtggctgttacgcttgttctatccattggcctgatagtatgtattgctgtgatagcagtacttgtagctttggtggcttcaagcccaacaaagggatggagtgggcgaagccttagtctacttgatccaacttatgcaagcaagtacataccgattattgctagtgttagtgagcatcaacctcctacttggccctcttacttcatggacattaatgtgttggcattcttggttccagctggcattattgcttgcttttcacccttatcagatgcaagctcttttgtgatcctttacattgtaacttcagtatatttctctggagtcatggtgcggcttatgctagtacttgctccagcagcctgcatcatgtctgggattgctctttctgaagcttttgatgttttcacacgatcaatcaagtttcagttacctgttttaccaggattttcagaagttgatgctagggataccagttctgagagcactgtaccgcagactgaagtgccaaagacagataaaagtggagacacattgaaggagagaccctcaagaaagaacaggaagaaggaaaaggaaccagttgaaaagccttccattaaatctcaaattgaaaagagacttctggttttaccatttgagggatctgttcttgctatttttctacttgtgttgcttggagccttctatgtggttcattgtgtctgggcagcagctgaagcttattctgccccctctattgttctaacatcttattcaaatgatggtctccatgtttttgatgattttagagaggcttatgcatggttaagccacaacactgaggtggatgataaagttgcatcttggtgggattatgggtaccaaactactgccatggctaaccgcactgtcattgttgacaataatacatggaacaacacacatattgcaactgtcggtactgccatgtcttctccggaaaaggcggcttgggaaatttttaactcgttggacgtaaaatatgttcttgttgtttttggaggtcttgttggctaccccagtgatgatattaataagttcctgtggatggtccgtatcggagggggtgtattccctcatatcaaggaacccgattacttgagggatgggcagtatcggattgactctcaggccacccccaccatgctcaattctctcatgtacaaactctcttattacaggtttgtggacaccgatggtaagggctttgatagggtgaggcgaacagaaattggaaagaaatatttcaaactcacccattttgaagaggtattcacaacccaccattggatggttcggatttacaaactaaaaccaccaaggaacaggatccgcggaaagacaaagaagtcaaaatcgaaatcaagctcatcaagtagcagcacaaaaagaagtagcacacgaaagaatccttggcactgaaagtgatttattaagtgttggaagtagggagagatgtgtggtcagttatctgtaatttgatataatatacgaaggaatgcgagggcctccagagtgtggattgagcgaggaagcatagttttagttgattatttcttacgaaatgcaaatgacgatcagtcaaagattttgtagtcgcttctgatatgatctttgtcttgtatactcttttgcagtataatctttttaatacactgtttaggtgaaagaatgctctgcaatatttgaactgaccctggcgccatgattgaatggtgttattatgcgagaacctccaacctagaacagctagagttgtaacttcgctttttctccaaataatttgaaggattatttaggtttcacgtttca

SEQ ID NO: 5337 - DNA, 2604 bp, Panax ginseng
aagcagtggtatcaacgcagagtacatggggggtcttcacataactggaactggagacctacaaagaggctcgtactatctaattccagagcttcggttggccgtcaatggcggccttagagaacgcaaaagattcagctctacgatacgcgttcggaaatgttctatcattcttcatcctcctcctgatcggtgtgctcgcattttcgatccgtcttttctcggttattaaatacgagagcgttattcatgagtttgatccttatttcaattacagagtcactcagtttctcacaaagaatggaatatatgacttttggaactggtttgatgaccggacctggtatcctcttggtcgtgtgattggtggaactgtttaccctggattaacattgacagcaggaaccttatggtggatattgaattctttgaatattcctctatctgtggaaactgtttgtgtctttactgctcccatattctccgctaacgctgcatgggcaacctaccttttgacgaaggaggttaagggcacaggtgcaggactcactgcagcagctctattggccatggttccatcctatatatcccgatctgtggctggtagctatgataatgaagctgtagctatattcgctttgatattcactttctatctttatataaagacattgaacactggatctctcttctatgctacattgaatgccattgcatacttttacatggtctgttcttggggaggatacacctttattatcaacctcataccgatgcatgcacttctttgtattgtaactggtcgctattcttctcggttatacatagcatatgctccacttgttgttttgggaacactgttagccgcattggttcctgttgttggtttcaatgcagtcctaacatcagaacactttgcatcatttttggttttcattattatccatgtggtggctcttgcgtattacatcaaaggaattctctctccaaaaatgttcaaagtagcagttacacttgttgtatctgttggactggttgtatgttgtgctgtgatagctgtacttgtggcattggtagcttctagtccaacaaagggttggagtggacgaagtttaagcttacttgatccaacttatgcaagcaagtacataccaatcattgccagtgttagtgaacatcaaccacctacttggccgtcttactttatggacattaatgttttggcattcttggtaccagctggcattattgcatgctttttgccactatctgatgcaagctcctttgtggtcctttacattgtcacatcagtatatttctctggtgtgatggtgcgtctaatgcttgtacttgctccagcagcatgcataatgtctggtattgctctctctgaagcattcagtgtttttacacgatcaatcaaatttcagttacctggagtgtcacaaactcaccagattgatacaggagatcttggttctggagatgatgctatccaaaaagatgttgtgaaaactgataaaagtgatgagccagcaaaggaacggtcttcaaagaggaacaagaagaaggaaaaggagaatgtggaaaaggcttctaagccttctatcaagtcaaaaattgagaagaggctcctggttttacctctggagtcttctatcattgctcttctcttactggtgttgctgggtgccttttatgtagtccactgcgtctgggcagcagcagaagcatattcagcaccttctattgtgctaacgtctcattcacatgatggtcttcatgtgtttgatgattttagagaggcttatgcatggctaagccacaacactgaggtggatgataaggttgcatcttggtgggactatggttaccaaactactgctatggcaaatcgcactgttattgttgacaataatacctggaacaacacacatattgcaactgttggtactgctatgtcttctcctgaaaaggcagcttggggtaaatttttaactctttggatgtaaaatatgttcttgttgtttttggaggtcttgttggctatcctagtgatgatataaataagttcctatggatggttcgtataggaggtggtgtattccctcatatcaaggaacctgattatctgagagatggtcagtatcgaattgactctcaggccactccgaccatgttaaactgtctcatgtacaaactatcatatttcaggtttgtggatgcagatggtggtaaagggtatgacagagtaaggcagactgaaattggaaagaaatatttcaagctaacccattttgaggaggtattcacaactcaccattggatggttcgaatatacaaactaaaacctccaaggaacaggatccgatcgaggacaaagaaaacgaaatcgaaaactagtggctccacaacaagctcaaaaagaagtggagcaataaagaaaaatccttggcaataaatatataatttataggcaaggcattacctgaggtcagttatctgtaatagatatagattttgtatgcatgagtctcttgagaggtattatgcgggagaagaagttagtcacctttcttacagaaatgaaaagattaatccaag

SEQ ID NO: 5338 - DNA, 2766 bp, Eschscholzia californica
ggaagaaaacaagcttcaaaaagtcttcccctggctggtcttccaggaagaaacaaaagcttcaaaaaaccctggctgtgctctgatttccatctctctgcaataaggtgaattttacgccttcaatggcgactattgaaaaccctaaaggagaaggaactctgaggtatgccttcggcaatgttctttccttcttcatccttctcttgatcggagtactcgcattctcgatccgtatcttctccgttatcaagtatgaaagtgttattcatgagttcgatccttatttcaattacagagttactcagttccttacaaaaaatggaatatatgacttctggaactggtttgatgatcggacatggtatcctttaggtcgagtgattggtggaactgtctatccgggattgactttgacagcaggaactttatggacgttgctacaatctctgaatattcctttgtctgttgaaactgtttgtgtattcaccgctccaatattctctgcttttgctgcttgggctacctaccttctgacaaaggaagttaaaggtactggtgctggactgactgcagctgctcttttagcaattgtgccttcctatatatctcgttctgtagctggaagctacgacaatgaagctgtagctatctttgctttgatcttcactttttatctctacataaagacattgaataccgggtcccttttctatgccactttaaatgctctggcatacttttacatggtctgctcttggggaggatacacatttattattaaccttatcccaatgcatgcacttttgtgcatagtaactggccgctactcttctcgtctgtatgtcgcgtatgctccacttgttgtcctgggcacattattagctgctttagttcctgttgttggctttaatgcagtgatgacatcagaacattttgcttcatttttggttttcattattatccatgttgtggctcttgtctattatatcaaaggaattctctctccaaaaatgtttaaagttgccgttacgcttgttgtttctgttggcacggtaatttgttttgccgtggtagcagtacttgtagccctggtggcttccagtccgacaaaaggatggagtggtcgtagtttgagtcttcttgatccaacttacgcgagtaaatacatacccatcattgctagtgtaagtgaacatcagccaccaacatggccatcttactttatggacatcaatgttttggccttcttggttccagctggcataatcgcatgctttctccctctatcagatgccagctcatttgttgtcctttatattgtaacatcagtatatttctcaggagtcatggttcgccttatgcttgttctggctccagcagcatgcattttgtctggaattgctctgtctgaagcttttgacgtcttcacaagatcaatcaaatttcaattacctgcgttactgggggattccagttctgattcaggggatgcaacttctggttctgtggtacaaaatgatgtggtgaaggctgaagcaaatccagcttctgacaaaaacgaggactctctaaaggaaagaccagcgaaaaagaacaagaagaaagaaaaggacactactgtgaaagcatcgattaagtctcgaattgagaagaggcttctggtgctacctctggaagcatctgtcatagccattttgttgcttattttgttgggtgccttctacgtggttcattgtgtctgggcagctgctgaagcctattcagctccttctattgttctaacttctcattcacatgatggtcttcatgtgtttgatgatttccgagaagcttatgcatggttaagccataacactgaagtggatgataaggttgcatcttggtgggattatggttaccaaactacagcaatggctaatcgtactgtcattgttgataacaatacctggaataacacacatattgcaactgttggtactgccatgtcttctccagagaagcccgcgtgggagattttcaactccttggatgtaaaatatgttctcgtcgtctttggaggtcttgttggctatccgagtgacgatatcaataaattcctttggatggttcgtattggaggaggcgtctttcctcacatcaaggaacctgactatcttagagatggtcaataccggatcgattctcaggctactccaacaatgctaaactctcttatgtacaaactctcatatttcagattcgtcgaaacagatggtaaaggtttcgatagagtaaggaggactgaaattggaaagaaacatttcaagcttacccattttgaggaggttttcacaacgcaccactggatggttcgaatatacaaactaaaatctccaaagaacaggatccgaggaaagacaaagaaatcaaaatcgggttcaaaatcaagctcaaacacgaaaagggttgaaacaggaaagaagaatccttggcattaacaaacataatcgatagaacaggaaagctagaagagaactccattaaagatcaggcagctgtaatacattttcttaaaggtattcattatggaattctgcagagtttcttgcatttcagaggaatagttagggaggaaaagattggatatttaagttttgtagaatacttatttctttacttagttctaattaatctgattatttgtgtgtttttgatctcaactgatgatcaaataatgagcaagaataattgggtttcaaatctatatacattatacgagtttcg

SEQ ID NO: 5339 - DNA, 2626 bp, Castanea mollissima
gcgcacttaactcagagctcgatttggccgtcaatggcggcctcggagacctcaaacggaaccgccttaagatacgctttcggaaatgttctctccttcttcatcctcctcctgatcggcgttctcgcattctcgatccgacttttctccgttataaagtacgagagtgttattcacgagtttgatccttatttcaattatagagtcactcagtacctgacaaagaatggaatatatgacttttggaactggtttgacgatcggacttggtatcctcttggtcgagttattggcggaactgtttaccccggattgacattgactgcaggcaccttatattggattttgaattcgttgaacattcctctgtctgtggagactgtgtgtgtatttactgcacctatattttctgcttttgcatcatgggctacttatcttctgactaaggaagttaagggtgctggtgctggactgacagcagcggttcttttggccatggttccatcatatatatcccgatctgtggctggcagctatgacaatgaagccgtagctatatttgccttgatcttcacctttttcctttacataaagacattgaatacaggatccctcttctatgccactttaaatgccatagcatacttttacatggtttgctcttggggaggatacacctttattattaaccttataccgatgcatgttcttctgtgcattgtaactggtcgctattcttctcgactgtacattgcatatgctccccttgttgtcttgggaacgttgttagcttcgttggtgcctgttgttggattcaatgcagtcttgacatcagaacattttggatcatttttggttttcattattatccatgtggtggctcttgtgtattatatcaaagggattctctctccaaaaatgttcaaagttgctgttacccttgttttatctattggcctggtagtgtgttgtgctgtgatagcagtacttgtagcactggtagcttcaagtccgacaaagggatggagtggacgaagtttgagtctgcttgatccaacatatgcaagcaagtacattcctattattgctagtgttagtgagcatcaacctcctacttggccttcttattttatggacattaatgtcttggcattcttggttcctgctggcattattgcatgcttctcacccctgtctgatgcaagctcctttgtggtcctttatattgtgacatcagtttatttttctggagtcatggtgcggcttatgcttgtacttgctccagcggcatgcatcatgtctgggattgctctctcagcatcttttgatgtttttacacgatcaatcaaatttcagttacctggagtaaaaggaaattcccaagttgatgccgggtatactagttctgaaggcgttgtagtgcaaaatgaggttgcaaagactgacaaaaatgaagaggcattgaaggaacgaccctcgaaaaagaataggaagaaggaaaaggagcatgtggaaaagccttctgttaaggcccaaattaagaagaggctactggttttaccttttgaggcatctatcattgccattctcttgctaattttgctgggtgccttctatgtggttcactctgtctgggcggctgctgaagcttattctgctccttctattgttctaacatcttattcgcatgatggtcttcatgtttttgatgattttcgagaggcttattcatggttgagccataacactgaggtggatgacaaagttgcgtcttggtgggactatgggtaccaaactactgctatggctaatcgtactgtcattgttgacaataatacctggaataacacacatattgcaactgttggtactgccatgtcttctcctgagaaggcagcttgggaaatttttgactccttagatgtgaaatatgttcttgttgtctttggaggtcttgttggctacccgagtgatgatatcaataagttcctgtggatggttcgaataggaggcggtgtatttcctcatatcaaggaacctgattaccttagagatggtcagtatcggattgattctcaggccactccaaccatgcttaattgcctcatgtataaactctcatattacagatttgtggagacagatggtaaagcctttgatagggtcaggcgaacagaaattggaaagaaacatttcaaactcacccattttgaagaggtattcacaactcatcattggatggttcgcatatacaaactgaaacctcagaagaacaggatccggggaaaggccaagaaatcaagatcgaaagcaagctcaacaactagcactaaacgaagcgaaacacaaaggaagaatccttggcactgaagatctcatttgtcttatctgataggcaatttctaaattcagttactgtagttgatacatataaatgtacgttggagccgatggagaaggattgagctgtcatggttagtactattacagaaatgcaaatgaccggtcaaggattttgcagcctcatatatcctgtaatttctcatctttaacattcgggtggagcagatggaagagaacaattttgcattagttgtttgagcatggcgcttagtgatacattttt

SEQ ID NO: 5340 - DNA, 2740 bp, Citrus clementina
  Sequence also found in Organisms: Citrus sinensis
tcctctcactctctacactcgagacctacacgatacaaaaaccgcttcattctctctttaagattaaccttttaagttaactaaaatcagtgagcaaattggtcgtcaatggcggccgcagctaaggccggcgaggcgaccttgcgtcacgcctttggaaatgttctctcattcttcattctccttttgatcggagttctcgctttctcgatccgtctcttctctgttataaagtatgaaagtgtcattcatgagtttgacccgtacttcaattacagggtcactcagttcctaacgaagaatggcatatatgatttttggaactggtttgatgatagaacctggtatcctcttggtcgtgttattggtggaactgtttaccctgggttaaccttgacagcaggcaccatatggtggttattgaactccttgaatattcctctgtcagtggagacagtttgtgtgttcactgcacctatattctctgcttttgcttcgtgggcaacttaccttctaactaaggaagttaagggtgctggtgcaggactgacagctgcagctcttctggcaatggttccatcatacatatctcgatctgtggccggaagctacgataatgaagcagtagcaatatttgctttgattatcactttttatctttatataaagacactgaatactggatccctcttttatgccactttaaatgcgattgcatacttttacatggtttgctcttggggaggttatacctttattattaatcttattccaatgcatgtgcttctgtgcattgtaactggtcgctactcttctcgattgtacatcgcatatgctcctctggttgtcctgggaacgttgctggccgcattggtgcctgtggttggatttaatgcagtcatgacttctgaacattttgcatcatttttggtttttattatcctccatgtggtggctctcgtatattatatcaaggggattctctctcccaaaatgtttaaagtagctgtcacacttgtggtatcagttggcctggtagtctgttgtgctgtgatagcaattcttgtagcattggtagcttctagtccaacaaaaggatggagtgggagaagtttgagtctgcttgatccaacctatgcaagcaagtacataccaattattgctagtgtcagtgaacatcagccccctacttggccgtcttacttcatggacatcaatgttttggcattcttggttccagctggcattattgcgtgcttcttgcctttatctgatgcaagctccttcgtagtcctatatattgtgacatctgtttacttttcgggagtgatggtgcgccttatgcttgtatttgccccagcggcatgcatcatgtctgggattgctctgtctcaagcttttgatgttttcacaagatcaatcaagtttcagctgcttagaatactaggattttctgaagctgatgcaggggatggtagctctgctaatgttgtaccagaaaatgatgctgtaaaggttgataaaagtgaagaaacaataaaggaacgaccctcgagaaagaacaagaagaaggaaaaggagcaaatggaaaaggctcaagcagaaaagacttcggccaagtccaaaactgaaaagaggcttctggttttaccaatggagctgtctgtgattggtcttcttttacttgtgttcatgggtgcattttatgtggttcattgtgtctgggcagctgcagaagcttattcagccccctctattgttttaacatcttatacacatgaaggcctgcatgtttttgatgattttcgtgaggcttatgcttggttgcgccacaatacagaagtggatgacaaagttgcatcatggtgggattatggttaccaaacgactgccatggctaaccggacagtcattgttgataataatacttggaacaacactcatattgcaactgttggcactgccatgtcttctcctgagaaggcagcatgggaaatttttaactcactggatgtaaaatatgtgcttgtcgtctttggaggtcttgttggttaccccagtgatgatatcaataagttcctgtggatggtccgtataggagggggtgttttccctcatattaaagaacctgattatctgagggatggtcaatatcggattgattctcaggctactccaactatgctaaattgtctcatgtataaactttcatattacagatttgtggagactgatggcaaaggctttgatagagtgaggcggactgagattgggaagaaatatttcaaacttacacattttgaggaggtattcactactcaccactggatggttcggatatataaattgaaaccttcaaaaaataggattagaggaaagatgaagaaatcaaagtcgagaacaagcacacccagctcaaaaagaagcggatcacgaaagaagaatccttggcagtaggaagtaactttttgtagggaaatgttttaggttacttgtctgtaactcaaatttaaatgtaccctgaatcttttgagaaggatcacacaggagtagctggtcatttccatggtggaaatcgaaacgatatatcaaaagattttgcagtcttttcatatgatccttgttattggtccctcgtgataatcctccccattttttagatttgagtcatttttaaccagttttggaattggctgtttggcttgtcatttgctcaaagtatattatagcccttagaaac

SEQ ID NO: 5341 - DNA, 2618 bp, Flaveria ramosissima
cctcattgtaaagctcgattgactcaaaatctctcacaaaaccacacacagatcgttgatcgttgatcgttcgttaatggcggtacccgtagacaacctcacgaagccaccaccagcgtcttcaactctacggttcgcattcggaaatgttctcgcgttcttcatcctcctgttgatcggagttctcgccttctcgatccgtctgttctcggttattaagtatgagagtgtgattcatgaattcgatccgtatttcaattacagagtcactcagttccttacaaaaaatgggatatatgacttttggaattggtttgatgatcgtacgtggtatcctcttggacgagttattggtggaaccgtttaccctgggctgaccttgactgctggaaccatatggaaggtgcttcattccttgaatattcccctgtctgtggaaactgtgtgtgtattcactgccccagtcttctctgcctttgctgcatgggcaacatatctcttgactaaggaagttaagggaacaggtgctggattgactgctgcagttcttctggccatggtaccatcctacatatctagatcagtggctgggagctatgacaatgaagctgttgctatctttgctctaatctttaccttctacctctatgttaagactttaaacacaggatccctcttttatgcaacattaaattccattgcatacttctacatggtctgctcttggggagggtacacctttatcattaatctcataccgatgcatgtgcttctttgcattgtgactggtcgctattcatctcggttatacattgcctatgctccacttgttgtcttgggaacattattggcagcattggtgcctgttgttggttttaatgcggtcatgacatcagaacattttgcatcattcctggttttcattgttattcatgtggtggcccttgcatattatatcaaagggatactctctccgaagatgtttaaagtagctgctactcttgtagtatctgttggcctggtggtatgctgtgctgttgtagcagtacttgtagcagtagttgcatctagtcctacaaagggatggagtggacgaagtttgagtcttcttgatccaacttatgcaagcaagtacataccaatcattgcaagtgttagtgaacatcaaccccctacatggccttcttactttatggatcttaatgttttagcattcttggtccctgctggaattattgcatgctttacacccctatctgatgcgagctcctttgtgatcctttacttagtaatgtcagtatatttttctggtgtcatggtacgattaatgcttgtgctagctcctgctgcatgcataatgtctggaattgctctttctgaagcttttgatgttttcacaagatctattaaattctacatttctaacctatctgagtttctccaggttgatgcaggggattctgtacctgttaataatgtttctccacaaaatgatgtgttgaaaaatgaaaaaagagaagacatgttgaaagaacggccttctagaaaaaataagaaaaaagaaaaagagaatattgaaaagccatctgtcaagcccaaaacagaaaaaaggcccctggtcttgcctgtcgaagcatcattctttgctcttttcttgaccgtattgctgggtggtttctatgtggttcatagtgtttgggctgctgctgaggcatattcagctccttcaattgtgcttacttctcattcccatgacggacttcatgtttttgatgattttagagaggcctatgcatggttaagtcataacactgaagtagatgacaaagttgcatcatggtgggactatggttaccaaacaactgcaatggctaaccgtacagtcatcgttgacaataacacatggaacaacacacatattgctaccgttggtactgccatgtcatcccccgaaaaggctgcctgggaaattttcaactccttggatgtgaaatacgttcttgtcgtgtttggaggtcttgtgggctacccaagtgatgacataaataaatttttatggatggtgcgtattggaggaggtgtgttcccgcatatcaaggaacctgattatttgagagacggtcaataccgaattgactctcaggccactccaaccatgcttaatagtctcatgtataaactatcctatttcaggtttgtggaaaccgatggtggtaaagggtatgatcgagtaagaaggaccgaaattggaaagaaacattttaagttaactcattttgaggaggtattcacaactcaccattggatggtccggatttataaactaaaacctcaaagaaacaggatcagagggaagacaaagaagtctaaatcgaaaacaagctccagtacacccagaagtggaacaatgaagaaaaacccatggcattagaacttattattagatatgataagagttgttacttgtagtgtgaccaaccaaagattttgtcgcgaattataatggtgggaggatttttttataaaaccacagtaaaaaatgagtagatcagatattttctacttccccaccttattagcattttttttgctaaaagtaatatataaatattatgtag

SEQ ID NO: 5342 - DNA, 2624 bp, Aquilegia formosa
tctcaatattccatttctttgaatttacgccattaatggcagaattggagattgggaaaggatcgaaactcagatatgcatttggaaacgttctttctttattcattctccttttgatcggagttctcgctttttcgatccgacttttttcggttattaaatatgagagtgttattcatgaatttgatccttacttcaattacagagttactcagttccttacaaagaatggaatttatgacttctggaattggtttgatgatcgaacatggtatcccctcggccgtgtgattggtggaactgtttatccaggattgacactgacagcaggtacactatggtggatattgaattctttgaacatccctctatctgtggaaactgtttgtgtatttactgctcctatattttcggcttttgctgcttgggcaacttaccttctaacaaaggaagtcaagggtactggtgccggattgacagcagcagttcttctagcaatggtaccatcgtacatatctcgttccgtggctgggagctatgacaatgaagccgttgctatatttgctttgattttcactttttatctctatttaaagacactgaacactggatcactcttctatgccactttgaatgctctgtcatacttttatatggtttgctcatggggaggttacacattcattattaatcttataccaatgcacgcacttctgtgcattgtaactggtcgctactcttcccggttgtatattgcttatgctcctcttattgtcctcggcacactgttagcttcattggtgcctgttgttggttttaatgctgtgatgacatcagaacattttgcctcatttttggtttttataatcatacatgtggtggcgcttgtgtactatattaagggaattctcactccaaaaatgttcaaagtggccgttacactcgttgtttctgtcggcatgatagtctgttttgctatggtagcagtacttgttgccctagtagcttcaagcccaacaaagggatggagtggacgcagtttgagtcttcttgatccaacttatgcaagcaagtacattccaattatcgcgagtgtcagtgaacatcaaccacctacctggccatcttactttatggacatcaatgttttggcattcttggttccagctggcatcattgcatgctttctacctctgtcggatgccagctcctttgtggttctttacatagtgacatcagtatatttttcaggagttatggtacgtctcatgcttgtactagctccagcagcatgtatcttgtctggaattgctctttcggaagcttttgatgtatttacacgatcaattaaatgtcaactgtctgatttattaagtgatccgctacctgctgcaggggatatggcttcagagaattctgccgtacaaaacgatatagtgaaggttgataaacactcaactgcccaaaaaagtgatgaaggtttaaaggagaggacatcaaagaagaacagaaagaaagaaaaggaacacgtggaaaaggtttctatcaaagcacgaaaagagaagaggcttctggtgttacctttggagacatctgtcatagccattctcttacttgttatgctgggtgccttctatgtggttcattgtgtctgggcagcagctgaagcttactcggctccttctattgttctaacttctcattcacatgatggtcttcatgttttcgacgattttcgagaagcttatgcatggttgagccataacactgaggttgatgataaggttgcatcttggtgggattacggttaccagacgactgcaatggcgaatcgaactgtcatcgttgataacaatacctggaataacacacacattgcaactgttggtactgcaatgtcttctccggagaaagcagcttgggagatttttgattctttggatgtgaaatatgttcttgttgttttcggaggtcttgttggctatcccagtgatgatataaataagttcctgtggatggtgcgtattggagggggtgtatttcctcacatcaaagaacctgattatcttagggatggccagtaccgaattgattctcaggccactccaaccatgcttaattgcctcatgtacaagctctcatattatagatttgtagaaacagatggtaaaggattcgacagagtaaggaggactgaaattggaaagaaacatttcaagcttacccattttgaggaggtattcacaacacaccattggatggtacgaatatacaaactaaaatctccgaagaacagggtccgaggaaagacaaagaaatcaaaatcgaaagcaagttcagcagccaaattgaaaaaggtcgacaggggaaaaaagaatccttggcactaagaaacacgagaagatgcaagaggataagttctaattctcccccacacttccatatgcatgggttcttctaaatcctgcaagggcttgtgggggtgaggggtaaagtctggattttcttcggaagtagaagtacttatggaattttgtttttaatatccttatcatttttccccttctacaatccaaaatttgttgtataattgaaggaagaatacatgtatgaaccaatttaag

SEQ ID NO: 5343 - DNA, 2517 bp, Arnica chamissonis
aagtcttctctttgtaaagcttgattgactcgaaatctttctcacaaaaccacacaggtcgttaatggcggtccccgtagatagccttacaaagcaaacgccggcatcttcaacactacggttcgctttcggaaatgtccttgcgttcttcattctcctgttaatcggagtacttgcattctcgatccgtcttttctcggttattaagtatgaaagtgttattcatgaattcgatccttatttcaattacagagtcactcagttccttacaaagaacgggatatatgacttctggaattggtttgatgatcgtacctggtatcctcttggacgagtcattggtggaaccgtttaccctgggttgactttgactgctggaaccatatggaaggtgcttcaatccttgaacattcccctgtctgtcgaaactgtgtgtgtatttactgccccagtattctctgcctttgctgcatgggcaacatatctcttaactaaggaagttaagggaacaggtgccgggctgactgctgcagttcttctggccatggtgccgtcctacatatctagatcagtggctgggagctatgacaatgaagctgttgctatctttgctttaatctttaccttctacctctacatcaagactttaaacacaggatccctcttctatgcaacattaaattccatttcatacttctacatggtctgctcttggggagggtacacttttatcattaatctcataccgatgcatgtgcttctttgcattgtgactggtcgctattcgtctcggttatacgttgcctatgctccacttgttgtcttgggaacactattggcagcattggtgcctgttgttggttttaatgcggtcatgacatcagaacattttgcatcattcttggttttcattgttatccatgtggtggcttttgcatattatatcaaagggatgctctctccaaagatgtttaaagtagctgctacacttgtagtgtctgttggcctggtggtatgctgtgctgttgtagcagtacttgtagcagttgttgcatctagtcctacaaagggatggagtggacggagtttgagtcttcttgatccaacttatgcaagcaagtacataccaatcattgcaagtgttagtgaacatcaaccccctacatggccttcttactttatggatcttaatgttttagcatttttggttcctgctggaattattgcatgctttacaccactatctgatgcaagctcctttgtaatcctttacttagtaatgtcagtatatttttctggtgtcatggtacggttaatgcttgtgcttgctcctgctgcatgcataatgtcaggaattgctctttcggaagcttttgatgttttcacaagatccattaagttctacataactaacctatctgagtttctgcagattgatgcaggggattctttacctggtaataatgtttccccgcaaaatgatgtgttgaaaaatgagaaaaaagaagacgcgttgaaagaaaggccttctaggaaaaataagaaaaaagaaaaagagagtattgaaaagccatctgtcaagtccaaaacagaaaaaagacccctggttttgcctgttgaagcatccttctttgcacttttcttaaccgtgttattgggtggtttctatgtggtccatagtgtttgggctgctgcagaggcatattcagctccttcaatcgtgcttacttctcattctcatgatggacttcatgtttttgatgattttagagaggcctatgcttggttaagccataacactgaagtagatgacaaagttgcatcatggtgggactacggttaccaaacaactgcaatggctaaccgtacagtaattgttgacaataatacatggaacaacacacatattgctactgttggtactgccatgtcatcgcccgaaaaggctgcttgggatattttcaactccttggatgtgaaatacgtccttgttgtgtttggaggtcttgtgggctacccaagtgatgacataaataaatttttatggatggtgcgtatcggaggaggcgtgttcccgcatatcaaggaacctgattatttgagagacggtcaataccgaatcgactctcaggccactccaaccatgcttaacagtctcatgtataaactatcctatttcaggtttgtggaaactgatggtggtaaaggatatgatagagtaagaaggaccgaaattgggaagaaacattttaagttaactcattttgaggaggtgttcacaactcaccattggatggtccggatttataaattaaaacctcaaagaaacaggatcagagggaagacaaagaagtctaaatcgaaaacaagctccaccacacccagaagtggaacaatgaagaaaaatccatggcattagaacataacattagatgtgatacaattactacttttagaactgctgttaccaaccaaagattttgtagcgaattatgatgtggagggattttttaaaac

SEQ ID NO: 5344 - DNA, 2726 bp, Eucalyptus grandis
atggcggcctcggaggcatcatcggcggcgacggcgacggcgacggcgacgaccttgcggcaagccttcggaggcgtcctctccttcttcatcctcctcctgatcggcgtcctcgcgttctcgatccgtctcttctctgtcatcaagtacgagagcgtcattcacgagttcgatccttacttcaactacagagttactcagtttctcacgaaaaatgggatatatgacttttggaactggtttgacgatcggacatggtacccgctaggacgtgtgattggtggaactgtgtaccccggactaacgttgacagcaggcactctatggtggattttgaactctctgaatattcctctatctgtggagactgtgtgtgtgtttactgcacctatattctctgcctttgcttcatgggcaacctaccttttgacaaaggaagttaagggtgcaggtgctggattgacagctgcagccctcttagcgatggttccatcatatatatctcgatctgtggctggcagctatgacaatgaagcagtggcaatatttgcattgatctttacattctttctctacataaagacacttaatactggatcactcttttatgccactttgaatgccatctcctacttctacatggtttgctcatggggaggatacacattcatcatcaatctcattcccatgcatgcgttgctatgcattgtaactggtcgctattcctctcggctttacattgcttatgctcccctcgttgtcttgggaacattattggctgcattggtgcctgttgttggatttaatgcagtcatgacatcagaacattttgcatcatttttggtctttatcgtcattcatgtggttgctcttgtctattacatcaaaggaattctctccccaaagatgtttaaagttgctgttaccctggttctctctgcaggcttggtggtgtgcttcgctgtggtagcaatactcatagcactggttgcttccagtccaacgatggggtggagtggaagaagtctgagtctacttgatccaacttatgcaagcaagtacataccaattatagccagtgtcagcgaacatcagcctcctacatggccatcatattttatggacattaatgtcttggctttcttggttccagcaggcattattgcttgttttctgccattgtctgatgcgagttcctttgttgttctctatatcgtgacgtcagtatatttttcaggagtcatggtacggttaatgctggtccttgctccagcagcttgtatcttgtctgggattgctctctctgaagcttttgacactcttacacggtcaatcaagtttcagttacctggaatttctggtggaaactctgaagctaatgcaggggatgctagttctgctagtgccagtgcacagaatgatgtaatcaaggctgataaaactgaagagactgccaaggagagaccgtcaaggaagagcaagaagaaggaaaaggagccagtggaaaagcctccaagaaatcctcgaaatgagaaaaagcttttggttttaccttttgaagcgtctattgttggtatctttctacttgtcttgctgggcgccttctacgtggtccattgtgtctgggcagcagctgaagcttattcagccccttcaattgttctcacatctcattctcacgatggattacatgtttttgatgattttagagaagcttatgcatggctaagtcacaatacggaggtggatgataaagttgcatcatggtgggactacggttaccaaacaactgcaatggcaaatcgcactgtcatagttgataacaacacctggaataacacgcatattgcgactgttggtactgcaatgtcttctcctgaaaaggcagcttgggagattttcaactctttggatgtcaaatatgttcttgttgtctttggaggtctagtgggctatcctagtgatgatatcaataagttcttgtggatggtacggataggaggtggcgtgtttcctcatattaaagaacctgattacctaagagatggccaatatcggatcgattctcaggcaacgccaactatgttaaattgtctaatgtacaagctctcatattacaggtttgttgacaccgatggtaaagcttttgatcgagttaggcggacagagattggaaagaaacactttaagctcacccatttcgaagaggtgttcacaactcatcattggatggttcgcttatacaaactgaagcctccaaagaacaggctccgtggtaaaacgaaaaaattgaagtcgaaaacaagctctgcgtcaaactcaaagagaagtggaaagagaacaaagaatccttggcaatagaggttttgagattttacaggcaatgggttcggtagctacttgtacttcattgtataattataggcgaggcacctcagagatagttcgtgagagattaggtggtcattaaccttgcagagatgctagttctcaaggattttgcagttttgcctatgaaacaatatggaaaatgtttgtgctaactgcttctcgccgagggtgttccgatatttattttgcttctgttgcgtcctgctaagggcaagagattgctctagttcaatagattaggagttagctcaatctcgtgcttattcacaatggagtcccgcagcactaaatttttagtacatttccgtgattaagaatagagctatccttattca

SEQ ID NO: 5345 - DNA, 2480 bp, Flaveria ramosissima
agacaaagtctcctcattgtaaagctcgattgactccaaatctctcacaaaaccacacacagatcgttcgttaatggcggtccccgtagacaacctcacgaagccaccaccagcatcttcaactctacggttcgcattcggaaatgttctcgcgttcttcatcctcctgttgatcggagttctcgcgttctcgatccgtctgttctcggttattaagtacgagagtgtgattcatgaattcgatccgtatttcaattacagagtcacgcagttccttactaaaaatgggatatatgacttttggaattggtttgatgatcgtacgtggtatcctcttggacgagttatcggtggaaccgtttaccctgggctgaccttgactgctggaaccatatggaaggtgcttcattctttgaatattcccctgtctgtggaaactgtgtgtgtattcactgccccagtattctctgcctttgctgcatgggcaacatatctcttgactaaggaagttaagggaacaggtgctggattgactgccgcagttcttctggccatggttccatcctacatatctagatcagtggctgggagctatgacaatgaagctgttgctatctttgctctaatctttaccttctacctctatgttaagactttaaacacaggatccctcttttatgcaacattaaattccattgcatacttctacatggtctgctcttggggaggttacacctttatcattaatctcataccgatgcatgtgcttctttgcattgtgactggtcgctattcatctcggttatacattgcctatgctccacttgttgtcttgggaacattattggcagcattggtgcctgttgttggttttaatgcggtcatgacatcagaacattttgcatcattcctggttttcattgttattcatgtggtggctcttgcatattatatcaaagggatactctctccgaagatgtttaaagtagctgctactcttgtagtatctgttggcctggtggtatgctgtgctgttgtagcagtacttgtagcagtagttgcatctagtcctacaaagggatggagtggccgaagtttgagtcttcttgatccaacttatgcaagcaagtacataccaatcattgcaagtgttagtgaacatcaaccccctacatggccttcttactttatggatcttaatgttttagcattcttggtccctgctggaattattgcatgctttacaccactatctgatgcgagctcctttgtgatcctttacttagtaatgtcagtatatttttctggtgtcatggtacgattaatgcttgtgcttgctcctgctgcatgcataatgtctggaattgctctttctgaagcttttgacgttttcacaagatctattaaattctacatttctaacctatctgagtttctccaggttgatgcaggggattctgtacctgttaataatgtttctccacaaaatgatgtgttgaaaaatgaaaaaagagaagacatgttgaaagaacggccttctagaaaaaataagaaaaaagaaaaagagaatattgaaaagccatctgtcaagcccaaaacagaaaaaagacccctggtcttgcctgtcgaagcatcattctttgctcttttcttgaccgtgttgctgggtggtttctatgtggttcatagtgtttgggctgctgctgaggcatattcagccccttcaattgtgcttacttctcattcccatgatggactccatgtttttgatgattttagagaggcctatgcatggttaagtcataacactgaagtagatgacaaagttgcatcatggtgggactacggttaccaaacaactgcaatggctaaccgtacagtcattgttgacaataacacgtggaacaacacacatattgctactgttggtactgccatgtcatcacccgaaaaggctgcctgggaaattttcaactccttggatgtgaaatacgtccttgtcgtatttggaggtcttgtgggctacccaagtgacgacataaataaatttttatggatggtgcgtatcggaggaggtgtgttcccgcatatcaaggaacctgattatttgagagacggtcaataccgaattgactctcaagccactccaaccatgcttaacagtctcatgtataaactatcctatttcaggtttgtggaaaccgatggtggtaaagggtacgatcgagtaagaaggaccgaaattggaaagaaacattttaagttaactcattttgaggaggtattcacaactcaccattggatggtccggatttataaactaaaacctcaaagaaacaggatcagagggaagacaaagaagtctaaatcgaaaacaagctccaccacacccagaagtggaacaatgaagaaaaacccatggcattagaacttattattagatgtgataagagttattatttgtagtgtgaccaaccaaa

SEQ ID NO: 5346 - DNA, 2776 bp, Populus trichocarpa
cccttctcactcgagtctttcctcactcactaccctgctcctctcaaagtcgtcttctctttctactggacgacctacaaaaccaaaaaaccctctgttacgaagacacacgaatattatcaatggcggacggagagagctcgaaagaggcaactgcaagaacgctgcggaacgcgtttggcaatgtgctctctttcttcatcctcctcttgattggagttctcgccttctcgatccgccttttctctgtaataaagtatgagagtgttattcacgaattcgatccttatttcaattacagagttactcagtttttgacaaagaatgggatttatgacttttggaattggtttgatgatcgaacctggtatcctctcggccgtgtgattggtggaactgtttaccctgggttgaccttgacagcaggcacactatggtggttattgaattctttgaacattccattgtctgtcgagactgtttgtgtattcactgcaccaattttctctgcatttgcctcatgggcaacttaccttttgaccaaggaagttaagggtactggtgctggactgacagcagctgttcttttggccatggttccatcatatatatctcgatctgtggctggtagctatgacaatgaagctgtcgccatatttgctcttatcttcactttctatctttatataaagacattgaatacaggatccctcttttacgctactttaaatgccttggcatacttttacatggtctgctcatggggagggtacacctttattattaatctaattccaatgcatgtgctattgtgcattgtgactggtcgctattcttcccgactgtacattgcatatgctcctcttgtggttttaggaacgcttttagcagctttggtgcctgttgttggttttaatgcagttatgacatcagaacattttgcttcatttttggttttcattatcatccatgtggtggctcttgtgtaccatgtcaaagggaatctctctccaagaatgtttaaagtggctgttacgcttgttgtatctgtgggcctggtagtgtgctgtgctatgatagctgttctaatagcactggtagcttctagcccaacaaagggatggagcggacgaagtttgagcttgcttgatccaacttatgcgagcaagtatataccaatcattgctagtgtcagtgaacatcaaccccctacttggccatcttacttcatggacattaatgttttggctttcttggttccagctgggattattgcatgctttttgcctttatcagatgcaagctcctttgttgtgctttatattgtaacatctgtatatttttctggtgtcatggtgcgtcttatgctcgtgcttgctccagcagcatgcatcatgtctgggatcgccctttctgaagcttttaatgtcttaacacgatcaatcaagtttcagctacctggatcatcagggacttcccagtcaagggataccagtctgaataccgatggagaacaaaatgacatagccaagactgagaaaatggatgagacagtaaaagaacgaccatcaaaaaagaacaggaagaaagaaaaagagcctgtggagaaggcctctataaggtcccggattgaaaggagacttcttgttttacctttggaggcatctgtcattgctattatcttgctcgtgttgcttggcgctttctatgtggttcattgtgtctgggcagcagctgaagcttattcggcaccttctattgttttaacaacttattcacgagatggcggtcttcatgtttttgatgatttcagagaggcttatgcatggctaagccacaatactgaggtggatgataaagttgcatcatggtgggactatggttatcaaacaactgcaatggctaaccgcactgttattgttgacaataacacctggaataacacgcacattgcaaccgttggtactgctatgtcttctcctgagaaggcagcctgggaaatctttaactccttggatgtaaaatatgttctagttgtctttggaggtcttgttggctaccccagtgatgacattaataagttcctgtggatggttcgtataggagggggggtgttccctcatatcaaagaacctgattatttaagagatggtcaataccggatcgattctcaggccactccaaccatgctaaattgtctcatgtacaagctatcatattacaggtttgtggaaactgatggtaaagccttcgacagagttaggcagacagaaattgggaagaagtacttcaaacttacccattttgaggaggtattcacaactcaccattggatggttcgcatttacaaattgaaacctccaaagaacaggattcgagggaagaccaaaaaatcgaaattgaaagcaagctcaacttctagctcaaaaagaagcgcaacaggaaagagaaacccatggcactagtgaaataaattataggctaatgtgctcatatgtctgtaattcatataattataatcaagaagcttttgagagggatcttgcaggcatatttgatcattaccccagtaaaaagcaaaccagtagaaggattttgcagtctccacgtatgatcttgtgatgtcttaacaggactaatcaattttgaattaataccattagatctgtactgagcatgttgatgctatatgatgaatggcatctctcatatacgtgagataatacatttaccagttttctttatcagcgaaactttccagcttgcgggttttttt

SEQ ID NO: 5347 - DNA, 2492 bp, Cirsium arvense
cactcccaaagtcttctctttgtaaagctcgattgactccaaatctctcgcaactcacaaaaccacacacacattggaggttttccggccgccgttcatggcagtccccgtagataccataactaagccaccgccggcgtcttccacttcgactctacgcttcgcttttggaaatgtcctcgccttcttcattctcctgttaattggagtccttgcattctcgatccgtcttttctcggttattaagtatgaaagtgttattcatgaattcgatccttatttcaattacagagtcactcagttcctcacaaagaatgggatatacgacttttggaattggtttgacgaccgtacctggtatcctcttggacgagtcattggtggaaccgtttaccctggattgactttgacagctggaactatatggaaggtgcttcaatccttgaatattcctctgtctgtggaaactgtgtgtgtatttactgctcctgtattctctgcctttgctgcatgggcaacatatctgctgactaaggaagttaagggaacaggtgctggactgactgctgcagttcttctggccatggtgccatcttacatatctcgatcggtggctgggagctatgacaatgaagcggtggctatctttgctttgatcttcaccttctatctatacatcaagactttgaacacaggatccctcttctacgccacattaaattccatgtcatacttctacatggtctgttcttggggagggtacacctttatcatcaatcttataccaatgcatgtgcttctttgcattgtgactggtcgctattcgtctcggctctacattgcatatgctccactcgttgtcttgggaacattgttggcagcattggtgcctgttgttggttttaatgcagtcatgacatcagaacattttgcatcattcttggttttcattgtcattcacgtggtggctcttgcatattatatcaaaggaattctctctccgaagatgtttaaagtagctgctacccttgtagtatctgttggcctggtggtatgctgcgctgtagtagcagttcttgtagcagtggttgcatctagtcctacaaagggatggagtggacgaagtttaagtcttcttgatccaacttatgcaagcaagtacataccaattattgcaagtgttagcgaacatcaaccacctacatggccttcttacttcatggatattaatgttttagcatttttggttcctgctggaattattgcatgcttttcaccgctatctgatgccagcgcctttgtaatcctttacctagtaatgtcagtatatttttctggtgtcatggtacggctaatgcttgtgcttgctccagctgcatgcataatgtctggaattgctctttctgaagcttttgatgtttttacaagatccattaagttctacatatctaacctatccgagactctccagactgatgcaggggatattgtatctggtaataatgcttccccacaaaatgatgcgatcaagactgacaaaagagaagactcgttgaaggaaagaccttccaggaaaaataagaaaaaagataaggagatcgttgaaaagccttctgtcaaatctaagattgaaaagaggcccttggttttgcctgttgaggcatctttctttgctcttttcttgactgtgttgttgggtgccttctatgttgttcatagtgtttgggctgctgcagaggcttattcagctccttcaattgtgcttacttcccattcccatgacggacttcatgttttcgatgatttcagagaggcctatgcatggttaagccataacactgaagtagatgataaggttgcatcttggtgggattacggttaccaaacaactgcaatggctaaccgaactgtcattgttgacaacaacacgtggaacaacacacatattgctactgttggtactgccatgtcatctcctgaaaaggctgcttgggaaattttcaactccttggatgtgaaatatgtccttgttgtgtttggaggtcttgtgggctaccctagcgatgacataaataaatttctatggatggtgcgtataggaggaggtgtgttcccacatatcaaggaacctgattatttgagagatggtcaataccgaattgactctcaggccactccaaccatgctaaacagcctcatgtacaaactatcctatttcaggtttgtagagactgatggtggtaaaggatacgatagagtaaggaggaccgaaattggaaagaagtacttcaagttaactcattttgaggaggttttcacaactcatcattggatggtccggatctataaactaaaacctcaaaagaacaggatccgagggaagacaaagaaatctagatcgaaaagtagctcggccactccaacaagtggaacaacaaagaaaaatccatggcactagaagctaagtttgtaggtttactacagacaaatga

SEQ ID NO: 5348 - DNA, 2564 bp, Vigna unguiculata
caatttggccgtcaatggcggcctccgatgctcagaacggcgtgtcctctgtgaggcacgccttcggcaacgttctcgcgttctttatccttctcctgatcggcgttctggccttctcgatccgtctattctcggttattaagtatgagagtgttatccacgagtttgatccttatttcaactatagagtcactcagtttttgacaaagaatgggatatatgatttctggaattggtttgatgaccgaacttggtatccccttggtcgtgtaattggtgggactgtttatcctgggttgactttgacagccggcaccttatggtggatactgaattccctgaacatacctctctcagttgaaaccgtctgtgtgtttactgcacctatattctcagcctttgcttcatgggcaacttatcttctgacaaaggaggttaagggtacgggggctggcttgacagcagcaattcttctggctatggtcccatcctatatatctcgatcagtggctggcagctatgacaatgaagctgttgctatatttgctttgatcttcactttctatctctatattaagacgctcaacacaggatccctcttttatgccacactgaattccatagcatacttttacatggtttgctcgtggggagggtacacttttatcattaatcttattccaatgcatgcactcttgtgcattgtaactggtcgctattcttctcgactctacattgcatatgcacctcttgttgtattggggacactgttggcttctttggtgccagtggttgggtttaatgctgtaatgacatcagagcattttgcatcatttctggttttcattatcatccatgtagtggctcttgtgtactatattaaaggaattctttccccaaaaatgttcaaagtagccgtggcgctagttgtttctgttggcctggctgtatgctttgcgatggtggcagtacttatagcattggtagcttcaagcccaacaaaaggatggagtggaagaagtttaagtctgctagatcctacttatgcaagcaagtatattccaatcattgctagtgttagtgagcatcagccacctacttggccttcatacttcatggacatcaatgtcttggcattccttgttccagctggaattattgcatgtttctctcctctatctgatgcaagctcctttgtggtactttatattgttacatcagtatacttttccggagttatggttcgcttgatgcttgtacttgctccagcagcatgtatattgtctgggattgctctttctcaggcttttgatgttttcacaagatctatcaagtttcagttgccccacttatcagatcattctcaggcaggggaaggcagttctgaaaatgttgtgccaaatgattcggttaaggcagataaaactgaggacacatcaaaggaacggacctctaagaaaagcaagaagaaggaaaaggaacctgtggaaaagcctcttagcaagtcacaaattaagaaaaggctttccgttttacctctggaaacatccgtcgttgctattatcttgcttgtgttgctaggtgccttctatgtggttcacagtgtatgggcggcagcagaagcttattcagccccttctattgttttaacatcacattcacacgatgggcttcatgtttttgatgattttagagaggcatatgcttggctgagtcataatacagaagtagatgataaagtggcatcttggtgggactatgggtaccaaacaactgcaatggctaaccgaacagtcattgttgacaataacacctggaataacacacatattgctactgttggtactgccatgtcttctccagagaaggcagcttgggaaattttccattcactggatgtcaaatatgtccttgttgtcttcggaggactagtcggctatcctagtgatgatatcaataaattcctgtggatggttcgtattggagggggtgtattccctcacataaaggaaccagattatttaagggatggtcaatatcggattgattccatggccacaccaacaatgctaaactgcctcatgtataaactttcatattacaggtttgtggagacagatggtaaagctttcgacagagtgaggcggacagaaattggaaagaaacatttcaaacttacgcattttgaggaggtcttcacaactcaccattggatggttcggatatacaagttgaaaccaccaaagaacaggataagaggaaagactaaaaagtcgaaatcgaaaacaagctcaaaaactgcctcgaaaagaaaaggactgaagaggaatcccttctagtttagttttttcatttcctggggtaggggtaagcttattagtgtgcgtttaatgtatacatgtatacaactaatgcaattgccatgaaagagattttgccggcatggttagttactctcgagtatcgaatgatcaaatgaaaattttggaactccatattttgacccaattttgtaagatctcatttttaggattgaaatgcctatcagcaaatcatttcatgtt

SEQ ID NO: 5349 - DNA, 2449 bp, Ambrosia trifida
aataaacaaaaccacacacagatcgtcgttaatggcggtccctatagataataacctcaccaaaccaacgcctccatcttcaaccttacggtttgcgtttggtaatgtcctcgccttcttcattctgttgttgattggagtactcgcattctcgatccgtcttttctcggttattaagtatgaaagtgttattcatgaattcgatccttatttcaattacagagtcactcagttcctcacaaagaatgggatatacgacttctggaactggtttgatgatcgtacttggtatcctcttggacgagtcattggtggaaccgtttatcctgggttgactttgactgctggtaccatatggaaggtgcttcaatccttgaatattcccctgtctgtggaaactgtgtgtgtatttactgccccagtattctctgcctttgcttcatgggcagcatatctcttgactaaggaagttaagggaacaggtgctggactgactgctgcagttcttctggccatggtgccatcctacatatctagatcagtggctgggagctatgacaatgaagctgttgcaatctttgctttaatctttaccttctacctctacgtcaagactttgaacacaggatccctcttctatgcgacattaaattccattgcatacttctatatggtctgctcttggggagggtacactttcatcattaatctcataccgatgcatgtgcttctttgcattgtgactggtcgctattcgtctcggttatacattgcgtatgctccgcttgttgtcttgggaacattattggctgcattggtgcctgttgttggtttcaatgcggtcatgacatcagaacattttgcatcctttttggttttcattgttatccatgtggtggctcttgcatattatatcaaagggatactctctccaaagatgtttaaagtagctgctacacttgtagtatctgttggcctggtggtatgctgtgctgttgtagcagtacttgtagcagtagttgcatctagtcctacaaagggatggagtggacgaagtttgagtcttcttgatccaacttatgcaagcaagtacataccaataattgcaagtgttagtgaacatcaacctcctacgtggccctcttactttatggatcttaatgttttagcattcttggtccctgctggaattattgcatgcttttccccactatctgatgcaagctcctttgtaatcctttacttagtaatgtcggtatatttttctggtgtcatggtacggttaatgcttgtgcttgctcccgctgcatgtataatgtctggaattgctctttcggaagcttttgatgttttcacaagatccattaaattttacatatctaacctatccgagtctctccagattgatgcaggggatactgtacctggtaataatgtttccccgccaagtgatgtgttgaaaaatgacaaaaaagaagacacgttgaaagaacggccttctagaaagaataagaaaaaagaaaaagagaacactgaaaagccggctatcaagtccaaaactgaaaaaaggccactggttttgcctgtcgaagcatccttctttgctcttttcttgactgtgttgttgggtggtttctatgtggtccatagtgtttgggctgctgcagaggcatattcagctccttcaattgtgcttacttctcattcccatgatggacttcatgtttttgatgattttagagaggcctatgcatggctaagtcataacactgaagtagatgacaaagttgcatcatggtgggactatggttaccaaacaaccgcaatggccaaccgtacagttattgttgacaacaacacgtggaacaatacacatattgctactgttggtactgccatgtcatcacccgaaaaggctgcttgggaaattttcaactctttggatgtgaaatacgtgcttgtcgtgtttgggggtcttgtgggctacccaagtgatgacataaataaatttttatggatggtacgtattggaggaggtgtgttcccgcatatcaaggaacctgattatttgagagacggtcaataccgaattgattctcaggccactccaaccatgcttaacagtctcatgtataaactatcgtatttcaggtttgtggaaactgatggtggtaaaggatacgatcgagtaagaaggaccgaaatcggaaggaaacattttaaattaactcattttgaagaggtattcacaactcaccattggatggtccggatttataaattaaaaccacagaaaaacaggatcagagggaagacaaagaagtctaaatcgaaaacaagctccgccacacctagaagtggaacagtgaagaaaaatccatggcattagaacttaatattagttgtgatacagttattattggtagtaacgaactgcgagcatccaagg

SEQ ID NO: 5350 - DNA, 2544 bp, Helianthus annuus
cacacatacagaggtcgttaatggcggttcccgtagatagtctcgcaaaaccaccgcctgcatcgtcaactctacggttcgcgtttggaaatgttctcgcgttcttcattctgttgttgatcggagtgcttgcgttctcgatccgtcttttttcggttattaagtatgagagtgtaattcatgaattcgatccgtatttcaattacagagtcactcagttccttacaaagaatgggatatatgacttctggaattggtttgatgatcgtacctggtatcctcttggacgagtcattggtggaaccgtttaccctgggttgactttgactgctggaacaatatggaaggtgcttcaatccttgaatattcccctgtctgtggaaactgtgtgtgtatttactgcccccgtattctctgcctttgctgcatgggctgcatatcttttgactaaggaagttaagggaacaggtgctggactgactgctgcggttcttctggccatggtgccatcctacatatctagatcagtggctgggagctatgacaatgaagctgttgctatctttgctttaatctttaccttctacctgtacgtcaagactttgaacacaggatccctattctatgcaacattaaactccattgcatacttctacatggtctgctcttggggagggtatacttttatcattaatctcataccgatgcatgtgcttctttgcattgtgactggtcgctattcctctcggttatacattgcctatgctccgcttgttgtcttgggaaccttattggcagcgttggtgcctgttgttggttttaatgcggtcatgacatctgaacattttgcttcattcttggttttcatagttatccatgtggtggctcttgcatattatatcaaagggatactctcaccaaagatgtttaaagtagctgctacacttgtagtatctgttggcctggttgtaggctgtgctgttgtagccgtactagtagcagtagttgcatctagtcctacaaagggatggagtggacgaagtttgagtcttcttgatccaacttatgcaagcaagtacataccaatcattgcaagtgttagcgaacatcaaccacctacatggccttcttactttatggatcttaatgttttagcattcttggtccctgcaggaattatcgcatgctttagcccactatctgatgcaagctcctttgtaatcctgtacttagtaatgtcagtttacttttctggtgtcatggtacggttaatgcttgtgcttgctcccgctgcatgcataatgtctggaattgcactttctgaagcttttgatgttttcacaagatccattaaattttacataactaacctatccgagtccctccagattgatgcaggggatgctgtacctggtaatggtgtttcaccgcaaaacgatgtgttgaaaaatgacaaaaaagaagacacgttgaaagaacgaccttctagaaaaaacaagaagaaagaaaaagagactatagaaaagccatctgtcaagtctaaagctgaaaaaaagccactggttttgcctgtcgaagcatccttctttgctcttttcttgacggtgttgttgggcggtttctatgtggtccatagtgtttgggctgctgcagaggcttattcagctccttcaattgtgcttacttctcattcccatgacggacttcatgtttttgatgattttagagaggcctatgcatggttaagtcataacactgaagtagatgacaaagttgcatcatggtgggactacggttaccaaacaactgcaatggcgaaccgtacagtcattgttgacaataacacgtggaacaacacacatattgctactgttggtaccgccatgtcatcacccgaaaaggctgcttgggaaattttcaactccttggatgtgaaatacgttcttgtcgtgtttggaggtcttgtgggctacccaagtgatgacataaataaatttttatggatggtgcgtattggaggtggtgtgttcccgcatatcaaggagcctgattatttgagagacggtcaataccgaattgactctcaggccactccaaccatgcttaacagtctcatgtataaactatcctatttcaggtttgtagaaactgatggtggtaaaggatacgatcgagtaagaaggaccgaaattggaaagaagcattttaaattaactcattttgaggaggtattcacaactcaccattggatggtccggatatataaattaaaacctcaaaagaacaggatcagagggaagacaaagaagtccaaatcgaaaacaagctccaccaccacacccagaagtggaacaacgaagaaaaatccatggcattagaacttaatattagatgtaatacagttattatttgtagaaacgactgcgagcaacaaaagattttgtagcgaattataaccgtggcaggattttttttaaaccacagtaaaagaaatgtgtagctcagacattttctatttctttaacatgatatcatccttctctt

SEQ ID NO: 5351 - DNA, 2612 bp, Daucus carota
aacgactctactttctctctctccgcaaattgcagagcttgaaattatcatcaatggtggctgcagagaccgcgaaagacaaagctctacgctatgcattcggaaatgtcctctgcttcttcatcctcctcctcatcggcgttctcgccttctcgatccgtatcttctcggttataaaatacgagagtgttattcacgagttcgatccttatttcaattacagagtcactcagtttcttacaaagaacggaatatatgacttctggaactggtttgatgataggacctggtatcctcttggtcgtgtaattggcggaactgtttaccctggattaacgttaacagctggaactttatggtggacattgaatgctttgaacattcctttatcagtggagactgtttgtgtcttcactgctcccatattttctgcttttgctgcctgggcaacctactttttgacgaaggaggttaagggtactggtgcaggacttgctgcagcagctctattggccatggttccatcctatatatcgcgatccgttgctggtagttacgataatgaagctgtagctatatttgccttgatattcactttctatctctatattaagaccttgaatacgggatcacttttctatgctactttaaatgcaatcgcatacttttacatggtctgttcttggggaggatacaccttcataattaaccttattccaatgcacgcgctgctttgcatcgtcactggtcgctattctcctcggctatacatagcgtattgtccacttgtcgttttgggcacattgctagctgctttggttccagttgttggttttaatgctgtcctgacatcggagcattttgcatcttttttggttttcattatcatccatgtggtggcactagcatattatatcaaaggaattctctctccgaagatgtttaaagttgcagttactcttgttgtatctgttgggctggttgtctgttgtggtgtgatagccatacttgttgccctggtagcttccagtcctacaaaaggatggagtggacgcagtttaagcttgcttgatccaacttacgcaagcaagtacataccaatcattgccagtgttagtgaacatcagccacctacttggccgtcttactttatggacataaatgttttagcatttttggttccagctggcatcgttgcatgctttgtgccactatctgatgcaagctcctttgtggtgctttacattgtgacatcagtatatttctctggcgtaatggttcgactaatgcttgtacttgccccagcagcatgtataatgtcgggcattgcactttctgaagcattcagtgtatttacgcgatcaattaaatttcagttgcccggtttgtcgcagagtcaccaaatggatgcaggagatagtgtttctgaaccatctggtgatgtcatccaaaatgatattgtaaaaactgacagacatgatgagccagtaaaggaacgacctacaaggaggaacaagaagaaggaaaaggagaatgtggacaaggcttctaagccctctattaagtcaaagattgaaaataggcttttggttttgcctctagagacatctatcattgctctgtttttactggtgctgctgggtgccttttatgtagttcactgtgtctgggcagcagcagaagcttattcagcaccttctatcgtgctaacgtcacattcgcgtgatggtcttcatgtgtttgatgattttagggaggcttatgcatggctaagccacaatacagatgttgatgataaagttgcatcttggtgggattatggttatcaaactactgctatggctaatcgaactgttattgttgataacaacacctggaacaacacgcatattgcgacagttgggactgccatgtcatctcctgaaaaggcagcttgggaaatatttaactctttggatgtaaaatatgttcttgttgtctttggaggtcttgttggctatcctagtgacgatataaataaattcctgtggatggttcgtataggaggaggtgtgtttcctcacatcaaggaacctgactatctgagagatggccagtatcgaatcgactccgaggcaactcccaccatgttaaattgtctcatgtacaaattatcctattataggtttgtggagacagatggtggtaaagcgtttgacagagtaaggcggactgaaattgggaagaagtatattaaactaactcatttcgaggaggtattcacaactcatcactggatggtacgtatatacaaactgaagcctccgagaaacaggattcggtccaagacaaagaaatctaaatcgaaatctagctcatcagcaaacagagatagaagtgtaaaaaggaagaaaaatccctggcattaactacgaacttcgtattatttatgttgggtattttacatgtaacagatatagatttgtacgcaccgagccagagggatagttcatcagtgttcttgctagcaaaactgatcattccaagttcttaatactactccgatgctgttttcacctgagatgtaactgctgatacatattctaatcagtaaaattaaacaattttgacct

SEQ ID NO: 5352 - DNA, 2608 bp, Medicago truncatula
cttcaccaacgacttttctaccataaacccacagagtcacactccgagagaaagacactcactctcacattttcaatctctcttccgagctcaatctggccgttaatggcggccaccgatgctcaaacctcgctccggcacgcattcggtaacgttctcgcgttcttcattctgatcttgatcggtgttctcgccttctcgatccgtcttttctccgttataaagtacgagagcgttattcatgaattcgatccttacttcaactacagagtcactcagtttttgacaaagaatgggatatatgatttttggaactggtttgatgaccgaacttggtatccccttggccgtgtaatcggtgggactgtctatccaggtttgaccttgacagcaggcaccttgtggtgggtattgaattccttgaacatacctctctcagttgaaactgtttgcgtatttactgcacctatattctcagcctttgcttcgtgggcaacttatctattaacaaaggaggttaagggtgctggagctggcttaacagcagcagttcttctggctatggtcccgtcatatatatctcgatcagtggcaggaagctatgataatgaagctgttgctatatttgctttgatcttcactttctatctctatattaagacactgaatacagggtccctcttttatgcgactttgaactcaatagcatacttctacatggtttgctcgtggggaggatacacttttatcattaaccttattccaatgcatgtattattgtgcatagtaactggccgctattcttctcgactttatattgcatatgcacctcttgttgtattgggcacactgttggctgcattggtacctgttgttggatttaatgctgtaatgacgtccgagcactttgcatcatttctggttttcattctcatccatgtggtggctcttgtatactatattaaaggaatactgtcaccaaaaatgttcaaagtagctgtgacactagttgtatctggtggcctggcagtaggttttgcaatgatagcagtacttgttgcaatggtagctgcaagcccaacaatgggatggagtggaagaagtttgagtctattagatcctacttatgcaagcaagtacataccaatcattgctagcgttagtgagcatcagccccctacttggccttcttactttatggatatcaatgtcttggcatttttggttccagctggcattatcgcatgcttttcacctctatctgatgcaagctcttttgtgatactttatattgttacatcggtgtatttttctggtgtcatggttcgcctgatgcttgtacttgctccagcggcttgcatcttgtctgggattgctctttctcaagcttttgatgttttcactagatcaattaagcttcagctacccagtctatctgttgattctcatgttaatgctggagatgccagttctgaaagtgttgtgccggatgatacggtgaagactgataaaaccgaggacacacataaggaacgaacctcaaagaaaagcaagaagaaggaaaaggaacctgtggaaaagcctcctagcaagtcacaaattaagaaaaggcttttggttttacctctggaaacatccatcattgctattgtcttacttgtgttgctgggtgctttctatgtggttcacagtgtatgggctgcagcagaagcttattcagccccttctatcgttctaacatcacattcgcatgatggacttcatgtttttgatgattttagagaggcttatgcttggttgagtcataacacagaagtagatgataaagtggcatcttggtgggattacggataccaaacaactgcaatggctaaccgaactgttattgttgacaacaatacctggaataacacacatattgctactgttggtactgcaatgtcttctccagaaaaggctgcttgggaaattttcaactctttggatgtcaaatatgttcttgtcgtctttggaggattggtggggtatcccagtgatgatattaataagttcctgtggatggttcgtattggagggggcgtattccctcacataaaggaacccgattacttgagggatggtcaatatcgaattgataatatggccacaccaacaatgcttaactgcctcatgtataaactttcatattacaggtttgtggagacagacggtaaagcttatgacagagtgaggcggacggagattgggaagaaatatttcaaactaacgcattttgaagaggtgttcacaactcaccattggatggtgcggatatacaagttgaaacctccaaagaacaggattcggggaaagactaagaaaacaaaatctaaagcgagctcaaaaaccgtctcaaaaaagcaaggaataaaaaagaaccctttctagtttagttttccgttgctttattagttggtaagcatatttattagcacgcacttcattgtacacatgtatacaactaatagaaaggtcatggagagattttgccggcattgttagttactctctcgagtatcaaatgattaaacaatttttggaattacatgctttctaactgaatggtgaa

SEQ ID NO: 5353 - DNA, 2944 bp, Mimulus guttatus
cccaaagtctgttctatttgctatagcctacaaaaccccgccttcagtctcattttccacacttactgtgcgtttgtttattcgtgaaaaaaaaaaaaatccccaattctcgtacagaaccagagattccgaatcacggccgtcaatggcggcgccggagaatccacaacaacaggctgctactatccgtcacgcattcgggaatgtgctttcgttcctcattctattactcatcggcgttctcgctttctcgatccgtttattttccgtgattaagtacgagagtgtaattcatgaattcgatccttatttcaattacagagtgacgcagtttctcatcaaaagtggagtatatgacttttggaattggtttgatgaccgaacatggtatcctcttggacgtgtgattggtggaactgtttaccctggacttacgttgactgcgggtactttatggaggatattcaacgccttaaacattcctctaacggtggaaactgtttgtgtatttacggctccaattttttcggcttttgctgcgtgggcgacatatctactcacaaaggaagtcaaaggcgttggggctgggttgactgctgcagctcttctagccatggtaccatcttatatctctcgatctgtggctggaagctatgacaatgaagctgtggctatatttgctttgatcatcactttttatctgtacataaagaccttgaacacaggatcccttttttatgctactctcaatgcgatagcatacttttacatggtttgctcttggggagggtataccttcataataaatcttattccgatgcatgtgctgctgtgcattgtaactggtcgctattcttcacgcctctacattgcttatgctccacttgttgtcttgggaacattgttagctgctttggtgcctgttgtaggttttaatgctgtcatgacatcagaacatttcgcatcatttttagtcttcatcattatacatgttgtggctctggtttattatatcaaaggaattctcactccaaaaatgttcagagtagcagttacacttgttgtatcggttgggctgatagtcggttttgcggttttggctgtactgatagcactggtagcttctagcccaaccaaaggatggagtggacgaagtctgagcctgctagatccaacttacgcgagcaagtatataccaattattgctagtgttagtgaacatcagccccctacgtggccatcttacttcatggacctgaatgttttggcatttttagttccagccggcatcattgcatgcttcatgccactctctgatgcaagctcttttgcagttctttacattgttacatcagtatatttttctggtgtcatggtacgtctaatgcttgtacttgctccagcagcttgtataatgtccggaatcgctctttcagaagcttttgatgttctcactagatcaattaaacttcagttgctcgctgccacagaaaacccacagattaatgcaggggatgccactaaagtcaccccaaatgatgcagtgaagactgagaaaagtgaggactcagtgaaggaacgaagttcaaggaaaagtaaaaagaaggaaaaagagaatgtagaaaaagcttcttctgtatcccggaaggaaaagagacttttggtcttacccctggaggcttctatgattgcagttttcttgcttgttttgctcggtgctttctatgtggtccattgtgtctgggctgctgcagaggcttattcggctccatccattgtgctaaccactcgttctaatgacggcggccttcatgtctttgatgacttcagagaggcatatgcttggttgagccataacactgaggtggatgataaagttgcatcttggtgggactatggttaccaaacaactgctatggccaaccgcactgttatcgttgacaataatacctggaacaacacgcatatcgccacagttggtactgccatgtcctctcctgaaaaggcagcttgggaaattttcaactcattggacgtaaaatacgttcttgtagtttttggaggtcttgttggatatccaagtgatgacattaacaagtttctgtggatggttcggataggtggaggtgtatttcctcacataaaggaacctgattatttgagagatggtcagtacagaatcgatgctcaagcaacgccaaccatgcttaacagcctcatgtacaaactttcatattacagatttgtcgagacggatggtagaggctttgaccgggtgagacacactgaaatcggaaagaagcatttcaaacttacccattttgaagaggtattcactacacatcattggatggtccgtctttacaaactgaaatctcccaagaacagaatccgtgggaagaccaagaaatctaaatcgaaagctaccaccacaacaagctcaaaaagaatcggagcaagaaagaagaatccttggcattagctatagctccacaaagaagctatttggtattagctcgactttgtgatatgcgcttatctaggacaatagcagagaaaatatttgcatgcgcggtatgtggctagaatttgagtctttaatatgaagaaaaaatagacaaagcagacgagtaaaagatttttatttaatgttcggatgtatgatagggtgctagtaaagcgacgagaaacaattttgatttgctgtttaagttgacgaggttgtggactgtacaagaattagtttgaactgttcttacatataaaatcatctgactaacattatcttttgattgcgattaattgttcggattttaaatcttaaaagagtttacgaaagtaggagttttaacttttaaactagaaaccctgagttaattttcaagttttcaacatccatacacctttttcgcctattcgaatcaccaagttaaatcggttttgg

SEQ ID NO: 5354 - DNA, 2718 bp, Phaseolus vulgaris
cagacccaatacggtcttttgattctctgcaacccaacacagcttagtcttccccatcggctccgcaacgacttccacagatataaacctcactgagtcacagtgagactctctctctcgctctctgtctcttgttcgctcattttctctctcttcatagctcaatttggccgtcaatggcggcctcagatgctcagaacggcgtgttctccgtcaggcacgccttcggcaacgttctcgcgttctttatccttctcctgatcggcgttctcgccttctcgatccgtctattctcggttattaagtatgagagtgttattcacgagtttgatccttatttcaactatagagtcactcagtttttgacaaagaatgggatatatgatttctggaattggtttgatgaccgaacttggtatccccttggtcgtgtaattggtgggactgtttatcctggtttgaccttgacagcaggcaccttatggtggatactgaattccctaaacatacctctctcagttgaaactgtctgtgtgtttactgctcctatattctcagcctttgcttcatgggcaacttatcttctgacaaaggaggtgaagggtgcgggggctggtttgacagcagcaattcttttggctatggtcccgtcatatatatctcgatcagtggctggcagctatgacaatgaagctgttgctatatttgctttgatcttcactttctatctctatattaagacgctcaatacagggtccctcttttatgccactttgaattccatagcatacttctacatggtttgctcatggggagggtacacttttatcattaatcttattcctatgcatgtgctcttgtgcattgtaactggtcgctattcttctcgactctacattgcatatgcacctcttgttgtattgggtacactgttggcttccttggtgccagtggttgggtttaatgctgtaatgacatcagagcattttgcatcatttctggttttcattatcatccatgtagtggctctggtgtactatattaaaggaagtctttccccaaaaatgttcaaagtagctgtggcactagttgtttctgttggcgtggctgtgtgctttgcaatggtggcagtacttatagcattggtagcctcaagcccaacaaagggatggagtggaagaagtttaagtctgctagatcctacttatgcaagcaagtatattccaatcattgctagtgttagtgagcatcagccacctacttggccttcatacttcatggatatcaatgtcttggcattcctggttccagctggaattattgcatgtttctctcccctatctgatgcaagctcctttgtggtactttatattgttacatcggtatacttttctggagtcatggttcgcttgatgcttgtacttgctccagcagcatgtatattgtctgggattgctctctcccaggcttttgatgtttttacaagatctatcaagtttcagttgcccagcctatcagataattctcaggcaggggaaggcagttctgaaaatgttgtgccaaatgattcggtgaaggcagataaaactgaggacacttcaaaggagcgaacctctaagaagagcaagaagaaggaaaaggaacctgtggaaaagcctcttagcaagtcccaaattaagaaaaggcttttggttttacctctggaaacatccgtcattgctattatcttgcttgtgttgctaggggccttctatgtggttcacagtgtatgggcagcagcagaagcttattcagccccttctattgttttaacatcacattcacacgatgggcttcatgtttttgacgattttagagaggcatatgcttggctgagtcacaatacagaagtagatgataaagtggcatcttggtgggactatgggtatcaaacaactgccatggctaaccgaacagtcattgttgacaataacacctggaataacacacatattgctactgttggtactgcaatgtcttctccagagaaggcagcttgggaaattttccagtcactggatgtcaaatatgtccttgttgtcttcggaggactggttggttatcccagtgatgatatcaataaattcctgtggatggttcgaatcggagggggtgtattccctcacataaaggaaccagattacttaagggatggtcaatatcggattgattccatggccacaccaacaatgctaaactgtctcatgtataaactttcatattacaggtttgtagagacagatggtaaggctttcgacagagtgaggcggacagaaattggaaagaaacatttcaaacttacgcattttgaagaggtcttcacaactcaccattggatggttcggatatacaagttgaaatcaccaaagaacaggattagaggaaagactaaaaagtcgaaatcgaaaacaagctcgaaaactgcctcgaaaagaaatgaactaaaaaggaatcccttttagtttattttttttcatttctttgggtaggggtaagcttattttagtgtgcgtttaatgtatacagctaatgcaattgccttggaagagattttgccggcattgttagttactcttgagtatcgaatgaccaaatgaaaattttgaaactccacattttgacccaattttgtaatatctaatttttaggattgaaatgccaatcagcaaaatgatttca

SEQ ID NO: 5355 - DNA, 2707 bp, Fragaria vesca
tcgtctctgcaattctctctcgctcgttgaggtcgtcaatggaggcctccgagacctccagcggtaaaaccttgaggaatgccttcggtaatgtcctcgctttcctcatcctcatcctgatcggcgttctcgctttctcgatccgtctcttctccgtgattaagtacgagagtgttattcacgagtttgatccttatttcaattacagagtcactcagtttctgacgaagaatggaatatatgacttttggaattggtttgatgatcggacctggtatcctcttggtcgtgtgattggtggaactgtttaccctggattgaccttgacagcaggaaccttatggtggttgttgaattcattaaatattcctctttctgtggaaactatttgtgtttttactgcgcctatattctctgctttcacatcctggtcaacttaccttctgactcgggaagttaagggcactggtgctggactaacagctgcagctcttattgctatggtcccatcatatatttctcggtctgtagctggaagctatgacaatgaagctgtggctatttttgctttgatcttcactttctatctttatataaagacactgaatacaggatccctcttttatgcaactcttaattctctagcatacttttacatggtttgctcttggggaggctacacatttattatcaatcttattccaatgcatgtgcttatgtgcattgtaactggtcgatactcatcacggctgtacattgcctatgctcctcttgttgtcttgggaacactattagctgctttggtgcctgttgttggattcaatgcagtcatgacatcggaacattttgcatccttcttggtttttattattatacatgtggttgcatttgtgtactatatcaaaggggttctttctcctaaaatgttcaaagttgctgtgacacttgttctgtctattggcctggtagtatgctgtgctgtgatagcagtactggtagctttggtagcttcaagcccgacaaaggggtggagtgggcgaagtctaagtctacttgatccaacctatgcaagcaagtacataccaattattgctagtgttagtgaacatcaacctcctacttggccctcgtacttcatggacattaacgtgttggcattcttagttccagctggcataattgcatgcttttcccccttatcggatgcaagctcttttgtcatcctttatattgtaacatccgtttatttctctggagttatggtgcggcttatgttggtgcttgctccagcagcatgcattacctccggaattgctctctctgaagcttttgaagttttcacacgatcaatcaagtttcagttacctggtttaccaggactttcaccagttgaggcagaggagaccagtactgatagcactgtaccactgaatgaagtgcctaagacggataaaggtggggagacattaaaggagagaccctcaagaaagaacaggaagaaggaaaaagaaccagtagaaaagccttcgatcaaagctcgaattgaaaagaagcttctggttttaccttttgagggatcaattcttgctatttttctacttgtgctgctgggtgccttctacgtggttcattgtgtctgggcggcagcagaagcgtattcagccccatccattgttcttacatctcattcacatgacggtctccatgtttttgatgattttagagaggcttatgcatggctaagccacaatactgaggtggatgataaagtcgcatcttggtgggattatgggtaccaaaccactgccatggctaaccgcactgtcattgttgacaataatacctggaacaatactcatattgcaacagtcggtactgccatgtcttctccagaaaaggctgcatgggaaattttcaactcgttggatgtaaaatatgttcttgttgtatttggaggtcttgttgggtaccccagtgatgatatcaataaattcctgtggatggtccgtatcggaggtggtgtatttcctcatatcaaggaacccgattacttgagagatggtcagtatcggattgacaaccaggccacccctaccatgctaaattgtctcatgtacaagctctcttattacaggtttgtggacacggatggtaaaggcttcgatagggtgaggcgaacagaaattggaaagaagtatttcaaacttacccattttgaagaggtatttacaactcaccattggatggttcggatatacaaactaaaaccgccaaagaaccggatccgaggaaagactaagaaatcaaaatcgaaatcaacctcaacgagtagcggaaaaagtagtggaactagaaagaacccatggaactgaaagtcgtctatttctagcttatattatctgtaccttcatatgtatacaaaaagcgagggcctctagaggcagagaaaccatagtggcatttcttacgaatttcaaatgacacaaaattttgcgacgcttcagatgatttttgttttgtactcttttagagcataatcagtgttagatgaaaggactgcgaaaaacgaaaaaccagcttatctgcgatgagtcaatttggtagttcaaatgaaagcatccagagtttgagttgtatgaagagctcaacatgccctggctagacaacaatggttccttttgccaaataatgcaaagtaatcttgaca

SEQ ID NO: 5356 - DNA, 2636 bp, Trigonella foenum-graecum
cccactcttgtttcttcatcaacgacttttctactgtaaacccacagagtcacactccgagacagagaatcacactctctctcattctctatccttttccgagctcaatctggccgtcaatggcggccaccgatgctcaaacctcgctccgccacgcattcggcaacgttctcgcgttcttcatcctgatcttgatcggtgttctcgccttctcgatccgtcttttctccgttataaagtacgagagcgttattcatgaattcgatccttatttcaactacagagtcactcagtttttgacaaagaatgggatatatgacttttggaactggtttgatgacagaacttggtatccccttggtcgtgtaattggtgggactgtctatcctggtttgaccttgacagcaggcaccttgtggtgggtattgaattccttgaatatacctctctcggttgaaactgtttgtgtatttactgcacctatattctcagcctttgcttcatgggcaacttacctattaacaaaggaggttaagggtgctggagctggcttgacagcagcagttcttttggctatggtcccgtcatatatatctcgatcagtggcaggaagctatgataatgaagctgttgctatatttgctttgatcttcactttctatctctatattaagacactgaatacagggtccctcttttatgccactttgaactcaatagcatacttctacatggtttgctcgtggggaggatacacttttatcattaaccttattccaatgcatgtactattgtgcatagtaactggtcgctattcttctcgactttatattgcatatgcacctcttgttgtattgggcacactgttggccgcattggtacctgttgttggatttaatgctgtaatgacgtcagagcactttgcatcatttctggttttcattctcatccatgtggtggctcttgtatactatattaaaggaatactgtcaccaaaaatgttcaaagtagctgtgacactagttgtttctggtggcctggctgtatgttttgcaatgatagcagtacttgttgcaatggtagcttcaagcccaacaatgggatggagtggaagaagtttgagtctattagatcctacttatgcaagcaagtatataccaatcattgctagcgttagtgagcatcagccccctacttggccttcttactttatggacatcaatgtcttggcatttttggttccagctggcattatcgcgtgtttttcacctctatctgatgcaagctcttttgtgatactttatattgttacatcagtgtatttttctggtgtcatggttcgcctgatgcttgtacttgctccagcggcgtgcatcttgtcagggattgctctttctcaagcttttgatgttttcactagatcaattaagcttcagctacccagtctattagttgattctcctgttaatgttggagatgccagttctgaaagtgttgtgccggatgatacggtgaagactgataaaaccgaggacacacataaggaacggacctcaaagaaaagcaagaagaaggacaaggaacccgtggaaaagcctcctagcaagtcacaaattaagaaaaggcttttggttttacctctggaaacatccgtcattgctattttcttacttgtgttgctgggtgctttctatgtggttcacagtgtatgggctgcagcagaagcttattcagccccttctatcgttctaacatcacattcacatgatggacttcatgtttttgatgattttagagaggcttatgcttggttgagtcataacacggaagtagatgataaagtggcgtcttggtgggattacggataccaaacaactgcaatggctaaccgaactgttattgttgacaataatacctggaataacacacatattgctactgttggtactgcaatgtcttctccagaaaaggctgcttgggaaattttcaactctttggatgtcaaatatgttcttgttgtctttggaggattggtggggtatccaagtgatgatattaataagttcctatggatggttcgtatcggagggggtgtattccctcacataaaggaacccgattacttgagggacggtcaatatcgaattgataatatggccacaccaacaatgcttaactgcctcatgtataaactttcatattacagatttgtggagacagacggtaaagcttttgacagagtgaggcggacggagattgggaagaaatatttcaaacttacgcattttgaagaggtgttcacaactcaccattggatggtgcggatatacaagttgaaacctccaaagaacaggattcggggaaagactaaaaaaacaaaatctaaagcaagctcaaaaactgtctcgaaaaggcaaggaataaaaaggaaccctttttagtttagttttccgttgctttattagttggtaagcatatttattagcacgcacttcattgtacacacatgtatacaactaagagaaaggtcatggagagattttgtcggcattgttagttactctcttgagtatcaaatgatcaaacaatttttggaattacatgttttctgactgaatggtgaagatctcattttt

SEQ ID NO: 5357 - DNA, 2796 bp, Citrullus lanatus
cggagttggactcggggacttaccttgggaacccatgtttgcaaagtcgtctgtatctctctggttctcctccagttgagttgcgacctactctcctttcccggtctctcctctgacagacactcactctcaaacctctctctggccgtcaatggcggcttcagttccctccaagggatcaaccctaagggacgcatttggaaatgttctttccttcttcattctcatcttgatcggcgtcctcgcattctcaattcgccttttctctgtgataaagtatgagagtgttattcacgaattcgatccttatttcaattacagagttacccagtatctttcaaagatgggaatttatgaattttggaactggtttgatgatcggacctggtatcctctaggacgagtaattggtggaactgtttatcccggtctcacattaactgcaggcacattatggcgggtattgaatgccttgaacattcctttatctgtggaaactgtctgtgtattcactgcacccgtattctctgcttttgcttcatgggcaacttacctgttaacaaaggaagttaaaggtcctggtgctggactgacagctgctgctcttttggccatggttccatcatatatatcgcgatctgtggctggcagctatgacaatgaagctgtagctatatttgctctgatcttcactttctatctttatttaaagacattgaatacaggatcccttttctatgctactttaaatgcccttgcatatttctacatggtttgctcttggggaggttacacattcattattaatcttattccgatgcatgcacttctgtgcattgtaactggacgctattcttctcgattgtacattgcatatgctccttttgttgtcttgggaacactattggctgcactggtaccagttgttggatttaatgcagtgatgacatcagagcattttgcatcatttttggttttcatcattatccatgtggtggctcttgtttattatatcaaaggaactctctcccagaaaatgtttaaagtagctgtcactctcgtagtatctattgggctggcagtttgctgttcagtcattgcggttcttatagctcttgttgcttcaagcccaaccaaggggtggagtgggcgtagtttgagtcttctagatccaacttatgcaagcaagtacataccaataattgctagtgttagtgagcatcaaccacctacttggccttcttactttatggacatcaacgttttggctttcctggttccagccggtattattgcatgcttttcgccattatctgatgctagctcatttgtagtcctctacattgctacagcagtgtacttctctggagttatggtgcgtcttatgcttgtacttgccccagcagcatgcattatgtctggaattgcactttctcaagcctttgaagtttttactcggtctattaagtttcagatgcctggtgaagcgccagatgcacaagaagtgggagaaacgatctctgatggtgttgtaatacaacatgatgtggttaagcctgaaaaaagtgaagatacagttaaagaacggccctcaaaaaagaatagaaaaaaggaaaaggaaccagttgaaaagccttccgtcaagtcacaaattcgtaaaaggctgctagttctaccttttgcaacatctattattgctcttttcttacttgttttgctgggcgccttttatgtggttcattgcgtctgggcagctgcagaagcttattcagccccttctattgttttaacttctcactcccgtgatggtctccatgtttttgatgactttagagaagcttatgcatggttaagccacaacactgaggttgatgataaagttgcatcatggtgggattatggctatcaaactactgctatggctaatcgtacggtcattgttgacaataatacctggaacaatacccatattgcaaccgttggtactgctatgtcttctcctgaaaaggcagcctgggaaattttcaactccctggatgtaaaatatgtgcttgttgtctttggaggtcttgttgggtacccaagtgatgatatcaataagttcttgtggatggttcgtataggaggtggtgtatttcctcatatcaaggaaccggattacctaagagatggtcagtatcgcattgattctcaggccactccaacaatgctaaattgtctcatgtacaaactctcgtactacaggttcgtggagacagatggtaaaggatttgatagggtaaggcagacagaaattgggaagaaatattttaaactttcacattttgaagaggtattcaccactcaccattggatggtaagaatctacaaactgaaacctccaaagaacagaatcaggggaaaaaccaaaaaatcaaagacgaaatccagctcaactaccagttcgaaaagaaaaggaacaaaaaagagaaatccttggcactgaaagatcagctgacgacgggataccgttcaaaaagcatgtaagctacatatataattgacaaccttggcaggtaccttttgaggcatagtgataattttcttgcggacgtcgaaattttgtagtcttatcatatatttttccctttccttatgccacattttattaggatctaattgaaatatcaggccgacagatctttttacgcactttctgggcatttattcatcaaatttctccttgtctcttgggtgttagctcacgaagaaccatcttttacctagttagatatgcctaaccagaacaatttcttt

SEQ ID NO: 5358 - DNA, 2712 bp, Panax ginseng
aagcagtggtatcaacgcagagtacgcggggacagccacagggactgaagacctacaaaaaccccactcccccaaccaaacacactctctctactatttccagagattggtttggccgttaatggcggccttagagaactcgaaagattcagctctacgcttcgcatttggaaatgttctatcgttcttcatcctcctcttgatcggtgtgctcgcattttcgatacgccttttctcggttattaaatatgagagtgttattcatgagttcgatccatatttcaattacagagtcacccagtttctcacaaagaatggaatatatgacttctggaattggtttgatgaccggacatggtatcctcttggtcgtgtgattggtggaactgtttaccccggattaacattgactgcaggtaccttatggtggatattgaattctttgaatattcctttatctgtggaaactgtttgtgtcttcactgctcccatattctctgctaatgctgcatgggcaacttttttttgacgaaggaggttaagggcactggtgcaggactcactgcagcagctctattgggcatggttccatcctatatatcccgatctgtggctggaagctatgataatgaagctgtagctatatttgctttgatcttcactttctatctttatatcaagacattgaatacgggatcccttttctatgctactttaaatgccatagcatacttttacatggtctgctcttggggaggatacacctttattattaacctcataccaatgcatgttcttctttgtattgtgactggccgctattcttctcggttatacatagcgtatgctccatttgttgttttaggaacactgctagctgcattggttcccgttgttggtttcaatgcagtcctgacatcagaacattttgcatcatttctggttttcattattctccatgtggtagcttttgcatactatatcaaaggaattctttctccaaaaatgtttaaagtagcggttactcttgttgtatctgttggactggttgtatgttgtgctgtgatagctgtacttgtggcactggtagcatctagtccaacaaagggatggagtggacgaagtttaagcttgcttgacccaacttatgcaagcaagtacataccaatcattgctagtgtcagtgaacatcaaccacctacttggccgtcttactttatggacatcaatgttctggcattcttggttcctgctggtattattgcatgctttttgccgctatctgatgcaagctcctttgtggtcctttacattgttacatcagtatatttctccggtgtgatggtgcgtctaatgcttgtacttgctccagcagcatgcatattgtctggtattgctctttctgaagctttcacggtttttacacgatcaatcaaatttcagttacctggcgtatcacaaaatcttcagatagatgcgggggaaactggttctggtgatgttatccaaaatgatgctgtgaaaactgataaaagtgacgagccttcaaaggaacgaccttcaaagaggagcaagaagaaggaaaaggagaatgcggaaaaagtttctaaaccttctattaagtcaaagattgagaagaggcttctggttttacctctggagtcgtctatcattgctcttctcttactggtgttgctgggtgccttttatgttatccactgcgtctgggcagcagcagaagcatattctgccccttcaatagtgctaacctctcagtctcgtgatggtcttcatgtgtttgatgattttagagaggcttatgcatggctaagtcacaatacggaggtggatgataaagttgcgtcttggtgggattatggttatcaaactactgctatggctaatcgcactgttattgttgacaataatacctggaacaacacacatattgcaactgttgggactgccatgtcttctcctgaaaaggcagcttgggaaatttttaactctttggatgtaaaatatgttcttgttgtctttggaggtcttattggttatcctagtgatgatataaataagttcctctggatggttcgtataggagggggtgtattccctcacatcaaggaacctgattatctgagagatggtcagtaccggattgattctcaggccactccgacaatgttaaactgcctcatgtacaaactatcatactacaggtttgtggagacagatggtggtaaagggtttgacagagtaagacggactgaaatcggaaagaaatattttaagttaacctattttgaggaggtattcacaactcatcattggatggttcggatatacaaacttaaacctccaagaaacaggatgcgatcaaagataaagaagaaaactagttcaacgacaagcttaaaaacaagtggagcaagaaagagaaatccttggctttaaatactaggcaatttatgtcaggtcagttatatgtaatagatatagatttgtatgtttgagcctcttcagaaggattatgcgggataagttaatcaactttcttacagaaatgaaaaggattagttcaagattttgcactctattctgacactgtaatttctcttactttgttacatttgacgcattgtatccagtagagcaaaatcaaacaattttgagccaagatttaatgatttataatataaataataattt

SEQ ID NO: 5359 - DNA, 2726 bp, Cannabis sativa
acaagtctcctcctcgtttactcgtaccctgcaaaaccccttcactctctttctccctctactcttccaaagacgtaactcagagctctattttggccgtcaatggcggcctcggagacctcctcggggattgttttaaggaacgctttcggaaatgtcttctctgtcttcatcctcatcttgatcggtgtcctggcattctcgatccgactcttctctgtcattaagtatgagagtgtaattcacgagttcgatccttatttcaattacagagtcacacagtttctgacaaagagtggaatatatgaattctggaactggtttgatgatcggacatggtaccctcttgggcgtgtgattggtggaactgtttacccaggattgaccttgacagcaggatctatatggtggtttgtgaattcattaaacattccactgactgttgagactgtttgtgtatttactgcgcccatattttctgcttttgcttcctgggcaacttttcttctcactaaggaagttaaaggtactggtgctggactgactgctgcagctcttttggcaatggttccatcatacatatcacgttctgtagctggaagctatgacaatgaagctgtggccatattcgctttgattatcactttctatctttatataaagacattgaatacaggatctctcttttacgctacattaaactccatagcatacttttacatggtttgctcttggggaggctacacctttataattaatcttattccgatgcatgttcttctttgcattgtgactggtcgctactcatcccggttgtacattgcttatgctcctcttgttgtcttgggaacattactagctgctttggtgcctgtagttggatttaatgcagtcatgacatcagaacattttgcatccttcttggttttcattattatccatgtggtggctcttgtttattatattaaaggtcttctgtctgcaaaaatgttcaaagttgctgtcacactcattctgtctcttggcctggtactctgttttgctgtagtagctatacttgtagctctggtagcttctagcccaacaaaaggatggagtggaagaagtcttagtctacttgatccaacatacgcaagcaagtacattccaattattgctagtgttagtgagcatcaaccaccaacttggccttcttactttatggatattaatgttttagcattcttggttcctgctgggattgttgcatgcttctcacctctatctgatgcaagctcttttgtgatcctctatatagtaacatcagtttacttttctggagtcatggtgcgccttatgctagtatttgccccagcagcttgcatcttgtctggcattgctctctctgaagcttttgaagtttttacacgatcaataaagttccagttgcctggatcatcaatgaaaccccaaattgatgcagcggagacgagctctgttagtgtcataccagagaacgatgtggcaaaaactgataaaactgaagatacattaaaggaacgaccatcaagaaagaacaggaagaaagataaagaatctgtagctgctgtggaaaagccatctatcaagtctaaaattgagaagaggcttctggttttaccttttgaggcatctatcatagcaattttcttgcttgttttgcttggtgccttctatgtggttcattgtgtctgggcagcagcagaagcgtattcagccccatccattgttctaacatctcattcccacgatggtcttcatgtttttgatgattttagagaggcttatgcatggctaagccacaacactgaggtggatgataaagttgcatcttggtgggattatgggtaccagactactgcaatggctaaccgcaccgtcattgttgacaataatacctggaataacacacatattgcaactgttggtactgccatgtcttctcctgaaaaggcagcttgggaaatctttaactccttggatgtaaaatatgttcttgtggtttttggaggtctcgttggctaccccagtgatgacatcaataagttcctgtggatggttcgtattggtgggggtgtcttccctcacatcaaggagcctgattatctaagagatggtcagtatcgtatcgattctcaagcaactccaactatgctaaattcgctcatgtacaaactctcgtattacagatttgtggaaacagatggtaagggctttgatagagtgaggcggacagagattggaaagaaatatttcaaacttacccattttgaagaggtcttcacaactcaccattggatggtccggctatacaaactaaaacctccaaagaacaggattcgaggaaaaactaagaagtctaaaaaacttacaggtacaactcctaaaagaagcggagctggaaagaaaaatccttggctatgaaaattgagtagtcctcaacgtaattcgaagttcgggttacctgtaattccttacttataaacgagagagccttttagagagattgtggaggtgtagtggttaattttttacgatgatgctaattatagacaacgattttgcaggctcagtcacctggttttgtatctttttttgactcatcgttgggttaaagaaaaaagaaagaaaaaaagagaaccatttttgttttacttttcttttaatatattaatttaaaagggtccaactccaataagtttgaaaat

SEQ ID NO: 5360 - DNA, 2505 bp, Glycine max
cactctctctctcttcctctctctctcttcggagctcaatttggccgtcaatggcggcctccaatgctcacaacggcaccaccaccaactccatcaggcacgccttcggcaacgtcctcgcgttcttcatccttctcctcatcggcgttctggccttctcgatccgtctcttctccgttataaagtatgagagtgttatccacgagtttgatccttatttcaactatagagtcacccagtttttgacaaagaatgggatatacgatttctggaactggtttgatgatcgaacttggtatcccctcggtcgtgtaattggtgggactgtctatcctggtttgacgttgacagcaggcaccttatggtgggtactgaattccctaaacatacctctctcagttgaaactgtttgtgtgtttactgcacctatattctcagcctttgcttcatgggcaacttatcttctgacaaaggaggttaagggtgcgggggctggcttgacagcagcagttcttctggctatggtcccttcatatatatctcgatcagtggctggcagctacgacaatgaagctgttgctatatttgctttgatattcactttctatctctatattaagacactcaatacagggtccctcttttatgccactttgaattccatagcatacttttacatggtttgctcatggggagggtacacttttatcattaatcttattccgatgcatgtactcttgtgcatagtaaccggtcgctattcttctcgactgtacattgcatatgcacctcttgttgtattgggaacattgttggctgccttggtgcctgtggttgggtttaatgctgtaatgacatcagagcattttgcatcatttctggttttcattatcatccatgtagtggctcttgtgcactatatcaaaggaattctttcaccaaaaatgttcaaagtagctgtggcactagttgtttctgttggccttgcagtgtgttgtgcaatggtggcagtacttgtagcattggtagcttcaagcccaacaaaaggatggagtggaagaagtttaagtctgcttgatcctacttatgcaagcaagtatataccaatcattgctagtgttagtgagcatcagccacctacttggccttcatactttatggatatcaatgtcttggcattcctcgttccagctggcattattgcatgcttttctcccctatctgatgcaagctcctttgtggtactttatattgttacgtcggtatacttttctggagtcatggttcgcttgatgcttgtacttgctccagcagcatgtatcttgtctgggattgctctttctcaggcttttgatgttttcacaagatctattaagttgcagttgcccagcctattgggtcattctcacgttgatgcaggggaagccagttctgaaagtgttgtgacaaatgattcgatgaagtctgataaaagtgaggacacatcaaaggaacgaacctcaaagaagagcaagaagaaggaaaaggaacctgtggaaaagcctccgagcaagtcacaaattaagaaaaggcttttggttttacctctggaaacatccatcattgctattgtcttgcttgtgttgctaggtgccttctatgtggttcatagtgtatgggcagcagcagaagcttattcagccccttctattgttctaacatcacattcacatgatggacttcatgtttttgacgattttagagaggcttatgcttggctgagtcataatacagaaatagatgataaagtggcttcttggtgggactatggctaccagacaactgccatggctaaccgaactgtcattgttgataataatacctggaataacacacatattgctactgttggtactgccatgtcttccccagagaaggcagcttgggaaattttccactcattggatgtcaaatatgttcttgttgtctttggaggactggttggctatcccagtgatgatatcaataagttcttgtggatggttcgtattggagggggtgtattccctcacataaaggaaccagattatttaagggacggtcaatatcggattgattccatggccacaccaacaatgctaaactgcctcatgtataaactttcatattacagatttgtggagactgatggtaaagctttcgatagagtgaggcggactgaaattgggaagaaatatttcaaacttacgcattttgaggaggtgttcacaactcaccattggatggttcggatttacaagttgaaaccaccaaagaaccggattcgaggaaagattaaaaaatcaaaatctaaagcaagctcaaaaactacctcgaaaagaaaaggattaaaacggaaccccttttagtttagattttcgtttcttttagtaggtgactttatttcttagctgcgtttcatgtatacatgtatacgactaatgcaattgccatgatagggattttgccggcattattagttacttt

SEQ ID NO: 5361 - DNA, 2620 bp, Glycine max
cacactgcgactcagaagaaacgcactctctctctcttcctctctctctcttcggagctcaatttggccgtcaatggcggcctccaatgctcacaacggcaccaccaccaactccatcaggcacgccttcggcaacgtcctcgcgttcttcatccttctcctcatcggcgttctggccttctcgatccgtctcttctccgttataaagtatgagagtgttatccacgagtttgatccttatttcaactatagagtcacccagtttttgacaaagaatgggatatacgatttctggaactggtttgatgatcgaacttggtatcccctcggtcgtgtaattggtgggactgtctatcctggtttgacgttgacagcaggcaccttatggtgggtactgaattccctaaacatacctctctcagttgaaactgtttgtgtgtttactgcacctatattctcagcctttgcttcatgggcaacttatcttctgacaaaggaggttaagggtgcgggggctggcttgacagcagcagttcttctggctatggtcccttcatatatatctcgatcagtggctggcagctacgacaatgaagctgttgctatatttgctttgatattcactttctatctctatattaagacactcaatacagggtccctcttttatgccactttgaattccatagcatacttttacatggtttgctcatggggagggtacacttttatcattaatcttattccgatgcatgtactcttgtgcatagtaaccggtcgctattcttctcgactgtacattgcatatgcacctcttgttgtattgggaacattgttggctgccttggtgcctgtggttgggtttaatgctgtaatgacatcagagcattttgcatcatttctggttttcattatcatccatgtagtggctcttgtgcactatatcaaaggaattctttcaccaaaaatgttcaaagtagctgtggcactagttgtttctgttggccttgcagtgtgttgtgcaatggtggcagtacttgtagcattggtagcttcaagcccaacaaaaggatggagtggaagaagtttaagtctgcttgatcctacttatgcaagcaagtatataccaatcattgctagtgttagtgagcatcagccacctacttggccttcatactttatggatatcaatgtcttggcattcctcgttccagctggcattattgcatgcttttctcccctatctgatgcaagctcctttgtggtactttatattgttacgtcggtatacttttctggagtcatggttcgcttgatgcttgtacttgctccagcagcatgtatcttgtctgggattgctctttctcaggcttttgatgttttcacaagatctattaagttgcagttgcccagcctattgggtcattctcacgttgatgcaggggaagccagttctgaaagtgttgtgacaaatgattcgatgaagtctgataaaagtgaggacacatcaaaggaacgaacctcaaagaagagcaagaagaaggaaaaggaacctgtggaaaagcctccgagcaagtcacaaattaagaaaaggcttttggttttacctctggaaacatccatcattgctattgtcttgcttgtgttgctaggtgccttctatgtggttcatagtgtatgggcagcagcagaagcttattcagccccttctattgttctaacatcacattcacatgatggacttcatgtttttgacgattttagagaggcttatgcttggctgagtcataatacagaaatagatgataaagtggcttcttggtgggactatggctaccagacaactgccatggctaaccgaactgtcattgttgataataatacctggaataacacacatattgctactgttggtactgccatgtcttccccagagaaggcagcttgggaaattttccactcattggatgtcaaatatgttcttgttgtctttggaggactggttggctatcccagtgatgatatcaataagttcttgtggatggttcgtattggagggggtgtattccctcacataaaggaaccagattatttaagggacggtcaatatcggattgattccatggccacaccaacaatgctaaactgcctcatgtataaactttcatattacagatttgtggagactgatggtaaagctttcgatagagtgaggcggactgaaattgggaagaaatatttcaaacttacgcattttgaggaggtgttcacaactcaccattggatggttcggatttacaagttgaaaccaccaaagaaccggattcgaggaaagattaaaaaatcaaaatctaaagcaagctcaaaaactacctcgaaaagaaaaggattaaaacggaaccccttttagtttagattttcgtttcttttagtaggtgactttatttcttagctgcgtttcatgtatacatgtatacgactaatgcaattgccatgatagggattttgccggcattattagttactttcttgagtaatgaatgatgaaacaaaaaattttgaaactatatattttgactgaatgtttaagatctcatttttatgattgaaatgcgtttca

SEQ ID NO: 5362 - DNA, 2606 bp, Valeriana officinalis
cggagcacactcgtactgagtcgtgacctacatataaaatcctctctcactttctcacttcagagctcgatttgatcatcaatggctgcattagagaccgcgaaggattcaactcttcgttacgcttttggaaatgttctagcatttctcatcctccttctcatcggcgtgctcgcattttcgatccgtttgttctctgttatcaagtatgagagcgtaattcacgagtttgatccttatttcaattacagagtcactcagtttctgataaagaatggaatatatgacttctggaactggttcgatgataggacctggtaccctcttgggcgtgttattggtggaacagtttatcctggattaacattgacggctggcacattgtggtgggtacttaattccttgaacattcctctatctgtggaaactgtatgcgtatttactgctccaatattttctgcttttgctgcatgggcaacatacctcctgactaaggaagtcaagggcacaggggctggattgacggcagccgttcttttggccatggtgccgtcctatatatcgcgttctgttgctggaagctatgataatgaagcagtagctatattcgctctgatcttcactttctatctctatatcaagacactgaatacaggatccctcttcttcgctactttaaatgccatggcatacttctacatggtttgctcttggggtgggtacacttttatcatcaacctcattccaatgcacgcacttctatgcattgtaactggtcgctactcttcacggttgtacatagcatatgctccccttattgttttagggacgttattagccgcattggtgcctgtagttgggtttaacgcagttttgacatcagaacattttgcatcatttctggttttcattattatccatgtggtagctcttgcttactacatcaaaggaatgctcactccaaaaatgtttaaagtggcggttacacttgttgtatctgttggcctgttagtatgttgtgctgtgatagcagtacttgtagcattggtagcttctagtccaacaaaggggtggagtggacgcagtctaagtctgcttgacccaacttatgcaagcaagtatataccgattatcgcaagtgtcagtgaacatcagccacctacatggccttcatactttatggacatcaatgttcttgcattcttggtgccagccggcattgttgcttgctttttaccgctgtctgatgccagctcatttgtggttctttacatagtaacatctgtatacttctctggagtcatggtgcgtttaatgcttgtacttgctccagcagcatgtataatgtcgggtattgctctttccgaagcatttgctgttttcacaagatcagtcaaattccaactacctggtgcagcacagatttctgaagttaatgcaggggatactggctcggatagtgttattgcgcaaagcgatgtagtgaagactgataaagtcgaagatataccaaaagaacggccttcaaggaaaaacaagaaaaggaaaaacaagaaaagaaagagaggttactgaaaaggctcctgttaagaaacaagttcagaagaagcttctggttttacctatggaggcatctattattgctctactcttacttgtgttgcttggtgccttttatgttatacattgtgtatgggcagcggcagaagcatattcagcaccctctattgttctaacctctcaatcacatgatggccttcatgttttcgatgattttagagaggcttatgcgtggttaagccacaatactgaagtcgatgataaagttgcatcttggtgggattatggctaccaaaccacagcaatggctaaccgaactgtcattgtcgacaataatacatggaacaatacacatattgcaactgtcggtacagccatgtcatcgcctgaaaagcctgcctgggaaatttttaattctttggatgttaaatacgttcttgtcgtcttcggaggacttgttgggtaccctagtgatgatattaataagtttttgtggatggttcgaattggaggaggtgtctttcctcatatcaaggagcctgattatctgagagacggccagtacaggatcgataatcaagctactccaacaatgcttaactgcctcatgtacaaactctcatattacagatttgtagaaactgatggcaaaggattcgatagagtaaggaggactgaaatcggaaagaaaagatttaaacttactcattttgaagaggtatttacaacgcatcattggatggttcggatatacaaactaaaagctccgaagaacagaatcaggggaaagataacaaaatctaaattgaaatctagctcgaatacaaaaagaagcggaaacaaaaaagaaaatccatttaactagaagaatctttgagataccaatatggcattgattcattcgaggtcagttatctgtagttacagtttttatatgtatttgtacgcagagcctcttgagaggaattccgccgaattaatttagcaaacttccttaaaatagaaactcatcaaaatccatctttggataagtagccgatagaaca

SEQ ID NO: 5363 - DNA, 2325 bp, Manihot esculenta
tcactctctctctcaatggcggacccagagaacgccataggggcaacgactctgcgatatgcttttggcaatgttctctccttcttcatccttctcttgatcggagttctcgccttctcgatccgtctcttctctgtcataaagtacgagagtgttattcatgagtttgatccttatttcaattacagagtcacccagtttttaacgaagaatgggatttatgacttttggaattggtttgatgaccgaacctggtatcctcttggtcgagtgattggtggaactgtttatcctgggttgaccttgactgcaggcaccctatggtgggcattgaattctttgaatattcctttgtccgttgagactgtttgtgtattcactgcaccaattttctctgcatttgcttcatgggccacttatcttttgaccaaggaagttaaaggtgctggtgctggtctgacagcagctgctcttttggccatggttccatcatatatatctcgatcagtggctggcagctatgataatgaagctgtagctatatttgctttaatattcactttctatctttatataaagacattgaatacaggatccctcttttatgccactttaaatgccttggcatacttctacatggtttgctcatggggaggttacacttttataattaatcttattccaatgcatgtgcttctgtgcattgtgactggtcggtactcttccaggttgtacattgcatatgctccccttgtggtattgggaacgttattggctgctttggtgcctgttgttggttttaatgcagtcatgacatcagaacattttgcttcatttttggttttcattattatccatgtggtggcttttgtgtattatatcaaagggattctctctccaaaaatgttcaaagtagctgttacgcttgttgtatccattggcctggcagtctgttgcgctgtgctggcaattctaatagcgctggttgcttccagcccaacaaaggggtggagcggacggagtttaagtttgcttgacccaacctatgcaagcaagtacataccaattatcgccagtgttagtgaacatcaaccccctacatggccatcttacttcatggacatcaatgttctggctttcttggttccagctgggattattgcgtgctttcttcctttatctgatgcaagctcttttgttgtcctttacattgtgacatctgtatatttttctggagtcatggttcgattgatgctagtacttgctccagcagcatgtgtcatgtctggaattgccctttcggaagcttttagtgtcttcacaagatcaattaaatttcagctacctggattattggggagttcccaatcccaagttgactttttttatcaactccggaatcacaatgatttaatgcttttgatttttaagtcaggggatgctaaaaaagaaaaagagattgtggataaaccatctcttaaaaccaaaattgaaaaaaggcttctcgttttacctttggaggcatcaatctttggtatactattacttgtgttgcttggtgcattctatgtggttcattgtgtctgggcagccgcagaagcttattctgcaccatctattgttttaacatcttattcacgtgatggtggtctacatgtttttgatgattttagagaggcctatgcatggttaagccacaatacagatgtggatgataaagttgcatcatggtgggactatggttaccaaacaactgctatggctaaccgaactgttattgttgacaataatacctggaataacacacatattgcaactgttggcactgccatgtcttctcctgaaaaggcagcctgggaaatctttaactccttggatgtaaaatatgttctagttgtttttggaggacttgttggctaccccagtgacgacataaataagttcctgtggatggttcgtataggagggggagtgttccctcatatcaaagagccggactacctgagagatggccactatcggatagattctcaggctacgccaaccatgctaaattgtcttatgtacaaactctcatattacaggtttgtggaaactgatggtagaggttttgatagagtaaggcaaacagaaattgggaagaaaaatttcaaactcacacattttgaggaggcattcacaacacaccattggatggtccgcatatacaaattgaagcctcctaagaacaggatccgagggaagacgaaaaaatcaaaatcggtatgtatgaaaaaaacaagcacaaaaagaagcggagcaagtaagaggaatccatggcattag

SEQ ID NO: 5364 - DNA, 2751 bp, Cicer arietinum
gtaggctaacacaaccctcccttgtttctcccatcttggctcctgcaacgacttctctactataaaccccagtcagtccgaaacacagtctctccctctctcctctctctcctctctccactctctctctcgagctcaatttggccgtcaatggcggccaccgaggctcaatcctccctccggcacgcatttggtaatgttctcgcgttcttcatcctgatcctgatcggtgttctcgccttctcgatccgtctcttctccgttataaagtacgagagcgttattcatgaattcgatccttatttcaactacagagtcactcagtttttgaccaagaatgggatatatgatttctggaactggttcgatgaccgaacttggtatccccttggtcgtgtgatcggtgggaccgtctatcctggtttgaccttgacagcaggcaccttgtggtggatattgaattccttgaacatacctctgtcggttgaaactgtttgtgtatttactgctcctatattctcagcctttgcttcatgggcaacttatctactgacaaaggaggttaaaggtgctggggctggcttgacagcagcagttcttttggctatggtcccgtcatacatatctcgatcagtggctggaagctatgataatgaagctgttgccatatttgctttgatcttcactttctatctctatattaagacattgaatacagggtccctcttttatgccacattgaattcaatagcatacttctacatggtttgctcatggggagggtacacttttatcattaaccttattccaatacatgtgctattgtgcatagtaactggccgctattcttctcgactttatattgcgtatgcacctcttgttgtattgggcacactattggccgcattggtgcctgttgttggatttaatgctgtaatgacgtcagagcactttgcatcatttctggttttcattctcatccatgtggtggcttttgtatactatattaaaggaatactgtcaccaaaaatgttcaaagtagctgtggcactagttgtttctagcggcctggcagtaggtttggcaatgatagcagtacttgttgcaatggtagcttcgagcccaacaatgggatggagtggaagaagtttaagtctattagatcctacttatgcaagcaaatacataccaatcattgctagcgttagtgagcatcagccgcctacttggccttcttactttatggacattaatgtcttggcattcttagttccagctggcattattgcatgcttttcacctctatctgatgcaagctcttttgtgatactttatattgttacatcggtatatttttcaggtgtcatggttcgcctgatgcttgtacttgctccagcggcttgcatcttatctgggattgctctttctcaagcatttgatgttttcactagatcaattaagcttcagctacccagtctatcagttgattcccatgttgatgctggaaatgccagttccgaaagtgttgtgccaaatgatacggtgaagactgataaaatcgaggacacacctaaggagcggacctcaaagaagagcaagaagaaggaaaaggaacctgtggaaaagcctcctagcaagtcacaaattaagaaaaagcttttggttttacctttggaaacatccatcattgctattatcttacttgtgttgctgggtgccttctatgtggttcacagtgtatgggcagcagcagaagcttattcagccccttctatcgttctaacatcacattcaaatgatggactacatgtttttgatgattttagagaggcttatgcttggttgagtcataacacagaagtagatgacaaagtggcatcttggtgggattacggatatcaaacaactgcaatggctaaccgaactgtcatcgttgacaataatacctggaataacacacatattgctactgttggtactgccatgtcttctccagaaaaggcagcctgggaaattttcaactctttggatgtcaaatatgttcttgtagtctttggaggattggttggatatcccagtgacgatattaataaattcctgtggatggttcgtattggagggggtgtatttcctcacataaaggaacctgattacttaagggatggtcaatatcgaattgattctatggccacaccaacaatgcttaactgcctcatgtataaactttcatattacagatttgtggagacagatggtaaagcttttgatagagtgaggcggacggagattgggaagaaatatttcaaacttacgcattttgaagaggtgttcacaactcaccattggatggtgcggatatacaaattgaaacctccaaagaacaggatccgtggaaagattaaaaaatcaaaagctaaagcaagctcaaaacctgcctcgaaaaggaaagaactaaaaaggaaccctttttagtttagttttctgtttctttatcagtaggtaagcatatttattagttcgcacttcatgtacacatgtatacaactaatagaaaggccatggaaagattttgccggcattgttagttactctgagttttgaatgatcaaacaatttttggtattacatgttttttgactgaatggtggagatctcatttttaggattaagaaatcccagaccaaaattatttctttgatattttttggacatctacttggcatttatctattattattaggattcaaaata

SEQ ID NO: 5365 - DNA, 3025 bp, Petroselinum crispum
taaacacacacacaaagctcattgcagagagctcaaattaatcgtcaatggcggcaatagagaccgcgaacgacaaagctctacgttacgctttcggaaacgtgttgtgcttcttcatcctcctcctcatcggcgttctcgctttctcgatccgtcttttctccgtgattaagtatgagagtgttattcatgagtttgatccttatttcaattaccgagtcactcagtttcttataaagaacggaatatatgacttctggaactggtttgatgatcggacctggtatcctctcggtcgtgtaattggtggaactgtttaccctggattaacattaacagctggaactctatggtggatattaaattctctgaatattccattatctgtggagactgtttgtgtcttcactgctcccatattctctgcttttgcttcctgggcaacctactttttgacaaaggaggtcaagggcacaggcgcaggactcgccgcagcagctgtattggccatggttccatcctatatatctcgatctgttgccggaagctatgacaatgaagctgtagctatatttgcccttatcttcactttctatctttatgtgaagacgttgaatacgggatcacttttctatgcaacttttaatgcaatagcttacttctacatggtctgttcttggggaggatacaccttcattattaacctgattccaatgcatgcgcttctttgcatcgtgactggtcgctattcttctcggctatacatagcatattgtccacttgtggttttaggaacattgctagctgcattggttcctgttgttggtttcaatgctgtcctgacatcagagcattttgcttcatttttggtgtttattattatccatgtggtggcactagcatattatattaaaggaattctttccccaaagatgttcaaagttgcagttactcttgttttatcggttgggctggttgtttgttgtgctgttgtagctgtactttttgccctggtagcttccagccctacaaaaggatggagtggacggagtttaagcttgcttgatccaacttatgcaagcaagtacataccaatcattgccagtgttagtgaacatcagccacctacttggccttcttactttatggacattaatgttttagcattcttggttccagcaggcattgtcgcatgctttttgccgctatctgatgcaagctcctttgtgatcctctacattgtgacatcagtgtatttctctggtgttatggtgcgattaatgcttgtacttgctccagcagcatgtataatgtctggcattgctctttctgaagcttttactgtttttacgcgttcgattaaatttcagttgcccggtatatcacagagtcaccagattgatgcaggagatactagttctgaaccgtctggtgatgttatccaaaatgttgtaaaaactgataaagttgatgagccagtaaaggaacggcctttaaggagaaacaaaaagaaggagaaggagaatatggaaaaagcttctaagccttctatcaagtcaaagattgagaagaggcttatggttttacctttggagacatctatcattgcccttcttctactggtgctgctgggtgccttttatgttgttcactgtgtctgggcagcagcagaagcgtattcagcaccttctattgtgctaacgtctcattcgcatgatggacttcatgtgtttgacgattttagggaggcttatgcatggctaagccacaatacagacgtggatgataaagttgcgtcttggtgggattatggttatcaaactactgctatggctaatcgaaccgttatagttgataataacacctggaataacacacatattgcgactgttggtactgccatgtcatctcctgaaaaggcagcttgggaaatttttaactctttggatgtgaaatatgttctcgttgtattcggaggtcttgttggctattctagtgatgatataaataagtttctatggatggttcgtataggtgggggtgtgttcccacacatcaaagaacctgattatttgagagacggtcagtaccgaattgactcgcaggccactcccaccatgttaaattgcctcatgtacaaactgtcgtattacaggtttgctgacacagacgggggtaaagcatttgacagagtaaggcggactgaaattggaaagaagaatatcagattgacccattttgaggaggtattcacaacccaccactggatggtccgtttgtacaaactaaaacctccaagaaacaggattcgatctaagacaaagaaatccaaatcgaaatctagctcaacgacaaacctaaaaagaaggggaacaggaaagaaaaatccgtggcactaaatacatattataggtatttatctcgggtagttcatatgtaacagatatagatttgtaagcaccagccggtggaatgagggtcgttggtcactagttactacaacagattagcaaatgattaatcgaagattttgaattttactctgatactgtattctcacttgagttgttacttttgatacaatatttaaaagagaaatgttaaacacttcggaacagtttttccccccccccccccccccccccccccccctttaaaagaacttttgtactagatccagaaatagtcaaatgcccgatttctgatatttcattgtataggttcatgttgagtaatagattaatgattcatagagtgctttgtgctttatctttggtcctgtgtttgtcagattacgtgtggctataatattcaattcttgattcatgaaatgtgatttttccagaagtacagcataatctatctatatttgatactttgagcattctcgatggcctgggcctactgtatttgatatcccgtagtgtatgaattcaaatatgtcggacaaatatctcatactaatcggacactgatttgtcaggcgaatatctcatactccctccgtccctctagattgtataca

SEQ ID NO: 5366 - DNA, 2607 bp, Theobroma cacao
cttcattccttcttgcttcctacaaagtcttctctcttcagtctactcaaaacacacctacaacggcaacgcctaaaccccctccgcggtctctctctccccctctctttgtcttttagcatcggaccgttggttggccgtaaatggcggcgccagaggcctcatccgccgccgtcccaacgctaatgaccaacaacaccttacgaaacgctttcggcggcgttctctctttcttcatcctccttcttatcggagttctcgctttctcgatccgtcttttctccgttataaaatacgagagtgttattcacgagttcgatccttactttaattatcgagtcactcagtttcttacaaagaatgggatatatgaattttggaattggtttgatgatcgaacctggtaccctcttgggcgtgtgataggtggaactgtttaccctgggttgactttgaccgctggcaccatatggtggttgttaaattctttaaatattccactgtctgtggagaccgtttgtgttttcactgcacctatattttctgcttttgcgtcatgggcaacataccttttaactaaggaagttaagggtgctggtgctggactgacagctgctgtacttttggccatggtaccatcatatatctctcgttctgtggctggtagctatgacaatgaagctgtagcaatatttgctttgatcttcactttctatctttatataaagacactaaatactggatccctattttatgctaccttaaattcaattgcatacttttatatggtctgctcttggggagggtacacgttcattatcaacctcattccaatgcacgtgcttttatgcattgtaactggtcgctattcttcgcgattgtacatcgcatatgctcctcttgttgttctgggaacattgctagctgctttggtgcctgtagttgggtttaatgctgtcatgacatcagaacattttgcatcatttttggttttcattattatccacgtggtggctcttgtgtactatatcaaggggattctctctcccaaaatgtttaaagttgctgtgacacttgttatatctgctggcctggcagtgtgttgtgctgtgatagctgttcttatagctttagtagcttccagtccaacaaagggatggagtggacgaagcttaagtctgcttgatccaacttatgcaagcaaatatataccaatcattgctagtgttagtgaacatcaaccgcctacttggccatcttacttcatggacattaatgttttggcattcttggttccagctggtatcattgcatgctttttgcctttatcagatgctagctcatttgtggtactctatattgcgacatctgtatatttctctggagtgatggtacgcttaatgcttgttcttgctccagctgcttgcatcacatctggaatcgctctctcccaagcttttgatgttttcaccagatcaatcaagtttcagctacctggactatcaagcaatactgaagttgatgcaggggaaactagttctgctaccaaggaagcccaaaatgatgcagtaaagacagaaaaagctgaggagacatcaaaggatcgcccatcaaggaaaagcaagaagaaggaaagggagcatgtggaaaaaccttccaccaagaccaaagctgagaagaagaggcttctggctttacctctggaggcatctgtgatttctcttctcctacttgtcttcctgggtgcattctatgtggttcattgtgtttgggctgcagcagaagcttattcagctccctccatagttttaacatctcattcacatgatggtctacatgtttttgatgattttagagaggcttatgcatggttgcgccataatactgatgttgatgataaagttgcatcatggtgggactatggttaccaaacgactgctatggctaaccgcactgtcattgttgacaataatacctggaataatactcatattgcaactgttggtactgccatgtcttctcctgaaaaggcagcttgggaaatcttccactctttggatgtaaaatacattctcgtcgtctttggaggcctcgttggctacccgagtgatgacattaataaattcctatggatggttcgtatcggaggtggtgtgtttccccatatcaaagaacctgattaccttagagatggtcagtatcggattgattcccaggccactccaactatgctaaattgtctcatgtacaaactctcatattacaggtttgtggagacagatgggaaaggtttcgatagagttcggcggacagaaattggaaagaaatattttaaacttactcattttgaggaggtattcacaactcatcattggatggttcggatatataaactgaagcctcaaaagaaccggattcgaggaaagacaaagaaatcaaaatcgaaaactagctcaacaagcagctcaaaaagaagcggtacgagaaagaagaacccatggcactaagaaacagattatttttataaaggatggtgaattatgtgtaactcatagaacttgtacgggggagcctttttagagaggggattattcaggcatggtaatg

SEQ ID NO: 5367 - DNA, 2447 bp, Ricinus communis
agaaccttttgccctgcaacaaaacgcacagactcacctctcaatggcgggctcagagagcgccaaaggagagacgaccttgcgatacgcttttggaaatgttctgtccttttttatccttattttgatcggcgttctcgctttctcgatccgtctattctctgtgataaagtatgagagtgttatccatgagttcgatccttattttaattacagagtcactcagtttttaacaaagaaagggatatatgacttctggaattggttcgatgaccgaacctggtatcctcttggccgtgtgattggtggaactgtttatcctggcttgaccttgactgcaggaacactctggtggctgttgaattctttgaatattcctttatctgtcgagactgtttgtgtattcactgcaccaattttctctgcattcgcttcatgggcaacttatctcttgaccaaggaagttaaaggtgctggtgctggactgactgcagcggctattttggccatggttccgtcatatatatctcggtcagtggctggcagctatgataatgaagctgtagctatatttgctttgattttcaccttctatctttatttaaagacattgaatacaggatccctcttctatgccactttaaatgccctagcatacttctacatggtttgctcatggggaggatacacctttataattaatcttatcccaatgcatgtgcttttatgcattgtgactggtcggtactcttctcggttgtacattgcgtatgctcctcttgtggtcttgggaactctgttggctgcattggtgcctgttgtaggttttaatgctgtcatgacatcagaacattttgcatcatttttggtttttataatcatccatgtcgtggcttttgtgtattatatcaaaggaattctctctccaaatatgtttaaagtagctgttacccttgttgtatctgttggcctggcagtttgttgtgctgtgatggcagttctaatagcgatggtagcttccagccccacaaagggatggagtggacgaagcttgagtctgcttgatccaacctatgcaagcaagtatataccaatcatcgccagtgttagtgaacatcaaccccctacatggccatcttacttcatggacattaatgttttggcattcttggttccagctgggattattgcttgctttctacctttatctgatgcaagctcctttgttgtcctttacattgtgacttctgtatatttttctggagtcatggtgcgtctgatgcttgtacttgctccagcagcatgcataatgtctggaattgccctttctgaagcttttgatgtcttcacacggtcaattaagtttcagctaccaggagtatctgggaattccagagttggtttggaggatgctagttcaagtactgttgcggtgcaaaatgatgcaggaaagacagagaaacctgaagatatagcaaaggaacgaccttcaaaaaagaataaaaggaaagaaaaagaggttctggagaggccatccattagaaccagaattcaaaataggcttctcgttttacctttagaggcatctatttttggtattctattacttgtgttgcttggcgcctattatgtggttcattgtgtctgggcagcagcagaagcttattcagctccatctattgtattgacttctcatacacatgatggtggtttacatgtttttgatgattttagagaggcttatgcatggttaagccacaatacagaagtagatgataaagtcgcatcgtggtgggactatggttatcaaacaactgctatggctaaccgaactgttatagttgacaataatacctggaataatacacatattgcaactgttggaactgccatgtcttctcctgaaaaggcagcttgggaaatctttaactccttggatgtaaaatatgtactggttgtctttggaggtcttgttggctaccccagtgatgatatcaataagttcctgtggatggttcgtataggagggggtgtgttccctcatatcaaagagcctgattacctgagagatggccagtatcggattgattctcaggctacaccaaccatgttaaactctctcatgtacaaactttcatattacaggtttgtggaaaccgatggtaaaggcttcgatagagtgaggcgaacagaaatagggaagaaatatttcaaacttacgcattttgaggaggtattcacaacacaccattggatggttcgcatatacaaattgaaaccacagaagaacaggatccgaggaaaggccaagaagaaatcgaaaacaagctcaactcctagctccaaacgaagcagagctagtaaaaggaatccgtggcactaaataattttttttacaggctaatgttcttagatatcagtattcatatacgatttgtatgcaagag

SEQ ID NO: 5368 - DNA, 2565 bp, Glycine max
cacacttcctctctcttcctctctctcttcggagctcaatttggccgtcaatggcggcctccgaggctctcaacggcacaaccaccacctccatcaggcacgcgttcggcaacgtcctcgcgttcttcatacttctcatgatcggcgttctcgccttctcgatccgtctcttctccgttataaagtatgagagtgttattcacgagtttgatccttatttcaactatagagtcactcagtttttgacaaagaatgggatatatgatttctggaactggtttgatgatcgaacttggtatccccttggtcgtgtaattggtgggactgtctatcctggtttgaccttgacagcaggcaccttatggcggatactgaattccattaacatacctctctcagttgaaactgtttgtgtgtttactgcacctatattctctgcctttgcttcatgggcaacttatcttctgacaaaggaggttaagggtgtgggggctggcttgacagcagcagttcttctggctatggtcccttcgtatatatctcgatcagtggctggcagctacgacaacgaagctgttgctatatttgctttgatattcactttctacctctatattaagacgctcaatacagggtccctcttttatgccactttgaattccatagcatacttttacatggtttgctcatggggagggtacacttttatcattaatcttattccaatgcatgttctcttgtgcatagtaactggtcgctattcttctcgactgtacattgcatatgcacctcttgttgtattgggaacattattggctgccttggtgccagtggttgggtttaatgctgtaatgacatcagagcattttgcatcatttctggttttcattatcatccatgtagtggctcttgtgcactatatcaaaggaattctttcaccaaaaatgttcaaagtagctgtggcactagttgtttctgttggcctggcagtgtgttgcgcaatggtggcagtacttatagcattggtagcttcaagcccaacaaaaggatggagtggaagaagtttaagtctgcttgatcctacttatgcaagcaagtatataccgatcattgctagtgttagtgagcatcagccacctacttggccttcatactttatggatatcaatgtcttggcattcctggttccagctggcattattgcatgcttttctcccctatctgatgcaagctcctttgtgatactttatattgttacgtcagtatacttttctggagtcatggttcgcttgatgctcgtacttgctccagctgcatgtattttgtctgggattgctctttctcaggcttttgatgttttcacaagatctattaagttgcagttgcccagcctatcaggtcattctcacgttgatgcaggggaaaccagttctgaaagtgttgtgccaaatgatttggcgaagactgataaaagtgaggacacatcaaaggaccggacctcaaagaagagtaagaagaaggaaaaggaacatgtggaaaagcctccgagcaagtcactaattaagaaaaggcttttggttttacctctggaaacatccatcattgctattatcttgcttgtgttgctaggtgccttctatgtggttcacagtgtatgggcagcagcagaagcatattcagccccttctattgttctaacatcgcattcacatgatggaattcatgtatttgatgattttagagaggcttatgcgtggctaagtcataatacagaaatagatgataaagtggcatcttggtgggactatggataccaaacaactgccatggctaaccgaactgtcattgttgacaataatacctggaataacacacatattgctactgttggtactgccatgtcttccccagagaaggcagcttgggaaattttccactcattggatgtcaaatatgttcttgttgtctttggaggactggttggctatcccagtgatgatatcaataagttcctgtggatggttcgtattggagggggtgtattccctcacataaaggaaccagattatttaagggacggtcaatatcggattgattccatggccacaccaacaatgctaaactccctcatgtataaactttcatattacagatttgtggagacagatggtaaggcttttgacagagtgaggcagacagaaattgggaagaaacatttcaaacttacgcattttgaagaggtgttcacaactcaccattggatggttcggatttacaagttgaaaccaccaaagaacaggattcgaggaaagattaaaaaatcaaaatttaaagcaagctcaaaatctgcctcgaaaagaaaaggattaaaaaggaaccccttttagtttagtttttcatttcttttgatagatgactttatttcttagtgtgcgtttcatgtatacatgtatacaactaatgcaattgccatgaaaaggattttgccggcattattagttacttgcttgagtatcgaatgatcaaacaaaaattttgaaactatatagtttgactgaatgttta

SEQ ID NO: 5369 - DNA, 2694 bp, Glycine max
gtcacacactgagactcagaagaaacacacacttcctctctcttcctctctctcttcggagctcaatttggccgtcaatggcggcctccgaggctctcaacggcacaaccaccacctccatcaggcacgcgttcggcaacgtcctcgcgttcttcatacttctcatgatcggcgttctcgccttctcgatccgtctcttctccgttataaagtatgagagtgttattcacgagtttgatccttatttcaactatagagtcactcagtttttgacaaagaatgggatatatgatttctggaactggtttgatgatcgaacttggtatccccttggtcgtgtaattggtgggactgtctatcctggtttgaccttgacagcaggcaccttatggcggatactgaattccattaacatacctctctcagttgaaactgtttgtgtgtttactgcacctatattctctgcctttgcttcatgggcaacttatcttctgacaaaggaggttaagggtgtgggggctggcttgacagcagcagttcttctggctatggtcccttcgtatatatctcgatcagtggctggcagctacgacaacgaagctgttgctatatttgctttgatattcactttctacctctatattaagacgctcaatacagggtccctcttttatgccactttgaattccatagcatacttttacatggtttgctcatggggagggtacacttttatcattaatcttattccaatgcatgttctcttgtgcatagtaactggtcgctattcttctcgactgtacattgcatatgcacctcttgttgtattgggaacattattggctgccttggtgccagtggttgggtttaatgctgtaatgacatcagagcattttgcatcatttctggttttcattatcatccatgtagtggctcttgtgcactatatcaaaggaattctttcaccaaaaatgttcaaagtagctgtggcactagttgtttctgttggcctggcagtgtgttgcgcaatggtggcagtacttatagcattggtagcttcaagcccaacaaaaggatggagtggaagaagtttaagtctgcttgatcctacttatgcaagcaagtatataccgatcattgctagtgttagtgagcatcagccacctacttggccttcatactttatggatatcaatgtcttggcattcctggttccagctggcattattgcatgcttttctcccctatctgatgcaagctcctttgtgatactttatattgttacgtcagtatacttttctggagtcatggttcgcttgatgctcgtacttgctccagctgcatgtattttgtctgggattgctctttctcaggcttttgatgttttcacaagatctattaagttgcagttgcccagcctatcaggtcattctcacgttgatgcaggggaaaccagttctgaaagtgttgtgccaaatgatttggcgaagactgataaaagtgaggacacatcaaaggaccggacctcaaagaagagtaagaagaaggaaaaggaacatgtggaaaagcctccgagcaagtcactaattaagaaaaggcttttggttttacctctggaaacatccatcattgctattatcttgcttgtgttgctaggtgccttctatgtggttcacagtgtatgggcagcagcagaagcatattcagccccttctattgttctaacatcgcattcacatgatggaattcatgtatttgatgattttagagaggcttatgcgtggctaagtcataatacagaaatagatgataaagtggcatcttggtgggactatggataccaaacaactgccatggctaaccgaactgtcattgttgacaataatacctggaataacacacatattgctactgttggtactgccatgtcttccccagagaaggcagcttgggaaattttccactcattggatgtcaaatatgttcttgttgtctttggaggactggttggctatcccagtgatgatatcaataagttcctgtggatggttcgtattggagggggtgtattccctcacataaaggaaccagattatttaagggacggtcaatatcggattgattccatggccacaccaacaatgctaaactccctcatgtataaactttcatattacagatttgtggagacagatggtaaggcttttgacagagtgaggcagacagaaattgggaagaaacatttcaaacttacgcattttgaagaggtgttcacaactcaccattggatggttcggatttacaagttgaaaccaccaaagaacaggattcgaggaaagattaaaaaatcaaaatttaaagcaagctcaaaatctgcctcgaaaagaaaaggattaaaaaggaaccccttttagtttagtttttcatttcttttgatagatgactttatttcttagtgtgcgtttcatgtatacatgtatacaactaatgcaattgccatgaaaaggattttgccggcattattagttacttgcttgagtatcgaatgatcaaacaaaaattttgaaactatatagtttgactgaatgtttaaggtctcatttttctgattgaaatgcccatcagcaaaatgatttgataattttctggccatgtacactttgtatctaaggattaaaaataagtttttttggt

SEQ ID NO: 5370 - DNA, 2575 bp, Chelidonium majus
gactcggatcaaaagtcttctcctcgtcttcgttattaataaaaaccagaaaaaccctggctttctcttcttcttctgatcatatcttcatcatctttctccacaactgaactcgatttctcgccttcaatggcgtcagtggagaatgcaaatggagtagctgtagcagcagcagcagtagcaggaggaggaggagggacttctctcagatacgccttcggcaacgttctctccttgttcatccttctcttgatcggagttctcgccttctcgatccgtcttttttctgttattaagtatgagagtgttattcacgagtttgatccttatttcaattacagagttactcagttccttataaagaacggaatatacgacttctggaattggtttgatgaccggacatggtatcctcttggtcgtgtgatcggtggaactgtttatcctggattgactttgacagcaggaacattatggaagatactacattctctgaacattcctctttctgtggaaactgtttgtgtatttactgctcctatattctctgctaatgctgcttgggcgacctacctcctgacaaaggaagttaaaggtactggagctggattgatagcagcagctcttttagctatggtaccttcctatatatctcgttcagtagctggaagctacgacaatgaagctgtggccatctttgcgttgattttcactttctatctctatataaagacattgaacactgggtccctcttctatgccactttaaatgctctatcatacttttacatggtgtgctcttggggaggttacacctttattattaaccttattccaatgcatgcacttctgtgcattgtaactggtcgctactcttctcggctgtatgttgcttatgctcctcttgttgtcctgggtacactgttagccgcattggtgcctgttgttgggtttaatgctgtgctgacatcagaacattttgcatcgtttttggtttttattattatccatgtggtggctcttgtctactatatcaaaggaattctctctccaaaaatgtttaaagtggctgttacacttgtggtttctgttggcacggtagtctgtttggctgtggtagctgtacttgtagcattggtggcttccagcccaacaaaaggatggagtggtcgtagtttgagtcttcttgatccaacctatgcaagcaagtatatacccattattgctagtgtaagtgaacaccagccaccaacctggccatcatactttatggacatcaacgtcttggctttcttggttcctgctggcataattgcatgctttcttccgctatcagatgccagctcctttgctatcctttatattgtaacgtcagtatatttctcaggagtcatggtgcgtcttatgcttgtactggctccagcagcatgcattatgtctggaattgctctttctgaagcctttgatgttttcacaagatcaatcaaatttcaattgcctggaatactagggaattccacttctgatgcaggggatgttacatctggcgccacagtacaaaatgacgtagtgaaggctgatccagctgctgagaaaagcgaagacactctaaaggagcgaccatctaaaaagaacaggaagaaagaaaaggagcctgtcatgaaggcttctatcaagtcccggatcgagaagaggcttctggttttacctttggaggcatctgttctagccattctcttacttattttgttgggtgccttttatgtggttcattgtgtctgggcagctgccgaagcttattcagctccttctattgttcttacttctcattcacatgacggtcttcatgttttcgatgatttccgagaagcttatgcatggttaagccataacactgaagtggatgataaggttgcttcatggtgggactatggttaccaaaccactgcaatggctaatcgtactgtcattgttgacaacaacacctggaataacacacatattgcaactgttggtactgccatgtcatctcctgagaaggctgcttgggagattttcaactccttggatgtaaaatatgttcttgttgtctttggaggtcttgttggctaccccagtgatgatataaataaattcctttggatggtgcgtattggagggggcgtctttcctcacatcaaggaaccggactatctcagagatggtcaataccggatcgatgctcaggctactccaaccatgctaaattgcctcatgtacaaactatcatatttcagattcgtggaaacagatggtaaaggttttgacagagttaggaggactgaaattgggaagaaatatttcaagcttacccattttgaggaggtattcacaacacatcattggatggtgcggatatacaaactaaaacctcagaagaataggatcagaggaaagacaaagaaaacaaaatcgggttcaaaagtaagctcaactagctcaaaaagggttgaagggggaaagaagaatccttagggacaactaaaaaaaacattaattgtagtaacaggttagttttatatacggatgtgcatga

SEQ ID NO: 5371 - DNA, 2538 bp, Ambrosia trifida
acagttatacacacacatcaaagcttcattaataacgccgttaatggcggcctctacagacacaacaccatcatcatcgtcgactctccgtcacgcttccggaaacatcctcgcgttgtttattctcctattaatcggcgtactcgcattctccatccgtctttttcggttattaaatatgaaagtgttattcacgaattcgatccttatttcaattacagagtcactcagtttctcaccaagaatggggtgtatgacttctggaactggtttgatgatcgaacctggtatcctcttgggcgagtcattggtggaacggtttaccctggattgaccttaacagctggaactatgtggaaggtactccaattcttgaatattcctctgtcagtggaaactgtttgtgtattcactgctcctgtattctctgcctttgctgcatgggcaacatatctcttgacaaaggaagttaagggagtaggtgctggactaacagctgcagttcttctggctatggtgccatcttacatatctcgatcagtggctgggagctatgacaatgaagccgtagccatctttgctttgatcttcaccttctatttatacataaagacattgaacacaggatctcttttctatgctactttaaactccatggcatacttctacatggtttgctcttggggagggtacacttttattatcaatctcataccaatgcacgtgcttctttgcattgtgactggtcgatattcacctcggctatacattgcatatgctccacttgttgtcttaggaacgttaatggcagcattagtgcctgttgttggttttaatgcggtcatgacatcagaacattttgcatcgtttttggttttcattattattcatgtggttgctcttgcatattatatcaaaggaattctttcgccaaagatgtttaaagtagctgccaccctcgttgtatcagttggcttggtggtatgctgtgctgtagtagctgtacttatagcagtggttgcatctagtccaacaaagggatggagtggacgaagtctaagtcttcttgatccaacatatgcaagcaagtacataccaattattgcaagtgttagcgagcatcaaccacctacttggccatcttacttcatggacattaacatattagcattcttggttcctgctggaattattgcatgcttttcaccgctatctgatgcaagctcctttgtgattctttatatagtaatgtcagcatatttttccggggtcatggtacgactaatgcttgtgtttgctccagctgcatgcataatgtctggaattgctctttctgaagcctttgatgtctttacaagatcaattaaattttatgcatttcaagcagtagatacggtatcagcaagtactgtttctacgcaaaataatgtggtggagacagacaaaaaagagattcgttgaaggaacggccttccaagaaaaacaaaaggaaagaaaaggagaatgttgaaaagcctcttaagaaatcccagactgagaagcggccccttatcttacctgttgaagcatctgcatttgctctgttcttaactgtgttgctaggtgccttctatgtggtccatagtgtttgggctgcagcagaggcatattcagctccttcaattgttcttacttctcatacgcgtgatgggcttcatgtttttgatgattttagagaggcatacgcatggttaagccataacactcatgtagatgacaaagttgcatcttggtgggactatggttaccaaacaactgcaatggctaaccgcacagttattgttgacaataacacatggaacaacacacatattgctactgtcggtactgccatgtcatctcccgaaaaagcagcttgggaaattttcaactccttggatgtaaaatatgtccttgtagtttttggaggtcttgtgggctactccagtgatgacataaataagttcctgtggatggttcgtataggaggaggcgtcttcccacatatcaaggagcctgattatcttagagatggtcaataccgaattgattctcaggccactccaaccatgctaaacagcctcatgtacaaactatcatattttagatttgtggagactgatggtggtaaaggatatgaccgagtaagggggactgaaattggaaagaaacattttaaattaactcattttgaagaggtgttcacgactcaccactggatggttcggatatataaactaaaaccccagaagaacaggattcgggggaagacaaagaaatctagatcgaaaacaaactcgacgaaaacaagaacaatatcgaaaaagaatccttggcattaggcgctaaggggtgtgcccgaaagcaactaacaagagccgtaagttgtttttattaattgcaagtaccaaacatgaaaatgtgttagaagagagactgtaaggattttaaaaatccaacaacttgtgttggttacacatcattatctcgaggtaatcatagattttgctaatgtaaagt

SEQ ID NO: 5372 - DNA, 2551 bp, Ocimum basilicum
actgtgtgtagcttcaatcaacggcgtcaatggcggaacaagaggcttccaattccgctactttccgccacgctttcggaaatgtgctttccttttccgttctcttactgatcggcgtcatagctttctcgatccgtctcttctcagtgattaagtacgagagtgtgattcacgaatttgatccttatttcaattatagagtgacacagtatcttgtaaaaagtggagtatatgacttctggaattggtttgatgatcggacatggtatccacttggacgtgtgattggaggaactgtctaccctggacttacactgactgcgggtactttatggaggatatttaattccctaaatatccctctatccgtggaaacagtttgtgtgtttacagctcctatattttcagcttttgcttcatgggctacataccttctaacaaaggaaatcaaaggtactggtgctggcttgactgctgcagcgcttcttgcgatggtgccatcatatatatctcgatctgtagctggcagctatgacaatgaagcagtggctatatttgctttgatcttcactttctatctctatgttaagacgttgaacacaggatcccttttttatgctattctaaacgcaatagcatacttttacatggtttgctcttggggagggtacaccttcattataaatctgatcccaatgcatgtgctgctatgcattgtaactggtcgctattcttcacgcctctacatagcttatgctcctctagttgtattgggaacattgttagcagctttggtgcctgttgttggttttaatgctgtcatgacatctgagcattttgcgtcgttcttggtattcattatactacatgtcgtggctcttgtttattatatcaaaggaattctgactccaaaaatgttcaaagtagcagtcacccttgtcatagcagttgggctgattttctgctttgctgtattggctgtacttatagcattagtagcttcaagcccaactaaaggatggagtggacggagtttaagtctgctagatccgacttatgctagcaagtatataccaatcattgcaagtgttagtgaacaccaaccccctacttggccatcttactttatggacatcaatgtgttagcatttttggttcctgctggcattattgcatgctttttgccattgtctgacgctagctcctttgctattctatacattgtcacgtcagtatatttttcaggtgtcatggtgcgcctaatgcttgtactagctccagcagcttgtataatgtctggaattgcactttcagaagcttttgacgtttttactcggtccatcaaatttcatttagttggtgcaacagaaaacccccagggcaatgcaggggattcctctaatgttactcaacatgatgtgaagactgagaagagtgaggaaacattaaaggaacgaccttcaaggaaaagtaaaaagaaggacaaggaaaatacagagaaaccatctcctgtatcccgggtccaacagaagcttctcgtcttgcccttggagacttctttgcttgctgttttgttacttgtcttgcttggagcattttatgtggttcattgtgtctgggctgcagcagaggcttattctgcaccatcaattgttttgacctctcgttctcatgatggtctccatgtctttgatgacttcagagaggcatatgcatggttgagccataacactgaagtggatgataaagttgcatcatggtgggactatggctaccaaacaactgctatggctaatcgtacagttattgttgataataatacatggaacaacacacatattgcaactgttggcactgcaatgtcatctccagaaaaggcagcttgggaaattttcaactcgttggatgtaaaatatgttctagttgtttttggaggtcttgttgggtatcctagtgatgacattaacaagtttctatggatggttcggattggtggaggcgtgtttcctcacattaaggaacctgactatttgagagatggtcagtaccggattgactctcaagctactccaaccatgcttaactgtctcatgtacaaactttcgtattacagatttgtggatacagatggtagagggttcgaccgggtcagacaaactgaaatcgggaaaaagcatttcaaactctctcacttcgaagaggtgttcactactcatcattggatggtccggatatacaaactgaaatctcccagaaacagaatgcgcgggaaaaccaagaaatctgaatcgaaatcaagtgcttcgactagctcgaaaagaaacggaacacgaaagaagaatccctggcagtagtagtagcccagcatggcgatacattctgatataggacagacaatgtagttgagacaaatttgcacggaaaatagatgatttgtgacaacttgttggcttgatatttgtgggatattttggtaggctacttctatttgagcaatcaatgtgtagggcaaattttgactcgctatatatattttagctccacaaggaaa

SEQ ID NO: 5373 - DNA, 2530 bp, Euphorbia peplus
ggtcgctgaggtcgccgccgccgcacaaggaggaacgaatttacgtaacgctttcggaaatgttctttccttgttcatcctcatcttgatcggcgttctcgccttctcgattcgtcttttctctgtgatcaaatacgagagtgttattcatgagtttgatccttatttcaattacagagtcactcagttcttgacgaagaatgggatatatgacttttggaattggtttgatgatagaacctggtatcctcttggccgtgtgattggcggaactgtttatcctggcttgaccttgactgcaggctcgttatggtggttattgaattctttaaatattcctctgtctgttgagactgtctgcgtattcactgcaccaattttctctgcatttgcttcatgggctacttatcttttgaccaaggaagttaaaggtgctggtgctggtctgacagctgcagctcttctggccatggttccatcatatatatcaagatcagtggctggaagttatgataatgaagctgtggctatatttgctttaatattcactttctatctatatataaagacgttgaatactggatccctcttttacgccactttaaatgctttggcgtacttctacatggtttgctcatggggaggatatacatttataattaatctcattcccatccacgtgcttctctgcattgtaactggtcggtactcttcccggttgtacattgcatatgctccacttgtcgtcttgggaacattgttggctgctttggtgcctgttgttggttttaatgcagtcatgacatcagaacattttgcttcatttctggttttcattattatccatgtggtggcttttgtacattatattaaagggattctctctccaaaaatgtttaaagtagctgttacgctcgttatatctgttggcctggtagtctgctgtgcagtgatagcaattcttgttgcagtggtagcttccagccctacgaagggatggagtggacgcagtttgagtctactggatccaacttatgcaagcaaatatataccaattattgctagtgttagtgaacatcaacccccaacatggccatcttacttcatggacattaatgtcttagcattcttggttcctgctggaattgttgcatgcttcctacctttatctgatgcaagctcgtttgttatcctttatattgtgacatccgtatatttttctggagtcatggtgcgtctgatgcttgtatttgctccagcagcatgcatcatgtctggaatttccctttctgaagctttcaatgttctcactcaatcaattaaatttcagctgcctgggtcatcaggcagttaccgtgttgattctgggaatgccagttcaagtactactgtagcacaggatgatgctgcaaaggttgaaaacactgaagagacagtaaaagaacgaccttcaaaaaagaataagaagaaagataaagaaagagagaaagaggttgtggataagccatctgttagatccaggattgaaaagaggcttctcgttttaccttttgaggcatccattattggtgttctgttacttgtgttgcttggtgctttctatgtggtccattgtgtctgggcagcggcagaagcttattcagcgccatccatcgtgttgacatctcattcaccagatggcggtctacatgtctttgatgatttcagagaggcctatgcatggttaagccacaacactgaggtggatgataaagttgcatcatggtgggactatggttatcaaacaactgctatggctaaccgaactgttattgttgacaataacacttggaataacacacatattgcaactgttggcactgctatgtcttcccctgaaaaggcagcctgggaaatctttaactccttggatgtgaaatatgttcttgttgtctttggaggtctcgttggctacccaagtgacgatataaacaagttcctgtggatggttcgtataggaggaggcgtgttcccccatatcaaagagccagattatctaagagatggccagtatcggattgataatcaagctacaccaacgatgctgaactgtctaatgtataaactttcatatttcaggtttgtggaaactgatggtaaaggttttgatagagttaggcgaacagaaattgggaagaaacacttcaagcttacccattttgaggaggtattcacaactcatcattggatggtccgcatatacaaattgaaacctcaaaagaacagaattcgaggaaaggtgaagaagtcaaaatcgaaaacaagctcaactagcagctcgaaaagaagtggagcaaccaaaagaaatccgtggcagtaagtgaactatttagaggcttttgcttttagatgtgtatttcatacaacagaaatttgtgaacaatagcattttactagagagatgaaaatggtgaccaaagattttgcctatttaaatgatcttgtattttgttaggacattgtactaattaatcaaattttggacaatgca

SEQ ID NO: 5374 - DNA, 2589 bp, Ambrosia trifida
atcaaagctccattaataacgccgttaatggcggcctctacagacacaacaacaccatcatcatcgtcgactctccgtcacgcctccggtaacatcctcgcgttctttattctgttattaatcggcgtactcgcattctccatccgtcttttctcggttattaaatatgaaagtgttattcacgagttcgatccttatttcaattacagagtcactcagtttctcaccaagaatggggtgtatgacttctggaattggtttgatgatcgaacctggtatcctcttgggcgagtcattggtggaactgtttaccctgggttgactttaacagctggaactatgtggaaggtactccaattcttgaatattcctctgtcagtggaaactgtttgtgtattcactgctcctgtattctctgcctttgctgcatgggcaacatatctcttgacaaaggaagttaagggagtaggtgctggactaacagctgcagttcttctggctatggtgccatcttacatatctcgatcagtggctgggagctatgacaatgaagccgtagccatctttgctttgatcttcaccttctatttatacataaagacattgaacacgggatctcttttctatgctactttaaactccatggcatacttctatatggtttgctcttggggagggtacacttttattatcaatctcataccaatgcacgtgcttctttgcattgtgactggtcgatattcacctcggctatacattgcatatgctccacttgttgtcttaggaacgttaatggcagcattagtgcctgttgttggttttaatgcggtcatgacatcagaacattttgcatcgtttttggttttcattattattcatgtggttgctcttgcatattatatcaaaggaattctttcaccaaagatgtttaaagtagctgccaccctcgttgtatcagttggcttggtggtatgctgtgctgtagtagctgtacttatagcagtggttgcatctagtccaacaaagggatggagtggacgaagtctaagtcttcttgatccaacatatgcaagcaagtacataccaattattgcaagtgttagcgagcatcaaccacctacttggccatcttacttcatggacattaacatattagcattcttggttcctgctggaattattgcatgcttttcaccgctatctgatgcaagctcgtttgtgattctttacatagtaatgtcagcatatttttccggggtcatggtacgactaatgcttgtgtttgccccagctgcatgcataatgtctggaattgctctttctgaagcctttgatgtctttacaacatcaattaaattctatgcatttcaagcagtggataaggtaacagcaagtactgtttctacgcaaaataatgtggtggagacagacaaaaaagaagactcgttgaaggaacgaccttccaagaaaaacaaaaggaaagaaaaggagaatgttgaaaagcctcttaagaaatcccagactgaaaagaggccccttatcttacctgttgaagcatctgcatttgctctcttcttaactgtgttgctaggtgccttctatgtggtccatagtgtttgggctgcagcagaggcatattcagctccttcaattgttcttacttctcatacgcgtgacgggcttcatgtttttgatgattttagagaggcatacgcatggttaagccataacactcatgtagatgacaaagttgcatcttggtgggactatggttaccaaacaactgcaatggctaaccgcacagttattgttgacaataacacatggaacaacacacatattgctaccgtcggtaccgccatgtcatctcccgaaaaagcagcttgggaaattttcaactccctggatgtaaaatatgtccttgtagtttttggaggtcttgtgggctactccagtgatgacataaataagttcctgtggatggttcgtataggaggaggtgtcttcccacatatcaaggagcctgattatcttagagatggtcaataccgaattgattctcaggccactccaaccatgctaaacagcctcatgtacaaactatcatattttaggtttgtggagactgatggtggtaaaggatatgatcgagtaagggggactgaaatcggaaagaaacattttaaattaacacattttgaagaggtgttcacgactcaccactggatggttcggatatataaactaaaacctcagaagaacaggattcggggaaagacaaagaaatctagatcgaaaacaaactcgacgaaaacaagaacaatatcgaaaaagaatccttggcattaggcgctaaggggtgtgcccgaaagcaactaacaagagccgtaagttgtttttattaattgcaagtaccaaacatgaaaatgtgttagaagagagactgtaaggattttaaaaatccaacaaacttgtgttggttacacattattatctcgaggtaatcatagattttgctaatgtaaagtaaaaaaaaaagagagagatttacacacattcaacataattggtgttttccgtaaaaaagaa

SEQ ID NO: 5375 - DNA, 2765 bp, Trifolium pratense
cgacttttctacgataaaccccagtcagtcacactccgatagacacagacactctctatctctctcttccgagctcaatttggccgtcaatggcggccaccgatgctcaaacctctctccgtcacgcattcggtaacgtcctcgcgttcttcatcctgatcttgatcggtgttctcgccttctcgatccgtcttttctccgttataaagtacgagagtgttattcacgagttcgatccttatttcaactacagagtcactcagtttttgacaaagaatgggatatatgatttctggaactggtttgatgaccgaacttggtatccccttggtcgtgtaatcggcgggactgtctatcctggtttgaccttgacagcaggcaccttgtggtggatattgaattccttgaacatacctctctcggttgaaactgtttgtgtatttactgcacctatattctcagcctttgcttcgtgggcaacttatctattaacaaaggaggttaagggtcctggggctggcttgacagcagcagttcttttagctatggtcccgtcatatatttctcgatcagtggcaggaagctatgataatgaagctgttgctatatttgctttgatcttcactttctatctctatattaagacactgaatacagggtccctcttttatgccactttgaactcaatagcatacttctacatggtttgctcatggggaggatacacttttatcattaaccttattccaatgcatgcactattgtgcatagttactggccgctattcttctcgactttatattgcatatgcacctcttattgtattgggcacactgttggccgcattggtacctgttgttggatttaatgctgtaatgacgtcagagcactttgcatcatttctggttttcattctcatccatgtggttgctcttgtatactatattaaaggaatactgtcaccaaaaatgtttaaagtagctgtggcgctagttgtttctggtggcctggcagtatgttttgcaatgatagcagtacttgttgcaatggtagcttcaagcccaacaatgggatggagtggaagaagtttaagtctcttagaccctacatatgcaagcaagtacataccaatcattgctagtgttagtgagcatcagccgcctacttggccttcttactttatggacattaatgtcttggcatttttggttccagctggcattatcgcatgcttttcgcctctatctgatgcaagctcttttgtgatactttatattgttacctcggtgtatttttctggtgtcatggttcgcctgatgcttgtacttgctccagcggcttgcatcttgtccgggattgctctttctcaagcttttgatgttttaactagatcaattaagcttcagctacccagtctattagttgattctcctgttgatgctggagatgccagttctgaaagtgttgtgccggatgatactgtgaagactgataaaacggaggacacccaaaaggaacggacctcaaagaagggccgaagcaggaagagtagctctgaaaatgttgaaaagcctcctagcaagtcacaaattaagaaaaggctttcggttttacctctggaaacatccatcattgctattgtcttacttgtattgctgggtgccttctatgtggttcacagtgtatgggcagcagcagaagcttattcagccccttctatcgttctaacatcgcattcacatgatggacttcatgtttttgatgattttagagaggcttatgcttggttgagtcataacacggaagtagatgacaaagtggcatcttggtgggattacggataccaaacaactgcaatggctaaccgaactgttattgttgacaataatacctggaataacacacatattgctaccgttggtactgcaatgtcttctccagaaaaggctgcttgggaaattttccactctttggatgtcaaatatgttcttgttgtctttggaggattggtggggtatcctagtgatgatattaataagttcctgtggatggttcgcattggagggggtgtattccctcacataaaggaacccgattacttgagggacggtcaatatcgaattgataatatggccacaccaacaatgcttaacagcctcatgtataaactttcatactacagatttgtggagacagacggtaaagcttttgacagagtgaggcggacggagattggaaagaaatatttcaaacttacacattttgaagaggtgttcacaacccaccattggatggtgcggatatacaagttgaaacctccaaagaacagaattcgggggaagactaaaaaatcaaaatctaaaacaagcccgaagactccctcgaaaaggaaagaactgaaaaggaaccctttttagtttagttttcggtttctttattagttggtaagcatatttattagtacgcactttatgtacacatgtatacagctaatagaaaggtcatgaagagattttgccggctttgttagttactctcttgagcatcaaattatcaaacaatttttgtaattgcatgttttctgactgaatggtgaagatctaatttttaggattaagatgcccttgagaaaaatgatttctttgaaattttttggacatctacacttggcatttttctattatggtattgaaaatacgaacatactgacttagctttaacgataacgtaacgtaataactatagtcctttaaggatgattatag

SEQ ID NO: 5376 - DNA, 2666 bp, Arabidopsis thaliana
gtgagagattgttttgccggagatagtagttttcgcgtctccaaaaacccttcgacctttgccggagatagtagttcctcactctctttaatccgattcatcgagccggagagctcaccttccgccgcgtaaaatggcggctctagaaagcccactgccgggaacgccgactgcgatgaggaatgctttcggcaacgttttatcagtcctgatcctcgtcctcattggtgtcctcgctttctcgatccgactcttctctgttataaagtatgaaagtgtgattcatgagtttgatccttacttcaattatagagtcactcagttcttatcgaagaatggaatatacgagttctggaattggtttgatgataggacctggtatcctcttggccgtgtgattggaggaactgtttaccctgggttaactttgactgctggaaccatctggtggggattaaattcattaaacattcctctgtcagtagagactgtctgtgtcttcactgcacctgtattttcagcttttgcatcctgggcaacttaccttttgacaaaggaagttaagggctccggtgctggacttgcagctgctgctcttttggccatggttccctcatatatatcccgatctgtagctggtagctatgacaatgaagctgttgccatctttgctttgatcttcactttttatctttacataaagacattaaatacaggttccttattttatgccaccctgaatgctcttgcatacttttacatggtatgttcatggggaggttacaccttcattatcaatctgataccaatgcacgtgcttttgtgcattgtaactgggcgatactctccccgactgtacattgcctatgctcctttggttgtgttaggcacgttgttagcggcattggtgcctgttgttggtttcaatgcggttttgacttctgaacattttgcctcgtttttggtttttatcatcatccacgttgtagctctcgtatactacatcaaaggcattctttctcccaaaatgttcaaagttgctgtgacacttgttgtgtctatcggcatggttgtgtgtttcatagttgtggcaattcttgtggcattggtggcttcaagtccaacaggaggatggagtggtaggagtttaagtttacttgatccaacttatgcaagcaagtatattccaattattgcaagtgtcagtgaacatcaacctccaacgtggccatcttatttcatggatatcaatgttttggctttcttggtccctgctggcatcattgcgtgcttttcgcctctatctgatgccagctcttttgtggtcctttacattgtaatgtctgtatacttttctggagttatggttcgtcttatgctcgtgcttgctccagcagcatgcatcatgtctgggattgcgctctctcaagcttttgatgttttcacgggttccatcaaataccagttaggcgcatcgtctaattccacagatgatgcagaggacaacacttccacgaacaatgccccaaaagatgatgtttctgctggtaagactgacaagggtgaagaaattgtaaaagagcgttcttccaaaaagggcaagaagaaagagagagaaccggctgataaaccttctgttaaggccaagattaaaaagaaggctcttgtcttgcctcttgaagcctctatagttgcgcttcttctccttataatgttgggtgctttctatgtgatccattgtgtttgggcagctgcagaagcatattcagctccatcaatagttttgacatctcaatcgcgtgatggcctacatgtctttgatgattttagagagtcttatgcatggttaagccataatactgatgtggatgataaagtggcatcatggtgggactatggttatcagacgacagctatggctaatagaactgtgattgttgacaataacacatggaataatactcacattgcaactgttggcactgcaatgtcatctccagaaaaggcggcgtgggaaattttcaactccttggatgtgaaatatgttcttgtcgtctttggtggtcttattggttaccctagtgatgacatcaacaagtttctgtggatggttcgtattggaggcggcgtctttccacatataaaggaagctgattatctgagagatgggcaataccggattgattctgaggccactccaacaatgttgaacagccttatgtacaagctctcttactacaggtttgtagagacggatggtaaaggttatgatcgggtgaggcggacagagattgggaagaagcattttaagcttacacatttcgaagaggttttcacgagtcaccattggatggttcggctatacaagctgaaacctcccaggaacaggattcgtggtaaagcaaagaaactgaaatcgaaaacaagctctggattgagttcaaaatcagcgaagaagaacccgtgggtctagaaatcctagaattttcaatgttggatggtgagctatatgtcaactcttaggtctctttattatcgagaaagttgttgcagacgcagtcaagtttctggtgtaggattcgtaaaaattttgttaactttattcgaatttcatgtttattgcggagattttcaagtacggtagctaaagtatccatattacatcc

SEQ ID NO: 5377 - DNA, 2808 bp, Gossypium hirsutum
tctactcaatacaaaagtcacacacaagtacaaacgcaacgctaaacagccccttccatacttctctctttgtctcttcgcaagtgatcgctgattagccgtcaatggcggccccagagacctcaaccgctgccgtcccaacgctgtacaccaacaacaccttaagaaatgctttcggcggcgttctctctttcttcatcctcctccttatcggtgttatggctttctcgatccgtctattctccgttataaaatacgagagtgttattcacgagttcgatccttactttaactatagagtcactcagtttcttgcaaagaatggtatatacgaattctggaattggtttgatgatcgaacctggtatcctcttgggcgtgtgataggcggaactgtttatcctggattaactttgactgctggcaccatatggtggttgttaaattctttaaatattccactgtctgtggagaccgtttgtgttttcactgctccaatattctctgcttttgcttcatgggcaacataccttttgactaaggaagttaagggtactggtgctgggctgacagctgctgctcttttggccatggttccatcgtatatctctcgttctgtggctggtagctatgacaatgaagctgtagcaatatttgctttaatcttcaccttttatctttatataaagacattaaatactggatccctgttttatgccaccctaaattcaatctcatacttttatatggtgtgctcttggggaggatacacgttcattattaacctcattccaatgcacgtacttctatgcattgtaactggtcgtttttcttctcggctgtacattgcatatgctcctcttgttgttttgggaacactgcttgctgctttggtgccagtagttgggtttaatgccgtcatgacatcggaacattttgcatcattcttggttttcattattatccatgtggttgcttttgtgtactatatcaaagggattctttcccccaagatgtttaaagttgctgtgacacttgttgtatctgttggcctggcagtatgttgtgctgttatagctgttcttatagcattagtagcttccagtccaacgaagggatggagtggacgaagcttaagtctgcttgacccgacttatgcaagcaaatatataccgataattgctagtgttagtgaacatcaaccacctacatggccatcttatttcatggacattaatgttttggcattcttagttccagctggtatcattgcgtgctttttacctttatcagatgcaagctcattcgtggtcctctatattgcaacatctgtatatttctctggagtaatggtacgccttatgcttgtgcttgctccagctgcatgtatcacatctggaattgctctctcccaagcttttgatgttttcactggatcaattaagtttcagcttactggggcatcaagcaatactgaagttgatgctgcggaaactagttcctctactgctgaatcacagactgatgcagtgaagactgaaaaacctgaagagacagcaaagaatcgaccctcaaggaagagcaagaagaaggaaagggagcatggtgaaaaaccttcgaccaaagccaaagctgagaagaagaggcttcttgctttgcctttggagtcatctgtgatttctcttctcctacttgtcttgttgggtgctttctatgtggttcactgtgtttgggctgcagctgaagcttattcagccccctcaattgttttaacatctcgttctcatgatggtctacatgtttttgatgattttagagaggcttatgcatggctgcgccataatacagatgttgatgataaagttgcctcttggtgggactatggttaccaaaccactgctatggctaatcgcacagtcattgttgacaataatacctggaacaatactcatattgcaactgttggtactgcgatgtcttctcctgaaagggcagcttgggaaattttccactctttggatgtaaaatatgttctagtcgtctttggaggtctcgttggctaccccagtgatgatattaacaagttcctctggatggttcgaattggaggtggtgtgtttcctcatatcaaggaacctgattacctgagagatggccagtatcgcattgattcccaggccactcccaccatgctaaattgtctaatgtataaactctcttattacaggtttgtagaaactgatgggaaaggcttcgatagagttaggcagacagaaattggaaagaaatattttaagctcactcatttcgaggaggcattcacaactcatcattggatggttcggatatataaactgaagcctccgaagaacaggattcgaggaaagacgaagaaatcgaaatcgaaaactagctcaacaacaagcagtcctaaaagaagtggaacgaaaaagaagaatccatggcagtaagaacacaaatattttataacaatggtgaaagcatctgtaactcaataggattgtatgcatgagggagccttttagagagatgatccagttattcaggcaatggtaaggtaattttcctcttaagtagaaatacaaccaagacaatcaaagtaaaacaggatttgtggaacacctgacttgatcgctataatctttacgaaatcatcgaaacgtttaacacattaaatttcagggaaaagtgtcatttttcttgttaggttagtttataaatttgtttacttcacactatcttttgcatggtttaacaagcttaatatatttataacatgtttccctt

SEQ ID NO: 5378 - DNA, 2904 bp, Gossypium raimondii
gggagcacccgcactccttgttgtctcttccaaagtcttcttcttcagtctactcaatacaaaagtcacacacaagtacaaacgcaacgctaaacagccccttccatacttctatctctctttgtctcttcgaaagtgaccgctgattagccgtcaatggcggccccggagacctcaaccgctgccgtcccaacgctgtacaccaacaacaccttaagaaatgctttcggcggcgttctctctttcttcatcctcctccttatcggtgttatggctttctcgatccgtctattctccgttataaaatacgagagtgttattcacgagttcgatccttactttaattatagagtcactcagtttcttgcaaagaatggtatatacgaattctggaattggtttgatgatcgaacctggtatcctcttgggcgtgtgataggcggaactgtttatcctggattaactttgactgctggcaccatatggtggttgttaaattctttaaatattccactgtctgtggagaccgtttgtgttttcactgctccaatattctctgcttttgcttcatgggcaacataccttttgactaaggaagttaagggtactggtgctgggctgacagctgctgctcttttggccatggttccatcgtatatctctcgttctgtggctggtagctatgacaatgaagctgtagcaatatttgctttaatcttcaccttttatctttatataaagacattaaatactggatccctgttttatgccaccctaaattcaatctcatacttttatatggtgtgctcttggggaggatacacgttcattattaacctcattccaatgcacgtacttctatgcattgtaactggtcgtttttcttctcggctgtacattgcatatgctcctcttgttgttttgggaacactgctagctgctttggtgccagtagttgggtttaatgccgtcatgacatcggaacattttgcatcattcttggttttcattattatccatgtggttgcttttgtgtactatatcaaagggattctttcccccaagatgtttaaagttgctgtgacacttgttgtatctgttggcctggcagtatgttgtgctgttatagctgttcttatagcattagtagcttccagtccaacgaagggatggagtggacgaagcttaagtctgcttgacccgacttatgcaagcaaatatataccaataattgctagtgttagtgaacatcaaccacctacatggccatcttatttcatggacattaatgttttggcattcttagttccagctggtatcattgcgtgctttttacctttatcagatgcaagttcattcgtggtcctctatattgcaacatctgtatatttctctggagtaatggtacgccttatgcttgtgcttgctccagctgcatgtatcacatctggaattgctctctcccaagcttttgatgttttcactggatcaattaagtttcagcttactggggcatcaagcaatactgaagttgatgctgcggaaactagttcctctactgctgaatcacagactgatgcagtgaagactgaaaaacctgaagagacagcaaagaatcgaccctcaaggaagagcaagaagaaggaaagggagcatggtgaaaaaccttcgaccaaagccaaagctgagaagaagaggcttcttgctttgcctttggagtcatctgtgatttctcttctcctacttgtcttgttgggtgctttctatgtggttcactgtgtttgggctgcagctgaagcttattcagccccctcaattgttttaacatctcgttctcatgatggtctacatgtttttgatgattttagagaggcttatgcatggctgcgccataatacagatgttgatgataaagttgcctcttggtgggactatggttaccaaaccactgctatggctaatcgcacagtcattgttgacaataatacctggaacaatactcatattgcaactgttggtactgcgatgtcttctcctgaaagggcagcttgggaaattttccactctttggatgtaaaatatgttctagtcgtctttggaggtctcgttggctaccccagtgatgatattaacaagttcctctggatggttcgaattggaggtggtgtgtttcctcatatcaaggaacctgattacctgagagatggccagtatcgcattgattcccaggccactcccaccatgctaaattgtctaatgtataaactctcttattacaggtttgtagaaactgatgggaaaggcttcgatagagttaggcagacagaaattggaaagaaatattttaagctcactcatttcgaggaggcattcacaactcatcattggatggttcggatatataaactgaagcctccgaagaacaggattcgaggaaagacgaagaaatcgaaatcgaaaactagctcaacaacaagcagtcctaaaagaagtggaacgaaaaagaagaatccatggcagtaagaacacaaatattttataacaatggtgaaagcatctgtaactcaataggattgtatgcatgagggagccttttagagagatgatccagttattcaggcaatggtaaggtaatttttccttaagtagaaatacaaccaagacaatcaaagtaaaacaggatttgtggaacacctgacttgatcgctataatctttacgaaatcatcgaaacgtttaacacattaaatttcagggaaaagtgtcatttttcttgttaggttagtttataaatttgtttacttcacactatcttttgcatggtttaacaagcttaatatatttataacatgtttcccttataaatacttcattttaaacacttcttgattcctatggttcttgt

SEQ ID NO: 5379 - DNA, 2594 bp, Papaver somniferum
caactgaaaatctcgatttctcgccaccaatggcgacggttatagagactgtcaaaccaccaccaggaggagcatcaagtgaacgaaatctgagaaacgcattcggaggcgttttatctttattcattcttctattgattggaattcttggattctcgatccgtcttttctctgttattaagtatgaaagtgttattcatgagtttgatccttacttcaattacagagttactcagtttcttatcaagaacggaatatatgatttctggaactggtttgatgaccgaacatggtatccccttggtcgagtgattggtggaactgtttatcctggattgacattgacagcaggaacactatacaagatactacatgctttgaacatccctttgtctgtggaaactgtttgtgtgttcactgcccctatattctctgctttcgctgcttgggcgactttccttttgaccaaggaagttaagggtactggtgctggattgacagcagctgctcttttggctatggttccttcttatatatctcgttctgtagctggaagctatgacaatgaagctgtagctatctttgctttaatcttcactttctatctctatataaagacattgaacaccggatctctcttctatgcgactttaaatgctctagcatacttttacatggtgtgctcttggggaggttacacctttattattaaccttatcccaatgcatgtacttctgtgcattggaactggtcgttactcttctcggctgtatgttgcatatgctcctcttgttgtcttgggtacattattggccgctttggtgcctgttgttggcttcaacgctgtgatgacctcggaacacttcgcttcattttggtttttatcattatacatgtggtggctcttgtgtattacatcaagggagttctctctccaaaaatgttcaaagtggctgtgacacttgtggtatctgttggcatggcggtctgtattgccgttgttgcaatccttgtggcagtggtggcctccagcccaacaaagggatggagtggtcgcagtttgagtcttcttgatccaacttatgcgagcaagtatatacccattattgctagtgttagtgagcaccaaccgccaacgtggccatcttactttatggacatcaacgttttggcattcttggttccagctggtataatttcatgctttcttccactatcggatgccagttccttcgctgtcctttatatagtaacatcagtatacttctcaggagtcatggttcggctgatgcttgtattcgctccagcagcatgcattatggctggaatcgctctttctggagcctttgatgttttcacaagctcagtcaaatttcaactgcctggattactaggggattctgatgcagggaatattacttccggggatgtagtacaaaatggcgtaaccatggctgattcaaatgcagctgctaagaaaagcgaagaaactctaaaggaacgtccatcgaagaagaacaagaagaaagaaaaagaacctgtagtgaaggcttctattaagtccaaaattcagaagaggcttctggtcttacctttggaagcatctatcattgcccttctcttgcttattttgttgggtgccttttatgtgattcattgtgtctgggcagctgctgaagcttactcagctccttctatcgttctaacctctcagtcacatgatggccttcatgttttcgatgattttagagaagcttatgcttggttaagccataacactgaagtagatgataaggttgcgtcatggtgggactatggttaccaaactactgcaatggctaatcgtactgtcattgttgataataatacctggaataacacacatattgcaactgttggaactgccatgtcttctccagagaaagccgcgtgggaaattttcaactcgttggatgtaaaatatgttcttgtcgtctttggaggtcttgttggataccctagtgatgatataaataaatttctctggatggttcgtattggaggtggtgtgtttcctcacatcaaggagcctgactatctcagagatggtcagtaccggatcgataatcaagcaactccaactatgctgaattccctcatgtacaaactttcatattacagatttgtggaaacagatggtaaaggttatgacagagtaaggaggactgaaattggaaagaaacatttcaagcttacacattttgaggaggtcttcaccacacaccattggatggtgcggctatacaagctaaaacctccaaggaacaggattaaaggaaagacaaagaaatcaaaagggacttcaaaatcaagctcaactagcacaaagggaaagaagaacccttggcattaggaaaaccaacttatagtaacaggttagcttttataatagggggatgagaatgtgtctcagtcgagagattcattttgcaggtcgggtgttgttaacaaatacaaattgataaaagattttgtagctcagattttgtatcattctttttctttcttccccttctgcactcattataaaaggaagagagtgatttttatgatga

SEQ ID NO: 5380 - DNA, 2585 bp, Vinca minor
cgctgtagcagagcttgttttggccgtcaatggcggagcaggagacgacgtcgtcgacgccatcaaccctacgatacgcatttggaaatgtcctctcattcctcatccttctcttaatcggcgttatcgctttctcgatccgtctcttctctgtaattaagtacgagagtgtaattcatgaatttgatccttatttcaattacagagtcactcagttccttacgaagaatggaatatatgatttctggaattggtttgatgatcggacctggtatcctcttgggcgtgtgattggaggaactgtttatcctggactaacattgacagcgggcaccttgtggtggttgttgaattctttaaacattcctctgactgttgaaactgtctgtgtgtttactgccccggtattctcagcatttgcttcttgggcgacataccttttgacaaaggaaattaagggcactggtgctggtttgactgctgcagcacttttggccatggttccttcctatatatcacgatcggtggctggcagttatgataatgaagccgtggctatatttgctttaatcttcactttctacctctatataaagaccttaaacactggatctctcttttatgcaactctgaatgccattgcctacttttatatggtttgctcatggggagggtacacctttataatcaacattattccgatgcatgtgctgctatgtattgtaaccggtcgctattcttctcgattatacattgcatatgctccacttgttgttctcggaacattgttggctgcattggtccctgttgtagggtttaacgcagtcatgacatcagaacattttggatcatttctggtttttatgatcatccatgttgtagctcttgtttactatatcaaaggaattctgtcgccaaaaatgttcagggttgccgttacacttgtgttcacattttccctgatagtttgcggtattgtggtggccatacttatagcattggttgcatccagcccaacaaaaggctggagtgggcgtagtttgagtctgcttgatccaacttatgcaagcaagtacatcccgattattgctagcgttagtgagcatcaaccacctacttggccatcttattttatggatattaatgtcttggcattcttggttccagctggcatcatagcatgcttttcgccactctccgatgcaagctcttttgccgttctttacattgtaatatccgtctatttctctggtgttatggttcgactaatgcttgtccttgccccagcagcttgtataatgtctggaattgctctttcaggagcacttgatgtatttactcgttcaatcaaatatcagttgcctgatatatcagaaaattcacgaactaatgggataccagttctgacagtgttgcttcacagaatgatgtggtaaagactgagaaaagtgaagaaactgtaaaggaaagaccctcaaggaaaagcaagaaaaagaaggaggaaaaggagaacgctgagaaggcttccattaggtcattggttgagaggagactttcggttttacctctggagacttctttgatagctatatttttgcttatcttgctggttgccttttacgtggttcactgtgtctgggcagcagcagaagcatattcagcaccctctattgtgctaacgtctcagtctcatgatgggcttcatgtttttgatgactttagagaggcttatgcatggttgagtcataacacagaggtggatgataaagttgcatcttggtgggactatggttaccagacaactgcaatggctaaccgcacagtgattgttgataataacacctggaacaacactcatattgctactgttggcactgctatgtcctccccggaaaaggcagcttgggagattttcaattctttggatgtaaaatatgtgcttgttgtctttggaggtcttgttggctacccaagcgatgatattaacaagttcttatggatggttcggataggagggggtgtttttcctcacatcaaggaaccggattatctgagagatggccaatatcggatcgattctcaggccaccccaaccatgctaaattccctcatgtacaagctatgttattacagatttgttgagacggatggcaaaggctttgatagagtaaggcgaactgaaattggaaagaaacattttaagctcaactattttgaggaggttttcactactcaccactggatggtccggttatacaagttaaaacctccaaggaacagaattcgagggaagaccaagaaatctaaagcgaaatctagctcaacaactacatcaagaagtggcagcataagaaagaggaatccttggcattagaaaacattttatgctaggaagtgatatcaggccattctgttgtaagaaaaatataatagttttacgtcagcctcttggtagggattgtgcggcagaagttatatttacaacagggatgagaaaactcaaaagattttgcagttttaaagtattactttgacatcgttttaaccagtcacaggcgaattgaaaagtaaaacatgtagtttcg

SEQ ID NO: 5381 - DNA, 2768 bp, Musa acuminata
cgaaacccttgcaaagtcttcgtcgcggtctcgtcttccgtcccttcgcgtgctcccgtgcttgatcccgccgtcgatggcggcttcctccgagaccaaaggggaaggaaccctgaggaaggctttcgggggcgttctcggcttcttcattctcctcctgatcggagccctcgccttctcgatccgcctcttctccgttatcaagtacgagagcgtgattcacgagttcgatccgtacttcaactacagagtcactcagtttcttacaaagaatggaatatatgatttctggaactggtttgatgatcgaacctggtatccccttggtcgtgtaattggtggaactgtttaccctggtttgacgctaacagcaggttccatatggtggctgctgaataacctgaacattcctctgtcagtggagaccgtctgtgtattcacagctccaatcttttcagctaatgcatcttgggctacgtaccttctcacgaaggaagttaagggaactggagctggattaactgctgcagccctattggcaatggtgccctcgtacatatcaagatctgtggctggtagctatgacaatgaagctgttgcaatatttgccttaatattcacgttttatctttataccaagacactgaatacgggatcactcttctatgctaccttaaatgctctgtcatacttctacatggtgtgctcttggggaggctatacattcatcattaaccttattccaatgcatgttttgctatgtattgtaactggtcgttactctccacggttgtacattgcctatgcccctcttgttgttttgggaacacttctagcctctttggtgcctgtggtgggtttcaatgccgtgatgacatcggagcattttgcttcatttttggtttttataataattcatgtggttgcacttgtttattatatcaaaggaattctatctcccaagatgtttaaagtggctgtgacacttgttgtgacgattggcattgctgtttgttgtgcagtgttggctattcttatagcactggtggcctctagtcctacaaaaggttggagtgggcgtagcttgagtcttcttgatccaacttacgcaagcaagtacatacccatcattgctagtgttagtgaacatcagccaccgacatggccttcttatttcatggacatcaatgtgttggcattcttggttccagctggtattgttgcatgttttttgcctctgtctgatgctagctcgtttatggttctgtatataacaacatcagtatacttttctggtgtcatggtgcgtcttatgcttgtactagctccagctgcatgcattatgtctgggattgcactttctgaagcctttgatgtcttcacacggtcaataaaacttcagttgcctaaattatttgaaagtcctcctcctggttcaggggatattgattccgctcaagatgaagttgtaaaggtggataacaaggcagcaactgataaatctgaaactgctccaaaagaaagaccatcaaagaagaataggaaaaaggaaaaagaaattgtggaaacgactattaaaaggcctctaaaggcaaaaagacttctggtgctgcctttggaggcatctgcagtcgcaattcttctactgatcatacttggtgctttttatgtggttcattgtgtatgggcagcagcagaagcttattctgccccatcaattgttctaacatctcattcccatgatggattacacgtttttgatgattttcgcgaagcctatgcatggttgaggcataatactgatgtagatgataaggttgcctcttggtgggactatggttaccaaacaaccgcaatggcaaatcgtactgtcattgttgataataacacctggaataacactcatattgcaactgttggcactgctatgtcttctccagaaaagccggcatgggagatattcaactccctggatgtcaaatatgttttggttgtctttggaggtcttgttggctacccaagtgatgatattaataagttcctttggatggttcgaattggaggaggtgtgtttccacatatcagggagcctgactaccttagggatggccaatatcgaatcgatgcacaggcaactccaacaatgttgaactgccttatgtacaagctgtcttattacaggtttgtagaaacagatggtaaaggctttgatagagtcaggaggacagaaatagggaaaaaacatttcaaactaacccatttcgaggaggtgttcactacacatcattggatggttcgtatttacaaattgaaacccccaaagaataggatccggggaaaatcgaagaaatctaaatcaaattccaaaacaagtccaagcaattcgaagaggcacggtaacttacggaagaacccctggcagtgatttgaataaagcaaattggccgtccggtatagtgtagctggcccttcccatagactattcttgccgttttgctcatgaactattggaagagtgagttgcagctaatagcggcggatgcttggcagaggactaaatacaagactatgatcacacagtccctattatatcttttatttattttttgccttgcatcatcagggggagatatgagatttttgatagcttaccaagaaagacccttttagatttgtcatttgtcatgtgatagtgattcatctgtgtaacctcggatcgtttggcttgtaacggtggatcccaaccagagaagatagcagaaataacc

SEQ ID NO: 5382 - DNA, 2344 bp, Chrysanthemum coronarium
cacacaaaaatcaaagccgttaatggcggcatctacagacacaacaacgacgagtctccgtcacgcatccggtcacatcctagccttcttcattcttctcctgatcggcgtactcgcattctcgatccgtcttttttcggttattaagtatgaaagtgtgattcatgagtttgatccttatttcaattacagagttactcagtttctcacaaagaatgggatatatgacttctggaattggtttgatgatcgaacatggtatcctcttggacgagtcattggtggaacagtttaccctgggttgactttaacagccggaactatgtggaaggtacttcagtccttgaatattccactatccgtggaaacagtttgtgtattcactgctcctgtattctctgccttcgctgcatgggcaacatatctcttgacaaaggaagttaagggagcaggtgctggactaacagctgcagttcttctggccatggtaccatcatacatatctcgatcagtggctgggagctatgacaatgaagctgtagccatatttgctctgattttcaccttctatctctacataaagacattgaacacaggatcccttttctacgctactttaaactcaatttcatacttctacatggtttgctcgtgggggggttacacctttattatcaacctcataccaatgcatgtgcttctttgcattgtgactggtcgctattcacctcgtctgtacattgcatatgctccacttgttgtgttaggaacattattggcagcattagtacctgttgttggttttaatgcggtcatgacatcagaacattttgcatcctttttggttttcattattatccatgtggttgctcttgcatattatattaaaggaatgctctcgccaaagatgtttaaagtagctgccaccctcgttgtatcagttggcctggtggtttgctgtgctgttgtagctgtacttatagctgtggttgcatcaagtccaacaaagggatggagtggtcgaagtctgagtcttcttgatccaacatatgcgagcaagtacataccgataattgccagtgttagcgaacatcaaccacctacttggccatcttacttcatggatattaatatattagcattcttggttcctgctggaattattgcatgcttttcaccgctatctgatgcaagctcctttgtcattctgtacatagtaatgtcagcatatttttcaggtgttatggtacgacttatgcttgtgtttgctccagctgcatgtataatgtctggaattgctctttctgaagccttcgatgttttcacaagatcaataaaattctatgcatctgagtcatctgaaaatgtccagaatgaagcaggagataatgtgatgaagactgacacaaaagaagagatattaaaggaacgaccttccaagaaaaacaagaagaaagagaaggagaataacgttgaaaagcccactaagaagtcccacactgaaaagcgggccctagttttacctgttgggttatctgtgttttctctgttcttaatcgtgttgctagctgccttttatgtggtccatagtgtttgggctgcagcagaggcatattcagctccttcaattgtgctcacttcttattcacctgatggggggcttcatgttttcgatgatttcagagaggcttatgcgtggttaagccataacactgaagtagatgataaagttgcatcttggtgggattacggttaccaaacaactgcaatggctaaccgcacagttattgttgacaacaacacatggaacaacacacatatagctactgttggtactgccatgtcatcacccgaaaaagctgcgtgggaaattttcaactccctggatgtaaaatacgtccttgtcgtttttggaggtgtggtgggctactctagtgatgacataaataagttcctatggatggttcgtataggaggaggtgtattcccacatatcaaggagcctgattatctgagagatggtcaataccggatcgattctcaggctaccccaactatgctaaacagtctcatgtacaaactgtcatatttcaggttctgggagaccgatggtggtaaaggatatgatagagtaaggaggactgaaatcggaaggaagcatttcaaattaacacattttgaagaggtcttcacaactcatcattggatggtccggatttatcaactaaaacctcagaagaacaggattcgggggaagacaaaaaagtctagatcgaaaacaagctcatcaacaccaacaaaaacaagaacaataacgaagaagaatccttggcactagatgcca

SEQ ID NO: 5383 - DNA, 2750 bp, Triphysaria pusilla
gtcttgtcgaaagtcctactgctacaaaacccgccttcagtcttgttctcacactcggtgtgtgtatttgcagactcgcaattttcatacagaaagattgaatcagggccgtcaatggcggtgccggagacttcaaaccaaacggctcttcgtcatgctttcggaaatgtgatttccttcttggttctgttactcatcggtgctctcgctttctcgatccgcctgttctccgttatcaagtacgaaagcgtaattcatgaattcgatccttatttcaattacagagtgactcagtttcttacgaaaagtggggtatatgacttttggaattggttcgatgaccgaacttggtatcctctcggacgagtgattgggggaactctttaccctggacttatgttgactgcaggcactttatggagggtatttaacgccttgaatattcctctatctgtggaaactgtatgtgtgttcacagctcctattttctctgcttttgcgtcgtgggcaacataccttctgacaaaggaagtcaaaggtgctggtgctgggttgactgctgcagctcttttggccatggtaccatcatatatctcacgatctgtggctggaagctacgacaatgaagctgtggctatatttgctttgatcttaactttctatctctatataaagacactgaacacaggatctcttttttatgctactctaaatgcgatagcatacttttacatggtttgttcttggggagggtacacatttattataaatcttattccgatgcatgtaatgctatgcattgtaactggtcgctattcttcaaggctctacattgcttatgctccacttgttgtcttgggaactttgttagcggctctggtgcctgttgtaggttttaatgctgtattgacatcagagcattttgcttcatttttagttttcatcattatacacgttgtggctctagtttatcacatcaaaggaattctctcacctcaaatgttcaaagtagcggttactcttgttgtatcagctgggctgattgtttgcggtgctgttttggctgtattagtagcattggtagcttccagcccaacaaaaggatggagtggacgaagtttgagcctgctcgatccaacttatgcgagcaagtacataccaattattgccagtgttagtgaacatcaaccccctacatggccgtcttactttatggacattaatgttttggcatttttggtcccagctggcatcattgcatgctttttgccactctctgatgcaagctcttttgcagttctttatattgttacagcagtatatttctctggtgtcatggtgcgcctgatgcttgttctcgctcccgcagcttgtataatgtctggaattgctctttcagaagcttttcatgtttttactagatcgataaaattccacttgctgagtgcaacggaaagccccaatgtcaatgcaggggataccactactgttgcacaaaataatgtggtgaagaccgagaagaatgaggatgcaccaaaggaaaagtcttccaaaaagaacaagaagaaggaaaaggagaatgtagagagagtttctcttgtatcccggatagaacagaagcttctggttttaccattggagacttctctcgttgccgttttcttacttgtcttgctgggtgctttttacgtggtccattgtgtctgggccgctgcagaggcttattctgctccatctattgtgctaacctctcatactaatgatggccttcacgtctttgatgacttcagagaggcatattcttggttgagccataacacagaggtggacgataaagttgcatcttggtgggattatggttaccaaacaactgctatggcaaaccgtactgttattgttgacaataatacttggaataacacacatattgcaactgttggtactgcaatgtcctctcctgaaaaggcagcttgggatattttcaactcattggatgtgaaatatgttctagttgtttttggaggtcttgttggctatccaagtgatgacattaacaagtttctgtggatggttcggatagggggcggtgtatttcctcacattaaggaacctgattatttgagagacggacagtaccggattgattctcaagcaactccaaccatgcttaacagcctcatgtataaactttcgtattacagatttgtggagacagatggtggtagaggctttgacagggtgaggaatactgaaatcgggaaaaagtatttcaaacttactcactttgaagaggtattcaccactcatcattggatggtccggatatacaagttgaaaaccccaaggaatagaatccgtgggaagaccaagaaatctaaatcgagaggtggctctacaacaagctcaaaacgaagtggaacaaaaaagaagattaatccttggaattaactcgactttgtgattctcacttgtgtacgacaatcaatctcagtgtgctgtactcgcaatatttttatgaccggacttttatctttcatatagaggaaacagaaaaggaaggatcttgctcggtaccatatatatattgatgtttaacgtccggatatttcataggatgatagtgctagttgagagctgtttaacaaattttgacatgctttttatgatgaggccgttgactacaagaaaccacatatttagtcccgtgttcatggataggttcaatgacaattttcatatcatcttagaac

SEQ ID NO: 5384 - DNA, 2428 bp, Tripterygium wilfordii
agtcttcgccttctcgatccgtctattctccgttataaagtacgagagtgtcattcacgaatttgatccttatttcaattacagagtcactcagttcctgacgaagaatggaatatatgacttttggaattggtttgacgatcgaacctggtatccgctgggccgtgtgattggtgggactgtttatcctgggttgaccttgacagcaggcaccatatggtggtttgtgaactctttaaatatccctctttctgtggagactgtttgtgtgttcactgctcctattttttccgcttttgcttcatgggcaacttacctcttgacaaaggaagtgatgggtgctggtgctggactgacagcagcggctcttttggccatggttccatcatacatatcacgatctgtagctggcagctatgacaatgaagccgtggctatatttgctttaatcttcactttctatctttatataaagaccctgaatacaggatccctcttctatgccactctaaatgccatagcatacttttacatggtttgttcatggggaggatacacctttataatcaatctcattccgatgcatgtccttctgtgcattgtaactggccgttactcttcccgactgtacattgcttatgctcctcttgttgtcttagggaccttgttagctgcactggtacccgttgtcggattcaatgcagtcatgacatcagaacactttgcgtcgtttttggttttcatcatcctccatgtagtagctcttgcatactatatcaaaggaattctttctccaaaaatgttcaaagtagctgttacgcttgttgtatctgttggcttggttgtgtgttgtgctgtggtagcagttttgatagcattggtagcctccagcccaacgaagggatggagtggacgaagtttgagtctgcttgatccaacttacgcaagcaaatacattccaattatagccagcgttagcgaacatcaacccccaacctggccatcttacttcatggacatcaatgttttggcattcttggttccagctggcattattgcatgctttttgcctctgtctgatgcaagctcctttgcggtgctttatattgtgacatcggtatatttctctggtgtcatggtgcgccttatgcttgtacttgctccagcagcttgtatcatgtctgggatcgccctgtctaaagcttttgatgttttaacacgatcaatcaagtttcagctacctacactgttggggaactcacaagttgatgcaggggataatagttctggtgctgttgtagcccaaaatgatgcagcaaggattgataaaagtgaagataaactgagggagcgaccatcaaagaagaacaagaagaaggaaaaagaaaatgtggaaatttcatctaccaagcctaagaaggaaaaaaggcttctggttttacctatggtggcatctgctattgctattttcttacttgtgatgcttggtgccttctatgtggttcattgtgtctgggcagctgctgaggcttattcagctccttccattgtcttaacgtctcattcacctgatggtggtttacatgtttttgatgattttagagaggcatatgcgtggttgagccataatactgaggttgatgacaaagttgcatcatggtgggactatggttatcaaacaactgctatggctaaccgcactgtcattgttgacaacaacacatggaataacacacatattgctactgttggtactgccaatgtcttctcctgaaaaggctgcctgggaaatctttaactcactggatgtgaagtatgttctagtcgtctttggaggtcttgttggctaccccagtgatgatattaataagttcctgtggatggttcgtataggagggggtgtcttcccccatatcaaggaacctgattacctcagagatggtcagtatcgcattgattctgaggccactccaaccatgttaaactgtctcatgtacaaactttcgtatttcagatttgtggaaacggatgggaaaggctttgacagagtgaggcggacagaaatcgggaagaaatatttcaagcttacccatttcgaagaggtgtttacaactcaccattggatggtacgtatatacaaattgaaacctcctaagaacagaatcaggggaaagaccaaaaaatcgaaatcgaaagcgagctcaacaagtagctcaaaaaggagtggtacaagaaagaacccttggcactagaaaacatcagaacgtttatatttaaggttagtttctgtaattttcatatgattgcaagcaaaaaccctttagagagtgggccggttgtcgtttttatttacaggaatgcaaatgatgatacagaagattttgtagtctcatcccttgatcatgtaatttgcccagccaccataatg

SEQ ID NO: 5385 - DNA, 2625 bp, Papaver somniferum
attcttctattgattggaattcttggattctcgatccgtcttttctctgttatcaagtatgaaagtgttattcatgagtttgatccttacttcaattacagagttactcagtttcttatcaagaacggaatatatgatttctggaattggtttgatgaccggacatggtatcccctcggtcgtgtgattggaggaactgtttatcctggattgacattgacagcaggaacactatacaagatactacatgctttgaacatccctttgtctgtggaaactgtttgtgtgtttactgctcctatattctctgctttcgctgcttgggcgactttccttttgaccaaggaagttaaaggtactggtgctggattgacagcagctgctcttttggccatggttccttcttatatatctcgttctgtagctggaagctatgacaatgaagctgtagctatctttgctttaatcttcactttctatctctatataaagacattgaataccggatccctcttctatgcgactttaaatgctttagcatacttttacatggtgtgctcttggggaggttacacctttattattaaccttatcccaatgcatgtacttctatgcattggaactggtcgttactcttctcggctgtatgttgcgtatgctcctcttgttgtcctgggtacattattggccgctttggtgcctgttgttggcttcaatgctgtgatgacctcggaacacttcgcttcattcttggtttttattattatccatgtggtggctcttgtgtattacatcaagggagttctctctccaaaaatgttcaaagtggctgtgacacttgtggtatctgttggcatggtggtctgtattgccgttgttgcgatccttgtagcagtggtggcctccagcccaacaaagggatggagtggtcgcagtttgagtcttcttgatccaacttatgcaagcaagtatatacccattattgctagtgttagtgagcaccagccgccaacatggccatcttactttatggacatcaacgttttggcattcttggttccagctggtataatttcatgctttcttccactatcggatgccagttccttcgccgtcctttatatagtaacatcagtatacttctcaggagtcatggttcggctgatgcttgtattcgctccagcagcatgcattatggctggaatcgctctttctggagcctttgatgttttcacaagctcagtcaaatttcaactgcctggattactaggggattctgatgcaggggatattacttccggggatgtagtacaaaatggcgtaaccaaggctgattcaaatgcagctgctgagaaaagcgaagaaactctaaaggaacgtccatcaaagaagaacaagaagaaagaaaaagaacctgtagtgaaggcttctattaagtccaaaattcagaagaggcttctggtcttacctttggaagcatctatcattgcccttctcttgcttattttgttgggtgccttttatgtgattcattgtgtctgggctgctgctgaagcttactcagctccttctatcgttctaacctctcagtcacatgatggtcttcatgttttcgatgattttagagaagcttatgcttggttaagccataacactgaagtagatgataaggttgcgtcatggtgggactatggttaccaaactaccgcaatggctaatcgaactgtcattgttgataataatacctggaataacacacatattgcaactgttggaaccgccatgtcttctccagagaaggctgcgtgggaaatcttcaactcgttggatgtaaaatatgttcttgtcgtctttggaggtcttgttggataccctagtgatgatataaataaatttctctggatggttcgtattggaggtggtgtgtttcctcacatcaaggagcctgactatctcagagatggtcagtacaggatcgataatcaagcaactccaaccatgctgaattccctcatgtacaaactctcatattacagatttgtggaaacggatggtaaaggttacgacagagtaaggaggactgaaattggaaagaaacatttcaagcttacacattttgaggaggtcttcaccacacaccattggatggtgcggctatacaagctaaaacctccaaggaacaggattaaaggaaagacaaagaaatcaaaagcgagttcaaaatcaagctcaactagcacaaagggaaagaagaacccttggcattaggaaaaccaacttatagtaacaggttagcttttataatagggggacgagattgtgtctcagttgagagattcattttgcaggtcgggtgttgttaacaaatacaaattgataaaagattttgtagctcagattttgtatcattctttttctttcttccccttctgcactcattataaaaggaagagagtgatttttatgaagaaatccgatgaagatatgatctgccattttgagttcatagaaaattaatgaggtgtaaactaaagttaaaaaattgagttgatagagaaaattaatgaggtgtaataactaaagttaaaaaattcaagtagtgttgtaaaacaaaaaaaaaaaaaa

SEQ ID NO: 5386 - DNA, 2707 bp, Tropaeolum majus
gcactccctccttgttccacattcactctaaatctcgtcctgatcgccggtcaatggtggccccggagagtcaaccgtcagggacgaatttgaagtttgcggtcgggaatgtgttgtcgttcttcattctcatcctaatcggagtcctcgccttctccatccgtctcttctctgttataaagtatgagagcgttattcatgagtttgatccttatttcaattatagagttactcagtttctgtcaaagaatggcatatatgatttttggaattggtttgatgaccgaacctggtatcctcttggccgtgtgattggtggtactgtctaccctgggttgacattgacagcaggcaccatatggcggatattgaatgctttaaacatccctctgtctgtggagactgtttgtgtattcactgcacccatattttctgcttttgcctcttgggccacttatctcctaaccaaggaagttaaaggtactggtgccggactgacagcagctgttattttggccatggttccatcgtatatatctcgttctgtggccggcagctacgacaatgaggctgtggccatatttgctctgatatttaccttttatctctatattaagactttgaatacaggatcactcttttatgccactctaaatgctttagcatacttttacatggtctgctcatggggaggatacacctttatcatcaatcttattccgatgcacgtgcttctgtgcattgtaactggtcgttattcttctcgactctatattgcatatgctccctttgtagtattgggaacattgttggcagcattggtccctgtagttggcttcaatgctgtcatgacatcggaacattttgcctcatttttggttttattgttattcatgtcgtggctcttgtgtattatatcaaaggaattctctcccccaaaatgtttaaagtagcggtgatgcttgttgtatctgttggcctggtagtttgttttgctgtaatagcaattcttatagcgttggtagcctccagtccaacaaagggatggagcggacgaagtttgagtcttctggacccaacttatgcaagcaaatatataccaattattgccagtgttagtgaacaccaaccacctacttggccctcctacttcatggacatcaatgttttggcattcttggttcctgctggcattgttgcatgcttcttgcctctatctgatgcaagctcctttatggtcctctatatagttacatctgtctatttctctggagtgatggtccgtctcatgcttgtacttgctcctgctgcatgcatcatgtctggaattgctctctcccaagcttttgatgttttaacaggatcaattaagtttcagttaccaggactgttaggggatcccaagattgatgcaggggataccagttctgcgtctgaaatagcccaaaacaatgaagtaaagaccgacaaaactgaagacacattaaaggaacgaccatcaaaaagaaacaagaagaaggagaaggagagggagaaggagccagcagaaaaaccatctgttaagcctaaaactgggaaaaggctcctggctttgcctatggaaacatctgtgcttggtcttctactacttatcatgttgggtgccttctacgtggttcattgtgtgtgggcagcagcggaagcttattcagccccttctatagtattgacatctcagtcgcacgatggcctgcatgtttttgatgattttagagaggcttatgcatggttgagccataacactgatgtggatgacaaagttgcatcatggtgggactatggttaccagaccactgcaatggctaatcgcacagtcattgttgataataatacttggaataacacacatattgcaacagtgggcactgcaatgtcttctccagaaaaggcagcttgggagatttttaactcattggatgtaaaatatgttctcgttgtgtttggaggttttgttggctaccccagtgatgatataaataagttcctgtggatggtccgtataggagggggtgtcttccctcatatcaaggaacctgattacttgagggacggtaattatcggatagattctcaggccaccccaacaatgttgaactctctcatgtataagctctcctattacaagtttgtcgatactgatggtaaaggatatgatagagttagaaggacagaaatcggaaagaagcatttcaaacttacccatttcgaggaggttttcacaacacatcactggatggttcggatatacaagctgaaacctcagaaaaacaggatccgtgggaagacaaagaagttaaaatcgaaaactagcttgaaaagaagcgatacgagtagaaagaatccttggcactaaaaatcttactttcatagattaatactgaggtcagttacttgtaatccaaatctaatttatgtaggaggcttcagagaagtgggaatgaatatgcttttgggctatacaccataccccttcacataaaattcaaatgattaatcgaaagattttgtttattttttcgataataacttgtaattcatgcattatcattctactgctgcttttctagaaaaaaagagagaacattaaatcaattttaagctagtaactaaggggaatgatattatgtacaagatgtatgattttccacctactgaaaaacctgtcctt

SEQ ID NO: 5387 - DNA, 3778 bp, Brassica oleracea
gaagatagttttgcttccataaacccttcccacctttgagactcctttctcactctcctctcctccgaagagctcaccttcgccgcgtaaaaatggcggctgtagagagcccacctcccggaacgccgtctgcgatgaggaatgctttcgggaccgttctgtcagctctgatcctcgtcctcattggtgtcctcgctttctcgatccgactcttctccgtgataaagtatgaaagtgtgattcatgagtttgatccttacttcaattatagagtcactcagttcttatcaaagaatggaatatacgagttctggaattggtttgatgatcggacctggtatcctcttggccgtgttattggaggaactgtttaccctggtttaacattgacggctggaaccatctggtgggtcttgaattcaataaacattcctctgtcagtagagactgtttgtgtcttcactgcacctgtgttttctgcttttgcatcatgggcgacttaccttttgaccaaggaagttaagggctccggtgctggactagcagctgccgctcttttagccatggttccctcatatatatcccgatctgtagctgggagctatgacaacgaagctgttgccatttttgctttgatcttcactttttatctttacataaagacactaaatacaggttccttgttttatgccaccttgaatgccattgcatacttttacatggtatgttcgtggggaggttacaccttcattatcaatctgattccaatgcatgtgcttctgtgcattgtaactggccgatactctccccgactatacattgcctatgctcctttggttgtgttgggcacgctgttagctgcgttggtacctgttgttggcttcaatgcggttttgacgtctgaacattttgcctcgttcttggttttcattatcatccatgtagtagcactcgtatactatatcaaaggcattcttactcctaaaatgttcaaagttgctgtgacacttgttgtgtctatcggcctggttgtgtgtctcatagttgtggcagttcttgtggcactggtggcttcaagtccaacaggaggatggagtggtaggagtttgagtctacttgatccaacttatgcaagcaagtatattccaattattgcaagtgtcagtgagcatcagcctccaacttggccgtcctatttcatggatatcaatgttttggctttcttggtccctgctggcatcattgcgtgcttttcgcctctgtctgatgcgagctctttcgtggtcctctatattgtaatgtctgtatacttctccggagttatggttcgtcttatgctcgtgcttgctccagcagcatgcatcatgtctggaattgcgctctctcaagcttttgatgttttcacgggttccatcaaataccagttatcgtctaaatccaaagatgatgcagaggacaacacttctacaaaaaatgccccaaaagatgatgcttcttctggtaagactgacaagggtgaagaagtttcaaaagaacggtcttcaaaaaagggcaagaagaaagagagagaacctgctgagaaaccttctgttaagtctaagattgtgaagaaaaaggctcttgttttgcctcttgaagcctctatagttgcgcttcttctccttataatgttgggtgctttctatgtgattcattgtgtttgggcagctgcagaagcatactcagctccatcaatagttttgacatctcaatcgcacgatggccttcacgtctttgatgattttagagagtcttatgcatggttaagccataatactgacgtggatgacaaagtggcatcatggtgggactatggttatcagacgacagctatggctaatagaactgttattgttgacaacaacacctggaataatactcacattgcaactgttggcactgccatgtcatctccagaaaaggcggcgtgggaaattttcaattccttggatgtgaaatacgttcttgtcgtctttggtggtgtgattggttacccaagtgatgatattaataagtttctgtggatggtgcgtattggaggcggcgagtttcctcatataaaggaagctgattatctgagagatggtcaataccggattgattcagaggccacgccaacaatgttgaactgccttatgtacaagctctgctactacaggtttgtagagacagatggtaaaggctatgacagggtcaggcggacagagattgggaagaaacatttcaagctcacacatttcgaagaggttttcactagtcaccattggatggttcggatatacaagctgaaacctcaaaagaacaggattcgtggtagagtaaagaagctgaaacagaaaacaagctctggagtgagctcaaaatcagtgaagaagaatccgtggatgtagaaatcctagaactttcaatgttgttgctgacgcagtcaagtttctggtgtaggattcgtaaaagttttgtagaacttttgtggatttgttaaagcgaattttatgtttattgtggagatttacaccagatgatatctatgaagaattttaagttaatatcaaataagcatatacctattttacaagccaaacaacgctcacctctttcacgtgaagctttgcattgtcatgtaacgtcttgataaaacatttgctgattaactcagcttttagctctagttagttaacttttggtttggtgtttacctgctccgttcatttcctcttcaagaagcccaatgcattataaaagcccattaataaagcccaaaacatcagcagaatcttgttttcatgttttgcgaagacgaatcatatcccaaagtacgacagtcaccgttcagttaaaagtatcagacaagaagcaaccacgatgcttagccccgccactctcacccggaaaacaccactcccgttcaactctctcgggttttccggcattcacacatcgtacttcaaccgaaggaggactcttactgaagctggttcaagcagggctctttcgtttgggcacaaactaaatcgtggtggtcgtgtcaattggtctgggcgttccggtaccgtgttgggacatctgggtcgggtctattcggtctcaggtggaagttcaggtgactccggcggaattggtggttcaggtggaggtggtggtggtggtggtgatagttcaggcggtggaggtgatgaaggcagtggcggaaacggaaacaagtggtcatttctgtcatggtacttggctcttctatcaaactatcctgttttgaccaaagctgtgacatcagcaattttgacactcattggtgatttgatctgtcagcttacaatcaatagaacctcatctctggacaaaaagaggacactcacgtttaccatattgggattaggactagtcggtccagcattgcatttctggtatttgtatttgagcaaagtggtgacagcttccggattatcaggcgcagttctgaggcttttactggaccagtttgtttttgctcctgtttttgttggagttttcttatcagctgttgtggcacttgaaggaaaaccatcacatgtcataccgaagctgaagcaggagtggactggtgcagtggtagcaaattggcagctatggataccatttcagtttcttaacttcagatttgttccacaaaactttcaggtgctcgcttcaaacgtagtggcattggcttggaacgtgattttatcattcaaagctcacaaagaagttgttgcaaaataggcaa

SEQ ID NO: 5388 - DNA, 2723 bp, Brassica napus
ggccgaggtttacgatcagttgatatcgaactcgtatcgtacattacgggccgggggaagatatttttttgcttcggtaagcccttcccactcttcttcccaccttgagactctcctttctcacttcaccttcgccgcgtaagaatggcggctgtagagagcctacctcccggaacgccgtcagcgatgaggaacgctttcgggaccgttctgtcagctctgatcctcgtcctcattggtgtcctcgctttctcgatccgactcttctccgtgataaagtatgaaagtgtgattcatgagtttgatccttacttcaattatagagtcactcagttcttatcgaagaatggaatatacgaattctggaattggtttgatgatcggacctggtatcctcttggccgtgtgattggaggaactgtttaccctggcttaacattgactgctggaactatctggtgggtcttgaatgcaataaacattcctctgtcagtagagactgtttgtgtcttcactgcacctgtgttttctgcttttgcatcatgggcgacttaccttttgaccaaggaagttaagggttccggtgcaggattagcagccgctgctcttttggccatggttccctcttatatatcccggtctgtagctgggagctacgacaacgaagctgttgccatttttgctttgatcttcactttttatctttacataaagacactaaatacaggttccttgttttatgccaccctgaatgccattgcatacttttacatggtatgttcgtggggaggttacaccttcattatcaatctgataccaatgcacgtgcttctgtgcattgtaactggccgatactctccacgactatacattgcctatgctcctttggttgtgttaggcacgctgttagctgcgttggtacctgttgttggcttcaatgcggttttgacgtctgaacattttgcctcgttcttggttttcattatcatccatgtagtagcactcgtatactatatcaaaggcattcttactcctaaaatgttcaaagttgctgtgacacttgttgtatctatcggcctggttgtgtgtctcatagttgtggcagttcttgtggcactggtggcttcaagtccaacaggaggatggagtggtaggagtttgagtctacttgatccaacttatgcaagcaagtatattccaattatcgcaagtgtcagtgagcatcaacctccaacttggccgtcctatttcatggatatcaatgttttggctttcttggtccctgctggcatcattgcgtgcttttcgcctctgtctgatgcgagctctttcgtggtcctctatattgtaatgtctgtatacttctccggagttatggttcgtcttatgctcgtgcttgctccagcagcatgcatcatgtctggaattgcgctctctcaagcttttgatgttttcacgggttccatcaaataccagttatcgtctaaatccaaagatgatgcagaggacaacacgtctacaaaaaatgccccaaaagatgatgcttcttctggtaagactgacaagggtgaagaagttgcaaaagaacggtcttcaaaaaagggcaagaagaaagagagagaacctgctgagaaaccttctgttaagtctaagattgtgaagaaaaaggctcttgttttgcctcttgaagcctctatagttgcgcttcttctccttataatgttgggtgctttctatgtgattcattgtgtttgggcagctgcagaagcatactcagctccatcaatagttttgacatctcaatcgcacgatggccttcacgtctttgatgattttagagagtcttatgcatggttaagccataatactgacgtggatgacaaagtggcatcatggtgggactatggttatcagacgacagctatggctaatagaactgttattgttgacaacaacacctggaataatactcacattgcaactgttggcactgccatgtcatctccagaaaaggcggcgtgggaaattttcaactccttggatgtgaaatacgttcttgtcgtctttggtggtgtgattggttacccaagtgatgatattaataagtttctgtggatggtgcgtattggaggcggcgagtttcctcatataaaggaagctgattatctgagagatggtcaataccggattgattcagaggccacgccaacaatgttgaactgccttatgtacaagctttgctactacaggtttgtagagacagatggtaaaggctatgatcgagtcaggcggacagagattgggaagaaacatttcaagctcacacatttcgaagaggttttcacgagtcaccattggatggttcggatatacaagctgaaacctcaaaagaacaggattcgtggtagagtaaagaagctgaaacagaaaacaacctctggagtgagctcaaaatcagtgaagaagaatccgtggatgtagaaatcctataactttcaccgttggatggtgagttctatgttaactcttaggtctctctttaccctcgaggaagttgttgcggacgcagtcaaagtttctggtgtaggattggtaaaagttttgtagacttttatgtggatttgttaagatgaattttcatgtttattgtggagaattactggagaattacactagatatctatgaagaagtttaaatttatcaaataaacatctatttacac

SEQ ID NO: 5389 - DNA, 2379 bp, Chrysanthemum coronarium
gaaataaggactgactcacacaaaacacaaatcaaaagccgttaatggcggcatctacagacacaccagcaacaacgacgactttccgtcatgcatccggtcacatcctcgcattcttcatccttctcttgatcggcgttctcgcattctcgatccgtcttttttcggttattaagtatgaaagtgtcattcatgagttcgatccttatttcaattacagagttactcagtttctcacaaagaatgggatatatgacttctggaattggtttgatgatcgaacctggtatcctcttggacgagtcattggtggaacagtgtaccctgggttgactttaacagccggaactatgtggaaggtacttcagtccttgaatattccactatctgtggaaacagtttgtgtattcactgctcctgtattttctgcctttgctgcatgggcgacatatctcttgacaaaggaagttaagggaccaggtgctggactaacagctgcagttcttctggccatggtaccatcatacatatctcgatctgtggctgggagctatgacaatgaagctgtagccatatttgctctgattttcaccttctatctctacataaagacattgaatacaggatcccttttctacgctactttaaactcaatcgcatacttctacatggtttgctcatggggaggttacacctttattatcaacctcataccaatgcatgtgcttctttgcattgtgactggtcgctattcacctcgtctatacattgcatatgctccgctcgttgtgttaggaacattattggcagcattagtacctgttgttggttttaatgcggtcatgacatcagaacattttgcatcctttttggttttcattattatccatgtggttgctcttgcatattatatcagaggaatgctctcgccaaagatgtttaaagtagctgccaccctcgttgtatcagttggcctggtggtttgctgtgcggttgtagctgttcttatagctgtggttgcatcaagtccaacaaagggatggagtggtcgaagtctgagtcttcttgatccaacatatgcgagcaagtacataccgataattgccagtgttagcgaacatcagccaccaacttggccgtcttacttcatggatattaatatattagcattcttggttcctgctggaattattgcatgcttttcaccgctatctgatgcaagctcctttgtcattctgtacatagtaatgtcagcatatttttcaggtgtcatggtacgacttatgcttgtgtttgctccagctgcatgcataatgtccggaattgctctttctgaagcctttgatgttttcacaagatcgattaaattttatgcatctgagtcatctgaaaatgtccagaatgaagcaggagataatgtgatgaagactgacacaaaagaagagatattaaaggaacgaccttccaagaaaaacaagaagaaagagaaggagaataacgttgaaaagcccactaagaagtcccacactgaaaagcgggccctagttttacctgttgggttatctgtgttttctctgttcttaatagtgttgctagctgccttttatgtggtccatagtgtttgggctgcagcagaggcatattcagctccttcgattgtgcttacttctcattcacctgatggggggcttcatgtatttgatgatttcagagaggcttatgcatggttaagccataacactgaagtagatgataaagttgcatcttggtgggattatggttaccaaacaactgcaatggctaaccgtacagttattgttgacaacaacacatggaacaacacacatatagctactgttggtactgccatgtcttctcccgaaaaagctgcgtgggaaattttcaactccctggatgtaaaatacgtccttgtcgtttttggaggtgtggtgggctactctagtgatgacataaataagttcctatggatggttcgtataggaggaggtgtattcccacatatcaaggagcctgattatctgagagatggtcaataccggatcgattctcaggctaccccaactatgctaaacagtctcatgtacaaactgtcatatttcaggttctgggagaccgatggtggtaaaggatatgatagagtaaggaggactgaaatcggaaggaagcatttcaaattaacacattttgaagaggtcttcacaactcatcattggatggtccggatttataaactaaaacctcagaagaacaggattcgggggaagacaaaaaagtctagatcgaaaacaagctcatcaacaccaacaaaaacaagaacaataacgaagaagaatccttggcactagatgccatttttgt

SEQ ID NO: 5390 - DNA, 2685 bp, Arabidopsis lyrata
gtgagagagagttttgccggagatagttagtcctcgcgaccaaaaacccttcggccttgaagtcgtgtctgttcttgctcctcactctctctaatccgattcatcgagccggagagctcactttccgccgcgtaaaatggcggctctagagagcccacagccgggaaccccgactgcgatgaggaatgctttcggcaacgttctatcagtcctgatcctcgtcctcattggtgtccttgctttctcgatccgactcttctctgttataaagtatgaaagcgtgattcatgagtttgatccttacttcaattatagagtcactcagttcttatcgaagaatggaatatacgagttctggaattggtttgatgatcggacttggtatcctcttggccgtgtgattggaggaactgtttaccctgggttgactttgactgctggaaccatctggtgggtcttgaattcgttaaacattcctctgtcagtagagactgtttgtgtcttcactgcacctgtattttcagctttcgcatcctgggcaacttaccttttgaccaaggaagttaagggctccggtgccggactagcagctgctgctcttttggccatggttccctcatatatatcccgatctgtagctggtagctatgacaatgaagctgttgccatctttgctttgatcttcactttttatctttacataaagacattaaatacaggttccttattttatgccaccctgaatgcccttgcatacttttacatggtatgttcatggggaggttacaccttcattatcaatctgataccaatgcacgtgcttttgtgcattgtaactgggcgatactctccccgactgtacattgcctatgctcctttggttgtgttaggcacactgttagctgcattggtgcctgttgttggtttcaatgcggttttgacttctgaacattttgcctcgtttttggttttcatcatcatccacgttgtagctcttgtatactacatcaaaggcattctttctccgaaaatgttcaaagttgctgtgacacttgttgtgtctatcggcatggttgtgtgtttcatagttgtggcaattcttgtggcattggtggcttcaagtccaacaggaggatggagtggtaggagtttgagtctacttgatccaacttatgcaagcaagtatattccaattattgcaagtgtcagtgaacatcaacctccaacttggccatcttatttcatggatatcaatgttttggctttcttggtccctgctggcatcattgcgtgcttttcgcctctatctgatgccagctcttttgtggtcctttacattgtaatgtctgtatacttttctggagttatggttcgtcttatgctcgtgcttgctccagcagcatgcatcatgtctgggattgcgctctctcaagcttttgatgttttcacgggttccatcaaataccagttaggtgcatcgtctaattccacagatgatgcagaggacaacacttccacgaacaatgccccaaaagatgatgcttctgctggtaagactgacaagggtgaagagattgtaaaagagcggtcttccaaaaagggcaagaagaaagagagagaacctgctgataaaccttctgttaagtctaagattaagaagaaggctcttgttttgcctcttgaagcctctattgttgcgcttctcctccttataatgttgggtgcattctatgtgatccattgtgtttgggcagctgcggaagcatattcagctccatcaatagttttgacatctcagtcgcgtgatggcctacatgtctttgatgattttagagagtcttatgcatggttaagccataatactgatgtggatgataaagtggcatcatggtgggactatggttatcagacgacagctatggctaatagaactgttattgttgacaacaacacctggaataatactcacattgcaactgttggcactgcaatgtcatcttcagaaaaggcggcgtgggaaattttcaactccttggatgtgaaatatgttcttgttgtctttggtggtcttattggttacccaagtgatgacattaacaagtttctgtggatggttcgtattggaggcggcgtctttcctcatataaaggaagctgattatctgagagatgggcaataccggattgattctgaggccactccaacaatgttgaactgccttatgtacaagctctcttactacaggtttgtaaagacagatggtaaaggttatgatcgggtgaggcggacggagattgggaaaaagaattttaagctcacacattttgaagaggttttcacgagtcaccattggatggttcggatatacaagctgaaacctcccaggaacaggattcgtggtagaacaaagaaactgaaatcgaaaacaagctctggattgagttcaaaatcagtgaagaagaacccgtggatctagaaatcctagaattttcaatgttggatggtgagttatttgtcaactcttaggtctcttttttatcgaggaagttgttgcagacgcagtcaagtttctggtgtaggattcgtaaaattttggtaactttatttggatctcttaatgcgaatcttatgtttattgcggagattatcaagtacggtggctaaagtatccattttacattcact

SEQ ID NO: 5391 - DNA, 2768 bp, Brassica rapa
gtagttcccgtgagtgtgagaggttgtttgtttctccgaagatatttttttgcttcggtaagcccttcccactcttcttcccaccttgagactctcctttatcacttcaccttcgccgcgtaagaatggcggctgtagagagcctacctcccggaacgccgtctgcgatgaggaacgctttcgggaccgttctgtcagctctgatcctcgtcctcattggtgtcctcgctttctcgatccgactcttctccgtgataaagtatgaaagtgtgattcatgagtttgatccttacttcaattatagagtcactcagttcttatcgaagaatggaatatacgaattctggaattggtttgatgatcggacctggtatcctcttggccgtgtgattggaggaactgtttaccctggcttaacattgactgctggaactatctggtgggtcttgaatgcaataaacattcctctgtcagtagagactgtttgtgtcttcactgcacctgtgttttctgcttttgcatcatgggcgacttaccttttgaccaaggaagttaagggttccggtgcaggattagcagccgctgctcttttggccatggttccctcttatatatcccggtctgtagctgggagctacgacaacgaagctgttgccatttttgctttgatcttcactttttatctttacataaagacactaaatacaggttccttgttttatgccaccctgaatgccattgcatacttttacatggtatgttcgtggggaggttacaccttcattatcaatctgataccaatgcacgtgcttctgtgcattgtaactggccgatactctccacgactatacattgcctatgctcctttggttgtgttaggcacgctgttagctgcgttggtacctgttgttggcttcaatgcggttttgacgtctgaacattttgcctcgttcttggttttcattatcatccatgtagtagcactcgtatactatatcaaaggcattcttactcctaaaatgttcaaagttgctgtgacacttgttgtatctatcggcctggttgtgtgtctcatagttgtggcagttcttgtggcactggtggcttcaagtccaacaggaggatggagtggtaggagtttgagtctacttgatccaacttatgcaagcaagtatattccaattatcgcaagtgtcagtgagcatcaacctccaacttggccgtcctatttcatggatatcaatgttttggctttcttggtccctgctggcatcattgcgtgcttttcgcctctgtctgatgcgagctctttcgtggtcctctatattgtaatgtctgtatacttctccggagttatggttcgtcttatgctcgtgcttgctccagcagcatgcatcatgtctggaattgcgctctctcaagcttttgatgttttcacgggttccatcaaataccagttatcgtctaaatccaaagatgatgcagaggacaacacttctacaaaaaatgccccaaaagatgatgcttcttctggtaaggctgacaagggtgaagaagttgcaaaagaacggttgtcaaaaaagggcaagaagaaagagagagaacctgctgagaaaccttctgttaagtctaagattgtgaagaaaaaggctcttgttttgcctcttgaagcctctatagttgcgcttcttctccttataatgttgggtgctttctatgtgattcattgtgtttgggcagctgcagaagcatactcagctccgtcaatagttttgacatctcaatcgcacgatggccttcacgtctttgatgattttagagagtcttatgcatggttaagccataatactgacgtggatgacaaagtggcatcatggtgggactatggttatcagacgacagctatggctaatagaactgttattgttgacaacaacacctggaataatactcacattgcaactgttggcactgccatgtcatctccagaaaaggcggcgtgggaaattttcaattccttggatgtgaaatacgttcttgtcgtctttggtggtgtgattggttacccaagtgatgatattaataagtttctgtggatggtgcgtattggaggcggcgagtttcctcatataaaggaagctgattatctgagagatggtcaataccggattgattcagaggccacgccaacaatgttgaactgtcttatgtacaagctctgctactacaggtttgtagagacagatggtaaaggctatgatcgagtcaggcggacagagattgggaagaaacatttcaagctcacacatttcgaagaggttttcacgagtcaccattggatggttcggatatacaagctgaaacctcaaaagaacaggattcgtggtagagtaaagaagcttaaacagaaaacaagctctggagtgagctcaaaatcagtgaagaagaatccgtggatgtagaaatcctataactttcactgttggatggtgagttctatgttaactcttaggtctctctttaccctcgaggaagttgttgcggacgcagtcaaagtttctggtgtaggattggtaaaagttttgtagacttttatgtggacttgttaagatgaattttcatgtttattgtggagaattacactagatatctatgaagaagtttaaatttatcaaataaacatctatttacacccaaacaccgctcaactttcacctgaagctctgcaggatcattgaacgtaatggcatgatcttgttcaaggcagt

SEQ ID NO: 5392 - DNA, 2374 bp, Cyclamen graecum
aagctcgtatctctctctagctctcgccgtcaatggcggcccccgacgctgccaccggatcgagtctccgctccgccttcggaaacgtgttatcgatcttcatcctcatcctcatcggcgtcctcgccttctcgatccgtctattctctgttataaagtatgagagtgtaattcacgagttcgatccttatttcaactacagagtcactcagttcctaacaaagaatggaatatatgacttctggaattggtttgatgatcggacatggtatcctcttggacgtgtaattggtggaactgtttaccctggattgacattgacagctggcaccatgtggaagatactgcattctttgaatattcctctatcggttgaaaccgtttgtgtcttcacagcacctgtgttctctgccaatgctgcttgggcaacataccttctgactaaggaagttaaaggtactggtgctggccttactgcagcagcattgttgggcatggttccatcttatatatctcgatctgttgctggaagctatgacaatgaagctgttgctatatttgctttaatcttcaccttctatctatatataaagacgttgaacactggatcccttttttatgcaactttaaatgccatagcatatttttacatggtttgctcttggggagggtacacctttattattaatcttataccgatgcatgtcctcctgtgcattgtaactggtcgatattcttctcggctgtacattgcttatgctccactggttgtcttgggaacattgttggctgcattggtgcccgttgttggatttaatgcggttttgacatccgaacattttgcgtcttttttggttttcattattatccatgtggtggctctggcatattatataaaagggatcctgtcaccaaaaatgtttaaagtagctgctacccttgttgtatctgttggcttgatagtatgtgttgcagtaatagctatattgatagcactggtagcttctagcccaacaaagggatggagtgggagaagtttgagtttgcttgatccaacttatgcaagcaaatatataccaatcattgcaagtgtcagcgaacatcaaccacctacttggccttcctattttatggacatcaacgttttagcgttccttgttccggctggcattgttgcctgctttttaccactaacggatgcaagctcctttgtggtgctttatattgtaacctcagtttacttctctggagtcatggtgcgcctaatgcttgtacttgctccagctgcatgcatactatctggaattgctctctcagaatcttttgatgtctttacccgttcaataaaatttcagttactgggaagaccgcaaaattccgagactgacgcggcaggggatacgagtcccagtagcattaccgcaaataatgagacaatgaagtctcagaaaagtgatgagtcattgaaagaaagaccttcaaggaaaaatgaagactcgtccaaggaacgcctttcaaaaaagagcaagaaaaaggaaaatgtagagaaagctactgtgaagcctgtgaagcctaagacgggaaagaggcttctgattttaccgctggaagcatctattattgccatcttcttactggtgttgttggttgccttttatgtggttcattgtgtttgggctgctgcagaagcttattccgcaccttctatcgttttaacatctcagactaatgacggacttcacgtgtttgacgattttagagaggcttatggatggttgagccacaacactgacgtggatgataaagtcgcatcttggtgggactatggttatcaaacaactgctatggccaaccgtactgtcattgttgataataatacttggaataacacacatattgctactgttggcactgccatgtcttctcctgagaaagcagcctgggagatatttaactctctggatgtgaaatatgttcttgttgtatttggaggtcttgttggatatccaagtgacgatattaacaaattcttgtggatggttcgtattggtggtggtgtattcccccatatcaaagaagctgattatctgagagatggccagtaccggatagattctgaagccactccaaccatgttaaattgtcttatgtacaaactctcatattacagatttgtggagacagatggtaaaggcttcgacagagtaaggagaacgccgatagggaagaaatacttcaagcttactcattttgaggaggtattcacgacacaccattggatggtgcgtatatacaagctaaaacctccaaagaacagaatcagaggaaagacaaagaaatcaaagacgaaaactagctcaacaagatcaaagac

SEQ ID NO: 5393 - DNA, 2873 bp, Aristolochia fimbriata
ccacgacgcccgattccaaagtctctgggagtcgtctccaagacctattagaaagacttcgcgccttggcttctagtcgaggttgctccgcttctagcaggaatggcggaccaggcggagactaagaaagtctctcttagaaacgcttggggtaatgtgtttgcgtttttcattctccttctgatcgggatctttgcgttctcgatccgactcttttctgtcataaagtatgagagcgtcattcacgaatttgatccttattttaattacagagttactcagtttcttacaaggaatggaatatatgatttctggaattggttcgatgatcgtacttggtatccgcttggtcgtgtcataggtggaactgtttaccctggattgacattaacagcaggctcaatatggtggctactaaattccctgaacattcctctttcggtggaaactgtttgtgtgtttactgctccaattttctcagcaaatgctgcttgggctacttatcttcttactaaggaagtcaagggagtgggggcaggattgactgcagcaacacttttggctatggttccatcctatatatctcgatctgttgctggtagctatgacaatgaagctgtagcaatttttgctttgatattcacattttacctatacataaagactctaaacacaggctccctcttttatgctactctgaatgctcttgcgtacttttatatggtctgctcgtggggaggctatacatttattattaatcttattccaatgcatgtgcttttgtgcatagtgacgggtcgttactcatctcgattgtatattgcgtatgctcctcttgttgttttggggacattgttggctgctttggtgccggttgttggctttaatgcagtgatgacatcagaacattttgcatcatttttggttttcatcattgttcatgtggtggcacttgtccactacataagagggattctttctccaaaaatgttcagagtagcaatgacacttgttcttacaattggactggcggtttgttgtgcggtggttgccgtgcttgtagcattagtcgcttcaagtcctacaaagggatggagtggtcgaagtttgagtcttctggacccaacttatgctagcaaatatattcctataattgcgagcgtcagtgagcatcaaccaccaacatggccttcatatttcatggacatcaatgtcttggctttcctggtcccagctggcataattgcatgctttctacctttgtcagatgcaagctcctttgtggtcctgtacattgtcacgtcagtttatttttctggcgttatggtgcgccttatgcttgtattggccccagctgcttgtattatgtctggaattgctctttctgaagcctttgatgttttcactcgatcagtgaaatttcaatttcctactttgctagggagtcctcttcccgatgcaggggatgcaactttggagagtgtgggccttcaaagtaatgttgtacaagctgagaagtccaatgaaaaggctgatgaaaatctaaaagagcgggcttcaaaaaaaacaagaaaagagaaaaggaaagtgttgagaagattcctcttaagactaggtctgagaagaggcttttggttttgcctttcgagacatctttcatcggcattctattgctaataatcatgggcagcttctatgtgattcattgtgtgtgggcagcagcagaagcttattcagcaccatctattgttctgacttcccaatctcatgatggattacatgtttttgatgattttcgagaagcttatgcttggttacagcataatactgaggaggatgacaaggttgcatcttggtgggattatggttatcaaacaacagctatggctaaccgtactgtgattgtggataataatacttggaataacacacatattgccactgtgggtacagccatgtcttctccagagaaagcagcatgggatattttcaactctttagatgtaaaatatgtcctagttgtttttggaggacttgttggttatcctagtgatgatatcaacaaattcctctggatggttcgtattggtgggggtgtatttcctcacatcagagaaccagattaccttagggatgggcaatatcgaattgattccgaggctacaccaacaatgctgaatagtctcatgtacaaactttcgtactacaggtttgtggaaacagatggaaaaggctttgacagagtaaggaggacagaaattggaaagaaatatttcaaacttacttattttgaggaggtatttacaacacatcattggatggtccgtgtgtacaaattgaaacctccgaagaatagacacagaggaaagacaaaaaaagtaaaatcgtctacaaaaccaagttccacagctggtgggaagaggggcgagagtaaacggaatccatggctctagattggatttgattagcaattttgctagtagacctgtgttactttgccctaaaaccctagtgagaaagtgaacatcagtgtagggtctttctttttcttttttctttttttttatttttaactgctctcattaggtgttttttacttttaggatatgtagctagggtaatgattttgtagccccgttgtaacatgtcatgttttgtactgtaagctgttctagttaaaattttaacatatttgagggagcgtgcagtgccgaagtagttaaaaccaggctagtggcatttttcagcctctgcaggtcaatttatatgctagagtgctgatgcgttctgattaaacgattacatatatcaaatgcaacttttggacattttggttttcttgcattcaaactaattagaattctagcttttac

SEQ ID NO: 5394 - DNA, 2690 bp, Eutrema halophilum
tttcccgtgagatagttttgccgtggaaaaacccttcgaccttgaacctgtttctctttctctctctctctttaatccgattcttcgagccggagagctcactttcgctgcgttgtaatggcggctctagagagcccacctccgggaacgccgtctgcgatgaggcatgctttcgggagcgttctgtcagctctgatcctcctcctcattggggtccttgctttctcgatccgactcttctctgtcataaagtatgagagtgtgattcatgagtttgatccttacttcaattacagagtcactcagttcttatcaaagaatggaatttacgagttctggaattggtttgatgatcggacctggtatcctcttggccgtgtgattggaggaactgtataccctgggttaacgttgactgctggaaccatttggtgggtcttgaattcattaaacattcctctgtcagtagagactgtttgcgtcttcactgcacctgtattttcagctttcgcatcctgggcaacttaccttttgaccaaggaagttaagggctccggtgcaggactagcagctgctgctcttttggccatggttccctcatatatatcccgatctgtcgctggaagctatgacaatgaagctgttgccatttttgctttgatcttcactttttatctttacataaagacactaaatacaggttccctgttttatgccaccctgaatgccattgcatacttttacatggtatgttcttggggaggttacaccttcatcatcaatctgattccaatgcatgtgcttctgtgcattgtaactggtcgatactctccccgactgtacattgcctatgctcctttggttgttttaggcacgctgttagctgcattggtacctgttgttggtttcaatgcggttttgacgtctgaacattttgcctcgtttttggttttcatcatcatccacgttatagctctcgtatactacatcaaaggcattctttctcctaaaatgttcaaagttgctgtgacacttgtggtgtctatcggcctggttgtgtgtttcatagttgtggcagttcttgtggcattggtggcttcaagtccaacaaaaggatggagtggtaggagtttgagtctacttgatccaacttatgcaagcaagtatattccaattattgcaagtgtcagtgaacatcaacctccaacttggccgtcctatttcatggatatcaatgttttggctttcctggtccctgctggcatcgttgcctgcttttcgcctctatctgatgccagctcttttgtggtcctttatattgtaatgtctgtatacttttctggagttatggttcgtcttatgctcgtgcttgctccagcagcatgcatcatgtctgggattgcgctctctcaagctttcgatgttttcacggcttccatcaaataccatttaagtggatcgtctaattccaaagatgatgcagaggacaagacttctacaaacaatgcctcaaaagatgatggttctgctgggaagactgacaagggtgaagaaagtgcaaaagagcgatcgtcgagaaagggcaagaagaaagagagagaacctgccgataaaccttctgttaagtccaagattgtgaagaagaaggcgcttgttttgcctttcgaagcctctatcgttgcgcttcttctccttataatgttgggtgctttctatgtgattcattgtgtttgggcagctgcagaagcatattcagctccatcaatagttttgacatctcaatcgcgcgatggcctacatgtctttgatgattttagagaatcttatgcatggttaagccataatactgacgtggatgacaaagtagcatcatggtgggactatggctatcagacgacagctatggctaatagaactgttatagttgacaacaatacctggaataatactcacattgcaactgttggcactgcaatgtcatctccagaaaaggcggcgtgggaaattttcaactccttggatgtgaaatacgttcttgtcgtctttggtggtctgattggttacccaagtgatgatattaacaagtttctgtggatggtgcgtattggaggcggcgtctttcctcatataaaggaagctgattatctgagagatggccaataccggattgattctgaggccactccgacaatgttgaactgccttatgtacaagctctcttactacagatttgtagagacagatggtaaaggttttgatcgggtcaggcggacagagattgggaagaagaatttcaagctcacacatttcgatgaggttttcacgagtcaccattggatggtccggatatacaagctgaaacctcaaaagaacaggattcgtggtagagcgaagaagctgaaattgaaaacaagctcttcaaaatcagcgaagaagaatccgtggatctaaaaaaatcgtagaacttttcaatgttggatggtgagttgagttctatgttaactcttaggtctctctttattttcaaggaagttgttgcagacgcagtcaagtttctggtgtaggatttgtcaaaattttgtaaaactttacatatttggatttgttaacccgaattttatgtttgttgtaaatcgggacccaatccaaaagaaaagaaaaaaaaaactcgaaatagccttagtttgagt

SEQ ID NO: 5395 - DNA, 2748 bp, Chrysanthemum coronarium
cacacacatggcggtccccgtcgacaccgtcaccaaacaaccaccgccgccgtcgtcgtctctccgtttcgcattcggaaacgtcctcgcgttctttattctgctcttgatcggagttctcgcattctcgatccgtttgttttcggttattaagtatgagagtgttattcatgaatttgatccgtattttaattatcgtgtcactcagttcctcacaaagaacggaatatatgacttctggaattggtttgatgatcgtacctggtatcctcttggacgagtcattggtgggaccgtttacccgggattgacattgacagccggaactatatggaaggttcttcaatccttgaacatacctctctctgtggaaaccgtgtgtgtatttactgctcctgtgttctctgctttcgctgcatgggcaacatatctcctgaccaaggaagttaagggaacaggtgctggactgactgctgctgttcttctggccatggtgccatcctatatatcccgatccgtggctgggagctacgacaatgaagccgtggctatctttgctttgatatttaccttctatctctacatcaagactttgaacacgggatccctgttctacgcgacactaaactccatttcatacttctacatggtctgctcctggggagggtacaccttcatcatcaatctcattccgatgcatgtgcttctttgcatcgtgactggtcgctattcgtctcggctatacattgcatatgctccacttgttgtcctgggaactttattggcagctttggtgcctgttgttggttttaacgcggtcatgacatcagaacattttgcatcattcttggttttcattgttatccatgtggttgctcttgcttattatatcaaaggaattctctctccaaagatgtttaaagtagctgctacccttgtagtatccgttggcttggtggtatgccttgctgtagtaggagtacttgtagcagtagttgcatccagtcctacaaagggatggagtggacgaagtttaagtcttcttgatccaacttatgcaagcaagtacataccgatcattgcaagtgttagtgaacatcaaccacccacatggccgtcttactttatggatcttaatgttctagcgttcttggttcctgctggaattattgcatgcttttcaccgctatctgatgcaagctcctttgtcattctgtacatagtaatgtcagcatatttttcaggtgttatggtacgacttatgcttgtgtttgctccagcggcatgcataatgtctggaattgctctttctgaagccttcgatgttttcacaagatcaataaaattctatgcatctgagtcatctgaaaatgtccagaatgaagcaggagataatgtgatgaagactgacacaaaagaagagatattaaaggaacgaccttccaagaaaaacaaaaagaaagagaaggaaaacattgttgaaaagcccactaagaagccccacactggaaagcgagcccttgttttacctgttgggttatctgtgttctctctgttcttaatcgtgttgctagctgccttttatgtggtccatagtgtttgggctgcagcagaggcatattcagctccttcgattgtgcttacttctcattcacctgatggggggcttcatgtatttgatgatttcagagaggcttatgcatggttaagccataacactgaagtagatgataaagttgcatcttggtgggattatggttaccaaacaactgcaatggctaaccgtacagttattgttgacaataacacatggaacaacacacatatagctacagttggtactgccatgtcatctcctgaaaaagctgcatgggaaatttttaactccctggatgtgaaatacgtccttgtagtttttggaggtgtggtgggctactctagtgacgacataaataagttcttatggatggttcgtataggaggaggcgtattcccacatatcaaggaacctgattatctgagagatggtcaataccggatcgatgctcaggccactccaactatgctaaacagtctcatgtacaaactatcatatttcaggttttgggagacggatggtggtaaaggatatgatagagtacggaggacagaaatcgggaagaagcattataaattaactcattttgaagaggtattcacaactcatcattggatggttcggatttataaactaaaaccccagaagaacaggatccgtgggaagaccaagaggtctagatcgaaaacaagctcgtctacatcaacaaaaacaagaacaataacgaaaaagaatccatggcactagaagccatttttgtttttattttttaaaaatgaactatctgaggtagattcaatacatgtatcgttttggtgaattagccgcagcaagccagggatttggacattttgtagtcccttatagttgtgtgatttaatgtatggtatgctcagaaaattttatagccaactgaactaggcacctagcttatttgatcgcacaagccatggttgatccttttatatggcttcacttggcgggcttgacgaacctaaataagcggagccttatggtgtaaagggaaaatattcaaatataacggccaaacttgttgcgggtttctttaaagcaaagtcagggattctttatcatggtcacgactcatgacgttattcttaacatagtgcttccatgtaaatatttataaa

SEQ ID NO: 5396 - DNA, 2725 bp, Eutrema parvulum
gtgagagattgttttgccgaggatagttttctgcttcgaaaaacccttcgagtcttcttccaccttgaagtcgtttctgtccattctcacacactctctctctctctcttcaatccgattcttggagccggagagctcaccttcgccgcgtaaaaaatggcggctcttgagagcccacctcctggtacgtcgtctgcgatgaggaatgctttcgggaccgttctgtcagctctgatcctcgtcctcattggtgtccttgctttctcgatccgactcttctctgtcataaagtatgaaagtgtgattcatgagtttgatccttacttcaattatagagtcactcagttcttatcgaagaatggaatatacgagttctggaattggtttgatgatcggacctggtatccccttggccgtgtgattggaggaactgtttaccctgggttaacattgactgctggaaccatctggtgggtcttgaatgcaataaacattcctctgtcagtagagactgtttgtgtcttcactgcacctgtattttcagctttcgcatcctgggcaacttaccttttgaccaaggaagtgaagggctccggtgcaggactagcagctgctgctcttttggccatggttccttcatatatatcccgatctgtcgctggaagctatgacaatgaagctgttgccatttttgccttgatcttcactttttatctttacataaagacgctaaatacaggttccttgttttatgccaccctcaatgccattgcatacttttacatggtatgttcttggggaggttacaccttcataatcaatctgataccaatgcatgtgcttctgtgcattgtaactggccgatactctccacgactgtacattgcctatgctcctttggttgtattgggcacgctgttagctgcattggtacctgttgttggcttcaatgcagttttgacgtctgaacattttgcctcgtttttggttttcatcatcatccacgtagtagcactcgtatactatatcaaaggcattctttctcctaaaatgttcaaagtcgctgtgacacttgttgtgtctatcggcctggttgtgtgtctcatagctgtggcagttcttgtggcactggtggcttcaagtccaacaggaggatggagtggtaggagtttgagtctacttgatccaacttatgcaagcaagtacattccaattattgcaagtgtcagtgaacatcaacctccaacttggccgtcctatttcatggatatcaatgttttggctttcttggtccctgctggcatcattgcttgcttttctcctctatctgatgcgagctcttttgtggtcctctatattgtaatgtccgtatacttttccggagttatggttcgtcttatgctcgtgcttgctccagcagcatgcatcatgtctggaattgcgctctctcaagcttttgatgttttcacggcttccatcaaataccagttaggtggatcgtctaattccaaagatgatgcagaggacaacacttctacaaacaattccccaaaagatgatgtttcttctggtaagactgacaagggtgaagaagttgcaaaagaacggtcgtcaaaaaagggcaagaagaaagagagagagcctgctgagaaaccttctgttaagtccaagattgtgaagaaaaaggctcttgttttgcctcttgaagcctctatagtcgcgcttcttctcctgatcatgctgggtgctttctatgtgattcattgtgtttgggctgctgcagaagcatactcagctccatcaatagttttgacatctcaatcgcgcgatggcctacatgtctttgatgattttagagaatcttatgcatggttaagccataatactgacgtggatgacaaagtagcatcatggtgggactatggctatcagacgacagctatggctaatagaactgttatagttgacaacaatacctggaataatactcacattgcaactgttggcactgcaatgtcatctccagaaaaggcggcgtgggaaattttcaactccttggatgtgaaatacgttcttgtcgtctttggtggtcttattggttacccaagtgatgatattaacaagtttctgtggatggtgcgtattggaggcggcgtctttcctcatataaaggaagctgattatctgagagatggccaataccggattgattcagaggccacgccaacaatgctgaactgccttatgtacaagctctcttactacagatttgtagagacagatggtaaaggttttgatcgggtcaggcggacagagattgggaagaagaatttcaagctcacacatttcgatgaggttttcacgagtcaccattggatggtccggatatacaagctgaaacctcaaaagaacaggattcgtggtagagcgaagaagctgaaattgaaaacaagctcttcaaaatcagcgaagaagaatccgtggatctaaaaaaatcgtagaacttttcaatgttggatggtgagttgagttctatgttaactcttaggtctctctttattttcaaggaagttgttgcagacgcagtcaagtttctggtgtaggatttgtcaaaattttgtaaaactttacatatttggatttgttaacccgaattttatgtttgttgtaaatcgggacccaatccaaaaaaaaacaaaaatttaaacagtcgaaatagcttcag

SEQ ID NO: 5397 - DNA, 2822 bp, Chenopodium quinoa
aggtcttgaagtctactcatcgagtcttccgatgaaaatcatcaactactagtcagtagtcagtcacccaaaacccctgcgcaaaatctctctctcgaccttcacttctctctccaatggcggacactgaaaccgccaatggatcttctctacgaaacgccttcggaaatgtgcttgctgttttcatcctcatcttgatcggagttctcgctttctcgatccgtcttttctctgttatcaaatatgaaagcgtcattcatgagtttgatccttatttcaattatcgagttactcagtttctcacaaagaatggcatatatgacttttggaactggtttgacgacagaacctggtacccactgggtcgtgtgattggtggaactgtttatcctggattaacactgacggcaggtaccatgtggtggttgctgcattctgtgaacatccctttgtctgtggagactgtctgtgtgtttactgcaccagtattttctgcttttgcatcatgggcaacctattttctcacaaaggaagtgaagggcccgggtgcagggttaacagctgcattactattgggcatggttccatcctatatatctcgatctgtggctggcagctatgacaatgaagccgtagctatttttgcattgatttttaccttctatctttatgtcaaaactttgaacaccggctctctgttttatgcaactttgaatgccatagcatacttctatatggtttgctcgtggggaggatacaccttcataattaatcttattcccatgcacgtgctcctttgcattgttactggtcgatattctaacagactgtatattgcatatgctcctctggttgtgttgggcacattgttagctgcattggttcctgttgttggtttcaatgccgtcttgacatcagaacattttgcatcatttttggtgttcattattatccatgtggtcgcacttgtgtattacatcaagggaatcctttctcctcagatgttcaaagttgctgtaactcttgtagtaactggtggcctggcagtttgttttgctgtagcagctatacttattgcgctcgtggcttctagcccaacgatgggatggagtgggcgaagtcttagtctccttgatccaacttacgcaagcaaatacataccgatcattgctagtgttagtgaacatcaaccgcctacatggccatcttacttcatggacatcaatgtattggcattcttggttcccgctggaattattgcttgtttttcaccgctgtctgatgcaagctcgtttgtagtcctctacattgtgatgtcagtatacttttcaggtgttatggtgcggcttatgctagtacttgctccggcagcgtgcataatgtctggaattgctctgtcggaagcttttgatgtttttgctcggtctatcaaatttcagttgccctcattgttagaaactccccctgatgaggcaggagaagtgagttctggcaatgctgagatacaaaaaattgtggcaaaaactgataaaaatgaagatgccataaaagagcggccttcgaaaaagggaaagaagaaggaaaaggaaaaggaaaaagaaaaggaagttcctgagagggctcccgtgaggtcccgtgttgggagaaggcttcttgttttaccctttgaagcatctctaattgccttgttcttaactgtcttgctgggtggtttttatgtggtacactgtgtttgggcagcagcagaggcatactcggcgccatctattgttttgacatctcatacacatgatggtctgcatgtttttgatgatttcagggaggcatatgcttggttaagccacaacactgaggtggatgataaagtggcatcttggtgggactatggataccaaacaacagccatggccaaccgtactgtcattgttgataataacacctggaataatactcacattgccactgttggaacagctatgtcttctccggaaaaggcagcatgggaaatttataactctctggatgttaaatatgtcctcgttgtatttggaggtcttgtgggctaccccagtgacgatatcaataaattcttgtggatggttcgaataggaggtggtgtatttcctcatattaaggaacctgattatctgagagatggtcagtatcggattgactctcaggcaacaccaacgatgcttaatagtttaatgtacaagctttcatactacagatttgtagaaacagatggaaaaggatatgacagagttaggaggactgaaattggaaagaagcatttcaagcttactcattttgaggaggcatttacatctcatcactggatggtaaggatttataaattgaagcctccaaagaacagattaagaggaaagatcaagaaatcaaaatcgaaaacaagctcagctagctcaaaaagaagcagcactgtgaaaaggaatccatggcagtaacttctttttccattccttgttgcatatttatagagtagggaagtcttaggtcactcaattgtaacccatagggcttctagagagaaatcatagagcattgattgaatcaaagaaatagttacctacgacgcttagtcctcccccctcacttttaccagttagttatttacttcatggggagagaaggctgctccaattttctactctggtcgcgtgattgtggtgtttttggcatgttaatggaaatgtgtaagcctgtactaaatattagaccattgagagatattctaagtaatttacacagagttgttttttgcagccaaaatgattctccaattttgaatttcagttgca

SEQ ID NO: 5398 - DNA, 2330 bp, Helianthus annuus
ctcaacgaaatcactacacactcaaaaaacacacacacacaccaaacttcattaccgccgttaatggcggcatctacagatacaacggcagcagcaccgtcgtcgactctacgtcacgcctccggtaacatcctcgcgttctttattctcctattgatcggcgtactcgcattctcgatccgtcttttctcggttattaagtatgagagtgttattcacgagttcgatccttatttcaattacagagttactcagtttctcacaaagagcggggtgtatgacttctggaattggtttgatgaccggacatggtatcctcttgggcgagtcattggtggaacggtttaccctggattgactttaacagctggaactatgtggaaggtactccaaatgttgaatattcctctatcggtggaaactgtttgtgtattcactgctcctgtattctctgcctttgctgcatgggcaacatatctcttgacaaaggaagttaagggagtaggtgctggactaacagcagcagttcttctagccatggtaccatcctacatatcccgatcagtggctgggagctatgacaatgaagccgtagccatctttgctttgatcttcaccttctatttatacataaagacgttgaacacaggatctcttttctatgctactttaaactccatggcatacttctacatggtttgctcttggggagggtacacttttattatcaacctcataccaatgcatgtgcttctttgcattgtgactggtcgctattcacctcggctatacattgcatatgctccacttgttgtcttaggaacgttaatggcagcattagtgcctgttgttggttttaatgcagtcatgacatcagaacattttgcatcgtttttggttttcattattattcatgtggttgctcttgcatattatatcaaaggaattctctcaccaaagatgtttaaagtagctgtcacccttgttgtatcagttggcctggtggtatgctgtgctgtagtagctgtacttatagcagtggttgcatctagtccaacaaagggatggagtggacgaagtctaagtcttcttgatccaacatacgcaagcaagtacataccgattattgcaagtgttagcgagcatcaaccacctacttggccatcttacttcatggacatcaacatattagcattcttggttcccgctggaattattgcatgcttttcaccgctatctgatgcaagctcctttgtgattctttatatagtaatgtcggcatatttttccggggtcatggtacgactaatgcttgtgtttgctccagctgcatgcataatgtctggaattgctctttctgaagcctttgatgtctttacaagatcaattaaattctatgcatttcaagcagtggatacggtatcagctagtactgtttctccgcaaaataatgtggtggagacagacaaaaaagaagacgtgttgaaggaacggccttccaggaaaaacaaaaagaaagaaaaggagactgtcgaaaagccgcttaagaaatccgaaacggaaaagaggcccctaatcttacctgttgaagcatctgcaattgctctcttcttaactgtgttgctaggtgccttctatgtggtccatagtgtttgggctgcagcagaggcatattcagctccttcaatcgttcttacttctcatacgcgcgacgggcttcatgtttttgatgattttagagaggcatacgcatggttaagccataacactcatgtagatgataaagttgcatcttggtgggactatggttaccaaacaactgcaatggctaaccgcacagttatcgttgacaataacacatggaacaacacacatattgctactgtcggtaccgccatgtcatctcccgaaaaagcagcttgggaaattttcaactctctggatgtgaaatatgtccttgttgtttttggcggtcttgtcggctactccagtgatgacataaataagttcttatggatggttcgtattgggggaggcgtcttcccacatatcaaggagcctgattatctcagagatggtcaataccgaattgattctcaggccacgccaaccatgctaaacagcctcatgtacaaactatcatatttcaggtttgttgagactgatggtggtaaaggatacgatcgagtaagggggactgaaattggaaagaaacattttaaattaactcattttgaagaggtgttcacgactcaccattggatggttcggatatataaactaaaacctcagaggaacaggattcgggggaagacaaagaaatctagatc

SEQ ID NO: 5399 - DNA, 2670 bp, Allium cepa
ttcaatccgccaataatggcggcatcacctgctacggagctgaaatctacctctaccttaagaaccgcttttggtggcgttctcgccactttcatccttcttcttattggaatccttgccttctcgatccgtttattttctgttattaagtacgaaagtgtgattcatgaatttgatccatatttcaattatcgagtcacccagtttcttgtgaagaatggaatttatgacttctggaattggtttgatgatcgaacctggtatcctcttggtcgtgttattggtggaactgtttatcctgggctgactctgacggctgcttctatgtggaagattgttaattccttgaatatacctctgtctgtcgaaacagtttgtgtttttacggctccagtattttcagcatttgcagcttgggcaacatatcttctaaccaaagaagtaaagggcactggagctggacttactgcagctgcacttttagccattgtgccttcctatatctcaagatctgtggctggcagttatgacaatgaagctgtagctatatttgcattgatcttcaccttttacctttatataaagacactgaatactggatcactgttttatgcaaccctaaatgctttgtcttacttttatatggtgtgctcctggggaggatatacgtttatcattaatcttattccaatgcatgttctcttatgcattggcactggtcgctactcttcaagattatacattgcatatgctcctcttgttgtattgggaacacttcttgctgcactggttcctgtggttgggttcaatgctgtgatgacttcagagcattttgcatcatttttggttttcattattatccatgtggtggctcttgtttactacgttaaaggaattctttcacccaagatgtttaaggttgcaatgacacttgttttgacattaggaattgctatatgttttgctgtgttagcaattctggttgcattggtggcttctagcccaaccaaaggatggagtgggcgtagcttgagtctgcttgatccaacatatgcaagcaagtacatacccatcatagcaagtgttagtgagcatcagccaccaacctggccctcttatttcatggatcttaatgtgttggctttcttggttccggctggtattgttgcatgttttctaccactatcagatgccagttcatttgtaatcctgtatattgtaacttcagtgtacttctccggagtaatggtgcgtcttatgcttgtattggccccggcagcatgcataatgtccggaattgctctttctgaagccttctctgtttttacacgatcgatcaaatatcaactgcccaatttagtagagggtcctatatctgaagccggggaaaataatgttgacagttctgttaactcaactgatgtaaaaaagtagcggccattaagccggaagatgattcaacagataaaccagtaaaaaagaaccggaggaaagatacggaaaagaagaaggaaaattatccgtggagaaaatttctaccaagtctcctaaagaaaaaaggcttcttgttttgcctttagaagcatcagctgttgctatactcttactcatcatactaggtggtttctatgtggttcattcggtatgggcagctgcagaagcttattctgcgccttctattgttctcacatctcactcacacgatggtttacatgtatttgacgactttcgtgaagcctactcatggctgagtcataatactgatgtagatgataaggtagcttcatggtgggactatggttaccaaacaacagcaatggccaatcgaactgtaattgttgataataatacatggaacaatactcatattgcaaccgttgggactgctatgtcttctccagaaaaagaagcttggcaaattttcaactcattggatgtcaaatatgttcttgtagttttcggcggtcttgttggttatccaagtgatgatataaacaaattcttgtggatggttcgaattggaggcggcgtgtttccccacatcaaggaacctgattatcttagggatggccaatatcgcattgattctgaagcaactccgaccatgctaaactgcctcatgtacaaactatcttattacaggtttgtcgaaactgatgggaaaggttttgatagagttaggaggacagaaataggaaaaaacatttcaagcttactcattttgaggaggtattcacaacacatcattggatggttcgtatttacaagttgaaaccacagaagaacaggatccgtgggaagctaaagaaatctaaatcgaaatcaaagtcttcaagtagtagtagaagtggaagtgcaaggaagaatccatggcattaaaccttgtttttgtatccaaacccattattttggaatattggcttaatttacgagttatgatgcggtaatgtttgcttttgcaaactggtttatgagagtaacttttaggatacatatattacatattaggtctgttacattatattttacaagagcagagaaaacatttaattttttgggaagcaaactgataatattatgtttaatctgattttggcctggttctaccctagtgtatgattatttcagtctgttttatttatttttgctttgacggcgaaaaacacacac

SEQ ID NO: 5400 - DNA, 2689 bp, Brassica napus
gtttgttcaccgaagatagttttgcttccataaacccttcccacctttgagactcctttctcactctcctctcctccgaagagctcaccttcgccgcgtaaaaatggcggctgtagagagcccacctcccggaacgccgtctgcgatgaggaatgctttcgggaccgttctgtcagctctgatcctcgtcctcattggtgtcctcgccttctcgatccgtctcttctccgtgataaagtatgaaagtgtgattcatgagtttgatccttacttcaattatagagtcactcagttcttatcaaagaatggaatatacgagttctggaattggttcgatgatcggacctggtatcctcttggccgtgtgattggaggaactgtttaccctgggttaactttgacggctggaaccatctggtgggtcttgaattcaataaacattcctctgtcagtagagactgtttgtgtcttcactgcacctgtgttttctgcttttgcatcatgggcgacttaccttttgaccaaggaagttaagggctccggtgctggactagcagctgccgctcttttagccatggttccctcatatatatcccgatctgtagctgggagctatgacaacgaagctgttgccatttttgctttgatcttcactttttatctttacataaagacactaaatacaggttccttgttttatgccaccctgaatgcctttgcatacttttacatggtatgttcgtggggaggttacaccttcattatcaatctgattccaatgcatgtgcttctgtgcattgtaactggccgatactctccccgactatacattgcctatgctcctttggttgtgttgggcacgctgttagctgcattggtacctgttgttggcttcaatgcggttttgacgtctgaacattttgcctcatttttggtttcattatcatccatgtagtagcactcgtatactatatcaaaggcattcttactcctaaaatgttcaaagttgctgtgacacttgttgtgtccatcggcctggttgtgtgtctcatagttgtggcagttcttgtggcattggtggcttcaagtccaacaggaggatggagtggtaggagtttgagtctacttgatccaacttatgcaagcaagtatatttccaattattgcaagtgtcagtgagcatcaacctccaacttggccgtcctatttcatggatatcaatgttttggctttcttggtccctgctggcatcattgcgtgcttttcgcctctgtctgatgcgagctctttcgtggtcctctatatcgtaatgtctgtatacttctccggagttatggttcgtcttatgctcgtacttgccccagcagcatgcatcatgtctggaattgcgctctctcaagcttttgatgttttcacgggttccatcaaataccagttatcgtctaaatccaaagatgatgcagaggacaacacgtctacaaaaaatgccccaaaagatgatgcttcttctggtaagactgacaagggtgaagaagttgcaaaagaacggtcttcaaaaaagggcaagaagaaagagagagaacctgctgaaaaactttctgttaagtctaagattgtgaagaaaaaggctcttgttttgcctcttgaagcctctatagttgcgcttcttctccttataatgttgggtgctttctatgtgatacattgtgtttgggcagctgcagagcatactcagctccatcaatagttttgacatctcaatcgcatgatggccttcacgtctttgatgattttagagagtcttatgcatggttaagccataatactgacgtggatgacaaagtggcatcatggtgggactatggttatcagacgacggctatggctaatagaactgttattgtcgacaacaacacctggaataatactcacattgctactgttggcactgccatgtcatctccagaaaaggcggcgtgggaaattttcaactccttggatgtgaaatacgttcttgtcgtctttggtggtgtgattggttacccaagtgatgatattaataagtttctgtggatggtgcgtattggaggcggcgagtttcctcatataaaggaagctgattatctgagagatggtcaataccggattgattcagaggccacgccaacaatgttgaactgccttatgtacaagctctgctactacaggtttgtagagacagatggtaaaggctatgatcgagtcaggcggacagagattgggaagaaatatttcaagctcacacatttcgaagaggttttcacgagtcaccactggatggttcggatatacaagctgaaacctcaaaaaaacaggattcgtggtagagtaaagaagcttaaacagaaaacaagctctggagtgagctcaaaatcagtgaagaagaatccgtggatgtagaaatcctataactttcactgttggatggtgagttctatgttaactcttaggtctctctttaccctcgaggaagttgttgcggacgcagtcaaagtttctggtgtaggattggtaaaagttttgtagacctttatgtggatttgttaagatgaattttcatgtttattgtggagaattacactagatatctatgaagaagtttaaatttattcaaaataaaacatctaatttacacccaaaaaaaaaaaaa

SEQ ID NO: 5401 - DNA, 2723 bp, Tabernaemontana elegans
cctcacacctacgctcactccctcccgtcagtgtgtaatagcagctttttttggccgtcaatggtggactcggagactttggggccatcgactctacgtaacgcctttggaaatgttctctcattcctcattcttcttctaatcggcgttatcgctttctcgatccgtctgttctctgtgattaagtacgagagtgtaattcatgaatttgatccttatttcaattatagagtcactcagtttcttacgaagaatggaatatatgatttctggaattggtttgacgatcggacctggtatcctcttggccgtgtgattggaggaactgtttatcctgggttaacattgacagcaggcaccttgtggtggttgttaaattccttgaacattcctctctcggtggaaactgtgtgtgtgtttactgcccctgtcttctcggcatttgcttcttgggcaacataccttttgacaaaggaagtcaaaggcactggtgcgggattgactgctgcagctcttttggccatggttccgtcctatatatcccgatcagtggctggcagctatgataatgaagctgtagctatatttgctttaatcttcactttttacctctatataaagactttaaacacagggtccctcttttatgcaactctgaatgcaattgcctacttttatatggtttgctcttggggagggtacacctttataatcaaccttattccaatgcacgtgctgctatgtattttaactggtcgctattcttctcgattgtacattgcatatgctccacttgttgttctgggaacattgttggctgcattagtccctgttgtggggtttaacgcagtcatgacatcggagcattttgcttcatttctggttttcattattatccatgtggtagctcttgtttactatatcaaaggaattctttcaccaaaaatgttcaacctcgccgttactcttgtgttaacagttgccctgatagtttgctgtgctgtggtggccattcttatagcattggtagcatccagcccaacaaaggggtggagtgggcgtagtttgagtctgcttgatccaacttatgcaagcaagtatataccaattattgccagtgttagtgagcatcaaccaccaacttggccatcttacttcatggatatcaatgttttagcattcttggttccagctggcatcatagcatgctttttgccactctctgatgcaagctcttttgctgtcctttacattgtaacatctgtatatttctctggtgtcatggttcgactaatgcttgtgcttgccccagcagcatgcataatgtctggaattgctctttcaggagcatttgatgtatttactcgttcggtcaaataccagttgcttggtatacaacaaaattcacagactaatgcaggggataccggtcctgataatgttgtctcacagaatgaagtggtaaagactgagaaaagtgtgctaaagactgagaaaagtgaagacacggtaaaggaaagaccctcaaagaaacacaagaaaaaggagaaggagaaggagaaggaaaggaaaaggaaaacgccgagagggcttctattaggtcatttgttgaggagaggcttttggttttacctctagaggcttctttagcagctatttttttgcttatcttgctggttgccttttacgtggttcattctgtctgggcagcagcagaagcatattcagcaccttccattgtgctaacatctcattctcctgatggccttcatgtttttgatgactttagagaggcttatgcatggctgagtcataacacagaggtggatgataaagttgcatcatggtgggactatggctaccagacaactgcaatggctaaccgcactgttattgttgataataacacctggaacaacactcatattgctacggttggaactgccatgtcctctccagagaaggcagcctgggagattttcaactctttggatgtaaaatatgtgcttgttgtctttggaggtcttgtcggctatccaagtgatgacattaacaagttcttatggatggttcggataggagggggtgtttttccgcacatcaaggaaccagattatctcagagatggccaatatcggattgattctcaggccacccagaccatgctaaattgtctcatgtacaagctgtcttattacagattcgtcgagacagatggcaaaggctttgatagagtgaggcgaactgaaattggaaagaaatattttaaactcaactattttgaggaggtatttactactcaccactggatggtccggatatacaaattaaaacctccaaggaacagaatccgaggaaagaccaagaaatctaaatcgaaatccagctcgacagccacctcaaaaagtggcagaacaagaaagaagaatccttggcactagaaaaagcattttatggttaggaagtgatctcagggcattatgttgtaagaaaaaatatagtttcacgtcgtactcttggttgggattgagcggcagaagttcgatttacaacagggatgagaaaattcaaagattttgtagtcttaaagtattaattgacatcaatttttaacttggtcaacaggcaatttgaaaagaaaaacccagtatttttcgggaacaagctcgtgtttcttaagacgttaagtgtgatcgaatctcagttatacatattttgcttac

SEQ ID NO: 5402 - DNA, 2837 bp, Silene vulgaris
tggcggccactgagtccgccattaacactggatcttctctacgtcacgcttccggaaatgtgcttgccgtcttcattctcatcttgatcggcgttctcgctttcgcgatccgtctcttctctgttattaagtatgagagtgttattcatgagtttgatccttatttcaattatcgcgttacgcagtttcttaccaagaatggcatatatgacttctggaactggtttgacgacaggacctggtatccattgggtcgagtaattggtggaacagtgtaccctggattaactctcaccgcaggcacactatggtggttattgaattctttgaacattcctttgactgtggaaactgtctgtgtgtttactgcaccaatattttcggcttttgcttcatgggcaacctatcttctcacaaaggaagtgaagggcacaggtgctggactgacagctgcattacttttaggcatggtgccatcctatatatctcgatctgtagcaggcagctatgacaatgaagctgtggctatatttgctttgatatttactttctatctttatgtaaagacactgaataccggttctctgttctatgcaactttgaatgcaatagcgtacttttacatggtttgctcctggggaggatacaccttcatcattaaccttattcccatgcatgttcttctgtgcattgttactggtcgatattctcacaggctgtatattgcatatgctcctctgattgtgttgggcacactgttggctgctttggtccctgttgtcggttttaatgcagttttgacttcagaacatttcgcatcatttttggtgttcattattctccacgtggttgcttttgtgtattacattaagggaactctttcaccgcagatgttcaaagtagctgtgactcttgtcgtatctattggcatggcggtttgttttgctgtagccgcagtacttgtggcattggttgcttcaagtccaacaatgggatggagtggacgaagtcttagccttcttgatccaacttacgctagcaaatatataccgatcattgctagtgtcagtgaacaccaaccgcctacgtggccatcttacttcatggacattaatgttttggccttcttggtgccagctggaattgtttcgtgcttcttacctttgtctgatgcaagctcatttgtaatcctctacatagtgacatcagtttacttttcaggagtcatggtgcgtcttatgcttgtatttgccccagcagcatgcatattgtccggaatagcactttctgaagcttttgatgtttttgctcggtctattaaattccagttgcctacaatattagatacttcagaaaatgaggcaggagttctcagttctggcagtgctgggctacaaaatgatgtggtgaaagctaataaaggtgacgatgtcacaaaggatcgacctctgaaaaagggcaaaaagaaggagaaggaaaaggagaaggaatctgctgggactgcttccttgaagtcccgtcttgagaagaggcttcttgttttaccactggaagcatctatcatcgccttactcttaactatctttcttggaggtttttatgtgatacattgtgtttgggctgcagcagaagcatactcagctccttctatcgtcttgacatctcatacacatgatggtctgcatgtttttgacgattttagagaggcctatgcttggttaagccacaacacagaggtggatgataaggtggcttcttggtgggattatgggtaccaaactacagcaatggctaatcgcactgttattgtcgacaataatacctggaataacactcacattgctactgttggaactgccatgtcctctcctgaaaaggcagcatgggaaatattcgactctctggatgtcaaatatgtgcttgttgtatttggaggtcttgtgggatacccaagtgacgatatcaataaatttttgtggatggttcggataggaggaggtgagttccctcacatcaaggagcctgattatctgagagacggccagtatcgcattgactctgaggcaacacctaccatgctgaattctttgatgtacaagctctgttattacagatttgtggagacagatggcaagggatatgatagggtgcgaaggactgagattggaaagaaatatttcaagcttacccactttgaggaggcgtttacatcccatcactggatggtacgaatatacaaattgaaaccgcaaaagaacagaattagaggaaagggcaagaaactgaaatcgaaaacaagctcgaccgcctcaaaacgaagcaccaacaccagaaggaatccttggcattagtctctcttcccttgtattttccctcttttcatcactagggaactcgtaggtcagttgctttcaatccatacatagcttatatggttcgacttttagaaagatctcagagagcatagtttgatctattgatgaaggattcgaaaaaccaagagaaaatttgctttatgctaaaagattttgtctcccgaattttttgccttaattatccatcgatcttggtggaaaaagattagttcacaaagggatccattaagagatcaagaaatagcatacttctgcaatacagttatttctgttgttctagtactccattttatttcctttggattggaatggaacaaaagcaaaatgactcaccaaattacccgaggttactatatctattgtgaagttgcagtcatttgatgcaaatctttacggttacttggacaattattttgttattgcaatacagaaggtaggttgtgtatattgaacttctcctta

SEQ ID NO: 5403 - DNA, 2589 bp, Malus domestica
tcgctgcccgcaaaaacccttcctcctcctcagacctcagtctcctcctccatcgctcttccaaaagctcggagcttgatttggccgtcaatggcggcctcggagacctccaacggaacgaccttgaggcacgcttttggaaatgtcctctccttcttcatcctcatcctgatcggcgtcctcgcattttcgatccggctcttctctgttataaagtacgagagtgttattcacgagtttgatccgtacttcaattacagagtcactcagtttctgacgaagaatggaatatacgatttttggaactggtttgatgaccgaacctggtatcctcttggtcgtgtgattggtggaactgtttaccctggattgaccttgactgcaggatccctatggtggtttttgaattctttgaacattcctctttctgtggaaactatttgcgtatttactgcacctatattctctgctttcacatcatgggcgacttaccttctgactcgggaagttaagggtgctggtgctggactaacagctgctgctcttatagccatggtcccgtcatatatttctcggtcagtggctggaagctatgacaatgaagctgtggctatttttgctttgatcttcactttctatctttatataaagactctgaatacaggatccctcttctatgcaactcttaatgccatagcgtacttttacatggtttgctcttggggaggctacacatttattattaaccttattccaatgcatgtgcttctttgcattgtaactggccgctactcttctcgtctatacattgcatatgctcctcttgttgttttgggaacgttgttagcggctttggtgccggtggttggattcaatgcagtcatgacatcagaacattttgcttccttcttggtttttattattttacatgtggtcgctcttgtgtactatatcaaagggattctctctccgaaaatgttcaaagtggctgtcacgcttgtagtatccattggcctgctagtatgtttagctgtggtagcagtactcgtagctctggtagcttcaagcccaacaaagggatggagtgggcgaagtctaagtctacttgatccaacttatgcgagcaagtacataccaattattgctagtgttagtgagcaccagcctcctacttggccctcttactttatggatattaatgtgttggccttcttggttccagctggaattattgcatgcttttcacccttatcagatgcaagctcttttgtgatcctctatattgtaacatcagtatatttctctggagtcatggtgcgacttatgctagtacttgctccagcagcgtgcatcatgtctgggattgctctgtctgaagcttttgacgttttcacacgatcaatcaagtttcagttacccggtcttctagtgccttcccaagttgatgcaggggaaaccagttccgagaacactgtatcccagaatgaagtgccgaaaacagataaaagagcagacacattaaaggagagaccctcgagaaagaacaggaagaaggaaaaggaaccagttgaaaagccttccattaaatctcaaattgaaaagaggcttctggttttaccatttgagggatctattcttgctatatttctacttgtgttgcttggagccttctatgtggttcattgtgtctgggcagcagcagaagcttattcagccccgtctattgttctaacatctcattcacatgatggtcttcatgtttttgatgattttagagaggcttatgcgtggctaagccacaacactgaggtggatgataaagttgcctcttggtgggattatgggtaccaaactactgccatggctaatcgcactgtcattgttgacaataatacatggaacaacacgcatattgcaaccgtgggtactgccatgtcttctccagaaaaggcagcttgggaaattttcaactcattggatgtaaaatatgtcctcgttgtttttggaggtcttgttggctaccccagtgatgatattaacaagttcttgtggatggtccgaattggagggggcgtattccctcatatcaaggaacctgattacttaagggatggacagtatcgcattgacaatcaggcgacccccaccatgctaaattctctcatgtacaagctctgttattacaggtttgtggacacagacggtaaaggctttgatagggtgaggcaaacagaaatcggaaagaaacatttcaaacttactcattttgaagaggtgttcacaactcaccattggatggttcggttatacaaactaaaaccgccaaagaacaggatccgaggaaagacaaagaagtcaaaatcgaaatcgagctcaacgagtagcacaaagaggcggaacgaaaaggaatccttggcattaatctgtggtcacgtatctgtaatctcatataacatatatacagaaacgctgagagggcctctggagaaagtgattgagagcaggcatagttttagttgatcatttcttacgaaacgcaaatcgatcaaaagattttgtagccacttgtgatatggatcttgacttgta

SEQ ID NO: 5404 - DNA, 2621 bp, Brassica oleracea
gagtgagattgcttcgaaaacccttcccgagtcttcgtcctcctccttcaaagtcgtctctctctctctagagccggagagctcacattctcagcgtagaaaaaaatggcgactctagagagtccacctcccggaacgccgtctgcgatgaggaatgctttcgggaccgttctctcagctctgatcctcctcctcattggtgtcctcgctttctcgatccgactcttctctgtgataaagtatgaaagtgtgattcatgaatttgatccttacttcaattacagagtcactcagttcttatcgaagaatggaatatacgagttctggaattggtttgatgatcggacctggtatcctcttggccgtgtgattggaggaactgtttaccctggtttaacattgactgctggaaccatctggtgggccttgaatgcaataaacattcctctgtcagtagagactgtttgtgtcttcactgcacctgtattttcagctttcgcatcctgggcgacttaccttttgaccaaggaagttaagggctccggtgcaggactagcagctgctgctcttttggccatggttccctcatatatatcccgatctgttgctggaagctacgacaatgaagctgttgctatatttgctttgatcttcactttctatctttacataaagacactaaatacaggttccctgttttatgctacactgaatgccattgcatacttctacatggtatgttcttggggaggttacaccttcattatcaatctgataccaatgcatgtgcttctgtgcattgtaactggccgatactctcctcgactgtacattgcctatgctcctttggttgtgctgggtacgctgttagctgccttggtacctgttgttggcttcaatgcggttttgacatctgaacattttgcctcatttttggttttcatcatcatccacgtagtagcactcgtatactatatcaaaggcattctttctcccaaaatgttcaaagttgctgtgacacttgttgtgtccatcggcctggttgtgtgtctcatagttgtggcagttcttgtggcactggtagcttcaagtccaacaggaggatggagtggtaggagtttgagtctacttgatccaacttatgcaagcaagtatattccaattattgcaagtgtcagtgagcatcaacctccaacttggccgtcctatttcatggacatcaatgttttggctttcttggtccctgctggcatcattgcgtgcttttcgcctctatctgatgcgagctctttcgtggtcctgtatattgtgatgtccgtatacttctccggagttatggttcgtcttatgcttgtgcttgctccagcagcatgcatcatgtctggaattgcgctctctcaagcttttgatgttttcacggcttccatcaaataccagttaggtcgatcggctaattccaaagatgatgcagaggacaacacttctactaacaatgccccaaaagatgattcatcttctggcaagactgacaagggtgaagaagttgcaaaagaacggtcgtcaaagaaaggcaagaagaaagagagagagcctgctgataaaccttctgttaagtccaagattttgaagaaaagggctcttgttttgcctcttgaagcctctatagttgcgcttcttctccttataatgttgggtgctttctatgtgattcattgtgtttgggcagctgcagaagcatactcagctccatcaatagttttgacatctcaatcgcgtgatggcctacacgtctttgatgattttagagagtcttacgcatggttaagccataatactgacgtggatgacaaagtggcatcatggtgggactatggttatcagacgacagctatggctaatagaactgttatcgttgacaacaacacctggaataatactcacattgcaactgttgggactgcaatgtcatctccagaaaaggcggcgtgggaaatcttcaactccttggatgtgaaatacgttcttgtcgtctttggtggtcttattggctacccaagtgatgatattaacaagtttctgtggatggttcgtattggaggcggcgtctttcctcatataaaggaagctgattatctgagagatggcaattaccggattgattctgaggccacgccaacaatgttgaactgccttatgtacaagctatcttactacaggtttgtagagacggatggcaaaggttatgatcgggtcaggcggacggagatcgggaagaaaaatttcaagctcacacatttcgaagaggttttcacgagtcaccattggatggttcgtatatacaagctgaaacctcagaagaacaggattcgtggtagagcaaagaaactgaaactgaaaacaagctctggattggactcgaaagcagcgaagaagaatccgtggatctagaaacccctagaaatttttaatgttggatggtgagttatatgttaactcttattaggtcactcttttatcctcagaggaagttgttgcagacgcagtcaagtttctgatgttaggattcgtaaaacttttgtagacttgggagttttatgtttattgtggagatttacaaattc

SEQ ID NO: 5405 - DNA, 2869 bp, Gossypium hirsutum
acccctctctacacactctctctgtcccttcgcattggactgttgattggccgtcaatggcggctccagaggcctcaaccgccgccgtaccgactctatacaccaataacaccttgcgaaatgctttcggcggtgttctctctttcttcatcctcctcctgatcggagttctcgctttctcgatccgtcttttctctgttataaaatacgagagtgttattcatgagttcgatccttactttaattacagagtcactcagtttcttacaaagaagggaatttatgaattttggaattggtttgatgatcgaacttggtaccctcttgggcgcgtgattggcggaactgtttaccctgggttgaccttgacagctggcaccatttggtggttgttaaattctttaaatattccactgtctgtggaaactgtttgtgtttttactgcacctatattctctgcttttgcttcatgggcgacatacctcttgactaaggaagttaagggtgctggtgctggactgacagctgctgttcttttagccatggttccatcatatatctcccggtctgttgctggtagctatgacaatgaagctgtagcaatatttgctttgatcttcactttctatctttatttaaagaccctaaatactggatccctgttttatgccaccttaaattcacttgcatacttttatatggtctgctcttggggaggatacacattcattattaacctcattccaatgcatgtgcttctatgcattgtaactggtcgatattcttctcgattgtacatcgcttatgctcctctcgttgttttgggaacattactagctgctttggtgccagtagtggggtttaatgctgtgatgacatcagagcattttgcatcatttttggttttcattattatccatgtagtggcttttgtgtactatatcaaggggattctttcccccaaaatgtttaaagttgctgtgacacttgttgtgactgttggcctggcagtgtgttgtgctgtgatagctgtacttatagcattagtagcttccagtccaacaaagggatggagtggacgaagcttaagtctgcttgacccaacttatgcaagcaaatatataccaatcattgctagtgttagtgaacatcaaccacctacttggccatcttatttcatggacattaatgttttggccttcttggttccagctggtatcattgcctgctttttgcctttatcagatgcaagctcattcattgtcctctatattgcaacctctgtgtatttctctggagtaatggtccgcttaatgcttgtgcttgctccagctgcatgcatcacatctggaattgccctttccgaagcttttgatgttttaaccggatcaataaagtttcagctacctggagtaacaagcaatgctgaagttgatgcaggggaaactagttctgatactagtgaagcacagactgatgaagtaaaggcagagaaacctgatgacacatcaaagaatcgaccctcaaagaaaagcaagaagaaggaaagggagcttgcggaaaatcctcctgccaaagccacagccaaagccaaagccaaagctgagaagaagaggcttcttgctttacctttggaggcatctgtgatttcacttctcttactggttgtgctgggcgccttctatgtggttcattctgtttgggctgcagcagaagcttattcagctccttcaatagttttaaccactcgttcacgtgatggtctacatgtttttgatgattttagagaggcttatgcatggttgagccataatacagatgtcaatgataaagttgcatcatggtgggactatggttaccaaaccactgccatggctaatcgcactgttattgtcgacaataatacctggaacaatactcatatcgcaactgtcggtactgccatgtcttctcctgaaagggcagcttgggaaattttccactccttggatgtcaaatatgttcttgtagtctttggaggtctcattggttaccccagtgatgatattaataagttcctgtggatggttcgaatcggaggtggtgtctttcctcatatcaaggaaccagattatcttagagacggacaatatcgaattgactcccaggccactccaaccatgctaaattgtctaatgtataaactctcatattacaggtttgttgaaaccgatgggaaagcctatgatagagttaggcggacagagatcggaaagaaatattttaaactcactcattttgaggaggtattcacaacacatcattggatggttcggatatataaactgaagcctcttaagaacaggattcggggaaaggcaaaaaaatcaaaatcgaaaactagttcaacaagcagttctaaaagaagtggaaccaaaaagaagaatccatggcagtaggaaacagaatattgataccaatggtaaaaatttctctgtaactcgagtagaatcgtttgtttgccaaaagagccttttaggttttgctcggtagcgagaatgaaaggagacgggaagtttgttattccaataattgttcagactctttttcagctttcctatcgagcaaacccgtgatagagtttgattacgccggctatgttaggtgattttctttgagaattacaatatataaatcaaaacgattttgcaggtttcgcttgatctttgtaatctgtaacgcatcaggttcagggttaagatcagatttaggtcaagttcagatataatgctcatatcatatttatgtgttaactctggcttaaagcagagatttttaaggaaaattatttcgtgcattgcaggtagcgttaaaaaaaaagaaaaaagta

SEQ ID NO: 5406 - DNA, 2792 bp, Setaria italica
ttcgcgatcgcgaggtcttcgtctccgcctgggtccagcgctgggatttccgcgccctccacccacacagccaacgacgttgccgcaatggcggagccggtctcctccgcggcggccagcggcggcgggagactccgcaacgccttcggcggcgtgctctgcgccttcacgctcctcctcatcggcgtcgtcgcgttctcgatccgcctcttctccgtaatcaagtacgagagcgtgatccacgagttcgacccctacttcaacttccgcgtcactcagtttctgtcgaagaatggaatttacgagttctggaactggtttgatgataggacatggtatccccttggccgtgtgattggtggcactgtgtatcctggtttgacattgactgctggaactatgtggtggttggtgaacgctcttaacatcccattgtctgtggagacagtttgtgtgttcactgctccaattttctcggcaaatgcttcctgggctacttacctgttaacaaaggaagcaaagggcacaggagctggattaatggcagcagccattttggcaatggtcccctcatatatctcaagatctgttgcaggcagctatgataatgaagctgtggcaatatttgccttgatatttacattttatctgtatgtaaagacactgaacacagggtcgctcttttatgcaacgctcaacgctctttcctatttctacatggtctgctcttggggaggctacacattcattatcaaccttatcccaatgcatgttctcttgtgcattgttactggtcgttattcttcgcggctctacattgcatatgctccccttgttatacttggaacacttctagcagccttagtacctgtggttggttttaatgcagtaatgacctctgagcactttgcatcatttctggtgttcataatccttcacgtggttgctcttgtgtattacatcaaagggcttttgactcctaggctgttcaaagttgctatgactcttgtcatatctgttggcttagctgtttgttttgcagtagtagctgtacttgtcgcattggtggcatctagtccaacaaaaggctggagtggccgcagcttgagtctacttgacccaacttatgcaagcaagtacatccccatcattgccagtgtcagtgaacaccaacctcctacctggccctcttattttatggacatcaatgtgttggccttcctgattcctgctgggattatttcatgcttcttgcctttgtctgacgcaagctccttcatggtcttgtacttagtcactgcagtgtatttttctggagtaatggtgcggcttatgcttgtccttgctcctgctgcgtgcattttatctgggattgctctctctgaagttttcggtgtcctcacacgatccattaaatttcagctgtcaaaattatttgatgatagctctgctgctgtttctgcttctggtgacagtggcccagagagttctacaaattcaacaaaaagtgaaaataggaatgaaaaatctgaaacagctccaaaggaaaaaccatcaaagaagaaccgaaagaaggaaaaagaagtggcagagagtgttcctgtaaagcctaaaaaagaaaagaggcttttggttctgccttttgaattatccattatgggtattttgttgctgattgtgctaggtggtttctatgtagtccattgtgtatgggcagcagctgaagcgtactccgcaccttcaatcgtgctgacatctcgttcacgtgatggattgcatgtttttgatgatttccgtgaagcttatgcatggctgagccataacacagatgttgacgacaaggttgcttcctggtgggactatggttaccaaacaactgcaatggccaacagaactgtgattgtagacaataatacctggaacaacactcacatagcaacagttggtacagcaatgtcatccccggaaaaagcagcttgggaaatcttcaattctttagatgtcaaatatgtgcttgttgtcttcggagggcttgttggctaccctagtgatgatatcaataagtttctttggatggttcgcataggaggtggtgtattcccacacatcaaggagccagattatcttagggatggccagtaccgtgttgatgctcaagccactcctactatgctgaattgcctcatgtacaagctttgctattacaggtttgtggagactgatggaaaaggcttcgacagagtaagaggatatgaaattggaaagaagcatttcaagctaacacattttgaggaggtattcacaacccaccattggatggtccgtatttataaactgaaaccccagaagaacagggttcgaggcaagttgaagaagttgaaatctaatgccaaaactagttccacccttgtggcaggccgaaagaagaacccgtggcaatagatgaagttaacaatagtgtcatttacttgatacttgctgttgctaggtcaactgcactaagcttgtgaaccagaaaaccacaggactagattagagatatctgcactgttgttgtatttgaccctcgttatatgttcttggaaccggccagcggggtgctgatgaaatttttgatagacctgagcaaatttttcgcgccctttttctggtatactgttcgtgtcgtttgcactgaagatgcaagattgaaaggcgtctgttagaacgaggtcagaatggtcgtgggtgtatttgctgccattaatttaacgttgaatcacacgccttaaaatttcaattcaactatttga

SEQ ID NO: 5407 - DNA, 2396 bp, Lactuca sativa
gctagaagcaagtcttctctttgtcgtgtctagttgactcgaccgaaatcgctataaacccgaacgaaaacacacacacatcaaagcaattacgcccgttaatggcggcctctacagatacaacggcagcgccgtcgacgactctccggcacgcctctggaaatattctcgcattcttcatcctcctgttaattggcgtactcgcattctcgatccgtcttttttcggttattaaatatgaaagtgttattcacgagttcgatccttatttcaattacagagttactcagtttctcacgaagaatgggatatatgatttctggaattggtttgatgatcgaacctggtatcctcttggacgagtcattggtggaacggtttaccctggattgactctaacagctgggacaatatggaaggtacttcagtccttgaatattcccctatctgtggaaactgtttgtgtattcactgctcctgtattctcagcctttgctgcatgggcaacatatctcttgacaaaggaagttaaaggagcaggtgctggactaacagctgcagttcttctggccatggttccatcttacatatctagatcagtggctgggagctatgacaatgaagctgtagccatctttgctttgatcttcaccttctatctctacattaagacattgaacacaggatcccttttctatgctactttaaactcaattgcatacttctacatggtatgctcttggggaggatacacctttattatcaatctgataccaatgcatgtgcttctttgcattgtgactggtcgctattcatctcggctctacattgcatatgctccacttgttgtcttgggaacattactggcagcattagtgcctgttgttggttttaatgcagtcatgacatcagaacattttgcatcatttttggttttcattatcatccatttggtcgctcttgcatattacattaaaggaatcctctcaccaaagatgtttaaagtagcagccactcttgttatatcagttggcatggtggtatgctgtggtgtagtagctgtacttgtagcagtggttgcatctagtccaacaaagggatggagtggaagaagtttaagtcttcttgatccaacatatgcaagcaaatacattccaattattgcaagtgtcagtgaacatcaaccacctacttggccatcttactttatggatctaaatgtactagcattcttggttcctgctggaattattgcatgtttttcacctctatctgatgcaagttcctttgtcatcctttacatagtaatgtcggtatatttttccagtgtcatggtacgattaatgcttgtgcttgctccagctgcatgcatattatctggaattgctctttctgaagcctttgatgttttcacaagatcaattaaattctatgtatctgacctatctgaaaatctccagactgaagcaggggatggagcatctgctagtaatgtgtccatggaaaataatgacaaaaaagaagagttgttgaaggaaagaggttccaagaaaaacaagaagaaagagaaggtggttgtggaagagagttctaagaagaagaagactgaaaagaggcctttagttttgcctgttgacacatcgatttttgctcttttcttaattgtgttgttgggtgccttctatgtggttcatagtgtatgggctgcagcagaggcttattcagctccttcaattgtgctgacttctcattcacccgaagggcttcatgtttttgatgatttcagagaggcttacgcatggttaagccataacactgaagtagatgataaagtggcatcatggtgggactatggttaccaaacaacagcaatggctaaccgtacagttatagttgataacaacacatggaacaacacacatattgctactgttggcactgccatgtcatcacccgaaaaagctgcttgggaaattttcaactccttggatgtcaaatatgtccttgttgtttttggaggtgttgtgggatactctagtgatgatataaataagttcctatggatggttcgtataggaggaggtgtcttcccacatatcaaggagcctgattatcttagagatgggcaataccgaattgattcacaggcgactccaaccatgctaaactgccttatgtataaactatcatatttcaggtttgtggagacggatggtggtagaggatatgatagagttaggaggactgaaatagggaaaaaacatttcaagttgactcattttgaagaggtgttcacaactcatcattggatggttcggatatataaactaaaacctcaaaagaacaggattcgtggcaagacagcaaagaaatctagatcggtataactacacttt

SEQ ID NO: 5408 - DNA, 2900 bp, Panicum virgatum
aaataacactattttcatgggcttactagcaaaagcgcaataaatcccgagtgccccgtccccggagctggactggagcccccggttcgcgatcgcgaggtcttcgtctccgcttgggtccagcactgggatttacgcgccctccacccacaaccaacgagcggctgcaatggcggagcccgaggtctcctccgcggcggccggcggcggcggacgactccgtaacgccttcggcggcgtgctctgtgccttcacgctcctcctcatcggcgtcgtcgcgttctcgatccgcctcttctctgtaatcaagtacgagagcgtgatccacgagttcgacccctacttcaacttccgcgtcactcagtttttgtcgaagaatggaatttacgagttttggaactggtttgatgataggacatggtaccctcttggccgtgtgattggtggcactgtgtatcctggtttgacattgactgctggaactatttggtggttggtgaactctcttaacatcccattgtctgtggagacagtttgtgtgttcacagctccaattttctcggcaaatgcttcttgggctacttacctgttaacaaaggaagcaaagggcactggagctggattaatggcagcagccattttggcaatggtcccctcgtacatctcaagatcagttgcaggcagctatgataatgaagctgtagcaatattcgccttgatatttacattttatctgtatgtaaagacactgaacacagggtcactcttttatgcaacgctcaatgccctctcgtatttctacatggtgtgctcttggggaggctacacgttcattatcaaccttatcccgatgcatgttctcttgtgcattgtaactggccgttattcatcgcggctctacattgcatatgctccccttgttatacttggaacacttctggcagccttagtacctgttgttggttttaatgcagtaatgacctctgagcacttcgcatcatttctggtgttcataatccttcatgtggttgctcttgtgtattacatcaaagggcttttgtctcctaggctgttcaaagttgctatgactcttgtcatatctgttggcttagccgtttgttttgctgtagtagctgtgcttgttgcgttggtggcatctagtccaacaaaaggctggagtggccgcagtttgagtctacttgacccaacttatgcaagcaagtatatccccatcattgccagtgtcagtgaacaccaacctcctacctggccctcttattttatggatatcaatgtgttggccttcctgattcctgctgggattatttcatgcttcttgcctttgtccgatgcaagctccttcatggtcttgtacttagtcactgctgtttatttttctggagtaatggtgcggcttatgcttgttcttgctcctgctgcatgcattctatctgggattgcgctctctgaagtttttggtgtcctcacacgatccattaaatttcagctgtcaaaattatttgatgatagctctgctgcttcaggtgacagtagctcagagagttctacaaattcagcaaaaagtgaaactaggaatgaaaaatctgaaacagctccaaaggaaaaaccatcaaagaagaaccgaaagaaggaaaaagaagtggcagagagtgttcctgtaaagactaaaaaggaaaagaggcttttggttctgccttttgaattatccgttatgggtattttgttgctgattgtgttaggtggtttctatgtggtccattgtgtatgggcagcagctgaagcgtactctgcgccttcaattgtgctgacatctcgctcacgcgatggattgcatgtttttgatgatttccgtgaagcttatgcatggctgagccataacacagatgttgacgacaaggttgcttcctggtgggactacggttaccaaacaactgcaatggccaacagaactgtgattgtagacaacaatacctggaacaacactcacatagcaacagttggtacagcaatgtcatccccggaaaaagcagcttgggaaatcttcaattctttagatgtcaaatacgtgcttgttgtctttggagggcttgttggctaccctagtgatgatatcaataagttcctttggatggttcgcataggaggtggtgtatttcctcacatcaaagagccagattatcttagggatggccagtaccgtgttgatgctcaagccactccaactatgctgaattgcctcatgtacaagctttgctattacaggtttgtggagactgatggaaaaggctttgacagagtaagaggatatgaaataggaaagaagcatttcaagctaacacattttgaggaggtattcacaactcaccattggatggtccgaatttacaaactgaaaccccaaaagaacagggttcgaggcaagttgaagaagttgaaatctaatgccaaaactagttccacccttgcggcaggccgaaagaagaacccgtggcaatagatgaagttaacaatactcgatacttgctgttgataggtcaactgcactgagtttgtgaaccagaaaaccacagaactagattagagatatctgcactgttgttgtatttgacccttgtcatgttcttggaaccggccagcagggtgctgatgaaatttttgatagacctgagcaaattttcgcgaccttatctccgtgtcacgtgcgttgaaggtgtcaaggttatcatacggtgaaaggtgtcgtttagaacaatgtcattttggtcgttggtatattcgatttcattagagatttgaggatgaatcacgcaccttgaagtttcgatgcaactattttaatggccaaaaatataattatgggttgctttgctatttatttt

SEQ ID NO: 5409 - DNA, 2340 bp, Brassica napus
cgtctgcgatgaggaatgctttcgggaccgttctctcagctctgatcctcctcctcattggtgtcctcgctttctcgatccgactcttctctgtcataaagtatgaaagtgtgattcatgaatttgatccttacttcaattacagagtcactcagttcttatcgaagaatggaatatacgagttctggaattggtttgatgatcggacctggtatcctcttggccgtgtgattggaggaactgtttaccctgggttaacattgactgctggaaccatctggtgggccttgaatgcaataaacattcctctgtcagtagagactgtttgtgtcttcactgcacctgtattttcagctttcgcatcctgggcgacttaccttttgaccaaggaagttaagggctccggtgcaggactagcagctgctgctcttttggccatggttccctcatatatatcccgatctgttgctggaagctacgacaatgaagctgttgctatatttgctttgatcttcactttctatctttacataaagacactaaatacaggttccctgttttatgctacactgaatgccattgcatacttctacatggtatgttcttggggaggttacaccttcattatcaatctgataccaatgcatgtgcttctgtgcattgtaactggccgatactctcctcgactgtacattgcctatgctcctttggttgtgctgggcacgctgttagctgccttggtacctgttgttggcttcaatgcggttttgacatctgaacattttgcctcatttttggttttcatcatcatccacgtagtagcactcgtatactatatcaaaggcattctttctcccaaaatgttcaaagttgctgtgacacttgttgtgtccatcggcctggctgtgtgtctcatagttgtggcagttcttgtggcactggtagcttcaagtccaacaggaggatggagtggtaggagtttgagtctacttgatccaacttatgcaagcaagtatattccaattattgcaagtgtcagtgagcatcaacctccaacttggccgtcctatttcatggacatcaatgttttggctttcttggtccctgctggcatcattgcgtgcttttcgcctctatctgatgcgagctctttcgtggtcctgtatattgtgatgtccgtatacttctccggagttatggttcgtcttatgcttgtgcttgctccagcagcatgcatcatgtctggaattgcgctctctcaagcttttgatgttttcacggcttccatcaaataccagttaggtcgatcggctaattccaaagatgatgcagaggacaacacttctactaacaatgccccaaaagatgattcatcttctggcaagactgacaagggtgaagaagttgcaaaagaacggtcgtcaaagaaaggcaagaagaaagagagagagcctgctgacaaaccttctgttaagtccaagattgcgaagaaaagggttcttgttctgcctcttgaagcctctatagttgcgcttcttctccttataatgttgggtgctttctatgtgattcattgtgtttgggcagctgcagaagcatactcagctccatcaatagttttgacatctcaatcgcgtgatggcctacacgtctttgatgatttcagagagtcttatgcatggttaagccataatactgacgtggatgacaaagtggcatcatggtgggactatggttatcagacgacagctatggctaatagaactgttatcgttgacaacaacacgtggaataatactcacattgcaactgttgggactgcaatgtcatctccagaaaaggcggcgtgggaaatcttcaactccttggatgtgaaatacgttcttgtcgtctttggtggtcttattggctacccaagtgatgatattaacaagtttctgtggatggttcgtattggaggcggcgtctttcctcatataaaggaagctgattatctgagagatggcaattaccggattgattctgaggccacgccaacaatgttgaactgccttatgtacaagctatcttactacaggtttgtagagacggatggcaaaggttatgatcgggtcaggcggacggagattgggaagaaaaatttcaagctcacacatttcgaagaggttttcacgagtcaccattggatggttcgtatatacaagctgaaacctcagaagaacaggattcgtggtagagcaaagaaactgaaactgaaaacaagctctggattggactcgaaagcagcgaagaagaatccgtggatctagaaacccctagaaatttttaatgttggatggt

SEQ ID NO: 5410 - DNA, 2791 bp, Gossypium raimondii
cccctccctacacactctctctgtcccttcgcattggactgttgattggccgtcaatggcggctccagaggcctcaaccgccgccgtaccgactctatacaccaataacaccttgcgaaatgctttcggcggtgttctctctttcttcatcctcctcctgatcggagttctcgctttctcgatccgtcttttctctgttataaaatacgagagtgttattcatgagttcgatccttactttaattacagagtcactcagtttcttacaaagaagggaatttatgaattttggaattggtttgatgatcgaacttggtaccctcttgggcgcgtgattggcggaactgtttaccctgggttgaccttgacagctggcaccatttggtggttgttaaattctttaaatattccactgtctgtggaaaccgtttgtgtttttactgcacctatattctctgcttttgcttcatgggcgacatacctcttgactaaggaagttaagggtgctggtgctggactgacatctgctgttcttttagccatggttccatcatatatctcccggtctgttgccggtagctatgacaatgaagctgtagcaatatttgctttgatcttcactttctatctttatttaaagaccctaaatactggatccctgttttatgccaccttaaattcacttgcatacttttatatggtctgctcttggggaggatacacattcattattaacctcattccaatgcatgtgcttctatgcattgtaactggtcgatattcttctcgattgtacatcgcttatgctcctctcgttgttttgggaacattactagctgctttggtgccagtagtggggtttaatgctgtgatgacatcagagcattttgcatcatttttggttttcattattatccatgtagtggcttttgtgtactatatcaaggggattctttcccccaaaatgtttaaagttgctgtgacacttgttgtgactgttggcctggcagtgtgttgtgctgtgatagctgtacttatagcattagtagcttccagtccaacaaagggatggagtggacgaagcttaagtctgcttgacccaacttatgcaagcaaatatataccaatcattgctagtgttagtgaacatcaaccacctacttggccatcttatttcatggacattaatgttttggccttcttggttccagctggtatcattgcctgctttttgcctttatcggatgcaagctcattcattgtcctctatattgcaacctctgtgtatttctctggagtaatggtccgcttaatgcttgtgcttgctccagctgcatgcatcacatctggaattgccctttccgaagcttttgatgttttaaccggatcaataaagtttcagctacctggagtaacaagcaatgctgaagttgatgcaggggaaactagttctgatactagtgaagcacagactgatgaagtaaaggcagagaaacctgatgacacatcaaagaatcgacccttaaagaaaagcaagaagaaggaaagggagcttgcggaaaatcctcctgccaaagccacagccaaagccaaagccaaagctgagaagaagaggcttcttgctttacctttggaggcatctgtgatttcacttctcttactggttgtgctgggcgccttctatgtggttcattctgtttgggctgcagcagaagcttattcagctccttcaatagttttaaccactcgttcacgtgatggtctacatgtttttgatgattttagagaggcttatgcatggttgagccataatacagatgtcaatgataaagttgcatcatggtgggactatggttaccaaaccaccgccatggctaatcgcactgttattgttgacaataatacctggaacaatactcatatcgcaactgtcggtactgccatgtcttctcctgaaagggcagcttgggaaattttccactccttggatgtcaaatatgttcttgtagtctttggaggtctcattggttaccccagtgatgatattaataagttcctgtggatggttcgaatcggaggtggtgtctttcctcatatcaaggaaccagattatcttagagacggacaatatcgaattgactcccaggccactccaaccatgctaaattgtctaatgtataaactctcatattacaggtttgttgaaaccgatgggaaagcctatgatagagttaggcgcacagagatcggaaagaaatattttaaactcactcattttgaggaggtattcacaacgcatcattggatggttcggatatataaattgaagcctcttaagaacaggattcggggaaaggcaaagaaatcaaaatcgaaaactagttcaacaagcagttctaaaagaagtggaaccaaaaagaagaatccatggcagtaggaaacagaatatttataccaatggtaaaatattctctgtaactcgaatacaatcgtttgtttgccaaaagagccttttaggctttgctcggtagcgagaatgaaaggagacgggaagtttgttattccaataattgttcagactctttttcagctttcctatcgagcaaacccgtgatagagtttgattacgccggctatgttaggtgattttctttgagaattacaatatataaatcaaaacgattttgcaggtttcgcttgatctttgtaatctgtaacgcatcaggttcagggttaagatcagatttaggtcaagttcagatataatgcgcatatcatatttatgtgttaa

SEQ ID NO: 5411 - DNA, 2505 bp, Cichorium intybus
ggaaatgtcctcgcgttcttcattctcctgttaattggcatactcgcattctcgatccgtcttttttcggttattaaatacgaaagtgttattcacgagttcgacccttatttcaattacagagttactcagtttctcacaaagaacgggatatatgacttctggaattggtttgatgatcgaacctggtatcctcttggacgtgtcattggaggaacagtttaccctggattgactttaacagctggaactatatggaaggttcttcaatccttgaatattccactatctgtggaaactgtttgtgtattcactgctcctgtattttctgcctttgctgcatgggcaacatatctcttgacaaaggaagttaaaggagcaggtgctggattaacagctgcagttcttctggccatggtaccatcttacatatccagatcagtggctgggagctatgacaatgaagctgtagccatctttgctttgatcttcaccttctatctctacataaagacattgaacacaggatcccttttctatgccactttaaactcaatggcatacttctatatggtttgttcttggggagggtacacctttattataaacctcataccaatgcatgtgcttctttgcattgtgactggtcgatattcatctagactgtacattgcatatgctccacttgttgtattgggaacattactggcagcattagtgcctgttgttggttttaatgcagtcatgacatcagaacattttgcatcatttttggttttcattattatacatttggtcgctcttgcatattacatcaaaggaattctctccccaaagatgtttaaagtagctgccacccttgttgtatcagttggcatggtggtatgctgtgctgtagtagctgtacttgtagcagtggttgcatctagtccaacaaagggatggagtggacgaagtctaagtcttcttgatccaacgtatgcaagcaaatacataccaattattgccagtgttagtgaacatcaaccacctacatggccatcttacttcatggatctaaacgttttagcattcttggttcctgctggaattattgcatgcttttcacctctatctgatgcaagttcctttgtgattctatacatagtaacatcagtatatttttccagtgtcatggtacgattaatgcttgtacttgctccagctgcatgcatactctccggaattgctctttccgaagcctttgatgttttcacaagatccattaaattctacatttccggcctaaccgaaaccattgaaacccaagcaggagatgcagtttctaatgtgttggagatcgataaaaaacaagacttgttgaaggaaaaagaaaaaccttccaaaaagaacaagaaaaaagagaaagtgattgtggaagttgaaatcactgaaaaaaagaggcctttagtcttacctgttgacacatccatttttgctcttttcttaatcgtgttacttgctaccttctatgtggtccatagtgtgtgggccgcagccgaggcgtattccgctccttcaattgtcttaacttctcattcacccgaaggccttcacgtttttgatgatttcagagaggcttacgcatggttaagccacaacactcacgtagacgataaagttgcatcttggtgggactacggttaccaaacaaccgcaatggctaaccgaacagtcattgtcgataataacacgtggaacaacacacatatcgcgactgtcggtaccgccatgtcatcacccgaaaaagctgcttgggaaattttcaactccttggatgtcaaatacgtgcttgttgttttcggaggtgttgtgggatactctagtgatgacataaataaattcctatggatggtacgtataggaggaggtgtctttccacatatcaaggagcctgattatctcagagatggtcaataccgtatagattcacaggctactccaactatgttaaattgcctcatgtacaaactatcgtatttcaggtttgtggagacagatgggggtaggggatatgatagagttaggaggactgaaattggaaagaagcatttcaagttgagtcattttgaagaggtgttcacaactcatcattggatggttcggatttataaattaaaacctcaaaggaatagaattcgtggcaagacaaagaaatctagatcgaaaactagctcggccactacaacgagaacgagaaccttgacgaaaaagaatccttggcactaggagcggtttttattttaatttccaggcctaaactatatatgaggtagattaaatgtaatacaaacaaaccgaaataacattttttttgcattcaaaatctatgtcggaagattactactttatcatagattgggttgtgttgacaatgtcatcgataacacgcaaaccatgttacaaaccattttcactgtgcaatgggtctcgtaatgcatataatacgactcgtcatttcaatcc

SEQ ID NO: 5412 - DNA, 2424 bp, Euonymus alatus
agaaagaggacattgtcgtcattcaacagcaagtcagacctagttccgtcacctcattggccggggaattgtttcattgttttgtccacaacgagctctttactgcaactacaaggtcttcctcttactttggtctaccccgaagaagaccagccaacacccgctacatttggtcacacaatctgcgaacttcatctttctgaaatttgagttcactttagccgtcaatggcggcccctgaaaccgcgacggcaacgaccctgcgatatgccttcgggaatgttctctcgttcttcattctcctcctgatcggagtcctcgccttctcgatccgtctattctccgttataaagtacgagagtgtcattcacgaatttgatccttatttcaattacagagtcactcagttcctgacaaaaaatggaatatatgacttttggaattggtttgacgatcgtacctggtatccccttggtcgtgtgattggagggactgtttatcctgggttgacattgacagcaggcaccatatggtggttgctgaactctttaaatatcccgctttctgtggagaccgtttgtgtgttcactgctcctattttttccgcttttgcttcatgggcaacttaccttttgacaaaggaaatgatgggcgatggtgcaggactgacagcagcggctcttttggccatggttccatcatacatatcacgatctgtggctggcagctatgacaatgaagctgtggctatatttgctttaatcttcactttctatctttatataaagacgctgaatacaggatccctcttctatgccactttaaatgccatagcatacttttacatggtttgttcatggggaggctacacctttataatcaatcttattccaatgcatgtgcttctgtgcattgtaactggccgctactcttcccgactgtacattgcttatgctcctcttgttgtcttggggaccttgttagctgcactggtgcctgttgtcggattcaatgcagtcttgacatcagaacactttgcatcatttttggttttcatcatcatccatgtagtagctcttgcatactatatcaaaggaattctttctccaaaaatgttcaaagtagctgttactcttgttgtatctgttggcctggtggtgtgttgtgctgtggtggcagttttgatagcattggtagcctccagcccaacaaagggatggagtggacgaagtttgagtctgcttgatccaacttacgcaagcaagtacattccaattatagctagcgttagcgaacatcaacccccaacttggccatcttacttcatggacattaatgttttggcattcttggttccagctggcattattgcatgctttttgcctctgtctgatgcaagctcctttgcggtgctttatattgtgacgtctgtatatttctccggcgtcatggtgcgccttatgcttgtacttgctccagcagcttgtatcatgtctgggattgccctgtctcaagcttttgatgttttaacacgatcaatcaagtttcagctgcctacactgttggggaactcacaagttgatgcaggggataatagttctggtagtattgtagcccaaaatgatgtagtaaggattgataaaagtgaagacaaactgagggagcgaccatcgaagaagaacaagaagaaggaaaaagaaaatgtggaaatggcatcttccaagcccaagaaggaaaaaaggcttctggttttacctctggtggcatctgctattgctattttcttacttgtgatgcttggtgccttctatgtggttcattgtgtctgggcagctgctgaggcttattcggctccttctattgtcttaacgtctccttcacccgatggtggtttacatgttttcgatgattttagagaggcatatgcctggttgagccataatactggggttgatgacaaagttgcatcatggtgggactatggttatcaaacaactgctatggctaaccgcactgtcattgttgacaacaacacctggaataacacacatattgctactgttggtactgcaatgtcttctcctgaaaaggcggcctgggaaatctttaattcgttggatgtgaaatatgttctagtggtctttggaggtcttgttggctaccccagtgatgatattaataagttcctgtggatggttcgtataggagggggtgtcttcccccatatcaaggaacctgattacctcagagatggtcagtatcgcatcgactctgaggccactccaaccatgttaaactctctcatgtacaaactttcatatttcagatttgtggaaacagatgggaaaggccttgacagagtgaggcggacagaaattgggaagaaatatttcaagcttacccatttcgaagaggtgtttacga

SEQ ID NO: 5413 - DNA, 2706 bp, Phalaenopsis aphrodite
agtttacacccctccgtcagtacgagaatcaacccctagctgaaggaagactccacttcctctgctggtctctctttcatcgacacagcaatggtggctccggtcgatccgaaacccgggggagccctaagaaacgccttcgccggcgttttgggtttcttcattctttttctcataggtgtcctcgccttctcgatccgcctcttttcagttataaagtacgagagcgtgatccacgagttcgatccatattttaactacagggttactcagttccttaccaaaaatggaatttacgagttctggaattggtttgatgatcggacctggtatccccttggtcgtgttattggtggaactgttcatcccggactaacacttacagcaggcacaatgtggtggatacttaattctctcaacattcctctttcagttgagactgtttgtgtcttcactgcaccagttttctccgcttttgcggcgtgggctacatacttgctaacaaaggaggttaaaggcattggatctggattgactgctgcaattctcttagcactggtcccctcttatatctcacgttctgtggctggcagttatgacaacgaggctgtagcgatatttgctctaatattcaccttttatctttatgtaaagacgctgaacacaggatcacttttttattccaccttaagtgctttatcgtatttttatatggtatgttcttggggaggctacacattcattataaacctaattccgatgcatgttcttctatgtattgtgaccggtcgctactcttctcgattatacatcgcatatgcccctcttgttgttttgggaacacttctagctgcattggtgcctgtggttggttttaatgcagtgatgaagtcggagcattttgcatcctttttggtcttcattattattcatgtcgtggcctttgtttattttatcaaagggattctttcaccgaagatgtttaaagtggctataactcttgttttgaccgttggaattgctatttttgtagcagttattgcagtacttgttgcacttgtttcttccagtccaactaaaggatggagtgggcggagcttgagcctgcttgacccgacatatgcaagcaagtacatacccatcattgctagtgttagtgaacatcaaccacctacatggccttcatatttcatggatattaatatattggcattcttagttccagctggcatcgttgcatgcttcttaccgctatctgatgccagctcttttgtagtgctgtaccttgttacttctgtttatttttctggtgttatggttcgacttatgctcgtgctagctccagctgcatgcatcttgtctgggattgctctttcagaagcttttgttgttctgacacgatctgttaaacttcagctagtcaaattattagaggggccgcccctttccaatgcaggggataccaaaggtgagagatctgcagctcaaaatgatgtaccgaatgcaaataagcaggattcttccaataaaaccgaagatattaaagatcgttcgtcaaaaaagaacaggaagaaggagaaggaaaccattgagaaggctcctgtcaaatctagaaatgagaagaggcttctggttttgccgcttgaggcatctgccgttgcgattcttttgttagttgtgcttagtggtctttatgtgattcattgtgtatgggcagctgcagaagcttattcggcaccttcaattgttcttacgtctcgctcacatgatgggctccatgtgtttgatgattttcgtgaagcctatgcatggttaagtcataatactgaagtggatgataaggtggcatcatggtgggattatggctaccaaaccacggcaatggccaaccggactgttatcgttgataataatacgtggaataacactcacatagccactgttggtactgccatgtcttcaccggagaaggcagcctgggaaattttccagtctttggatgtgaaatatgttcttgttgtctttggaggccttgttgggtatccaagtgatgacatcaacaaatttctctggatggttcgcattggaggaggagtttttccacatattaaagagcctgattatcttagggatggtcagtatcgtattgacgcccaggccaccccaacaatgttgaactgccttatgtacaagttatcatattacagatttgttgaaacggatggcaaaggctttgatagagtgaggaggacagaaatcggaaagaagcattttaagttgtcccattttgaggaggtgttcacaacacatcactggatggtacgaatctacaagctgaagccggagaagaataggataaagcggaagaccaaaaagccaaaactatcttcaaaaacatcgtctggtgcaagaagagatggaagcactaagaaaaatccatggcagtgacattgtcaacggcacacgacacacgattgtttcagttggagagaattttgatggaccgaatagaatttataatattatcacaattagctggtgacaatgcctaataaagcgcccagttttaggatgtgtttgtgacctttttttttcttttattttcataattgtattttgcagattattgtcatttttgtatgcgattgcaattttcttatctttcaatatttttttatgatgagagagatgatatatcacaacggc

SEQ ID NO: 5414 - DNA, 6213 bp, Ananas comosus
tctttgccttcgtcttcgtttttcgccttcgaacccctctccctctacctcgcgccccctctctctactatctcgtgttgcccgagctcgcggcggcgccggtcatggcggagcccgctgggggcggcgctctcaggaacgccttcgggggcgttctcagcatcttcatcctcatcctcattggagtcctcgccttctcgatccgactcttctccgtgatcaagtacgagagtgtgatccatgagttcgatccctacttcaactaccgagtcactcagtttcttactaagaatggaatttatgacttttggaactggttcgatgatcgaacttggtatccacttggtcgagtgattggtggaaccgtataccctggattgacactaacagcggggaccatgtggtggatattgaattccctcaacattccgttgtcagttgagactgtctgcgtgtttactgctcctattttttcggcaaatgcatcttgggctacctaccttctgacaaaggaagttaaaggtgctggagccggattgactgcagcagcattactagcaatggttccttcatatatttcacgatctgttgctggcagctacgacaatgaagctgtagcaatatttgctcttatatttacattttatctatatataaagacactgaatacagggtcacttttttatgctacgctaaatgctatcgcatatttctacatggtctgctcttggggaggctacacattcatcatcaatcttatcccaatgcatgtactcctatgcattgtaactggccgctactcttcgcgcttgtatattgcttatgcccctcttgttgtcttgggaactcttctagcagcattggtacctgtagttggttttaatgctgtggtgacgtcagagcacttcgcatcatttctggttttcataatccttcatgtggttgctcttgtatattatatcaaaaggattctatctccagctatgttcaaagtggctgtgacactggttgtgaccattggcatggctgtttgttgtgcagtaatagctatacttatagcattggtggcttctagcccgacaaaaggatggagtgggcgtagtttgagtttacttgacccgacttatgcaagcaagtacatacctattattgctagtgtcagtgagcatcagccaccaacatggccttcatattttatggacatcaatgtgttggctttcttggttcctgctggcatcatagcatgctttttacctttatctgatgccagctcattcgtggtcctatatttagtaacatcagtatatttctctggagtaatggtgcgccttatgcttgtattggccccagcagcatgcatcacctcaggaattgctctttctgaagcatttgatgtttttacccgatcaatcaagtttcaactgcctaatttatttagtaattctcccagtgcaggggataatagttcagagagttctgtttctcaagatgtagtgaagaatgataaccatagacaggttgagaaatctgaaactgttccgaaagtaaaaggtgataattctagaccaacagagaaatctgaagctgttatgaaaggaaagcaatcgaagaagaatcgcaagaaggaaaaggatttggaggaagaggacattcttaagcctaagaaggaaagaaggcttttagtgttgcctttagaagcatctgcagttgccattcttcttctgattgtccttggtggcttttatgtggtccattgcgtatgggcggcagcagaagcgtattctgcaccctcaattgttctaacatctcattcacatgatggcttgcatgtttttgatgacttccgtgaagcatatgcatggttgcgacataatactgatgaagatgataaggtggcatcttggtgggattatggttatcaaacgagtgccatggctaaccgtactgttatagtagacaataatacttggaataacacccatatagcaacagttggtacagccatgtcttccccagagaaggctgcatgggagatctttaactctttagatgtcaaatatgtcctggtagtctttggaggcctcgttggctaccctagtgatgatattaataaattcttgtggatggttcgcattggaggtggtgtgtttcctcacatcaaggaacctgattatcttagggatggccagtaccgcattgatgctcaggctactccgacgatgctgaattgcctcatgtacaagctctcttattacaggtttattgaggcagatggttcaggctttgacaaggtcaggagaacagaaatagggaagaaacattttaagctaacccattttgaggaggcgtttaccactcatcactggatggttcgcatttacaaacttaaacctccaaagaataggatcaagggaaaatggaagaaatctaaatcgagctcaaagtcgagttccaaaaggaatggagctacaaggaagaacccatggcagtaatcctcggaatattttccactaatcagtgttcggctttgttattcacatgacgcttggtagagagtattgagattgctcatgttcgtgcggtggaatgaatattagagattataattttgacaatcacctcctcgtatactgtagaattgtttcctgtgttttctttacgaaaagcagacagatgatcgtgaaattttttagaggtgaaatcaaaaattattgtagagactataaaggttagtgaggttatttatttccgcaatctcttaacgaactacactgacaattatggtgattcaacagattagcttattttcataattttacttcccgcaaaacaacttatgttagatgaggttattttgggtcggtccgtctccattctttttcattcccatagcattcgatatagcacaaatcatcaaatacagaatacaaataaagaaaaaattattaccacagcgattgctcgatagcaaatacaaatgattgcaagcagtaaacctcatcctgatagttaaatagaacttattcacaactgattcaaagtagcaggtcggaaaaaactaaataaacattaataatataacaacgaacccgaaagctcctgctaacccaaagaataaataactaaccttcatgatatcacgtaactacaagaatgattgaagcattctaacttttacaaaccaactctcaaacaaaccaaatcccatatttaagtcagtagtattacatcacctaaaaccgatctgataaggcgaatatagtctggtgtagaaaacactgccctcgaaggtatcatgatgctgcaatcagaacgatcgagaactcaatgattctcccaaacctgcgctggtaatatagatatacagaacgcatacagacaagccttgccaaggagctactaataaatcacctgtagatactacgtactgttttataacatcttatagcttctttggaaggttgtaggttttcttcaggaacttagtggcttgctcatcatttctatagcacaaaatgcgtaacaatgtattggcctcattcgggctccaatgcccggatgttggcggcaaaggaaaccgcgatttggcttgagaaccatatgcttcaacaatcattcttctgaaccgttcgatcaggctctctgtatcagttcggaagagcggtaatacgttcttcacttggctcgctgccttctcgaccaactcttcaggcaaaccatccccatccgccaaaaataaatctttgagagatttaaaatcatcttcaatcatccgagcatcttgtttagtgaatgcacgcaaggggccgcctgctaaaagcactagcaagaagccatcaaaagaagctttcattaaagcagttattgctcggttacgcactctgtcatgcatggtatttgatatcgtttctagggttgggtcaagctctcttaggaagggctcaattctagaagacgcggtctcaccaacgtaaaggctgtcccacagaacatgacttagatcatgaaagatcaccttataggctgttgtctcacaaagctgttgaatcccttcttggcaagctgacaaggagagatcaaacttgatctctagcccgtttgatatatcagcatgagcagattcgacgtttcttaaacatgttatgattttcttctccaggttatccaactctgtccgaatatgatgaagtgtgttcatgcgcacgcaaagctgtggcaatccaagagaggcatttccattagttgagccaacctgtgatcttcttttcggcacattgtggtgtggtttttcctttttcctgaacaattttgaaccaacctcacatcttgttaatgcaggcagtgcagggatgaaagtattccgtgttccacatcctgactttgcttttgatgcataatgttgcagacttctatcaagtccaattatgaggtccggcagcagggcagggtgcattggtattggcagctgaaaaaatgcatctaaagtctcatcaattatccgaagaacctccaccgcagatggggcgcaactctccctgttagccctgggattccaagtctcttgctgcaaattccgatcaacccattccttaagtctgttcactcttgtttttatccattctttcactagattagcaattgcagactcggcctcataaggtggcatctgacgaattaatgacttgcccccatcatcactatcaacggaatcttcgacggcaataagcacgagatctttctccaacttatcagcagctttgagcacttggactgtgtctggtgttaactcagtaagaccagctacaaattgctttaactcatttccatagcaagaatgtagtgtcgcaacggcaacacctgcagctagtggatgccattgcttcaatattggactgaatagctctttttccttctttgctagatcgccaatgtcctttgcaaggatggaaaggactggggtaggagtagcctgattttttgatgaccgtctatttgaatctgcttgttccattctttgagcaaaagcagtacggagagacgatcgtatgtaagtgtcaatcctgctgcgagctacatcagtttcttctttcctcttacgacggtattcattagatatatcttcaacaagaattttagcagctgtcactcctatagagacaatactcggcatagactcaatgttactagaattgaaggtctcatgataagccagaagtcttttttctgtccaacccattattgagctgagtgttgaactcagaattttagaataaactggatcctttgtcgttttagcatcctttgcaacctcagctaactgattatcagcctcaaacaggagatcattgtctacttgaccggtggtaacaaaacggctgaataaaacccaagtaaaacaaagattgtgaagcatctgattgattccgaggataacccaagtcttttttatttgctctaatacctccaagctctcttccacaatggaaccttcctcaccattatcaaagcaagcttctatcagcatatggtatagatggagattaagtggaaatccatctgcccaatggcaggcgtctgaagatccatcaaaggatctgcaagcgagggcagtaacagcgctacgtaaaatctgcattgattctgaattccttccagtttcaagtggcctatctgaagctccgcgtatgatctggcgtagcctttgagctgaaacatccgatttctctagtggaataagtgggtgtagaagtaatccagcttcgaggagcttcaagttcctgatcttccaggcctcatattcttgtgggtctggaaaatctgatgctttgaactgttgcagtagttctaggggcaaaaccatagcctctacacgtctcccaagttgtcccgccgcgaccctaagcaaacccctccggatccgagcatcgctctgctccgagatccgcatctgaatccttataagctctccagcagagatctgcttcttcgccgaggacttcgcggggctcccgtcctttccggggctcttcttcgacgccgacaacgatttgagccctagggccttcttcatcttgctcgcggcggcggaggtgagcgatcgctgcagcgacggcgaggcggaaagcggcgaggcggagagcgacggcgacagcgaccggtctccggcggcggcgccgggggagggcttctgtgatcgaatgccactagacagaa

SEQ ID NO: 5415 - DNA, 2907 bp, Saccharum officinarum
gcaccagatcgcgtcgcgaggtcttcgtctccgcttgggtccagcactgggatttgcgcgccttccacccacacacacccaaggacgcaacacaggccgcaatggcggagcccgaggcctcctccgcggcggccggcggcggccggcggctccgcaacgcgttcgggggcgtgctctgcgccttcacgctcctcctcatcggcgtcgtcgcgttctcgatccgcctcttctccgttatcaagtacgagagcgtgatccacgagttcgacccctacttcaacttccgcgtcactcagtttttgtcgaagaatggaatttacgagttctggaactggtttgatgataggacatggtacccccttggccgtgtgattggtggcactgtgtatcctggtttgacattgactgctggaactatttggtggttgctgaactctcttaacatcccattgtctgtggagacagtttgtgtgttcacagctccaattttctcagcaaatgcatcctgggctacttacctgttaacaaaggaagcgaagggtactggagctggattaatggcagcagccattttagcaatggtcccctcatatatctcaagatctgttgcaggcagctatgataatgaagctgtagcaatattcgccttgatatttacattttatctatatgtaaagacgctgaacacaggatcactcttttatgcaacactcaatgctctctcatatttctacatggtctgctcttggggaggctacacattcattatcaatcttatcccaatgcatgtcctcttgtgcattgtaactggtcgttattcttcacggctctacattgcatatgctccccttgttatacttggaacgcttctggcagcattagtacccgtggttggttttaatgcagtaatgacctctgagcacttcgcatcatttctggtgttcataattcttcatgtggttgctcttgtgtattatatcaaagggcttttgactcctaggctgttcaaagttgctatgactcttgtcatctctgttggcttagctgtttgtttcgcagtagttgccatacttgtcgccttggtggcatctagtccaacgaaaggctggagtggccgcagtttgagcctacttgatccaacttatgcaagcaagtacatccccatcattgctagtgtcagtgagcaccagcctcctacctggccctcttattttatggacattaatgtgttggccttcctgattcctgctgggattatttcatgcttcttgcctctgtctgacgcaagctccttcatggtcttgtacttagtcactgcagtgtatttttctggagttatggtacggcttatgcttgtccttgctcctgctgcgtgcattttatctgggattgctctatctgaggttttcagtgtcctcacacgatccattaaatttcagctgtcaaaattttttgatgacagccctacttcttcaggtgacagtagcccagagagttctacaaattcaacaaaaaatgaaaataggaatgaaaaatctgaaacggctccaaaggaaagaccgtcaaagaagaaccggaagaaggagaaagaagcagcagagagtgttcctgtaaagcctaaaaaggaaaagaagcttttggttcttccttttgaattatctgttatgggtattttgttgctgatcgtgttaggtggtttctatgtggtccattgtgtatgggcagcagctgaagcgtactccgctccttcaattgtgttgacatctcgttcacgggatggattgcatgtttttgatgatttccgtgaagcttatgcatggctgagccataacacagatgttgatgacaaggttgcttcctggtgggactatggttaccaaacaactgcaatggccaacagaactgtgattgtagacaataacacctggaacaacactcatatagcaacagttggtacagcaatgtcgtccccagaaaaagcagcttgggaaatcttcaattctttagatgtcaaatatgtgcttgttgtctttggaggacttgttggataccctagcgatgatatcaataagttcctttggatggtacgcataggaggtggtgtgttccctcacatcaaggaaccagattatctgagggatggtcaataccgcgttgatgctcaagccactccaactatgctgaattgcctcatgtacaagctttgttattacaggtttgtggagaccgatgggaaaggctttgacagagtaagaggatatgaaataggaaagaagcatttcaagctaacacattttgaggaggtattcacaacccaccattggatggtccgtatatataaactgaaaccccagaagaacagggttcgaggcaagttgaagaagttgaaggctagtgccaaaactagttccacacttgcggcagggcaaaagaagaacccgtggcaatagatgaagttaacaatagtgtcatttacttgatacttgttgctaggtcaactgcactaagttcgtgaactagaaaaccacagaactagattagagatctgcactgttgtatttgactctcgttatatgttcttgcaaccggccagagtgctgatgaaatttttgatagaccagaggaagtttatctatcccatgggtagagattggatgctgaatttcttggcgaaagggttgctgctcccagtgtacttgctgttttgtgtaagcaacaaattttcatacaaggttctcggatgatagtgacttccggcatctgaagtaaacacagaatgctgtcaggaacttgtgtggcagctcggtgaaagtggtgcggatggtttccaatctgatgagatttgccattaaatccggtggatatcgaaacatgcagaaaaattgtttgttcgagtaaaaaaaaaac

SEQ ID NO: 5416 - DNA, 2775 bp, Brassica rapa
gcgccagtagtttactaccgcaaagctgtaattcctgcgagtgagattgcttcgaaaaacccttcccgagtcttcgtcctcctcctccttcaaagtcgtctctctctctctctatctctagagccggagagctcacattctcagcgtaagaaaaatggcgactctagagagtccacctcccggaacgtcgtcgtctgcgatgaggaatgctttcgggaccgttctctcagctctgatcctcctcctcattggtgtcctcgctttctcgatccgactcttctctgtgataaagtatgaaagtgtgattcatgaatttgatccttacttcaattacagagtcactcagttcttatcgaagaatggaatatacgagttctggaattggtttgatgatcggacctggtatcctcttggccgtgttattggaggaactgtttaccctggtttaacattgactgctggaaccatctggtgggccttgaatgcaataaacattcctctgtcagtagagactgtttgtgtcttcactgcacctgtattttcagctttcgcatcctgggcgacttaccttttgaccaaggaagttaagggctccggtgcaggactagcagctgctgctcttttggccatggttccctcatatatatcccgatctgttgctggaagctacgacaatgaagctgttgctatatttgctttgatcttcactttctatctttacataaagacactaaatacaggttccctgttttatgctacactgaatgccattgcatacttctacatggtatgttcttggggaggttacaccttcattatcaatctgataccaatgcatgtgcttctgtgcattgtaactggccgatactctcctcgactgtacattgcctatgctcctttggttgtgctgggtacgctgttagctgccttggtacctgttgttggcttcaatgcggttttgacatctgaacattttgcctcatttttggttttcatcatcatccacgtagtagcactcgtatactatatcaaaggcattctttctcccaaaatgttcaaagttgctgtgacacttgttgtgtccatcggcctggttgtgtgtctcatagttgtggcagttcttgtggcactggtagcttcaagtccaacaggaggatggagtggtaggagtttgagtctacttgatccaacttatgcaagcaagtatattccaattattgcaagtgtcagtgagcatcaacctccaacttggccgtcctatttcatggacatcaatgttttggctttcttggtccctgctggcatcattgcgtgcttttcgcctctatctgatgcgagctctttcgtggtcctgtatattgtgatgtccgtatacttctccggagttatggttcgtcttatgcttgtgcttgctccagcagcatgcatcatgtctggaattgcgctctctcaagcttttgatgttttcacggcttccatcaaataccagttaggtcgatcggctaattccaaagatgatgcagaggacaacacttctactaacaatgccccaaaagatgattcatcttctggcaagactgacaagggtgaagaagttgcaaaagaacggtcgtcaaagaaaggcaagaagaaagagagagaacctgctgacaaaccttctgttaagtccaagattgcgaagaaaagggctcttgttttgcctcttgaagcctctatagttgcgcttcttctccttataatgttgggtgctttctatgtgattcattgtgtttgggcagctgcagaagcatactcagctccatcaatagttttgacatctcaatcgcgtgatggcctacacgtctttgatgattttagagagtcttacgcatggttaagccataatactgacgtggatgacaaagtggcatcatggtgggactatggttatcagacgacagctatggctaacagaactgttattgttgacaacaacacctggaacaatactcacattgcaactgttggcactgcaatgtcatctccagaaaaggcggcgtgggaaatcttcaactccttggatgtgaaatacgttcttgtcgtctttggtggtcttattggctacccaagtgatgatattaacaagtttctgtggatggttcgtattggaggcggcgtctttcctcatataaaggaagctgattatctgagagatggcaattaccggattgattctgaggccacgccaacaatgttgaactgccttatgtacaagctatcttactacaggtttgtagagacggatggcaaaggttatgatcgggtcaggcggacggagatcgggaagaaaaatttcaagctcacacatttcgaagaggttttcacgagtcaccattggatggttcgtatatacaagctgaaacctcagaagaacaggattcgtggtagagcaaagaaactgaaactgaaaacaagctctggattggactcgaaagcagcgaagaagaatccgtggatctagaaacccctagaaatttttaatgttggatggtgagttatatgttaactcttattaggtcactcttttatcctcagaggaagttgttgcagacgcagtcaagtttctgatgttaggattcgtaaaacttttgtagacttgggagttttatgtttattgtggagatttacaaattcaggtggccagatcgaatcccaatccaacaaaataaaaactcaaaaatagcttcagattgacttcttaaatattcatttaaagaattattgatgtgatctaca

SEQ ID NO: 5417 - DNA, 2871 bp, Pennisetum glaucum
gtgctctgcgccttcacgctcctcgtcatcggcgtcctcgcgttctcgatccgcctcttctccgtgataaagtacgagagcgtgatccacgagttcgacccctacttcaacttccgcgtcactcagtttttgtcgaagaatggaatttacgagttctggaactggtttgatgataggacatggtatccccttggccgtgtgattggtggcactgtgtatcctggtttgacattgactgctggaactatgtggtggttggtgaactctcttaacattccgttgtctgtggagacagtttgtgtgttcactgctccaattttctcggcaaatgcttcctgggctacttacctgctaacaaaggaagcaaagggcacaggagctggattaatggcagcagccattttggcaatggtcccctcatatatctcaagatctgttgcaggaagctatgataatgaagctgtagcaatatttgccttgatatttacattttatctgtatgtaaagacactgaacactgggtcgctcttttatgcaacgctcaacgctctttcctatttctacatggtctgctcttggggaggctacacattcattatcaaccttatcccaatgcatgttctgttgtgcattgtaactggtcgttattcttcacggctctacattgcatatgctcctcttgttatacttggaacacttctggcagctttagtacctgttgttggttttaatgcagtaatgacctctgagcacttcgcatcatttctggtgttcataatccttcatgtggttgcacttgtgtattacatcaaagggcttttgactcctaggctgttcaaagttgctatgactcttgtcatatctgttggcttagctgtttgttttgcagtagtagctgtactcgtcgctttggtggcatctagtccaacaaagggctggagtggccgcagtttgagtctacttgacccaacttatgcaagcaagtacatccccatcattgccagtgtcagtgaacaccaacctcctacctggccctcttattttatggacatcaatgtgttggccttcctgattcctgctgggattatttcatgcttcttgcctttgtctgatgcaagctccttcatggtcttgtacttagtaactgcagtgtatttttctggagtgatggtgcggctaatgcttgtccttgctcctgctgcgtgcattttgtctgggattgctctctctgaagtttttggtgtcctcacacgatccattaaatttcagctatcaaaattatttgttgatagctctgctgcttcaggtgacagtagcccagagagttctacaaattcaacaaaaactgaaaataggaacgaaaattctgaaacagctcccaaggaaaaaccatcaaagaagaaccgaaagaaggaaaaagaagtggcagagagtgttcctgtaaaacctaataaaaaagaaaagaggcttttggttctgccttttgaattatccgttatgggtattttgttgctgattgtgttaggtggtttctatgtagtccattgtgtatgggcagcagccgaagcgtactccgcgccttcaattgtgctgacatcccgttcacgtgatgggttgcatgtttttgatgatttccgtgaagcttatgcatggctgagccataacacagatgttgacgacaaggttgcttcctggtgggactatggttaccaaacaactgcaatggccaacagaactgtgattgtagacaataatacttggaacaacactcacatagcaacagttggtacagcaatgtcatccccggaaaaagcagcttgggaaatcttcaattctttagatgtcaaatatgtgcttgtggtctttggagggcttgttggctaccctagtgatgatatcaataagtttctttggatggttcgcataggaggtggtgtattccctcacatcaaggagccagattatcttagggatggccagtaccgcgttgatgctcaagccactccaactatgctgaattgcctcatgtacaagctttgctattacaggtttgtggagactgatggaaaaggctttgacagagtaagaggatacgaaataggaaagaagcatttcaagctaacacattttgaggaggtattcacaacccaccattggatggtccgtatttataaactgaaaccccagaagaacagggttcgaggcaagttgaagaagctcaaatctaatgccaaaactagttccaccctcgcggcaggccgaaagaagaatccgtggcaatagatgaagttaacaatagtgtcatttacttgatacttgctgttgctaggtcaactgcactaagcttgtgaaccagaaaaccacagaagtagattagagacatctgcactgttgttgtatttgaccctccttatgttcttggaaccggccagggtgctgatgaaatttttgagacctgagcaaactttttttgtggataatgagtatatatttcccaatggcatccagcaaattttctccagaaacaaactggactagtatgtgtgtactagtatatagtatacatgtacgtgtacggtggccccacttgtcatcgttcttaaaaaagtttgctcagcatccgccgtaagattttcaacagcttctgcggactcgtcatttggacggaccactgcctcactcggcagctccacgcctccacctactactagcttccacgtcacgtcagcagtcttagacctgtaaagctgagcccaaacagtcaaacaacaccaatggcgccttttgaccgagtcaaacatccgagctggcatcccgctatctacttgctcccgcagtcaccctttccttccgttgaccggtgcctccctc

SEQ ID NO: 5418 - DNA, 2635 bp, Echinochloa colona
gttcgcgatcgcgaggtcttcgtctccgcctgggtccagcgctgggatttccgcgcctccagccacagccaacgacgcggccccaatggctgagcccgaggtctcctctgcggcggcaggcggcggcggacgactccgcaacgccttcggcggcgtgctctgcgccttcacactcctcctcatcggcgtcctcgcgttctcgatccgcctcttctcggtaatcaagtacgagagcgtgatccacgagttcgacccctacttcaacttccgcgtcactcagtttttatcaaagaatggaatttacgagttctggaactggtttgatgataggacatggtatccccttggccgtgtgattggcggcactgtgtatcctggtttgacattgacggctggaactatttggtggttggtgaactctcttaacatcccattgtctgtggagacagtttgtgtgttcacagctccaattttctcggcaaatgcttcctgggcgacttacctgttaacaaaggaagcaaagggcacaggagccggattgatggcagcagccattttggcaatggtcccctcatatatctcaagatctgttgcaggcagctatgataatgaagctgtagcaatatttgccctgatatttacattttatctatatgtaaagacactgaacacagggtcgctcttttatgcaacgctcaacgcgctctcatatttctacatggtttgctcttggggaggctacacattcattatcaaccttatcccaatgcatgtgctcttgtgcattgtaactggccgttattcttcacggctctacattgcatatgctccacttgttatacttggaacacttctggcagccttagtacctgtggttggttttaatgcagtaatgacctctgagcatttcgcatcatttctggtgtttataatccttcacgtggttgctcttgtgtattacatcaaagggcttttaactcctaggctgttcaaagttgctatgactcttatcatatctattggcttagctgtttgttttgccgttgtagctgtactggttgcggtggtggcatctagtcctacaaaaggctggagtggccgcagtttgagtctacttgacccaacttatgcaagcaagtacatccccatcattgctagtgtcagtgaacaccaacctcctacctggccctcttattttatggacatcaatgtgttggccttcctgattcctgctgggattatttcatgcttcttgcctctgtcggacgcaagctccttcatggtcttgtacttagtcacggcagtgtatttttctggagtaatggtgcggcttatgcttgtccttgctcctgctgcatgcattttatctgggattgctctctctgaagctttcggtgtccttacacgatccgttaaatttcagctgtcaaaattatttgatgatagctctgctgctgtttctgcttcaggtgacagtagcccagagagctctacaaattcaacaaaaggtgaaaataggaatgaaaaatctgaaacagctccaaaggagaagccatcaaagaagaactggaagaaggaaaaagaaccgccagagagtgttcctgtaaagcctaaaaaagaaaagaagcttttggttctgccctttgaagtatccgttatgggtattttgttgctaattgttttaggtggcttctatgtggtccattgtgtgtgggcagcggctgaagcgtactccgcgccttcaattgtgctgacatctcgcacacgcgatggattgcatgtttttgatgatttccgtgaagcttatgcatggctgagccataacacagatgttgacgacaaggttgcttcctggtgggactatggttaccaaacaactgcaatggccaatagaactgtgattgtagacaataatacctggaacaacactcacatagccacagttggtacagcaatgtcatccccggaaaaggcagcctgggaaatcttcaattctttagatgttaaatatgtgcttgttgtcttcggagggcttgttggctaccctagtgatgatatcaataagttcctttggatggttcgcataggaggcggtgtattccctcacatcaaggagccagattatcttagggatggacagtaccgtgttgatgctcaagccaccccaactatgctgaattgcctcatgtacaagctttgctattacaggtttgtggagactgatggaaaaggctttgacagagtaagaggatatgaaataggaaagaagcatttcaagctaacacattttgaggaggtattcacaacccaccattggatggtccgtatttataaactgaagccccagaagaacagggttcgaggcaagttgaagaagtcgaaatctaatgccaaaactagttccacccttgcggcaggccgaaagaacccgtggcaataggtgaagttaacaatagtgtcatttacttgatacttgctgttgctaggtcaactgcactaagcttgtgaaccagaaaaccacaggactagattagagatatctgcactgttgttgtaattgaccctcgttatatgttcttggaaccggccagggtgctgatgaaatttttgataaacctgagcaagtttttcgcgt

SEQ ID NO: 5419 - DNA, 2445 bp, Flaveria ramosissima
atcggcgttctcgcattctcgatccgtcttttctcggttattaagtatgaaagtgttattcacgagttcgatccgtatttcaattacagagttactcagtttctcactaaaaacggggtgtatgacttctggaactggtttgatgatcggacctggtatcctcttgggcgagtcattggtggaacagtttaccctgggttgactttaacagctggaactatgtggaaggtactccaattcttgaatattcctctgtcggtggaaactgtttgtgtattcactgctcctgtattctctgcctttgctgcatgggcaacatatctcttgacaaaggaagttaagggagtaggagctggactaacagctgcagttcttctggccatggtaccatcctacatatcccgatcagtggctgggagctatgacaacgaagctgtagccatctttgctttgatattcaccttctatctctatataaagacattgaacacaggatctcttttctacgctactttaaactccattgcatacttctacatggtttgctcttggggagggtacacttttatcatcaacctcataccaatgcatgtgcttctttgcattgtgaccggtcgctattcacctcgtctatacatcgcatatgctccacttgttgtcttaggaacgttaatggcagcattagtgcctgttgttggttttaatgcagtcatgacatcagaacattttgcatcgtttttggttttcatcattattcatgtggtggctcttgcatattatatcaaaggaattctctcaccaaagatgtttaaagtagctgccacccttgttgtatcagttggcctggtgatatgctgcactgtagtagctgtactcatagcagtggttgcagctagtccaacaaagggatggagtggacgaagtctaagtcttcttgatccaacgtatgcaagcaagtacataccaattattgcaagtgttagtgaacatcaaccacctacttggccatcttacttcatggatataaatgtattagcattcttggttccggctggaattattgcatgcttttcaccgctatctgatgcaagctcctttgtgattctctacatagtaatgtcagtatatttctccggtgtcatggtacgtctaatgcttgtttttgctccagctgcatgcataatgtctggaattgctctttctgaagcctttgatgttcttacaagatcaattaagttctatgtgtttcaagcaggggataccatatccgctagtattgttgctatgcaaaacaatgcgatggatactgacgaaaaagaagtctcgttgaaggaacggccttccaagaaaaacaaaaggaaggaaaaggagaatgttgaaaagcctcttaagaaatcccagactgaaaagaagcccctgatcttacctgttgaggcatctgtgtttgctctgtttttaactgtgttgctaggcgccttctatgtggtccatagtgtttgggctgcagcagaggcgtattcagctccgtcaatcgtgcttacttcgcattcgcgtgatgggcttcatgtttttgatgatttcagagaggcatatgcatggttaagccataacactcatgtcgatgataaagttgcatcttggtgggactatggttaccaaacaactgcaatggctaaccgcacagttattgttgacaataacacatggaacaacacacatattgctactgttggcactgccatgtcatctcctgaaaaagctgcctgggaaattttcaactccctggatgtaaaatatgtccttgttgtttttggaggtcttgttggctactctagtgatgacataaataagttcctgtggatggttcgtataggaggaggcgtctttccgcatatcaaggagcctgattatcttagagatggtcaataccgaattgattctcaggccactccaaccatgctaaacagcctcatgtacaaactatcatatttcaggtttgtggagactgatggtggtagaggatacgatagagtacgggggactgaaatcggaaagaaacattttaaattaactcattttgaagaggtgttcactactcaccattggatggttcggatatataagctaaaacctcaaaggaacaggattcgggggaagataaagaaatctagatcgaaaacaagctcgacaagtccaacaaaaacaagaacaataacgaaaaagaatccttggcattagaaaacttgggatgagttagaagagtgacttttaaggatcttagacatcaagaaaacttttgttggatatactgccaatatcttctggcaacgatagatcttgctaatgtaaactaaaaatgagaactgaaattataacatgctaagttgagatgagtaatctctatccttaaaggtatcatattttcacctcaccttgcgacagaaa

SEQ ID NO: 5420 - DNA, 2730 bp, Zea mays
gttcacgatcgcgaggtcttcgtctccgcctgggtccagctctcggatttccgcgcgttccacttccacccacacacacacccccaaggacgcaggccgcaatggcggagcccgaggtctcccccgcagcggccggcggcggcgggcggctccgcaacgccttcgggggcgtgctctgcgccttcacgcttctcctcatcggcgtcgtcgccttctcgatccgcctcttctctgtaatcaagtacgagagcgtgatccacgagttcgacccctacttcaacttccgcgtcactcagtttctgtccaagaatggaatttatgagttctggaactggtttgatgataggacatggtacccccttggccgtgtgattggtggcactgtgtatcctgggttgacattgactgctggaactatgtggtggttgctgaactctcttaacatcccattgtcggtggagacagtttgtgtgttcacagctccaattttctcagcaaatgcatcatgggctacctacctgctaacaaaggaagcgaaaggtactggagctggattaatggcagcagccattttagcaatggtcccctcatatatttcaagatctgttgcaggcagctatgataatgaagctgtagcaatatttgccttgatatttacattttatctatatgtaaagacgctgaacacgggatcactcttttatgcaacactcaatgctctctcatatttctacatggtctgctcttggggaggctacacattcattatcaatcttatcccaatgcatgtcctcttgtgcattgtaactggtcgttattcttcgcgtctctacattgcatatgctccccttgttgtacttggaacgcttctggcagcattagtaccggtggttggttttaatgcagtaatgacctctgagcacttcgcatcatttctggtgttcataatccttcacgtggttgctcttgtgtattatatcaaagggcttttgactcctaggctgttcaaagttgctatgactcttgtcatatctgttggcttagctgtttgttttgcagtagtagccatacttgttgcattggtggcatctagtccaacgaaaggctggagtggccgcagtttgagtctacttgacccaacttatgcaagcaagtacatccccatcattgctagtgtcagtgaacaccaacctcctacctggccctcgtattttatggacattaatgtgttggccttcctgattcctgctgggattatttcatgcttcttgcctctgtctgacgcaagctccttcatggtcttgtacttagtcactgcagtttatttttctggagtaatggtacggcttatgcttgtccttgctcctgctgcgtgcattttatctgggattgctctatctgaagttttcagtgtgctcacacgatccattaaattgcagctgtcaaaattatttgatgatagccctacttcttcaggtgacagtagcccagagagttctacaaattcaacaaaaaatgaaaataggaatgaaaaacacgaaatagctccaaaggaaaaaacatcaaagaagaaccggaagaaggagaaagaagtggcagagagtgttcctgtaaagcctaaaaaggaaaataggcttttggttctgccttttgaattatctgttatgggtattttattgctcatcgtattaggtggtttctatgtggtccattgtgtatgggcggcagctgaagcgtactccgcgccttcaattgtgttgacatctcgttcacgagatgggttgcatgtttttgatgatttccgtgaagcttacgcatggctgagccataacacagatgttgatgacaaggttgcttcctggtgggactatggttaccaaacaactgcaatggccaacagaactgtgattgtagacaataacacctggaacaacactcatatagcaacagttggtacagcaatgtcgtccccagaaaaagcagcttgggaaatcttcaattctttagatgtcaaatatgtgcttgttgtctttggaggacttgttggataccctagcgatgatatcaataagttcctttggatggtacgaataggaggtggtgtgttccctcacattaaggagccagattatcttagggatggtcaatatcgcgttgatgctcaagccactccaactatgctgaattgcctcatgtacaagctttgttactacaggtttgtggagactgatggaaaaggctttgacagagtaagaggatatgaaataggaaagaagcatttcaagctaacacattttgaggaggtatttacaacccaccattggatggtccgcatatataaactgaaaccccagaagaacagggttcgaggcaagctgaagaagttgaaggccagtgccaaaactagtcccacacttgcggcagggcgaaagaacccgtggcaataggtgaagttaccaatagtgccatttacctgatactttgttggtagatcaagtgcgctaggttggtgaaccagaaaactacagaactagattagagatctggactattgtattggaccctcgttatatgttctcccaaccggccgggtgctgatgaaatttttgatagaccagaggagtttatcaatcccatgggtttgagattggatggcggcgataattttctagtgacaggggttgtttaagactacctgttacttgctgttttgtgtaacctacaattttt

SEQ ID NO: 5421 - DNA, 2571 bp, Elaeis guineensis
gggttcttgccttctcgatccgcctcttttccgttatcaagtacgagagcgtgatccacgagttcgatccatacttcaattaccgagtcactcagtatcttacaaagaatggaatttatgacttctggaactggtttgatgatcgaacctggtatcctcttggtcgtgtgatcggtggaactgtttatccagggttgacattaacagcaggttccatgtggtggttactgaattctctgaacattcctctatcagtggagactgtctgtgtattcactgctcccattttctctgctaatgcagcttgggctacattccttcttacaaaggaagttaagggcactggggctggattgacggcagcagttctattagcaatggtgccttcttatatttcaagatctgtggctggcagttatgacaatgaagctgtagcaatttttgctctagtatttacattttatctttatataaagacactgaatacaggatcactcttctatgctaccttaaatgctctgtcatacttctacatggtgtgctcttggggaggctatacattcatcattaaccttattcctatgcacgttctgctgtgtattttgactggtcgctactcctcacgattgtacattgcttatgcccctcttgttgtcttgggaacacttctagcttccttggtgcccgtggttggttttaatgcagtgatgacgtcagagcattttgcatcatttttggttttcataatcattcatgtggttgcttttatttattatatcaaagggattctatctccaaagatgtttaaagtggctatgacacttgttgtaacaattggcttggctgtttcttgtgcggttatagctatatttatagcattggtggcttccagccccacaaaaggatggagtgggcgtagtttgagtcttcttgatccaacttatgcaagcaagtacatacccatcatcgctagtgttagtgaacatcagccaccaacatggccttcatattttatggacatcaatgttttggcattcttggttccagctggtatcatagcatgctttttgcctttatctgatgctagctcatttgtggtcctgtacttagtaacatcagtctatttttctggagtaatggtgcgtcttatgcttgttttggctccagctgcatgcatcatgtctggaattgctctttctgaagcctttgatgtttttacacggtcaatcaaacttcagctgcctaacatactcgacaatccacctgatgcaggagatatgaattctgtgagttcaatagctcaaaatgatgcatcaaagattgatagccatgcagcaactaaatctgaaacagtatcaaaagaaagaccatcaaggaagaaccggaagaaggaaaaggaaaaagaaaaagaaaatagtggaaaaagttcctagtcattctgaaaataaaaaaaggctgctggtattgcccttggaagcatctgcagttgccattcttctcctcatcgtacttggtggtttttatgtggttcattgtgtatgggcagcagcagaagcttactctgccccttcaattgttctaacatcgtatgcccatgatgggttgcatgtgtttgatgattttcgtgaagcctatgcatggttgcggcataatactgatgtggatgataaggtggcatcttggtgggactatggttaccaaacaactgcaatggctaatcgtactgtcatagttgataataatacctggaataacactcatattgcaactgttggtactgccatgtcatccccagagaaagcagcttgggagatttttaactccttggatgtcaaatatgtcttggttgtctttggaggtcttgttggctacccaagtgatgatatcaataagttcctgtggatggttcgcattggcggtggtgtatttccacacatcagggaacctgattatcttagggatgggcaatatcgtattgatgctcaagcgactccaacaatgctgaattgcctcatgtacaagctctcttattacagatttgtggagacagatggaaaagcctttgatcgtgtgaggaggacagaaataggaaagaaatatttcaagctgacacattttgaggaggtattcactacacatcattggatggttcgtatttataagctgaaacctccaaagaataggatccgaggaaagttgaagaagcctaaatcgagttctaaatcttcttcaagcaatcacaaaagggctggaaatacacaaaagaacccgtggcagtgaaccgattccaaggagaatgcctagaggattccattatatatgcgtgacccttggaaagagttttagggatagtgcatctttgatagtttttgcaggctcaaacgactagaaatttgattaagaaattttcagtggcctcccatattgtatgctatccccttttcagttgcattattatcagaggaccattgttaacaaatttttgacgggttgcagacaagtaatatagaaattcgagccgtttgcattattttttttatgcattcaaagagtcagtttactttttacaac

SEQ ID NO: 5422 - DNA, 2757 bp, Oryza sativa
gatttcgcgaggtcttcgcttcgtctccgccccacacccccaaacccacagccacgacgcggccgcaatggcggagcccgagtcctccacggccgcggccggcggcagccgcctccgcaacgcctgcgggggcgtgctgtgcgccttcaccctcctcctcatcggcgtcctcgcgttctcgatccgcctcttctccgtgattaagtacgagagcgtgatccacgagttcgacccctacttcaacttccgcgtcactcagtttttgtcgaagaatgggatctacgagttctggaactggtttgatgacaggacatggtatccccttggccgtgtgattggcggcactgtgtatcctggtttgacattgacagctggaaccatttggtggttgctaaattctctaaacattccgttgtcagtggagactgtttgtgtgttcactgctccaatattctcagcaaacgcttcctgggctacttaccttttaacaaaggaagccaaaggcactggggctggattgatggcagcagctattttggcaatggttccctcatacatctcaagatccgttgcaggaagctatgataatgaagccgtagcaatatttgctttgatattcacattttatctatatgtaaagacactgaacacaggatcactcttttatgcaacgctcaatgctctctcatatttctacatggtctgttcttggggaggttacacattcatcatcaaccttattccaattcatgtactgttgtgcattgtcactggtcgttattcttcacggctttacattgcttatgctccccttgttatactgggaacacttctggcagccttagtacccgtggttggttttaatgcagtgatgacgtctgagcactttgcatcatttctggtgttcataatccttcatgtggttgctcttgtgtattacataaaaggacttctaactcccaggctgttcaaagtagctatgactcttgtcataacagttggcttggctgtttgttttgcagtaatagctatactcatcgctttggtggcatctagccccacaaaaggatggagtgggcgcagtttgagtctacttgatccaacctatgcaagcaagtacatccctattattgctagtgtcagcgaacatcaaccccctacctggccctcctatttcatggatatcaacgtgttggccttcttgattcctgctgggatcatttcatgcttcttgcctttatctgatgcaagctccttcgtggtcttgtacttggtcaccgcagtatatttttctggagtaatggtgcggcttatgcttgtccttgctcctgctgcgtgcattttatctggaatcgctctttctgaggctttcgacgtcctcacaagatccgttaaatatcagctatcaaaattatttgatgacagccctgctgcttcaggggatagtagtgcagagagttctagcgctagtactgtctccacaaattcagcaaaaaatgagactagacctgaaaaaactgaaacagccccaaaggaaaaaccatcaaagaaaaaccggaagaaggaaaaggaagtggctgaaagtgttcctgtaaagcctaaaaaggaaaagaagcttttggtacttcctatggaggcatctgttttgggcattttgttgctgatcgtgttaggtggtttctatgtggtccattgtgtgtgggcagcagctgaggcgtactcagctccttcaattgtgttgacttctcgttcgcgtgatggattgcatgtttttgatgatttccgtgaagcctatgcatggctcagccataacacagatgttgatgacaaggttgcgtcctggtgggattatggttatcaaacaactgcaatggccaacaggactgtaattgtagacaataatacttggaataatacccacatagcaacagttggaacagcgatgtcatctccagaaaaagcagcttgggagatcttcaattctttagatgtcaaatatgtccttgttgtatttggaggtcttgttggctaccctagcgatgatattaacaagttcctttggatggttcgcataggaggtggtgtattccctcacatcaaggaacctgattatcttagggatggtaactatcgtgttgatgctcaaggcaccccaactatgctgaattgcctcatgtacaagctttgctattacaggttcgttgagaccgatggcaaaggttttgatagagtaagaggatatgaaataggaaagaagcatttcaaactaacacattttgaggaggttttcacaacccaccactggatggtccgtatatataaactgaaacctcaaaagaatagggttcggggcaagttgaagaagttgaaatctggctccaaagctagctcaacgaatgcggcgggccgaaagaagaacccatggcaataaaaatgagtaaatgcgaaaagcgacgtggctgcttggaatttgcttttgctagctcaactgcaactaagctcaaaagaactagaaaaccacaggcctaggattagagattgctgcgttattgcactcagtatttgacacccctaatatgtttttgggaccagcaggagtgctgaagaaatttttgatagactgctctaagctttttggccccattgtttgcaacacgcggtttagtgtcttttatactccttttgcactgaagatgtttaggcggacgtacaatggaagtttatttagaaaaatgagaacgtggctatttattgttt

SEQ ID NO: 5423 - DNA, 2760 bp, Oryza sativa
gcgatttcgcgaggtcttcgcttcgtctccgccccacacccccaaacccacagccacgacgcggccgcaatggcggagcccgagtcctccacggccgcggccggcggcagccgcctccgcaacgcctgcgggggcgtgctgtgcgccttcaccctcctcctcatcggcgtcctcgcgttctcgatccgcctcttctccgtgattaagtacgagagcgtgatccacgagttcgacccctacttcaacttccgcgtcactcagtttttgtcgaagaatgggatctacgagttctggaactggtttgatgacaggacatggtatccccttggccgtgtgattggcggcactgtgtatcctggtttgacattgacagctggaaccatttggtggttgctaaattctctaaacattccgttgtcagtggagactgtttgtgtgttcactgctccaatattctcagcaaacgcttcctgggctacttaccttttaacaaaggaagccaaaggcactggggctggattgatggcagcagctattttggcaatggttccctcatacatctcaagatccgttgcaggaagctatgataatgaagccgtagcaatatttgctttgatattcacattttatctatatgtaaagacactgaacacaggatcactcttttatgcaacgctcaatgctctctcatatttctacatggtctgttcttggggaggttacacattcatcatcaaccttattccaattcatgtactgttgtgcattgtcactggtcgttattcttcacggctttacattgcttatgctccccttgttatactgggaacacttctggcagccttagtacccgtggttggttttaatgcagtgatgacgtctgagcactttgcatcatttctggtgttcataatccttcatgtggttgctcttgtgtattacataaaaggacttctaactcccaggctgttcaaagtagctatgactcttgtcataacagttggcttggctgtttgttttgcagtaatagctatactcatcgctttggtggcatctagccccacaaaaggatggagtgggcgcagtttgagtctacttgatccaacctatgcaagcaagtacatccctattattgctagtgtcagcgaacatcaaccccctacctggccctcctatttcatggatatcaacgtgttggccttcttgattcctgctgggatcatttcatgcttcttgcctttatctgatgcaagctccttcgtggtcttgtacttggtcactgcagtatatttttctggagtaatggtgcggcttatgcttgtccttgctcctgctgcgtgcattttatctggaatcgctctttctgaggctttcgacgtcctcacaagatccgttaaatatcagctatcaaaattatttgatgacagccctgctgcttcaggggatagtagtgcagagagttctagcgctagtactgtctccacaaattcagcaaaaaatgagactagacctgaaaaaactgaaacagccccaaaggaaaaaccatcaaagaaaaaccggaagaaggaaaaggaagtggctgaaagtgttcctgtaaagcctaaaaaggaaaagaagcttttggtacttcctatggaggcatctgttttgggcattttgttgctgatcgtgttaggtggtttctatgtggtccattgtgtgtgggcagcagctgaggcgtactcagctccttcaattgtgttgacttctcgttcgcgtgatggattgcatgtttttgatgatttccgtgaagcctatgcatggctcagccataacacagatgttgatgacaaggttgcgtcctggtgggattatggttatcaaacaactgcaatggccaacaggactgtaattgtagacaataatacttggaataatacccacatagcaacagttggaacagcgatgtcatctccagaaaaagcagcttgggagatcttcaattctttagatgtcaaatatgtccttgttgtatttggaggtcttgttggctaccctagcgatgatattaacaagttcctttggatggttcgcataggaggtggtgtattccctcacatcaaggaacctgattatcttagggatggtaactatcgtgttgatgctcaaggcaccccaactatgctgaattgcctcatgtacaagctttgctattacaggttcgttgagaccgatggcaaaggttttgatagagtaagaggatatgaaataggaaagaagcatttcaaactaacacattttgaggaggttttcacaacccaccactggatggtccgtatatataaactgaaacctcaaaagaatagggttcggggcaagttgaagaagttgaaatctggctccaaagctagctcaacgaatgcggcgggccgaaagaagaacccatggcaataaaaatgagtaaatgcgaaaagcgacgtggctgcttggaatttgcttttgctagctcaactgcaactaagctcaaaagaactagaaaaccacaggcctaggattagagattgctgcgttattgcactcagtatttgacacccctaatatgtttttgggaccagcaggagtgctgaagaaatttttgatagactgctctaagctttttggccccattgtttgcaacacgcggtttagtgtcttttatactccttttgcactgaagatgtttaggcggacgtacaatggaagtttatttagaaaaatgagaacgtggctatttattgttta

SEQ ID NO: 5424 - DNA, 2510 bp, Cycas rumphii
cgcgaatgtgtatgggatttgcttcggcgggttcattttcgtaaagcggagtcacgagggtttggagtagcagtgagggcaattttcttcaataacagaggagatggctgtttcaggcgattattatagaaatgccttcggcattgtgctctcaacttccatactcattctaatcggcattcttgcattttccatacggcttttttcggttattaagtttgagagcgttattcatgaatttgatccttacttcaactacagagttacacagtatcttaccaaaaatggaatatacgacttttggaactggtttgatgaccgaacctggtatccgctgggccgtgttattgggggaacagtatatcctgggcttactttaacagcagggaccatatggtgggtattgaattctttgaacattcctctttcggtggaaactgtttgtgttttcactgctcctattttttcagctaatgcagcatgggcaacatatcttttgacaaaggaagtcaaaggcactggagccggcctcactgcagctgctctcatagcaatggtgccttcatacatctcacgatctgtggctggaagttatgataatgaggctgtggccatatttgctttggtctttacattctatctctatattaagacactaaacacgggatctcttttctatgcgaccttgaatgcactggcctacttttatatggtctgctcctggggtggttacactttcatcataaatcttattccaatgcacgtgcttctatgtattgtcactgggcgctattcatctcgcttgtacattgcttatgctcctctggtggttcttggcactttattggctgcactggttccagttgttgggttcaatgcagtgatgacatctgaacattttgcctcatttctggtatttattatacttcagattgtggcattggtgcatcatatcaaacggattctttctcctaagatgtttaaagtggcattgaccctagtaatctctgttggcatgatggtatgcattgcattggtagcaatattggtggcattggtggctgcaagcccaacaaagggttggagcggccgaagtctaagtcttcttgatccgacatatgcaagcaaatatattcctatcattgcaagtgttagtgagcaccaaccacctacctggccatcctattttatggacataaatgctttggcgttcctagtccctgcaggcattattgcatgttttttaccactgtccgatgcaagctcctttttagtgctttatcttgtgacatcagtatacttctctggtgtaatggtgcgacttatgctagtgctggctccagcagcttgtattttgtcggggattgctctttctgaagccttctctacgctgacacagtcagtgaaacaccagcttccagctttattaggacattccttgccagaacagatggatgcttccactgtcaactcagctgcaggaaaagatgtatcaaaggcagagttgagagactcccactctgagaagggtgaagagccttcaaaagagaagccttcgaaaaggaacaggaagaaggagaaagataacgtggaaaaggttttggataaaaaggattccaagaagaagctgttgattttgcctttggaggcatcggctattggtattttgttgcttgttattttgggcagcttttacgtgattcattgtgtttgggcggcggcagaagcttattcagctccttcaattgtgcttacatctcagtcacatgatggatttcatgtctttgatgattttcgagaagcatatgcatggttacgacataacacggatgaggacgataaggttgcatcttggtgggactatggttaccaaacaacagcaatggctaatcgaactgtgatagttgacaacaatacttggaacaatacacacattgcaactgttggtacagctatgtcatctcctgagaaacaagcatgggaaattttccaatccttagatgtgaaatacgttctagttgtatttggaggcttggttggatacccaagtgatgatatcaacaaattcctttggatggttcgcataggaggtggcgtttttccacatataaaggaacctgactatctaagggatggtcaatatcggatagactctcaagcaacaccaacaatgctcaattgccttatgtataagctttcatactatagattcactgaagcaagtatggacggtagagggtttgatagagtaaggagaactgagatagggaaaaagaatttcaaattgactcattttgaggaggtttttacaacccatcattggatggtccgtatttacaagctgaagcctctgaaaaataggattcgggctaaaagcaagaaaagaacaaaatcgagctcaaaaaacaagtcagcaagtttgaagaagcaaatgcaaaagaatccatggtattgataatgaaggctgggttgtcaatactcctccaaatatgttagggagtgctcacatt

SEQ ID NO: 5425 - DNA, 2870 bp, Hordeum vulgare
acagagatttctccgtccctctccccctcgcccagcccccacacacccagccgcgactcggctgcaatggcggagcccgtggccaacgcggcggcgcccgcccccgcgcccggccgcctccgcaacgccttcggcggcgtgctctgcgccttcaccctcctcctcatcggcgtcctcgccttctcgatccgcctcttctccgtgatcaagtacgagagcgtgatccacgagttcgacccctacttcaacttccgcgtcacccagtttttgtcgaagaatggaatctatgagttctggaactggtttgatgataggacatggtacccccttggtcgtgtgattggtggcactgtgtatcctgggttgacattgacagctggaagcatctggtggttggtaaatgctcttaacatcccattgtcggtggagactgtctgcgtgttcactgctccaattttctcagcaaacgcttcctgggctacttacctcttgacaaaggaagcaaagggcactggagctggattgatggcagcagccattctggcaatggtcccttcgtacatctcaagatcagttgctggcagctatgataatgaagctgtggcaatatttgccttggtattcacattttatctgtatgtaaagacactgaacacaggatcactcttttatgcaacgctcaatgcgctctcatatttctacatggtctgttcttggggaggctacacattcatcataaacctgattccgatgcatgtgctcctttgcattgtaaccggtcgttattcttcacgactttacattgcatatgctccccttgttatactgggaacacttctggcagctttggtacctgtcgttggttttaatgctgtattgacatctgagcactttgcatcatttctggtgtttataatccttcatgtggttgcttttgtgtattacatcaaaggactgttgactcccagactgttcaaaatggccatgactcttgttataactgttggcttggctgtttgttttgcagtggtagctatactcgtagcgttggtggcatctagcccaacaaaaggctggagcgggcgcagtttgagtctactggacccaacctatgctagcaagtatattcccatcattgccagtgtcagtgaacatcaaccccctacctggccctcttattttatggacatcaatgttttggccttcttggttcctgctggaataatttcatgcttcttgcctttgtccgatgcaagttcattcatggtcttgtacttggtcactgccgtatatttttctggagtgatggttcggcttatgcttgtccttgctcctgctgcgtgcattctatctgggattgctctctcctcagccttcgatgtcctcacacgatctatgaaatttcagctatcaaaactatttgatgatggccctgctatttcagggaatggtagcccaaatggttctagcgctagcacggttaatacaagttcatccaaaaatgagaagactgaaaaatctgaagcagctccaaaggaaaaaccatcaaagaagaaccggaagaaggacaaagaagtgacagaaagtgtttctgtcaagcctaaaaaggaaaagagactttcggtactgcctttggaagcatctattatgggcactcttttgctggtcgcgttaggtggtttctatgtggtccattgtgtttgggctgcagctgaagcgtactctgctccttcaattgtgttgacatctcgttcacgtgagggattgcatgtttttgatgatttccgtgaagcttatgcatggcttagccataacacagatgtagatgacaaggttgcatcctggtgggactatggttatcaaacaactgctatggctaacaggactgtgattgtagacaacaatacctggaacaacactcacattgcaacagttggtacagcgatgtcatccccagagaaggcagcatgggagatctttgattctttagatgttaaatatgtgcttgttgtgtttggagggctggttggctaccctagtgatgatattaacaagttcctttggatggttcgcataggaggtggtgaatttcctcacatcaaggagccagattatcttagagatggccagtaccgtgttgatgctcaagcaactccaactatgttgaattgcctcatgtacaagctttgctactacaggtttgttgagactgatggcaaaggttttgatagagtaagaggatatgaaataggaaagaagcatttcaagctaacacattttgaggaggttttcacaacccatcactggatggtccggatttataaactgaaacctcaaaagaacaggattcggggcaagttgaagaagttgaaatctagtgccaaaactagttcgacgcttgcagcggggcggaagaagaacccatggcaatgaagagaaacaatgttccattttacatgagagacttgatattgtagctcaactgcaccaagctcaaaagaactagaatactacagaactagattagagatatctgcattgttgtgctcgtatttgacccctaatatgttctttctgaaaccaggcagagtgctgatgagaatttttgatagatgaattattttcttctcccctttgttgggacaatatcaatcgtgtcaacttgccccaaatgatgctatatgtagaatggagcatatgcttgctgcgataggtgcatctacaaactgggagctgtttgagcttttctaacagcatctctaatccatcctccaaaaaagaaaaaacaatgtacttggagggtgccatctagaccatctcccttaaaggcacttctctataaattttgagaggcaccctcaaactggtgt

SEQ ID NO: 5426 - DNA, 2740 bp, Secale cereale
gactggaggtcttcgtctccgcctgggaacgctaacagagatttctccgtccctctcccccttccccctctgccccccctcacgcacccagccgcgactcggccgcaatggcggagcccgtggccaacgcggcggcgcccgcccccgcccccggccgcctccgcaacgccttcggcggcgtgctctgcgccttcaccctcatcctcatcggcgtcctcgccttctcgatccgcctcttctccgtgatcaagtacgagagcgtgatccacgagttcgacccctacttcaacttccgcgtcacccagtttttgtcgaagaatggaatctacgagttctggaactggtttgatgataggacatggtatccccttggtcgtgtgattggtggcactgtgtatcctgggttgaccttgacagctggaagcatttggtggtttgttaacgctctgaacatccccttgtcggtggagactgtctgcgtgttcactgctccaattttctcagcattcgcttcctgggctacttacctcttgacaaaggaagcaaagggcactggagctggattgatggcagcagccattctggcaatggtcccttcgtacatctcaagatcagtcgctggcagctatgataatgaagctgtagcaatatttgccctggtattcacattttatctgtatgtaaagacactgaacacaggatcactcttttatgcaacgctcaatgctctctcatatttctacatggtctgttcttggggaggctacacattcatcataaaccttattccgatgcatgtgctgttgtgcattgtaactggtcgttattcttcacgactgtacattgcatatgctccccttgttatactgggaacacttctggcagctttggtacctgtcgttggttttaatgctgtattgacatctgagcactttgcgtcatttctggtgtttataatccttcatgtggttgcttttgtgtattacatcaaaggacttttgactcccaggctgttcaaaatggctatgactcttgttataacggttggcctggctgtttgttttgcagtggtagctatactcgtcgcattggtggcatctagcccaacaaaaggctggagcgggcgcagtttgagtctactggacccaacctatgcaagcaagtatattcccatcattgccagtgtcagtgaacatcaaccccctacctggccctcttattttatggatatcaatgttttggccttcttggttcctgctggaataatttcatgcttcttgcctttgtccgatgcaagttcattcatggtcttgtacttggtcactgcggtatatttttctggagtgatggttcggcttatgcttgtccttgctcctgctgcgtgcattctatctgggattgctctttcctcagccttcgatgtcctcacacgatctatgaaatttcagctatcaaaactatttgatgatggccctgctatttcagggaatggtagcccaaatggttctagtgctagcacggtcaatacaagttcatccaaaagtgaaaaggctgaaaagtccgaagcagctccaaaggaaaagccatcaaagaagaaccggaagaaggacagagaagtgacagaaagtgtttctgtcaagcctaaaaaggaaaagagactttctgtactgcctttggaagcatctgttgtgagcactttgttactgatcgcgttaggtggtttctatgtggtccattgtgtttgggctgcagctgaagcgtactctgcaccttcaattgtgttgacatctcgttcacgcgagggattgcatgtttttgatgatttccgtgaagcttatgcatggcttagccataacacagatgtggatgacaaggtcgcatcctggtgggactacggttatcaaacaactgctatggctaacaggactgtgattgtagacaacaatacttggaacaacactcacatagcaaccgttggtacagctatgtcatccccagaaaaggcagcatgggagatctttgattcattagatgttaaatatgtgcttgttgtgtttggagggctggttggctacccaagtgatgatattaacaagttcctttggatggttcgcataggaggtggtgaattccctcacatcaaggagccagattatcttagagatggccaataccgtgttgatgctcaagcaactccaactatgttgaattgcctcatgtacaagctttgctattacaggtttgttgagactgatggcaaaggctttgatagagtaagaggatatgaaataggaaagaagcatttcaagctaacacattttgaggaggttttcacaacccaccactggatggtgcgcatttataaactgaaacctcaaaagaacaggattcggggcaagttgaagaagttgaaatccagttccaaaactagttcgacgcttgcagcgggccgaaagaagaacccatggcaatgaagagaaaccgtgttccatttacttgaggcttgatattgtagctcaactgcaccaagctcaaaagaactagaatactacagaactagattagagatatctgcattgttgtgctcgtatttgaccccctaatgcggttctttctggaaccagccaaagtgctgatagaatttttgatagacgagttatgtttttctccccctttttcgggacaccgactttcgtgtcaacttgcaccccgtcgtatgtagaatggtgtctacatgaca

SEQ ID NO: 5427 - DNA, 2594 bp, Secale cereale
tggcggagcccgtggccaacgcggcggcgcccgccccgccccggccgcctccgcaacgccttcggcggcgtgctctgcgccttcaccctcatcctcatcggcgtcctcgccttctcgatccgcctcttctccgtgatcaagtacgagagcgtgatccacgagttcgacccctacttcaacttccgcgtcacccagtttttgtcgaagaatggaatctacgagttctggaactggtttgatgataggacatggtacccccttggtcgtgtgattggtggcactgtgtatcctgggttgaccttgacagctggaagcatttggtggttggttaacgctctgaacatccccttgtcggtggaaactgtctgcgtgttcactgctccaattttctcagcattcgcttcctgggctacttacctcttgacaaaggaagcaaagggcactggagctggattgatggcagcagccattctggcaatggtcccttcgtacatctcaagatcagttgctggcagctatgataatgaagctgtagcaatatttgccttggtattcacattttatctgtatgtaaagacactgaacacaggatcactcttttatgcaacgctcaatgctctctcatatttctacatggtctgttcttggggaggctacacattcatcataaaccttattccgatgcatgtgctgttgtgcattgtaactggtcgttattcttcacgactgtacattgcatatgctccccttgttatactgggaacacttctggcagctttggtacctgtcgttggttttaatgctgtattgacatctgagcactttgcatcatttctggtgtttataatccttcatgtggttgcttttgtgtattacatcaaaggacttttgactcccaggctgttcaaaatggctatgactcttgttataacggttggcctggctgtttgttttgcagtggtagctatactcgtcgcattggtggcatctagcccaacaaaaggctggagcgggcgcagtttgagtctactggacccaacctatgcaagcaagtatattcccatcattgccagtgtcagtgaacatcaaccccctacctggccctcttattttatggatatcaatgttttggccttcttggttcctgctggaataatttcatgcttcttgcctttgtccgatgcaagttcattcatggtcttgtacttggtcactgcagtatatttttctggagtgatggttcggcttatgcttgtccttgctcctgctgcgtgcattctatctgggattgctctttcctcagccttcgatgtcctcacacgatctatgaaatttcagctatcaaaactatttgatgatggccctgctatttcagggaatggtagcccaaatggttctagtgctagcacggtcaatacaagttcatccaaaagtgaaaaggctgaaaagtccgaagcagctccaaaggaaaagccatcaaagaagaaccggaagaaggacagagaagtgacagaaagtgtttctgtcaagcctaaaaaggaaaagagactttctgtactgcctttggaagcatctgttgtgagcactttgttactgatcgcgttaggtggtttctatgtggtccattgtgtttgggctgcagctgaagcgtactctgcaccttcaattgtgttgacatctcgttcacgtgaggggttgcatgtttttgatgattttcgtgaagcttatgcatggcttagccataacacagatgtggatgacaaggtcgcatcctggtgggactacggttatcaaacaactgctatggctaacaggactgtgattgtagacaacaatacttggaacaacactcacatagcaacagttggtacagctatgtcatccccagaaaaggcagcatgggagatctttgattcattagatgttaaatacgtgcttgttgtgtttggagggctggttggctacccaagtgacgatattaacaagttcctttggatggttcgcataggaggtggtgaattccctcacatcaaggagccagattatcttagagatggccagtaccgtgttgatgctcaagcaactccaactatgttgaattgcctcatgtacaagctttgctattacaggtttgttgagactgatggcaaaggctttgatagagtaagaggatatgaaataggaaagaagcatttcaagctaacgcattttgaggaggttttcacaacccaccactggatggtgcgcatttataaactgaaacctcaaaagaacaggatccggggcaagttgaagaagttgaaatccagttccaaaactagttcgacgcttgcagcaggccgaaagaagaacccatggcaatgaagagaaaccgtgttccatttacttgaggcttgatattgtagctcaactgcaccgagctcaaaagaactagaatactacagaactagattagagatatctgcattgttgtgctcgtatttgaccccctaatgtggttctttctggaaccagccaaagtgctgatagaatttttgatagacgagttatgtttttctccccctttttcgggacactgattttcgtgtcaattt

SEQ ID NO: 5428 - DNA, 2810 bp, Hordeum vulgare
acagagatttctccgtccctctccccctcgcccagcccccacacacccagccgcgactcggctgcaatggcggagcccgcggccaacgcggcggcgcccgcccccgcgcccggccgcctccgcaacgccttcggcggcgtgctctgcgccttcaccctcctcctcatcggcgtcctcgccttctcgatccgcctcttctccgtgatcaagtacgagagcgtgatccacgagttcgacccctacttcaacttccgcgtcacccagtttttgtcgaagaatggaatctatgagttctggaactggtttgatgataggacatggtacccccttggtcgtgtgattggtggcactgtgtatcctgggttgacattgacagctggaagcatctggtggttggtaaatgctcttaacatcccattgtcggtggagactgtctgcgtgttcactgctccaattttctcagcaaacgcttcctgggctacttacctcttgacaaaggaagcaaagggcactggagctggattgatggcagcagccattctggcaatggtcccttcgtacatctcaagatcagttgctggcagctatgataatgaagctgtggcaatatttgccttggtattcacattttatctgtatgtaaagacactgaacacaggatcactcttttatgcaacgctcaatgcgctctcatatttctacatggtctgttcttggggaggctacacattcatcataaacctgattccgatgcatgtgctcctttgcattgtaaccggtcgttattcttcacgactttacattgcatatgctccccttgttatactgggaacacttctggcagctttggtacctgtcgttggttttaatgctgtattgacatctgagcactttgcatcatttctggtgtttataatccttcatgtggttgcttttgtgtattacatcaaaggactgttgactcccagactgttcaaaatggccatgactcttgttataactgttggcttggctgtttgttttgcagtggtagctatactcgtagcgttggtggcatctagcccaacaaaaggctggagcgggcgcagtttgagtctactggacccaacctatgctagcaagtatattcccatcattgccagtgtcagtgaacatcaaccccctacctggccctcttattttatggacatcaatgttttggccttcttggttcctgctggaataatttcatgcttctcgcctttgtccgatgcaagttcattcatggtcttgtacttggtcactgcggtatatttttctggagtgatggttcggcttatgcttgtccttgctcctgctgcgtgcattctatctgggattgctctctcctcagccttcgatgtcctcacacgatctatgaaatttcagctctcaaaactatttgatgatggccctgctatttcagggaatggtagcccaaatggttctagcgctagcacggttaatacaagttcatccaaaaatgagaagactgaaaaatctgaagcagctccaaaggaaaaaccatcaaagaagaaccggaagaaggacaaagaagtgacagaaagtgtttctgtcaagcctaaaaaggaaaagagactttcggtactgcctttggaagcatctattatgggcactcttttgctggtcgcgttaggtggtttctatgtggtccattgtgtttgggctgcagctgaagcgtactctgctccttcaattgtgttgacatctcgttcacgtgagggattgcatgtttttgatgatttccgtgaagcttatgcatggcttagccataacacagatgtagatgacaaggttgcatcctggtgggactatggttatcaaacaactgctatggctaacaggactgtgattgtagacaacaatacctggaacaacactcacattgcaacagttggtacagcgatgtcatccccagagaaggcagcatgggagatctttgattctttagatgttaaatatgtgcttgttgtgtttggagggctggttggctaccctagtgatgatattaacaagttcctttggatggttcgcataggaggtggtgaatttcctcacatcaaggagccagattatcttagagatggccagtaccgtgttgatgctcaagcaactccaactatgttgaattgcctcatgtacaagctttgctactacaggtttgttgagactgatggcaaaggttttgatagagtaagaggatatgaaataggaaagaagcatttcaagctaacacattttgaggaggttttcacaacccatcactggatggtccggatttataaactgaaacctcaaaagaacaggattcggggcaagttgaagaagttgaaatctagtgccaaaactagttcgacgcttgcagcggggcggaagaagaacccatggcaatgaagagaaacaatgttccattttacatgagagacttgatattgtagctcaactgcaccaagctcaaaagaactagaatactacagaactagattagagatatctgcattgttgtgctcgtatttgacccctaatatgttctttctgaaaccaggcagagtgctgatgagaatttttgatagatgaattattttcttctcccctttgttgggacaatatcaatcgtgtcaacttgccccaaatgatgctatatgtagaatggagcatatgcttgctgcgataggtgcatctacaaactgggagctgtttgagcttttctaacagcatctctaatccatcctccaaaaaagaaaaaacaatgtacttggagggtgccatct

SEQ ID NO: 5429 - DNA, 2743 bp, Brachypodium distachyon
gggaacgctactgggatttctccgtcccacccccttccctccactcacagccgagattcggcagcaatggcggagcccgagccaaccacggcggcggccgctcccgctcccggccgcctccgcaacgccttcggcggggtgctgtgcgccttcaccctcctcctcatcggtgtcctcgcgttctcgatccgcctcttctccgtgatcaagtacgagagcgtgatccacgagttcgacccctacttcaacttccgcgtcactcagtttttgtcgaagaatggaatttatgagttctggaactggtttgatgataggacatggtatccccttggtcgtgtgattggtggcactgtgtatcctgggttgacattgacagctggaagcatttggtggttggtaaacgctcttaacatcccattgtcggtggagactgtttgtgtgttcaccgctccaattttctcagcaaatgcttcctgggctacttacctcttgacaaaggaagcaaagggcactggagctggattgatggcagctgccattctggcaatggtcccttcgtatatctcaagatcagttgcaggtagttatgataatgaagctgtagcaatatttgccttggtattcacgttttatctttatttaaagacactgaatacaggatccctcttttatgcaacactcaatgctctatcatatttctacatggtctgttcttggggaggctacacgttcatcataaaccttattccaatgcatgtgctcttgtgcattgtaactggtcgttattcttcacgactttacattgcatatgcaccccttgttatattgggtacacttctggcggccttggtacctgtggttggttttaatgcagtattgacatctgagcactttgcatcattcctggtgtttataatccttcatgtggttgcttttgtgtattatatcaaaggacttttgactcccagactgttcaaagtggctatgacccttgttataactgttggcttggctgtttgttttgcagtagtagctgtactcgttgcgttggtggcatctagcccaacaaaaggctggagtgggcgcagtttgagtctacttgacccaacctatgcaagcaagtacatcccaatcattgccagtgtcagcgaacatcaacccccaacctggccctcttattttatggatatcaatgtgctggccttcttggttcctgccgggataatttcatgcttcttgccattatccgatgcaagctccttcatggtcttgtacttggtcactgcagtctatttttctggagtaatggtacggcttatgcttgtcctcgctcctgctgcatgcattctatctgggattgctctgtcttcagctttcgatgtcctcacacgatctatgaaatttcagctatcaaaagtatttaatgatggctctgctgtttcaggggatagtattgcagagggttctactgctagtaatgacactaaaggttctagcactagcacggtcaatacaaattccgcgaaaattgaaaacaggactgaaaaatctgaaaaaccatcaaagaagaaccggaagaaggacagagaagtgacaggaagtgttcctgtaaagcctaaaaaggaaaagagactttcagtactgcctctggaagcgtctgttgtgggtactttgttactgattgtgttaggtggtttctatgtggtccattgtgtttgggctgcagctgaagcatactctgcaccttcaattgtgttgacatctcgttcacgtgaaggactgcatgtatttgatgatttccgtgaagcttatgcatggctgagccataacacagatgtagatgacaaggttgcatcctggtgggactatggttatcaaacaactgctatggctaacaggactgtgattgtagacaacaatacctggaataacacccacatagcaacagttggtacagcgatgtcatctccagaaaaagcagcatgggagatctttgattctttagatgtcaaatatgtgcttgttgtgtttggagggcttgttggctaccctagtgatgatattaataagttcctttggatggttcgcataggaggtggtgaattccctcacatcaaagaaccagattatcttagagatggtcaataccgtgttgattctcaagcaactccaactatgttgaattgcctcatgtacaagctttgctattacaggtttgttgagactgatggcaaaggctttgatagagtaagaggatatgagataggaaagaagcattttaagctaacacattttgaagaggttttcactacgcaccattggatggtccgtatttataaactgaaacctcaaaagaacaggattcgaggcaagttgaagaagttgaaatctagttccaaaactagttccacgcttgcagcaggccgaaagaagaacccgtggcaataaagagaaaccccatgtttcgtttacatgaaacccgatattgtagctcaagtgcgctaagctcaaaggactagaacactacagaactagattagagagatctgcattgttgtgctcggaacttgacaccccctgatatgttttcttggaaccagccagagtgctgaagacaatttttgatatggacaagaaacgtttcttgtctccccttctgggacacaacaggccgtgtcaactttcgcttgtcaatactggaacatgcccgttgtgatttaattagtttgttttatgcattgaa

SEQ ID NO: 5430 - DNA, 2599 bp, Avena sativa
cgagggtcttcgtctccgcctgggaacgctactgagatttctccgtcctctgccccctccgcacgcacacacccgcaatggcggagaccgaggccaaagcggcggcgcccgctcccgatcccggccgcctccgcaacgccttcggtggcgtgctgtgcgccttcaccctcatcctcatcggcgtcctcgcgttctcgatccgcctcttctccgtgatcaagtacgagagcgtgatccacgagttcgacccctacttcaacttccgcgtcactcagtttctgtcgaagaatggaatctacgagttctggaactggtttgatgacaggacatggtatcccctgggtcgtgtgattggtggcactgtgtatcctgggttgacattgacagctggaagcatttggtggtttgtgaatgctcttaacatcccattgtcggtggagactgtctgtgtcttcactgctccaattttctcagcattcgcttcctgggttacttacctattgacgaaggaagcaaagggcactggagctggattgatggcagcagcaattctggcaatggtcccttcatatatctcaagatcagttgcaggcagctatgacaatgaagctgtagcaatatttgccttggtgttcacgttttatctgtatgtaaagacactgaatacaggatctctcttttatgcaacgctcaatgctctctcatatttctacatggtctgttcttggggaggctacaccttcatcataaaccttattccgatgcatgtgctcttgtgcattgtaaccggtcgttattcttcacgactttacattgcatatgcaccccttgttatattgggaacacttctggcagccttggtacctgtggttggttttaatgcagtattgacatctgagcactttgcatcctttctggtgtttataattcttcatgtggttgccttcgtgtattacatcaaaggacttttgactcccaggctgttcaaaatggctatgactcttgttataactgttggcatggctgtttgtttcgcagtggtagctatacttgtagcattggtggcatctagcccaacaaaaggctggagcgggcgcagtttgagtctacttgacccaacctatgcaagcaagtatattcccatcattgccagtgtcagtgaacatcaaccccctacctggccgtcttatttcatggatatcaatgttttggccttcttggttcctgccgggataatttcatgcttcttgcctttatccgatgcaagctcattcatggtcttgtacttggtcactgcagtctatttttctggagtgatggttcgacttatgcttgtccttgctcctgctgcgtgcattctatctggggttgctctctcctcagcttttgatgtcctcacacgatctatgaaatttcagatatcaaaattatttgaggatggatctgctatttcagggaatggtagcgcagaaggttctagtgctagcacggtcaatacaaattcatcaagaaatgaaagtaggactgaaaaatctgaagtggttccaaaagaaaaaccatcaaggaagaaccggaagaaagaaaaagaagtgacagaaagtgttcctgccaagtctaaaaaggaaaagagactttcagtactgcctttggaagcatctgttgtgggcactttgttactgatcgtgttaggtggtttctatgtggtacattgtgtttgggccgcagcggaagcatactctgcaccttcaattgtgttgacatctcgttcacgcgagggaacacatgtttttgatgatttccgtgaagcttatgcatggcttagtcataacacagatgtagatgacaaggttgcatcctggtgggactatggttatcaaacaactgctatggctaacaggactgtgattgttgacaacaatacctggaacaacactcacatagcaacagttggtacagcaatgtcatccccagaaaaagcagcatgggagatctttcattctctagatgtcaaatatgtgcttgttgtgtttggaggtcttgttggctaccctagtgatgatatcaataagttcctttggatggttcgcataggaggtggtgaattccctcacatcaaggaaccggattatcttagagatggccagtaccgtgtcgatgctcaagcaactccaactatgttgaattgcctcatgtacaagctttgttattacaggtttgttgagactgatggcaaaggctttgatagagtaagaggatatgaaataggaaagaagcatttcaagcttacacattttgaggaggttttcacgacacaccattggatggtccgcatttataagctgaaaccccaaaagaacagggttcggggcaagttgaggaagttgaaatctggttccaaacctagttccactccttcagcagcccgaaagaacccatggcaatgaagaagagaaggatgcgctccattttgttgaaacttgatactgtagcttaagcgcactaagctcggaactagaatactacagaattagattagaattgctgtgctcggaatttgacaaaccaatatgttctttgcggaagaatttttgactgatga

SEQ ID NO: 5431 - DNA, 3171 bp, Sorghum bicolor
ggcctggcgacactgctctaaacttttgttcctatgctgccacttcgtcctcgaggcgtgtacgaacgctgctggggtgctgcgctcgtgtccgagcgctaggaccggtgattgccgactcttctcccagtccaaagtgcacgccaccgcaaggtccaaacacgaaaaagttcgataaacctccgcctcccgggcctccgccgccccaaaactctgcttctcaacagcaatgccggagccccagtcctctgtggcctcaagcggaagcgtagatcgcctccggaatgccttcggcggagtgctgtgcaccttcaccctccttctcatcggcgtcctcgccttctccatccgactattctctgtgatcaagtacgaaagcgtcatccacgagttcgatccctacttcaattaccgcgtcacccagttcttgtcaaagaatggcatatatgaattctggaactggtttgatgaccgaacatggtatcctcttgggcgtgttattggcggcactgtttatcctggtttgacacttactgctggtacaatatggtggctgctgaattccctgaacatcccattgtcagtggagactgtctgtgtcttcactgctccaattttctcagtcaatgcgtcctgggcaacttacctattaaccaaggaaacaaagggccctggggctggtttgatggcagcaactattctagcaatggtcccatcatacatctcaagatctgttgctggcagctacgataatgaagctgtagctatatttgctttaatattcacgttctatctatatgtaaagacactaaacactggatcactcttttatgcgacgcttaatgctctctcgtacttctacatggtttgttcttggggaggctacacattcatcatcaatcttatcccgatgcatgttctcttgtgtattgtgactggtcgttactcttcacgactttatattgcttatgctccccttattgtgcttggaacacttctagcagcattggtacctgttgttggttttaatgcagtaatgacgtcagagcactttgcatcatttctggtgtttataatcctccatgtggttgctctgggttatcacatcaaaggacttttaactcctcgactgttcaaagtggccatgccatttgttattacagttggattggctgtttgttttgctgttgcagcaatactcgttgcattgattgcatctagcccaacaaaaggctggagtggtcgcagtttgagtctgctggatccaacctatgcaagcaagtacatccctataattgctagtgtgagcgaacaccaaccaccaacctggccttcttattttatggatatcaatgtgctggccttcttagttcctgctgggatcatatcatgcttcttaccgttatctgatgcaagctcatttttggtcctgtacttggtaacctcagtgtatttctctggagtaatggttcgacttatgctggtccttgctcctgctgcatgcattttgtctgggattgctctgtctgaagcttttggtgtccttacaagatcaatgaaatttcagcgtccaacactggacgatggatcttctacagcaggggatgggagttctgatactcctaccaactcagaaatggtttcgaaggaaaaaccatccaagaaaaatcggaagaaagacagagactcagagggaagttcacctgttgatcatagaactgaagaaaagcttttagtactgccttgtgggccatctgctgtgggcataatgctgctgatcatactttctggtttttacgtagtccattgtgtgtgggctgctgcagaagcatattccgcaccttcaattgtgctaacatctcgttcacatgatgggtttcatgtttttgatgatttccgtgaagcttatggatggctgcgccataacacagatgtagatgataaggttgcatcttggtgggactatggttatcagacaactgcaatggcaaacagaactgttattgtggacaataatacatggaataacacacacatagcaacagttgggactgcaatggcatccccagaaaaagcagcatgggagatcttcaattccttagatgtcaaatatgtgctcgttatctttggagggcttattggctacccaagtgatgatattaataagttcctctggatggttcgaatcggaggtggtgtattccctcaaataaaggaagcagattaccttaaggatggcaactaccgcgttgatgctcatggcaccccaaccatgttgaattccctcatgtacaagctttgctattacaggttcgttgaaactgatggtaagggctatgatagagtgagaagatatgaaatagggaagaagcattttaaactcacacattttgaggaggttttcacaacccatcattggatggttcggatttacaaactgaaacctcagaagaacagagtcagagggaaactgaaatttaaatctagttcaaaaacaagtgctatgcggaaaactggtggaaagaagagcccatggcaatagagatcacaaaggcggggggtgctggagtcactagtcagcacagttactatcctgagaaaaccacaaattcacaaaaaggagttagattaaaagtatagcatcggtgtgttctttgttattgtcatggagcagattataggggtgcttcatggtttttggcatttgatcttcgtaacgacatttctgcagcgagggagtctgatgaaatttttgacaggttctggagtgaggctttatccccatttaaacaagatagactttgtttgtaggaacctgattgagcgcctggctgtttggaaataggagtgccatattatatctagttaccttacgtacatctttaaaggctgtttggtttgaagaatatgcagcttgttcgcttgaacttatccgccgaatctgctagccatttagcagtgttttctctcacaacaaattagctaacaattgaggtctatttttgaatgcaggatttttattttaattcctgtatttttctgtaaaaatgaattgttcctgtgaaatatctattttattcctgtggagtttccgcgtctaaggggcctttgcttggttttgcgaaatggaattaatttctacagtgacatgaacagtgtaacaacaggtga

SEQ ID NO: 5432 - DNA, 2780 bp, Podocarpus macrophillus
agcggcagcaggatccgttttgtcatttacaattctcattcttgtggccattcttgcattttcaattaggctcttctctgttatcaagtatgagagcgtcattcacgaatttgatccttacttcaattacagagtcacacagtatcttacgaaaaaaggagtgtatgacttttggaattggtttgatgaccgtacctggtaccctcttggtcgtgtcattggtggaacagtttatcctggtttgacattgacagcggggaccatgtggtggatactcaattccttgaacatacctctttcagtagaaactgtctgtgtttttacagctcctgtcttctcagccaatgcagcatgggcaacctatcttttgaccaaggaagtgaaaggcactggggcaggactcactgcagcagcacttatagcaatggtgccttcatatatctctcgatctgttgcgggcagttatgataatgaagctgtagccatatttgctttggtctttacattctatctatatatcaagacactgaatactggctctctcttttatgcaacattgaacgccttggcttacttttatatggtttgttcctggggaggatacacattcataatcaatcttattccaatgcatgttcttctatgcattgtcacgggccgctattcatcccgcttgtatattgcttatgctcctcttgtcattttgggtactctattggctgctcttgttccagttgttggatttaatgcagtcatgacatctgagcattttgggtcatttctggtatttattatactcaatgttgtggcattggggcactatattaagcgcactgtttcagccaagatgttcaaggtggccataacacttgttatttctattggcatggtggtgtctgttgcactggcagcagttttggtggcatcagtggcagcaagccctacgaaaggatggagtgggcgaagtttaagtcttcttgatccgacctatgccagcaagtatattcctattattgcaagtgttagtgaacatcagccaccaacttggccttcatattttatggatataaatgtgctagcatttctagtacctgcaggcatcattgcgtgttttctaccgttgtctgatgccagctcctttttggttctctacattgtgacatcagtatacttttctggtgttatggtacggcttatgctggtgttggcaccagcagcctgtattctatctggaattgctctttctgaagcttttacagtgctaacaagatccatcaaattccagaaggatgctgggacagtcaaatctgaagttgtgacagatcaatcgaatgatgggtctaaaagtgaagttgaaaaaggtaaagaacttccaagagagaaaccctctaaaaagagcagaaagaaggaaaaggagaacatggaaaaggttttggataaaaaggaaatcaagcagcggtcattgcttctacctgtagaagcatccgttgttggtattcttttacttattatattaggaagtttttatgtgattcattgtgtttgggctgcagcagaagcttattctgctccatcaattgtgcttacatctcatactcctgatggatttcatgtttttgatgattttcgagaaggttatgcatggttaagccataatactgatattaatgacaaggttgcctcttggtgggactatggataccaaacgacggcaatggctaatcgaactgttatagttgacaacaatacatggaacaatacacatattgcaactgttggtacagctatgtcatctcctgagagacaagcatgggaaattttccagtcgttggacgtaaaatatgtatttgtagtatttggaggtttggttggatatccaagtgatgatatcaataagtttctctggatggttcgcataggaggtggtgttttcccacatataaaagaacctgattatctaagagatggtcagtatcgaatagattcgcaggcaacaccaacaatgttgaattcgcttatgtataaactgtcatattatcgattcacagatatagatggtcgaggatatgatagagtgaggagaactgagatagggaagaaatattttaagctgactcattttgaagaggtttttacaactcaccattggatggttcgaatttacaagcttaagcctcaaaagaataggcttagaggaaaaagcaagaaaaaacgaaattgagttccaaaggggccaagtcatcaagtttgaagaaacaagagaagaggaacccttggcattgagactcttcacattatatttccatgcttgttgaggttgtgcacctgtatagtcatggttgctggatggctgcaactgcttgatatgggggttgttgctttccctttttggcagtgtcaatggacactagaattatgagaaagaggtgctacaattcctgataattggagatgtcaagatgaattatgaattgataatacaagacacacgatgtaatagagagttaactgtgaagatgtcaaaaccaattttgctttctcttatttcaggtgtaacacaatgttggttcatcatttttgttctattttaatgaatcctaattttgtttcatgttgctggtttataaattatactatggagaatccccagccttatgagcaaggagattaagatctccgtattttggagttccaatgatttagaaacaggatatgtataataatttagagaatttataatcacaggtttctatatgagtttgtagcgtacttatttaaaa

SEQ ID NO: 5433 - DNA, 2814 bp, Panicum virgatum
aaaactctgcttctcggcagcaatgccggagcctctatcctctacggcggcgagcgggggcggcggtcgccttaggaacgccttcggcggagtgctgtgcgccttcaccctcctcctcatcggcgtcatcgcattttcgatccgcctcttctcagtgatcaagtacgagagcgttatccacgagttcgatccctacttcaactaccgcgtcactcagtttttgtcaaagaatggaatctatgaattctggaactggtttgatgaccgaacatggtatcctctggggcgtgttattggcggcactgtctatcctggtttgacactaactgctggcacaatgtggtggttgctaaactcccttaacatcccattgtcggtggagaccgtctgtgtgttcaccgctccaatcttctcagccaatgcttcctgggcaacttaccttttaaccaaggaagcaaagggctcaggggctggtttgatggcagcagctatcctagctatggtcccatcatacatctcaagatctgttgctggcagctacgataatgaagctgtagctatatttgctttaatattcacgttttatctatatgtaaagacactaaacaccggatcactcttttatgcgacacttaatgctctctcatacttctacatggtctgttcttggggaggctacactttcatcatcaatcttatcccaatgcatgttcttttgtgtattgtaactggtcgttactcttcacgactttatattgcttatgctcccctcgttgtgcttggcacacttctagcagcattggtacctgttgttggttttaatgcagtaatgacatcagagcactttgcatcatttctggtgtttataatcctccatgtggttgctctggtttattacataaaagggcttttaactcctcggctgttcaaagtggccatgacatttgttgtaacagttggtttggccgtttgttttgctgttgcagcaattctcattgcattggtggcatctagcccaacaaaaggttggagtggtcgcagtttgagtctacttgacccaacctatgcaagcaagtacatccctattattgctagtgtgagcgaacaccaaccaccaacctggccttcttattttatggatatcaatgtgctagccttcttaattcctgctgggatcatatcatgcttcttaccattatctgatgcaagctcatttttggtcttgtacttggtaacttcagtgtatttctctggagtaatggtccgacttatgctcgtccttgctcccgctgcatgcattttgtctgggattgctctatctgaagcttttggtgtccttacaagatcgatgaaatttcagcgtccaatatcagatgatggctcttctacagcacatgatggtagttttgatactcctgccaactcagaacctgtttcaaaggaaaagccatccaagaaaaatcggaagaaaaacaaaggctcagagggaagtcctcctgttaatcctagaacagaagaaaaacttttagtgctgccttgtggaccatctgccgtgggtataatgttgctcatcatactttctgggttttatgtggtccattgtgtgtgggctgctgcagaagcatactcggcaccctcaattgtgctgacatctcgttcacatgatgggttgcatgtttttgatgatttccgtgaagcttatggatggctgcgccataacacagatgtagatgataaggttgcatcttggtgggactatggttaccagacaactgcaatggccaacagaactgttattgtagacaacaatacatggaataacacacacatagcaacagttgggacagcaatggcatctccagaaaaagcagcatgggagatcctaaattccttagatgtcaaatatgtgtttgttgtctttggagggcttattggctactcaagtgatgatatcaataagttcctctggatggtccgaataggtggtggtgtattccctcacataaaggaagcagattaccttagggatggcaactatcgtgttgatgctcatggcaccccaacgatgctgaattccctcatgtacaagctttgttattacagatttgttgaaactgatggcaagggctttgatagagtgagaagatatgaaatagggaagaagcactttaagctgacccatttcgaggaggttttcactacccaccattggatggttcggatttacaaactgaaacctcaaaagaacagagtcagagggaaactgaaactaaaatctagttcaaaaacaagttctaggcacaaaaccagtggaaagaagcgtccatggtaatagagatcagaaaggcggggtgctggacagctggagtcgtcaagatacagtcgcagcttgctcaaggtgtccaaacccgagaaaaccacgaactcacgaaaaaaaggaattagactagaaaaatcagcattggttcttgattattgtcatggagcacagtattgggatactctcatagtttcttgccattccaccctcccaatacgtttctccagacagtggaggtctgaaaattttgtttgtgttctggagtgaggcttttattatcgttgaaatgatgacgtttgtagggctctgactgggtgcctgcccattaggatttattggattccagtttatatcaagttgacattagtgacatgctgtagtaagttgctttactattaacagtttacaaatatccatgcaatgcaacagcatgttgctttactattaacagtttacaaatatccatgcaatgcaaacacattatatactgtctc

SEQ ID NO: 5434 - DNA, 2787 bp, Setaria italica
cctccccccaaatattctgtttctcagcagcaatgccggagcctcaatcctctacggcggcgagcgggggcggaggtcgcctccgcgacgccttcggcgaagtgctgtgcaccttcaccctcctcctcatcggcgtcctcgccttctcgatccgcctcttctccgtgatcaagtatgagagcgtcatccacgagttcgatccctacttcaactaccgcgtcactcagtttttgtcaaagaatggaatatatgaattctggaactggtttgatgaccgaacatggtatcctcttgggcgtgtaattggcggcactgtctatcctggtttgacactaactgctggcacaatatggtggttgctaaactcccttaacatcccattgtcggtggagactgcttgcgtcttcactgctccaatcttctcagccaatgcttcctgggcaacttaccttttaaccaaggaagcaaagggctctggggctggtttaatggcagcagctatcctagctgtggtcccatcatacatctcaagatctgttgctggcagctatgataatgaagctgtagctatatttgctttaatattcacgttttacctatacgtaaagacactaaacaccggatcactcttttatgcgacacttaatgctctctcatacttctacatggtctgttcttggggaggctacacgttcatcatcaatcttatcccaatccatgttctcttgtgtattgtgactggtcgttactcttcacgactttatattgcttttgctccccttgttgtgcttggcacacttctggcagcattggtacctgttgttggttttaatgcagtaatgacatcagagcactttgcatcatttctggtctttataatcctccatgtggtcgctctggtttattacataaaaggacttttaactcctcggctcttcaaagtggccatgacatttgttataacagttggtttggctgtttgttttgctgttgcagcaattctcattgcattggtggcatctagcccaacaaaaggttggagtggtcgcagcttgagtctgcttgacccaacctatgcaagcaagtatatccctattatcgctagtgtgagcgaacaccaaccaccaacctggccttcttattttatggatatcaatgtgctggccttcttagttcctgctgggatcatatcatgcttcttaccattatctgatgcaagctcatttttggtcctgtacttggtaacctctgtgtatttctctggagtaatggtccggcttatgcttgtccttgctcccgctgcatgcattttgtctgggattgctctatctgaagcttttggtgtccttacaagatcgatgaaatttcagcgtccgacatcaaatgatggctcttctacagcaggggatggtagttctaacactcctgccgactcagaagctgtttcaaaggaaaagccagccaagaaaaaccggaagaaaggcaaagactcagagggaagttctcctgttgatcctagaacggaagaaaaacttttagtgctgccttgtggaccatctgccgtgggtataatgttgctgatcatactttctgggttttatgtggtccactgtgtgtgggctgctgcagaagcatactcagcaccctcaattgtgctgacatctcgttcacatgatgggttgcatgtttttgatgatttccgtgaagcttatggatggctgcgccataacacagacgtagatgataaggttgcatcttggtgggactatggttatcagacaactgcaatggccaacagaaccgttattgtagacaataatacatggaataacacacacatagcaacagttgggacagcaatggcatccccagaaaaagcagcatgggagatcttaaattccttagatgtcaaatatgtgcttgtcgtctttggagggcttattggctacccaagtgatgatattaataagttcctctggatggttcgaataggaggtggtgtattccctcacataaaggaagcagattaccttagggatggcaactaccgtgttgatgctcatggcaccccaacgatgctgaattcccttatgtacaagctttgctattacagatttgctgacactgatggtaagggctttgatagagtgagaagatatgaaataggaaagaagcactttaagctgacccatttcgaggaggttttcacaacccaccattggatggttcggatttacaaactgaaacctcaaaagaacagagtcagagggaaactgaaactaaaatctagttcaaaaacaagttctatgcgcaaaaccggtggaaagaagagcccatggcaatagagatcacaaaggtggggtcctgggcagctggagtcaacagatacagtcacggcttgctcaaggtgcccaaacccgagaaaaactaccaactcacgaaaaaggaattagactagaaatatcagcattggtttgttcttgattattgccatggagcatagtatagggataccctgtgattcatagtttttgccattccacccttccgatacatttctccaggcaggggagatctgatgaaatttttgatatgttctggctggaggcttttatcatcgtttcaaaaagatggcgtttgtttgtagggatctgactgagagtgcctgatcattaggaatcatggattccagtttatatcaagttgacattagtgacaagccttagcaagttgcttactgtttacaatttatagatattcaatgcaatgcaacatattgtatagtgc

SEQ ID NO: 5435 - DNA, 2878 bp, Solanum phureja
gaaacaagggaaaaagtgaaagcaggttgtgttggttggcaaggtaataataagcttgaaaagcatatgcccctctctctccacctatatagatcaatcactgtacacaggcctcttcccaagaagacaaaattaacttcaaaataaagaaaccccaaaaaaaattggagaaaataatgagtacccattttgttacagggttcaaagctcctgtctttctctctcttcatcaacctcattgtggttatggggatggattatgattgagtgaactagacaaaagcttagctaagtcatcaggacatatcctctttcattccccacaatctactgtcagtcaacattatgcattttttccatctttgagctctacttttctttctttgttgttttcccctcaatttcatatcttatgagagttatttggtgaatggggttgctagatttcttgattttctgttgttgaatacagtaaaaaactgatcttttttgattttctatcaagaaaatgtggggagctgaaagaaaacagagattcaagataggaatagagtgaaaaatcaaatcttttttctcccctcttgcatttttataggctgctacattcaatcagcacaatgaggaagcatggatggcaacttccctatcatcctcttcaggtggtggctcttgctgtgtttctggcattgggatttgctttctatgtcttctttgcaccttttgtgggaaagaaattgcttcagtatattgtgatggggctttatactcctcttataattagtgcatttggcttgtatatctggtgcgctgctgctgatcctgctgatccaggagtttttaaatccaagaagtatcttaagaagctagaccacaaaaagcaagttcaacttaaagaatctaaattagggtgtgagacaaattcgtctattcaagatgctaatgctgcatcgattggggaaaatgcatctgggaaaagcaataaaggagctgaaccagctgcagatcacaatgaaactgaacagaaaattacagatactcgtcacagatcttgttcttccggattgttggctctactaccttgtgctattatcagcaactgcgcaggcagacatgaggagtcttctcagcaacagttgagtgaagatggcatgttctactgcagtttgtgtgaagtagaggtatttaaatacagcaagcattgcagagtatgcgacaagtgcgtcgatcagtttgaccatcattgcaggtggataaacaactgtatagggaaaaggaactatcgcaagttctttactctcatggtttcagccctcctactgcttatacttcagtggtcaactggaattcttgttcttatctgctgctttgttgagaagaagaaattttctgcggagatcacctccaaattaggaagcagtttctccattgttccctttgttatcgtagtggctgtctgtaccatcttggccatgatagcaaccctgccacttgctcaactcttcttctttcacatacttctcataaagaaggggattagcacctatgactacatcattgctctcagagatcaagagcaacaaggagttgcaggtcagcaaagtcctcaaatgtctactgttagctcccttactggattaagcagtgcaagttccttcaatactttccatcgagcagcatggtgcacaccacctcgcctttttgttgaggatcagtatgatgtagttcctcctgacactgtatcggtcagttcacttggcaaaaggtcaacggcggaggaacctatcaagaaaaagaatccagctgctgtgaagattagcccatggacgttagcacgattaaatgcagaggatgtttcaaaagctgctgctgaagcaaggaagaaatcgaaaattctccagccagtggtgagaaacaaagaaccttacattcttgaaacgaatagcagtttaggaagtagcgggcgtcgcatggtgcctagggttgataacaatagaaggagagctagtaaacgagttcgactccctgcagagttaccctttgaaaccatgagtaaaattcccaatgatatagctcaaaacagtagaaggcccatgataactgagtcatcaagcagtttagctccccttcagcttgaagcacggagtgatttccgaacaacccgaggactgtccacctcaggtgttgttgttgcttcttcacctgagagtagtttggactctcccgacattcacccactccgggtttcatcctcaggagttgaagacgctgcacgtcttgtaggtcatctatcatctggaatgactcttcagaaggacactccattgtctagatcgactagtgatggatatgaggcatctggtggggaagatagtgatcgtgtgcctacccgaattgtgcaaaggtcaacaaggtggagtagcattctttttggctctgatcaacaagatgatagagtcagaagattgatggtcccgtcttcatcaagccaggctaacatcaggaagcattgaacctccaaacatacttgggaattcttctgtaagctcttgaagctacatgatctgttaacatttcttaatttgttgatgatgtttgtccagtagtatataccttcaacttggcctgttccattgtccattgagttcaaatttttggatttttgggtgagagaagtgctgtaaatgtctagtggaaaaaaaactttctattctcttgtcctcaaatgcagcattcaatgatcacttcttgctgccatcacttagatgtggatttctacttaacaatttttttgggagtgccttcaatgttctaatgttgggatctcttgcttgccttactattcttgatacaatgactacttaaatgtttgccagaggtt

SEQ ID NO: 5436 - DNA, 2704 bp, Nicotiana benthamiana
aaaataatgagtacccattttgtttcaagactcaaagctcttaccttttatctctcttcaacctcattgtgcttatggggttgtggattatgattgagtgaactagacaaaagcttacctatagcaatcaagccatatcccttcactccttccccacactccactgtcagtcaaacatgtattttgtttccctttgagcttcctttatttgtagctttcttgttttctccccttcccatttcttccattttcatatctcatgaaacatatacagtgaacggccattcaagatatcttggttttctgttgttctgtacaataaaaatagagtaaaaatcaagtctttttctccccccttttgcatttcttgaaaacttttttgttggctgctacattcaatcagcacaatgaggaaacatggatggcaacttccttatcatcctctccaggtggtagctgttgctgtatttctggcattgggatttgctttttatgttttctttgcaccttttgtggggaagaaattgtttcagtatgttgtcatggggctttatactcctcttataataagtgcatttggcttgtatatctggtgcgctggtgctgatcctgctgatccaggagtttttaaatccaagaagtatattaagaagctagacaacaaaaagcgagttcaacttaaagaatctaaattagggtgtgagacgaattcgtctatacaggacgctaatgctgcttcaattggagaaaatgcatctgtaaaaagcaataaaggagctgaatcagctgcagatcacaatgcaactcaaaagaaaattgcagctactcatcgaaggggcttgttggcgctactaccatgtgctcttatctgcaactgcacaggtacacatgaagaatcttcccagcaacagttgagcgaagatggcatgttctactgcagtttgtgcgaagtagaggtatttaaatacagcaagcattgtagagtatgcgacaagtgcgtcgatcagtttgatcatcattgcaggtggctgaacaactgtataggtaaaaagaactatcgcaagttctttaccctcatggtttctgcacttctcctgcttatacttcagtggtcaactggaatttttgtactgatctactgcttcatcgagaagaagaaattttctgtggaaatcacctccaaattaggaagcagtttctcccttgttccctttgttattgtggtggcagtctgtaccatattggccatgatagcaaccctgccacttgctcagcttttcttctttcacatacttctcataaagaagggaattagcacctacgactacatcattgctctcagagatcaagaacaacaaggagttgcaggtcagcaaagtcctcaaatgtcaactgtcagctccttgactggattaagcagtgcaagctccttcaatactttccatcgagcagcatggtgcacgccgcctcgcctttttgttgaggatcagtacgatgtagttgctcctgacactgtatcggtaagttcacttggtaaaaggtcaacggtagaggaaccaatcaagaaaaggaatccagctgctgtgaagatcagtccatggacgttggcacgattaaatgcagaggatgtttcaaaagctgctgctgaagctaggaagaaatccaaaattctccagccagtggtgagaaacaaagaaccttacacccttgaaacaaatagcagtttaggaagtagtggtcgtcgcatggtgcctaggcctgataacaatagaaggagagctagtaaacgcgttcgactccccacagagctgccctttgaaaacttgagcaaaattcctagtgatatagctcaaaacagtagaaatgctatcatgtccgagacatcaagtagtttggctccacttcagcttgaagcacggagtgatttccgaacaagccgaggactttccagctcaggtggtgttgctgcttcttcccccgagagtagtttggactctcctgacattcacccactccgggtgtcatcatcaggagttgaagaagccacacgcttcgtgggcctatcatctgggatgactcttcagaaggacactccactgtctaggtcgactagtgatggatacgaggcatctggtggagaggatagcgatcgagtgcctactcgcattgtgcaaaggtcaacaaggtggagtagtattctttttggctctgatcagcaagatgatagattgagaagattgatggtgccatcttcatcaagccaggctaacatcaggaaacattgagcctcaaaaacatactcggaattcttgtgtaagctcttgaagttacatgacctgttgacatttcttaatttgttgatgtttgtccagtagtatataccttcaacatgttcttgttccattggccgttgagttacaatttttgggttttgggtgagagaagtgctgtaaatgtttagtggaaaaagattatatcattctcttgtcctcaaatgcagcattcaatgatcacttcttgttgctatcatttggaagctggaattctagttgcgatcttttggagttcattcaatgttctatggagaaaccactgggttctcttgcttgccttaagtgttcttttttttatttttatttattttgaatcccccaatttaggtgaatctatagtagtttcccacttccccagggtggctcgaacc

SEQ ID NO: 5437 - DNA, 2303 bp, Capsicum annuum
gggagggctatattcatgtgtacatttcagttctggtttatctaatttgggaattcttgaattgtttgattttaggtatgtatctttttggcaggtggtagctgttgctgtatttctggcattgggatttgctttctatgttttctttgcaccttttgttggaaagacaatgtttcagtatattgtgatggggctttatactcctcttattattagtgcatttggcttgtatatctggtgtgctgctgctgatcccgctgatccaggagtttttaaatccaagaaatatctaaagaagctagacaagaaaaagcaagtccaagttaaagaatctaaattaggatgtgagacgaattcgtctatacaggatgttaatgctgcatcaattggggaaaatgcatctgcaaaaagcaataaaggaactgaaccagctgcagatcacattgaaattgaacaggaagttacagctactcgtcaaagatctcgctcttccggattgttggctctactaccttgtgctcttatcagcaactgtgcaggtagacatactgaatcttctcagcaacagttgagtgaagatggcatgttctactgcagtttgtgtgaagtagaggtatttaaatacagcaagcattgcagagtatgcgacaagtgtgtagatcagtttgaccatcattgcaggtggataaacaactgtatagggaaaaggaactatcgcaagttctttacgctcatggtttcagccctcctgctgcttatacttcagtggtcaactgggattcttgtgctaatctgctgctttattgagaagaagaaattttctgcggaaatcacctccaaattgggaagcagtttctccattgttccctttgttattgtagtggctgtctgtaccatattggccatgatagctactctgccacttgctcaacttttcttctttcacatactcctcataaagaagggaattagcacctatgactacatcattgctctcagagatcaagagcaacaaggagttgcaggtcagcaaagtcctcaaatgtccactgttagctccctaactggattaagcagtgcaagctcctttaatactttccaacgagcagcatggtgcacaccacctcgcctttttgttgaggatcagtatgatgtagttcctcctgacaccgtatcagtcagttcacttggtaaaaggtcaacggcagaagaaccaattaagaaaaagaatccagctgctgtgaagatcagcccatggacattagcacgattgaatgcagaggatgtttcgaaagctgcggctgaagcaaggaagaaatcgaaaattctccagcctgtggtgagaaacaaagatccttacgctcttgaaacaaatagcagtttaggaagtagcggacgtcgcatggtgcctaggcctgataacaatagacggagagctggcaaacgagttcgactccctgcagagctaccctttgaaaccatgagtaagatccccagtgatatagctcaaaacagcagaaggcccatgatgaccgagtcatcaagcagtttagctccccttcagcttgaagcacggagtgatttccgaacaaaccgaggactgtccacctcaggtgttgttgttgcttcttcacccgagagtagtttggactctcctgacattcacccactacgggtgtcatcgtcaggagttgaagacgctgcacgtcttgtaggccacctatcatctggaacgactcttcagaaggacactccattgtccaggtcaactagtgatggatacgaggcatctggtggggaggatagcgatcgtgtgcctacccgaattgtgcaaagatcaacaaggtggagtagcattctttttggcgctgatcaacaagatgatagagttagaagattgatggtaccgtcttcatcaagccagactaacatcaggaagcattgagcctccaaacatacgtgcgaattcttctgtaagctcttgaagcggcacgatctgttaacatttcttaatttgttgacgatgtttgttcagtagtatataccttcaaccgttcaacttggcctattccattgagttccattttttggattttgggtgagagaagtgctgtaaatgtctagtggaaaaagattatgtctattctcttgtcctcaaatgcagcattcaatgatcacttcttgctgccatcacttgcaagttggtctttacttaacaaatttttgtagtggcttgaatattcttatgctgggatctcttgcttgccttactgttcttgatacaatgactagttagatacttg

SEQ ID NO: 5438 - DNA, 1207 bp, Solanum phureja
aacaccgacaaaagaacacaaatgccgatctgtagctcttcttcatcttcttcctctagctccacaaaatcatggatccttcacggcttagccgtcggagcagcagtagccgtagctctcggcgctcacgcttaccttggccgatccggcaagtttaggagccgggtcataggcatcatacccgcccgttttgcttctactcggtttcaagggaaaccgctcgttcagatcctcggcaagcctatgatccagagaacatgggaaagggcaaagcttgctgagacattggatcaagttgttgtggcaacagatgatgaaaagatagctgagtgctgtcgtggttttggcgctgaagtgataatgacttctgaatcatgtagaaatggaaccgagcgttgtaatgaggctcttcaaaagcttgataagaagtatgacattgttgttaatatacaaggagatgaacctcttattgaacctgaaataatagatggcatcgtcaaagccctacaggctgcacccgatgcggtctttagcactgctgtgacatctttgaaacctgaggatgcatttgatccaaatcgtgttaaatgtgtggttgacaatcgtggttatgcaatatatttttcacgagggctcatcccttataacaagtcaggcaaggttaatcctcagtttccttacttgctgcacctcgggatccagagttatgatacgaagttcctgaaaatatatccagagctgacaccaacaccattgcaactagaagaagatcttgagcagctaaaagtccttgaaaatggatacaaaatgaaggtgataaaagttgaccacgaggctcatggtgttgacaccccggaagatgtcgagaagatagagcagttcatgcgtgagagaaacatggcttagagcaaaatgagttattttgatgacttacatatgactcctacagctataaaggtggtgttctttggtttcaatttccgctttaattagcacgttaattaatctctcagcgttaacttttgtgaagaaaaaagaaataggaactgaacttgctgtataaatcctgcaaatagttcatactgtagagttgtttgaagtgtatgtttcacttaggtattcatttgttgtagcaaggttgtgtattcacattttctttcatattttacagttaattaatgtgtatttattaactatgatttagtga

SEQ ID NO: 5439 - DNA, 999 bp, Capsicum annuum
attctaataagaggcctctgcaatttcgcaatgactatctgtgattcatcatcttcctctgggtcctcaacaaaagcatggatccttcacggcttagctgctggagctgcattagccatagctgccggcgctcaggcttactatggtcgccgatccggcaagtatcggagtcgagtcatagggatcatacctgcacgtttttcttctactcggtttcaaggcaaaccactcgttcacatcctcggcaagccaatgatccagagaacatgggaaagggcgaagcttgctgagacattggatcaagtcgttgtggcaacagatgatgaaaagatagctgagtgctgtcgtggttttggtgctgaagtgataatgactgctgaatcatgtagaaatggaaccgagcgttgtaatgaagctcttcaaaagcttgataagaagtacgacattgttgttaatatacaaggagatgaacctcttatcgaacctgaaatcatagatggcatcgtcaaagccctgcaggctgcaccagatgcggtctttagcactgctgtgacgtctttgaaacccaaggatgcatttgatccaaatcgcgtaaaatgtgtggttgacaatcgtggttacgcaatatatttttcacgaggacttatcccttataacaagtcaggcaaagttaatccgcagtttccttacttgctgcacctcgggatccagagttatgatacaaacttcctgaaagtatatcccgagctgacaccaacgccgttgcaactagaagaagatcttgaacagcttaaagtccttgagaacggatacaaaatgaaggtgataaaagttgaccacgaggctcatggcgttgacaccccggaagatgtagagaagatagaacagttcatgcgcgatagaaacttggcatagagcgaaacgagttactttgatgacttatatgaacgataaaggtgacgttttttggtttcaatttccacgtggattcatgggcgg

SEQ ID NO: 5440 - DNA, 1359 bp, Solanum melongena
atagaaaacttgcatgttactcgaaaccgaatcaagcattttccaattgtgaagaacaaatggcgatctgtgactcatcatcgtcttcatatggctccacgaaagcttggatccttcacggcttagccgtcggagctgcgttagccgtagctctcggcgcccacgtttaccatagacgatccggcaagtttcggagccgggtcataggcattatacccgcccgttttgcttcttccaggtttccagggaaaccgcttgttcagataattggcaaacccatgatccagagaacatgggaaagggcaaagcttgctgagacattggatcaagttgttgtggcaacagatgatgaaaggatagctgagtgctgtcgtggttttggtgctaaagtgataatgacttctgtatcatgcagaaatggaaccgagcgttgtaatgatgctcttcaaaggcttgataagaagtatgacattgttgttaatatacaaggagatgaacctcttattgaacctgaaatcatagatggcattgtcaaagccctgcaggctgcaccagatgcagtctttagcactgctgtgacatctttgaaatctgaggatgcatttgatccaaatcgtgtaaaatgtgtggtagataatcgtggttatgcaatatatttttcacgagggctcatcccttataacaagtcaggcaaggttaatcctcagtttccttactcgctgcacctcgggatccagagttatgatgcaaaattcctgaaaatatatccagagctgacaccaacaccattgcaactagaagaagaccttgaacagctaaaagtccttgaaaatggatacaaaatgaaggtgataaaagttgaccacgaggctcacggtgttgacacccctgaggatgtcgagaagatagagcagttcatgcgtgagagaaacttggcttagagcaaaatgagttattttgatgacttacatatatgactcctatagctacaaaggtggtgttctttggtttcaatttgcgcttggattagcatatcaattatccctccaagctaattttcacaaaggaaaaagaaatcgagactgaacttgctgtataaatcctgcaaatagttcatactgtagagttatttgaagttatgtttcacttaggtattcatttgtcttggggaggttgtgtattcacatactttcatattttaccactatggttgaagacacgtgtcatgtatttattgagttgatataaatacccagtatgggtaagtacttaccgcgctctgtattgtgtgatagttgaggttgggggcaccttattggaattattttgagatacatttttcctgaggccttatccaag

SEQ ID NO: 5441 - DNA, 1299 bp, Capsicum annuum
aatacagaagcaaacgtagatttgatctgcactgagctaaatttagttcactccatcactagaattcacaatcgataaccaaatgtcgtcatcgtcttcgtcttcgtcttcgtcaagctcttcaaaatcatggatcataaatggtctggctataggagctgcaatggctgcggctctcggtgctcgcgcttacctggcccgatccggcaggtttcggagtcgggtcattggaattatacccgcccgttttgcttctactcgctttcagggtaaaccgcttgttcatatcctgggcaagccgatgatccagagaacatgggaaagagcaaaacttgctgctaccttggaccacgttgtcgtggcaacagatgatgaaaagattgctgagtgctgtcaaggttttggtgcagaagtaatcatgacctctgaatcatgtagaaatggaaccgagcgatgtaatgaagctcttcaaaagcttggaaaaaaatatgacattgtcgttaacatacaaggagatgaacctcttatagaaccagagataatagatggcattgtcaaagccctgcaggctgcaccagacgcggtcgttagcactgctgtgacgtctctaaaacctgaggatgcatttgatccaaatcgtgtcaaatgtgtggtcgacaatcgtggttatgcaatctatttttcacgaggattgatcccttataacaagtctggcaaggttaatcctcattttccgtacttgttgcacctaggaattcagagctacgattccaagttcctgaaaatatatccagaattggaacctacaccattgcaacttgaagaagatcttgaacaattgaaggtccttgagaatggatacaagatgaaggtgataaaagttgaccatgagactcacggtgttgactccccggaagatgcagacaagatagagcagttcatgcgggagagaaacttgtcttagagcagattaagtttctgttggataactttggtgatgtttagagatatagacgttgagctttctggaaaccattctcagtcggactcagtgcaccattgttgttgctgaattatatactcgaacttagaaataggaagtagctgcattcaatcctgcgaagttcaaattttgccgtttgtgatgtatacggtcttcaaccttgctagggacctagttatttccgtttatttcctaggctatgcatttctaattgtttcaatgagtggaattgtgtgatttagattatgtctacagggcagccctccgactgtcgaatatatacattttctccagag

SEQ ID NO: 5442 - DNA, 830 bp, Solanum tuberosum
agaacacaaatgccgatctgtagctcttcttcatcttcttcctctagctccacaaaatcatggatccttcacggcttagccgtcggagcagcagtagccgtagctctcggcgctcacgcttaccttggccgatccggcaagtttaggagccgggtcataggcatcatacccgcccgttttgcttctactcggtttcaagggaaaccgctcgttcagatcctcggcaagcctatgatccagagaacatgggaaagggcaaagcttgctgagacattggatcaagttgttgtggcaacagatgatgaaaagatagctgagtgctgtcgtggttttggcgctgaagtgataatgacttctgaatcatgtagaaatggaaccgagcgttgtaatgaggctcttcaaaagcttgataagaagtatgacattgttgttaatatacaaggagatgaacctcttattgaacctgaaataatagatggcatcgtcaaagccctacaggctgcacccgatgcggtctttagcactgctgtgacatctttgaaacctgaggatgcatttgatccaaatcgtgttaaatgtgtggttgacaatcgtggttatgcaatatatttttcacgagggctcatcccttataacaagtcaggcaaggttaatcctcagtttccttacttgctgcacctcgggatccagagttatgatacgaagttcctgaaaatatatccagagctgacaccaacaccattggaactagaagaagatcttgagcagctaaaagtccttgaaaatggatacaaaatgaaggtgataaaagttgaacacgaggctcatgg

SEQ ID NO: 5443 - DNA, 1356 bp, Nicotiana benthamiana
cacaaatcacattgtcgcgagactcgaccttcctcgctgaaactcgcaagatctaccaatttcttcaattctccattttcttccattaataagaaaatcaaatgccgatcatcagttcaaattcatcttcttcctcttcaaaatcatggatccttcatggtctagctgcgggagctgcaatggccgcggttctcggggctcgagcgtatcttggccgatccagcaagtttcggagccgggtcattggcattatacccgcccgttttgcttccactcgcttccagggtaaacccctcgctcatatcttgggcaagcccatgatccagagaacatgggaaagggcaaaacttgctgctaccttggatcacgttgttgtggcaacagatgatgaaaagatagctgcgtgctgtcaaggttttggtgctgaagtaataatgacttctgaatcatgtcgaaatggaaccgagcgttgtactgaagctcttcaaaagcttgcaaagaagtatgacattgtcgttaacattcaaggagatgaaccacttattgaacctgagataatagatggcattgtcaaagccctgcaggctgcaccagatgcggtctttagcactgctgcgacgtctttgaaacctgaggatgcatttgatccaaatcgtgttaaatgtgtggttgataatcgtggttatgcaatctatttttcacggggattgatcccttataacaagtctggcaaggttaatcctcagtttccttacttgctgcaccttggaattcagagctatgattcgaggttcctgaaaatatatccagaattagaacctacgccattgcaacttgaagaagatcttgaacagttgaaggtccttgagaatggatacaagatgaaggtgataaaagttgaccatgagactcatggtgttgacactccggaagacgtagacaagatagagcggttcatgcgggagaggaacttgtcttagaacagagtaagtttatattggatgactttggtgttgtatagagctatagatttgagctttctggaggccattcttaattggaattagtgcacaattgatgttactgaattatacatgtgaagatgaaagaacaatcctgcaaatagttcatattttggtgtttgtactgtcttcaaccttgctggggagtagggactagttatttccaacgatttgcaagattatgtgtttcttattctttcagtgttggaatactggaatttgggttatgtctacagggcaccctctgtctttgcctaacactacactgcgtgaaagcgctttagaggtacaagctgactgttgaatgtagactttttcctaggatgtgaataag

SEQ ID NO: 5444 - DNA, 914 bp, Manihot esculenta
atcattcgaccaatgtcgatgtgctcttcttcttcgtcgtcgtcgtcgtcgtcggccaagttatggattgtgcatggtattgtggctggtgctgcgatagctgctgctttcggtgctcgtgcttatcttggtagatccggaaagttccgaagccgggttgttggaatcattcctgcccgttttgcttcctctcgattcgagggcaagccactagttcaaattctagggaaacctatgattcagagaacttgggaaagagcaaaattagctactaccttggatcgcatagttgtggcaacggatgatgaaaagattgcagagtgttgtcgtggatttggggcagaagtgataatgacttcagaatcttgtagaaatggcacggagagatgcaatgaagcacttggaaagctagaaaagaaatatgacgttgttgtcaatattcagggggatgagcctctcattgaacccgaaataatagatggaattgttaaagcactgcaggcatccccagatgcagtgtttagtactgctgtaacatctttaaagcctgaagatgcatttgatcccaatagagtgaaatgtgtggtggacaatcgaggttatgctatttatttttcaaggggactcattccgtataataagtcaggaaaagtcaacccacaatttccatatttgcttcatctcggaattcagagctatgatgcaaagtttttgaagatatatccagaacttaaacctactccactacaactggaggaggatctggagcagctgaaagtccttgagaatggttataaaatgaaggtgataaaagttgaccatgaggcacatggtgttgacattccagaggacgttgaaaagattgaaactttgatgcgtgagcaaaatttgtcctagtttatacaaaccaaatt

SEQ ID NO: 5445 - DNA, 1190 bp, Vinca minor
acaaggtggatctcatctcacttcttattcccgcacttccaactgtttctgcgaaatccgatcgcaaaggttgataatcaccgagtgaattttttctctgatgaatcaatgacgatctgttcatcttcgtcatcgtcttcatcttcaagctcaagtaataaatcatggatatttcacggcattgctgttggggcagctattgcggtggcgattggggcacatgcttacctttatctccgccgtcccaataagtttcggactcaggtgatcggaattatacccgcccgttttgcttcctctcgcttccctggcaagcctcttgctcagatccttggtaaacccatgattcagagaacttgggaaagagcaatactggcttcatccttggatcatgttgttgtggcaacggatgatgagaagattgctgaatgctgtcgaggatttggtgctgatgtggttatgacatcagaatcgtgtcgaaatggtactgagcggtgtaatgaagctcttgaaatgatggggaataagtatgatattgttgttaatattcagggagatgaacctcttattgaacctgaaataatagatggaatcgtcaaagccctgcaggctgctccggatgcagttttcagcactgcagtgacttctttgaatcctgaagatgcatttgatccaaatcgtgttaagtgtgtagtggataatcgtggttatgctatctatttctccagagggctgatcccatttaacaagtcaggaaaagtgaatcctaaattcccatacttgcttcatcttgggattcagagctatgacacaaagttcctgaagatatacccagagctaactccaaccccacttcaacttgaagaagatcttgaacaacttaaagtccttgagaatggatacaagatgaaggtgataaaagttgatcatgaggcccacggtgtagatgcccctgaagatgtagagaagatagaacgtttcatgcgtgagaggaacttagcttagtttgcggatttgcagaaactactcaaagttttagaggtacattactataaactttggttttccagtccagttcgatctttccatccgtggctgttttcttcaagcgcggatcacgttggtgttggtcaaaagaaaataacttgaaggtacaattgaggataaagtgtaaactagttctcataggg

SEQ ID NO: 5446 - DNA, 1433 bp, Ricinus communis
atttggtacgagcgtggcattttatccgaatttgaccttttcagcttttcttttgctttttcgcccaagaattatttccagcaccaacaatgttatttcagattccctattcggttcagtggcctcgttgagaaatttgatctttactagtggcaaatcaatgaaagctcccgctatggacgtatatataaactgcggtgcagttagctacgaaatcgatcgtcttggagcacagagctttagattttttttttatggtgattattatatgctgccacatggtagcacgcaacgttgccacgttggcgcagcaggtgataatcctcctttttagacataagtcatctgtgtttctccagtcgacgactggcgttcatcactaacaataaatttcgaggtgagactaaatagagatcacttcaatctataactaataatcttgattttatctaattacgagaccaatgtcaatctgctcatctaattcctcatcctcgtcatctgggtccaagtcatggattgtgcatagtattgtggctggagctgctattgctgtaggtattggtgctagagcttatttgtctcgatctagaaagtttcgaagccgggttataggaatcatacctgctcgattcgcttcctctcgctttcaaggcaaacctcttgtccaaattttggggaaacccatgatccagagaacttgggaaagggccaaactggcaactactttggatcacataattgtggcaacggatgatgaaaagattgcagaatgttgtcgtggatttggggcagatgtcataatgacttcagaatcttgtagaaatggtacagagcggtgcaatgaagcaattggaaaactggaaaagaaatatgatgtggttgtcaatattcagggggatgagcctctcattgaacctgagataatagatggaattgttaaagcgctgcaggaagccccagatgcagtctttagcactgctgtgacatctttaaagcctgaagatgcatttgatcccaaccgagtgaaatgtgtggtggataatcaaggttatgcaatctatttttcaaggggactcattccttataacaaatcagggaaaatcaatccacaatttccatatttgcttcatcttggaattcagagctatgatgcaaagtttctaaagatatatccagagcttcagcctacaccattgcaactagaagaagatctagaacagcttaaagtccttgagaatgggtataaaatgaaggtaataaaggtagaccatgaagcacatggcgttgacgctccggaggatgttgaaaagattgaaagattgatgcgggaacacaatgttttatagtttaatactgtcatgaaattacaggttctataatgtttcatatattactaccggagaaaggctgcaagttcagttgtattatgc

SEQ ID NO: 5447 - DNA, 1028 bp, Nicotiana benthamiana
actcttaccaaaacacaagaagaagaaaaagcaagacgcaaatcacattgtcaaccttcctcgctgaaacacacgagatttgccaatttcttcaattctccattttctatcgttaataagaaaatcaaatgcccattgttacttcaaattcatcgtcttcctcttcaaaatcatggatccttcatggtctagctgcgggagctgcaatggccgcggctctcggggctcgagcgtatcttggccgatccggcaagtttcggagccgggtcattggcattatacccgcccgtttttcttccactcgcttccagggtaaacccctcgctcatatcttgggcaagcctatgatccagagaacatgggaaagggcaaaacttgctgctaaccttggatcacgttgttgtggcaacagatgatgaaaaggtagctgcgtgctgtcaaggttttggtgctgaagtaataatgacttctgaatcatgtagaaatggaaccgagcgatgtactgaagttcttcaaaagcttgcaaagaagtatgacattgtcgttaacattcaaggagatgaaccacttattgaacctgagataatagatggcattgtcaaagccctgcaggctgcaccagatgcggtctttagcactgctgtgatgtctttgaaacctgaggatgcatttgatccaaatcgtgttaaatgtgtggttgataatcgtggttatgcagtcttatttttcccggggattgatcccttataacaagttaggcaaggttaatcctcagtttccttacttgctgcaccttggaattcagagctatgattcggagttcctgaaaatacatccagaattggaacctacaccattgcaacttgaagaagatcttgaacagttgaaggtccttgagaagatgaaggtgataaaagttgaccatgaaactcatggggttgacaatccggaagacgtagacaagatagagcggttcatgcgggaaaggaacttgtcttagatcagtgtaagtttatattggatgactt

SEQ ID NO: 5448 - DNA, 1408 bp, Panax ginseng
tatcaacgcagagtacatgggggacggagagagtattgttttgatttcctctccatttttctcctagaaaattccttttccactcgatctgattctttccgttacctcgctccgggatccaaaggtacaaggagtacctttctactccttattaaacaatacatacataaaacccgatgtcgatctgtacttcatcatcttcttcttcgagcaccacagccaaagcatggattgtccacggcattgccgtcggagccgcaattgcggtggctgtcggcgcttatctcggtcgatccagtaaattccggagccgggtggttggaattatacccgcccgcttcgcttccactcgtttccaaggcaagcctctagttcagatactcggcaagcccatgatccagagaacatgggaacgtgcaaaattggcaacaacattggatcatcttgttgtggcaactgatgatgaaaaaattgctgactgttgtcgaggatttggtgctgatgtgataatgacgtccgaatcttgccgaaatggtactgagcgctgtaatgaagcactgcaaaagcttgcgaaaaagtatgatgttgttgttaatatacagggggatgaacctcttatcgaacctgatataattgatgggattgtcaaagcactgcaggctgctccagatgcagtgtttagcactgctgtcacatccttgaaacctgaagatgcatttgatccaaatcgtgtgaaatgtgtggtggataataatggttatgcaatctatttctcacgaggactgattccacataacaagtcagggaaggtcaatcctcaatttccatatttgcttcatcttggaattcagagctatgattcaaagttcctcagaatatatccggtgctgccacctactccgctgcaattagaagaagatctggagcagctcaaagtccttgagaatggatataagatgaaggtgataaaagttgaccataacgctcatggtgttgacaccccagaagatgttggaaagatagaaagtttcatgcgggagcataacttgttttagttctggcagacgcaagatcttctctagtatatgtatattggaaacgagagtacatttttatcagtgacatttatggatcaatactgtaactttttcctcagtcatacaattctgtaaattaattagtttatacggtatgtatatttactggatgtctggatgagaaaccgctgttctttgaatgaggaatgaaaataggctcatcatctgatgcagaactgaacgttaatgtatcaatgatatattttgtgattttatataaaacgaaaaaaaaaaaaaaaaaaaaaaacaaaaaaaaaacaaaaaaaaacaaaaagtaagagagagagacacagagagagcccccccccccc

SEQ ID NO: 5449 - DNA, 1587 bp, Mimulus guttatus
aaccagtttgtagagtgtgatttgaaatcgactgtttgttgatccaaacggttaatacctcccccacaagtagcaccaaatttccgtgctaccttcttctcccctttcttcattcgtctgtgcagatgccgatctgcaatccgtcttcttcgtcttcatcttcaagctctagctccaccaagtcctggattattcacggcctggcggttggggcggcggccgcggtggcgatcggcgcccatgcctacttcaattaccgccgatctggaaaattccggagccgggtcatcggaattatacccgcccgtttcgcttcatctcgctttgagggaaagcctctcgttcatattctcggcaagccaatgatccagagaacatgggaaagagcgaaaatggcaacttcattggatcatgttgttgtggcaacagatgatgataagattgctgaatgttgtagaggatttggtgccgatgtggtaatgacatcggaatcttgccggaacggcaccgaacgatgtaatgaagcacttcaaaagctcggtaaggaatacgatgttgttgtcaatattcagggcgatgaaccgctcattgaaccagaaattatagacggcattgttaaatccttgcaggcttctcccgatgcagtcttcagcactgcagtaacttctttgaaatacgaagatgcactcgatccgaatcgtgtcaaatgtgtggtggacaatcatggatacgcaatttatttttcacgaggacttataccatttaacaaatcgggaactgtcaaccctcgatttccatatttacttcatctgggaattcagagctacgattcaaagtttctcaagatatatccagagctaccgccaactccgcttcaactggaagaagatcttgaacaactgaaagtcctcgaaaatggatacaaaatgaaggtgattaaagtcgaccacgaggcccacggtgtagatgtcccagaagatgtagctaaaatcgagcagtacatgcgcgaaaggaacttgcattagcagcctgcctgcctgtatattttgcttacaatacctacttacatagtgagtttcacttgtgcatattgttggaatgaattcttttaaatcctataatatgctgtgaaaattggcttctattttattgcagcgctgatctgttgaaagtagaaaagacttgtgtgcagagtttttatgttggaaatgtacaaactcaatcatttgattcgatttgtgtatactaatgccctgtaattcattttcatataggagtgtaagaacttgtgtaagaacaaagaagacacccaattcgatttgtattggctttccaagggaatttggattttgggaaaaaaaaaaaaaaaaagaagcaaattaaataaatgattttgtttgagtttgcgtgtaaagatggtggaacagagggaaaatatatatatgttgtgtcaatcaaccacttcccaattatgataacacttctgccatttttttatttcaaaattgaactcttctgcacaaggaaggctcataattttgtcttcttcagcctcaaagggggaccaccatcaaaagttcaaaacag

SEQ ID NO: 5450 - DNA, 1238 bp, Vitis vinifera
gtcaaattacagtgacactcatccttacttccacgcctagcgaaaacgagagagatcaatccaatggctgtgtgttcctcatcttcttcttctggatcttcatccaacaccaaagcctggatcatccacggcattctcaccggcgctgcggtggccgtggccctcggcgcccacgcttaccttctcctccgccgatccggcaagttcaggagccgggtcgttggaattataccggcccgtttcgcttcgtctcggttccaggggaagcctctcgttcagatccttggaaagcccatgatccagagaacatgggaaagggcaaaactagcaacaacattggatcatgttgttgtggctacggatgatgataagattgcagattgctgccgaggatttggtgctgatgtgataatgacgtcagaatcgtgccgaaatggtactgaacgttgcaatgaagctcttcaaaagctagagaagcagtacgatattgttgtcaatatccagggggatgagcctcttattgaacctgagataattgatggggtcgttaaagctcttcaggcagccccagatgcagtgtttagcactgctgtcacatctttaaaacctgaagatggatttgatccaaatcgggtgaaatgtattgtagacaatcgtggttatgcaatctatttttcaaggggactgattccctttaataagtcaggggaagtcaaccaacagtttccatatctgcttcatctcggtattcagagctatgatacaaagttcctcagaatatatccagaccttccacctacaccacttcaactcgaggaagacctggagcagcttaaagtccttgagaatggatataagatgaaggtgattaaggttgatcatgaggctcacggtgttgacactccagaagatgttgacaagatagaaagcttcatgcgcgagaggaacttgtcttagttcatagcacagaaaacaaccactggaaaaatcgtatactggtaattagattgcattcagctacattcttctccattacagttctgtgtggtccatctaaacaaaatcatcaaaagggaacatattgaagccatttaacttttgtattttcattcccctaagctcagttagttaggtcaggttgatccatgaaatgtttagggttttttaatactctgttgttcatgtatgtgaactatagtttacagtttcaattgagagactctactattgtctttccc

SEQ ID NO: 5451 - DNA, 982 bp, Tabernaemontana elegans
cgtcttcctcttcgtcgtcttcgtcttcgagctcaagcaaagcatggatttttcacggccttgctgttggggcagctgtagctgtggcaattggggcacatgcttacctttatttccgcaggccgagcaagtttcggacaagggttatcggaattatacctgcccgttttgcttcctctcgcttcccggggaagcctctcgttcggatcctcggtaaacccatgattcagagaacttgggaaagggcaaaattggcttcatccttggatcatgttgtggtggcaacggatgatgagaaaattgctgaatgctgtcgaggatttggtgctgatgtggttatgacatcagaatcgtgccaaaatggtactgagcgatgtaatgaagctcttgaaatgctcgggaagaagtatgatgttgttgttaacattcagggagatgaacctcttattgaacctgaaataatagatggaatcgtcaaggcattgcaggctgcaccagatgcagtttttagcactgcggtgacttccttgaagcctgaagatgcatatgatccaaatcgtgtaaaatgtgtagtggataaccatggttatgctatctatttctcccgaggactggtcccgtttaacaagtcaggaaaagtaaatcctaaattcccatacttgcttcatcttgggattcagagctatgacacaaagttcctgaagatatacccagagcttccgccaaccccactgcaacttgaagaagatcttgaacaactgaaagtccttgagaacggatacaagatgaaggtgataaaagttgatcatgaggctcatggtgtagatgcccctgaagatgtagagaagatagaacattttatgcgtgagaggaacttagcttagtttggggattcatagaaactactcaaaagttttatcagtatgctactataaacttttggttttctagtctactttcgcctttgcatccgtctgttttc

SEQ ID NO: 5452 - DNA, 1021 bp, Chelidonium majus
gatggattctacgtcatcatctggatcaggtagtagtagtagtagcaagtcttggatcctatgcagtcttgctgccggagctgcaattgcagcgtcagcagccggggctttccattttcaaggtggatccagaaaattccgttctcgagtgatcggtataatccctgcccgtttcgcgtcctctcgattccaaggcaaaccccttgttcaaatcctcgggaaacccatgatccagagaacgtgggaaagaacgaaattggccaccacattagaccatgttgttgtcgcaacggatgatgaaaagattgcagaatgttgtcgaggttttggagccgatgttataatgacatcagaatcctgccgaaatggcacagagcgttgcaatgaagcactagagaaacttaataagaaatatgatattgttgtcaatattcagggggatgagcctctcattgaacctgagattattgatggggttgtgaaagctctgcagggagctcctgatgctgtttttagcaccgctgtaacatctctaaaacctgaagattcaatggatccaaacagagtgaaatgtgtagtggacaatcgtggctatgcaatctatttctcgagaggactaatcccatataataaatcaggacaagtcaatccaaacttcccttatttacttcatcttggtatccagagctacgacaccaagttcctaaagatatatccagagcttacgcctactccgctgcaactagaagaagatttggaacaacttaaagtccttgagaatggctataaaatgaaggtgatcaaggtcgaccatgatgctcatggtgtagacactccggaagatgttgagaagatcgaaactcttatgcgtgaaagaaatatatcttagtccaactgcaatgaaaagagaaaatataagccaaaagagcatctaaatatcagtagagagatcaacctttcctacattctaaggtggattctttagtgtattccaagtgtaatcaagtattgaattctgcat

SEQ ID NO: 5453 - DNA, 1156 bp, Ocimum basilicum
ccaagtgtaaactagcagtagcatgtggatctaaatcacgacggctgatgccacactccgcctcatccaaattcctctgaattctcttgcaaaatgcccatttgcgatccctcctcgtcttcctccgcctccgcctccgccaagtcctggatcatccacactcttgcggcggcggcagtggccctcggcgcccatgcctacatttattatcgccgatccggcaagtttcggagccgggtcatcggaattatacccgcccgctttgcttcctcccgcttccaggggaagcctctcgtccacatcctcggcaagcccatgatccagagaacatgggagagagctaaaatggcgacctccttggatcatgttgttgtggcgactgacgatgagaaaattgctgaatgttgtagaggttttggtgccgatgtggtaatgacatcggaatcatgccggaatgggaccgagcgctgtaatgaagcgcttacaaagttgggtaagcaatatgatgttgttgtgaatatccagggcgatgagccgctcatagaacctgaaataattgatggcattgtcaaggcgctgcaggctgctccagatgcagttttcagcactgcagttacttctttaaaacctgaagatgcaaacgatccgaatcgtgtcaaatgtgtggtggataaccatggctatgctatttatttctctcgaggactaataccatttaacaagtccgggagtgtcaaccctcagtttccatatttacttcatttggggattcagagctatgacacgaagtttctcacgatatacccagagctgcctccgactccacttcagctggaggaagatcttgagcagctgaaggttcttgaaaatggatacaagatgaaggtaataaaagttgagcatgagtgccatggtgttgatgtcccggaagatgtagataaaattgagagattcatgcgcgaaaggaacctgaattaggtagctgatcacatgatttctggtgttgataaaccgttgagtttgcttctcctgggcttcctttatgtcatgatcggattctacagatttgtactagatttattgtgtgtaatttaattaattagtttgtttggtatggtttcgttgtgaaattatattagtttgtaggtggaaattt

SEQ ID NO: 5454 - DNA, 1305 bp, Petroselinum crispum
gtgtacatagacttgtgacatattgactgacagacagagtatcttgttaagtgacactttgtgggtagttgaaaatgaatcccatgtccatttgcaaatctgaatcttcatcttcatcgtcttcaaacaaatcatggatcgtgcacagtctacttgttggtgctgcggtggcggtagctgtcggtgctcatctccggctaactagtagatttcgaagccgtgtggttggaattattccggcgaggtacgcttctacccgcttcgaaggcaagcctcttgttcaaatcctcggcaagcccatgatccagagaacgtgggaacgtgcaaatttagcgacaacactggaccatgttgttgtggccacggatgatgaaaaaatcgctagctgttgtcgaggatttggtgctgatgttataatgacatccgaatcttgtcgaaatggtactgagcgatgtaatgaagcccttcaaaaacttaaaaagaagtatgatgttgttgtcaatatacaaggggatgaaccactaattgaacctgaaatcattgatgggattgtgaaagcattgcagggtgctcctgatgcagtgtttagcacagctgtgacagccttagcacctgaagatgcatttgatccgaatcgtgtgaaatgtgtggtggataacaggggttatgcaatttatttttcacgaggattgattccttataacaagtcagggaaagtcaatccgaaatttccatacttgcttcaccttgggattcagagctttgatacgaagttcctaaaaatatatccagaacttccacctacccctctgcaactagaagaagatctagagcaactaaaagtcctggaaaatgggtacaagatgaaggtgataaaagttgaccacaatgcccatggtgttgataccccagaagatgttgaaaagatcgaacgttatatgcgtgagagaaatttgtcttagtcctgcaggtgcacagaagttctctatagaatatagtctgggaaggaggatgttcttccccactcccggaatctgattttgtcagcaaaggtttttgacaaagcccggactacgtttatttttccatattgcattagagtgttcataatatggattaagaaacttttataatgttccaatgctttgtaatttgagagatactttagcattttcttctttctactgtaattttaagctggtaactgtaatttctttcatatacctgtgcattttatcttcggagttatcttttgtaggttttgattgctttttataaactattacagaacttatatttaacaca

SEQ ID NO: 5455 - DNA, 1267 bp, Panax ginseng
gatttcctctccatttttctccttttctttcgttttccactcgatctgattctttccgttacctcgctccgggatccaaagcccaaaggtacaaggagtaccattctacttcttattaaacaatacatacataaaacccgatgtcgatctgtacttcatcatcttcttcttcgagcaccactgccaaagcatggattgtccacggcattgccgtcggagccgcaattgcggtggctgtcggcgcttatctcggtcgatccagtaaattccggagccgggtcgttggaattatacccgcccgcttcgcttccactcgtttccaaggcaagcctctagttcagatactcggcaagcccatgatccagagaacatgggaacgtgcaaaattggcaacaacattggatcatcttgttgtggcaactgatgatgaaaatattgctgactgttgtcgaggatttggtgctgatgtgataataacggccgaatcttgccgaaatggtactgagcgctgtaatgaagcactgcaaaagcttgcgaaaaagtatgatgttgttgttaatatacagggggatgaacctcttatcgaacctgatataattgatgggattgtcaaagcactgcaggctgctccagatgcagtgtttagcactgctgtcacatccttgaaacctgaagatgcatttgatccaaatcgtgtgaaatgtgtggtggataataatggttatgcaatctatttctcacgaggactgattccacataacaagtcagggaaggtcaatcctcaatttccatatttgcttcatcttggaattcagagctatgattcaaagttcctcagaatatatccggagctgccacctactccgctacaattagaagaagatctggagcagctcaaagtccttgagaatggatataagatgaaggtgataaaagttgaccataacgctcatggtgttgacaccccagaagatgttggaaagatagaaagtttcatgcgggagcataacttgttttagttctggcagatgcaagatctgctctagtatatgtatattggaaacgagatgacatttatggatcaagactgtaactttttcctcagtcatacaattctgtaaattaatttgtttatacggtatgtatatttactggatgtctggatgagaaaccgctgttctttgaatgaggaatgaaaataggctatcatctgaggcagaactgatgtgaacgttaatgtagtaattatatattttgctattttatg

SEQ ID NO: 5456 - DNA, 1362 bp, Panax ginseng
agtcttggtcgccaaagaacattacccatagtatattggtattgttttgatttcctctccatttttctccttttctttcgttttccactcgatctgattctttccgttacctcgctccgggatccaaagcccaaaggtacaaggagtacctttctacttcttattaaacaatacatacataaaacccgatgtcgatctgtacttcatcatcttcttcttcgagcaccactgccaaagcatggattgtccacggcattgccgtcggagccgcaattgcggtggctgtcggcgcttatctcggtcgatccagtaaattccggagccgggtcgttggaattatacccgcccgcttcgcttccactcgtttccaaggcaagcctctagttcagatactcggcaagcccatgatccagagaacatgggaacgtgcaaaattggcaacaacattggatcatcttgttgtggcaactgatgatgaaaatattgctgactgttgtcgaggatttggtgctgatgtgataatgacggccgaatcttgccgaaatggtactgagcgctgtaatgaagcactgcaaaagcttgcgaaaaagtatgatgttgttgttaatatacagggggatgaacctcttatcgaacctgatataattgatgggattgtcaaagcactgcaggctgctccagatgcagtgtttagcactgctgtcacatccttgaaacctgaagatgcatttgatccaaatcgtgtgaaatgtgtggtggataataatggttatgcaatctatttctcacgaggactgattccacataacaagtcagggaaggtcaatcctcaatttccatatttgcttcatcttggaattcagagctatgattcaaagttcctcagaatatatccggagctgccacctactccgctgcaattagaagaagatctggagcagctcaaagtccttgagaatggatataagatgaaggtgataaaagttgaccataacactcatggtgttgacaccccagaagatgttggaaagatagaaagtttcatgcgggagcataacttgttttagttctggcagacgcaagatcttctctagtatatgtatattggaaacgagagtacatttttatcagtgacatttatggatcaatactgtaactttttcctcagtcatacaattttgtaaattaattagtttatacgatatgtatatttactggatgtctggatgagaaaccgctgttctttgaatgaggaatgaaaataggctcatcatctgaggcagaactgatgtgagaggcaaacgttaatgtagtaattatatattttgctattttatataaagttaaatcttataatgactg

SEQ ID NO: 5457 - DNA, 1243 bp, Actinidia deliciosa
cacatccactctctctctctctctctctcgtccacactcccaatcgagtcccaacacatctaaacccaaaatcatcacaagttttatggacccaacgtcgttctgcgctccgtcatcttcgtccggatcgtcaagctccaccaaagcctggatcgtccacggcctcgtagttggggccgcggtcgcggtggctctcggggcccacgcctacctctacctgggccgatccggcaagttccggagccgggtcatagggatcatacctgcccgcttcgcctcgtctcgcttcccgggaaaaccactcgttcagatcctcggaaaacccatgatccagagaacgtgggaaagggcaaaaatggcaaccacattggatcaagttgttgtggcaacagatgacgaaaaaattgctgagtgctgccgaggatttggcgcagatgtgataatgacatcagaatcatgcctcaacggtaccgagcgttgcaatgaagcactacaaaagcttgagaagaagtatgatgtcgttgtcaatattcaaggggatgaacctctaattgaaccagaagtaatagatgggattgtcaaagccctgcaggcagcgccagatgccgtgtttagcactgcagtcacatctttgaaacctgaagatccatttgatccaaaccgagttaaatgtgttatggatactcatggttatgcaatctatttttcaaggggactgataccatataacaagtctgcaaaggtcaatcctcagttcccatatctgcttcatcttggtattcagagctatgatacgaagttcctcaagatatatccagagctgccatctacgctgttgcagcttgaagaggatttggaacagctaaaagtccttgagaatggctataagatgaaggtgataaaggtcaaccatgaagctcacggtgttgacgccccagaagatgttgaaaagatagaatgctttatgcgtgaaaggaacctgtcttagttagggccacacgcgacaagccccgagaggtataatctattatatgttgtccagaagaatacttttagttccgcttcacttggacatcggtggcgccttcttctttattcatggttctcacttatcctacaatatgacttccatgatatatattgtatcaaagctgtaaaatagtgtccattattaggcacagttggtatttgaatttcttagttggtgcatatatatatatgcaggtttgtgttttaaaaaaaa

SEQ ID NO: 5458 - DNA, 1185 bp, Sarracenia psittacina
aaacacatctgaacccagaaaactcatcgtacaccggaaaagcacacacatgaacccaatgtcgatctgtgcttcatcgccgtcgtcttcttcctctggatcgtcaagctccacaaaagcatgggtcgtgcatggcctggtggttgcagcggcggttgcggcggcggtgggggctcacgcctacctttacttcggccgcaagttccggagccgagtcgtcggaatcataccggcccgtttccgttcgtctcggttccaaggcaaacctctcgttcagatcctcggaagcccatgatccagagaacatgggaaagggcaaaaatggcaactacattggatcgagttgtggtggcaacggatgatgaaaagattgctgagtgctgtcaaggatttggtgctgaggtgataatgacatcagaatcgtgccgcaatggtactgagcgttgcaatgaagcactacaaaagcttgagaagaagtatgatgtcgtcgtcaatattcaaggggatgagcctctaattgaaccagaagtaatagatgggattgtcaaagcactgcaggcagccccagatgcagtatttagcacagcagtcacatctttgaaacccgaagatgcatttgatccgaaccgagttaaatgtgtagtggatacttgtggttatgcaatctatttttcaagaggactgattccacataacaagtctgggaaggtcaatcctcaatttccatatttgcttcatcttgggattcagagctatgatacaaagttcctcggaatatatccagagttgtcacctactccgttgcaattagaggaggatcttgaacagctaaaagtccttgagaatgggtataagatgaaggtgataaaggtagaccatgaagctcatggcgttgacaccccagaagatgttgaaaagatagaacgatatatgcgtgaaagaaacttgtcttagtttctggccacgccaaagaccccaaggatacaatacagcatagaatgtccaaaagcatactcagttacatttccagttgtaaactagagacaaattcttccttgtttgtagctattcttaatcgcacaatatgacgttcttgaaaagtattgtatcaatgctgcaaactgttttgcccgtaacaattgattttgtctcatatataaatagtttctcgtgcttgtattgcag

SEQ ID NO: 5459 - DNA, 1361 bp, Amsonia hubrichtii
acaccaaaatacacgcaaggaaaaacgagaatacgagacgcaaaacacatatgacaaggtggattcagatctctcactgtctcggttctcactcctaactcccgcgcttctcgcctctcgcctctcgcctttcacctctctgtgaaatcttatcacaaaggtgaataattactgcatttttctcgtatgaatccaatgacgatctgtacgccatcatcttccagctcaggcaaagcttggatctttcacggccttgctgttggggcagctgtagcggtggcaataggggcacatgcttacctttatctccgtcggccgagcaagtttcggacgcgggttatcggaattatacctgcccgttatgcttcctctcgcttcccgggcaagccccttgttcagatcctcggcaaaccaatgattcagagaacttgggaaagggcaaaactggcttcatcattggatcatgttgtggtggcaactgatgatgtgaagattgctgaatgctgtcgaggatttggcgctgatgtggttatgacatcagaatcatgccgaaatggtactgagcgatgtaatgaagctcttgaaatgctcggaaagaagtatgatattgttgttaatattcagggagatgaacctcttattgaacctgaaataatagatggaattgtcaaagcactgcaggctgcaccggatgcagtttttagcactgcagtgacttccttgaagcctgaagatgcatttgatccaaatcgcgtaaaatgtgtagtggataatcgtggttatgctatctatttctcccgagggttgatcccatttaacaagtcagcaaaagtgaatcctaaattcccgtacttgcttcatcttgggattcagagctatgacacaaagttcctgaagatatatccagagctgcctccaaccccattgcaactggaggaagatcttgaacaactgaaagtccttgagaatggatacaagatgaaggtgataaaaattgatcatgaggctcatggtgtagatgcccctgaagatgtagagaagatagtaacgttttatgcgagagaggaacctggcatagtttgtggattcatagagctaaaagttctatcagtacattactgtcgactttgggttttccagtctactttcaccattgcatccgtggctgctttctcttcatgcttagatcactgttagtaaacaggaaataacttgaaggaagaaatatgatgtgaaaattagtttcatagggaacatttttaattatactttgtcaataataccagtgagagggaccctgaggaggtttctgttggtactttttatgtattagtgctttcatgcatgtattttgagtcctt

SEQ ID NO: 5460 - DNA, 1552 bp, Populus trichocarpa
aaaagaaaaaaaagagagagggtattttcctcctccgaaaatgtcactatgtcacagtcatcactcatcatgactgatcagtaatcactcgtagatttacaagtgcctagtaaattacaagtgccggagaagcctgagtaacacactcacgacaaccaaacatgtcaatgtgctcctcctgttcttctgggtcttcatcgaccagatcatggatcgtgcacggcattgtagccggagctgcaattgctgcggccattggcgctggtgcttatctggttcggtacagaaagtttaggagccaggttgttggtatcatacccgcccgctatgcttcttctcgatttgaaggcaagccacttgttaatatccttggcaaacccatgatccagagaacttgggaaagggccaaactggcaactacactggatcatatagttgtggcaacagatgatgaaaaaatagcagaatgttgtcgaggatttggtgctgatgtggtaatgacttcagaatcttgtcgaaatggtacagaacggtgcaatgaagcacttcaaaaactagataagaaatatgatgtggttgtcaatattcaaggggatgagcctctcattgaacctgagataatagacggaattgttaaatccctgcaggcagccccggatgctgtgtttagcacagctgtaacctctttgaagcctgaagatgcatttgatcccaatcgagtgaaatgtgtggtggacaatcaaggctacgctatctatttttcaaggggattaattccttacaacaaatcggggaaggtcaatccacaatttccatatttgcttcatcttggaattcagagttatgatgcaaagtttctgaagatatatcctgagcttcaaccaactccactgcaactggaagaggatctagaacagcttaaggtcctggaaaatggttataaaatgaaggtcataaaagttgaccatgaggcgcatggtgtcgacattccagaagatgttgaaaagatagaaactttgatgcgtgagcaaaacttgtcttagttcaatactaactatgccagaggttagattataaggtggattagttgtctgtgtgttaaatatacaggttcaggggaaagggaaatcaagtaagacgctggttattggtttcactagccattttctaatattatagtcagatagtgccatagtattctttataggttcatttattatgttgatttcttctcctttctgtttaccaagttcagtgaactatcatgcagcattttgcatacagttgatgagttgcctgcatcataatagaagtgggaataactgaagtgtttggtttggttttgtttgtttgtttatttttagttataaaccctctcagtttatttatgttgtttatccgagccttttaaataaatggaattagtggctcaacgatccttctcaaattcctgtgttgtaatgaagtacaagttgtgatttactagtttgcatcagagatgagtggtgaattttcaactcatcctttgtgatttaaaccattctctctcata

SEQ ID NO: 5461 - DNA, 1633 bp, Quercus alba
aaaaaaaaatacaaatgtaactttacaaagctcacgacacgaagtcttcttccaaccttaccttagagacagttcataaaataagaaaagaaaagaaaagaaaaagttagagatttagagtgagcgatccacagtcaaagacacagagagagatccataaacaacatggttgccccgtcagtttgttcatcatcttcttcttcttcagatgggtcttcgagcaacaccaaggcttggatagtgcatggcattgtcgccggagtggcaatcgcggtggcggtaggcgctcgcgcctatctgggtcgatttgggaagttccggagtcgggtcgtcggcatcatacccgcccgtttcgcctcatccaggttccacggcaagcctctcgttcatattctcggaaagcccatgattcagagaacatgggaaagggcaaaactggcggctactttagaccatattgttgtggccacggatgatgacaagattgcagaatgctgtcgaggatttggtgcccatgtcataatgacatcagaatcttgccgaaatggtactgagcgatgcaatgaagctcttcagaagcttgaaaagaaatatgatattgttgtcaatattcagggtgatgagcctcttattgaacccgagatcatagatggggttgttaaagccctgcaggcagcaccagatgcggtgtttagcactgcagttacatctttaaaacctgaagatgcgtttgatccaaatcgagtgaaatgtgtggtggataatagaggttatgccatttatttttcaagggggctgattccgtttaacaagtcaggagacgttaatccacaatttccatacttgcttcatcttggaattcagagctatgattcaaagtttttgaagatatatccagagcttcaacctacgccactgcaactagaagaggatctggaacagcttaaagtccttgagaatgggtataaaatgaaggtgataaaggtagaccatgaggctcatggtgttgacgctccagaagatgtagaaaagatagaatcttacatgcgtgagaggaacttgtcttagatatatccgacaatgacaaggattccagttcatatgtgctcacaattaccattatcattgtgattcatttcaaatagtattcattggcattcttcagtgtacgaaatgcttggtccaaaggggagaaaatcatgttaaataggatatagatttatttatgagccactttccttcatattgtagagctatgtgattcagtcatagattgcagatcttgtttcacccatgacagataggttaaattttagagttaaatgtcaatgagattttttttttgggactttccttgtgattgagttttgtgaattcgtatattgattaagggattgttaaatatttgtaatgaataattgtgataaacttggcatgcaagcaaatccaatgctccttagaaaatatggtcacttcagatgggtatgaattgcaactatttactcgttttgatgatttgattagatgacttgtctttacaagcatgtgctcagagattctcttcctcaatcctaactaatttgtctattaattaaatgttaaaagtaaggataagggaaattaggtcgcccat

SEQ ID NO: 5462 - DNA, 1286 bp, Lippia dulcis
ggactaaactctatcttgtattttaatcatcataatttttaaaattttttaaatgaatcggtgcatcttttatcattacagggataaggcccactcgggtcaggactagacagtgcagcaaaggtggtacctgtagcgaggaaatgccaatctgcaatccatcttcttccgcaccatcttcgggctctagctcgaccaagatctggatcctgcacggcctcgccgtcggggcggcggctgcggtggcgattggtgcacatgcctatttctacttccgccgatccggcagcttccgaagccgagtggtcggaattatacccgcccgctatgcttcctctcgattcgagggtaagcctctcgtctcaatcctcgggaagcctatgattcagagaacatgggaaagagcaaaaatggcgacatcgttggatcatgttgttgtggcaacagatgatgataagattgctgaatgctgtagaggatttggtgctgatgtggtaatgacatcggaatcatgtagaaatggcactgagcgctgtaatgaagcacttcaaaagcttgtcaagaaatatgatgttgttgtcaatattcagggggatgaaccgctcatagaacctgaaatcatagatggaattgtcaaggcgctgcaggctgctccagatgcagtttttagcactgcagttactgctttgaaacctgaagatgcatttgatccaaatcgtgtcaaatgtgtggtggataatcgtggctatgcaatctatttctctcgaggacttataccatttaacaaatctggagaggtcaaccctcagtttccattatttactacatctgggaattcagagctttgattcaaagtttctcaagatatatccagagctgccacctactccacttcaacttgaagaagatcttgaacaactcaaggtccttagaaacggatacaagatgaaggttataaaagtagatcatgagtcgcatggtgttgatgtccctgaagatgtagagaaaatagagacttatatgcgagaaaggaacctgcaataggctgtatatactcgcacatatacaaggggtgtctatccaaagttttcttgagttacaaatttccccttctttgttttctagttcgacatgtaatcgcctttttctttattcgtgtattttggacctgtgtgtgtatatttctcctctagttcattttattagcgtgtaaagccactttattagatttgcaaggtccactattatctgtgaagatacatggccagtatattgatttgttccaa

SEQ ID NO: 5463 - DNA, 1305 bp, Vaccinium corymbosum
catcttcttccactggatcttcttcaagctcgaccaaagcatggatcgtccatggcgtggtggttggggccgcggtagcggtggcgctcggggcccacgcctaccttgccctcacccgatctgccaaatgtcggagtcgggtcgttggaatcatacccgcccgtttcgcttcgtctcgattccaaggcaaacctcttgttcagatcctcggaaagcccatgatccagagaacatgggaaagggcaaaaatggcaactacattggatcaagttgttgtggcgacagatgatgaaaagattgccgagtgctgtcgaggatttggcgctgatgtgataatgacatcagaatcatgccaaaaatggtactgagcgttgcaatgaagcactagaaaagcttgagaaaaagtatgatgttgtcgtaaatattcaaggggatgaacctctaattgaaccagaagtaatagatgggattgtcaaagcacttcaggcagccccagatgcagtatttagcacggcagtcacatctttgaaacccgaagacgcatttgatccaaatagagttaaatgtgtagtggatactcgcggttatgcagtctattttcaagaggacttattccatataataagtctggaaggtcaatcctcacttcccatatttgctacaccttgggattcagagctatgacacgaaattcctcaagatatatccaaagcttccgcctactccgttgcaactggaagaggatctggaacagctaaaagtccttgaaaatggatataagatgaaggtgataaaggtcgaccatgaagctcatggagtcgacaccccagaagatgtggaaaagatagaacggtttatgcgtgaaagcaactggtcgtagttctggccacgcgtgaaaccctcagaacatagtagtaaactagtaatacactgtccagaagcatacactcactttgttttcactcaacatcagcagcgaactgaattgaattgttttgtttgtgtcatgtaacctcttttcgtttatttgcctgagttagagactcttgtcagttgtcagtttgtagttttatcttccaattttatcggatgactccgaagggacagtttgtggttttatgtatccctgaagaattttgaaatgtgcgggtcgatagacttaagtgataagagagctttcgaaaagttctcatggttataatgaatattacaagctaaatttaattttgtgtttgaatcttggattgtggagtggaaggaaacaatagagaaaacatgaagttaaagaaatttatagttttaagt

SEQ ID NO: 5464 - DNA, 1445 bp, Citrus clementina
gtgaagagtgaagaagaagagtcgaagtgtcagtcaaacttcaaagcaattaggaagcttcgttgaataagatgtggattgtggatcagtatgccagtttctcatagtcgtgtaaaatcagaattagagagtgagagagattaaaagatgagctcaaaatcaatatgttcgccgtccgaatcttcttcctcaacaaagtcgtggatcgtgcacggcattgtagccggagcagcaattgctgttgccgtcggtgcgcgcgcctatctgggtcgatcgaagaactttcggagcagggtcgtgggtatcatacccgcccgtttcgcttcttctcgcttcgagggcaaaccccttgttaatatcctcggtaaacctatgatccagagaacatgggaaaggtccaaactggcaaccacattggatcacctggttgtggcaacggatgatgagaagattgcagaatgctgccaacaatttggtgctgatgtgataatgacttcagaatcttgccgaaatggtactgaaagatgcaacgaagcattacaaaagctggagaagaagtacgatattgttgtcaatattcagggagatgaacctcttattgaaccagagattatagatggtgttgtgaaagctctgcaggcagccccagatgcagtgttcagtactgctgtgacatctttaaaacctgaagatgcatttgatccaaatcgggtgaaatgtgttgtggataatcatggttatgccatatatttttcaaggggattaattccatataacaagtcaggaaaagtcaatccacaatttccatatttgcttcatcttggaattcagagctatgactcaaacttcctgaagatatatccaggccttcatcctactcccctacaactagaagaggatctagaacagctgaaagtccttgagaatggctataagatgaaggttataaaggtagaccatgaagctcacggtgttgatgctccagaagacgttgagaagatagaatcatttatgcgtgagagaaacttgtcctagtttttagtgacataatctgattaaaaggaaaggatgcgaatttgcctgtaccagcagtcagcttgctccatgttaattatagtttgattgggggtgtgttctttctctctgtgacagtctcttccccgggaaaataattctatttatatttgcctgccacggtttttcccattgttggagttaccggagtttttgtgggtgtacttgtaccagtagctgtgagtaacagcaattttgagttagacgttgattcattgtaataatacttttttttgtttttttggggtcctcgtctgttgttgagtttgtgaatatgtaccatattacatattttaaagtacttcttgctgtaatgaatggaataaaaagcgtaatatttaagttcttttacttgctgatagtatgtgctg

SEQ ID NO: 5465 - DNA, 1445 bp, Citrus sinensis
gtgaagagtgaagacgaagagtcgaagtgtcagtcaaacttcaaagcaattaggaagcttcgttgaataagatgtggattgtggatcagtatgccagtttctcatagtcgtgtaaaatcagaattagagagtgagagagattaaaagatgagctcaaaatcaatatgttcgccgtccgaatcttcttcctcaacaaagtcgtggatcgtgcacggcattgtagccggagcagcaattgctgttgccgtcggtgcgcgcgcctatctgggtcgatcgaagaactttcggagccgggtcgtgggtatcatacccgcccgtttcgcttcttctcgcttcgagggcaaaccccttgttaatatcctcggtaaacctatgatccagagaacatgggaaaggtccaaactggcaaccacattggatcacctggttgtggcaacggatgatgagaagattgcagaatgctgccaacaatttggtgctgatgtgataatgacttcagaatcttgccgaaatggtactgaaagatgcaacgaagcattacaaaagctggagaagaagtacgatattgttgtcaatattcagggagatgaacctcttattgaaccagagattatagatggtgttgtgaaagctctgcaggcagccccagatgcagtgttcagtactgctgtgacatctttaaaacctgaagatgcatttgatccaaatcgggtgaaatgtgttgtggataatcatggttatgccatatatttttcaaggggattaattccatataacaagtcaggaaaagtcaatccacaatttccatatttgcttcatcttggaattcagagctatgactcaaacttcctgaagatatatccaggccttcatcctactcccctacaactagaagaggatctagaacagctgaaagtccttgagaatggctataagatgaaggttataaaggtagaccatgaagctcacggtgttgatgctccagaagacgttgagaagatagaatcatttatgcgtgagagaaacttgtcctagtttttagtgacataatctgattaaaaggaaaggatgcgaatttgcctgtaccagcagtcagcttgctccatgttaattatagtttgattggtggtgtgttctttctctctgtgacagtctcttccccgggaaaataattctatttatatttgcctgccacggtttttcccattgttggagttaccggagtttttgtgggtgtacttgtaccagtagctgtgagtaacagcaattttgagttagacgttgattcattgtaataatacttttttttgtttttttggggtcctcgtctgttgttgagtttgtgaatatgtaccatattacatattttaaagtacttcttgctgtaatgaatggaataaaaagcgtaatatttaagttcttttacttgctgatagtatgtgctg

SEQ ID NO: 5466 - DNA, 1442 bp, Eucalyptus grandis
cagcaacgtcggcagcaaccgtagctcaaactaccgccaattccaaagctctcaaacccacccggacaagtaaccttcgcacgaccgtcggggtcgcgccgtcgcgtggtcggacatgaacccaatgtcgatctgcacctcgtcgtcgtcgtcgtcgtccgggtcgtcttcgtcttcttcgtattccaccgccaaagcgtggatcgtgcacgggatcgtcgccggcgtggcggtcgcggcggcgatcggcgctcgggcttatctcggcagggccgccaagttccggagccgggtcgtgggcatcataccggccagattcgcttcgtctcggtttcagggcaagcctctggtccccattctgggcaagcccatgatccagagaacgtgggagagagctaaactagctgcttctttggatcatgttgttgtggcaacggatgatgaaaagatagcagaatgttgtcgaggatttggtgcagatgtgataatgacatctgaatcatgtcggaatggcactgaacgctgcaatgaagctctacaaaagcttgacaaaaagtatgacatagttgtcaacatccagggggatgagcctcttatcgaacccgagataattgatggagttgttaaagctctgcaggctgctccagatgcagtatttagcactgcagttacctcgttaaagcctgaagatgcgtttgatccaaatcgtgttaaatgtgtagtagataatcgtggctatgctatttacttctctagggggttaattccacataacaagtctggaaaggtcaatcctaagtttccctatttgcttcatcttggaattcagagctatgattcaaagtttctaaagatatatccagagcttcagcctaccccactccagcttgaggaggatctagaacagcttaaagttctggagaatggttataaaatgaaggtaataaaggttgatcatgaggctcacggtgttgatactccagaagatgttcagaaaatagaatcatacatgcttgaaaggaacttgtcctaggtaggtgagatttcttcttcttttttctttcatgtggttaccatgtacttgtaagttggagatgtcagacttcatcttgctcaaagttagttcgccttgttcagctttagtgtgagagaattcgtgagacgcagagcactgattttgtgtggtgctttgcttcgtaagatagtgtagagctatttactcgttttcggatgatttacaaaatacggggattacaagcatcttgtggcggatggtagtatcatttgattgtaggttctggttctttacagtgcatagagtcaagatgagtgctaatgtatgcggaaacattgcagaatgtaggcgtacctgtggctccttttaaggaaatgattatagattgaaaaatgattagttctccaattatcgaatctgaaatgcc

SEQ ID NO: 5467 - DNA, 1437 bp, Rosmarinus officinalis
ggccggggggtgcacgacacccttcgaaagcagcctagcgtcatacgctcaggctatttgcggagctcaaaacaaacggtggatctcatctcactctcccagactcccagttctcacttctcattcccgcgcggccgagcctgtctgtgaaatctgatcgccaaggtggataatcgttgcatttttcacgtgtgaatccaatgacgatctgtgcaccatcatcttttgcttcttcttcatcatcttcaagctcaggccaggcatggatttatcacggccttgctgttggggcagctcttgcggtggctataggagcacatacttacctttatctccgccggccgagcaagtttcggactcgggttatcggagtaatacctgcccgttttgcttcctctcgcttcccaggcaagcctctcgttcagatcctcggcaaacccatgattcagagaacttgggaaagggcaaaaatggctccatccttggatcatgttgtggtggcaacggatgacgagaggatcgctgaatgctgtcgaggatttggtgctgatgtagttatgacatcagaatcatgccgaaatggtactgagcgttgtaatgaagctcttgaaatgcttgggaagaagtatgatatcctcgtcaatattcagggagatgaacctcttcttgaacctgaaataatagatggaatcgtcaaatcactgcaggctgcaccagatgcagttttcagcactgcagtgacttccttgaagcctgaagatgcatttgatccaaatcgtgtaaagtgtgtagtagataatcgtggttatgctatctatttctcccgagggctgatcccatttaacaagtcaggaagagtgaatcctaaattcccgtacttgcttcatcttggaattcagagctatgacacgaagttcctgaagatatatccggagctgactccaacaccactgcaacttgaagaagatcttgaacaactgaaagttcttgagaatggatacaagatgaaggtgataaaagttgatcatgaggcgcatggtgtagatgccccagaagatgtagaaaagatagaaagttttatgcgagagaggaacttagcttagtttggggattcacaaaaactattcaaaaagttttatcagtacgttactataaactttggtttcccagtctgtttcatctttgcatacgtggctgtttttcttcttcttgcgcagatcaatgttagtcaacaggaaataacttgaaggcagaaatgggatataacgtaaactagttctcataggggaaattttttgtttacaatgtcattgggttttattggtggttagtacgattaagcggaactggtgaggcttagcggaacttgtgaggcttatgttgtactctgtatgtattagtgctttaatacatgtttttgaagtatttttcctgttc

SEQ ID NO: 5468 - DNA, 1287 bp, Olea europaea
accgatagaacctacatccaagtgcaagcgcgattgaatcttctcttgtccagttatccgtaaaaaatctcttcgccaaagtatccaaatgccgatctgcacgccgtcatcttccgattcgagctctggctctagctccgtgtcaaccaaatcatggattattcacggcctggcggtgggggctgccgccgcggtggcgcttggtgctcacgtctacttgtattatcgtcgatccggaaggttccggagccgggttgtcgggatcatacctgcccgtttcgcttcctctaggttccaaggcaaaccactcgttcacatccttggcaagcccatgatccaaagaacatgggaaagggcaaaaatggcatctttattggatcatattgttgtggcgacggatgatgataagattgcagaatgctgtagaggatttggtgctgatgtgataatgacatcagaatcatgtcgaaatggcaccgagcgttgtaatgaagcacatcaaaagcttgggaacaagtatgatattgttgtcaatattcagggggatgaacctcttattgaacctgaaataatagatggcatagtaaaggctcttcaggctactccagatgcagtgttcagcactgcggttacttctttgaaatctgaagatgcatttgatccaaatcgcgtcaagtgcgtggtggacaatcgtggatatgcaatttatttttcacgaggactgataccattcaacaagtctggaaaggtcaatccgcaatttccatacctgcttcatctggggattcagagccttgattcaaagttcctagagatatatccagagctgccaccaactccacttcaactggaagaagatcttgaacagctgaaagtccttgaaaacggatacaaaatgaaggtaattaaagtcgaccatgaggcccatggtgttgataccccagaagatgtagagaaaattgaacgttatatgcaagagaaaaacttatcttagctccttcaatgccattgcgcattgcagagggatcttatgggaatacccacagttgagatcaacacagggatccaatttatgtattgtgagtcatcttcatttagtagagtaatgtacatggtgactgtaatgtgtgtaaaatgcgttctttaggtgtaaacaggcttgtagagtctgtaagaggagtatcattttccgaactcgagatgtgtgtcctttgcctaatccaaccatagtcgacgcatctttgttatatctgagttttttacaatagaatttttactttacacggc

SEQ ID NO: 5469 - DNA, 1080 bp, Triphysaria pusilla
gttttttgttgtttgatcacttgggcaagctcatcaaccatcactcaacgtgacgcatctctctggtttctctcattttttcttttcctgggcgaaaaatggcgatatgcagtccatcgtctttgtcgtcatcatcttcaagctctagctcctcgaaatcctggattattcacagcttggccattggggcggcggccgcggtggcgctcggtgcccatgcctacttctattatcgccgatccggcaagtttcgaagccgggttgtgggaattatacccgcccggtttgcttcatctcgcttcgaaggcaagcctctcgcttacatccttggaaagcccatgatccaaagaacatgggaaagggcaaaaatggcaacctcgttggatcatattgttgtggctactgatgatgataaaattgctgagtgttgtagaggatttggtgctgatgtggtgatgacatcggaatcgtgtcgaaacggaaccgaacgttgtaatgaagcacttgagaagctcggaaagcaatatgacgttgttgtcaatattcagggcgatgaaccactcatagaacctgaaatcatagatgggattgtcaaagccctacaggctgctccagatgcagtcttcagcactgcagttacttctttaaaacccgaagacgcgtttgatcctaatcgcgtgaaatgcgtggttgataaccgtggttacgcaatttacttttctagagggcttataccatttaacaagtctggaaaagtgaaccctcaatttccatatttgcttcatctggggattcagagctttgattctaagtttctcaagatatatcccgagctgccgtcaactccacttcagctagaagaagatcttgaacaattgaaggttcttgaaaatggatataagatgaaggttataaaagtcgaccatgaggcccatggtgtagatgtcccagaagacataggtaaaatagagcagtacatgcgcgaaaggaacctggaataatagctgtataaaaattgcctgcaaataatagtgttatttattatactggtgcattatattgttcttagtttggttttct

SEQ ID NO: 5470 - DNA, 919 bp, Panax ginseng
aattcatcttcttcttcttcttcttcttcatcaccatcttcaagcacttcttctaaatcatggattctaaatggccttgccgtcggagctgtcattgcggtggctgtcggtgctcatttccgccgatccagtaaatttcggaatcgggtcgtcggaattatacccgcccgatttgcttcttctcggttccaaggcaaacctctcgttcagatcctcggcaagccaatgatccagagaacatgggaacgtgtaaaattggccactacattggaccatgttgttgtggccacggatgatgaaaaaattgctgactgctgtcgaggatttggtgctcatgttataatgacatttgaatcttgccgaaatggtactgaacgctgtaatgaagcactgcaaaagcttgacaagaagtatgacgttgttgtcaatatacagggggatgaacctcttatcgaacctgaaatcattgatgggattgtcaaagcgctgcaggctgctccagatgcagtctttagcactgctgtcacatccctaaaacctgaagatgcatttgatccaaatcgtgtgaaatgtgtggtggataatcatggctatgcaatctatttttcacgaggactgattccacataacaagtcagggaaggtcttccgtacttgctacatcttgggattcagagctatgattcaaagttcctcagaatatatccagagctgccacctacccctctgcaactagaagaagatctggaacagctaaaagtccttgagaatggatacaagatgaaggtgataaaagttgaccataacgctcatggtgttgacaccccagaaagttgaaaagatagaacattttatgcgtgagagaaacttgtcttagttgtggcagatgcaagaagaggttgtttagcgaattctggaaa

SEQ ID NO: 5471 - DNA, 1390 bp, Rosmarinus officinalis
gattgaccgactccagacagcagctcgtgtgcctcatctaaatcccggcgaaaactctgctcgcaaatgacgttgtgcaatacctcatcgtcttcgacaggttctggctacagcaagtcgtggataatccacggtgtggcggtgggggcggcggctgctttggcgcttggggcccattacatgtattatcgacgatccggcaagttccggagccgggtcgtcggaattatacctgcccgctttgcttcttcccgcttccagggcaagcctctcgttaacatcctcggcaagcccatgatccagagaacatgggaaagagctaaaatggcaacctcattggaccatattgttgtggcgactgatgatgagaagattgctgattgctgtagaggttttggtgccgatgtggtaatgacatcggaatcgtgccgaaatgggacggagcgttgtaatgaagcgcttagcaagttggataagaaatatgatgttgttgtcaatatccagggcgatgagccgctcatagaacctgaaataatagacggcattgtcaaagcgctgcaggctgctccagatgcagtcttcagcactgcagttacttctctgaaatctgaagatgcatacgatccaaatcgtgtcaaatgtgtggtggataaccatggctatgcaatttatttctctcgaggattaataccatttaataagtccgggaatgtcaaccctcagtttccatatttacttcatttggggattcagagctatgatacaaagtttctcaacatatacccagagctgcctccgactccacttcagctggaggaagatctcgagcaactgaaggttcttgaaaatggatacaagatgaaggtgataaaagtcgaccatgagtcccacggtgttgacatcccagaagatgttgataaaatagagagctacatgcgcgaaaggaacctgcattagctgtataatttctcacaggatacaatactgattttacatatgcatgatgataagcagaatggtttcaggctacttctcctcggcttcatttatactctagtctttggatgaatgttttttcccccttctcgcagagctctaagatgaagactctgggggcaagtacttctactagtgtaatttgtttagcattatctttatgtggttatgtatattatggctgtaatttatggactagtgtaaatgcagtatggctggtttggtttcttttttagttctaagttttagtttcccatcttttaactgtagtttatgaagtagtgttgagttttgtaagagtatattttacttcttttctggaaattagaaatatttggataaatgatttgacattttgagttacagatttgaaaaataggaatatgttcgttaa

SEQ ID NO: 5472 - DNA, 1254 bp, Spinacia oleracea
cctcacactcagccactcagattgtcaagtgttggaaatggcaagctgtgcaatttcattctcttcttcttagttccgtacagtggtcacttttctccagcgattcccaaaatgcaccgacaaaaataactgcaacaaaaaacctcacccgtcacaaaaatccatcactgaaaaaccccatgtcgatttgtacgtcctcctcttcgtcatcatcaagctcgacaaaatcatgggtcgttcatggtttagtgttaggagcggcggctgccgcggcgattggtgctcacacttacttctacatccgccgatctcggaagtttcgttcgcgggtcatcggaattatacccgcccgtttcgcttcctctcggttccagggcaaaccccttgtccacattcttgggaaacccatgatccagaggacatatgaacaagcgaagctggcttctatgttggatcaagttgttgtagcaacagatgataataaaattgcggaatgctgccgaggatttggtgcagacgtaataatgacctcagaatcttgtcgcaatggtgctgagcgttgcagtgaagcacttcagaaacttaataagaagtacgacatagtagtcaatattcaaggagatgagcctttgattgaacctgatattatagatgggattgttaaagctctgcagtctgctccagatgctgtcttcagcactgctgtaacacctttgaaacctggggatgcttttgatacaaaccgtgtcaaatgtgttgttgataatcttggctatgctatctacttctccagaggacttatcccatataacaaatctgggatggtcaatccggatttcccatatttgctgcatcttggaattcagagttatgacgctgaattcctcaaaatatatccagagctaccatctacaccgttgcaactagaagaagatctggaacaacttaaagttcttgaaaacggctataaactgaaggttataaaggttgagcatgaagctcatggagttgacgttcctgaagatgtagaaaagatagaacggtatatgcgtgagagaaacttatcatagtttgtacaagggaaaatcattattggtatcctttctttatgttgattgatgaaaagaataagctttttgatttccttccttctgaaatagaaagatttgtgaattgtgtcaacaactttgtaacagtttctagtccacccataaatagtttcatgttaacttcctctgtaaaacactaattgat

SEQ ID NO: 5473 - DNA, 1152 bp, Theobroma cacao
gccactgcaaaccggttaaactctgtacagttaaaacactctgtctccagatctctgtctccccactctctctactaaaagcaaactgaaaaattttcaggacgaaatccaaagagacatgaacccaatgtcaatttgctcttcctcttcttcttcgtcttcttcttcttcttcttcaacagctaaagcttggatagttcacagcattctagctggtacagcaattgccgtagccataggtgcccgtgcctatctgggtcgggccaagaagttccggtcccgggtcgtgggcattatacccgccaggtttgcctcttcccggttccaaggcaagcctttggttcagatccttggaaaacccatgattcagagaacttgggaaaggtcaaaattggcaactacattggatcatatagttgtggctacggatgatgaaaagattgcagaatgctgtcgaggattcggtgctgatgtgataatgacatcagagtcttgtcaaaatggcactgaaaggtgtaatgaagcacttgaaaagctagagaagaagtacgacattgttgtgaatattcagggggatgaaccacttattgaacctgagataatagatggagttgttaaagctctgcaggcagcaccggatgcagtgtttagcactgctgtcacatccttgaaacctgaagatgcttttgatccgaatagagtgaaatgtgtggtagataatcatggttatgctatctatttctctagaggacttgtaccattcaacaaatcagcaaaagtgaatccacactttccgtacttgcttcatcttggtattcagagctatgattcagagtttctaaaaatatacccaaagcttcagcctactccactgcaactggaagaggatctggagcagcttaaagtccttgagaatggctataagatgaaggtcataaaggttgaccacgaggcccatggggttgacacacccgaagatgtggagaagatagaatctctaatgcgtgagaataacttgtcttagttcatctacgttgtttaggaaacagaaggaatgagaatggaaggaattgaaaaatgttttaagtaaaatttttcatcagaaattcatcgatactaagtcatttctgacaaaaaattttcgtgacaaaa

SEQ ID NO: 5474 - DNA, 1164 bp, Trifolium pratense
ttgtgccatgactatttgttcctcaccttcttcttcatcatcatcttcttcttccaataactcgaaaacatggattatccatggaattgtagctggagttgcaattgtagccgctgcctccggtgctcacgcatacttccgtcgattcaacaaattccgtagccgagtcgtaggcatcatacctgctcgatttgcttcctctcgattctctggaaagcctctcgttcaaattcttggcaagcctatgatccagaggacatgggaaagggcaaagctggcagcttcgttggatcatgttgttgtggcaactgatgatgaaaggattgctgactgctgtcggacatttggtgcagatgtcataatgacatcagagtcttgccgaaatggtactgagcgttgcaatgaagccctagagaagctcgggaaaaaatatgatattgttgtaaacattcagggtgatgagccacttgttgaacctgaaataatagatggtgttgtcaaagctttgcaggcagcgccagatgcagttttcagcaccgcagttacgtctttaaagccagaagatgcacttgatccaaacagagtgaaatgtgtggtagataatcgtggttatgccatctatttttcgcgagggttaatcccattcaataagtcagggaaagtcaatcagcagttcccatatttgcttcatcttgggattcagagctatgatacaaagtttctaaagatatacccagatcttcaacctactccattgcaacttgaggaggatttggagcagcttaaagtccttgagaatggctataagatgaaggtaataaaggttgaccatgacgcccatggtgttgacacccctgaagatgttgaaaaaatagaatctctaatgcgagagaggaacttatcttgaacgggtagtgaaaccatctgaaaattacctatttattagcacaagaagtcacctataaggatggcttgtattttctttttcgtgtaaaatcactcttgttgcttttatagattaccagcgttataatttgatttataatgttaccttttaggatggccattattcattaggactagattttcatgtacacaaacaagtatatccgagaatgaaaattttattatacatatttataagcacatgaatcatttatcatt

SEQ ID NO: 5475 - DNA, 1162 bp, Gossypium raimondii
acattaccttgttcccgcaaagtcgccttccaagacagtgaaacacacaattcaactctgtctccagatctctctgtctcccccttctctttctctctgaaaccaaataaaaataaattcgtgaacaccatgtcagtctgctcttcttcttcttcttcttcttcttcttcttcaacaggtaaagcttggatagttcacagtattttagctggcacagcaattgcggtagccattggtgcccgtgcctatctgggtcgggctaggaagtttcggacacgggtcgtgggaattatacccgccagatatgcatcttctcggttcgaaggcaagcctttggttcatatccttgggaaacccatgatccagaggacatgggagaggtcaaaactggcgaccacactggaccatctagttgtggcaacagatgatgaaaagatagcagaatgctgtcgaggatttggtgctgatgtgatcatgacatcagagtcttgtcaaaatggcaccgaaagatgtaatgaagctcttgaaaagctagagaagaagtatgacattgttgtgaatattcagggagatgaacctcttattgaacctgagataatagatggaattgttaaagctctgcaggcagcaccagatgcagtgtttagcactgctgtgacttctttgaaaccagaagatgcttttgatccaaatagagtgaaatgtgtggttgataatcgcggttatgctatttatttttctagaggactaataccatttaacaaatctgcgaaagtcaatccacagttcccttacatgcttcatcttggaattcagagctatgattcaaagtttctgcaaatatatccgaagcttcagcctacaccactgcaactagaagaggatctggaacagcttaaggtccttgagaatggctataagatgaaggtgataaaggttgagcatgaggctcatggagttgacacacctgaagatgtggagaagattgaatcattaatgcgtgagagaaacttgtcttaacaacttctttgtggaataggaaggttatacatttttctactatctttattaatgtaagatttgagaatttaaattaatcaaatgttttctgataaatcttaaataatgctggggtgatttttcttcaaaaaaaaaaaaatac

SEQ ID NO: 5476 - DNA, 1084 bp, Eutrema parvulum
attaaaccggaccagaccggtccttctcgctagctcggccaccgctttcttttttaacagagcaaactctctctcacactctcaccggagcaaagtgaagacactgattgattaatggcaatttgttcttcatcgtcttcgtcttcgtcttctcagaagacgtggattgtacacgggatcttggccggaacggcgattgctgcggcgattggcgcacatgcgtatctgggtcgatccaggaaattccggagccgggtcgtcggaatcatccctacccgttacgcttcctctcgattcgagggtaagcctctcgtgcaaatcctcggcaaacccatgatccagagaacttgggagaggtcgaaattagcttctacgcttgatcacgttgttgtagctacggatgatgaaaggatcgcgaattgctgtcgtggatttggtgccgatgtcatcatgacttcagagtcttgtagaaatggcactgaacggtgcaacgaagctctagaaaagctggagaagaagtatgatgtggttgttaacattcaaggagatgaaccactcattgagcctgagattatagacggtgtagtcaaagcacttcaggtagcacctgatgcagtgtttagcacagcggtaacatcactgaaaccagaagacggacttgatcctaaccgagtcaaatgtgtggtggacaaccgtggctatgctatctatttctcgagggggttgattccttataacaagagtggtaaagtcaatccagatttcccgtatatgcttcatcttggaattcagagctttgattcgaagtttctgaaagtatattcggagcttcaaccaacgccattgcagctagaagaggatctagagcagctcaaagtcctcgagaatggctacaaaatgaaggttataaaggtggaccatgaagcgcatggagttgatacacccgatgatgtcgaaaagattgaatcgttaatgcgcgaaagaaacctgtcctagtccacaaatacagtatcttgctttattcatgaacacttttccttgttttacatgtgtggtttgtgtaatcgaattagagtagaaacct

SEQ ID NO: 5477 - DNA, 1629 bp, Populus trichocarpa
ggatatagtgatttgatatgagatctacaagtgccagagaagagcagtcaggacaaccatagacaaaaatgtcgatgtgttcttctgagtcttcatcgagcaaattttggatcgtgcacagcattgtagccggggctgcaattgctgcggccattggcgctggtgcatatctgggtcgatacagaaagtttaggagccgagttgttggtatcatacccgcccgttatgcttcttctcggtttgaaggcaaaccacttgttaatatccttggcaaacccatgatccagagaacttgggaaagggccaaactagcaagtacactggatcatatagttgtggctacggatgatgaaaaaattgcagaatgttgtcgaggatttggtgctgatgtgataatgacttcagagtcctgtcgaaatggtactgaacgatgcaacgaagcacttcaaaagctagataagaaatatgatgttgttgtcaatattcagggtgacgagcctctcattgaacctgagataatagatagaattgttaaagcactgcaggcagccccagatgcagtgtttagcactgctgtaactgctttgaagcctgaagatgcattcgatcccaatcgagtgaaatgtgtggtggataatcatggctatgctatctatttttcaaggggattaattccttacaacaaaacgggaaaggtcaatccacaatttccttatatgcttcatctaggaattcagagttatgatacaaagtttctgaagatatatcctgagcttcgatctactccactgcaactagaagaggatttggaacagcttaaggtccttgaaaatggttacaaaatgaaggtaataaaagttgaccacgaggcacatggtgtcgacattccagaagatgttgaaaagatagaaactttgatgcgtgagcaaagcttttcttagttcaatactaactatgccaaaggttaggttttaagatggatagggttgtatgcgtgtttaatatacaggtccaatatacagttcaatactaactatgccaaaggttagtttttaagatggattgggttgtatgcgtgtttaatatacaggtccaatggatagggatgtcaagtaggatgctgattattggttgcacaagccagtttttaatattatagttatatagtgcaatgctattctttataggttcatttactttttgattaattttttgtgttaccaagttcagtgaactattatgcggcaacgagtgcctgtagctataacagaagaagtggggatagctgaagtctttgtttttgttaactgtagctcgttctttttttctaaatataaaccctctcaatttattcacattgtttatctgagccttataaataaaaagaattaatggctcaatgatccttctcaacatcatgtgttgtagtaaagtacacactgggttgagattactaggttgcattagagatgaatggtgggttttcaactcatcctctgtgtgatttaaaccattctctctaaaagttactggttttggacctaaacgttgtcttcagtagaaatagggctcgggttgccttctttaacactgcttttctacagtggaatctctgatgttcatgttcat

SEQ ID NO: 5478 - DNA, 1205 bp, Tropaeolum majus
caaagccataaccccacgcattgattaaagtaaagacggtacatttaaattcaccagatgctctataaatgttttctgtcggtgatgatataaatccgtagaacatttcttcacctgaagtttgaggtatagtatatagcatatagtaccgacacgcataaatttgacaatagaagagtattcaatgacaatttcatcatcatcatcttcttcctcatcaaccaaatcatggatcttgcacggaatcgtcgctggtacagcagttgcactggcgataggtgctcgtgtttacctcgctcgatctagtaaattaaggacccgcgttgtggggatcatacctgctcgattcgcttcatctcggttcgagggaaaacccttggtccacattctcggcaaaccaatgatccagaggacttgggaacagtcaaaactagctacaacattggatcacgtggttgtggcaacggatgatgagaggatcgctgaatgctgtcgaggattcggtgcagatgttataatgacttcagaattttgccgaaatggcactgagcgttgcaatgaagcacttgaaaagctagagaagaagtatgatattgtagtcaatattcagggagatgagcctcttatcgaacctgagataatagatggtgtcgttaaagcccttcaggcagccccagatgctgtgtttagcactgctgtaacatctttgaaacctgaagatgcttttgatcgaaatcgagtgaaatgtgttgtagataatcgtggctatgctatttacttttctagaggattaattccacataataaggcaggaaaagtcaatccacaattcccttatttgcttcatcttggaattcagagctatgattcaaagtttctaaaagtatatccagagctccaaccaacaccattacaactggaggaggatttggagcagctcaaagtccttgaaaatgggtataaaatgaaggttataaaggttaatcacgaggctcacggtgtcgacatccctgaagatgttgaaaagattgaatcttttatgcgccagagaaatctatcttagtttcagatggacaaaaaacggattttcaagaataccatccatatttttttgtgattaatatatttgatttcatggggtctagcttctaggacattgttgttgtacacatagttcttcgtccggtccgcctgtaaaaaaacga

SEQ ID NO: 5479 - DNA, 1441 bp, Prunus mume
aggtcagtgaagaattacaacagagcacccaaaaatctaccaacgaaaaaacgcaccaaagataacgacggtgtctctctctctgtctctctcggttcactctgttcagtgagatcaacatgaaccccatgtcggtttgctcctcgtcgtcgtcgtcgtctgggtcttggagcagcaccaaggcatggatcgtccacggaatcgtcgccggagttgcaattgcggtggcaattggcgcccgggtttacttgggtccgccaaagaagtttcggagccgggtcgttggtatcatccccgcccgtttcgcttcttcacgtttccagggcaagcctctcgctcagatcctcggaaagcccatgatccagagaacatgggaaagggcaaaactggcaactacactggatcatgttgttgttgcgacagacgatgagaagattcgagaatgttgtcgcagttttggagctgatgttgtaatgacctcagaatcctgcaggaatggtactgagcgttgttctgaagcaattcaaaagcttgagaagaagtatgatatagttgtcaatattcagggggatgagcctcttattgaacctgagataatagatggaattgttaaagctttgcaggaagccccagatgcagtgtttagcactgcagtcacatcattaaaactagaagacgcatttgatccaaatcgagtgaaatgtttggttgacaattctggttatgccatctatttttcaagggggttgattccatttaacaagtcaggcaaggccaatccacagtttccctatatgcttcatctaggaattcagagctatgatacaaggttcctaaaaatatatcctcagcttgaacctactcctttgcaactagaagaggatctggagcagcttaaagtccttgaaaatgggtataagatgaaggtgatcaaggttgaccatgaggctcatggtgttgacgccccagaagatgttgagaagatagaatctctaatgcgcgagaggaacttgtcttagaaattcctagtttgtggtatatcagaccattaaaaagcaagtaaatctttcatagacccacacttaatgattggagttactaagtttagttatatgcgggtttgctggtatgctgcgtcaagagaaaggatatggagaggtataaatttaatctgttacaaattcccctgtatattaaaagtgatttatttctgagtcattccttgtagggtttttgtccacccattgtctgctgtccatagccgaaagtttagagttgtatgttatttatgagttgtattctaattttgtttcctgcccctgattataatgtgcatcagtatgtattctatctctatgtgtcataatagaaggattaattttgttcacatttatgctgaactgtgccgactctctctctctctctctctctctctctctct

SEQ ID NO: 5480 - DNA, 1138 bp, Arabidopsis lyrata
taaaccggatcagagaacggtcttttcctcgctggctcggccaccgctttttcaacagaacaatatttctctctctttctctctgtctcactcactctctcactcaccggagcaaagtgatgtcggtgtgttcttcatcatcgtcttcttcttcttctcagaaaacatggattgtacacgggatcttggccggagcagcgattgctgcggcaattggcgcaagtgcgtatctgggtcgatccagaaaattccggagccgggtcgtcggaatcatccccgcacgttacgcttcctctcgattcgagggtaagcctctcgtgcaaatcctcggcaaacccatgatccagagaacttgggagaggtcgaaattagctactacgcttgatcatattgttgtagctacggatgatgaaaggattgcggagtgctgtcgtggttttggtgccgatgtcatcatgacttcagagtcttgcagaaatggcactgagcggtgcaacgaagcgctagagaagctggacaagaagtatgatgtggttgttaacattcaaggagatgaaccactcattgagcctgagattatagatggtgtagtcaaagcacttcaggtaacacccgatgcagtgtttagcacagcggtgacatcattgaaaccagaagacgggcttgatcctaaccgagttaaatgtgtggtggacaatcgtggctatgctatctatttctcgaggggtttgattccttataacaagagtggtaaagtcaatccagattttccgtacatgcttcatcttggaattcagagctttgattcaaagtttctgaaagtatattcggagcttcaaccaacgccattgcagcaagaagaggatctagagcagctcaaagtccttgagaatggctacaaaatgaaggttataaaggtggatcatgaagctcatggagttgatacacccgatgatgtcgaaaagattgaatctttaatgcgcgagagaaacctatcctagtccacaaagacaaaatccaaatcgtgttttcaaattttttactttttccgttacttttttccggagacttgtgtgatcgatcgaaccagggactagtataaatgtaattgaattcaaatgtaagctctacagatttc

SEQ ID NO: 5481 - DNA, 1227 bp, Triphysaria pusilla
aagtattgagagatctaagttttttgttgtttgatcacttgggcaagctcatcaaccatcgctcaacgtgaagcatctctctggtttctctcattttttcttttcctgggcgaaaaatggctatatgcagtccatcgtctttgtcgtcatcatcttcaagctctagctcctcgaaatcctggtttattcacagcttggccattggggcggtggcgctcggtgcccatgcctacttctattatcgccgatccggcaagtttcgaagccgggttgtgggaattatacccgcccggtttgcttcatctcgcttcgaaggcaagcctctcgcttacatccttggaaagcccatgatccaaagaacatgggaacgggcaaaaatggcaacgttgttggatcatattgttgtggctactgatgatgataaaattgctgagtgttgtagaggattcggtgctgatgtggtgatgacatcggaatcgtgtcgaaatggaaccgaacgttgtaatgaagcacttgagaagctcggaaagcaatatgacgttgttgtcaatattcagggtgatgaaccgctcatagaacctgaaatcataggtgggattgtcaaagccctacaggctgctccagatgcagtcttcagcactgcagttacttctttaaaacccgaagacgcatttgatccaaatcgcgtcaaatgtgtggtcgataaccgtggttatgcaatttacttctcgagagggcttataccatttaacaagtctggaaaagtgaaccctcaatttccatatttgcttcatctggggattcagagctttgattctaagtttctcaagatatatccagagctgccgtcaactccacttcagctagaagaagatcttgaacaattgaaggttcttgaaaatggatataagatgaaggttataaaagtcgaccatgaggcccatggtgtagatgtcccagaagacataggtaaaatagagcagtacatgcgcgaaaggaacctggaataatagctgtataaaaattgcctgcaaactatagtgttatttattatactggtgcattatattgttcttagtttggttttctccttaaatggcttctctttcacttgttcaaaatgtaacctcagtgtacattacactgttattcatttatagcgtaacaccaaaatcgatttgttccaaacagtgcatatattcgtcgatcaaatcatttatttaattg

SEQ ID NO: 5482 - DNA, 1319 bp, Prunus persica
aggtcattgaagaattacaacagagcacccaaaagtctaccaacgaaaaaacgcaccaaagataacgacggtgtctctctctctctgttcgctttgttcagtgagatcaacatgaaccccatgtcggtttgctcctcctcctcctcgtcgtcgtctgggtcttggagcagcaccaaggcatggattgtccacggaatcgtcgccggagttgcaattgcggtggcaattggcgccagggtttacttgggtccgccaaagaagtttcggagccgggtcgtcggcatcatccccgcccgtttcgattcttcacgtttccagggcaagcctctcgttcagatcctcggaaagcccatgatccagagaacatgggaaagggcaaaactggcaactacactggatcatgttgttgttgcgacagacgatgagaagattcgagaatgttgtcgcagttttggagctgatgtcataatgacctcagaatcctgcaggaatggtactgagcgttgttctgaagctattcaaaagcttgagaagaagtatgatatagttgtcaatattcagggggatgagcctcttattgaacctgagataatagatggaattgttaaagctttgcaggaagccccagatgcagtgtttagcactgcggtcacatcattaaaacttgaagacgcatttgatccgaatcgagtgaaatgtgtggttgacaattctggttatgccatctatttttcaagggggttgattccatttaacaagtcaggcaaggccaatccacagtttccctatatgcttcatctaggaattcagagctatgatacagggttcctaaaaatatatcctcagcttgaacctactcctttgcaactagaagaggatctggagcagcttaaagtccttgaaaatgggtataagatgaaggtgatcaaggttgaccatgaggctcatggtgttgacgccccagaagatgttgagaagatagaatctctaatgctccagaggaacttgtcttagaaattcctagtttgtggtatatcagaccattaaaaagcaagtaaatcttccatagacccacacttaatgattagagttactaagctcttacaaattcccctgtatattaaaagtgatttgtttctgagtcattccttgtagggttttttcccccccattgtttgctctccatagccgaaagtttagagttgtatgttatttatgagttgtattctaattttgttttctgcccctgattatcatgtgcatcagtatgtattctatgtctatgtgtcataatagaaggattaattttgttcacattt

SEQ ID NO: 5483 - DNA, 1059 bp, Citrullus lanatus
aatagagtggaaaagtgaagggggaagcgacaacccaatttccgcaacagtgcaatagcgagtccttctcatagcggaaaaccatgtcggtttgctcttcttcttcttcgtcatcatccgggtacctcggcagtgccaaggcctggattgttcatgggattgtcgccgggatcaccatcggcgcggccgtcggagctcgagcttatttgggtcgatccaagaaattccgtagccgcgttgttggaatcattcccgcccgcttcgcctcttctcggttccaggggaagcctctcgttgagattctcggaaagcccatgatccagagaacatgggaaagggcaaaaatggctacttcattggattgtgttgttgtagcgacggatgatgctaagattgcacaatgctgtagaggatttggtgctgatgttgtaatgacatcagagtcttgccggaatgggactgagcgttgtaatgaagcacttcagaagcttgaaaagaaatatgacattgttgtaaatattcaaggggatgagccccttattgaaccggagatcattgacggcatcgttaaagctctgcaggctgccccagatgcagtgttcagcactgcagtgacatccttaaaacctgaagatgcattcgatcccaatcgtgtgaagtgcgtggtggataatcatggttatgctatttatttttcaagaggattgatccctttcaacaagtcaggaaaggtcaaccttcattatccatatttgcttcatcttggaatccagagcttcgattcgaaatttttaagtatgtatcctgaacttgaaccaacaccgttgcaactagaagaagatctagaacagctaaaagtattagagcatggctacaaaatgaaggtgattaaggttgaccatgaggctcatggtgttgatgttcctgaagatgtggaaaagattgaatcttttatgaaggaaaggaacctagcttaaataagaccaacgggtgaaagttatacacacgatacgatttcgtttttagtctaggcttgaaaaagatttgctgttattttgt

SEQ ID NO: 5484 - DNA, 1169 bp, Daucus carota
aaaaactgtacagagattcatgtatatatagagttaagcatacagagcttatgaacttgacaatttgaataattgtactgaattgtgttcagtttgaaactgaatccaatgtcgatctccacatcttcatcatcatcttcaagcaaatcatggatcgtgcacagccttctcgtcggagctgcgatggcggttgccgccggtgcttatctccggcgaggtaatcgattcaggagccgtgtggtcgggattatacccgccaggtacgcttcctcgcgcttcgagggcaagccgctcgttgaaatcctcggcaagcccatgatccagagaacatgggaacgtgcaaacttggcgacaatgctggaccatgttgttgttgccacggatgatgaaaaaatcgctacttgttgtcgaggatttggtgctgatgtcataatgacatctgaatcttgtcgaaatggtactgagcgatgtaatgaagcacttcaaaaacttaaaaagaagtatgatgttgttgtcaatatacaaggggatgaaccactcattgaacctgaaataattgatgggattgttaaagcattgcaggctgctcctgatgcagtgtttagcactgctgtgacatctttagcacccgaagatgcttttgatccgaatcgtgtgaaatgtgtggtggataacagtggttatgcaatttatttttcacgaggattgattccttataacaagtcagggaaagtcaatccgaaatttccgtacttgcttcaccttggaattcagagttttgatacaaagttcctcaaaatataatcagagctcccgcccacccctctgcaactagaagaagacctggaacaattaaaagtcctggagaatggatacaagatgaaggtgataaaagttgaccacaatgcccatggtgttgacaccccagaagatgttgaaaagattgaacgttatatgcgtgagagaaatttgtcttagtcctgcagggtacaagcagtttatagaatatagtcttggaaggaggatgttctttcccagtgtctggttttgtcagcaaaagtttttgagacagagctcatactacattgattcttctatccgtattagggtgttggtaatatggattcagaaattttataatgttccaacgctttgtaattcgaaagatg

SEQ ID NO: 5485 - DNA, 3224 bp, Malus domestica
cccgaattcctgtacccgccgtatccgcctctgcaacatggaggagccaccgacacaaagctttctctacgaaaccttacccgccctctctcttcccaccctcaaccaatctccgccgccgcccgatgacctcgagccctactctgttttccgcaacgaaattactctctccactccccaatgcgctccggtcgacaccgccgcccccgatttcttctccctcgacgtcaccgccgatgaacctgacccaattctttcctccttgtcttctgtccgcctagcggagccatggacgccgctttaccaatccgagccgacgacgccggctcttgaagtcgagccgaagctagagagcgggtggtttcgtggccattgtaaattcaagagccctatgcttcagcttcataaagagatagtggatttttgtgattttctgtctccaaccccagaagaacaagagtcacgcagtgcagcagtacaacgtgtctctgacctaatcaaatatatatttcctcgatccaaggtactgtttttttcctacgtattggtgagtgcgaatgtgcaggttgaagtttttgggtccttcaagacggggctatatcttcccgctagtgatatcgatgttgtgattatggggtcaggcgtcaaaacaccacaggaaggattgaaggccctttctagggcattgtcacagatgggcctggcaaaaaggattcaggtgattggaaaagcacgtgtacctattattaagtttgtagagaaaacaagtggagttgcctttgacataagttttgacatagaaagtggaccaaaagctgctgattttattcagggtgcagtatctaagtggcctcctttgcggcctttatgtttgattttgaaagtctttttacaacagagagaactaaacgaggtgatgaagaagacgaaggcactgggcccaagagagacagcccaattggagcaattaaaacttaagagtggagaaatgcagcatacccagatggaatttcgcctctttcggcagctaagcaaggatttggagctgcttctggacaccccaattgagtacaactttgtcctgcagcttgagagaaaagcaaccgattttgtagtggtgggccgaacagaaattggaggcaaagaggatgagaacaaatgaagatgcaagatatcgaaccccgtacctctcgcatgcaaagagaactacatccccaaattgagcctcggggaatgtcgagctctggaacaaaacttgggagttcttttggtaaacttctttgatttttatggacgcaaattgaacacttcagatgttggtgtatcgtgtaacggagcaggcaccttttttaaaaagagtgttaaagggttcagaagcaatggacgaccctttcttctagccatcgaggacccccaggcaccggaaaatgacgtcgggaagagctccttcaactattttcagattagatcagctttttcaatggcgtacgctacattgacaaaccctaaggtcatcatgtgcctagggccaaacaggagcattctcggtaccataattaggcctgattcgacattggtggaacgcaaaggagggcctggaatggagttaccaggcaattggcagttagatgatgaagatgatcccctgccgcggggacatgattctgctgcaggtgacagtgggcaatcatcaggaaagaagaggaaagcttcatttaaagagaagtcaagtaagaagggaaaagaaaatggggaggtggggaagaagatcagatatgaagaaaatggctcaaggcgagagaagagcgggcatgaggaaaatggttcaaggaaagacaaggggaaaaagaagatgaggaggcagagacattcccaagatagtgccaatagttttggtccttatggtggctccccatatattgctccggacgggatccgggtccccaacttccgtctaccacaaacgacccgtttcgaacgggtgaaaatgaaatcaaacatcaacccaatgtcgacgtgctcgtcgtcgtcctcctctggatcttggaacagcaccaaggcatggatcgtccacggaatcgtcgccggagttgcggttgcggtggcaattggggcccgggtctacttgggtccgactaagaagttccggagccgggtcgtcggcatcatacctgcccgctttgcttcttctcgtttccagggcaagcccctcgttcagatcctcggaaaacccatgattcagagaacatgggaaagagcaaaacttgcaagtacactggatcgtgttgttgtggcgacagatgacgagaggattcaagaatgttgtcacagttttggagctgatgtcgtaatgacctcagaatcctgccggaacggtaccgagcgttgctctgaagcaattgagaagctcgagaagaattatgatatagttgtcaatattcaaggggatgagcctcttattgaacctgagataatagacggaattgttaaagctttgcaggaagctccagatgcagtgtttagtactgcagtcacgtcattaaaatttgaagatgcattggatccaaatcgagtgaaatgtgtggtggataatagtggttatgccatctatttttcaagggggctgattccatttaacaagtcaggaaaggcgaatccacagtttccctatttgcttcatctaggaattcagagctacgatacaaagtttctaaagatatatccagaacttcaacctactcctttgcaactagaagaggatctggagcagcttaaggtccttgaaaatgggtataagatgaaggtgattaaagttgaccatgaggctcacggtgttgacgcccctgaagatgttgagaagattgaatctctaatgcgcgaaaggaacttgtcttaggagttcctagtttgcagcagtaaatcagaccatggaaaagagtatgtcttccgtagactcgtaattattgtgattgtagctgttaagttttctaagggttttccggcatgctgccgagtttttgcaaaattttttgtatattaagagtgaattattaccagtcattccttgtggatctgtttatctcttccactgatgaatttggtatccatagccgaaagtttaggattctttattgtataatttgtattttaatgatgtttatcgtatgaattagtgtgtattactattatgtgccataattgagggattaaattttgttcacata

SEQ ID NO: 5486 - DNA, 1132 bp, Gossypium hirsutum
aattacattaccttgttcccgcaaagtcgccttccaagacagtgaaacacacaattcaactctgtctccagatctctctgtctcccccttctctttctctctgaaaccaaataaaaataaattcgtgaacaccatgtcagtctgctcttcttcttcttcttcttcttcaacaggtaaagcttggatagttcacagtattttagctggcacagcaattgcggtagccattggtgcccgtgcctatctgggtcgggctaggaagtttcggacacgggtcgtgggaattatacccgccagatatgcatcttctcggttcgaaggcaagcctttggttcatatccttgggaaacccatgatccagaggacatgggagaggtcaaaactggcgaccacactggaccatctagttgtggcaacagatgatgaaaagatagcagaatgctgtcgaggatttggtgctgatgtgatcatgacatcagagtcttgtcaaaatggcaccgaaagatgtaatgaagctcttgaaaagctagagaagaagtatgacattgttgtgaatattcagggagatgaacctcttattgaacctgagataatagatggaattgttaaagctctgcaggcagcaccagatgcagtgtttagcactgctgtgacttctttgaaaccagaagatgcttttgatccaaatagagtgaaatgtgtggttgataatcgcggttatgctatttatttttctagaggactaataccatttaacaaatctgcgaaagtcaatccacagttcccttacatgcttcatcttggaattcagagctatgattcaaagtttctgcaaatatatccgaagcttcagcctacaccactgcaactagaagaggatctggaacagcttaaggtccttgagaatggctataagatgaaggtgataaaggttgagcatgaggctcatggagttgacacacctgaagatgtggagaagattgaatcattaatgcgtgagagaaacttgtcttaacaacttctttgtggaataggaaggttatacatttttctactatctttattaatgtaagatttgagaatttaaattaatcaaatgttttctgataaatcttaaataatgctagggtga

SEQ ID NO: 5487 - DNA, 1133 bp, Trifolium pratense
ttgtgccatgactatttgttcctcaccttcttcttcatcatcatcttcttcttccaataactcgaaaacatggattatccatggaattgtagctggagttgcaattgtagccgctgcctccggtgctcacgcatacttccgtcgattcaacaaattccgtagccgcgtcgtaggcatcatacctgctcgatttgcttcctctcgcttctctggaaagcctctcgttcaaattcttggcaagcctatgatccagaggacatgggaacgggcaaagctggcagcttcattggatcatgttgttgtggcaactgatgatgaaaggattgctgactgctgtcggacatttggtgcagatgtcataatgacatcagagtcttgccgaaatggtactgagcgctgcgatgaagccctagagaagctcgggaaaaaatatgatattgttgtaaacattcagggtgatgagccacttgttgaacctgaaataatagatggtgttgtcaaagctttgcaggcagcgccagatgcagtttttagtactgcagttacgtctttaaagcctgaagatgcacttgatccaaacagagtgaaatgtgtggttgataatcgtggttatgccatctatttttcacgagggttaatcccattcaataagtcagggaaagtcaatcagcagttcccttatttgcttcatcttgggattcagagctatgatacaaagtttctaaagatatatccagatcttcaacctactccattgcaacttgaggaggttttggagcagcttaaagtccttgagaatggctataagatgaaggtaataaaggttgatcatgacgcccatggtgttgacacccctgaagatgttgaaaaaatagaatctctaatgcgacagaggaacttatcttgaacgtgtagtgaaaccgtctaaaaattagcttatttaatagcacaagaagtcacctataagcatggcttgtattttctttttcgtgtaaaatcactcttgctgcttttgatagattaccagtgttataatttgatttataatgttacttcttaggatagtcattactcattaggactagatttccatgtacacaaacacgtatatccgagaatgaaaattttattta

SEQ ID NO: 5488 - DNA, 953 bp, Cucurbita pepo
actcgtagcgggagatcatgtcggtttgctcttcttcttcctcttcatcatcaggcgggtacctcggcagtgccaaagcctggatcgtgcatgggattgttgccggaatcacaattggcgccgccatcggagctcgagcttatttgggtcgatccagaaaatttcggagccgcgttgtcggaatcattcccgcccgattcgcctcttcacggttccaggggaagcctctcgttgagattctcggaaagccaatgatccagagaacttgggaaagagcaaaaatggctactacattggattgtgttgttgtagcaaccgacgatgcaaagattgcacaatgctgtaaaggatttggtgctgatgttgtaatgacatcagagtcttgccggaatggaactgaacgttgtaatgaagcacttcagaagctggagaagaaatacgatatcgttgtaaatattcaaggagatgagccgcttatcgaaccggagatcatcgatggcattgttaaagctctacaggctgccccggatgcagtgttcagcactgcagtgacatccttaaaacctgaagatgcattcgaccccaatcgcgtgaagtgcgtagtggataatcgtggatacgctatttatttctcaagaggattgatccctttcaacaagtcaggaaaggtcaaccttcaatatccttatttacttcatcttggaatccagagttttgattcgaaatttttaagtatatatcctgaactccaatcaacaccattgcaactagaagaggatttagaacagctaaaagtgttggaacatggctacaaaatgaaggtgattaaggtcgaccacgaggcgcacggtgttgatgttcctggagatgtagaaaagatagaatcttttatgaaggaaaggaacctttcttaatgaagattaaccaaagaaagctatactttcgaattgata

SEQ ID NO: 5489 - DNA, 1213 bp, Beta vulgaris
actcacactccttcacatcttttcttcacttctttctcccacaattccgaaaatgtaccgacaatttttctaactgcaaaatcaccaaaacccatataaaaattcaaatcccatgaatcccctgtcaatgtgctcatcttcttcctcacaatcaagctcaacaaaaacttgggttgttcatgggctagtgttgggtgcagctgctgcggcagcaatcggcgcgcacgcctacttctttcttcgccgatccagaaaattccgtgcgcgcgtcattggaattatacccgcgcgctttgcatcttctcgctttgaaggcaaacctcttgtagaaattctcggaaaacccatgatccagaggacatatgaaagagcgaagctagcttctatgctggatcaagttgttgtggcgacggatgacaataagattgccgaatgctgccgaggatttggtgcagatgtaataatgacctcagaatcgtgtcgaaatggtgctgagcgttgcagtgaagcacttcaaaagcttaccaagaaatacgatgttgtcgtcaacattcaaggagatgagcctttgattgatcctgagataatagatgggatagttaaagctctgcagtctgctccagatgctgtcttcagcactgctgtcacacctttaaagcctgaggacgcttttgatccaaaccgtgtcaaatgtgttgtggataatcttggctatgctatctacttctccagaggactcatcccatataacaaatctgggaaggtcaatccggattttccatatatgcttcatcttggtattcagagctatgatgctgaattcctcaaaatatatccagatctgcaacctacgccgttgcaactagaagaagatcttgaacaactcaaagttctagaaaacggctataaattgaaggttataaaggttgagcatgaagctcatggagtcgatgttcctgaagatgtagaaaagatagaaagatatatgcgagagaaaaacttgtcctagtgtataagagaatattattccagaagtccagccgattcagtgtgattaatggaggttcgttttgctctctctttagtctttacttttcctttagatgatcaaagtgaagaatatgttctccctttgatgaacgtgaactgggtcagcttggaactttcttttctttgaatagcaccagtacaagagtgaattgtgtggggacct

SEQ ID NO: 5490 - DNA, 1332 bp, Euonymus alatus
tttcacttactcagcccactgacccaagtttaatgtcacccaaagaaaggaaaattcacagaaaattctgcagaaggtttagtcagtgacgctgaaattacttgactcaagtgaagaagatgggccctacttcagtctgctctccatcgtcatctgggtcttcttcatcgaccaagtctttgatcgttcatggcattgttgccggagcggccatagcagtggccatcggtgctggagcgtatcttggtcgatttagaaagtttaggagcagggtcgtgggtatcatacccgctcgttttgcttcctctcggttcgaggggaagcccctaatcgaaatccttggcaagcccatgatccagagaacttgggagaggagcaaattggcaactacattggatcatgttgtagttgcaaccgatgatgaaaagattgcggaatgctgcataggatttggcgctgatgtgataatgacatcagaatcttgccaaaatggcacggagcgatgcaatgaagcacttcagaaattagaaaagaaatatgatattgttgttaatattcaaggggatgagcctcttattgagcctgagattatagatggggttgttaaagcgctgcaggcagccccagatgcagtatttagcacagcagtcacttctttgaaacctgaggatgcctttgatccaaatcgagttaaatgtgttgtggataatcgtggctatgctctttatttttcacgaggactgattccatacaataagtcagctcaaatcaatccagattttccttatctgcttcatcttgggattcagagctatgattcaaagtttcttcgtatatatcctgatctccaacctacaccactacagctagaggaggatctggagcagcttaaagtcctggagaatggttataagatgaaggtgataaaagttgaccacgaggctcatggtgttgatattcctgaagatgttgagaagattgaagctttgatgcgtgagagaaacttgacctagtatgtagcatgaagtttagaccttgagaaaattatttttctgcatatattcttacaagtagcttgctcatcaaccgatcttatgtggatttggagtatgctgtctgatatgcactttcctagccaaaaaaagagagattcaaattaaggtgaccgggtaaggattcacgagtacactatagaattactgtggctatatgctaatttgttgtctggttggtttgtttttcttataatatgtatcatgtttttccattttttggtttagtaactgagcaaaggtggaaaatcggattctttaataaattatcgactgcttg

SEQ ID NO: 5491 - DNA, 1351 bp, Amaranthus tuberculatus
caagcaacctttgtttctcccgcggcaccgagagacagagcgtaccgacaagcataagagccacaacacaaatcaagaaatttcttgatgtcgatgtgtacatcatcttcctcgtcatcatcaaactccacaaagacatggattgttcatgggttgttattgggagctgctgcaattggtgcacacgcttaccttttgcttcgccgatccagaaaatatcgttcccgtgtcatcggaatcattcctgctcgctttgcttcttcccgttttgaaggaaagcctcttgtcgacattcttggcaaacccatgatccagaggacatatgaaagagcaaagctggcatctatgttggatcaagttgttgtagcaacagatgacaataagattgcagactgctgccgtggatttggcgccgaatgtaattatgacctcagaatcttgtcgaaatggtgctgagcgttgcagtgaagcactaaacaagcttggaaagaagtatgacattgtcgtcaatattcaaggggatgagcccttgattgaacctgagatcatagatgggatagttaaagcactccagtcggctccggatgctgtcttcagcaccgcagtgactcctttgaaggctgaggatgcttttgacccaaaccgggtgaaatgtgttattgataatcatggatatgctatctacttctccagaggacttgttccatataacaaatctgggaaggtcaatccagatttcccatatttactccatcttggtatccagagctatgatgctgagttcctcaaaatatatccagacctaccacctaccccgttgcaactcgaagaagatctggaacaactcaaagttcttgaaaatgggtataaattgaaggttataaaggttgaacatgaagctcacggagtggatgttcccgaagatgtagaaaaaatagaaagatatatgcgtgagagaaatctatcctagtttctttgagaaaacgtttgtgtggaaatacaggatattcaatatggatatgcagaggtttgttttgcttattttctttcgtttgtagatgaccgaagaggatattataccgtcactgatgaagtgcctcatcttaaacgtgtttatttcgtttatttttaaaatttaagaatagaaacagatgtaccagtgagttgcgtgaagaattcctatacatcgtttgtggtcgatccaggaacagctcatacatatatcgacatctttaatttctgaaattttctagaattatttgtattgttgtacacagtaaaaccaatttgagatgaacggatttcgttgttagtttgttacaatgatcttaacatatctatatcaatgtcg

SEQ ID NO: 5492 - DNA, 1386 bp, Cajanus cajan
gtaggcaaggtagatctgcggagcgcagatagatgcaataattgattgtctgaaattcgataacgtcaccgatttcgtttgggtccccactccccaaacactctcatcttccttccttttatcctcttgtttggatcatggcaatttgttcctcaccctcctcatcttcttcttcttcttcttcttcttcttctacgtcgtcgtttggttctcccaacaacgccaagacctggatcatccatggcattgtggctggggttgcgattgcagcggcggtgggtgcacgcgcctacatgacccgattcaacaagtttcggagtcgggtcgtcggtatcatacccgcccgatacgcttcgtctcgcttccagggaaagcctctcgttgaaatccttggcaagcccatgatccagagaacatgggaaagggcaaagctggctgctacattggatcatgtcgttgtggcaactgatgacgaaaagattgctgactgctgtcgacaatttggagctgatgttataatgacatcagaatcctgcagaaatggtactgagcgctgcaatgaagccctacaaaagcttgggaaaaaatatgatattgttgtgaacattcagggtgatgagccacttgttgaacctgagataatagatggtattgttaaagctttgcaggcagctccagatgcagtgttcagcactgcagtcacatctttaaagcctgaagatgcacatgatccaaatagggtgaaatgtgtggtagataatcgtggttatgccatctatttttcacgaggattaatcccgttcaacaagtcagggaaggtcaatcaacaattcccgtatttgcttcatcttgggattcagagctatgatacgaagtttctgaagatataccctgatcttcaacctactccattgcaacttgaggaggatttggagcagcttaaagtccttgagaatggctacaagatgaaggtgataaaagttgatcatgaggcccatggtgttgacactcctgaagatgttggaaagatagaatcttttatgcgtgagaggaacttgtcttgaactctcagatacagcaatgaaaccatatgcaaatcaatcataaagcacattacatcacagatagaaaagggttttatttatttattttcttttagtatatatcttcttgttttattatgtataatgtatgttattttcttaatacagcaatgtattttatcatcatagtacttattttattatttatagtgtatgttattttcttaatacagcaatgtatgttatcatcatagtacttattttattatttataatgtatgttattttcttaatcatcggcagtatgacttggtttcttggtttcatgtacgactattaatat

SEQ ID NO: 5493 - DNA, 1043 bp, Cucumis melo
tcccaatttcccatcggtgcaatagcgagctcttttcttagcgggagaccatgtcggtttgttcttcttcttcatcttcatcatccggttacctcggcagtgccaaggcctggattgttcatagtatcgtcgccggaatcgctatcggtgccgccttcggagctcgatcttatttgggtcgatccaagagattccgtagccgcgttgttggaatcattcccgcccgctttgcctcttctcggttcgaggggaagcctctcgttgagattctgggaaagcccatgatccagagaacatgggaaagggcgaaaatggctactacattggattgtgttgttgtagcaaccgatgatgctaagattgcacaatgctgtaaaggatttggtgcggatgttgtaatgacatcagagtcttgccggaatgggactgagcgttgtaatgaagcacttcacaagcttgaaaagaaatatgacatcgttgtaaatattcagggggatgagcctcttattgaaccagagatcattgacggcatcgttaaagctttgcaggctgccccggatgcagtgttcagcactgccgtgacatccttaaaatctgaagatgcattcgatcccaatcgggtgaagtgcgtagtggatagtcgtggttatgctatctatttttcaagaggactgatccctttcaacaagtcaggaaaggtcaaccttcaatttccttatttgcttcatcttggaatccagagctatgattcgaaatttttaagtatttatcctgaactcgaaccaacaccattgcaactagaggaggatttagaacagctaaaagtattagaacatggctacaaaatgaaggttattaaggttgaccatgaggctcatggtgttgatgttcctgaagatgtggaaaaaattgaatcttttatgaaggaaaggaacctagcttaactaagaccaacagaacaaagttacttttattcgataccaatttcatttttagtatttatagtatttatacgggcttgaaaacatttgttgttactttgt

SEQ ID NO: 5494 - DNA, 1729 bp, Malus domestica
tcaaaaaatactaaagtcaaattgcaagataaatccaagcgagccaaagcgttagcaaccaaattcgtttctcgatagacaagtcacaagaggagctacaatcgtaaaataaaatcatgacaatataagatcaaactccctaaagaattgattatacatttgagcatttagaatcaagagcaagtcggttgatccaacttccaattacccaaaacgacccgtttcaaacaggtgaaaagtataaataccccaagaaaaccagaaatcttaccaaactaaacgatagctgcgttcactcggttcagtgagatcaacatcatcccaatgtcgtcgtcgtctggatcttggaacagcaccaaggcatggatcgttcacggaatcgtcgccggagttgcggttgcggcggcaattggggcccgggcctacttgggtccgactaggaagttccggagccgggtagtcggcattatacccgcccgcttcgcttcttctcgtttccagggcaagcccctcgttcagatcctcggcaaacccatgattcagagaacatgggaaagggcaaaactagcaagtacattggatcatgttgttgtggcaacagatgatgagaagattcgagaatgttgtcgcagttttggagctgatgtcataatgacctcggaatcctgccggaacggtaccgagcgttgttctgaagcaattgagaagctcgagaagaagtatgatatagttgtcaatattcagggggatgaacctcttattgaacctgagataatagatggaattgttaaagctttgcaggcagctccagatgcagtgtttagcactgccgtcacgtcattaaaacttgaagatgcaatggatccaaatcgagtgaaatgtgtggtgaataatagtggttatgccatctacttttcaagggggttgattccatttaacaagtcaggaaaggccaatccacagtttccctatttgcttcatcttggaattcagagctatgatacaaagtttctaaagatatatccagaacttcaacctactcctttgcaactagaagaggatctggagcagcttaaggtccttgaaaatgggtataagatgaaggtgattaaggtcgaccatgaggctcacggtgttgacaccccagaagatgttgaaaagattgaatctctgatgtgcgaaaggaacctgtcttaggagttgtagtttgcagcagtatatcagaccatgggaaaaagagtatgtcttccgtagactcgtaattattgtgattatagttaagttttctaaggggtttgccgtggcatgctgccgggtttgtgcaaatttatttgtatattaaggtgggacgggacagaacggagtgggacgaggcgttccgtcccacgtttggtgcgcctaaaacgggtggaacgcgctgttctacgggacaagttttgggtgaattttcattccgcctcaccttcctggaacgactcgttccacatccgtggaacacaaaattataacctctttgtttctttcttcttcctccttgtttccatccgaaggcatctttgctccctctttgttccgtcccgtgccgtcttgtcccgttccatttcgtcccgtcccatctgcataccaaacgatacctaagagtgatttatttccagtccagccattccttgtagatctgtttctcttccactgatgatttggtatacatatccgaaagtttagaattctc

SEQ ID NO: 5495 - DNA, 1026 bp, Glycine max
gtcactgagttcattatttcattcatccttagcttattcctcttgtttgggtcatggcaatttgttcctcaccatcatcgtcatcgtcatcttcttcttctacgtcgtcgtttggttcctcgaacaccgcgaaggcgtggataatccatggcattgtggccggagtggcgattgctgcggcggtgggcgcacgcgcttacatgacccgattcagcaagtttcggagccgggtcgtgggcatcatacccgcccgattcgcttcctcgcgctttgagggaaagcctctcgttcaaatcctgggcaagcccatgatccagagaacatgggaaagggcaaagctggcagctacattagatcatgttgttgtggcaactgatgatgaaaagattgctgactgctgtagacaatttggagctgatgttataatgacctcagaatcttgcagaaatggtactgagcgctgcaatgaagccctacagaaacttgggaaaaaatatgatattgttgtcaacattcagggtgatgagccacttattgaacctgagataatcgatggtgttgtgaaagctttgcaggcagctccagatgcagtgttcagcacagcagtcacatctttgaagcctgaagatgcccatgatccaaatagagtgaaatgtgtggtagataaccgtggttatgccatttacttttcacgaggattaatcccattcaacaagtcagggaaggtcaatcaacagttcccgtatttgcttcatcttgggattcagagctatgatgcaaagtttttgaatatataccctaatcttcgacctactcctttgcaacttgaggaggatttggagcagcttaaagtccttgagaatggctacaagatgaaggtgataaaagttcatcatgaggctcatggtgttgacactcctgaagatgttggaaagatagaatctctaatgcgtgagaggaacttatcttgaactctcaccacggcagtgaaaccatatatgcaaattaatcattagcacaccacca

SEQ ID NO: 5496 - DNA, 1053 bp, Ambrosia trifida
agccaatgagcccaaatccgatctgcaccggatcttcttctacagatcacagttcaccaaattactgattctgcatggcgtggccgccgccgccgccctagtcgccggagcccacgcttacttgtattaccggcggtccaccgccatgtttcggagtcgagtatgggcataattccagcaagatttgcttcttcccgcttccaaggcaaaccccttgttgagatccttggcaaacccatgatccagaggacttgggagagagcaaagttggctacgacattggaccgtgttgttgtggcaacggatgatgaaaagattgcggaatgttgtcgagggtttggtgctgatgtaataatgactgcagaatcgtgcagaaatggtgctgagaggtgtagtgaagcacttcagaagctcgagaaaaagtatgatattgttgtcaatattcaaggagacgaacctctgattgaactgaaataattgatgggattgtcaaagctcttcagaccaccccagatgcagttttcagcactgcagtaacatctttgaaaccagaagatgcttttgatccaaatcgtgtgaaatgtgtggttgataatcgtggttatgcgatctacttttctcgagggctgatcccttttaacaagtcagggaaagtcaatcctgcattcccatataatcttcatctaggcattcagagctatgattcggaatttctgaagatctatcctgatctgactccaactccgttgcaactggaagaagatttggaacagttgaaagttcttgaaaacggttacaagatgaaggtaataaaagttgatcatgatgctcatggtgtcgatacgcctgaagatgttgccaagattgaaagttttatgcgcgaaaggaacttgtcttagcttcgtgttgggatttgtctagctgaaatgaggttttgccaccaaagtattgagctttcatcacattagtgtttgtttaaatgttttccttggtttattttcgtcaatgagtgtaatttgtaacgtaaagcttgaatttctaaccgtaatgatg

SEQ ID NO: 5497 - DNA, 1447 bp, Chenopodium quinoa
acatgattcgaacccaggtactcaatattgcaagctttttatcatcaactatcttttctcacttttctcccacaatccccaaatatgcaccgacaaccataactgtatcatcataaatccttcatcaaagagagaaaaacgaagaattcaatcaaatccaacgaaccccatgtcaaattcttcatctttatcttcttcgagctccacaaaatcgtgggttgttcatggattggtggttggagcagcggttgcggcttccattggtgctcacacatacttctacttccgtcgatctcggagatttaggtcccgggttatcggaattattcccgctcgatttgcttcttctcgatttgaggggaaacctcttgttgatattcttggcaaacctatgatccagaggacatatgaaagagcgaagctggcttctatgttggatcaagttgttgtggcaacagatgataataagattgcagaatgctgccgaggatttggtgcagatgtaataatgaccgcagaatcttgtcgtaatggtgctgagcgttgcagtgaagcacttcagaagctcaacaagaagtacgacattgttgtcaacattcagggggatgagcctttgattgaacctgagataatagatgggatagttaaagctctacagtctgccccagatgctgtcttcagcactgctgtcacaccattaaagcctggggacgcttttgacacaaaccgtgtgaaatgtgttgttgataatcttggctatgctatctacttctccagaggactcatcccatataacaaatctgggcaggtcaatccggatttcccatatttgctccatcttggtattcagagctatgatgccgaatttctcaaaatatatccagatctgccacctacaccgttgcaactagaagaagatcttgaacaactcaaagtccttgagaacggctataaactgaaggttataaaagttgagcatgaagctcatggagtcgatgttcctgaagatgtagaaaagatagaaagattcatgcgtgaaaagaacttatcatagttttacaagagtgtcatcacagaattacagactgactcggtgtgattttagtgaggtttggttttcttgctgtccttatgcttagacaattgaagagaagaatatatttgtcgatgaacaactttggatttttttttctactgaatataaaaagtaagataggtgagaattgtgtgaagaaaccttttgacagtttctactcagcttatagtggattgcatagcttcttgttagcttcaattctatctctatacacgatgtaataaaaccatttgagatggaggtgtgcaatttgttgtcattgatatgttgaaacccaatcagtgaacatgtttgtaatgtgtttctataaatctctttaatggttttactgcattctcttccgaaacatcg

SEQ ID NO: 5498 - DNA, 1109 bp, Eschscholzia californica
agaaatatgagcacattgtgttcatcatcggaaaacaacagcagcaagagttggatcgtccatgccctagttgccggtgctgcaattgcagcggcagccggagcttactcattaatttcacttcgtcgatacggaaaatttcgttctcgtgtcattggtatcgttcctgctcgttttgcttcttctaggtttgaaggaaaaccccttgtcaaaatcctcggcaaacccatgatccagaggacgtgggaaagagcaaagttggcatcaaccctagaccatattgttgtggcaacggatgatgaaaggattgccgaatgttgtcgagggtttggagcagatgttataatgacatcagaatcttgtcaaaatggtactgaacgttgcaatgaagcactaatgaaaattggcaagaaatatgatattgtcgtcaatattcaaggggatgagcctcttattgaacccgatattatagatggaatcgtaaaagctctgcaggaagctccagatgctgtttttagcactgccgttacatcactaaaacctgaagattcaagtgatccaaacagggtgaaatgtgttgttgacaatcgtggatacgccatttatttctcaaggggattgatcccatataataaatcaggaaaagtcaatccgaacttcccatatttacttcatctcggtatccagagctatgatgtgaagttcttgaagatatatccagagcttacgcctactccactgcaacttgaagaagacttagaacaacttaaagttctcgagaatgggtataaaatgaaggtgatcaaggttgaccatgatgctcatggtgtggacactccagaagatgttgagaagatagaagctcttatgcgtgaaagaaacttatcttgatccgcaaaacaaatcaacgattctgaggaagaaatctcatctttagattgaccttcccgtgcatttttacattttgaggttgatcttgtattcttctattgtctacatttgattggggatttttttttatccaccaagacttcgtatgagtttctttttttatgagatacttcggatgagtttgggatacctcaattatattcgcaaatatactttcc

SEQ ID NO: 5499 - DNA, 1123 bp, Trifolium pratense
catcatcatcttcttccaataactcaaagacatggatcatccatggaattttagctggagttgcaattgcagccgctgcatccggtgctcacgcttacttccgtcgattcaacaaattccgtagccgagtcgttggcatcatacctgctcgatttgcttcctctcgcttctctggaaagcctctcgttcaaattcttggcaagcctatgatccagaggacatgggaaagggcaaagcttgcagcttcattggatcatgttgttgtggcaactgatgatgaaatgattgctgactgctgtcggacatttggtgcagatgtcataatgacatcagagtcttgccgaaatggtactgagcgctgcgatgaagccctagagaagctcgggaaaaaatatgatattgttgtaaacattcagggtgatgagccactaattgaacctgaaataatagatggtgttgtcaaagctttgcaggcagcgccagatgcagtttttagtactgcagttacgtctttaaagcctgaagatgcacttgatccaaacagagtgaaatgtgtggttgataatcgtggttatgccatctatttttcacgagggttaatcccattcaataagtcagggaaagtcaatcagcagttcccttatttgcttcatcttgggattcagagctatgatacaaagtttctaaagatatatccagatcttcaacctactccattgcaacttgaggaggatttggagcagcttaaagtccttgagaatggctataagatgaaggtaataaaggttgaccatgacgctcatggtgttgacacccctgaagatgttgaaaaaatagaatctctaatgcgcgagaggaacttatcttgaacgtggagtgaaaccgtctgaaaattagcaattttattagcacaagaagtttcctataaggatggcttgtattttcatttacacgtaaaatcactcttgttgcttttgatagattacctgtgttataatttgatttataatgttactttttaggatggtcattactcattaggactagatttccatgtacacaaacaagtatatccgagaatgaaaattttatttatacaaaaaagaagaaagtaccgattgcg

SEQ ID NO: 5500 - DNA, 1157 bp, Ambrosia trifida
ggggatacacacacactctaatcactcaagccaatgagcccaaactcgatctgcaccggatcttcgtctacagatcacggttcaaccaaattactgatcctgcatggcgtcgctgccgccgccgccctagtggccggagcccacgcttacttgtattaccggcggtccaccgccatgtttaggagtcgagtagtgggcataattccagcaagatttgcttcttcacgctttcagggcaaaccccttgttgagatccttggcaagcccatgattcagagaacttgggagagagcaaagctggcaacaacattggatcgtgtcgttgtggcaacggatgatgaaaagatcgccgaatgctgtcgaggatttggcgctgatgtaataatgactgcagaatcatgcagaaatggtgctgagaggtgtagtgaagctcttcaaaagctcgagaagaagtatgatattgttgtcaatattcaaggagacgaacctctaattgaacctgaaataattgatgggattgtcaaagctcttcagaccaccccagatgcagttttcagcacagcagtcacggccttgaaaccagaagatgcttttgatccaaatcgcgtgaaatgtgttgttgataatcgtggttatgccatctacttttctcgagggctgatcccctttaacaagtcagggaaagtcaatcctgcattcccgtataatcttcatctaggtattcagagctatgattcggaatttctaaagatatatcctgatctgactccaactccgttgcaactggaagaagacttggaacagttgaaagttcttgaaaatggttacaagatgaaggtaataaaagtcgatcatgatgctcatggtgtcgatacgcctgaagatgttgccaagattgaaagctttatgcgcgaaaggaacttgtcgtagcttcatgttgggatttgtctagctgcaatgaggttttgccaccaaaatatcgagctttcataacactagtgtttgtttaattgttttcctttgtttattttcctcaatgagtgtaatttgtagcgtaaagtttgaatttctaaccataatgatggtaatcagtatcttcgtaatgcctttgttgtatactttgagaacgttatatattgtagaaagttttctagaca

SEQ ID NO: 5501 - DNA, 1107 bp, Glycine max
cgccagttagtcactgagttcatccattcatccttcgcttattcctcttgtttgggtcatggcaatttgttcctcactttcatcgtcatcgtcatcgtcttcttcttctacatcgtcctttggttcctcgagcaccgcgaaggcgtggatcatccatggcattgtggccggagtggcgattgctgcggcggtgggtgcacgcgcttacatgactcgattcagcaagtttcggagccgggtcgtgggcatcatacccgcccgattcgcttcctcgcgcttccagggaaagcctctcgttcaaatccttggcaagcccatgatccagagaacatgggaaagggcaaagctggcagctacattggatcatattgttgtggcaactgatgatgaaaagattgctgattgctgtcgacaatttggagctgatgttataatgacatcagaatcttgcagaaatggtactgagcgctgcaatgaagccctacagaagcttgggaaaaaatatgatattgttgtcaacattcagggtgatgagccacttattgaacctgagataatagatggtgttgtgaaagctttgcaggcagctcctgatgcagtgttcagcactgcagtcacatctttaaagcctgaagatgcacatgatccaaatagagtgaaatgtgtggtagataatcgtggttatgccatttatttttcacgaggattaatcccattcaacaagtcaggaatggtcaatcaacagttcccgtatttgcttcatcttgggattcagagctacgatgcaaagtttctgaatatataccctgatcttcaacctactccgttgcaactcgaggaggatttggagcagcttaaagtccttgagaatggctacaagatgaaggtgataaaagttgatcatgaggctcatggtgttgacactcctgaagatgttggaaagatagaatctctaatgcgtgagaggaacttgtcttgaactctcagacacagcagtgaaatcatatgcaaattaatcattagcacaccgcatcgcaaatagaaaaagggttcattttatttttttgttttagtataaaccttcttgttgcttacaacatagtacgc

SEQ ID NO: 5502 - DNA, 1194 bp, Daucus carota
gattgatactcataatttatataaaaactgtacagagattcatgtatatatagagttaagcatacagagcttatgaactcgacaatttgaacaattctactgaattaagttcagtttgaagctgaatccaatgtcgatctccacatcttcatcatcatcatcttcaagcaaatcatggatcgtgcacagcctcctcgtcggagctgcgatggcggttgccgccggtgcttatctccggcgaggtaatcgattcaggagccgtgtggtcgggattatacccgccaggtacgcttcctcgcgcttcgagggcaagcctctcgttgaaatcctcggcaagcccatgatccagagaacatgggaacgtgcaaacttggcgacaatgctggaccatgttgttgttgccacggatgatgaaaaaatcgctacttgctgtcgaggatttggcgctgatgttataatgacatctgaatcttgtcgaaatggtactgagcgatgtaatgaagcacttcaaaaacttaaaaagaagtatgatgttgttgtcaatgtacaaggggatgaaccactcattgaacctgaaataattgatgggattgttaaagcattgcaggctgctcctgctgcagttgttagcactgctgtgacagccttagcacccgaagatgcttttgatctgaatcgtgtgaaatgtgtggtggataacagtggttatgcaatttatttttcacgaggattgattccttataacaagtcagggaaagtcaatccaaaatttccgtacatgcttgaccttggaattcagagttttgatacaaagttcctcaaaatatatccagagctcccgcccacccctctgcaactagaagaagacctggaacaattaaaagtcctggagaatggatacaagatgaaggtgataaaagttgaccacaatgcccatggtgttgacaccccagaagatgttgaaaagattgaacgatatatgcgtgagagaaatttgtcttagtcctgcagggtacaagcagtttatagaatatagtcttggaaggaggatgttctttcccattgtctggttttgtcagcaaaaatttttgggacgagctcatactacattgattcttctatccgtattagggtgttggtaatatggattcagaaattttataatgttccaacgctttgtgattcgaaagatgg

SEQ ID NO: 5503 - DNA, 2254 bp, Cicer arietinum
ttcctctctcctctcatctgtcacggtggtcttccatcagtccaccctccatatttcttatcacaaacttccttaatcatattattattcataccatagactaaattaatactatacccattttctcattatagtccctgaacaaatatctctttcaacctttaaatcaaacaccgtgtgtgcttcttggatcttgctatccttgcaaagccttgagatgaagaaattccagtgtttcatttccaaactaaaactagtacatgcaatccaaattcaacattcattccaaatttgacattcagtgatattcaaatttgctatcctttcaaaccgaataaaacatgcttgagatttggttgttttgccttttttgttggatcatgctttttggtagaattcaatggttgtggttactcgttgttgccgagaatttcaatcttatgatgacttcgattttcctaatttgaaattctctattttcaagcttttgagtggtaattaacagtgcataaattaacagtaacaaaatggaggataaatggtgagagggaaaaaaagggggctgatatggaggagccgccagttgagtacggggacagagtcacggtggtggtagcagtgatgctgaactgtgaccgacagaaaaaggaaaacattattcagtgttgagggtgcaccaaaagatctcgtggaatctctcaatccaatgactattaattgtgttccagcatgaggcacttgtttagtggtccaccttagacaccacccataaaacatgaggaattactttaacataaatagacagatctgaaaatattgtccactttgccactgtccccttctctccttaaagacttttcgtgccatggcaatttgttcttcaccctcatcttcttcttcatcatcttcttcatcctcgtatgattcttccaacaactcgaagtcattgatcatccatggcattgttgctggagtcgcagttgcagctgctgtcggtgctcgcacttacctgactcgattcaacaaattccgtagccgggtcgtaggcatcatacccgctcgatttgcttcgtcacggttctctggaaagcctctcgttcaaattcttggcaagcctatgatccagagaacatgggaaagagcaaagctggcagcttcattggatcatgtcgttgtggcaactgatgatgaaaagattgctgattgctgtcgccaattcggtgcagatgtcataatgacatcagtgtcttgccgaaatggtactgagcgctgcaatgaagcactacagaagctcgggagaaaatatgatattgttgtaaacattcagggtgatgagccacttgttgaacctgaaataatagacggtgttgtcaaagctttgcaggcagctccagatgctgtgtttagcactgccgttacgtctttaaagcctgaagatgctcttgatccaaacagagtgaaatgtgtggttgataatcgtggttatgccatttatttttcacgagggttaatcccattcaataagtcagggaaggtcaatcaacagttcccttatttgcttcatcttgggattcagagctacgatacaaagtttctaaagatatacccagatcttcaacctactccattgcaacttgaggaggatttggagcagcttaaagtccttgagaatggctataagatgaaggtaataaaggtcgatcatgatgcccatggtgttgacacccctgaagatgttgaaaaaatagaagctctaatgcgtcagaggaacttgtcttgaacgtgtagttatagcagtgaatccatcgaaattataaattattaaaacgagaagcaaccgacaaggaaggcttgtattcttttttaagcaatgctatataatatgaaagatgatgatgcacacgagtgtaacaatttgatctataatgttacatttatggatgggcattaggactagaaattcatgtacacatgtatatgggagaaagaaaaatttatttacacatatattatcttagaaaaatagcagttgcacttgcatgatattttgattcgtagtgttagttaaaagcttgtaagaaattgatttctattgtttgtagggctgtggtattgcatataattcatgtaagactaatattaataatgttgaattctgaataattatgttgaattatctttaatattggaagccagcaaaataacttcaatattgaaagtgaaagaacaatatacagaattttttaaatctgac

SEQ ID NO: 5504 - DNA, 1234 bp, Musa acuminata
tgcgtcaccatatctccccgacgctctgatccaattattcctctcgcgttgtcgactcggaatcttgatttgtctgctcttcgatggcgatctgcgctccctcctcctcggattcgtcgtcgggatccagggcgtgggtggtccacgcggcgttgctcggggcggcgatcgcggcggcggctggcgcacatttctacctccgccgctggtccagcgggttccggagccgggtggtcggcatcatccccgcccggttcgactcctcccgcttccagggcaaacccctcgctcaaatcctcggcaagcccatgatccagagaacatgggagagagcaaagttagcttcaaccttggagaatgttgttgttgcaacagatgatgaaaagattgcagaatgttgtagaggatttggagcagatgtcgtaatgacatcagttggatgcagaaatgggactgagcgttgcaatgaagcccttgaaaaacttggaaagaattatgacattgttgtcaatatccagggggatgagcctcttattgagcctgagataatagatggtattgttaaagcattgcagggagctcctgatgctgttttcagtactgctgtcacgtccttgaaacctgaagatggacttgatcccaacagggtaaagtgtgtggttgataatcatggttatgcgatctacttctcaaggggattgatcccattcaacaagtcagggaaagttaatccacaatttccttatctacttcatttaggcattcagagctttgatgcaaagttcttgaagatctacccacaactaccacctactcctctgcaactggaagaagacctggagcaacttaaagtgctggaaaatgggtacaagatgaaggtaatcaaggtgaatcatgacgcccatggtgtagacactcctgaggatgttgcaaaaatagaagcattgatgcgagaaagaaatattgcatagtggaatggctgaaacggtatgagagatctgatgcattcctatgcaattaagcgtcggaatgagcatttcatagggtggatcaacatctttaccaaatgattcttatgttactctacttcttagtgactatttcgttgttgttgctcattcaatttgtagcttttatcttgacaagataagttttatatcatatcggttgtatcgcatgaccaactcaatcaaaataagggagattgctcgatgagctatgttgtatgtatgag

SEQ ID NO: 5505 - DNA, 1001 bp, Cucumis sativus
aatagaaagggaaaaagaagggggaagcaacagccaacagcccaatttccgcatcagtgcaacagcgagctcttctcttagcgggagaccatgtcggtttgctcttcttcttcttcgtcatcatccggttacctcggcagtgccaaggcctggattgttcatggtatcgtcgctggaatcgccattggtgccgccttcggagctcgatcttatttgggtcgatccaagaaattccgtagccgcgttgttggaatcattcccgcccgctttgcctcttctcggttcgaggggaagcctctcgttgagattcttggaaagcccatgatccagagaacgtgggaaagggcgaaaatggctactacattggattgtgttgttgtagcgactgatgatgctaggattgcacaatgctgtaaaggatttggtgctgatgttgtaatgacatcagagtcttgccggaatgggactgagcgctgtaatgaagcacttcagaagcttgaaaagaaatatgacattgttgttaatattcagggggatgagccccttattgaaccagagatcatcgacggcattgttaaagctttgcaggctgccccggatgcagtgttcagcactgccgtgacatccttaaaacccgaagatgcattcgatcccaatcgggtgaagtgcgtagtggatagtcgtggttatgctatctatttttcaagaggattgatccctttcaacaagtcaggaaaggtcaaccttcaatatccttatttgcttcatcttggaatccagagctttgattcgaaatttttaagtatgtatcctgaactcgagtcaacaccattgcaactagaagaggatctagaacagctaaaagtattagaacatggctacaaaatgaaggttattaaggttgagcatgaggctcatggtgttgatgttcctgaagatgtggacaaaattgaatcttttatgaaggaaaggaacctagcttaactaagatcaacagaaca

SEQ ID NO: 5506 - DNA, 1417 bp, Lupinus angustifolius
aacaaaaataaaagataagttccacaagaatatcttgtcctcctaccatgtacgaaaagaaaaaacacatgcagatccaaaattacattcagtttgccactgtcacatcacatttgtgattggtccttcctctcgcattatccttcactttcttcttcttcttcttcttcatcatagcatgggaatttgttcatcaccttcatcgtcatttgaatcttccaataacggaaagacatggatcatccatggaattgtggtaggagtagcagttacagcagctgtggttgcacacgcttaccttaaccgattcaacaaaatccggacccgggtcataggcatcatacccgcccgattcgcttcttctcgcttcccgggaaaacctctcgttctaatccatggcaagcccatgatccagaggacatgggaaagggcaaaattggcagctacgttggatcatgttgttgtggcaactgatgatgaaaagattgctgactgttgtcgacaatttggagctgatgtgataatgacatcagaatcttgccaaaatggtactgagcgctgcaatgaagccctacagaagctcgggaaaaaatatgatgttgttgtcaacattcagggtgatgagcctctaattgaacctgaaataatagacggtgttgtcaaagctttgcaggcagatccagatgcagtgttcagcactgcagtcacatctttaaaccctgaagatgctcatgatccaaatagagtgaaatgtgtggtagacaatcgtggttatgccatctatttttcacggggattaatcccattcaacaagtcagggaagattaatcaacagttcccttatttgcttcatcttgggattcagagctatgatgcgaagtttctaaagatatatccttatcttcagcctactccattacaacttgaggaggatttggagcagcttaaggtccttgaaaatggctataagatgaaggtagtaaaagttgaccatgaggcccatggtgttgacactcctgaagatgttcaaaagatagaatctcttatgcttgagaggaacttggcttgaactctacagcaatgaaaccaagtgtaagctaagcattagtaacaatgcatcacagataaagatggcctgtaaccctctattttttttgcttgttgctttcaacaacttagcacaagtgtcttgatttatgatgaaatattttagtttaggtaataggaaatgtccccatttagtgttaatatatgatacagaagtgagaatgcaaacttttggttaagactttcagagaagtatgccagtaaactatattttcaaccatcattaagtctcaaatttttgtttgttgttttttttgtagagaaaatgttagttggttttataatgaagaaatttttgcttgctcctaaa

SEQ ID NO: 5507 - DNA, 1154 bp, Chenopodium quinoa
tcaatcaaatccaacgaaccccatgtcaaattcttcatctttatcttcttcgagctccacaaaatcgtgggttgttcatggattggtagttggagcagcggttgcggcagccattggtgctcacacatacttctacttccgtcgatctcggaggtttaggtcccgggttatcggaattattcccgctcgatttgcttcttctcgatttgaggggaaacctctggttgatattcttggcaaacctatgatccagaggacatatgaaagagcgaagctggcttctatgttggatcaagttgttgtggcaacagatgataataagattgcagaatgctgccgaggatttggtgcagatgtaataatgaccgccgaatcttgtcgtaatggtgctgagcgttgcagtgaagcacttcagaagctcaacaagaagtatgacattgttgtcaatattcagggggatgagcctttgattgaacctgagataatagatgggatagttaaagctctgcagtctgctccagatgcagtcttcagcactgctgtcacacctttaaagcctggggatgcctttgacacaaaccgtgtgaaatgtgttgttgataatcttggttatgctatctacttctccagaggactcatcccatataacaaatctgggcaggttaatccggatttcccatatttgctccatcttggtattcagagctatgatgctgaattcctcaaaatatatccagatttgccacctacaccattgcaactagaagaagatctggaacaactcaaagtccttgagaacggctataaactgaaggttataaaggttgagcatgaagctcatggagtcgatgttcctgaagatgtagaaaagatagaaagattcatgcgtgaaaagaacttatcatagttttacaagagtgcatcacagaattacagactgacttggtgtgattttagtgaggtttgtttttcttgctgtctttatgctttagacaattgaagagaagaacatacttgtcgatgaacaactttggattttttttttcactgaatataaaaagtaagataggtgagaattgtgtgaagaaacctttttgacagtttctactcagcttatagtggattgcatagcttcttgttagcttcaattctat

SEQ ID NO: 5508 - DNA, 1144 bp, Amorphophallus konjac
cggtgtgtgtggtgtggggggggcgggagtctttgttcggatggcgagtctgctcgccgtcgtcgatggcctcgtcgggatccggggtcagttcgtccaaggtgtggatcgtgcacgggctgatgctgggggcggcggtggcggccggagcctacgcggcgttctccttccgccggggcggaaggttccggagccgggttgtcggcatcatcccagcgcgtttcgcctcctcccgcttccaggggaagccccttgtcgacatcctcggcaagcccatgatccagaggacatgggagagagcaaaattggctactacattggatcatgtagttgtggcaacagatgacgaaaagattgcagagtgctgcaggggattcggagctgacgtgataatgacatcagaaacttgtcgcaatggaactgagcgctgcaacgaagcactccagaaacttgataaaaagtatgatatcgttgtaaatattcagggtgatgagcctcttatagaaccagaaataatagatggtgttgtaaaagctctgcagggagctcctgatgcagtgttcagcactgctgtgacatctctgaaacctgaagatggaactgacaccaaccgtgtaaagtgtatagtggacaatcatggctatgcaatttatttctccaggggattgatcccattcaacaagtcaggaaaagttaatcctaaattcccatatctactgcaccttggtattcagagctacgattcaaactttttaaggatttatccagagcttcctcctactcccttgcaactagaagaagacctagagcagttgaaggttcttgagaatggctacaaaatgaaggtaatcaaggtcgatcacgacgcccacggggtggacacccctgaagatgttgagaagcttgaagcactgatgcgagagaggaacctggcttaagatagaatttggggagccagcgaagaaagccgacgagtctttgtgaagatacacgcgaggttgcactcgtcttggggcatttccaggctcgtctcatatcgaactgtaactctgtataagtgggttgttcttgggatcccattagcgaggctgtttgtgttcgtgcctcgtgaccaaaccgaatcacgtaaaaatttccctccttt

SEQ ID NO: 5509 - DNA, 1231 bp, Raphanus sativus
ggaacagatcaatcttctctctctctctctctctctctttcactgaacagtctcacaagagcaaagtgaaagaccgttgcttgattaatgtcaccctcttcctcttcatcatcctcctcgtcttctcagaagacatggattgtacacgcaatcttagccggaacagcgatcgcagcagcgattggcgcacgtgcctatctgggtcgatccaggaaattccggagccgggtcgtcggaatcatccccgcccgttacgcctcctctcgattcgagggaaagcctctcgtgaaaatcctcggcaaacccatgatccagagaacttgggagagatcgaagttagcttctacgcttgatcacgttgttgtagcaacggatgatgaaaggattgcggattgctgtcgcgggtttggtgctgatgtcatcatgacttcagagtcttgcagaaacggtactgagcggtgcagtgaagcgctagaaaagctggagaagaagtatgatgtggttgtcaacattcaaggagatgaaccactcattgagcctgagattatagacggtgttgtcaaagcacttcagagagcacctgatgcagtgtttagcacagccgtgacttcattgaaaccagaagacggacttgatcctaaccgagtcaaatgcgtggtggacaaccgtggctacgctatctatttttcccggggtttgattccttataacaagagtggtaaagtcaatccagacttcccttacatgcttcatcttggaatacagagctttgattcaaagtttctcaaagtatattcggagcttcaaccaacgccactgcagctagaagaggatctagagcagctcaaagtccttgaaaatggctacagaatgaaggttataaaggtggatcatgaagctcatggagttgatacacctgatgatgtcgaaaaaatcgaatctttaatgcgggaaagaaacctcctctagtccacataataccagagatcttgctttcaaactttatacatgaaacgccttttcttgttttactgtgcgacttatcagtcaaattagggactataatagatatgcctgcaatgtggtgtggaacccaatggatattatattactttgtgattgaattcaattcttggcaccaccagttaacttacacctatttttttttgtaattttatgtagcagtacttgtgtttggttcagccaagaaaagatgagaattaaggaggga

SEQ ID NO: 5510 - DNA, 1263 bp, Trigonella foenum-graecum
gctattgtccactttgccactgtcaccttctcttcgtcgtgttatggcaatttgttcatctccttcatcatcatcatcatcatcatcatcttcgtcttcttcctcgattgattctcccaacaacacgaaggcatggatcatccatggaattttggttggagtttcaattgcagctgctgctggtgctcacgcttaccttagtcgattcaacaaattccgtagccgggtcgtaggcatcattcccgctcgatttgcttcctccaggttccaaggaaagcctcttgttcatattcttggcaagcctatgatccagagaacatgggaaagggcaaagctggcagcttcattggatcatgttgttgtggcaactgatgatgaaaaaattgctgactgctgtcggaagttcggtgcagatgtcataatgacatcagagtcttgccaaaatggtactgagcgctgcaatgaagccctacagaagcttgggagaaaatatgatatagttgtgaacatacagggtgatgagccacttgttgaacctgaaataatagacggtgttgtcaaagctttgcaggcagccccagatgcagtgttcagcactgcagttacggctttaaagcctgaagatgcacatgatccaaacagagtgaaatgtgtggttgataatcgtggttatgccatctatttttcacgaggattaatcccattcaataagtcagggaaggtaaatcaacagttcccttatttgcttcatcttgggattcagagctatgatacaaagtttctaaagatatacccatatcttcaacctactccattgcaacttgaggaggatttggagcagctcaaagtccttgagaatggctataagatgaaggtaataaaggttgaccatgaggcccatggtgttgacacccctgaagatgttgaaaaaatagaagctctaatgcgtcagaggaacttgtcttgaacatgaagttgtagcagtgaaaccgtctgaaaattagcaattatttacgcaagaagtcattgataaggatgcgctggatggcaactcttaatgctttcgatagagtacgagtgttataatttgatttataacgttacattaggggatgggcaataggaaaaaatatacacaagtatatgcgagaatgaaaattttatttatacgtatattgcacatgaatcattatcattagaaaatagtagtggcccttggatgatattatgatggaacggaaaattttcctttatataaataaa

SEQ ID NO: 5511 - DNA, 1075 bp, Arabidopsis thaliana
gcctcactctctcactcactcaccggagcaaagtgatgtcggtgtgttcttcgtcttcttcttctcagaaaacatggattgttaacgggatcttggccggaacagcgattgcagccgcaatcggcgcacgtgcttatctgggtcgatccaagaaattccggagccgggtcgtcggaatcattcccgcacgttacgcttcctctcgattcgagggtaagcctctcgtgcaaatcctcggcaaacccatgatccagagaacttgggagaggtcgaagttagctactacgcttgatcatattgttgtagccactgatgatgaaagaatcgcggagtgttgtcgtggatttggtgccgatgttatcatgacttcagagtcttgcagaaatggcactgagaggtgcaacgaagcgctagaaaagctggagaagaagtatgatgtcgttgttaacattcaaggagatgaaccacttattgagcctgagattatagacggtgtagtcaaagcacttcaggtaacaccggatgcagtgtttagcacagcggtgacatcattgaaaccagaagacgggcttgatcctaaccgagttaaatgtgtggtggacaatcgtggctatgctatctatttctcaaggggtttgattccttataacaagagtggtaaagtcaatccagattttccgtacatgcttcatcttggaattcagagctttgattcgaagtttctgaaggtatattcagagcttcaaccaacgccattgcagcaagaagaggatctagaacagctcaaagttcttgagaatggctacaaaatgaaggttataaaggtagatcatgaagctcatggagttgacacacccgatgatgtcgaaaagattgaatctttaatgcgcgaaagaaacatgtcctagtccacaaaatcattttcctttcttttctttttttccctttcattaggagtacgtgataaacgccttgaaagagttgtggcattgtgtgtgagacatcgaaggtttactgatacgacatcgaaggtttactatcatttacctaaagaaagtatcgtgttactttttga

SEQ ID NO: 5512 - DNA, 1024 bp, Brassica oleracea
gatcaaactgaaagaccgctgcttgattaatggcactctcttcttcttcatcttctcagaagacatggatcgttcacggtatcttagccggaacagcgatcgcagcggcgattggcgcacgtgcctatcttggtcgatccaggaaattccggagccgggtcgtcggaatcatccccgcccgttacgcttcctctcgattcgagggcaagcctctcgtgcaaatcctcggcaaacccatgatccagagaacttgggagaggtcgaagttagcttctacgcttgatcacgttgttgtagcaacggatgatgaaaggattgcggattgctgtcgtgggtttggtgcagatgtcatcatgacttcagagtcttgcagaaatggtactgagcggtgcaatgaagcactagaaaagctggagaagaagtatgatgtggttgttaacattcaaggagatgaaccactcattgagcctgagattatagacggtgttgtcaaagcacttcaggtagcacctgatgcggtgttcagcacagcggtgacgtcattgaaaccagaagatggacttgatcctaaccgagtcaaatgtgtagtggataaccgtggctacgctatctatttctccaggggtttgattccttataacaagagtggtaaagtcaatccagattttccttacatgcttcatcttggaatacagagctttgattcaaagtttctcaaagtatattcggagcttcagccaacaccattgcagctagaagaggatctagagcagctcaaagtccttgaaaatggctacaaaatgaaggttataaaggtggatcatgaagctcatggagttgatacacctgatgatgtcgaaaaaatcgaatctttaatgcgcgaaagaaacctcctctagtccacataatacagagatcttatgcataatgtctccactatctagaataggataattcgccctaaatattatctgttacttgtttgtaaacattatgcaagtatggcgactaagtttaaaagcgc

SEQ ID NO: 5513 - DNA, 1210 bp, Brassica rapa
attaaaccggaacagaccggtccttcgctggcacgtccaccggttttattaaaggaacaaactctccactgaacacactctcaccggatcaaactgaaagaccgctgcttgattaatggcactgtcttcctcttcatcttctcagaagacatggattgttcacggtatcttagccggaacagcgatcgcagcggcgattggcgcacgtgcgtatctgggtcgatccaggaaattccggagccgggtcgtgggaatcatccccgcccgttacgcttcctctcgattcgagggcaagcctctcgtgcaaatcctcggcaaacccatgatccagagaacttgggagaggtcgaagttagcttctacgcttgatcacgttgttgtagcaacggatgatgaaaggattgcggattgctgtcgtgggtttggtgcagatgtcatcatgacttcagagtcttgcagaaatggtactgagcggtgcaatgaagcactagaaaagctggagaagaagtatgatgtggttgttaacattcaaggagatgaaccactcattgagcctgagattatagacggtgttgtcaaagcacttcaggtagcacctgatgcggtgttcagcacagcggtgacgtcattgaaaccagaagatggacttgaccctaaccgagtcaaatgtgtagtggataaccgtggctacgctatctatttctccaggggtttgattccttataacaagagtggtaaagtcaatccagattttccttacatgcttcatcttggaatacagagctttgattcaaagtttctcaaagtatattcggagcttcagccaacaccattgcagctagaagaggatctagagcagctcaaagtccttgaaaatggctacaaaatgaaggttataaaggtggatcatgaagctcatggagttgatacacctgatgatgtcgaaaaaatcgaatctttaatgcgcgaaagaaacctcctctagtccacataatacagagatcttatgcataatgtctccactgttacttgtttgtaaacattatgcaagtatggcgactaagtttaaaagcgcaatcagaaacgaacaatacaaagattgagtttcaaaattatatgtaactagaaaaactgtagaatcacaaccatacaatattaattaatgaaatttcaaaaaggatgtatgttattggtttgtataatttagtgg

SEQ ID NO: 5514 - DNA, 1313 bp, Brassica napus
tacgatagcttgatattgaactcgtatcgtacattacgtgcggtgacctctcaccgtgatcaactgaaagaccgctgcttgattaatggcactgtcttcttcttcatcttctcagaagacatggatcgttcacggtatcttagccggaacagcgatcgcagcggcgattggcgcacgtgcgtatctgggtcgatccaggaaattccggagccgggtcgtgggaatcatccccgcccgttacgcttcctctcgattcgagggcaagcctctcgtgcaaatcctcggcaaacccatgatccagagaacttgggagaggtcgaagttagcttctacgcttgatcacgttgttgtagcaacggatgatgaaaggattgcggattgctgtcgtgggtttggtgcagatgtcatcatgacttcagagtcttgcagaaatggtactgagcggtgcaatgaagcacttgaaaagctggagaagaagtatgatgtggttgttaacattcaaggagatgaaccactcattgagcctgagattatagacggtgttgtcaaagcactccaggtagcacctgatgcggtgttcagcacagcggtgacatcattgaaaccagaagatggacttgaccctaaccgagtcaaatgtgtagtggataaccgtggctacgctatctatttctccaggggtttgattccttataacaagagtggtaaagtcaatccagattttccttacatgcttcatcttggaatacagagctttgattcaaagtttctcaaagtatattcggagcttcagccaacaccattgcagctagaagaggatctagagcagctcaaagtccttgaaaatggctacaaaatgaaggttataaaggtggatcatgaagctcatggagttgatacacctgatgatgtcgaaaaaatcgaatctttaatgcgcgaaagaaacctcctctagtccacataatacagagatcttatgcataatgtctccactgtctacaataggataattctccctaaatattacctgttacttgtttgtagacattatgcaactatggcgactaagtttaaaagcgcaatcagaaacgaacaatacaaagattgagtttcaaaattatatgtaactaagaaaacagcttagattatattaaattacaggatatgcatagaacaaaaaaaaaatcaatggtcttacgctacgtacgtaagtaaggaatcgtaccgtttgactaacaccgtaccgtacaacttcccgaagtaacttaatacgaagaaggtaagtaaaactttcctagacgtaaagtcgggta

SEQ ID NO: 5515 - DNA, 1130 bp, Gossypium hirsutum
acattaccttgttcccccgcaaagccgcctttcaaaacagtgaatcacacacttcaactctgtctccagatctctctgtctcccccttctctttctatctgaaaccaaataaaaataaattcgtgaacaccatgtcagtctgctcgtcttcttcttcaacaggtaaagcttggatagttcacagtattttagctggcacagcaattgcggtagccattggtgcccatgcctatctgggtcgggctaggaagtttcggacacgggtcgtgggaattatacccgccagatatgcatcttctcggttcgaaggcaagcctttggttcatatccttgggaaacccatgatccagaggacatgggagaggtcaaaactggcgaccacactgaaccatctagttgtggcaacagatgatgaaaagatagcagaatgctgtcgaggatttggcgctgatgtgatcatgacatcagagtcttgtcaaaatggcaccgaaagatgtaatgaagctcttgaaaagctagagaagaagtatgacattgttgtgaatattcagggagatgaacctcttattgaacctgagataatagatggaattgttaaagctctgcaggcagcaccagatgcagtgtttagcactgctgtgacttctttgaaaccagaagatgcttttgatccaaatagagtgaaatgtgtggttgataatcgtggttatgctatttatttttctagaggactaataccatttaacaaatctgcgaaagtcaatccacagttcccttacatgcttcatcttggaattcagagctatgattcaaagtttctgcaaatatatccgaagcttcagcctacaccactgcaactagaagaggatctggaacaacttaaggtccttgagaatggctataagatgaaggtgataaaggttgagcatgaggctcatggagttgacacacctgaagatgtggagaagattgaatcattaatgcgtgagagaaacctgtcttaaacaatgtctcttcggaataggaagggtatacaattttctactatctttattaatgtaagatttgagaattaaaattaatcaaatgttttctgataaatcttaaataatgctgggggtgattttttt

SEQ ID NO: 5516 - DNA, 2462 bp, Cannabis sativa
acgtaaaacagaatagtaaaaaaaaatggatttcatttttgataaaaaagaaaaacattcgaaagaaattaggatgaacagtgaatagattgcaataaaaaaaaaataaaaaaaaaagaaactttgttcccaattcaacatgcgtcaccttttgtctgctcaagcttttgcttctgccagctcacgcaccacctgtgattcacttcttcccaccgccaccgcttttcccagccttgtaggcttcgcacgccttcactctcctatctctcgctaaggaaacatttttttttttcaaaagctcgctaaggaaacattcagtgagtgattgacacaacacgccatgtccacacgttcttcttcatccacatcttcttcgtcttcatgtggatcttcggccactaccattgcatggatcggttatggcatagccgccattacggctgcagcaattggagcccgcttctatctgggtcgagctactaagttccgaagccgggtcgttggcattattcccgctcgttttgcttcctcccgctttgagggcaagcctctcgttcagatcctcgggaagcccatgatccagagaacatgggaaagggcaaagcttgcgggttcgttggatcatattgttgtggccacggatgatgataagattgcagaatgctgccgagggtttggtgctgatgttgtaatgacttcagtgtcctgtcgaaatggtactgagcgttgcaatgaggcacttcagaagcttggtaagaagtatgacatagttgtcaacattcagggcgatgagcctcttcttgaacctgagatcatagatggaattgtaaaagctttgcaggatgcacctgatgcagtatttagcactgcagttacatctttaaaaccagaagacgcatttgatccgaatagagtgaaatgtgtgatggataatcgaggttatgctatctacttttcaagggggctacttccatataacaagttagggaaagtcaatccacagtttccatattggcttcatctcggaattcagagctacgattccaagtttctccagatatattctgagcttgaacccactcccttacaactagaagaagatcttgagcagcttaaagtccttgaaaatggatacaagatgaaggtgattaaggttgaccatgaagctcatggtgttgacattccagaagatgttgagaagatagaatctctcatgcgtcagaataatttgtcttaagtttttttttcccctctttaaaagtgaaattttgtcttagtttgtatactacatatcttccttttcttttgaaagggatatactacacatctataattatagaaaacacaatatcaaagtcgtctatgtaaacttattattgtctggttcacttggttaaggagagaataagagtgttaattgagtaaccccatctgatttatttatccttttccagttgtaactcattctatgtaagtccattttttattcattattattatgacagctatttacatcccatgtttgaagcaatttccatgatttgtgcagtagttgtatgtaatatatactattcagattgtcaaacacgaggaaaataatgtattttttctttcctagtgttgaagtattttgacatgttaattgctacattttctaaaattgttagagcaattggccttttctaattttaaacatggactcttttgattcgggtaaactttagttgttgaggatatattgactttgtataaaaaaaattactaataaattgacaaataaagaaagaaggtggtattagtccaagtccctcggagtagctcagttggtagagcggagttttttgagtttgtgagacaagtgccaaacgacaaagcaatagacttcataagtttaagatcacaagtcggttcgtttcttttccctaggttgataacatgacactattttttttaactttaaataaaaagtttacttcaaaattaggagaagaattctatctaggaaagtgaacatgccagacaaacttgttcctctgtctcctaacctaacccaaaaacagaaatccatgctctactcctactcatattctgatattgcgtgtctttatagaccaaattcaaattcatcacacactggctctgccactcacaccacactagtaagtaagtaagtaacaactctttgacacaaaaaaggcacaaacgacacagattgtaacactgtaacaacaggtgtcgttttctgtaatggcgtactgaagttggcaaaaattaattacaatacaagattaggatgagaagaaaaatcttaaatgaatccaaatcttgaaattaatttaattccgtagtagtagttgttgttgagcttccgtgaccaacttcacctctgtttggaaaagtagaaccgatagtgagtcaatggagaagtagacgaacccacctggcgagtgagtcacgaacga

SEQ ID NO: 5517 - DNA, 1182 bp, Papaver somniferum
aaggactgaggaagaagaaggatggatcagggttcatcatgtggatcaaacagtaattgtaagtcatggattatgtacggactagttacaggtgccgcaattgcagcggcagcaattggagctgctttttcaattcgaggaggatctgggaaattcaggagtcgtgtaattggtattatacctgctcgttatgcttcctctagattcgaagggaaacctttggttcatattcttgggaaacccatgatccagagaacatgggagagagcaaaactagcctcgacactagaccatgttgttgtggcaacggatgatgaaaagattgcagaatgctgtcgagggtttggtgctgatgtgataatgacatcagaatcttgcagaaatggtaccgagagatgcaatgaagcattggagaagcttgagaagaaatatgatattgtcgtcaatattcagggggatgaacctcttattgaaccagagatcatagatgggattgttaaagctttgcagggagctcctgatgctgttttcagcactgccgtgacatctttgacgcctgaagattcaaccgatccaaaccgggtgaaatgtattgttgacaaccatggctatgcaatttatttctcgaggggactaatcccatttaataaatcaggaaaagtcaatccgaacttcccgtatctacttcatcttggtatccagagctatgactcgaagtttttgaagatatattcagagcttgcacctactccactgcaacttgaagaagatttagagcaacttaaggtccttgagaatggttataaaatgaaggtgatcaaggttgatcacgatgctcatggtgttgacactcccgaagatgttgggaaactagaagctctcatgcgtgaaagaaatttagtataatctgctactgaacacttgattcccttgctataattgtttattttcatcttctactgtaatatagaatcccacttggttcccttgttattattttttattttcatcttcgtgtaaatccttaacagtatatggaaccacaaacccttccagttttcagaagtgtttattacgtgcataacttcaatgagattacaaatgcactacttatcttccttatctcattaaccttttattgaaaatgaattaaatgtcgttgccagtgaaaaaaaaaaaaaa

SEQ ID NO: 5518 - DNA, 1024 bp, Cichorium intybus
gggatgtcgaccaaatcgtgggttttgcacggcgttgccgttgccgctgctctcgtcggtgctcacgcttacttttattaccgccgatctgctaccatgtttcggagtcgagtggtgggcataattccggcccggttcgcttcttcccgatttcagggcaaacccctcgttgagatcctcggcaaacccatgatccagagaacttgggaaagagcaaagttggcaacaacattggatcgtgttgttgtggcaacggatgacgaaaagattgctgagtgttgtcgtggatttggtgctgacgtgataatgactgcagaatcgtgcagaaacggcgccgagaggtgtagtgaagcccttcaaaagctggacaaaaagtacgacatcgttgtcaatattcaaggagatgaaccgctaatcgaacctgaaattatcgatggaatcgtcaaagcccttcagaccaccccagatgcagttttcagtacagcagtcacatctttgaaaccagaagatgcttttgatccaaatcgtgtgaaatgtgtggttgataaccgtggttatgcaatctacttttctcgaggactaatcccttttaacaagtctggcaagacaaatcctgaattcccatataatcttcatcttggcattcagagctatgattcggaatttttaaagatttatccggatttgactccaactccattgcaactagaagaagatttggaacaacttaaagttcttgaaaatgggtacaagatgaaggtaataaaagtggatcatgatgctcatggtgtggatactccagaagatgtggcaaagattgaaaattttatgcgcgaaaggaacttgtcttagtgtaattttgtgattttgccaccaaaatcttatgaaagttttataaaattagtgtttttttttcataaagtgtaatttgtagttttaaggcttgaatggtggctcaactgatgtatatttcttgtgcatttgttgtagagtcggagtaaaattttagatattatatgttgta

SEQ ID NO: 5519 - DNA, 1004 bp, Ananas comosus
cttgctctccgtggtggccatgacgatttgcgcttcgtcgtcctcggattcgacgggatcggagacgagcagggcgtggatcgtgcacggcgtggtcgtcctcgccggcgccgcggcggcggcggcgctctatctccggcggtcgcggaatctccggaggcgcgtggtggggatcatcccggcccgcttcgcctcctcgcgcttcgagggcaagcccctcgtccgcatcctcggcaagcccatgatccagagaacatgggagagagccaagttagcttccactcttgaccatgttgttgtggcgacggataatgaaaaaattgcagaatgttgtagaggatttggagctgatgtgataatgacatcagaatcatgcagaaatggaactgaacgttgtaatgaagcactgcaaaaacttggcaaaacttatgatattgttgtcaatattcaaggagatgagccacttattgaaccagagattatagatggtattgtcagagcattgcagggagctcctgatgctgttttcagcacagctgtcactgcactgaaacctgaagatgcatttgacccgaatcgagtaaagtgtgttataaacaacagtgggtatgcaatttacttctcaagggggctaatcccatttaacaagtctgggaaagttaatcctaagttcccgtatcttcttcatttgggtattcagagctatgataccaaatttctaaagatatatccgcaacttccgcctactcctctgcaactagaagaagacctggagcaacttaaagttcttgagaatgggtacaagatgaaggtaatcaaagttgatcatgatgctcatggcatcgacacacccgaggacgtcgagaaaatagaagcactgatgcgagaaagaaacattcagtagcagaggcagtagaataatagcacaagaaattttgcacatcgcgggagagtaattcctagttttattgtcaactatattccactattgttgttgttgttgt

SEQ ID NO: 5520 - DNA, 940 bp, Papaver somniferum
atggatcagggttcatcatgtggatcaaacagtaattgcaagtcatggattgtgtacggtctagttacaggtgctgcaattgcagcagcagcaattggagctgctttttcaattcgaggatctgggaaattcaggagtcgtgtgattggtattatacctgctcgttatgcttcctctagattcgaagggaaacctttagttcatattcttgggaaacccatgatccagagaacatgggagagagcaaaactagcctcgacactagaccatgttgttgtggcaacggatgatgaaaagattgcagaatgctgtcgagggtttggtgctgatgtgataatgacatcagaatcttgcagaaatggtaccgagagatgcaatgaagcattggagaagcttgagaagaaatatgatattgtcgtcaatattcagggggatgaacctcttattgaaccagagatcatagatgggattgttaaagctttgcagggagctcctgatgctgtttttagcactgcagtgacatctttgacgcctgaagattcaaccgatccaaaccgggtgaaatgtattgttgacaaccatggctatgcaatctatttctcaaggggactaatcccatttaataagtcaggaaaagtcaatccgaacttcccgtatctacttcatcttggtatccagagctatgactcgaagtttttgaagatatattcagagcttgcacctactccgcttcaacttgaagaagatttagagcaacttaaggtccttgagaatggttataaaatgaaggtgatcaaggttgatcacgatgctcatggtgtcgacactcccgaagatgttgggaaactagaagttctcatgcgtgaaagaaatttagtataatcagctgctgaacacttgatttcgttgatattattgtttattttcatcttctactgta

SEQ ID NO: 5521 - DNA, 1434 bp, Fragaria vesca
aacgacctaagcggttgacccaaactataaatacctgaaatcacagtaacaaagcatcaccatctacctcaacccagagtgggtgcattgcttcagcgacagagatcaccatcaccatgaacctcaaatccgttcgcccttcttcttcgtcctcttcctcctcatcatccgggtccaccgccaaggtatggatcgtccacggactcgtcgccggagttgccattgccgcggccattggcgccagggcctacctgggcccaattaggaagttccggagccgggttgtcggcatcatacccgcccgttatgcttcgtcaaggtttcaggggaagcctctcgttcagatcctcggaaagcccatgatccagagaacatgggagagggcgaaaatggcatctacattggatcatattgttgtggcgacggatgatgagaagatagcagaatgctgtagaagttttggagctgatgtcataatgacctcagagtcatgccctaatggcactgagcgttgttatgaagccattcaaaagcttgagaagaagtatgatgtagttgtcaatattcagggagatgagcctcttgttgaaccagagataatagatgggattgttaaagctctgcaggaagccccggatgcagtgtttagcaccgcagtcacgtccttaaaacttgaagatgcatctgatccgaatcgagtgaaatgtgtggtggataataatggttatgccatctatttttcaagggggctgatcccatttaacaagtcaggcaaggccaatccgcagtttccatatatgctccatctaggaattcagagctatgatacaaagtttctaaagatatatcgagagctgaagcccactcctttgcaactagaagaagatctggagcagcttaaagtccttgaaaatggttatagaatgaaggtgatcaaggtcgaccatgaggctcatggtgttgacacccctgaagatgttgagaagatagaagctttaatgcgtgagagaaacatctcctaagttcctggtgaagtggtagtgcatcaaaacatgataaatggagttataacttttctaggcacacttatcatgttcatagttgtaattaagcatcacattggatttgctaccgtgctggcttgtaacatcagtacatacagctgtctagttaaatatcaaggacggggaaagctatatgattagtgttaatacagatccccctgtatatcgatttggttttgctttaaggaaaagagaatgatttagttttggattcggctcattagttgctaagttcggagatttatatgacggttagttaaacattctacattttaacacttgtatctctagtttgtgtcattcctctgtttgtaatttaacttgtggtaatgtagtttctatttaatgataaactcataaaagtattggt

SEQ ID NO: 5522 - DNA, 1068 bp, Eutrema halophilum
attaaaccggtccagaccggttcttttctcgctggctcggtcaccgctttttaacagagcaattgtctctttctcactctcacactctcgccggagcaaagtgcagtcggtgattaaatagatggcagcctgttcttcatcgtcttcgtcttctcagaagacgtggattgtacacgggatcttggccggaacggcgattgcagccgcgattggcgcacgtgcgtatctgggtcgatccaggaaattccggagccgggtcgtcggaatcattcccgcacgttacgcttcctctcgattcgagggtaagcctctcgtgcaaatcctcggcaaacccatgatccagagaacttgggagaggtctaaattagcttctacgcttgatcacgttgttgtagccacggatgatgaaaggatcgcggattgttgtcgtggatttggtgccgatgtcatcatgacttcagagtcttgcagaaatggcactgaacggtgtaatgaagcactagaaaagctggagaagaagtatgatgtggttgttaacattcaaggagatgaaccactcattgagcctgagattatagacggtgtagtcaaagcacttcagttagcacctgatgcagtgtttagcacagcggtgacgtcattgagaccagaagacggacttgatcctaaccgagtcaaatgtgtggtggacaaccgtggctatgctatctatttctccaggggtttgattccttataacaagagtggcaaagtcaatccagatttcccgtacatgcttcatcttggaatccagagctttgattccaagtttctgaaagtatattcggagcttcaaccaacgccattgcagctagaagaggatctagagcagctcaaagtccttgagaatggctacaaaatgaaggttataaaggtggaccatgaagcgcatggagttgatacacctgatgatatcgaaaagattgaatctttaatgcgcgaaagaaacctttcctagtccacaaatacagagcttccttttgaaatcttatacttgaatgaacccttttccttggtttctttttttgt

SEQ ID NO: 5523 - DNA, 1196 bp, Echinacea purpurea
cacacacactgatcagtcgagctgatgagcccaaaatcgatctgtaccggatcctctccggatcaaacttcaaccaaatcactgattctgcatggcgtcgccgccgccgccgctctagttgtcggagctcacgcttacttcttttaccgccgatctgccaccatgtttcggagtcgagttgtgggcataattccggcccgatttgcttcttcccgctttcagggcaaaccccttgttgagatcctcggaaaacccatgatccagaggacttgggagagagcaaagttggcaacgacattggatcgagtcgttgtggcaacggatgatgaaaagattgcggaatgctgtcgaggatttggtgcggatgtaataatgactgcagaatcgtgcagaaatggtgctgagaggtgtagtgaagctcttcaaaagcttgagaaaaagtatgatattgtcgtcaatattcaaggagacgaacctctaattgaacctgaaataattgatgggattgtcaaagcccttcagaccaccccagatgcagttttcagcacagcagtaacatccttgaaaccagaagatgctttcgatccaaatcgcgtgaaatgtgtggttgataatcgtggttacgcgatctatttttctcgaggactaatcccttttaacaagtcagggaaagtcaatcctgcattcccatataatcttcatctaggtattcagagctatgactcagaatttctaaagatttatcccgatctgactccaactccattgcaactggaagaagatttagaacagttgaaagttcttgaaaatggttacaagatgaaggtaataaaagttgatcatgatgctcatggtgtcgatacgcctgaagatgttgccaagattgaaaattatatgcgcgaaaggaatctgtcttagcatcatgtctggttgtttagctgcagtgaggtgttgccaccaaaatagtgaagatttcatcataccggtgtttgttttcctttgtttattttcttcagtgagtgtaatttgtatcttaaagcttgaatttctaacagggtatgtttctaatgggtttgttgtatactttgagaacattatacttgtagaaagttttctagacgcaataacttaaatatttaaatgtaacggtcgtttttatcttttagaattcttttatgcttaaaccaatgtttcgc

SEQ ID NO: 5524 - DNA, 1149 bp, Ambrosia trifida
gcacacagatatcagtcgagccaatgagcccaaatccgatctgcaccggatcttcgtctacagatcagacttcaaccaaattactaattctgcatggcgtggccgccgccgccgccctagtcgccggagcccacgcttacttgtattaccggcggtccaccaccatgtttcggagtcgagtagtgggcataattccagcaagatttgcttcttcacgctttcagggcaaaccccttgttgagatccttggcaaacccatgattcagagaacttgggagagagcaaagctggcaacaacattggatcgtgtcgttgtggcaacggatgatgaaagattgctgaatgctgtcgaggatttggcgctgatgtaataatgactgcagaatcatgcagaaatggtgctgagaggtgtagtgaagctcttaaaaagctcgagaagaagtatgatattgttgtcaatattcaaggagacgaacctctgattgaacctgaaataattgatgggattgtcaaagctcttcagaccaccccagatgcagttttcagtacagcagtcacggctttgaaaccagaagatgcttttgatccaaatcgcgtgaaatgtgttgttgataatcgtggttatgtgatctacttttctcgagggctgatcccttttaacaagtcagggaaagtcaatcctgcattcccgtataatcttcatctaggtattcagagctatgattcggaatttctaaagatttatcctgatcttactccaactccgttgcaactggaagaagatttggaacagttgaaagttcttgaaaacggttacaagatgaaggtaataaaagtcgatcatgatgctcatggtgtcgatacgcctgaagatgttgccaagattgaaagtttatgcgcgaaaggaacttgtcgtagcttcatgttgggatttgtctagctctaatgaggttttgccaccaaaatattgagctttcatcacactagtgtttgtttaattgttttcctttgtttattttcctcaatgagtgtaatttgtagcgtaaagtttgaatttctaaccgtaatgatgtatgttcctaatgcgtttgttgtatactttgagaacattatattttgtagaaagttctctagacgtgataacgtaaa

SEQ ID NO: 5525 - DNA, 1007 bp, Cirsium arvense
gattagtgcttatctgttaattttgtggtaaaaagcaccccaagtgaaaaagaaaactacattatacactatatacgcattgatcaccggatgattcccaactcgagctcttcacttcgcctccggatcatttgtaatgtcgtcaactaaagcatggattttgcacgccgtcgccgccgccgcagctctagcagtcggtgctcccgcttatttctattaccgccgatctgccaccatgttccggagtcgagtagtcggcataattccggcccggttcgcttcttctcggtttcagggcaaaccccttgttgatatccttggcaaacccatgatccagagaacttgggaaagagcaaagttggcaacaacattggactgtgttgttgtggcaacggatgatgaaaagattgcagagtgttgtcggggatttggtgctgatgtcataatgactgcagaatcctgcagaaatggtgctgagaggtgtagtgaagcacttcaaaagctcggcaaaaagtatgacattgttgtcaatattcaaggagacgaacctcttattgaccctgaaataatcgatgggattgtcaaagctcttcagaccaccccggatgcagtgttcagcacagcagttacatctttgaaaccggaagatgcttttgatccaaatcgtgtgaaatgtgtggttgataaccgtggttatgcaatctacttttctcgagggctgatcccttttaacaagtcagggaagaccaaccctgaattcccatataatcttcatcttggtattcagagctatgattcggaatttctgaaaatttatccggatcttacaccaactccattgcaactagaagaagatttggaacagcttaaagttcttgaaaatggatacaagatgaaggtgataaaagtggatcatgatgctcatggggtggatactcctgaagatgttgccaagatcgaaagttttatgagggaaagaaacttgacttgagcttaatcgttaatcc

SEQ ID NO: 5526 - DNA, 1342 bp, Arachis hypogaea
tctgtctccatcgcaagatctgtcgcgctctgtcaccatcgcaagctctgtcgcgctctgtcaccgtcgcaagctcgtcttcttgcttcggccgtcaacgctccttgcagatcgatctcctcctcattcttcactttgccatggccttttgcccatcgccttcgtcttcttcttcttcctctgattcttcatcctcgtcttcctcgccgtttgagtcttccaacagcgcaaagttctggatcctccatggcattatggccggagttgcagttgctgctgcggtcggtgctcgcgcctactggactcgggtcaagaaattccggaaccgggtcgtcggcatcatacccgcccgatttgcttctacccggtttcagggaaagcctctcgttgagattcttggtaaacctatgatccagaggacatgggaaagggcaaagctggcagccacgttggatcaagttgttgtggcaactgatgatgaaaagattgctgagtgctgtcgaaagtttggagctgatgttgtaatgacatctgagtcttgtcgaaatggtactgagcgctgcagtgaagccctagagaagcttggtaaaaactatgatattgttgtcaacattcagggtgatgaacctcttattgaacctgaaataattgatggcattgtcaaagctttgcaggcaactccagatgcggtgttcagtactgcagtcacatctttaaagccagaagatgcacttgatccgaatagagtgaaatgtgtcgtagataatcgtggttatgctatctatttttcacgaggattgatcccattcaacaagtcgggaaaagtcaatcaacaatttccttatttgcttcatctggggatacagagctatgatacaaagtttctgaagatatatccagatcttcagcctactccattgcaacttgaggaagatttggaacagcttaaagttctcgagaacggctataagatgaaggtaataaaagttaaccacgaggcccatggtgttgacattccagaagatgttcaaaagatagaatctctaatgcgtgagaggaacttgtcttgaactcttggttatgactatgaaacctcctgaaaactaaccactaaaatcatcaagtttggaattaaattttgttcttattcgttttcctaatagtcatgcttgtttctatccacacaaactgtgttttgtaatgtatgttcacttgcgaagtttgttctgttttaatccagtagtatttataacatggaaagttgagttatacacagattgtggtgcacagataccacttcagaaaaaaaagttgtacgtggattacttggttgatgcatcaa

SEQ ID NO: 5527 - DNA, 978 bp, Cichorium intybus
atcagccatgagttggatgatctccaagtcgacgtctgctggatcttctcgtccggaaaatgtgatgtcgaccaaattctgggttttgcacggcgttgccgtcgccgctgctctcgtcggtgctcacgcttacttttattaccgccgatctaccaccatgtttcggagtcgggtggtgggcataattccagcccgcttcgcttcttcccgatttcaggggaaacccctcgttcagatccttggcaaacccatgatccagagaacttgggaaagagctaagttggcaacaacattggatcgcgttgttgtggcaacggatgatgaaaagattgcagagtgttgtcgtggatttggtgccgacgtgataatgacttcagaatcatgcagaaacggcgccgagagatgtagtgaagcacttgaaaagctcgacaaaaagtatgacatcgccgtcaatattcaaggagacgaaccgctaatcgaacctgaaattatcgatggaatcgtcaaagcccttcagaccaccccagatgcggttttcagtacagcagtcacatctttgaaacctgaagatgcttttgatccaaatcgtgtcaaatgtgttgttgataaccgtggttatgcaatctacttttctcgaggactaatcccttttaacaagtctggcaagacaaatcctgaattcccgtataatcttcatcttggcattcagagctatgattctgaatttttaaagatttatccggatttgactccaactccattgcaactagaagaagatttggaacaactaaaagttcttgaaaatgggtacaagatgaaggtaataaaagtggatcatgatgctcatggtgtggatactccagaagatgtggcaaagattgaaaattttatgcgcgaaaggaacttgtcttagtgtaattttgtgattttgccaccaaaatcttatgaaagttttataaaattagtgtttttttttca

SEQ ID NO: 5528 - DNA, 1277 bp, Cichorium intybus
ggagctgggtaggtaggaagaagagtgtgctaaatcgattccattagctttccttctcccttacaaatctgagatcttttcttctttccaaatccaatctcaacccccccccccccccccccccccccccccccccccccccccccccccccccgtcgtcgataactccatcctatcagccatgagttggatgatctccaagtcgacgtctgctggatcttctcgtccggaaaatgtgatgtcgaccaaattctgggttttgcacggcgttgccgtcgccgctgctctcgtcggtgctcacgcttacttttattaccgccgatctgctaccatgtttcggagtcgagtggtgggcataattccagcccggttcgcttcttcccgatttcagggcaaacccctcgttgagatcctcggcaaacccatgatccagagaacttgggaaagagcaaagttggcaacaacattggatcgtgttgttgtggcaacggacgatgaaaagattgcagagtgttgtcgtggatttggtgctgacgtgataatgactgcagaatcgtgcagaaacggcgccgagaggtgtagtgaagcacttcaaaagctcgacaaaaagtatgacatcgttgtcaatattcaaggagacgaaccgctaatcgaacctgaaattatcgatggaatcgtcaaagcccttcagaccaccccagatgcagttttcagtacagcagtcacatctttgaaaccagaagatgcttttgatccaaatcgtgtgaaatgtgtggttgataaccgtggttatgcaatctacttttctcgaggactaatcccttttaacaagtctggcaagacaaatcctgaattcccgtataatcttcatcttggcattcagagctatgattcggaatttttaaagatttatccggatttgactccaactccattgcaactagaagaagatttggaacaacttaaagttcttgaaaatgggtacaagatgaaggtaataaaagtggatcatgatgctcatggtgtggatactccagaagatgtggccaagatcgaaaattttatgcgcgaaaggaacttgtcttagtgtaattttgtaattttgccaccaaaatcttgaaggttttatcaaattaatgtttttttttcataaagtgtaatttgtagtttaaggcttgaatagtggctcacatgatgtatatttcttgtgcatttgttgtagagtcggagtaaaattttagatattatatgttgtacaagttattaacacaaacttt

SEQ ID NO: 5529 - DNA, 1439 bp, Cichorium intybus
cacaggaactaaaatacaaatttccatacctgaatatatcaatataacaatccaaacgtcaaattttgtaatgcataaaccaaacaatcagtttttaagtaatcatacgattcctattccatcattggctagcttgttgctttgggtgtttggtttgttggattccatgggatttgaccggaattggaacccaattccattccattacggtgtttggttgcaaatgagtacgggattgaattcctttggtgtacaatttcatagacacacggtgacacagatcagccatgagttggatgatctccaagtcgacgtctgctggatcttctcgtccggaaaatgtgatgtcgaccaaattctgggttttgcacggcgttgccgtcgccgctgctctcgtcggtgctcacgcttacttttattaccgccgatctgctaccatgtttcggagtcgagtggtgggcataattccggcccggttcgcttcttcccgatttcagggcaaacccctcgttgagatcctcggcaaacccatgatccagagaacttgggaaagagcaaagttggcaacaacattggatcgtgttgttgtggcaacggatgacgaaaagattgctgagtgttgtcgtggatttggtgctgacgtgataatgactgcagaatcgtgcagaaacggcgccgaaaggtgtagtgaagcccttcaaaagctggacaaaaagtatgacatcgttgtcaatattcaaggagatgagccgctaatcgaacctgaaattatcgatggaatcgtcaaagcccttcagaccaccccagatgcagttttcagtacggcagtcacatctttgaaaccagaagatgcttttgatccaaatcgtgtgaaatgtgtggttgataaccgtggttatgcaatctacttttctcgaggactaatcccttttaacaagtctggcaagacaaatcctgaattcccatataatcttcatcttggcattcagagctatgattcggaatttttaaagatttatccggatttaactccaactccattgcaactagaagaagatttggaacaacttaaagttcttgaaaatgggtacaagatgaaggtaataaaagtggatcatgatgctcatggtgtggatactccagaagatgtggccaagattgaaaattttatgcgcgaaaggaacttgtcttagtgtaattttgtgattttgccaccaaaatcttgaaggttttatcaaattagtgttttttttttcctaaagtgtaatttgttgtttaaggcttgaatggtggctcaactgatgtatatttcttgtgcatttgttgtagagtcggagtaaaattttagatattatatgttgtacaagttattaacacaaactttcaatatagacaataattttctttattatgccaatgtatttacattcttttacccg

SEQ ID NO: 5530 - DNA, 1298 bp, Cichorium intybus
tgggtgtttggtttgttggattccatgggatttgaccggcattggaacccaattccattccattccggtgtttggttgcaaatgagtacgggattgaattcctttggtatacaatttcatagacacacggtgacacagatcagccatgagttggatgatctccaagtcgacgtctgcttgatcttctcgtccggaaaatgtgatgtcgaccaaattctgggttttgcacggcgttgccgtcgccgctgctctcgtcggtgctcacgcttacttttattaccgccgatctgctaccatgtttcggagtcgagtggtgggcataattccggcccggttcgcttcttcccgatttcagggcaaacccctcgttgagatcctcggcaaacccatgatccagagaacttgggaaagagcaaagttggcaacaacattggatcgtgttgttgtggcaacggatgacgaaaagattgctgagtgttgtcgtggatttggtgctgacgtgataatgactgcagaatcgtgcagaaacggcgccgagaggtgtagtgaagcacttcaaaagctcgacaaaaagtacgacatcgttgtcaatattcaaggagatgaaccgctaatcgaacctgaaattatcgatggaatcgtcaaagcccttcagaccaccccagatgcagttttcagtacagcagtcacatctttgaaaccagaagatgcttttgatccaaatcgtgtgaaatgtgtggttgataaccgtggttatgcaatctacttttctcgaggactaatcccttttaacaagtctggcaagacaaatcctgaattcccatataatcttcatcttggcattcagagctatgattcggaatttttaaagatttatccggatttgactccaactccattgcaactagaagaagatttggaacaacttaaagttcttgaaaatgggtacaagatgaaggtaataaaagtggatcatgatgctcatggtgtggatactccagaagatgtggcaaagattgaaaattttatgcgcgaaaggaacttgtcttagtgtaattttgtgattttgccaccaaaatcttatgaaagttttataaaattagtgtttttttttcataaagtgtaatttgtagttttaaggcttgaatggtggctcaactgatgtatatttcttgtgcatttgttgtagagtcggagtaaaattttagatattatatgttgtacaagttattaacacaaactttcaatatagacaataattttctctattatgccaatgtatttacattcttttaccc

SEQ ID NO: 5531 - DNA, 1330 bp, Aquilegia formosa
atgatcgtacagatctcactcactcactcactcactcactccattgtcaattattactatttactactctctctctctctctctctcccgccttttcgtctgagaaacagaggagaaatgaattcaatatcgacatgtttgtcttcatcatcatcatcttcatctggaacaaactctaaagcattgatcgtacatggattacttgctactgcagcaattgcaggaggtgcttatgttgctatttcactttgtcgtacaagtaaatttagaagtagagttattggtattatacctgctcgttttgcttccactagatttgaaggaaaacctcttgttcctatcctcgggaaacccatgatccagagaacatgggaaagggcaaagatggcaactacattggaccacattgttgtggcaacggatgatgaaaagattgcagaatgctgtcgagggttcggagcagatgtgataatgacttcggaatcttgcagaaatggaactgagcgctgcaatgaagcacttctaaaactggagaagaagtatgatgttgttgtcaatatacagggggatgagcctcttattgaacctgagataatagatggtattgtgaaagctcttcagggagcccctgatgctgtattcagcactgctgtaacatctttgaaacctgaagatggacatgatccaaatagggtgaaatgtgtggtggataatcagggttatgcaatctatttttcaagaggactaatcccatttaacaagtcaggacaagtgaatccaaagttcccatatctactgcatttaggtatccagagttatgacacaaaatttttaaggatatatccagaccttccacccactccactgcaactagaagaagatttagaacagcttaaagttcttgaaaatgggtataagatgaaggtgatcaaggttgatcatgatgcccacggtgttgatactcctgaagatgttgagaagatagaatcattgatgcgtgaaagaaatatatcataatccatggcaacatacaaaataactgagacgatatgttctcttgaaattgtcagaatccatgctccaagctctagttttctgggtgaatcttgtactatcttctgtaattaaaagtgagactcttgggccagtttctctacattagtttattgatgaaataacttcacaggattgtatattttattgttagtaattcaatttgtcaactagctagcttgtgtatgttttcagacagtatgtaaagtatgaggacatataaattacaagggaagaactatgcttccatagtttgttgcaatgtcttgtttaacat

SEQ ID NO: 5532 - DNA, 1726 bp, Cocos nucifera
cctaaagataattataacagtcgacgacagcagcggagtaccgacacttcgagaccgacgacaggcctccttgtgaaccgggatccgaggacatcttctccgccaatctcttctattattgttcccttgccagctctgactcttgttctcaaaattcgagtctttccctggtagagtggaggaatagatggtgatttgctccccctcgtcggagtcgtcgtcggcgacgagcggccgggcctggattatccaagcgctggtcgccggcgcggcggtggcggtggcggtgggtgcccacgcggcggtgtatttcaagtggttcaggaagggccggagccgggtggtgggaatcatccccgctcggttcgcttcctcgcggttcgaggggaaacccctggtccagattcttgggaagcctatgatccagagaacatgggagagagcaaagttggcttctaccttggaccatattgttgtggcaacggatgatgagaggattgcagaatgttgtagaggatttggagctgatgtgataatgacagcagaatcatgccggaatggaactgaacgctgcaatgaagcactgttaaagcttggaaaacattatgatattgttgtcaatatccaaggagacgagcctcttcttgaaccagatataatagatggcattgttagagctttgcagggtgcccctgatgcagttttcagtactgctgtcacatccttgaaacctgaagatggacttgacccgaacagggtaaagtgtgttgtggataatcatggttatgcaatctacttctcaaggggtttgatcccatataacaagtcaggaaaagtcaatccagagtttccctatctacttcatttgggcattcagagcttcgattcaaagtttttaaggatctatccggagcttccacctactccactgcaactagaagaagaccttgaacaacttaaagttcttgaaaatggatacaagatgaaggtaatcaaggttgaccacgatgcccatggtgtagacactcctgaagatgttgaaaaaatagaagcacttatgcgagagaggaacatttcatagaagagagcatatgtgaagaaagaaatgtgatgcgtacatcagaaataaggccttgtttggtgcattctccacactgggttgacatcatttttgatttggttgtcagctatcctcagtgctctgtgatttattctctgctcgtgttgtttatttagtttttagagtgtcgccacattgatcatgacttaaacaagtccaaatcaataaagaacacagaaccattggtgatttccctgttggatcatgtgaaatgctagtgttcgagttcgtgaaggaaatggtgtcaatggggatgttgatatggttgctgatataagcaacctgaccaaattccctgcctttcatgtattatgtagcttcaagttcataatcaggataattgcttctgcaaactttgagagcttccaggctagctttacgacacatccataagccagagctacttgcaatgatctttgtgatcttggtaatgagacagaaaacatccaatcctcgagttgcttccgtctgccactgaggttcaatgatggcttcatttggtcaagcggttgcttcaattagtgtgaaaggccaaattgcgaggagaatgggtggaacaagctctattctttgacatagaacttactgctttgctggtgtttatat

SEQ ID NO: 5533 - DNA, 950 bp, Echinacea purpurea
ggataatccacggtgtggcggtgggggcggcggctgctttggcgcttggggcccattacatgtattatcgacgatccggcaagttccggagccgggtcgtcggaattatacctgcccgctttgcttcttcccgcttccagggcaagcctctcgttaacatcctcggcaagcccatgatccagagaacatgggaaagagctaaaatggcaacctcattggaccatattgttgtggcgactgatgatgagaagattgctgattgctgtagaggttttggtgccgatgtggtaatgacatcggaatcgtgccgaaatgggacggagcgttgtaatgaagcgcttagcaagttggataagaaatatgatgttgttgtcaatatccagggcgatgagccgctcatagaacctgaaataatagacggcattgtcaaagcgctgcaggctgctccagatgcagtcttcagcactgcagttacttctctgaaatctgaagatgcatacgatccaaatcgtgtcaaatgtgtggtggataaccatggctatgcaatttatttctctcgaggattaataccatttaataagtccgggaatgtcaaccctcagtttccatatttacttcatttggggattcagagctatgatacaaagtttctcaacatatacccagagctgcctccgactccacttcagctggaggaagatctcgagcaactgaaggttcttgaaaatggatacaagatgaaggtgataaaagtcgaccatgagtcccacggtgttgacatcccagaagatgttgataaaatagagagctacatgcgcgaaaggaacctgcattagctgtataatttctcacaggatacaatactgattttacatatgcatgatgataagcagaatggtttcaggctacttctcctcggcttcatttatactctagtctttggatgaatg

SEQ ID NO: 5534 - DNA, 1150 bp, Papaver somniferum
cagaggaagaagaaagatggatcagggttcatcatgtggatcaaacagtaactgtaagtcatggattatgtacggactagttacaggtgctgcaattgcagcagcagcaattggagctgctttttcaattcgaggaggatctgggaaattcaggagtcgtgtaattggtattatacctgctcgttatgcttcctctagattcgaagggaaacctttagttcatattcttgggaaacccatgatccagagaacatgggagagagcaaaactagcctcgacactagaccatgttgttgtggcaacggatgatgaaaagattgcagaatgctgtcgagggtttggtgctgatgtgataatgacatcagaatcttgcagaaatggtaccgagagatgcaatgaagcattggagaagcttgagaagaaatatgatattgtcgtcaatattcagggggatgaacctcttattgaaccagagatcatagatgggattgttaaagctttgcagggagctcctgatgctgttttcagcactgccatgacatctttgacgcctgaagattcaaccgatccaaaccgggtgaaatgtattgttgacaaccatggctatgcaatttatttctcgaggggactaatcccatttaataagtcaggaaaagtcaatccgaacttcccgtatctacttcatcttggtatccagagctatgactcgaagtttttgaagatatattcagagcttgcacctactccactgcaacttgaagaagatttagagcaacttaaggtccttgagaatggttataaaatgaaggtgatcaaggttgatcaccatgctcatggtgtcgacactcccgaagatgttgggaaactagaagctctcatgcgtgaaagaaatttattataatcagctactgaacacttggttcccttgctattattgtttattttcatcttctactgtaatatagaatcccacttccacttggttcccttgttattattttttattttcatcttcgtgtaaatccttccagtatatggaaccacaaacccttctagttttcagaagtgtttattacgtgcataacttcaatgacattacaaatgcactacttgtgtctacattatctcattaaccttttattgaaatgaa

SEQ ID NO: 5535 - DNA, 1134 bp, Helianthus annuus
cacacacactgaacagtcggtcatgccaatgagcctaaactcgatctgcaccggatcttcttcctcggatcgcggttctaccaaatcatcgttgattctgcatggggtcgccgccgccgccgctctagtcgtcggcgctcacgcttactacttttaccgccgatctgccaccgtgttccggagtcgagtagtgggtataattcctgcccggtttgcttcttcccgatttcagggtaaacccctcgttgagatcctcggcaaacccatgatccagaggacttgggagagagcaaagttggctacaacattggatcgtgtcgttgtggcaacggatgatgaaaagattgcagaatgctgtcgagggtttggtgctgatgtaataatgactgcagaatcgtgcagaaatggtgctgagaggtgtagtgaagcacttcaaaagctcgagaaaaagtatgatattgttgtcaatattcaaggagacgaacctctaatcgaacctgaaataattgacggcattgtcaaagctcttcagaccaccccagatgcagttttcagcacggcagtcactgctttgaaaccagaagacgctttcgatccaaatcgtgtgaaatgtgtggttgataatcgtggttatgcgatctacttttctcgagggctgatcccttttaacaagtcaggaaaagtcaatccttcattcccatataatcttcatctaggtattcagagctatgattcggaatttctgaagatttatcctgatctgactccaactccattgcaactggaagaagatttggaacagttgaaagtacttgaaaacggttacaagatgaaggtaataaaagtcgatcatgatgctcatggtgtcgatacgcctgaagatgttgccaagattgaaagttatatgcgcgaaaagaacttgtcttagcttcatgtcgggttgtctagtttcagtgaggttttgccactaagatggtgaagatttcgtcataccagtgtttgttttcctttgtttattttcttctatgagtgtaatttgtagcgtaaagcttgaatttccaaccgtatgttcctaatgcttttgttgtatactttgtgcacattatattttgtagaaagttttctagacagaat

SEQ ID NO: 5536 - DNA, 1135 bp, Helianthus annuus
cacacacactgaacagtcggtcaagccaatgagcctaaactcgatctgcaccggatcttcttcctcggatcgcggttctaccaaatcatcgttgattctgcatggggtcgccgctgccgccgctctagtcgtcggcgctcacgcttactacttttaccgccgatctgccaccgtgttccggagtcgagtagtgggtataattcctgcccgatttgcttcttcccgatttcagggtaaacccctcgttgagatcctcggaaaacccatgattcagcggacttgggagagagcaaagttggctacaacattggatcgtgtcgttgtggcaacggatgatgaaaagattgcagaatgctgtcgagggtttggtgctgatgtaataatgactgcagaatcgtgcagaaatggtgctgagaggtgtagtgaagcacttcaaaagctcgagaaaaagtatgatattgttgtcaatattcaaggagacgaacctctaatcgaacctgaaataattgacggcattgtcaaagctcttcagaccaccccagatgcagttttcagcacagcagtcactgctttgaaaccagaagacgcttttgatccaaatcgcgtgaaatgtgtggttgataatcgtggttatgcgatctacttttctcgagggctgatcccttttaacaaatcaggaaaagtcaatccttcattcccatataatcttcatctaggtattcagagctatgattcggaatttctgaagatttatcctgatctgactccaactccattgcaactggaagaagatttggaacagttgaaagtacttgaaaacggttacaagatgaaggtaataaaagtcgatcatgatgctcatggtgtcgatacgcctgaagatgttgccaagattgaaagttatatgcgcgaaaagaacttgtcttagcttcatgtcgggttgtctagttgcagtgaggttttgccaccaagatagtgaagatttcgtcataccagtgtttgttttcctttgtttattttcttctatgagtgtaatttgtagcgtaaagcttgaatttccaaccgtaatgatgtacgttcctaatgcttttgttgtatactttgtgaacattatattttgtagaaagttttctag

SEQ ID NO: 5537 - DNA, 1094 bp, Flaveria ramosissima
ccacaaataaataaacacacatgatacacacaccagtgtgaatcttgatcaccgacaagatgacccccaaatcgatctgcacttcatcttctccggccaacagtgattttccgatgaccaccaaagcactgattctgcacggcgtcgctgccgccgccgcattagtcgtcggagctcacgcatattattattatcaccgatccaccaagtttcgcagtcgagttgtgggcataattccagcacgattcgcttctacaagatttcaagggaaaccccttgttgagatcctcggaaaacccatgattcagaggacttgggagagagcaaagttggcaacaacattggattgtgttgttgtggcaaccgatgatgaaaagattgcagaatgctgtcgaggatttggcgcagatgtaataatgactgcagaatcatgcaggaatggtgctgagaggtgtagtgaagcacttcaaaagcttaagaaaaagtatgatattgttgttaatattcaaggagatgaaccgcttattgaaccagaaataattgatgggattgtcaaagctcttcagaccaccccggatgcagttttcagcactgcagtcacgtctttaaaacctgaagatgcttttgatccaaatcgtgtgaaatgtgtggttgataatcgtggttatgcaatctacttttctcgagggctgatccccttcaacaaatcagggaaggccaatcttgaattcccatataatcttcatcttggtattcagtgctatgattcggaatttctgaaaatttatccggacctgacaccaactccattacaactagaagaagatttagaacagctgaaggttcttgaaaatggttacaagatgaaggtaataaaagtggatcatgatgctcatggtgttgatactccagaagatgtggccaagattgaaaatttcatgcgcgaaaggaacctgtcgtaagggcaatctctcaagttttttagttccagttttcgtcgtaccagttttcatattattttcagtgtgttctattttgttacctgtgtgtaaaatttgagtttgagtcttgaatggtatctagtgatgtactac

SEQ ID NO: 5538 - DNA, 1204 bp, Flaveria ramosissima
cgacaatgtgatacgtaaaccgccacaaataaataaacacacatgatacacacaccagtgtgaatcttgatcaccgacaagatgacccccaaatcgatctgcacttcatcttctccggccaacagtgattttccgatgaccaccaaagcactgattctgcacggcgtcgccgccgccgccgcattagtcgtcggagctcacgcatattattattatcaccgatccaccaagtttcgcagtcgagttgtgggcataattccagcacgattcgcttctacaagatttcaagggaaaccccttgttgagatcctcggaaaacccatgattcagaggacttgggagagagcaaagttggcaacaacattggattgtgttgttgtggcaacggatgatgaaaagattgcagaatgctgtcgaggatttggcgcagatgtgataatgactgcagaatcgtgcaggaatggtgctgagaggtgtagtgaagcacttcaaaagcttaagaaaaagtatgatatagttgttaatattcaaggagatgaaccgcttattgaacctgaaataattgatgggattgtcaaagctcttcagaccaccccggatgcagttttcagcactgcagtcacatctttaaaacctgaagacgcttttgatccaaatcgtgtgaaatgtgtggttgataatcgtggttatgcaatctacttttctcgagggctgatcccctttaacaaatcagggaaggccaatcttgaattcccatataatcttcatcttggtattcagtgctatgattcggaatttctgaaaatttatccggacctgacaccaactccattacaactagaagaagatttagaacagctgaaagttcttgaaaatggttacaagatgaaggtaataaaagtggatcatgatgctcatggcgttgatactccagaagatgtggccaagatcgaaaattttatgcgcgaaaggaacctgtcgtaagggcaatctctcaagttatttagttccagttttcatcgtaccagttttcatattattttcagtgtgttcattttgttacctgagtgaaaattatagtttgaagcttgaatggtatcagcgatgtatacatgtaaaactagtttaatctaaacatcgacgtattaacttgtggtttgtgtattcttttgttgtggtgtatgttaactgtttaacatattta

SEQ ID NO: 5539 - DNA, 985 bp, Centaurea maculosa
caatggacttgaactccatctgtactccatcatcttcttcttcttcttcttcctcttcagctaagttattacttctccacggcgtcgccgccgccgttgccgtcgccgtcggtgcacacgcttacgtttatcaccgtcgtcgatccgccgccaagttccgtagtcgagtggtaggcataattcctgcgcgctttgcttcttctcgatttgaaggaaaacctctcgttatgatcctcggcaagcctatgatccagagaacttgggagagagcaaaattggctaccacattggatcatgttgttgtggcaacggatgatgaaaagattgcagattgttgtcggggatttggtgccgatgtgataatgacatcagaatcctgtcgaaatggagctgagcggtgtagtgaagcacttgaaaagcttgagaaagagtacgatattgttgtcaatatccagggagacgagcctcttatcgaacccgaagtaatagatggaatcgttaaagctcttcagaccacccccgatgcagtgttcagcaccgcggtcacatccttgaaacctgaggatgcatttgatccaaatcgtgtgaaatgtgtggtcgatagccatggttatgcggtctacttctctcgaggactaatcccttttaacaagtcggggaagttcaatagcaaattcccgtataatctgcatcttggtattcagagttatgatacgaaatttttgaaaatatatccgaagctgaccccgacaccgctgcaactagaggagatttagagcaacttaaagttcttgaaaatggatacaagatgaaggttatacatgttgatcatgatgctcatggtgtcgatacaccggaagatgttgctaagatcgaaagctttatgcgtgaaaagaacttggcgtagtttcatggttatttgttgtttctttgttccatggtatatattggggtggatgtcaggtctgtgtatatcgtacaattg

SEQ ID NO: 5540 - DNA, 1138 bp, Cichorium intybus
tttcatagacacacggtggcacaaatcagccatgagttggatgatctccaggtggacttgtgctggatcttctcgtccggaaattgggatgtcgaccaaatcgtgggttttgcacggcgttgccgttgccgctgctctcgtcggtgctcacgcttacttttattaccgccgatctgctaccatgtttcggagtcgagtggtgggcataattccggcccggttcgcttcttcccgatttcagggcaaacccctcgttgagatcctcggcaaacccatgatccagagaacttgggaaagagcaaagttggcaacaacattggatcgtgttgttgtggcaacggatgacgaaaagattgctgagtgttgtcgtggatttggtgctgacgtgataatgactgcagaatcgtgcagaaacggcgccgaaaggtgtagtgaagcccttcaaaagctggacaaaaagtatgacatcgttgtcaatattcaaggagatgagccgctaatcgaacctgaaattatcgatggaatcgtcaaagcccttcagaccaccccagatgcagttttcagtacggcagtcacatctttgaaaccagaagatgcttttgatccaaatcgtgtgaaatgtgtggttgataaccgtggttatgcaatctacttttctcgaggactaatcccttttaacaagtctggcaagacaaatcctgaattcccatataatcttcatcttggcattcagagctatgattcggaatttttaaagatttatccggatttaactccaactccattgcaactagaagaagatttggaacaacttaaagttcttgaaaatgggtacaagatgaaggtaataaaagtggatcatgatgctcatggtgtggatactccagaagatgtggccaagattgaaaattttatgcgcgaaaggaacttgtcttagtgtaattttgtgattttgccaccaaaatcttgaaggttttatcaaattagtgttttttttttcctaaagtgtaatttgtagtttaaggcttgaatggtggctcaactgatgtatatttcttgtgcatttgttgtagagtctgagtaaaattttagatattacatgttgtacaagttattaacacaaactttcaatatagac

SEQ ID NO: 5541 - DNA, 1180 bp, Cichorium intybus
atagacacacggtggcacaaatcagccatgagttggatgatctccaggtggacttgtgctggatcttctcgtccggaaattgggatgtcgaccaaatcatgggttttgcacggcgttgccgtcgccgctgctctcgtcggtgctcacgcttacttttattaccgccgatctgctaccatgtttcggagtcgagtggtgggcataattccagcccggttcgcttcttcccgatttcagggcaaacccctcgttgagatcctcggcaaacccatgatccagagaacttgggaaagagcaaagttggcaacaacattggatcgtgttgttgtggcaacagacgatgaaaagattgcagagtgttgtcgtggatttggtgctgacgtgataatgactgcagaatcgtgcagaaacggcgccgagaggtgtagtgaagcacttcaaaagctcgacaaaaagtacgacatcgttgtcaatattcaaggagacgaaccgctaatcgaacctgaaattatcgatggaatcgtcaaagcccttcagaccaccccagatgcagttttcagtacggcagtcacatctttgaaaccagaagatgcttttgatccaaatcgtgtgaaatgtgtggttgataaccgtggttatgcaatctacttttctcgaggactaatcccttttaacaagtctggcaagacaaatcctgaatttccatataatcttcatcttggcattcagagctatgattcggaatttttaaagatttatccggatttgactccaactccattgcaactagaagaagatttggaacaacttaaagttcttgaaaatgggtacaagatgaaggtaataaaagtggatcatgatgctcatggtgtggatactccagaagatgtggccaagattgaaaattttatgcgcgaaaggaacttgtcttagtgtaattttgttattttgccaccaaaatcttatgaaagttttatcaaatttgtgttttttttttttttttcataaagtgtaatttgtagtttaaggcttgaatggtggctcaactgatgtatatttcttgtgcatttgttgtagagtctgagtaaaattttagatattacatgttgtacaagttattaacacaaactttcaatatagactttctttattatgccaatgtattatttatttagtccac

SEQ ID NO: 5542 - DNA, 1847 bp, Cocos nucifera
gcagacggtacgtgatgcaaaattagggctcgccgatatgactccaaagtgaggagaattcctgctcatttattctagctcaattattcatgctttgcgacttcgtataccggaagaagagaccaacattttcttagccgggggacgtcaacaatggagtgccgccgctcggaaaccgacgtcaagcctgcatgcgatcttggatccgtggagattttctccaccaatctcttctagtatttcttcccaccaattccgacttccctgtctctcaaaattcgagtcttctcagtagagtgaagggatcgatggcggtttgctctccctcgtcgaagtcctcgtcggcgacgagcggcagggcctgggttgtccacgcgctggtcgtcggagcggcagtggtggcggcgcttggcgcccacgccgcggtgtacttcaagtggatcaggaaggatcggagccgggtggtggggatcatcccagcccggtttgcctcctcgcgcttcgaggggaaacccctggtccggatcctcgggaaacccatgatccagagaacatgggagagaacaaagttggcttctactttggaccatgttgttgtggcaacggacagtgaaaagattgcggaatgttgtagagaatttggagctgatgtgataatgacatcagaatcgtgcaaaaatgggactgaacgttgtaatgaagcacttcagaagcttggaaaaaattatgatattgttgtcaatatccaaggagatgagcctcttattgaaccggacataatagatggtgttgttagagctttgcagggagctcctgatgcagttttcagtactgctgtcacatccttgaaacctgaagatggacttgacccgaacagggtaaagtgtgttgtggataatcatggttatgcaatctacttctcaaggggtttgatcccatataacaagtcaggaaaagtcaatccagagtttccctatctacttcatttgggcattcagagcttcgattcaaagtttttaaggatctatccggagcttccacctactccactgcaactagaagaagaccttgaacaacttaaagttcttgaaaatggatacaagatgaaggtaatcaaggttgaccacgatgcccatggtgtagacactcctgaagatgttgaaaaaatagaagcacttatgcgagagaggaacatttcatagaagagagcatatgtgaagaaagaaatgtgatgcgtacatcagaaataaggccttgtttggtgcattctccacactgggttgacatcatttttgatttggttgtcagctatcctcagtgctctgtgatttattctctgctcgtgttgtttatttagtttttagagtgtcgccacattgatcatgacttaaacaagtccaaatcaataaagaacacagaaccattggtgatttccctgttggatcatgtgaaatgctagtgttcgagttcgtgaaggaaatggtgtcaatggggatgttgatatggttgctgatataagcaacctgaccaaattccctgcctttcatgtattatgtagcttcaagttcataatcaggataattgcttctgcaaactttgagagcttccaggctagctttacgacacatccataagccagagctacttgcaatgatctttgtgatcttggtaatgagacagaaaacatccaatcctcgagttgcttccgtctgccactgaggttcaatgatggcttcatttggtcaagcggttgcttcaattagtgtgaaaggccaaattgcgaggagaatgggtggaacaagctctattctttgacatagaacttactgctttgctggtgtttatat

SEQ ID NO: 5543 - DNA, 1212 bp, Flaveria ramosissima
tcacaaataaataaacataaacatacatcatatacacaccgcatcactagtgtggatcgttgatcaccgacaagatgactcccaaatcgatctgtacttcatcttctccggccaacgctgattttccaatgtccactaaatcactgattctgcacggcgtcgccgctgccgctgcattactcgtcggagctcacgcttattattattatcaccgatccaccaagtttcgcactcgagttgtgggcataattccagcacgattcgcttcttccagatttcaagggaaaccccttgttgagatcctcggaaaacccatgattcagaggacttgggagagagcaaagttggctacaacattggattgtgttgttgtggcaacggatgatgaaaagattgcagaatgctgtcgagggtttggtgcagatgtgatcatgactgcagaatcttgtagaaatggtgctgagaggtgtagtgaagcacttcaaaagcttaagaaaaagtatgatattgttgttaatattcaaggagatgaaccacttattgaacctgaaataattgatgggattgtcaaagctcttcagaccaccccggatgcagttttcagcactgcagtcacatctttaaaacctgaagacgcttttgatccaaatcgtgtgaaatgtgtggttgataatcgtggttatgcaatctacttttctcgagggctgatcccctttaacaaatcagggaaggccaatcttgaattcccatataatcttcatcttggtattcagtgctatgattcggaatttctgaaaatttatccggacctgacaccaactccattacaactagaagaagatttagaacagctgaaagttcttgaaaatggttacaagatgaaggtaataaaagtggatcatgatgctcatggtgttgatactccagaagatgtggcaaagatcgaaaattttatgcgcgaaaggaacctgtcgtaagggcaatctgtcaagtttttaaattccagttttcatcgtaccagttttcatattattttcacacagtgttcattttgttacccgagtgtaaattatagtttgaagcttgaatggtgtcagtgatgtatacattgtaaaactagttaatactaaaatctacgtattaacttgtggtttgtgtattctttttgttatggtgtatactaactgtttaacatatttaaaataattattg

SEQ ID NO: 5544 - DNA, 1128 bp, Brassica rapa
cggtccttttttttaagagattagaagcaaacgaactcactctcccttcactgacaagcctcaccggagcaaagtgaaagacgctaatgacactctgttcttcatcttcgtcttctcagaagacatggattgttcacgggatcttggccggaatggcgattgctgcggcgataggcgcacgtgcgtatctgggtcgatccaggaaattccggagccgggtcgtgggaatcatccccgcccgttacgcttcctctcgattcgagggaaagcccctcgtgcaaatcctcggcaaacccatgatccagagaacttgggagaggtctaagttagcctctacgcttgatcacgttgtcgtggccaccgatgacgaaaggatcgcggattgctgtcgtggattcggtgctgatgtcatcatgacatcagagtcttgcagaaacggtactgagcggtgcaacgaagctctagagaagctggagaaggagtatgatgtggttgttaacattcaaggcgatgaaccactcattgagcctgagattattgacggtgttgtcaaagcacttcaggtttcacctgacgcagtgtttagcacagcggtgacgtcactgaaaccagaagacgggcttgatcctaaccgagtcaaatgtgttgtggacaaccgtggctatgctatctatttctcaagaggcttgattccttttaacaagagtggtggagtcaatccagagttcccgtatatgcttcatcttggtattcagagctttgattccaagtttctgaatgtatattcggagcttcaaccaacgccattgcaggtagaagaggatctagagcagctcaaagttcttgagaatggctacaaaatgaaggttataaaggtggaccatgaagcccatggagttgatacacctgaagatgttgaaaagattgaatctttaatgcgtgaaagaaacctctcatagtcctcaaaaatacacatcttgctttcacatgaactcctttccttgttttatgatatggttcttccctgttttttactctgtaattcaacgagttaacttacacatatcttttttaagctaatgtaatactactggtagatataaataataggaaagaaatgtggaagct

SEQ ID NO: 5545 - DNA, 1199 bp, Phaseolus vulgaris
tagatctgaagttgagtgcccaaaattaagcaaagtcactcactttctaaattcttctctttgtttgggtcatggcaccatgctcatcgtcttcttcttcttcttctacggcgtcgtttggttcttcgaccaccgcaaagacgtggattgtccatggaattgtggcgggagtggccattacggcggcggtgggtgcacgcgcttacatgacccgattcagcaagtttcggagccgggtcgttggtattatacccgcccggtatgcctcttcgaggtttcagggaaagcctctcgttcaaatcctgggcaagcccatgatccagagaacatgggaaagggcaaagctggcggttacattggatcatcttgttgtggcaactgatgatgaaaagattgctgactgctgtcgacaatttggagctgatgttattatgacttcagaatcttgcaaaaatggtactgagcgctgcaatgaagctctacagaagcttgggaaaaattatgatattgttgtcaacattcagggtgatgaaccacttattgaacctgagataatagacggtgttgtgaaaactttgcaggcagctccagatgcagtgttcagcactgcagtcacatctttaaagcctgaagatgctcatgatccaaatagagtaaaatgtgttgtagataatagtggttatgccatctatttttcacgaggattaatcccattcaacaagtcagggaaggtcaatccaaagttcccgtatttgcttcatcttgggattcagagctatgatgcaaagtttctaaggatataccctgatcttcaaccaactcctttgcaactagaggaggatttggagcagcttaaagtgcttgagaatggctacaagatgaaggtgataaaggttaatcatgaggctcatggtgttgacactccagaagatgttggaaagctagaatctctaatgcgtgagaggaacttgtcttgaactcagataccatatagaaactaaatacaaattaatcatcagcacacataagaggtagaaaatgacttttttttccccttttagtataaatcttcttgttgcattcaacagagtatacgtgttattatttatgttgtatgttattttttttatctatagataatagacttctgtgatacacggaatacatatttattacaatattagagtgaaaagataaat

SEQ ID NO: 5546 - DNA, 1016 bp, Brassica napus
actgacaagcctcaccggagcaaagtgaaagacgctaatgacactctgttcttcatcttcgtcttctcagaagacatggattgttcacgggatcttggccggaatggcgattgctgcggcgataggcgcacgtgcgtatctgggtcgatccaggaaattccggagccgggtcgtgggaatcatccccgcccgttacgcttcctctcgattcgagggaaagcccctcgtgcaaatcctcggcaaacccatgatccagagaacttgggagaggtctaagttagcctctacgcttgatcacgttgtcgtggccaccgatgacgaaaggatcgcggattgctgtcgtggattcggtgctgatgtcatcatgacatcagagtcttgcagaaacggtactgagcggtgcaacgaagctctagagaagctggagaaggagtatgatgtggttgttaacattcaaggcgatgaaccactcattgagcctgagattattgacggtgttgtcaaagcacttcaggtttcacctgatgcagtgtttagcacagcggtgacatcgttgaaaccagaagacgggcttgatcctaaccgagtcaaatgtgttgtggacaaccgtggctatgctatctatttctcaagaggcttgattccttttaacaagagtggtggagtcaatccagagttcccgtatatgcttcatcttggtattcagagctttgattccaagtttctgaatgtatattcggagcttcaaccaacgccattgcaggtagaagaggatctagagcagctcaaagttcttgagaatggctacaaaatgaaggttataaaggtggaccatgaagcccatggagttgatacacctgaagatgttgaaaagattgaatctttaatgcgtgaaagaaacctctcatagtcctcaaaaatacacatcttgctttcacatgaactcctttccttgttttatgatatggttcttccctgtttttactctgtaattcaacgagttaacttacacatat

SEQ ID NO: 5547 - DNA, 1136 bp, Helianthus annuus
cacacacactgaacagtcggtcatgccaatgagcctaaactcgatctgcaccggatcttcttcctcggatcgcggttctaccaaatcatcgttgattctgcatggggtcgcagccgccgccgctctagtcgtcggcgctcacgcttactacttttaccgccgatctgccaccgtgttccgaagtcgagtagtgggtataattcctgcccggtttgcttcttcccgatttcagggtaaacccctcgttgagatcctcggcaaacccatgatccagaggacttgggagagagcaaagttggctacaacattggatcgtgtcgttgtggcaacggatgatgaaaagattgcagaatgctgtcgagggtttggtgctgatgtaataatgactgcagaatcgtgcagaaatggtgctgagaggtgtagtgaagcacttcaaaagctcgagaaaaagtatgatattgttgtcaatattcaaggagacgaacctctaatcgaacctgaaataattgacggcattgtcaaagctcttcagaccaccccagatgcagttttcagcacagcagtcactgcgttgaaaccagaagatgctttcgatccaaatcgtgtcaaatgtgtggttgataaccgtggctatgcgatctacttttctcgagggctgatcccttttaacaagtcaggaaaagtcaatccttcattcccatataatcttcatctaggtattcagagctatgattcggaatttctgaagatttatcctgatctgactccaactccattgcaactggaagaagatttggaacagttgaaagtacttgaaaacggttacaagatgaaggtaataaaagtcaatcatgatgctcatggtgtcgatacgcctgaagatgttgccaagattgaaagttatatgcgcgaaaagaacttgtcttagcttcatgtcgggttgtctagttgcagtgaggttttgccaccaagatagtgaagatttcgtcataccagtgtttgtttttctttgtttattttcttctatgagtgtaatttgtagcgtaaagcttgaatttccaaccgtaatgatgtaccttcctaatgcttttgttgtatactttgtgaacattatattttgtagaaagttttctagg

SEQ ID NO: 5548 - DNA, 879 bp, Valeriana officinalis
aaatggatccaaggtacgaatctgcacctcctcgtcgccgggaccatcatctagggcatggatcatacacgggctggcagtgggagctgcggttgcggtggctattggagcacacgcttacataaaccttctccgccccgctaaattccggacccgagtaattggtatcatacccgcccgtatggcttcatctcggttccatggcaaacctctcgttcaaattctcggaaagcctatgatccagagaacttgggaaagggcaaaattggcaaaaacattggatcatgttgttgtggctacggatgacgaaaaaattgccgaatgctgtcgaggatttggcgctgatgtgataatgacagcagagtcttgtcgtaatggtactgaacgttgtaacgaagcactggaaaaacttgagaagaagtacgatgttgttgtcaatatccagggagatgaacctcttgttgaacctgaaataatagatggaatagtcaaagcacttcaggaagctccggacgccgtgttcagcactgcagttacgtccttaaaacccgacgatgcatttgatacaaatcgtgtcaagtgtgtggttgataaccgcggttatgcaatctacttttcacgaggactaattccacacaacaagtcaggaaaggccaatccagaattcccttatttgcttcatcttgggattcagagttacgatacaaaattccttaaaatttatccggagctgccgcctactccactccaactagaagaagatcttgaacaactaaaagtccttgaaaatggttacaagatgaaggtgataaaagttgagcatgatgctcacggcgtagacaccccagaagacattgagaagatagaaagttatatgcg

SEQ ID NO: 5549 - DNA, 1373 bp, Brassica oleracea
gatttgttacgtgattgtgatttttattttacctttgtttagaatcaatgttatttagcaaattgaatccaatcaaaccgggccagaccggtctattttttaagagaacaaagcaaacgaactctcctctcccttcttcactgacaagcctcaacggagcaaagtgaaagacgctaatggcactctgttcttcatcttcgtcttcagaagacatggattgttcacgggatcttggctggaacggcaattgctgcggcgattggcgcacgtgcgtatctgggtcgatccaggaaattccggagccgggtcgtgggaatcatccccgcccgttacgcttcctctcgattcgagggcaagcccctcgtgcaaatcctcggaaaacccatgatccagagaacttgggagaggtctaagttagcctctacgcttgatcacgttgtcgtggccaccgatgacgaaaggatcgcggattgctgtcgtggattcggtgctgatgtcatcatgacttcagagtcttgcagaaacggcactgagcgttgcaacgaagcactagagaagctggagaaggagtatgatgtggttgttaacattcaaggcgatgaaccactcattgagcctgagattattgacggtgttgtcaaagcacttcaggtttcacctgacgcagtgtttagcacagcggtgacatcgttgaaaccagaagacgggcttgatcctaaccgagtcaaatgtgttgtggacaaccgtggctatgctatctatttctcaagaggcttgattccttacaacaagagtggtggagtcaatccagagttcccgtatatgcttcatcttggtattcagagctttgattccaagtttctgaatgtatattcggagcttcaaccaacgccattgcaggtagaagaggatctagagcagctcaaagtccttgagaatggctacaagatgaaggttataaaggtggaccatgaagcgcatggagttgatacacccgaagatgttgaaaagattgaatctttaatgcgtgaaagaaacctgtcctagtcctcaaaaatacacatcttgccctcacattttatgcatgaactcttttccttttaatttttatttttttatgatatggttcttccctgttttttactctgtaatttgaactgattcttggaccacgagttaatttacacctatatttcgtaatctaatggtatactgaagaaatgtggaagcttgtgtttggtacatccaagaaaagatagtgatcaaggagtgagggacatgttgatattattatataatcattggcttatttcggaaaacttgctaaatgccttgaaggctgtttcctttatgtgagagagatctgagatctg

SEQ ID NO: 5550 - DNA, 1170 bp, Primula obconica
gtgcaacagtgtgatgtcgatctgcagtccactcttctgaaaactactacgaaatcatggctggtacacggtctggcgttgggtgccgcggtggccgtggcaattggcgcacgtgcctattacttaagcgggcgacccggatccgccaacttcaggacccgggtcgtagggatcatacccgctcgatacgcttcgtctcggttcccggaaaacctctcgttaatatcctcggaaagcccatgatccagagaacatgggaaagggcgaaattggcaactacactggatcgcgtagttgtggcgactgatgatgaaaaaattgctgaatgttgtcgtggatttggtgctgatgtaatcatgacatccgagtcttgcccaaatggtaccgagcgttgcaacgaagcactacaaaagcttgagaagaagtacgatgttgttgtcaatatacaaggggatgaacctctaattgaacctgaagttattgacggtattgtcaaagcattgcagtctgccccagatgcagtctttagcactgctgtcacatctttgaaacccgaggacgcgtttgattctaaccgagtgaaatgcgtggttgataaccgcggctatgctatatatttttcgagaggactaataccgtttaataaatctgggaaggttaattccaagtttccatacttgttgcatcttgggattcagagctatgataccgacttcctgaaaatatatccaaagctttcacctactcctcttcaactagaagaagatctggaacagctaaaagtccttgaaaatggatacaagatgaaggtgataaaggtggaccatgaagctcatggcgtagatgcaccagaagatattgaaaagatagaacgttttatgcgtgagcgaaacttattctagcacatgccttctaacaagccttcaactcactatctatgctatatctactttgtctctgttttcgctagtctaatatatgtgcttccattttattttttttgggtatattgtgattaaggccttttttggtgttctcagtttagtgtttcagttgctcctccttggtttatccattatctgtgtgacatagtcttgatggatttccaatcctattcttttactagtatttgattatgtaaaattgtgtagagttgggaattgttgtttt

SEQ ID NO: 5551 - DNA, 1385 bp, Conyza canadensis
agcaacttttttaaccccaccaaaacatctcaacaaaatgaacggccattcagcttttacccccatccaaatcgcagctattcttttttctctttaaacacagagactgatcagtcaacccaaatgacacccaagtcaccctgtaccggatcttcttcctcagatcacggtggtcaattcatgatgtcaaccaaatcgtggattctgcatggggtcgccgccgccgccatagctgtcggagctcacggatactttttctaccgccgatccaccatgtttcggagccgggttgtgggcataattccggcccggttcgcttcttcccggtttgaaggaaaaccccttgttgaaatacttggcaaacctatgatccagagaacttgggagagagcaaaattggctacaacattggatcgtgttgttgtggcaacggatgatgaaaagattgcagaatgttgtcgaggatttggtgctgatgtgataatgactgcagaatcgtgcagaaatggtgctgagaggtgtagtgaagcccttcaaaaactcgagaaaaagtatgatattgtcgtcaacattcaaggagatgaacctcttattgaacctgaaattattgatgggattgtcaaagctcttcagaccaccccggatgcagttttcagcactgcagtcacatctttgaaaccagaagatgcttttgatccaaatcgtgtgaaatgtgtggttgataaccgtggctatgcaatatacttttctcgagggctgatcccttttaacaaggctgggaaagccaatcctgacttcccatataatcttcatctcggtattcagagctatgattcggaattcctaaagatttatccagacctgactccaactccactacaactagaagaagatttggagcagcttaaagttcttgaaaatggttacaagatgaaggtaattaaagtggatcatgaggctcatggtgttgatactccagaagatgtcgccaagattgaaaaatatatgcgtgaaagaaacctgtcttagtgcaatcgtctagtttacgtgaggttgtagctcaaattgttgaaggtttcatcagcctagtggttgtgttcatttgttcttttgacaagtaaatcgttttgtaccgagcttaatgtgtagtttaagctagaatggtgctccaactgtggctcaaccgatgtatatttcatgtgcatttcttgtagagtcccggtagaaatttaaaagtttattttgtaacaagatttatggtcaaaatttgtaataagtttttggatttaaacccagagtataaatttattagtttttgatattctgtttacttattgatgttaaatttctcttgtgtcatacctttatgatgaaatacgagtgat

SEQ ID NO: 5552 - DNA, 1253 bp, Lactuca sativa
atgactaaaatatagttttggggcaaaaagcagggcaaggtgatatgtaaaccgccacaaataaacaaacttaatactatttcaatttcggaaacacacggtgaaacagatcagccatgagttggatgatccccaagtcgacctgtgctgaatcttctcgtccgatgtccaccaaagcatgggttttgcacggcgtcgccgtcgccgctgctctggtcggtgctcacgcttacttctattaccgccgatctgccaccgtgtttcggagtcgagtagtgggcataattccagcccggttcgcttcttctcgatttcagggcaaacccctcgttgagatcctcggaaaacccatgatccagagaacttgggaacgagcaaagttggcaacgacattggatcgcgttgttgtggcaacggacgatgaaaagattgcagagtgttgtcgtggatttggcgccgatgtgataatgactgcagaatcgtgtagaaatggcgcagagaggtgtagtgaagcacttcaaaagctcgacaagaaatatgacattgttgtcaatattcaaggagatgaaccactaattgaccctgaaatcatcgatggaattgtcaaagcccttcagactacccctgatgcagttttcagcacagcagttacatctttgaaaccagaagatgcttttgatccaaatcgtgtgaaatgtgttgttgataatcgtggttatgcaatctatttttctcgaggactcatcccctttaacaaatctgggaagataaatactgaattcccttataatcttcatcttggcattcagagctatgattcggaatttttaaagatttatccggatttgtctccaactccattgcaacttgaagaagatttggaacaacttaaagttcttgaaaatgggtacaagatgaaggtaataaaagtggagcatgatgctcatggtgttgatactccagaagatgtggccaaaattgaaaaatttatgctcgaaaggaacttgtcttagtgtaattttgtgattttgtcaccaaaagcttgaagagtttttatcaaattagtgtttatttgttgtagagttggagttaaaatttagacattatattttgtacaagttattaacaaaaacatttacatgagtttgtaagtttagcatgtgataaagtgtatcaaattgtcggaatacgaaagtgaaacttgtaatacttttgctatttgtacaaacaatatattttaacttttatttatc

SEQ ID NO: 5553 - DNA, 1465 bp, Lupinus angustifolius
aaaaaggataacaagcgaccacagtttctgaagtaacgaggcagatccaaaattgtgttgaggttgttactgtcacatcctcaccgacacatagtccttcctttcatcgtatcctacaccttcttttctttcttcttctcaccatgtcaatttctccttcaccttcatcttcttcttcatcatcctcttcttcttcttcttcatcttcgtcgttggaatcttggaataacgggaagacatggatcatcaatggcattgtggcaggagttgcaattgcagcagctgtgggtgcacgcacttacctcaaccgattcaacaaattcagaagccgggttgtgggtatcatacccgcccgattcgcttcctctcgcttccagggaaagcctctcgttcaaattcttggcaagcccatgatccagaggacatgggaaagggcaaagttggcagctacattggatcatgttgttgtggcaactgatgatgaaaggattgctgactgctgtcgaaaatttggagctgatgtgataatgacatcagaatcttgccgaaatggtactgagcgctgcaatgaagccctacagaagcttgggaaaaaatatgatgttgttgtcaacattcagggtgatgagcctcttattgaacctgaaatagtagatggggttgtcaaagctttgcaggcagctccagatgcagtgttcagcactgcagtcacatctttaaagcctgaagatgctcatgacccaaatagagtgaaatgtgtggtcgacaatcgtggttatgccatctatttttcacgaggattaatcccattcaacaagtcagggaaggttaatcaacagttcccttatttgcttcatcttgggattcagagctatgatgcaaagtttctaaagatatatccgcatcttcagcctaccccattacaacttgaggaggatttggagcagcttaaagtccttgaaaatggatataagatgaaggtaataaaagttgaccacgaggcccatggcgtcgacactcctgaagatgttcaaaagatagaatctcttatgcgtgagaggaacttgtcttgaactctacagcaatgaaaccaactgtaagctaagcattagtacaatacattacagataaagatggtctataactctattcatttttataacttttgtgcttgtattcaacaagtagcgcgggtgttatgatttataatgaaatattttagcataggtagtaggacttgtttttcctccccattactagtgtttgtatatgatacagaagtgagaatgcaaatttagtttaagtatatttattgtatcttattctagaaaaggttgaagtgggatgtggataatttgtaatgacctgcagaaaagtgtgcgattgaactatatttgcccatcatgaagtccccacttgatgttagttgattttataaagaagaaattgttgcttgctcgtaaaa

SEQ ID NO: 5554 - DNA, 1098 bp, Cichorium intybus
caaaaaggatggtactgtgatatgtgaaccgccacaaataaacaaacttattatagtatacactttcatagacacacggtggcacaaatcagccatgagttggatgatctccaggtggacttgtgctggatcttctcgtccggaaattgggatgtcgaccaaatcgtgggttttgcacggcgttgccgttgccgctgctctcgtcggtgctcacgcttacttttattaccgccgatctgctaccatgtttcggagtcgagtggtgggcataattccggcccggttcgcttcttcccgatttcagggcaaacccctcgttgagatcctcggcaaacccatgatccagagaacttgggaaagagcaaagttggcaacaacattggatcgtgttgttgtggcaacggatgacgaaaagattgctgagtgttgtcgtggatttggtgctgacgtgataatgactgcagaatcgtgcagaaacggcgccgaaaggtgtagtgaagcccttcaaaagctggacaaaaagtatgacatcgttgtcaatattcaaggagatgagccgctaatcgaacctgaaattatcgatggaatcgtcaaagcccttcagaccaccccagatgcagttttcagtacggcagtcacatctttgaaaccagaagatgcttttgatccaaatcgtgtgaaatgtgtggttgataaccgtggttatgcaatctacttttctcgaggactaatcccttttaacaagtctggcaagacaaatcctgaattcccatataatcttcatcttggcattcagagctatgattcggaatttttaaagatttatccggatttaactccaactccattgcaactagaagaagatttggaacaacttaaagttcttgaaaatgggtacaagatgaaggtaataaaagtggatcatgatgctcatggtgtggatactccagaagacgtggccaagattgaaaattttatgcgccaaaggaacttgtcttagtgtaatcttctgattttgccacaaaaatcttgcagctttttattaatttaatttaatattttttctaaagtgtaatttgtagttttaaggcttgaatg

SEQ ID NO: 5555 - DNA, 1749 bp, Aristolochia fimbriata
cactgccacatcttgcccgcgacgtcttctcttatcgttttgatttttctgatgctccgaggtccgaaggagtaaaagactaattaatgggcctcttgtttgaatcaaataggatacccgattacggcccatatctgaaaaataaaaacgataatgggcctgccacctggcacaagtcagatgaggaagcggtcgacccggccgaggaggcaccaactcggccgagtcactctgcctactctgtcctctggactctagtcgttactcccttccatgttcttatggccttttctttccacacagatcattctctccccttcggtgcactctgagtgagattgagaagccatttttcgcgtattactcgaccttctttcgttgatttttcgtcggtgttcgaatcttttgtcgtactgcaaagatcggaggaaatttgctccggatctgttgcatttctcctgttttccatagaacgagccagaggagatcgagaggaacatgaccatctgttccccttcttcctcttcttcaagtggcaagtcatggatcgtacatgggttactggccggagccgcagtcgtggcagcgggaacttatgcaataatttctattcgcaaatcaggaaatttgaggagcagagttgtgggcattattccagctcgttttgcttcttcgcggtttcccggaaaaccgctaatcccaatcttaggaaaaccaatgatccagcggacatgggaaagagcaaaattagcctcaactttagaccatgttgtggtggctaccgatgatgaaaacattgcggagtgctgtcggggttttggagccgatgtgataatgacctcagaatcatgccgaaatggtactgagcgctgcaatgaagcacttcaaaagcttgggaagaagtttgacattgttgtcaatattcaaggcgatgaaccagttattgaacctgaaataattgatggtgttgtcaaagccctccagggagccccggatgctgtattcagcactgcagttacagccttgaaaccggaagatgggtttgatccaaacagagtgaagtgcatagtggacaatcgtggctacgctctctatttctccagggggctaatcccatacaacaagtctggcaagatcaatcctgagttcccttattttcttcatttgggtattcagagctatgattcaaactttttgagaatatacccacagcttccaccaacacccttgcaactcgaagaagatctggaacaacttaaggttcttgagaatggttacaagatgaaggttatcaaggttgatcatgatgcccatggtgtggacactccagatgatgttcacaaaattgaattaatgatgcgagagagaaatataagttaatgcacccagagacggaagtagcagctgatatgtgttgaatccgccctgcttcaaaatgctatgcctgttactattgggtttgaggttcctgtctagtgcattggcagagatgagagctctcctacccagttctcatgcaggtgatcagatgtcacagtgaaaaaatctgtacatttttttggcttttttgtagtttattgtggcttcttgttagtttttattcttttattgtggagttgtattctgagcatgtctgattcaactgcggtgtattattgtgcttcaagaacaattttgctcgaaggacttagcaggtgtatgaaaaaaacctcaaaatatagtgaatggttatttcacctgggactcgta

SEQ ID NO: 5556 - DNA, 1128 bp, Centaurea maculosa
ggggatcaatccatatttctcaacactccaacagcaatggagttaaactcgatctgtgcttcaccatcttcttcttcttcatcctcttcggctaaattgttgcttctccacggcgtcgccgtggcggttgccgtcgccatcagtgcagacgcttacatattctaccaacgacgatctgccgccaagttccgtagccgagtggtaggcataattcctgcgcgctttgcttcttctcgatttgaaggaaaacctctcgttatgatcctcggcaagcctatgatccagagaacttgggagagagcaaaattggctaccacattggatcatgttgttgtggcaacggatgatgaaaagattgcagattgttgtcggggatttggtgccgatgtgataatgacatcagaatcatgtcgaaatggcgctgagcggtgtagtgaagcacttgaaaagcttgagaaagagtacgatattgttgtcaatatccagggagacgagcctcttatcgaacccgaagtaatagatggaattgttaaagctcttcagaccacccccgatgcagtgttcagcaccgcggtcacatccttgaaacccgaggacgcatttgatccaaatcgtgtgaaatgtgtggttgatagccatggttatgcggtctacttttctcgaggactaatcccttttaacaagtcggggaagttcaatagcaaattcccgtataatcttcatcttggtattcagagttatgatacgaaatttttgaagatatatccgaagctgaccccgacaccgctgcaactagaggaagatttagagcaacttaaagttcttgaaaatggatacaagatgaaggttatacatgttgatcatgatgctcatggtgtcgatacaccggaagatgttgcaaagatcgaaagctttatgcgtgaaaagaacttggcgtagtttcacggttggttttgttgttcctttgtttcaacggtaaactattggggtagtttcatggttggttttgttgttcctttgtttcacggtaaactattggggtagtttcatggttggttttgttgttcctttgtttcacggtaaactattggggtagatggatgtcaggtctacatacatctcatagtt

SEQ ID NO: 5557 - DNA, 1184 bp, Fagopyrum esculentum
gaatgcgtgaaggacgatgacgaactatcaataaagctctggccagtgacccactgggtctacagaattttaacaagactttgctaggataagggttgaataaacctgcattcacttgctgaacagagagatctgcgatggtggttggatccccgccatcgtcttcctcttcctctgaatcgtcctcctctaaagcttggatctatggcgccgtggctgcagttgtaattggggcacatgcttactaccgctccagaaagttccggactcgtgtcatcggcataatccccgctcgttttgcttcctctcgctttcctggcaagcctcttgttcagatcctcggaaaacctatgatccagagaacatgggagagggcaaagttggcgtctacattggatcatgttgttgttgcaacagacgatgacaagattgctgagtgctgcagaggatttggagctgatgtggttatgacttcagaatcttgccgaaatggtactcaacgttgtaatgaagctctccagaagcttcagaagaaatatgacgttgttgtcaatattcaaggggatgaacccttgattgatccttatataatcgatgggattgttaaagctctgcagagtgctcctgatgctgttttcagcactgcagttacccctctcaagcctgaggatgcatttgatccaaatcgagtaaaatgcattgttaataaccagggttacgccatttatttctcaaggggacttatcccttttaacaagtctggaaatgttaatccaaagttcccatacatgcttcatcttggcatccagagttatgattcaagcttcttgaaagtatatgcggagctgccacctacattgcttcaactagaagaagatctagaacagcttaaagtactcgaaaatggctacaagatgaaggttataaaggttgagcatgatactcacggagtcgacgtccctgaggacgtggagaagatggaaaactttatgcgggagaacaacttggcctagctcataggcaatccctttccatggcagtatgccactgtcaatgtaatttatcattttgatttaagggctccctttgtaattcatcttccttaaaagttcactgagtttatgtaatcttctcttttccgtttttttttcaaataaatatggaatgcccaattatattctacc

SEQ ID NO: 5558 - DNA, 986 bp, Flaveria ramosissima
ttctctcggcgtttgcgtattcattcatatttatacccaaataagatctgctctacatcttctccaaaatcacagtgaattcgtaaaatgccgaccaaatcactgattttgcacggcgtcgccgccgcagctctagccgccggtgctcacgctttcttctactaccgccggtccgccaccgtgtttcggagtcgagttgtcggcattattccagcccgattcgcttcttcacggtttcacgggaaacccctcgtcgagatcctcggcaaacccatgatccaaagaacttgggagagagcaaagatggcgacaacattggatcgtgttgttgtggcaacggacgatgaaaagattgcagaatgctgtcggggttttggtgctgatgtaataatgactgcagaatcgtgcagaaatggagccgaaaggtgtagtgaagcacttcaaaagcttgacaagaggtatgatattgttgtcaatattcaaggagatgaacctcttattgaacctgaaattattgatgggattgtcaaagctctgcagaccaccccagatgcagttttcagcactgcagtaacatctttgaaaccagaagatgcttttgacccgaatcgtgtcaaatgtgtggtcgataatcgtggttatgcgatctacttttctcgtggctgatcccttttaacaagtcagggaaagttaatcctgaattcccatataatcttcatcttggtattcagagctatgattcagaatttctaaagatttatccggatctgagtccaactcattgcaactggaagaagatttggaacaacttaaagttcttgagaatggttacaagatgaaggtaataaaagtggatcatgatgctcatggtgtagatactccagaagatgtagcgaagatagaaagttttatgcgtgaaaggaatttgtcttagcctcgtttcaggtttcaaagaaggttcgtgctgccaaaatcttgatgatttc

SEQ ID NO: 5559 - DNA, 1916 bp, Cocos nucifera
ctggctcgatcaatagatactctcagataaaagaaatttaattcaatcaccattggcattccacaatatgcagacggtacgtgatgcaaaattagggctcgccgatatgactccaaagtgaggagaattcctgctcatttattctagctcaattattcatgctttgcgacttcgtataccggaagaagagaccaacattttcttagccgggggacgtcaacaatggagtgccgccgctcggaaaccgacgtcaagcctgcatgcgatcttggatccgtggagattttctccaccaatctcttctagtatttcttcccaccaattccgacttccctgtctctcaaaattcgagtcttctcagtagagtgaagggatcgatggcggtttgctctccctcgtcgaagtcctcgtcggcgacgagcggcagggcctgggttgtccacgcgctggtcgtcggagcggcagtggtggcggcgcttggcgcccacgccgcggtgtacttcaagtggatcaggaaggatcggagccgggtggtggggatcatcccagcccggtttgcctcctcgcgcttcgaggggaaacccctggtccggatcctcgggaaacccatgatccagagaacatgggagagaacaaagttggcttctactttggaccatgttgttgtggcaacggacagtgaaaagattgcggaatgttgtagagaatttggagctgatgtgataatgacatcagaatcgtgcaaaaatgggactgaacgttgtaatgaagcacttcagaagcttggaaaaaattatgatattgttgtcaatatccaaggagatgagcctcttattgaaccggacataatagatggtgttgttagagctttgcagggagctcctgatgcagttttcagtactgctgtcacatccttgaaacctgaagatggacttgacccgaacagggtaaagtgtgtggtggataatcatggatatgcaatttacttctcaaggggtttgatcccatttaacaagtcaggaaaagtcaacccacggtttccttatctacttcatttgggcattcagagctttgattcaaagtttttaaggatctatccgcagcttccacccactcccctgcaactagaggaagaccttgaacaacttaaagttctggaaaatggatacaagatgaaggtaatcaaggttgaccatgatgcccatggcgtagacactcctgaagatgttgaaaaaatagaagcacttatgcgagagaggaacatttcatagaagagagcatatgtgaagaaagaaatgtgatgcgtacatcagaaataaggccttgtttggtgcattctccacactgggttgacatcatttttgatttggttgtcagctatcctcagtgctctgtgatttattctctgctcgtgttgtttatttagtttttagagtgtcgccacattgatcatgacttaaacaagtccaaatcaataaagaacacagaaccattggtgatttccctgttggatcatgtgaaatgctagtgttcgagttcgtgaaggaaatggtgtcaatggggatgttgatatggttgctgatataagcaacctgaccaaattccctgcctttcatgtattatgtagcttcaagttcataatcaggataattgcttctgcaaactttgagagcttccaggctagctttacgacacatccataagccagagctacttgcaatgatctttgtgatcttggtaatgagacagaaaacatccaatcctcgagttgcttccgtctgccactgaggttcaatgatggcttcatttggtcaagcggttgcttcaattagtgtgaaaggccaaattgcgaggagaatgggtggaacaagctctattctttgacatagaacttactgctttgctggtgtttatat

SEQ ID NO: 5560 - DNA, 1457 bp, Medicago truncatula
gaatttccttacccgaagtaccaagcttttctgccgccgcaacagggttattgttaacgagattttgaggcattagttccggtgtctccgccgtaacagggttcggttttgtttctttcttctcttgtgctcaaaaaacatgggaaatgcatataacagaagacaacggatctgaagcgattattcactttgccactgtcacattctctccttctgccatgacaatttgttcctcctcagattcatcatcgtcctcttcttcttcctcgattgattcttcttcttcttccaacaacaacttgaagacatggatcatccatggcattttgtttggagtttcaattgcagctgtagctggtgctcgcgcatatttcaatcgattcaacaaattccgtagccgagttgtaggcattatacctgccagatttgcttcatcgagattcgaaggaaagcctcttgttcatattcttggcaaacctatgatccagagaacgtgggaaagcgcaaagctggcagcttcattggatcatctagttgtggcaactgatgatgaaaagattgctgactgctgtcggaaattcggtgcagatgtcataatgacatcagagtcttgtcgaaatggtactgagcgctgcaatgaagccctacagaagcttgagagaaaatatgatatagttgtaaacatacagggtgacgagccacttcttgaacctgaagtaattgacggtgttgtcaaagctttgcaggcagctccagatgcagtgttcagcactgcagttacggctttaaagcctgaagatgcacatgatccaaacagagtgaaatgtgtggttgataatcgtggttatgcaatctatttttcacgaggattaatcccattcaataagtcagggaaggtcaatcagcagttcccttatttgcttcatcttgggattcagagctatgatacgaagtttctaaagatatacccagatcttcaacctactccattgcaacttgaggaggatttggagcagcttaaagtccttgagaatggctataagatgaaggtaataaaggttgaccatgaggcccatggtgtcgacaccccggaagatgttgaaaagatagaagctctaatgcgtcagaggaacttgtcttgaacatgttgtagcattgaaacagtctaaaaattagcaactattaacacgagaagtcatcgacacggatgcaccggatcgaatacgagtgttataatttgatttgtagtgttacttttttgggacggggaatataacaagaatttcatatacactagtatatgcaagaatggaaattttatttatacgtatattgcacatgaatcattatcatcattagaaaaaaatgtagtggtccttggatgatattatgaatcttgattataagcatgtagaaaattcatttatattatttgtactttccttctttagtcattt

SEQ ID NO: 5561 - DNA, 1086 bp, Silene vulgaris
agtctgttagcacgccaacaatggagaatcaaatgtcagtaaaatcatgggtaacatatggattactaatgggagcggcaacggcggtagcgattggtgcacacgcattgttcttccgtcgtcgatcttctaaattccgatcacgcgtagtcggaatcataccggcgcgttacgcttcgtctcgcttcgagggaaaacctcttgttgatatcttaggcaagcctatgatccagcgtacatgggagagagcgaagttggcgtctatgttggatcaagttgttgtggcaacagatgatgataaaattgcgaattgttgtcgtggttttggtgctgatgtgattatgacttcagaatcttgtagaaatggagctgagcgttgcagtgaagcacttcagaagcttggcaagaagtatgacattgttgtcaatatccaaggagacgagcctttgattgaaccagagataattgatgggattgttaaagcattacagtgctctcctgatgctgtcttcagcacagccgtaacgtctttgaagccagaggatgcatttgatccaaatcgtgtgaaatgtgtgatcgataatcttggttatgcaatctacttctccaggggactcattcccttcaacaagtctgggaaggtcaattcagattttccttatttactacatctaggaattcagagctatgatgcaaagttccttaaaatatattcagacctcacgcctactccattgcaattagaagaagatctcgaacaactgaaagttcttgaaaatggctataaaatgaaggttataaaggttgagcatgaagctcatggtgtcgatgttccagaagatgtagagaagatagaaagatatatgcgtgaacggaacttgtcctgatctgtgagaccccgcttgttacaaggtacaaacattttactatattcgtcagctttcttttcaatgctgatacctacttaataattacgctcttgattttgtgtacatctcccgcttatatttcttagtttgtagaggttaacttgacttgtgagactagtagtcaaaatgttttactgctcatttctttacctaattc

SEQ ID NO: 5562 - DNA, 946 bp, Taraxacum officinale
cacagatcggccatgagttgcatgatccccaagtcgacttctgctggatcttctcgcccggaatttgtgatgtcgaccaaagcatgggttttgcacggcgtcgccgtcgcggctgctctcgtcggcgctcacgcatacttctattaccgccgatctgccaccatttttcggagtcgagttgtgggcataattccagctcggttcgcttcttcccgatttcagggcaaacccctcgttgagatcctcggcaaacccatgatccagagaacttgggaaagagcaaagttggcaacgacattggatcgcgttgttgtggcaacggatgatgaaaaaattgcagaatgctgtcgtggattcggtgctgatgtgataatgaccgccgagtcttgcagaaacggcgccgagaggtgtagtgaagcacttcaaaaactcgacaaaaagtacgacattgttgtcaatattcaaggagatgaaccgctaattgaccctgaaataatcgatggaattgttaaagcccttcagacgaccccagatgcagttttcagcactgcggtcacatccttgaaaccagaagatgcttttgatccaaatcgtgtgaaatgtgttgttgataatcgtggttatgcaatttacttttctcgaggactcattccttttaacaagtctggtaagatcaatactgaattcccgtataatcttcatcttggtattcagagctatgattcggaatttttaaagatatacccggatttgactccaactccattgcaactagaagaagatttggaacaacttaaagttcttgaaaatgggtacaagatgaaggtaataaaagtggatcatgaagctcatggtgtcgatactccagaagatgtggccaaacttgaaaatatatgcgcgaaggaacttgtcttaatgtaatactgtgatgaatgttgactgattc

SEQ ID NO: 5563 - DNA, 930 bp, Flaveria ramosissima
ccaaagtcacagtgaattcgtaaaatgccgaccaaatcactgattttacacggcgtcgccgccgcagctctagccgccggtgctcacgctttcttctactaccgccggtccgccaccgtgtttcggagtcgagttgtcggcattattccagcccgattcgcttcttcacggtttcacgggaaacccctcgttgagatcctcgggaaacccatgatccaaagaacttgggagagagcaaagatggcgacaacattggatcgtgttgttgtggcaacagatgatgaaaagattgcagaatgctgtcgcggttttggtgctgatgtaataatgactgcagaatcgtgcagaaatggagccgaaaggtgtagtgaagcacttcaaaagcttgacaagaagtatgatattgttgttaatattcaaggagatgaacctcttattgaacctgaaataattgatgggattgtcaaagctctgcagaccaccccagatgcagttttcagcactgcagtaacatctttgaaaccagaagatgcttttgacccgaatcgtgtcaaatgtgtggttgataatcgtggttatgcgatctacttttctcgtgggctgatcccttttaacaagtcagggaaagtcaatcctgaattcccatataatcttcatcttggtattcagagctatgattcagaatttctaaagatttatccagatctgactccaactccattgcaactggaagaagatctggaacagcttaaagttcttgaaaatggttacaagatgaaggtaataaaagtggatcatgatgctcatggtgtagatactccagaagacgtcgcgaagatagaaaatttttatggcgagaaaggattttggtacttaggcctcgtttcaggtttcaaagaaggtttgtgctgccaaaatcttgataatttc

SEQ ID NO: 5564 - DNA, 1057 bp, Flaveria ramosissima
ccggccaacagtgattttccgttgaccaccaaagcactgattctgcacggcgtcgccgccgccgccgcattagtcgtcggagctcacgcatattacttttatcaccgatccaccaagtttcgcagtcgagttgtgggcataattccagcacgaatcgcttcttccagatttcaagggaaaccccttgttgagatcctcggaaaacccatgattcagaggacttgggagagagcaaagttggcaacaacattggattgtgttgttgtggcaacggatgatgaaaagattgcagaatgctgtcgaggatttggcgcagatgtgataatgactgcagaatcgtgcaggaatggtgctgaaaggtgtagtgaagcacttcaaaagcttaaaaaaaagtatgatatagttgtaatattcaaggagatgaaccgcttattgaacctgaaataattgatgggattgtcaaagctcttcagaccaccccggatgcagttttcagcactgcagtcacatctttaaaacctgaagacgcttttgatccaaatcgtgtgaaatgtgtggttgataatcgtggttatgcaatctacttttctcgagggctgatcccctttaacaaatcagggaaggccaatcttgaattcccatataatcttcatcttggtattcagtgctatgattcggaatttctgaaaatttatccggacctgacaccaacaccattacaactagaagaagatttagaacagcttaaagttcttgaaaatggttacaagatgaaggtaataaaagtggatcatgatgctcatggtgttgatactccagaagatgtggcaaagatcgaaaattttatgcgcgaaaggaacctgtcctaagggcaatctgtcagttctttaaattccagtttttgtcggaaactcgtaccagttttcatattattttcacagagtgttcagtttgttacccgagtgtaaattatagtttgaagcttgaatggtgtcagtgatgtatacatagtaaaactaatttaatactaaaatctacgtattaacttgtggtttgt

SEQ ID NO: 5565 - DNA, 1187 bp, Artemisia annua
caaaacatatactgtataaatcttcatattcagtattcacacacactgacatacaacacactgattactcactcatgagcggtgaacccagctgtactagattggatcgggtcattttcatgtcaaccaaatcagctattctacacgccgccgccgttgcgacggcgttagcggcgggttactattactaccggcgatccgccactgttttccggagccgggtcgtgggtataattccggcccggtttgcttcttcccggtttgagggtaaaccccttgttgaaatacttggaaaacccatgattcagagaacatgggagagagcaaagttggcaacaacattggatcgtgttgttgtggcaacggatgatgaaaggatagcagaatgttgtcgaggatttggtgctgatgtgataatgactgcagaatcgtgcagaaatggcgctgaaagatgtagtgaagcacttcaaaagctcgagaaaaagtatgatattgttgtcaatattcaaggagatgagcctcttattgaacctgaaatcattgatgggattgtcaaagctcttcagaccaccccagatgcagttttcagcacttgtgttacatctttgaaaccagaagatgcttttgatcctaatcgtgtgaaatgtgtggttgataaccgtggttatgcaatctatttctctcgaggactgatcccttttaacaagtcagggaaggtcaatcctaaattcccatacaatcttcatctcggtattcagagctatgattcagaatttttaaagatttatccggacttgacaccaactccattgcaactagaagaagatttggaacaacttaaagttcttgaaaatggttacaagatgaaggtaataaaagtagatcatgatgctcatggtgttgatactccagaagatgtcgccaagatcgaaaattttatgcgcgaaaggaacttgtcatagttcagtggtgtccattttgaaaatctcataacactagcgttcgttttcgtttgttctttttcaggtattcattttgttccgggagtgtaatatgtagtttaaagcttgaatggtgtcacattcatgtatatttattttgtagagtctgagccaaaatttagacatttccattttataagttttattgtcaaatttatgtgataaattagcagtattgatttttgg

SEQ ID NO: 5566 - DNA, 3782 bp, Hordeum vulgare
cccacgcgatgacaacactgtttgttttgtttgctcaggatcaagccggaaagtcagagagaaaagctttcccgagtgagtcccgtccgtcccccctctccctccgcctatttagcgccgcgctcgccgcttcctcctcccatccccagcctcaatcgccacccctgtcccggagcaaccagcgatggcgcgcgtctccagttccaggaagcgcatgctccacaccaacagcaacaagaagggcgacgaggttgccgccaccgccaccgccagcgccacggccagcgacggccgccccgtccgcgtctacgccgacggcatcttcgacctcttccacttcggccacgcccgcgccctcgagcaggccaagctgctgttccccaacacgtacctgctggtgggatgctgcaacgacgacctcacacggcgctacaagggcaagaccgtcatgaaccaggaggagcgatacgagtccctgcgccactgcaagtgggttgatgaggtcattcctgatgccccctgggttctcacgccagaattcattgagaagcatcagattgattatgtcgcacatgatgctttgccttatgctgatacaagcggtgcttcaaatgacgtctatgagtttgtcaagaagattggaaaattcaaggaaacaaaaaggactgatggagtatcgacatcggacctcataatgaggatagtgaaggattacaaccagtatgtcatgaggaatttagcacgaggttactcaaggaaagatatgggcgtgagctatgttaaggagaaacaactgcaagtgaatatgaagatcaataaactgcgggagactgtgaaggcgcagcaagaaaagttgcaaacggtggcgaagacggctgggataaaccacgaagagtggctggcgaacgcggatcgctgggtggcgggcttcctggagaagttcgaggagcactgccacgtcatggagactgccatcaaggaccggatacaggagaggctggggaggcaggccggcaaaggcatagcggccggtctcatgcggcagccggtggcggcggcctgatcttccagaccaggtcttggtgatggtttgaacgaacaccgagaaagcgagaagttgctagttgtgtgcttgtgtcatggaatgtgatgcttgtgcgagtaaagtggttgagttagctgagcaaatcctttgtattattgttttttttgtttgttggtggaggatgtgcgtgcgtgtgtgtattgtttcacagttttgtactacgcagatgtctatagcagaggcgtttggtgtcgagcgtctacctactatgtggagagagttttttttttaaagctatgtggagagagttttgttgcccttgttctttgtaggctgtatcttttgtaatgagggatggatatgtgccattttttttgtgtggttactccataagaaaaatggagcacatgttaagatgaacagcgcttaaatttgtgtaacccatcaagaatgctggtgtttttccccaacaaaaaaagaagaaaataatgctggtgtttacgcttgatgaagtagtgatgtgtgctgggtgctgaaatggcaacccaaggatcccaatccggatacatcctggactggtgctcctggccacatacatacacctgccgacctgcgtcaggcagagctccgaaaagtccgtccggttcgcatcagcagcagcgagaggcagccaaccccgctgcttccgtctccgtttctgcttctgctccactccactgggcgctgggcggccggtcgtccatggccgcgacgatgatgggcatttccgctttgcgctcccaccacccgctccccctgccgaccgcgcgcccggccgcggctctcccccgcgccacgtcgccgacgtcgcaccaacccagtctgctcacgcttctaggatgcggatgccgacgccgacgcggcctcccccattctccctgcagctccccccctcgcgcctcgctctcctcgggcggccccgactcggctgctttcatggcattggctcccaacaatgccgcccttcgccaccgcctcatcgcccccaactccaccggcggctccggagacgccgccgccgccgccgccggaggcctgcccagcgttgttggcatcgcgcacctggcggtgtcgctgggcatcgtgctggccacggacaagtacctgaagcaggcgttcgtggcggcgtccatcaagttccccagcgccctcttcggcatgttctgcatcttctccgtgctcgtcgtcctcgacaccgtcgcgccggcgctggccaagggcttcatggacttcttcgagcccgccacgctcttcatccagcggtggctgccgctcttctacgtcccctccctcgtcgtcctgcccctcgccgtcagggacgtccccgccgcctccggcctcaagatctgcctaatcacattcggtggctggttcgcgtcgctggcggtggcggggtacacggcgctgaccgtgaggaagatcgtcaagacggagctcatcgcggccgagccgatgggcaagccgtccgccttcgtgacgctggagttctgggcgtggggcgccgtcttcgtcgcctccttcgccacggcgttcgtgaaccccacggcgcttggcaccacggccaggacgtgcctcccgttcatgctcgcttccactgtactgggatacatggttggttctgggttaccatctggcatcaagacattgttacacccgatcatctgctgcgcgctttccgcgaatttgtcggcggtggcatatgggtacctgtccgggtccggaatggatgctgcgctaggcgattacctgacaaaggtgccatcgaatcctggagctggtgacgtcctgatggggtttcttggctctgtcatcttatcatttgccttctcaatgttcaagcagagaaagcttgtgaagaggcacgcggcagagatattcacgtcgatcgccattgcgtcgacattctccctgtactcgacggccatcctaggacgcctggttgggctggagccaacgttgaccatctcgatcttgccaaggtgcataaccgtggcgttggctctgagcatagtgtctttcttcgaaggcgcaaacacttcggtgacggctgccgtggttgttctgacgggcctgatcggcgccaacttcgtgcaggcggccatggacaagcttggcctcaacgaccccatcgccagagggatcggaacagcttccagtgctcatgggttgggaaccgcggcgctgtcggccaaggagcctgaggcgctccccttctgcgccatcgcctacgcgctcaccggcattttcggctccctgatctgctcctctccggccgtcaggcaaagcctcgtgttcatagccggctgacacacatatacactagtacacaggcatacagcaacagcagcagcttgtgatgagtttttattttcctttttataaaagaatggtaagtgctttggagaaaaaaaatgcaaaatttcccaacaaaaatatgtgcataactttggctcatgtaaagatggatggttgaaacaactcaaggcgtgagtactgagtagtattcccttgcttgcttagctgcaaatgttcattgattgcttttctccttgtgattctcctattatttggtttggtgtcaacaattggcatgtctatctggttggctacaaattggttcttgcccatccttagagcaagtatacaatatagttggctataagcctttttatatgaagataaattcatccgtggtcat

SEQ ID NO: 5567 - DNA, 1963 bp, Secale cereale
tcagacaaccgaaaggtctgcccgcttcgcatcagcactcagcagcgagaggcagccaactcctgctgcttccgtctccgtttccgcttctgctcgactccactggccggtcgttcgctcatggccgcgatgattatggggatttccgctttgcgctcccaccacccgctccgtctgccgaccgcgcgcccggccgcggctctcccccgcgccacgtcgccgacgtcgcaccaacccaggtcgctcacgcttctacgatgccgatgccgacgcagcctcccccattgttcctgcagctcctctcctcgcgcctcactctcgtcaggcgcccccgactcggctgctttcatggcattggctcccaacaatgccgcccttcgccaccgcctcgtcgcccccaactccaccgccggccccggagacggcgccgccaccgccaccggaggcctgcccagcgttcttggcatcgcgcacctggcggtgtcgctgggcatcgtgctggccacggacaagtatctgaagcaggcgttcgtggcggcgtccatcaagttccccagcgccctcttcggcatgttctgcatcttctccgtgctcgtcgtcctcgacatcgtcgcgccggcgctggccaagggcttcatggacttcttcgagcccgccacgctcttcatccagcgctggctgccgctcttctacgtcccctccctcgtcgtcctgcccctcgccgtcagggacatcccggccgcctccggcctcaagatctgcatcatcacactcggtggctggttcgcttcgctggcggtggcggggtacacggcgctcaccgtgaggaagatcgtcaagacggagctcatcgcggccgagccgatgggcaaaccgtccgccttcgcgacgttggagttctgggcgtggggcgccgtcttcgtcgcctccttcgcgacggcgttcgtgaaccccacggcgcttggcaccacagccaggacgtgcctcccgttcatgctcgcttccactgtactgggatacatggttggttctgggttaccgtctggtatcaagaaattgttacacccgatcatctgctgcgcgctttctgcaaatttgtcggcggtcgcatacgggtacttctccgggtccggaatcgatgccgcgctaggtgattacctgacaaaggtgccatccaatcctggagctggtgacgtcctcatgggttttcttgggtctgtcatcttgtcatttgccttctcaatgttcaagcagagaaagcttgtgaagaggcacgcggcagagattttcacgtcgatcgccattgcgtcgacattctccctgtactcgacggccatcctaggacgcctgattgggctggagccaacgttgaccatctccatattgccaaggtgtataaccgtggcgttggctctgagcatagtgtctttcttcgaaggcgcaaacacgtcgctgacggctgccgtggttgttctgacgggcctgatcggcgccaacttcgtgcaggcggccatggataagcttggcctcaacgaccccatcgccagagggatcggaacagcctccagtgctcatgggttgggaaccgcggcgctgtcggccaaggagcctgaggcgctccctttctgcgccatcgcctacgcgctcaccggcattttcggctccctgatctgctcctctccagccgtcaggcaaagtctggtgttcatagcgggctgacagacatatacaccagtatatacaacaacaacaacaacaacagcttgtgatgagtttttttcttttccttttatgaaagaatggtaagtgctttggaggacaaaggtgcaaaatttcccgccaaaaaaggtcaacatgcaaaaatggatggttgcaacaagtcaaggtgtgagtagtactcccttgcttgtatagctgcaaaatgttcagtgattgcttttctccatgtgatttttcttcgtaa

SEQ ID NO: 5568 - DNA, 1683 bp, Avena sativa
cggactctgcttccgttttggtttccgcttctgctccaatcccattcatggcagccatgattgggatttccgctttacgctccctccacccgctccctctcaccttctcgggctcggccgcggctcctccccgcgccacgttgacgctgccgctgccgttgcaccaacaaccccgctcctgcacgactccacgatgccgatgccgatgccaacgacggagccttccccattccactccccgcgtcagagcagccgcgtcttcgcctccatcaggggacaccagctccgccgccttcatggcgtcgcctcccgacaatgctgccctccgccaccgcctgatcgcccccaactccaccgccggcaccggagactccaccaccgccgccgcttccggagtcctgcccagcgttcttggggtcgcgcacctggcggtgtcgctgggcatcgtgctggccaccgacaagtacctgaagcaggcgttcgtggccgcgtccatcaagttccccagcgccctcttcggcatgttctgcgtcttctccgtgctcgtcgtcctcgacgtcgccgcccccgcgctcgccaagggcttcatggacttcttcgagcccgcatcgctcttcatccagcgctggctcccgctcttctacgtcccctccctcgtcgtcctcccgctcgccgtcagggacgtcccggccgccgccggcctcaagatctgcctcatcacatttgccggctggttcgcctcgctcacggtggcgggatacacggcgctgaccgtgcggaagatcgtcaagacggagctcgtcgcggccgagccgatgggcaagccgtcccccttcgccacgctggagttctgggcgtggggcgccgtcttcgtagcctcgtttgccacggcgtttgtcaatcccacggcgcttggcaccacggcgaggacgtgcctccccttcatgctcgcctccactgtactgggatacatggttggttctgggctgccatctggtatcaagaaactgttgcatccaatcatctgctgcgcgctctctgcaaatttcgcggcggtggcatatgggtacctctccgggtctggaatcgacgctgcgctaggtgattacctgacaaaggtgccatcggatcctggagccggtgacgtcctgatgggctttcttgggtctgtcatcatatcctttgcgttctcaatgttcaagcagagaaagcttgtgaagagacacgcggcagaaatcttcacatcgatcgccgttgcttcaacattctccttgtactcgactgccatccttggacgcctgatcgggctggagccgacactgaccatctcgatcttgccgaggtgtataactgtggcgttggctctgagcatagtatctttctttgaaggtgcgaatacttcggtgaccgctgccgtggttgtcctgacgggcctgatcggtgcaaacttcgtgcaagcagccatggataagcttggcctcaacgaccctatcgctagaggaatcggaacagcatccagcgctcatggtctgggaacagcagcgctgtcggctaaggagcccgaggcgctccctttctgcgcaatcgcctacgcgctcaccggcatcttcggctccctcatttgctcctctgcggccgtcaggcaaagccttgtgttcatagccggctgacatacgtgtgaat

SEQ ID NO: 5569 - DNA, 1903 bp, Brachypodium distachyon
cttcgcatcagcggcagcggcaaaggaagactctgcttcagcttccccgggcttgacattcattcatggcagcgaccatgattgggatgaccgctcttggcttccacaacacccatcgaccactcctcctccactcggctctcccccgcgccacgtcgccgccggttccccgcttctgcacgcttccgcgatgccgatgccaaagcagctcctcttcttcctgcggctgctctgcccgtgccacaagggcactccctcccagctccgcggctttcatggcgtcgcctccccacaatgccgcccttggccaccgcctgatcgcccccaactccaccgccggcaccggagacgccgccgccgccgcccctcctccgggaggaatcctgcccagcgttgtcggtgtggctcacctggcggtgtcgctggggatcgtgctggcgacggacaagtacctgaagcaggcgttcgcggcggcggccatcaagttccccagcgcgctcttcggcatgttctgcgtcttctccgtgctcctcgtcctcgacaccctcgccccttccctcgccaaaggcttcatggatttcttcgaacccgccacgctcttcatccagcgctggctcccgctcttctacgtcccttccctcgtcgtcctccccctcgccgtcagggacatccccgccgcctccggcctcaagatcggcctaatcacatttggaggttggtttgcttcgctgacggtggccggatacacggcgctggcggtgaggaaggtcgtcaagacggagctcatcgcggcggagcccatgagcaagccgtccgcattcgcgacgctcgagttctgggcgtggggcgccgtcttcgtggcctcgttcgccacggcgttcgtgaaccccacggcgcttggcaccacggccaggacctgcctgcctttcctgctcgcttccactgtgctgggatacatggttggttctgggttgccgtctggtgtgaagaaagtgctgcacccaatcatctgctgcgcgctttctgctgatttggcggcagtggcgtatggctacctctccggctctggaattgacgctgcactaggtgattacctgacaaaagtgccatctaatcctggagccggtgacgtcctcatgggttttctcggctctgtcatcatatcattcgccttctcaatgtttaagcagagaaagctcgtgaagaggcacgcggcagagatcttcacctcgatcgccatcgcgtcaaccttctccttgtactcgacggccatcctgggacggctgattgggctggagcccacactgaccatatcgatacttcccaggtgcataaccgtggcgttggcgctgagcatcgtgtctttcttcgaaggagcgaacacttcgctgacggcagccgtggttgttctgacgggcctgatcggcgccaacttcgtgcaggcggccatggataagctcgggctcaacgaccccatcgccagaggaatcggaactgcttccagtgctcatggtctgggaacggcggcgctgtcagcgaaagagccagaagcgctgccgttctgcgccatcgcctacgcgctcaccggcatcttcggctccctcatttgctcctcttcggctgtcaggcaaagccttgtcttcatagccggctgacacattattgacccacggggttctttcttttcgtttctttttttataaaaggaaagagagagaaaacggcaaactttgctcggagaagaagaagctgaagtgcagatttttgggccaatgtcaacatgggatagatcgatgcttgaagcaagacatgtatagaaaggtgtgaatggctcgtgtactacctacctgtaaatgtttaaaaattaataagacgacatcaatcaatacaaggaccttctaaa

SEQ ID NO: 5570 - DNA, 2067 bp, Hordeum vulgare
atgaagtagtgatgtgtgctgggtgctgaaatggcaacccaaggatcccaatccggatacatcctggactggtgctcctggccacatacatacacctgccgacctgcgtcaggcagagctccgaaaagtccgtccggttcgcatcagcagcagcgagaggcagccaaccccgctgcttccgtctccgtttctgcttctgctccactccactgggcgctgggcggccggtcgtccatggccgcgacgatgatgggcatttccgctttgcgctcccaccacccgctccccctgccgaccgcgcgcccggccgcggctctcccccgcgccacgtcgccgacgtcgcaccaacccagtctgctcacgcttctaggatgcggatgccgacgccgacgcggcctcccccattctccctgcagctccccccctcgcgcctcgctctcctcgggcggccccgactcggctgctttcatggcattggctcccaacaatgccgcccttcgccaccgcctcatcgcccccaactccaccggcggctccggagacgccgccgccgccgccgccggaggcctgcccagcgtgagtgctcctcctcctcatctccctgttgatagagaatcgaacaatcgtccacgacagatggttgttggcatcgcgcacctggcggtgtcgctgggcatcgtgctggccacggacaagtacctgaagcaggcgttcgtggcggcgtccatcaagttccccagcgccctcttcggcatgttctgcatcttctccgtgctcgtcgtcctcgacaccgtcgcgccggcgctggccaagggcttcatggacttcttcgagcccgccacgctcttcatccagcggtggctgccgctcttctacgtcccctccctcgtcgtcctgcccctcgccgtcagggacgtccccgccgcctccggcctcaagatctgcctaatcacattcggtggctggttcgcgtcgctggcggtggcggggtacacggcgctgaccgtgaggaagatcgtcaagacggagctcatcgcggccgagccgatgggcaagccgtccgccttcgtgacgctggagttctgggcgtggggcgccgtcttcgtcgcctccttcgccacggcgttcgtgaaccccacggcgcttggcaccacggccaggacgtgcctcccgttcatgctcgcttccactgtactgggatacatggttggttctgggttaccatctggcatcaagacattgttacacccgatcatctgctgcgcgctttccgcgaatttgtcggcggtggcatatgggtacctgtccgggtccggaatggatgctgcgctaggcgattacctgacaaaggtgccatcgaatcctggagctggtgacgtcctgatggggtttcttggctctgtcatcttatcatttgccttctcaatgttcaagcagagaaagcttgtgaagaggcacgcggcagagatattcacgtcgatcgccattgcgtcgacattctccctgtactcgacggccatcctaggacgcctggttgggctggagccaacgttgaccatctcgatcttgccaaggtgcataaccgtggcgttggctctgagcatagtgtctttcttcgaaggcgcaaacacttcggtgacggctgccgtggttgttctgacgggcctgatcggcgccaacttcgtgcaggcggccatggacaagcttggcctcaacgaccccatcgccagagggatcggaacagcttccagtgctcatgggttgggaaccgcggcgctgtcggccaaggagcctgaggcgctccccttctgcgccatcgcctacgcgctcaccggcattttcggctccctgatctgctcctctccggccgtcaggcaaagcctcgtgttcatagccggctgacacacatatacactagtacacaggcatacagcaacagcagcagcttgtgatgagtttttattttcctttttataaaagaatggtaagtgctttggagaaaaaaaatgcaaaatttcccaacaaaaatatgtgcataactttggctcatgtaaagatggatggttg

SEQ ID NO: 5571 - DNA, 1109 bp, Triticum aestivum
cagtctgcttccctctgcggctcctccgatctgaactcgccgccagccgcctcccgcctgcttccggggttcgtgcctctccgacagctcgccgtcgccgcctcccccttgtctccgtgccccgcccccgccgcgcccttccccacgtgctgcttccgcgcccgcgcgctccacctgacccacccgcccggtcctgttcggcggtgtgcaggcgtgcgccctgccctgcactacagaagcagccagcctgcggccaccagctaccggccggccctcccaccgccccacgactgaacacagcacacaggtgtaccaccctgttttaaattcctagatccggctaccggagagcggagctgtgcccgcgcgagatggggatggaggagtccgcggggggcgcgcgaggcaggccaaggagtcgctggagctggcgttccagatgtcccagatcctggacactggcctcgaccgccacaccctctcgctgctcatggcgctctgcgaccgcggcgccaacccggaggccctcgccgccctcgtccgtgagctctcctccgccgctcccctggcccccgccacccccaccgcgcccgcctcaaacgccgtggtggccccgaccgctccctcgctgttcccctccggctttcgccagctctaggctactagggttcgtgccctcgaccgcttcttctttttcctcccagatgacaccgcttgtcacttgatcgccttgtacgtgtgcacctaggccttccatcctgtatgctgaaactggttcctgatttgtattctcgagaatcgagattggtaatgcaagggggtctgtgtcaaactctgtcacactctagcaaatgattttctcttctgttggctgaaatcgcttcctggtgtgtatccccaatattgataatgcaatggaatctgtcaaattctgttatccacattcttgcacatggattcattcgttgaattatccatatcgttatgacaccaatgcaagattgcagagacgaatttgaaatacaatctacttatttggatcacctgtataattgtgaattccatgtttaagtgactcgaaacatgcccatgagtagaattgttgttat

SEQ ID NO: 5572 - DNA, 1008 bp, Triticum aestivum
ccacgcgtccgcgagaaaaaaagaaaaggagggagacgaacggaacagagcggcgaccaccagggacctcggcggcggccacacccaggtggaccgccctttctaaaatacctagactcggctaccggagagcggaactgtgcccgcgagatgggaatggaggagtctgcggggggcgccgcgaggcaggcgaaggagtcgctggagctggcgttccagatgtcccagatcctggacaccggcctcgaccgccacaccctctcgctgctcatggcgctctgcgaccgcggcgccaacccggaggctctcgccgccctggtccgcgagctgtcctccactgctcccccgtccgccgctgcccccaccgcgcccgcctccaacgccgtggcggcaccgaccgccccctcgctgttcccctccggctttcggcagctctaggctagggttcgtgccctcgaccccttcttctttttcctcacggatgacaccgcttgccacttgatcgcgttgtatgtgtgcacttaggtcttccattctgtaggctgaaactggttcgtgatttgtattctcaagattagtaatgcaagggggtctgtgtcaaactctgtcacattctagcaaatgattttctcttctgttggctgaaatcgcttcctggtttgtatcctcaatattgataatgcaatggagtctgtgtcaaattctgttatccacattcctgcacatggattgattcgttggaattattcatatcattatatgacaccaatgcaagagattacagagacgaatttgaagtacagtctacttatttggatcacatgtataactgtgaattccacgtttaagtgactcgaaacatgcccatgagtagaattgttgttatgtcaatgttccttgttctggagacatcccaattagtagctctcctttatcattcggcacacgtgtttcaatcgctgctagattcaccatagtcaagggctgagaatttgaacttacctttag

SEQ ID NO: 5573 - DNA, 912 bp, Secale cereale
aggcgacgaacggaacagagcggcgaccaccaggagctcggcggccaccaccagggacctcggcggcgagtcccaaagatctcggcagccacgcccagatttgtgaactgtccgtcgatctgcaggctgattgaaggtggaccaccctttttaaaattcctatactcggttaccggagagcggaactgtgcccgcgcgagatgggaatggaggagtcggcggggggtgccgcgaggcaggcgaaggagtcgctggagctggcgttccagatgtcccagatcctggacaccggcctcgaccgccacaccctctcgctgctcatggcgctctgcgaccgtggcgccaacccggaggctctcgccgccctcgttcgcgagctgtcctccaccgctcccccgtccgccgctgcccccgccgcgcccgcctccattgccgtggcggcaccaaccgttccctcgctgttcccctccggctttcggcagctctaggctagggttcgtgccctcgaccccttcttctttttcctcacggatgacaccgcttgccacttgaccgcgttgtatgtgtgcagttaggtcttccattctgtaggctgaaactggttcgtgatttgtattctcaagattagtaatgcaagggggtctgtgtcaaactctttcacattctagcaaatgattttctcttctgttggctgaaattgcttcctggtttgtacctcaatattgataatgcaatggagtctgtcaaattctattaacaaaaaaaaaaaaaaaaaaaaaaaaaaaaaaaagaaaaaaaaaaaagaaaaaaaaaaaaagaaaaaaaaaaagaaaaaaaaagaaaaaaaaaaaaaaagaaaagaaagaaagaagaatagagagagagatatagactacacgacacgacgacgac

SEQ ID NO: 5574 - DNA, 632 bp, Triticum aestivum
ttaaattcctagatctggctagcggagagcggaaggggaagccgacggcgaccgcgcccccgtgagatgggaatggaggagtcggcggggggtgccgcgaggcaggccaaggagtcgctggagctggcgttccagatgtcccagatcctggacaccggcctcgaccgccacaccctctcgctgctcatggcgctctgcgaccgcggcgccaacccggaggccctcgccgccctcgtccgcgagctctcctccgccgctccgccgtctgccgccgccaccgcacccgcctccaacaccacagcggccccggccaccccctcgttgttcccctccggctttcgccagctctaggctactagggttcgtgccctcgactccttctttttcctcccagatgacaccgcttgtcacttgatggcgttgtgtgtgtgcacgtaggccttccatgctgtatgctgaaactggttcctgatttgtattctcgagaatcgagattggtaatgcaaggggggtctgtgtcaaactctgtcacgctctagcaaatgattttctcttctgttggctgaaattgcttcctggtttgtatcctcaagattgataatgcaatggagtctgtgtcaaattctgttatc

SEQ ID NO: 5575 - DNA, 576 bp, Secale cereale
gttcgttagtaggcgtacactcgttaattacctagactccctaccggagagcggagggagggacggtgactgcgcccccgtgagatgggaatggaggagtcggcggggctgccacgaggcaggcgaaggagtcgctggagctggcgttccagatgtcccagatcctggacaccggcctcgaccgtcacaccctctcgctgctcatggcgctctgcgaccgtggcgccaacccggaggccctcgccgccctcgtccgtgagctctcctccgccgctcccccggctgccgcccccaccgcacctgcctccaacaccactgcggccccggccgccccctcgctgttcccctccggctttcgccagccctaggctagggttcgtgctctagacctcttcttctttttcctaccagatgacacaacttgtaacttgatcgcgttgtatgtgtgcatgtaggccttctatgctgtatgctgaaactggttcctgattttattctcaagattggtaatgcaagggggtctgtgccaaactctgtcacactctagcaaatgattttctcttctgttggctgaaa

SEQ ID NO: 5576 - DNA, 469 bp, Avena sativa
gccaatcgtgcacacgagcaaccggcgcacagcacacgcgaaccagagctgttactgccggccgccggcctaccagagaccggaaggggaagcgagatgggaacggatgcctcggccggagtagcggcgaggcaggccaaggagtcgctggagctggcgttccagatgtcccagatcctggacaccggcctggaccgccacaccctctcgctgctcatggcgctctgcgaccgcggcgccaacccggaggccctcgccgccctcgtccgcgagctctcctcctccgctcccccgacggccgcccccgcgccctcctccaacggcgcggcggcgcccacgccgaccccgacggccgcctcgctgttcccctccgccttccgccagccctagcttagggtttgtgtttccccccttcgttcccgattgagacatcttgtgactttgcgattgaatgtgtgcacttaggcct

SEQ ID NO: 5577 - DNA, 577 bp, Festuca arundinacea
ggcacgaggcctcgtgccccgccgtccggccgccacgacctcgacctcagttccatcatctagtcgtgcattcgaactgagatgggaacggagggggctgcggcgaggcaggcgaaggagtcgctggagctggcgttccagatgtcccagatcctcgacaccggcctcgaccgccacaccctctcgctgctcatggcgctctgcgaccgcagcgccaacccggaggccctcgccgccctcgtccgcgagctctcctccgccgctcccccgacggccacccccgcgtccaacggcgcggctccgcccgccccgaccccgacggccgcctcgctgttcccatccggcttccgccagccctagctagggtgttgtgactgtaggcaactgatgttcctgatttgaagtccgagcaaatctgatacttggcttgctggaggagtcgataaagctttagtccggtggatgtaaatcttgctttagacgtaggatgtgcttgtgatgttgttttcacagaaaagttgtggttcatcgagctcagttccatcagccaatcgtaagctgtaacattcaaactctt

SEQ ID NO: 5578 - DNA, 970 bp, Saccharum officinarum
aaaaatcccaaaccctaacatctctccatggacgacggcgacggcggactgagcttcgacttcgagggcggcctcgactccgtcccggcggccgggggcgggggccccgtgccgtcctccaccgaccctggcgcgggcggaggcggaggcggcgacgggctgggtatgcacgggcgcggccgaggtcgcgggagctaccgccagacggtgtgccggcactggcttcgcggcctctgcatgaagggcgaggcgtgcgggttcctgcaccagttcgacaaggcccgcatgcccgtctgccgcttcttccgcgacttcggcgagtgccgcgagcccgactgcgcgtacaagcactcgtacgacgacgtcaaggagtgcaacatgtacaagatggggttttgtcccaatggtcctaattgccggtacaagcatatcaagctacctgggccaccgccttctgttgaggaagttcttcagaagattttgcagatgcgctctttcaacagatatggtcagaatagaaataataattataatcagcagggggagagacctcaacatccacagggttctgggatgcctaaccaaaactcggcagaaaatgctactgctgcagctccaccagctggtggacaacaagcacaaacgctgaatcaacagccaccacagcagcagcagaagccaaatacaaatgaccaggcccaaggtgtttcaaatggccatcaggccacaagaatcgccacaccccttccacaaggaccatctaggtgtgtgtggagtttctagtcatgcttgtaaagcttttagaactgtgaaaactacgtatatagtttagttttggttgcaacagcgtatctcataaaactactatgttatatcatatgttttgacacttgttgataaattgtacttaatttcaaccttgtgtcttctgtaactgattgaaagaaaaagtttgtagttatttttgctc

SEQ ID NO: 5579 - DNA, 2422 bp, Sorghum bicolor
ttccccctctctcttttactcgaatcgaagaaaaaaatcccaaaccctaacatctccccatggacgacggcgacggcggactgagcttcgacttcgagggcggcctcgactccgtcccggcggccggtggcgggggccccgtgccgtcctccaccgaccctggcgcgggcggaggcggaggcggcgatgggccgggtatgcacgggcgcggccgaggtcgcgggagctaccgccagacggtgtgccggcactggcttcggggcctctgcatgaagggcgaggcgtgcgggttcctgcaccagttcgacaaggcccgcatgcccgtatgccgcttcttccgcgacttcggcgagtgccgcgagcccgactgcgcgtacaagcactcgtacgacgacgtcaaggagtgcaacatgtacaagatgggtttttgtcccaatggtcctaattgccggtacaagcatatcaagctacctgggccaccaccttctgttgaggaagttcttcagaagattttgcagatgcgttctttcaacagatacggtcagaatagaaataataattataatcagcagggggagagacctcagcatccacagggttctgggatgcctaaccaaaattcggcagaaaatgctactgctgcggctccaccagctggtggacaacaagcacaaacgatgaatcaacagccaccacagcagcagcagaagccaaatacaaatgaccaggcccaaggtgtttcaaatggtcaacaggccactagaatcgccacaccgcttccacaaggaccatctaggtacttcattgttaaaagttgcaatcgggagaatctggaaatatcagttcagcaaggaatttgggccacgcagaggagtaacgaggctaaactcaatgaagcttttgaatccaccgagaatgttattttgatattctcaattaatagaactcgcaatttccagggttgtgcaaagatgacttctaggatcggtggctacattggtggtggaaactggaaatctgctcatggaacagcgcattatggtcggaatttctctatgcagtggcttaagctttgtgagttgtcatttcagaaaacccatcatctccgcaatccatacaatgataacctccctgttaagatcagcagagattgccaggaactagaacctttcattggtgagcagttggcttctctgctttatctggagccagacagcgaacttacggctatgctaattgcagcagaggccaagcgagaggaggaaaaagcaaagggtgtcagtgctgacgaggcagctgataatcaagatattgtgctgtttgacgacaatgaagaggatgaggaagaggaaagcgaggaggaagaagaagccaatggccaagagtctcaagggaggggaagaggaagggggatgatgtggcctcctcaaatgccgatgatgcgtgggccaatgatggcagggcgtggcttccctcccaacatgatgggtgatggctttggtttcggcggcggtttcggcatgcctgatccttttggcatgccacgtggcttcccaccatttgttggcccaaggttccccggggactttgctagaggcccgatgcctgggatgggcttccctggtaggcctccgcagcctttccctctaggtcttgacatgatgatgggccctggccgtggtccactgatgggaggcatgggaatgggcgggcctggacggcctaatcgccccatgggtatggcgcccttcatgcccccgccacctccaaataaccgtgctgcgaagcgggagcagagaaggccagggggtgaccgtggcgacaggttcgaaacagtgtcatcagaccagggcaacaggggccatgataacactggaaactctggggcagatggagccagagcccagtctggagacaggtatggtagaagcgcccttcgggatgatgacagtgagagtgaagaggaggcggctcccaggcgatcaagaaaacgatagagcgatactgagtggctgagattcatgctgttactagatataattgaggtactggtgaaacaaagttgagatagacaaattgattctctcttattttgtaaactgagattagaactaagatagtgaagaatgtggattatgtgtaactgcatgctgtgggaagtgacattggtagttgaattttgctcatgcgggaaaggtgtaagcacattgtggcaaggctgaggttattctagtggtgcatcacagtatggctcatgagttagaaaactggtagaatagcgttggcatgaactatctgttcagttgtgccagttgttgcgtcgtgcttatcatcacaacaatgtacacaagacaacatgatgaggatggtttatggtcttacattatggggaaacatacatatcatcaaaatacgctcgccc

SEQ ID NO: 5580 - DNA, 1900 bp, Zea mays
atatacaaccctaggcacttagatcgattttccgagacaactaaaagactacatgatgcaaaccttatatagggaatcgtgtagagatatacccttcacgaagagtcatctcttgattttttcacttaacccagagattcttaattaataaagttgtacatgcttttagccatttagctcataaagtatgctagaatgagctaaaagtgatccaactgagcaaaagacatctcactctcctcaccccaaattaggatatggcaggtgctaaaatttagcacatccaaacactacatgtgaaaaaatggagtttgatttccactccaccacccccggaagaaaaaaactgtccaatcgaatcaaagagagaaaaaaaatcctaaaccctagcatctcccatggacgacagcgatggcggactgagcttcgatttcgagggcggcctcgactctgccccagcttctgggggcgggggccccgtgccgtcctccaccgaccccggcgcgggtgtcgggggaggcggcgacgggctgggtatgcacgggcgcggccgaggtcgcgggagctaccgccaaacggtgtgccggcactggcttcgcggcctctgcatgaagggcgaggcctgcggattcctgcaccagttcgacaaggcccgcatgcccgtctgccgcttcttccgcgacttcggcgagtgccgcgagcccgactgcgcgtacaagcactcgtacgacgacgtcaaggagtgcaacatgtacaagatgggtttttgtcccaatggtcctaattgccggtataagcatatcaagctccctgggccaccgccttctgttgaggaagttcttcagaagattttgcagatgcgctcttttaacagatacagtcagaatagaaataataattataatcatcaaggggagagacctcaacatccacaaggttctgggttgcctaaccaaaactcggcagaaaatgccactgccgtggatccaccagctggtggacaacaagcacaaacgctgaatcaacaaccaccacagcagcagcagaagccaaatacaaatgatcaggcccaaggtgtttcaaatggtcatcaagccactagaatcgccacaccccttccacaaggaccatctaggtacttcattgttaaaagttgcaatcgggagaatctggaaatatcagttcaacaaggaatttgggccacacagaggagtaatgaggctaaactcaatgaagcttttgaatccactgagaatgttattttgatattctcaattaatagaactcgcaatttccaggggtgtgcaaagatgacttctaggattggtggctacattggtggtggaaattggaaatctgctcatggaacagcgcattttggtcggaacttctctatgcagtggcttaagctttgtgagttgtcttgctgattatgtactcctgtttgtttatcaccactttaatcgtagcttgccgtttccagatgatgggatattagactttgagctgataactgataatcatagcttatgcgtatgaacgtgctttagataggcatggatattgatttctctttttgttcgattcctcacaatcacattactcctttaattgctcatgtgacattgtggcaaagacatggaaattcctaatgcaactaatgactgacaaattaacctattacccattacataagtcatgttgttgctgcctggcttgggcggggaagccgtgtgtaacaccccgtccaatccctggaccaacggtacttactcctgacagctctctaggatcatatatcgtccccacagaccaacacgagtcttttgtgcgcactttgtcctccctcatgcgcacccgggaaaacatcctggtcggtcacccatcctaaattgctcca

SEQ ID NO: 5581 - DNA, 2383 bp, Setaria italica
cagacctcctcggtctctctcctagtatcggagaaagatcccaaaccctaacatctctccatggacgacggcgacggcggcctgagcttcgacttcgagggcggcctcgactccgccccggcgggcggagccggcggtcccgtgccgtcctccaccgaccctggcgcgggcggcgggggaggcggcgacgggccgggcatgcacgggcgcggccgtggccgcgggagctaccgccagaccgtgtgccggcactggctgcgcggcctctgcatgaagggcgacgcgtgcgggttcctgcaccagtttgacaaggcccgcatgcccgtctgccgcttcttccgcgacttcggcgagtgccgcgagcccgactgcgcctacaagcactcgtacgacgacgtcaaggagtgcaatatgtacaagatggggttttgtcccaatggccctagttgccggtacaagcatgccaagctacctgggccaccgcctcctgttgaggaagttctacagaagattttgcagatgcgctctttcaacagatacggtcagaatagaaacaataactataatcagcagggtgagagacctcaacatccacagggttctgggttgcctaaccaaaactcagcagaaaatgctactgctacggctccaccaactggtggacaacaagcacaaattacgaatcaacagccaccacagcagcagcagaagccaaatacaaatgaccaggtccaaggtgcttcaaatggccatcaaactgctagaatcgcaacaccccttccgcaagggccatctaggtactttattgttaaaagttgcaatcgggagaatctggaaatatcagttcagcagggaatttgggctacccagaggagtaacgaggctaaacttaatgaagcttttgaatccactgagaatgttattttaatattctcaattaatagaactcgccatttccaggggtgtgcaaagatgacttctaggattggtggctacattggtggtggaaattggaaatctgctcatggaacagcacattatggtcgaaacttctctatgcagtggcttaagctttgtgaactgtcatttcagaaaactcaccatctccgcaatccatacaatgataatctccctgttaagatcagcagagattgccaggaactagaacctttcattggtgaacagttggcttcgctgctttatctggagccagacagcgaacttacggctatgctgattgcagcagaggctaagagagaagaggaaaaggcaaagggagtcagtgctgatgaggcagctgataatcaagatatcgtgctgtttgatgataacgaagaagaggaggaagaggaaagtgaggaggaagaagaaagcaacggccaagagtcacaagggaggggaagagggagggggatgatgtggccccctcaaatgccaatgatgcgtgggccaatgatgggagggcgtttccctcccaacatgatcggcgacggctttggtttcggcggtggcttcggcatgcctgatccgttcggcatgccgcgcggtttcccaccctttggtggcccaaggtttcccggtgactttcctagaggccctatgcccggtatggccttcccgggcaggcctccgcagcctttccctctgggccttgacatgatgatgggccccggccgtggcccgatgatgggaggcatgggaatgggcgggcctggacggcctaaccgtcccatgggtatggcacccttcatgcccccgccacctccgaacaaccgcgccgcgaagcgggagcagagaaggccgggcggcgacaggtttgagacggtgtcggaccagggcagcaggggccacgagaactctggagctgacggagccagatcgcagtccggcgacaggtacagtagaagcgccctccgggatgatgacagcgagagcgaagaggaagcggctcccaggcggtcaaggaaacggtagagaaatgctacgctgtgcgcctgggcctccatgctgttgcctgattatagagcgggctacctgtgcaacagagttgaggtcgtctaaaatagatattctctatcttttgttcctgctgggattagaactaaaatagtgaaagatgcagattgtgtgcaactgcatagtgctgtgtgggcagccatagcccatactggtagttgaattttgctctggcggcaaagacctaagctttattttggcaggttgagattgttctggcggtgtatcagagtatcagttagaaaattgtacaataacgacggcttaaattatctgtcgtattttttttttattctgtgctgttaccattgtaatgtacactacaacgacatgaggatgatctatacacatacaggatagggttcaa

SEQ ID NO: 5582 - DNA, 1170 bp, Panicum virgatum
aatcccaaaacaattttaatttactcttcctccacagtcgtcctctctccccctcgcctactatcggagaaagatcccaaaacctaatccctccatggaagacggcgacggcggcctgagcttcgacttcgagggcggcctcgactccgccccggcggtcgggggccccgtgccgtcctccgcggaccctggcgtgggcggcggcggaggcggcgatggtccgggcatgcacggccgcggccgcggccgcgggagctaccgccagacggtgtgccggcactggctgcgcgggctctgcatgaagggcgacgcgtgcgggttcctgcaccagttcgacaaggcccgcatgcccgtctgccgcttcttccgggacttcggcgagtgccgcgagcccgactgcgcctataagcactcttacgacgacgtcaaggagtgcaacatgtacaagatggggttttgtcccaatggccctaattgccggtacaaacatgtcaagctacctgggccaccgcctcctgttgaggaagttctacagaagattttgcagatgcgctctttcaacagatacggtccgaatagaaacaataactataatcagcagggtgagagacctcaacatccacagggttctgggttgcctaaccaaaatgcggcagaaaatgctactgctacggctccaccaactggtggacaacaagcaccaatggcgaatcaacagcctccacagcagcagcacaagccgaatacaaatgaccaggtccaaggtgcttcaaatggcaatcaaactactagaatcgcaacaccgcttccacaagggccatctaggtacttcattgttaaaagttgcaatcgagagaatctggaaatatcagttcagcagggaatttgggccactcagaggagtaatgaagctaaacttaatgaagcgtttgaatccactgagaatgttattttaatattctcaatcaatagaactcgccatttccaggggtgtgcaaagatgacttctagaattggtggctacattggtggcggaaattggaaatctgctcatggaacagcacattatggtcggaacttctctatgcagtggcttaagctctgtgaactatcatttcagaaaactcatcatctccgcaatccatacaatgataatctcccagttaaggt

SEQ ID NO: 5583 - DNA, 2716 bp, Saccharum officinarum
gcgcgcagcggtacctcacgtaccggccggaatcccgggtcgcaccacgcgtccgcaaaatcctcctctcctctctctctcctccggcctcctcgcgattgcagcgactacgcggcgagagacacagctgcccccgcaacgaaagaacggataagagagggcgaaattgacagaggggagacggaagaccaggagcggcgtcgagctaaaagcgccggcggcggccatggccaccgtggaccggacccggactttcatgaaggacgtcaaacgcgtcatcattaaggtgggcactgcagttgtcacgacgcatgatgggcgacttgctttgggtcggctaggggctctttgtgagcaggtgaaggagctgaacgccctaggatacgaggtgatcattgtgacctcaggtgctgttggtgtggggaagcagaggctcaagtacaggaagcttgtcaatagcagctttgctgatctgcaaaagccacagatggagctggatggaaaggcttgcgctgccgttggacagagtggcctcatggctctttacgatatgctatttactcaacttgatgtatcgtcttcccaacttcttgtgacagacagtgattttgagaatccaaacttccgggagaggctccgtgaaactgttgagtcactattagatcttaaagttgtaccaatatttaatgaaaatgatgccatcagcactagaaaggctccatatgaggattcatctggtatattttgggataatgacagtttagccggtcttctagctatagaacttaaagcagatctccttgttctactcagtgacgtggatggcctctacaatggtccaccaagtgaacctcaatcaaagataatacatacctacatcaaagagaaacatcacaatgagatcacttttggtgataagtcacgtgttggtagaggaggaatgacagctaaagtgaaggctgctttcgtggcttcaaacagtggcacgcctgttgttattacaagtggatttgcatctcagagcatccttagagttctccaaggagagaaaattggcactctctttcataaggacgcaagtctgtgggaaccatccaaagatgttagtgctcgtgagatggctgtctctgcaagagaatgttcaaggtgtttgcagaatttgtcatcggatgagcgcaagaaaatattgctagatgttgcagatgctttggaggagaatgaggatttgattaaaactgagaatgaagctgatgttgctgcagcacaagatgctggatatgaaaaatctttgattgctaggttgactttgaagccaggaaagatagcaagcctcgcaaaatccatccgcactcttgcacatatggaagacccaatcaaccagatactcaaaagaacagaggttgctgaagatttggttcttgagaaaacatcttgcccattaggggtgctattgatcgtttttgagtccaggcctgatgccttggtccagattgcatcgttagcaattcgaagtggcaacggtcttctcctgaaaggtggaaaagaagccatgagatcaaacacagtattgcataaggttataactggtgcaattcctagcaacgtgggtgaaaaacttattggacttgttacaagtagagatgaaatcgctgatttactaaagcttgatgatgtcattgatcttgtcattccaagaggcagcaataagctggtttcacaaatcaaggcatcaactaagatccctgtccttggtcatgctgatggtatttgtcatgtatacatcgacaaatcagctgacatgaatatggcaaaacgaatagtgatggatgctaaaattgattacccagcagcctgcaatgctatggagacattgcttgttcataaagatcttataaaggctccaggtcttgaggacctactgctatctctcaaaacagaaggagttactctttatggagggcctgttgcgcaggaactattgtgcattccaaaagcagattcattccatcatgaatatagctctatggcctgcacaattgagttcgttgatgatgtacaggcagcaattgaccatatacatcgctatggaagtggacatacagattgcattgttactacagatgataaagtagcagaaacttttctgcgccaagttgatagtgctgctgtattttataatgcgagcacacgattctctgatggggctcgttttggattgggtgctgaggttggcataagcacagggcgcatacatgctcgcgggcccgtgggtgttgaaggtctcttaactacacgctggatcatgcgagggagtgggcaagtggtgaacggtgacaaggatattgcatacacccataagaaccttcctttgcaatgaggcaggttgtttttgtgcttaatcaggattcgtgtcgttccagtgatggttgatagtttcatcatcagataggagcagagaatggtgaatcttttcgattgaggactgtgaatccatggactgcaatgttcagtcattgtgtagaccatcattctggtggttcattctgtatgagcttggaggcaccccacctccccaataaagcagtgctgggagtaatagagcactaatgtaccgaggttgtgtctagttaaacaagagaaaccggttatattgttatatttattttatattttatttggtgcgattgaacccatgtcaaaaaaaaaaaaaaaaaaa

SEQ ID NO: 5584 - DNA, 2690 bp, Zea mays
atcctgactgaggtaggttgttgccatttttgttccctcacccagtccgtctcaccacttcaaaaaccctctcctctctcatccgccttcctggcgattgcggcgacgaggtgacgatagagctgcccccgcaaggaaaacggacaagagaggcggaggctgatagggagaggagacggaggaccaagagcggcgtcgatctaaaagcgttggcggcggccatggccaccgcggaccggacccggactttcatgaaggacgtcaaacgcgtcatcatcaaggtgggcactgcagtcgtcacgaggggtgatgatgggcgactggctgtgggccggttggggtgtctttgtgagcaggtaaaagagctgaatgtcttaggatacgaggtgatccttgtgacctcaggtgctgttggtgtggggaagcagaggctcaagtacaggaagcttgtcaatagcagctttgctgatctgcaaaagccacagatggagctggatggaaaggcttgcgctgctgttggtcagagtggcctcatggctctttatgatatgctatttacccaacttgatgtgtcctcctcgcaacttcttgtgacagatagtgattttgagaatccaaactttcgggagaggctctgtgaaactgttgagtcactattagaccttaaagttgtaccaatatttaatgaaaatgatgccatcagcactagaaaggctccatatgaggattcatctggtatattctgggataatgacagtttagctggtcttttggctattgaacttaaagcagatctccttgttctactaagtgatgtagatggtctatacagcggtccaccaagcgaaccgggatcaaagatcattcatacctacattaaagataaacattacagtggaataacttttggggataagtcacgtgtaggtagaggaggaatgacagctaaagtgaaggctgcttttgtggcttcgaacagtggcacacctgttgttattacaagtggatttgcatctcagagcattgttagagttctccaaggagagaagattggtactctcttccataaggatgcaagtctgtgggagccatccaaggatgttagtgctcgtgagatggctgttgctgcaagagaatgttcaaggcgtctgcagaatttatcatcggatgaacgcaagaaaatattgttagacattgcagatgctttggaacaaaatgaggatctaattagaactgaaaatgaagctgatgtatctgcagcacaagatgctggatatcagaaatctttggttgatagattgacattgaagccagaaaagatagcaagccttgcgaaatccatacgcactcttgcaaatatggaagacccaatcaaccagatactcaaaagaacagaggttgctgaagacttagtgctcgaaaaaacatcttgccctctgggtgtgctgttgattgtttttgagtccaggcctgatgccttagtccagattgcgtctttagcagttcgaagtggcaatggtcttctcctgaaaggtggaaaagaagccatgagatcgaacacagtattacataaggttataactggcgcaattcctgacaacgtgggtcaaaaacttattggccttgttacaagtagagatgaaatcgctgatttactaaagcttgatgatgtcattgatcttgtcattccaagaggcagcaataagctggtttcgcaaatcaaagcatcaactaagatacctgtcctcggtcatgcggatggtatttgtcatgtatacattgacaaatcagctgacatgaatatggcaaaacgaatagtgatggatgccaaaactgattacccagcagcctgcaatgctatggagacattgcttgttcataaagaccttataaaggctccaggtcttgatgatatactcctatcactcaaaacagaaggagttgctatttatggagggcctgttgcacatgaagtactgtgtattccgaaagcagattcattccatcatgaatatagctctatggcctgcacaattgagttcgttgatgatgtacagtcagcaattaaccatatacatcgttatggaagtgcacatacagattgcattatcaccacagatgataaagtagcagaaacttttctgcgtcaagttgatagtgctgctgtatttcataatgcgagtacacgattctctgatggggctcgttttggattgggtgccgaggttggcataagcacagggcgtatacatgctcgcgggcctgtgggtgttgaaggtctcttaacaacacgctggatcatgcgaggaagtgggcaagtggtgaatggtgacaagaatgttgcatacacccataagaaccttcccttacaatgaggctgtttttgtgcttgatcaggattcgtgtctatccagtgatgtttgatagtttcatcaggcaggagcatagaatggtgaatcttttcgattgaggactgtgaatccatggatgttcagtcattgtttgtgtagacattgtggtgagcttggaggccaccccacctccccaataaagcagtgctgggagtaatagagcactgatgtactgagggtgcctaggttatatttgttttgcggtcgaacacaaacaatttttgttggtgacttgtttcttatgattctacatatttcaaggtttatgtgctgtcctaa

SEQ ID NO: 5585 - DNA, 2877 bp, Pennisetum glaucum
cttcacctgctctgtgcgagcaggttggctgaggaaccgtgcgcccccgtcactgctcctccatcagcctaatcaaatagataaagtatcgtaggtggcggcgccgtaaggatctcgcattctcgctggtgcctggcggaggatttctgcgctcctcacccatcccaccaccacttaaaaaccgctcctctctgtcctccgcactcctcgcgattgcggcgaagaggcggcgagagagcccccaccgaaaaaagctggataagaggggaagaagttgacagagaggggagacggaggacccagaagcggcatcgagctagaagcgccgccgccggtcatggcgaccgcggaccggacccggagcttcatgaaggacgtcaaacgcgtcattatcaaggtgggcacagcagttgtcaccagacacgatgggcgattggctttgggtaggcttggagctctgtgcgagcaggtgaaggaactgaacactcttggatatgaggtgatcatggtcacctcaggtgctgttggtgtgggaaggcagaggctcaagtaccggaagcttgtcaatagcagctttgcagatctgcaaaagccacagatggagctggatggcaaggcttgtgctgctgttggtcagagtggtctcatggctctttacgacatgttatttacacaacttgatgtgtcatcttctcaacttcttgtgacagacagtgattttgagaatccaaacttccgggagaggctctgtgagactgttgagtcacttttagatcttaaagttgtgcctttatttaatgaaaatgatgctataagcactagaaaggctccgtatgaggattcatctggtatattttgggataatgacagtttagccggtctgttagcaattgaactcaaagctgatcttcttgttctactaagtgatgtggatggcctctacagcggtccaccaagtgaacctcagtcaaagctcatacacacctacattaaggaaaaacatcacaatgaaatcacatttggggacaagtcacgtgtaggtagaggaggaatgactgctaaggtgaaggctgcttttgtggcttcaaatagtggcacacctgttgttattacaagtggatttgcatctcagagcatccttagagttcttcaaggagagaaaattggtactctctttcacaaggacgcaaatttgtgggaaccatcgaaggatgttagtgctcgtgaaatggctgttgctgcaagagaatgttctagacgtctacagaatttgtcatccgatgagcgcaagaaaatattgttagatgttgctgatgctctagaggcaaaggaggatttaattagagctgagaatgaagcagatgtaattgcagcacagtatgctggttatgagaaatctttggttgctagattgaccctgaagccaggaaagatagcaagcctcgcaaaatcgatccgcactcttgcaaacatggaagaccctatcaaccaaatactcaaacgaacagaggttgctgaagatttagttctggagaaaacatcttgccctttgggtgtgctcttgattgttttcgagtctcggcctgatgccttggtccagattgcatccttagcgattcgaagtggtaatggccttctcctaaaaggtggaaaagaggctatgagatcaaacacaatactgcataaggttataactgatgtccttcctgacactgttggtaaaagacttattggtcttgttacaagtagagatgagattgctgacttgctaaagcttgacgatgttattgatcttgtaattccaagaggtagcaatcagctggtttcacaaattaaggcatcaactaagattccagttcttggccatgcagatggtgtctgtcatgtatacattgacaaatcagctaacatggatatagcaaaacgaattgttattgatgccaaaattgattacccagcagcctgcaatgcaatggaaacattacttgttcataaagatcttataaagtcaccaggacttgatgacatactgctatcactcaaaacagaaggagttgctatttatggagggcctgttgcgcatgaactactgtccattccaaaagcagattctttccatcatgagtatagctctatggcttgtacaattgaatttgttgatgatgtacaatcagcaattgaccatatacatcgttatggaagtgcacatacagattgcattgtcactacagatagtaaagtagcagaaacttttctgcgacaagttgatagtgctgctgtgtttcataatgcaagtacacgattctctgatggggctcgctttggattgggtgctgaggttggcataagcacagggcgcatacatgctcgtggacctgtgggtgttgaaggtctcttgacaacacgctggatcatgcgtggaagtgggcaagtggtgaatggtgacaaggatgttacctacacccacaagaaccttcctttgcaatgagggttcttgtgagattgatcaaggattcaatgcttatccagtgaagtctggtagtttcatcagacaagtagaaatggagaatttggagatcaaggatcggaatccatatgctgcattattcagtattgtgcaaaaacaccttattgcagcgtttcggtaggtcattctgtaggagagtggaggccttggcctccccaaagtcacaataaataaagcagtgctgagagtaagagggtgcacactattgttaccgaagctatgcgtaggtttgaaaccagagaaaccgattgcattgttttgtttattttggtctgatagaaccatgaaccatataatatcgtaatttttgtgaaacaaaaaaaaaaaaaaaaagtaaaactctagacgtt

SEQ ID NO: 5586 - DNA, 3058 bp, Panicum virgatum
cggatacgtgcgtcccccgagacctctcggatcagacgggcggaccacgttagcggaggagccgtgcggcctcctcctccgtcgattcccccgggacccctaatcggatagatagataaatgctcgtagcgcggcggcggcgcagcccgcggcaggttgttgcgctggtgcgatttctgcgccctcacccctcccaccgccacttcgaaatccactcctctctctcctccgccgtcctcgcgattgcggcgacgaggcggcgagagagcgcccgcccccaccgaaaaatactggataggtgacggggaggggagacggaggaccaggggcggcgtcgagctagaagcgccgccgccggccatggcgaccgcggaccggacccggagcttcatgaaggacgtgaaacgcgtcatcatcaaggtgggcactgcagttgtcaccagacacgatgggcgactggctttgggcaggcttggatctctgtgcgagcaggtgaaagaactgaacacacttgaatatgaggtgatcatggtcacctccggtgctgtcggtgtggggaggcagaggctcaagtaccggaaacttgtcaatagcagctttgctgatctgcaaaagccgcagatggagctcgatggaaaggcttgtgctgctgttggtcagagtggcctcatggctctttacgacatgttatttaaccaacttgatgtgtcctcttctcaactgcttgtgacagacagtgattttgagaatccaaacttccgggagaggctccgtgagactgttgagtcactgttagacctcaaagttgtaccagtatttaatgaaaatgatgctatcagcactagaaaggctccatacgaggattcctctggtatattttgggataatgacagtttagcaggtctgctagcaattgaactcaaagctgatcttcttgttctactaagtgatgtggatggcctctacagtggtccaccaagtgaacctcaatcaaagatcatacatacctacattaaggagaaacatcacagtgaaattacatttggggacaagtcgcgtgtgggtagaggaggaatgactgctaaagtgaaggctgcttttgtggcttcaaacagtggcacgcccgttgttattacaagtggatttgcatctcagagcatccttagagttcttcaaggagagaaaattggtactctctttcataaggatgcaagtttgtgggaaccatccaaggatgttagtgctcgtgagatggctgtcgctgcaagggaatgttccaggcgcctacagaatttgtcatcagatgagcgcaagaaaatattgttagatgttgccgatgctctagaggcaaatgaggatttaattagagctgagaatgaagcagatgtacttgcagcacaagatgctggatatgagaaatctttggttgctagattgaccctgaagccaggaaagatagcaagccttgcaaaatccatccgcactcttgcacatatggaagaccctatcaaccaaatactcaaacgaacagaggttgctgaaaatttagttctggagaaaacgtcttgccctttgggtgtgctcttgatagttttcgagtcacggccagatgccttggtccagattgcatctttagcaattcgaagtggtaatggccttctccttaaaggtggaaaagaagccatgagatcaaacacaatactgcataaggttataactgatgcccttcctggcagtgttggtaaaagacttattggccttgttacaagtagagatgagattgctgacttgctaaagcttgatgatgtcattgatcttgtaattccaagaggtagcaataagctggtttctcaaatcaaggcatcaactaagatccctgttcttggccatgcagatggtgtctgtcatgtatacattgacaaatcagctgacatggatatagcaaaacgaattgtgatggatgccaaaattgattacccagcagcctgcaatgccatggaaacattacttgttcataaagatcttataaagtccccaggtcttgatgacatactgatatcactcaaaacagaaggagtttctatttatggagggcctgttgcgcacgaagtattgtccattccaaaagcagattcattccatcacgaatatagctctatggcctgcacagttgaatttgttgatgatgtacaatcagcaattgaccatatacatcgttatggaagtgcacatacagattgcattgtgactacagatagcaaagtagcagaaacttttctgcgtcaagttgatagtgctgctgtgtttcataatgcaagtacacgattctctgatggggctcgctttggattgggtgctgaggttggcataagcacagggcgcatacatgctcgtggaccagtgggtgttgaaggtctcttaacaacacgttggatcatgcgtgggagtgggcaagtggtgaatggtgacaaggatgttgcatacacccataagaaccttcctttgcaatgatgcaagtaatgattactttccctataaatctgttgcaagtcatattgcagactattaaatgatagggggtagaaatcaactttcctatgcaattatgtaggttgtgtttgagcctgatcgatgattcagtgcttatccagtgaagtctgatagtttcatcagacaacaagcaggaaatggtgaatcttttggagattgaggacggtgaatccataagactgtattattcggtcattctgccaaaaaagaaacatcttattgcggcgtttcaataggtcattctgtatgagagtggaggccccagcctccccagtgttacaataaaataaaattgtgctgagagtaagagagggagcactattgtaccgaagctatgtgttggttgaaacaaagaaactgattgcatttttttgtttagtttattttggtctaatcgaaccatgataatatcgtgttcacttagttgcttgctagtatcgagttgctcttgttacatgatcgtaggcatccatcctttatctcatgacattgtccttcagagttgtta

SEQ ID NO: 5587 - DNA, 2685 bp, Echinochloa colona
cctcctccgccctcctcgcgattgcggcgacaaggcggcgagagagagctctctccctccccggataagagggggagaagttgacagagaggagagacggaggaccaggagcggcgtcgagctagaagcgccgccgccggccatggcgaccgcggaccgtacccggagcttcatgaaagaggtgaaacgcgtcatcatcaaggtgggcactgcagttgtcaccagacatgatgggcgattagctttgggcagacttggagctctgtgcgagcaggtgaaggaactgaacactcttggatacgaggtgattatggtcacctcaggtgctgtcggtgttgggagacagaggctcaagtaccggaagcttgtcaatagcagctttgctgatctgcaaaagccacaaatggagctggatggaaaggcttgtgctgctgttggtcagagtggcctcatggctctttacgatatgttatttacccaacttgatgtgtcctcttcgcaacttctagtgacagatagtgattttgagaatccaaacttccgggagagactccgcgaaactgttgaatcactgctagatctaaaagttgtaccagtgtttaatgaaaatgatgctatcagcactcgaaaggctccatatgaggattcatctggtatcttttgggataatgacagtttagcaggtctgctagcaattgaacttaaagccgatcttcttgttctactaagtgacgtggatggcctctacagtggtccaccgagtgaacctcaatcaaagataatacatacctacattaaggagaaacatcacaatgaaattacatttggagacaagtcgcgtgtaggtagaggaggaatgacagctaaagtgaaagccgcttttgtggcttcaaacagtggcacacctgttgttattacaagtggatttgcatctcagagtattgttagagttctccaaggagagaaaattggtactctctttcataaggatgcaagtttgtgggaaccatccaaggatgttagtgctcgtgagatggctgttgctgcaagagaatgttctaggcgtctacagaatttgtcatcagatgagcgcaagaaaatattgttggatgttgcagatgctctagaggcaaatgaggaattaattagaactgagaatgaagcagatattgtcacagcacaagacgctggatatgagaaatctttggttgctagattgaccctgaagccaggaaagatagcaagccttgcaaaatccatccgcactcttgcgaatatggaagaccctatcaaccagatactcaaaagaacagaggttgccgaaaatttagttctggagaaaacatcttgccctttgggtgtgctcttgattgtttttgagtcccgccctgatgccctggtccagattgcatcgttagcaattcgaagtggtaacggccttctcctaaaaggtggaaaagaggccatgagatcaaacgcaatactgcataaggttataactgatgcccttcctgacaatgttggtaaaagacttattggccttgttacatctagagatgagatcgctgatttactaaagcttgatgatgttattgatcttgtcatcccaagaggtagcaataagctggtttcacaaatcaaggcatcaactaagatccctgttcttggccatgcagatggtgtctgtcatgtatacattgacaaatcagctaacatggaaatagcaaaacgaattgtgatggatgccaaaattgattatccagcagcctgcaatgcaatggaaacattacttgttcataaagatcttataaagtccccaggttttgatgacatactgctatccctaaaaacagaaggagtttctatttatggagggcctgttgcacatgaagtgttgtccattccaaaagcagattcattccatcatgagtatagctctatggcctgcacagttgaatttgttgatgatgtacaatcagcaattgaccatatacatcgttacggaagtgcacatacagattgcattgtcaccacagatagtaaagtggcagaaacttttctgcatcaggttgatagtgctgctgtctttcacaatgcaagtacaagattctctgatggggctcgctttggattgggtgcagaggttggcataagcacaggacgcattcacgctcgtggaccagtgggtgttgaaggtctcttaacaactcgttggatcatgcgtgggagtgggcaagtggtgaatggtgacaaggatgttgcgtacacccataagaaccttgctttgcaatgaggttggttctgagcttgataaggattcagtgtttatccagtggagtctgatggtttcatcagacaacaagcagagaatggtgaatccagtggagtctgatggttcatcagacgacaagcagaaaatggtgaatcttctggaccttgaggacggtggatcaatagactgcattggtcattgttgtgcaaaagaacattattgcggcgtttcggtaggttattctgtatgaaatttgagagtggaggctccggcctccccattgttaaaataaagtaacctcgtctaggagtagagaaagcgcactattgtaccgaagctatgcatagattgaaaccatagaaccggcattgttaattggtttgttttggtctgatggaaccatacaatgtggt

SEQ ID NO: 5588 - DNA, 2641 bp, Avena sativa
tcccaccctcccacacatcgcggctgcggcgacgaggcggcgagggggcgtggaaaaccacagcggataagtgacagggagaggcggcgactctccgcccgcggccatggcgcgcgccgaccccaaccggaacttcatgaaggacgtgaagcgcatcatcatcaaggtgggcactgctgttatcactagaaatgatgggagattggctttgggcaggatcggagccctgtgtgagcaggtgaaagatcttaacgctcaaggatacgaggtgattatggtcacctcaggggctgttggtgtggggcgacagcgactcaggtaccggaagcttgtcaatagcagcttcgctgatctgcaaaagccacagaatgagctggatggaaaggcttgcgctgccgttggtcagagtgggctgatggcactctacgatatgttgtttacacaacttgatgtatcctcgtcccagcttcttgtgacagacagtgattttgagaattcaaacttccgggagcgactccgtgaaactgtcgaatcactattagaacttagagttattccaatatttaatgaaaatgatgccatcagtacgagaaaggctccatatgaggattcatccggtatattctgggataatgacagtttggcaggtctattggcattggaactgaaagctgatctccttcttctactcagtgatgttgatggtctctacagtggtccaccaagtgaacctgcatcaaagataatacatacttatatcaaagaaaaacattatcacgaaattacttttggagacaaatctcgtgttggtagaggtggcatgacagctaaagtccaagctgctgtctgggcttcaacgggtggtgtacctgttgttattacaagtggatgcgcatctcagagcattgttaaagtcctccaaggggaaaaaattggtactctttttcataagaatgcaagtttatgggaaccatccatggatgctagtgtccgtgaaatggctgtttctgcaagagactgttcgaggcgtctacagaatttgtcatcagaggagcgcaagaaaatattattagatgttgcagatgctttagaggcaaatgaggatttaattaagtctgagaacgaagctgatgtagctgtggcacatgaggctgggtatgagagttctttgattgctagattgactctgaaacaaggaaagatagcaagccttgccaaatctgttcgcactcttgcgaatatggaagaccctattaacgagatactgaaacgaacagaggttgctgatggtttagttctcgagaaaacatcttgtcctctgggtgttctcttgattgtttttgagtcccgacctgatgccttggtccagattgcgtctttagccattcgtagtggtaatggtcttcttctgaaaggtggaaaggaagcgatgagatccaatgcaattttgcataaggtaataaccaatgctattcctgacaatgttggtgaaaaacttattggccttgttacaactagagatgaaattgcagatttgctgaagcttgatgatgtcattgatcttgtcattccaagaggcagtaataagctggttgctcaaatcaaggcaacgactaagattcctgttcttggccatgctgatggtgtttgtcatgtatatattgacaaatcagcagacatggatatggcaaaacgtattgtgatggatgcaaaaattgattacccagctgcctgcaatgcaatggagacattacttgttcataaagatcttgccaaaacttcagaacttaatgacatactggtagcactcaaaacagaaggagttaacatttatggcgggcctgttgcgcataaaatattggggtaccccaaagcggattcgttacatctggagtacagttctatggcttgcacagttgagtttgttgatgatgtacagtcagcaattgaccatatacatcgctatggaagtgcacatacagattgtgtggttactacagatgataaagtagcagagacctttctacgacaagttgatagtgctgccgtagtatacaatgcaagtacaagattctccgacggggctcgttttggactgggtgctgaggttggcataagtacagggcgtatacatgcacgtggacctgtgggtgttgaaggtctcttaactacacgatggcttttacgagggaaagggcaagtggtgaatggtgacaaggatgtcgcctacactcataagacccttcctttgcactgactttgcaacgaggtcgtcttggtcaggattcagtgaaaaccttgtgaagtctgaaagtttaggcagactacaatgaaagaaaaagggtgaatcttgtgaagattgaggggcggtgaatcaattaatttgtgtacaaactatcttattgtggcggtttggtagatcagtttgtatgagtttggaggctccggctctccagtgttgtaataaaagagctgcagcaatgctaggagcaagagattactaatgtatcgacactataagcagtatgttgcttgggactagtgatccatcagcatccgtgattgctctgtacactgtaatagttgtttttacacttccttctgtcatggtggctagggcaacttaatctggagctgccgt

SEQ ID NO: 5589 - DNA, 2607 bp, Secale cereale
agaggcggcgcgccgagccagccagccagcccaccccgcccgcggccatggccggcgccgaccccaaccggagcttcatgaaggacgtgaagcgcatcatcatcaaggtgggcactgcagttatcaccagaaatgatggaagactggctctgggcaggattggagccctgtgcgagcaggtcaaggatcttaatgctcaaggatatgaggtgattatggtcacctcgggcgctgttggtgttgggcgacagcggctcaggtaccggaagcttgtcaatagcagctttgctgatctgcagaagccacagatggagctggatgggaaggcctgcgctgctgttggtcagagtgggctgatggcactctatgacatgttgtttacccaacttgatgtctcatcatcacaacttcttgtgacagatagtgacttcgacaattcaaatttccgggagcgactccgtgaaactgtcgagtcgttattagagcttagagttattccaatatttaatgaaaatgatgccatcagtaccaggaaggctccatatgaggattcatctggtatattctgggataatgacagtttggcagggctactggcattggaactgaaagctgacctccttgttctacttagtgatgtggatggcctctacagcggtccaccaagtgaaccttcatcaaagttaatacatacttatatcaaagaaaagcattatcatgaaattacttttggagataagtcccgtgttggtagaggtggcatgacagcgaaagtccaggctgctgtctgggcttcaacgggtggtgtacctgttgttattacaagtggatgtgcatctcagagccttgttaaagttctccgtggggaaaaaattggtactctttttcataaaaatgcaagttcttgggaaccatccaaggacgctagtgtccgtgaaatggctgttgctgcacgagattgttcaaggcgtctacagaatttgtcatcagaggagcgcaagaaaatattattagatgttgcggatgctttggaggcaaatgaggatttaattagatccgagaatgaagcagatgtagcagcagcacatgaggctgggtatgagagtgctttggttgctagattgactctgaaaccaggaaagatagcaagccttgccaaatctgtccgcactcttgcgaatatggaagaccctattaacgagatactaaaaagaacagaggttgctgatggtttagttcttgaaaaaacatcttgccctttgggtgttctattaattatttttgagtctcgacctgatgccttggtccagattgcatctttagccattcgaagtggtaacggtcttctcctaaaaggtggaaaagaagcaatgagatcaaatgcaatattgcataaggttataaccaatgctattcctgacaatgttggtgaaaaattgattggccttattacaactagagatgaaattgcagatttgctaaagcttgatgatgtcattgatcttgtcattccaagagggagtaataagcttgttgctcaaatcaaatcatcaacaaagattcctgttcttggccatgctgatggtgtttgtcatgtatatattgacaaatcagcagacatggatatggcaaaacgtattgtgatggatgcaaaaattgattacccagcggcctgcaacgcaatggagacgttgcttgttcataaagatattgtgaagactccagaacttaatggcatactgctagccctcaaaaccgcaggagttaatctttattgcggccctgttgcgcataaagtattgggctacccgaaagcagattcattacatctggagtacagttctttggcctgcacagttgagatagttgatgatgtacaatcagcaattgaccatatacatcgctatggaagtgcacatacagattgtgtggtcactacagatgataaagtagcagagacctttctacgtcaagttgatagtgctgccgtattatacaatgcgagtacaagattctccgacggggctcgttttggactgggtgctgaggttggcataagtacaggccgtatacatgcacgcggacctgtgggtgtggaaggtcttttaactacacgatggctcttacgagggaaagggcagattgtgaatggtgacaaggatgttgcgtacacccataagagtcttcctttgcaatgagaaaatggtgtggtaaggattcggcgaaaaccctctgaagtatgatagtctcatcagaccaaggaaagaaaaccggtgaatcttatgaagattgagggacggtggatcaattaatttgtgtacaaaccatcttattgtggcggttgggtcgatcggtttgtatgagctttggaggcttgggctctccagtgttataataaaaaaaacccagcaattctaggtgtgagagagtactaatgtgccgatacaataagcagcatgtttcgtgggaccggcaatccagcagcatctgcaattgctcggtacagtgtaacggttgtttttacacctcatctatcatggtggccagggttaatctggagctgccgtttgtgttgtttttcttctattgaagttatgagctcatgca

SEQ ID NO: 5590 - DNA, 2741 bp, Triticum aestivum
cgcccctcgccctttaaaaccgctcggctctatccctcccttttctgacctccccacacatcgcggctgcggcgacgaggaaaatacactgcagataagagagagggaggggcgagcgagcgagacagggagaggcggcgcgccgagccagccagcccacaccgcccgcggccatggccggcgccgaccccaaccggagcttcatgaaggacgtgaagcgcatcatcatcaaggtgggcactgcagttatcaccagaaatgatggaagactggctttgggcaggattggagccctgtgcgagcaggtcaaggatcttaatgctcaaggatatgaggtgattatggtcacctcgggcgctgttggtgtggggcgacagcggctcaggtaccggaagcttgtcaatagcagctttgctgatctgcaaaagccacagatggagctggatggaaaggcgtgcgctgctgttggtcagagtgggctgatggcactctatgacatgttgtttacccaacttgatgtgtcatcatcacaacttctcgtgacagatagtgacttcgacaattcaaatttccgggagcgactccgcgaaactgtcgagtcattattagagcttagagttattccaatatttaatgaaaatgatgccatcagtacgaggaaggctccatacgaggattcatctggtatattctgggataatgacagtttggcaggtctactggcattggaactgaaagctgatctccttgttctgcttagtgatgtggatggcctctacagcggtccaccaagtgaaccttcatcaaagttaatacatacttatatcaaggaaaaacattatcatgaaattacttttggagacaagtcccgtgttggtagaggtggcatgacagctaaagtccaagctgctgtgtgggcttcaacgggtggtgtacctgttgttattacaagtggatgtgcatctcagagccttgttaaagttctccgtggggaaaaaattggtactctttttcataaaaatgcaagtttgtgggaaccatccaaggacaccagtgtccgtgaaatggctgttgctgcacgggattgttcaaggcgtctacagaatttgtcatcagaggagcgcaagaaaatattgttagatgttgcggatgctttagaggcaaatgaggatttaattagatccgagaatgaagcagatttagcagcagcacatgaggctgggtatgagagtgctttggtttctagattgactctgaaaccaggaaagatagcaagccttgccaaatctgttcgcactcttgcgaatatggaagaccctattaacgagatactgaaaaggacagaggttgctgatggtttagttcttgagaaaacatcttgccctttgggtgttctattgattatttttgagtcccgacctgatgccttagtccagattgcgtctttagccattcgaagtggtaatggtcttctcctaaaaggtggaaaagaagcaatgagatcaaacgcaatattgcataaggttataaccaatgctattcctgacaatgttggcgaaaaattgattggccttattacaactagagatgaaattgcggatttgctaaagcatgatgatgtcattgatcttgtcattccaagagggagtaataagcttgttgctcaaatcaaatcatcaacaaagattcctgttcttggccatgctgatggtgtttgtcatgtatatattgacaaatcagcagacatggatatggcaaaacgtattgtgatggatgcaaaaattgattacccagctgcctgcaacgcaatggagacgttgcttgttcataaagatcttatgaagactccagaacttaatgacatactagtagcactcaagacagcaggagttaatctttattgcgggcctgttgcgcataaagtattgggctacccgaaagcagattcattacatctggagtacagttctatggcttgcacagttgagatagttgatgatgtacaatcagcaattgaccatatacatcgctatggaagtgcacatacagactgtgtggtcactacagatgataaagtagcagagacctttctacgtcaagttgatagtgctgccgtattatacaacgcgagtacaagattctctgatggtgctcgttttggactcggtgctgaggttggcataagtacaggccgtatacatgcacgtggacctgtgggtgttgaaggtcttttaactacacgatggctcttacgagggaaagggcaagtggtgaatggtgacaaggatgttgaatacacccataagagtcttcctttgcaatgagaaaatggtgtggtaaggattccgcgaaaaccctctgaagtatgagagtctcatcagactaaggaaagaaaaccagtcgatcaattaatttgtgtacaaaccatcttattgtggtggatcggtggatcaatttgtatgagcttggaggcttcggctctccggtgttataataaaaacaaaccagcaattctaggagtgagagtactagtgtgccgatactataagcagtatgtttgttggtcccggtaatccagcagattggtcgttcttgctattaaagttgtgcattgaggccacctcggacgtgccatacttcactcgtactcccggcctggttacattgactagaaatgtcagttcaaatagaacatggcttaggctaaatcaaattaagcagacatacataaatcttggccc

SEQ ID NO: 5591 - DNA, 2662 bp, Triticum aestivum
cagggagaggcggcgcgccgagcaggccagcccacaccccgcccgcggccatggccggcgccgacctcaaccggagcttcattaaggacgtgaagcgcatcatcatcaaggtgggcactgcagttatcaccagaaatgatggaagactggctttgggcaggattggagccctgtgcgagcaggtgaaggatcttaatgctcaaggatatgaggtgattatggtcacctcaggcgctgttggtgtggggcgacagcggctcaggtaccggaagcttgtcaatagcagctttgctgatctgcaaaagccgcagatggagctggatgggaaggcatgcgctgctgttggtcagagtggtctgatggcactctatgacatgttgtttacccaacttgatgtgtcatcatcacaacttcttgtgacagatagtgacttcgacaattcaaatttccgggagcgactccgcgaaactgtcgagtcattattagagcttagagttattccaatatttaatgaaaatgatgccatcagtacgaggaaggctccatacgaggattcatctggtatattctgggataatgacagtttggcaggtctactggcattggaactgaaagctgatctccttgttctgcttagtgatgtggatggcctctacagcggtccaccaagtgaaccttcatcaaagttaatacatacttatatcaaggaaaaacattatcatgaaattacttttggagacaagtcccgtgttggtagaggtggcatgacagctaaagtccaagctgctgtgtgggcttcaacgggtggtgtacctgttgttattacaagtggatgtgcatctcagagccttgttaaagttctccgtggggaaaaaattggtactctttttcataaaaatgcaagtttgtgggaaccatccaaggacaccagtgtccgtgaaatggctgttgctgcacgggattgttcaaggcgtctacagaatttgtcatcagaggagcgcaagaaaatattattagatgttgcggatgctttagaggcaaatgaggatttaattagatccgagaatgaagcagatttagcagcagcacatgaggctgggtatgagagtgctttggtttctagattgactctgaaaccaggaaagatagcaagccttgccaaatctgttcgcactcttgcgaatatggaagaccctattaacgagatactgaaaaggacagaggttgctgatggtttagttcttgagaaaacatcttgccctttgggtgttctattgattatttttgagtcccgacctgatgccttagtccagattgcgtctttagccattcgaagtggtaatggtcttctcctaaaaggtggaaaagaagcaatgagatcaaacgcaatattgcataaggttataaccaatgctattcctgacaatgttggcgaaaaattgattggccttattacaactagagatgaaattgcggatttgctaaagcatgatgatgtcattgatcttgtcattccaagagggagtaataagcttgttgctcaaatcaaatcatcaacaaagattcctgttcttggccatgctgatggtgtttgtcatgtatatattgacaaatcagcagacatggatatggcaaaacgtattgtgatggatgcaaaaattgattacccagctgcctgcaacgcaatggagacgttgcttgttcataaagatcttatgaagactccagaactcaatgacatactagtagcactcaagacagcaggagttaatctttattgtgggcctgttgcgcataaagtattgggctacccaaaagcagattcattacatctggagtacagttctatggcttgcacagttgagatagttgatgatgtacaatcagcaattgaccatatacatcgctatggaagtgcacatacagactgtgtggtcactacagatgataaagtagcagagacctttctacgtcaagttgatagtgctgccgtattatacaacgcgagtacaagattctccgatggtgctcgttttggactcggtgctgaggttggcataagtacaggccgtatacatgcacgtggacctgtgggtgttgaaggtcttttaactacacgatggctcttacgagggaaagggcaagtggtgaatggtgacaaggatgttgagtacacccataagagccttcctttgcaatgagaaaatggcgtggtaaggattccgcgaaaaccctctgaagtatgagtctcatcagactaaggaaagaaacccggtggatcaattaaattgtgtacaaaccatcttattgtggcggatcggtggatcaatttgtatgagcttggaggcttcggctctccggtgttataataaaaacaaatcagcaattctaggagtgagagtactagtgtgccgatactataagcagtatgtttcttgggcccggtaatccagcagcattggcaattgctcgttcttgctattgaagttgtgcattgaggccacctcggacgtgccatccttcactcgtactcccggcctggttacattgactagaaatgtcagttcaaatagaacatggcttaggctaaatcaaattaagcagacatacataaatcttggcccaacgtgctgacgcaaatggacgtgtgtccttttttgtc

SEQ ID NO: 5592 - DNA, 2964 bp, Hordeum vulgare
ggcggacgcagaggatcacggggttcgttggcgagccgctggggtttcgctcacggaaccaagcaccaacccctcacccctttaaaaccgctcggctctatccctctcctctctctctgacctccccacacatcgcgggtgcggcgacgaggcgacgggaaaaaaaacaccgcagataagagagaggcggcgcgccgagcctgcccgcggccatggccagcgccgaccccaaccggagcttcatcaaggacgtgaagcgcatcataatcaaggtgggtactgcagttatcaccagaaatgatggaagattggctttgggcaggattggatccctgtgcgagcaggtgaaggatcttaatgctcaaggatatgaggtgataatggtcacgtccggcgctgttggtgtggggcgacaacggcttaggtaccggaagcttgtcaatagcagctttgctgatctgcaaaagccacagatggagctggatggaaaggcgtgcgctgctgttggtcagagtgggctgatggcactttatgatatgttatttactcaacttgatgtatcatcatcgcaacttcttgtgacagatagtgacttcgacaattcaaatttccgagagcgactccgtgaaactgtcgagtcattattagagcttagagttattccaatatttaatgaaaatgatgccatcagcacgaggaaggctccatatgaggattcatctggtatattctgggataatgacagtttggcaggtctactggcattggaactgaaagctgatctccttgttctacttagtgatgtggatggcctctacagcggtccaccaagtgaaccttcatcaaagttgatacatacttatatcaaagaaaaacattatcatgaaattacttttggagacaagtcccgtgttggtagaggtggcatgacagctaaagtccaggctgctgtctgggcttcaacgggtggtgtacctgttgttattacaagtggatgtgcatctcagagccttgttaaggttctccgtggggaaaaaattggtactctttttcataaaaatgcaagttcgtgggaaccatcaaaggacgccagtgtccgtgaaatggctgttgctgcacgagattgttcaaggcgtctgcagaatttgtcatcagaggagcgcaagaagatattattagatgttgcagatgctttagaggcaaatgaggatttgattagatcagaaaatgaagcagatgtagcagcagcacacgaggctgggtatgagagtgctttggttgctagattgactctgaaaccaggaaagatagctagccttgccaaatctgttcgcactcttgcgaatatggaagacccaattaatgagatactgaaaagaacagaggttgctgatggtttagttctcgagaaaacatcttgccctttgggtgttctattgattatttttgagtcccgacctgatgccttggtccagattgcgtctttagccattcgaagtggtaatggtcttctcctaaaaggtggaaaagaagcgatgagatcaaacgcaatattgcataaggtcataaccaatgctattcctgacaatgttggtgaaaaattgattggccttattacaactagagatgaaattgcagatttgctaaagcttgatgatgtcattgatctcgtcattccaagagggagcaataagcttgttgctcaaatcaaagcatcaacaaagattcctgttcttggccatgctgatggggtttgtcatgtatatattgacaaatcagcagacatggatatggcaaaacgtattgtggtggatgcaaaaattgattacccagcagcctgcaacgcaatggagacgttgctcgttcataaagatcttatgaagactccagaacttgatgacatactggtagcactcaaaacagcaggagttaatctttattgcgggcctgttgcgcataaaatattgggctacccgaaagcagattcattacatctggagtacagttctatggcttgcacagttgagatagttgatgatgtacaatcagcaattgaccatatacatcgctatggaagtgcacatacagattgtgtggtcactacagatgatacagtagcagagacctttctacgtcaagttgatagtgctgccgtattatacaatgcgagtacaagattttctgatggggctcgctttggactgggtgctgaggttggcataagtacaggccgtatacatgcacgtggacccgtgggtgttgaaggtctcttgactacgcgatggctcttacgaggtaaagggcaaattgtgaatggtgacaaggatgttgtgtacacccataagagtcttcctttgcaatgagatatgtggtaaggattcggcgaaaaccctctgaaatatgattatttcatcggattacaaggaaagggaactgatgaaccttgtgaagattgaggggcggtggattaattaatttgtacaaaccatcattgtggtggtttggtagatcagtttgtatgagcttggaggctccggatttccagggttataataaaaaaacaaatcaacaattagtgagagagtactagtgtgccgatactattaagcagtatgtttctcgggaccgttaatccagcagcatctgcaattgctcggtgcagtgtaacggttgcttttatactttatctatcatggtggccagagtatctaatctggagctgctgtttttttgtggttttgcttgctcttgaagttgtatatgagctcataaataatggcttgtcctatacatattataggctgcactccgattttccttaggcataggttctttatgaaatatactttcgtattatgtactttcgctattgttctatagagttggtcaaacttgagcaagtttgatttaggacaaacgtagaactttaattgtttgtttttgaacggagggggtttgtgagac

SEQ ID NO: 5593 - DNA, 2405 bp, Hordeum vulgare
atcacggggttcgttggcgagccgctggggtttcgctcacggaaccaagcaccaacccctcacccctttaaaaccgctcggctctatccctctcctctctctctgacctccccacacatcgcgggtgcggcgacgaggcgacgggaaaaaaaacaccgcagataagagagaggcggcgcgccgagcctgcccgcggccatggccagcgccgaccccaaccggagcttcatcaaggacgtgaagcgcatcataatcaaggtgggtactgcagttatcaccagaaatgatggaagattggctttgggcaggattggatccctgtgcgagcaggtgaaggatcttaatgctcaaggatatgaggtgataatggtcacgtccggcgctgttggtgtggggcgacaacggcttaggtaccggaagcttgtcaatagcagctttgctgatctgcaaaagccacagatggagctggatggaaaggcgtgcgctgctgttggtcagagtgggctgatggcactttatgatatgttatttactcaacttgatgtatcatcatcgcaacttcttgtgacagatagtgacttcgacaattcaaatttccgagagcgactccgtgaaactgtcgagtcattattagagcttagagttattccaatatttaatgaaaatgatgccatcagcacgaggaaggctccatatgaggattcatctggtatattctgggataatgacagtttggcaggtctactggcattggaactgaaagctgatctccttgttctacttagtgatgtggatggcctctacagcggtccaccaagtgaaccttcatcaaagttgatacatacttatatcaaagaaaaacattatcatgaaattacttttggagacaagtcccgtgttggtagaggtggcatgacagctaaagtccaggctgctgtctgggcttcaacgggtggtgtacctgttgttattacaagtggatgtgcatctcagagccttgttaaggttctccgtggggaaaaaattggtactctttttcataaaaatgcaagttcgtgggaaccatcaaaggacgccagtgtccgtgaaatggctgttgctgcacgagattgttcaaggcgtctgcagaatttgtcatcagaggagcgcaagaagatattattagatgttgcagatgctttagaggcaaatgaggatttgattagatcagaaaatgaagcagatgtagcagcagcacacgaggctgggtatgagagtgctttggttgctagattgactctgaaaccaggaaagatagctagccttgccaaatctgttcgcactcttgcgaatatggaagacccaattaatgagatactgaaaagaacagaggttgctgatggtttagttcttgagaaaacatcttgccctttgggtgttctattgattatttttgagtcccgacctgatgccttggtccagattgcgtctttagccattcgaagtggtaatggtcttctcctaaaaggtggaaaagaagcgatgagatcaaacgcaatattgcataaggtcataaccaatgctattcctgacaatgttggtgaaaaattgattggccttattacaactagagatgaaattgcagatttgctaaagcttgatgatgtcattgatctcgtcattccaagagggagcaataagcttgttgctcaaatcaaagcatcaacaaagattcctgttcttggccatgctgatggggtttgtcatgtatatattgacaaatcagcagacatggatatggcaaaacgtattgtggtggatgcaaaaattgattacccagcagcctgcaacgcaatggagacgttgctcgttcataaagatcttatgaagactccagaacttgatgacatactggtagcactcaaaacagcaggagttaatctttattgcgggcccgttgcgcgtaaaatattgggctacccgaaagcagattcattacatctggagtacagttctatggcttgcacagttgagatagttgatgatgtacaatcagcaattgaccatatacatcgctatggaagtgcacatacagattgtgtggtcactacagatgatacagtagcagagacctttctacgtcaagttgatagtgctgccgtattatacaatgcgagtacaagattttctgatggggctcgctttggactgggtgctgaggttggcataagtacaggccgtatacatgcacgtggacccgtgggtgttgaaggtctcttgactacgcgatggctcttacgaggtaaagggcaaattgtgaatggtgacaaggatgttgtgtacacccataagagtcttcctttgcaatgagatatgtggtaaggattcggcgaaaaccctctgaaatatgattatttcatcggatt

SEQ ID NO: 5594 - DNA, 2784 bp, Brachypodium distachyon
ctctttctcaagctctcccccccccccctcttcccctcgcatcgcgcggctgcggcgacgggagggcgcaaaagaacactgcggataagagaggggagacaaagagagttggaggaagaagcagtcgccctgcggccatggcgagcgccgaccccaaccgggccttcatgaaggacgtgaagcgcatcatcatcaaggtgggcactgcagttatcactagaaatgatggaagattggctttgggcaggattggagccctatgcgagcaggtgaaggatcttaactctcaaggatatgaggtgattatggtcacctcaggtgctgttggcgttgggcgacagcgactcaggtaccggaagctagtcaatagcagcttcgccgatctgcaaaagccacagaacgagctggatggaaaggcgtgtgccgctgttggtcagagtggcctgatggcactctacgatatgttattcacccaacttgatgtttcgtcatcccaactccttgtgacagacagtgattttgataattcaaatttccgggagcgactctgtgaaactgtcgagtcactattagagcttagagttattccaatatttaatgaaaatgatgctgtcagtactagaaaggctccatatgaggattcatctggtatattctgggataatgacagtttggcaggtctactggcattggaattgaaagctgatctccttgttctacttagtgacgtggatggcctctacagcggtccaccaagtgaaccttcatcaaagataatacacacttacatcaaagagatacattatcaggaaatcacttttggagacaagtctcgtgttggtagaggtggtatgactgctaaagttcaggctgcatccttggcttcaggaggtggcatacctgttgttattacaagtggatttgattctcagagcattgttaaagttctccaaggggaaaaaattggtactctttttcataagaatgcaagtttgtgggaaccatccaaggatgctagtgtccatgaaatggctgttgctgcaagagattgttcaaggcgtctacagaatttgtcgtcagaggagcgcaagaaaatattatttgatgttgcggatgctttagaggcaaatgaggatttaattagatctgagaatgaagctgatatagctgcagcacaagaagctggatatgagacttctttggtttctagattgactctgaaaccaggaaaaatagcgagcctcgcaaaatctattcgcactcttgcaaatatggaagaccctattaatgagatactgaaaagaacagaggttgctgatggtttagttctcgagaaaacatcttctcctttgggtgttctcttaattgtttttgagtcacgacctgatgccctggtccagattgcatctttagccattcgaagtggcaacggtctactcctaaaaggtggaaaagaagcaatgagatcaaacaccatactgcacaaggttataaccaatgctattcctggtaatgttggtgaaaaactgattggccttgttacaactagagatgagattgcagatttgcttaagcttgatgatgtcattgatcttgtcattccaagagggagtaataagctggtttctcaaatcaaggcatcaactaagattcctgttctaggtcatgctgatggtgtttgtcatgtatatattgataaatcagcagacatggatatggcaaaacgtattgtgttggatgcaaagattgattacccagcagcctgcaatgcaatggagacattacttgttcataaagatcttgcgaagaccccagaacttgatgacatattgttagcactcaaaacagcaggagttaatatttatagtggccctgttgcccacaaagtattaggctacccgaaagcagattcatttcatctggaatacagttctttggcttgcacagttgagtttgtagatgatgtacaatcggcaatcgaccatattcatcgttatggaagtgcacatacggattgtgttgtgactacagatgataaagtagcagagtcttttctacgtcaagttgatagcgccgctgtattctacaatgcgagtacaagattctccgatggggctcgttttggactcggtgctgaggttggcataagtacaggtcgtattcatgcccgtggacctgtgggtgttgaaggtcttttaactacaagatggatcttacgagggaaagggcaagtggtgaatggggacaaggatgttgcatacacccacaagactctcccgttgcaatcaggccctttgcttcttgatcaggattcagtaaaaaacctgtgaatcaacatggtttcatcagactacaagcaaaaaaatgagcaaaaagggtgaatcttgtgaagatcaaggagggctgtgaatcaattaattacattgttcaatcatagtgtagaaactatcttattgcggcggtttgttggtagatcagtttatatgagcttggagactccggttctccaataataataataataataataaaaagaagcagcactactagaagtgagaagagtactaatgtaccgatgtgcacagtatgttgattgggaccatcaatcgagtagcatctgccattgcttggtgcactgtaacggttatttctacacttgattttatcatggtggccagagtatctagtctggagctgctgtttttgtgtttctcttgtacaagctcatgaaacaatcgaatgtgcacccagggtcatgaaacaatcgaatgtgctatgcagtct

SEQ ID NO: 5595 - DNA, 2621 bp, Secale cereale
gactacggggttcgttggcgagccgctggggtttctgcgcccctcgccctttaaaaccgctcggctctatccctctcttttctgacctccccacacatcgcggctgcggcgacgaggaaaaatacactgcagataagagagagagagaggagcgagcgagacagggagaggcggcgcgccgagccagccagccacgccccaccccgcccgctgccatggccggcgcccgaccccaaccggagcttcatgaaggacgtgaagcgcatcatcatcaaggtgggcactgcagttatcaccagaaatgatggaagactggctctgggcaggattggagccctgtgcgagcaggtcaaggatcttaatgctcaaggatatgaggtgattatggtcacctcgggcgctgttggtgttgggcgacagcggctcaggtaccggaagcttgtcaatagcagctttgctgatctgcagaagccacagatggagctggatgggaaggcctgcgctgctgttggtcagagtgggctgatggcactctatgacatgttgtttacccaacttgatgtctcatcatcacaacttcttgtgacagatagtgacttcgacaattcaaatttccgggagcgactccgtgaaactgtcgagtcgttattagagcttagagttattccaatatttaatgaaaatgatgccatcagtaccaggaaggctccatatgaggattcatctggtatattctgggataatgacagtttggcagggctactggcattggaactgaaagctgacctccttgttctacttagtgatgtggatggcctctacagcggtccaccaagtgaaccttcatcaaagttaatacatacttatatcaaagaaaagcattatcatgaaattacttttggagataagtcccgtgttggtagaggtggcatgacagctaaagtccaggctgctgtctgggcttcaacgggtggtgtacctgttgttattacaagtggatgtgcatctcagagccttgttaaagttctccgtggggaaaaaattggtactctttttcataaaaatgcaagttcttgggaaccatccaaggacgctagtgtccgtgaaatggctgttgctgcacgagattgttcaaggcgtctacagaatttgtcatcagaggagcgcaagaaaatattattagatgttgcggatgctttggaggcaaatgaggatttaattagatccgagaatgaagcagatgtagcagcagcacatgaggctgggtatgagagtgctttggttgctagattgactctgaaaccaggaaagatagcaagccttgccaaatctgtccgcactcttgcgaatatggaagaccctattaacgagatactaaaaagaacagaggttgctgatggtttagttcttgaaaaaacatcttgccctttgggtgttctattaattatttttgagtctcgacctgatgccttggtccagattgcgtctttagccattcgaagtggtaacggtcttctcctaaaaggtggaaaagaagcaatgagatcaaatgcaatattgcataaggttataaccaatgctattcctgacaatgttggtgaaaaattgattggccttattacaactagagatgaaattgcagatttgctaaagcttgatgatgtcattgatcttgtcattccaagagggagtaataagcttgttgctcaaatcaaatcatcaacaaagattcctgttcttggccatgctgatggtgtttgtcatgtatatattgacaaatcagcagacatggatatggcaaaacgtattgtgatggatgcaaaaattgattacccagcggcctgcaacgcaatggagacgttgcttgttcataaagatattgtgaagactccagaacttaatggcatactgctagcactcaaaaccgcaggagttaatctttattgcggccctgttgcgcataaagtattgggctacccaaaagcagattcattacatctggagtacagttctttggcctgcacagttgagatagttgatgatgtacaatcagcaattgaccatatacatcgctatggaagtgcacatacagattgtgtggtcactacagatgataaagtagcagagacctttctacgtcaagttgatagtgctgccgtattatacaatgcgagtacaagattctccgacggggctcgttttggactgggcgctgaggttggcataagtacaggccgtatacatgcacgtggacctgtgggtgtggaaggtcttttaactacacgatggctcttacgagggaaagggcagattgtgaatggtgacaaggatgttgcatacacccataagagtcttccgttgcaatgagaaaatgatgtcgtaaggattcggcgaaaaccctctgaaatatgatagtctcatcagaccatggaaaaaccggttgtgaagattggggggaggtggatcaattaatttgtgtacaaaccatcttattgtggcggttcggtagatcggtttgtatgagctttggaggcttgtgctctccagtgttataataaaaacaatcagcgattccaggagtgagagagtactagtgtgccgatactataagcagtatgttt

SEQ ID NO: 5596 - DNA, 2944 bp, Secale cereale
gtgccggcgtccctacgtaccctccggacgggagtcggacggaagtcggacggccgacgcggccggccgtctcctccgtcgaacgttgggtggacgcgccgcggcacgcacgcacgcacgccacggacacggcgtggcggcggcggcggacgcagaggatcacgggttcggttcggcgacgccggcctcggggtttcgtgcgcccctccgccctttaaaacccgtctccggctctatcccgcccttttccttgacgtccccaccaccaatcgcgggccgtgcggcgacggggaaaaagtaacaactgcagataagagagagagagaggagcgagcgagacaggagaggcggcgcgccgagccagccagccacgccccacccccgcccgccggccatggccggcgcccgaccccaaccggagcttcatgaaggacgtgaagcgcatcatcatcaagggtgggcactgcagttatcaccagaaatgatggaagactggctcgtgggcaggattggacgccctgtgcgagcaggtcaaggatcttaatgctcaaggatatgaggtgattagtggtcaccgtcgggcgcgtggttggtggttgggcgacaggcggctcgaggtaccggaagtcttgtcaatagcagtctttgctgatctgcagaacgccacagatggagctggatggaaggcctgcgctgctgtggtcagagtggctgatggcactctatgacatgttgtttacccaacttgatgtctcatcatcacaacttcttgtgacacgatagtgacttcgacaattcaaatttccgggagcgactccgtgaaactgtcgagtcgttattagagcttagagttattccaatatttaatgaaaatgatgccatcagtaccaggaaggctccatatgaggattcatctggtatattctgggataatgacagtttggcagggctactggcattggaactgaaagctgacctccttgttctacttagtgatgtggatggcctctacagcggtccaccaagtgaaccttcatcaaagttaatacatacttatatcaaagaaaagcattatcatgaaattacttttggagataagtcccgtgttggtagaggtggcatgacagctaaagtccaggctgctgtctgggcttcaacgggtggtgtacctgttgttattacaagtggatgtgcatctcagagccttgttaaagttctccgtggggaaaaaattggtactctttttcataaaaatgcaagttcgtgggaaccatccaaggacgctagtgtccgtgaaatggctgttgctgcacgagattgttcaaggcgtctacagaatttgtcatcagaggagcgcaagaaaatattattagatgttgcggatgctttggaggcaaatgaggatttaattagatccgagaatgaggcagatgtagcagcagcacatgaggctgggtatgagagtgctttggttgctagattgactctgaaaccaggaaagatagcaagccttgccaaatctgtccgcactcttgctaatatggaagaccctattaacgagatactaaaaagaacagaggttgctgatggtttagttctcgaaaaaacatcttgccctttgggtgttctattaattatttttgagtctcgacctgatgccttggtccagattgcgtctttagccattcgaagtggtaacggtcttctcctaaaaggtggaaaagaagcaatgagatcaaatgcaatattgcataaggttataaccaatgctattcctgacaatgttggtgaaaaattgattggccttattacaactagagatgaaattgcagatttgctaaagcttgatgatgtcattgatcttgtcattccaagagggagtaataagcttgttgctcaaatcaaatcatcaacaaagattcctgttcttggccatgctgatggtgtttgtcatgtatatattgacaaatcagcagacatggatatggcaaaacgtattgtgatggatgcaaaaattgattacccagcggcctgcaacgcaatggagacgttgcttgttcataaagatattgtgaagactccagaacttaatggcatactgctagccctcaaaaccgcaggagttaatctttattgcggccctgttgcgcataaagtattgggctacccgaaagcagattcattacatctggagtacagttctttggcttgcacagttgagatagttgatgatgtacaatcagcaattgaccatatacatcgctatggaagtgcacatacagattgtgtggtcactacagatgataaagtagcagagacctttctgcgtcaagttgatagtgctgccgtattatacaatgcgagtacaagattctccgacggggctcgttttggactgggtgctgaggttggcataagtacaggccgtatacatgcacgtggacctgtgggtgtggaaggtcttttaactacacgatggctcttacgagggaaagggcagattgtgaatggtgacaaggatgttgcatacacccataagagtcttccgttgcaatgagaaaatgatgtcgtaaggattcggcgaaaaccctctgaaatatgatagtctcatcagaccatggaaaaaccggttgtgaagattggggggaggtggatcaattaatttgtgtacaaaccatcttattgtggcggttcggtagatcggtttgtatgagctttggaggcttgtgctctccagtgttataataaaaacaaatcagcgattccaggagtgagagagtactagtgtgccgatactataagcagtatgtttcttgggaccggtaatccagcagcatctgcaattgctcggtacggtgtaacggttgtttcatctatcatggtggccagggttaatctggagctgccgtttgtgttgtttttcttctattgaagttatgagctc

SEQ ID NO: 5597 - DNA, 2199 bp, Saccharum officinarum
gtcgacccacgcgtccgcctccctttcacgccacggggagcgacctccgccgccgccgccatgccgaagcactaccgccctgcgggtaagaagaaggaggggaatgcggcaaagtacatcacgaggaccaaggcggtcaactacctgcaagttagcctcgcaatcttcaggaagctatgcattctaaagggtgtctttccgcggcagccaaagaagaaggtggaagggaaccacaagacctactaccacacgaaggatattgcattccttgctcatgaccctttgatcgagaagttcagggagattaaggtccatcgaaggaaggttaaaaaggctgttgctaagaaaaacagggatctcgcagacaggctgttgaatcggccaccaacttacaagcttgataggcttgtccttgaaaggtatccaacatttgttgatgctcttcgtgacttggatgactgccttacaatggtgcatctgtttgcggcattacctgctgttgatggtgaacgtgttgaagtcaaacgaatccataactgccgcaggttaagccatgaatggcaagcatacatatcccgtactcattccctgagaaagacatttatttccgtgaagggcatatattaccaggctgaagttcaaggacaaaagatcacctggataactcctcatgctcttcagcaagtattaaccgatgatgttgatttcaatgtgatgctctcttttctagaattctacgagactcttctaggatttgtgaacttcaagctctatcattcaataaatgtaaattatcctcctattctggatccacgtctggaagctttagctgctgagctatatgcattgtgcagatacatgtctgctggttccagaagaatgattgggaattcacaatctgacgaagttatggaggatagggacgagaagactaaagctgatggagtaattgaggaagagaaggatgtgaagaataaagcaagctcaaaagcagatgaatctgagctcagattagcacagcttcaacatcagctcccaactaatgaacctggtgcactgatgaatcttgtagaagaatcgactgctgatgatgcagatgacgacgatactaaagaatgtaaaggtttatttaagaacttaaagttctacttgagtcgggaggtgcctagggagtccctattatttactatcccagcatttggagggactgtttcatgggaaggagaaggagctccgtttaaagaagaagatgaagatatcactcaccagattgttgataggccgacacaaagccatgttttcctctccagggagtatgttcaaccacagtgggtctttgattgtgtaaacgctcgtatcatattgccgacagaaggttatcttgttggaagagtacctccaccacatttgtctccttttgtggacaatgatgcagagggctacattcctgagtatgcagagacaataaagaggctgcaagctgctgctcgcaatgaggtcttgcctcttccaggtattggtgatgaagatctagacaattcattggtagcagcaatgatggatcgaacagaatctaacgaagctgctgaaaagaagaggaagttggagatgctagagaagcaataccatgatgaactgaagatggaaattgatggcgttgctttctctagtctgtcaaataaggaaggagataaatcaccagatgccaaagatgatactcagtcagatcgcgaggaggatgccagtaaacaagaggagaaggatgatgatgacattggtactgctctcatgtctcgcaagcagagaggcctttataaagccatgaagatgggcaaagaaaagaaaaaagacaaaattgagctactaaagaagagaaaaaagaacgcggattctagtgcttcttccaagaagcggcactgatgctcagagtttgccagcgccacataaatcttcatcgcattggtgtggcatctctagtagaaatgttgccatgatcagctcatctgcgtgccgagtccccgtgatgagtggttgtcttttgatatctcctatgtatgctgaagatgatatcgaggaatatgtaccaggaaacttgaatagaaaagttttgatctcctatgtactaagcatttagagtcgttattattgtttagcatggatatattgcttgtcttcttttatagaaaaggtacaagaatt

SEQ ID NO: 5598 - DNA, 2169 bp, Zea mays
ctctcttttcccctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattcctcgctcatgaccctttgatcgagaagttcagggagattaaggtccatcgaaggaaggttaaaaaggctgttgctaagaaaaacagggatcttgcagacaggctgttgaatcggccaccaacttacaagcttgataggcttgtccttgaaaggtatccaacattcgttgatgctcttcgtgacttggatgactgccttacaatggtgcatctgtttgcggcattacctgctgttgacggtgaacgtgttgaggtcaaacgaatccataactgccgcaggttaagccatgaatggcaagcatacatatcccgaacccattctctgaggaagacatttatttccgtgaagggcatatattatcaggctgaagttcaaggacaaaagatcacctggctaactccgcatgctcttcagcaagtattaactgatgatgttgatttcaatgtgatgctttcttttctagaattctatgagactcttctaggatttgtgaacttcaaactctatcattcaataaatgtaaattatcctcctattctggatccacgtctggaagctttagctgctgagctctatgcattgtgccgatacatgtctgctggttccagaagaatgattgggaattcacaaactgacgaagtaatggaagataaggatgagaaaagtaaagctgaggaagtaattaaggaagagaaggttgtgaagaataaagcaagctcaaaagcagatgaatctgagctcagattagcacagcttcaacatcagctcccaaccaatgaacctggtgcactgatgaatcttgtagaagaatcaactgccgatgatgcagatgatgatgatactaaagattgtaaaggtttatttaagaacttaaagttctacttgagtcgagaggtgcctagggagtccctgttatttataattccagcgtttggagggactgtttcatgggaaggagaaggagctccatttaaagaaatagacgaagatatcactcaccagattgttgataggccgacacaaagccatgttttcctctccagggagtatgttcaaccacagtgggtctttgattgtgtaaatgctcgtatcatattgccaacagaaggttatcttgttggaagagtacctccaccacatttgtctccttttgtggacaatgatgccgagggctacatgcctgagtatgcagagacaataaagaggctccaagctgctgctcgcaatgaggtgttgcctcttccaggtattggtgatgaagatctagacaattcactggtagcagcaatgatggatcgaacagcttctaacgaagctgctgaaaagaagaggaagctggagatgctagagaagcaatacatcgatgaactgaagaaggaaattgatggcgttgctttctctagtttgtcaaacaaggaagcagataaatcaccgaatgcaaaagatgatactcagtcagatcgtgaggaggatgccagtaaacaagaggaggatgatgatgatgatattggtactgctctcatgtctcgcaagcagagaggcctttataaggctatgaagatgggcaaagaaaagaaaaaggagaaagttgagctactcaagaagagaaaaaagaacgcggattctggcgcttcttccaagaagcggcactgatgtgtcacaaatcttcatcgcattggtgtgtcatctctagtagaaatgttaccatgatcagctctgcgtgccaatcccccatgatgggtgggttgccttttgatatctgctatgtatgcttaagatgagttcaaggatatgtaacatgaaacttgaatagaaaagttttgatctgtcttacgaagcatttagactcgttattattgtgaaacttgaatagaaaagttttgacctgtcttacgaagcatttatagt

SEQ ID NO: 5599 - DNA, 2867 bp, Panicum virgatum
cggcactctcagcaacacacccttcctccagcccaagcaccgccagccgccatataaaccaaaaccctaaaacccatctcctcctctctttccccctccctcgtcccggtccgaggagcgacctccgccgccgccgccatgccgaagcactaccgccctgcgggcaagaagaaggaggggaatgccgcgaagtacatcacgaggaccaaggcggtcaactacctgcaagtcagccttgcaatcttcaggaagctatgcattctcaagggcgtttttcctcgtcaaccgaagaagaaggtggaaggaaaccacaagacttactaccacatgaaggatattgcctttatcgctcacgaccctttgatcgagaagttcaggcaaatcaaggtccacagaaagaaggttaagaaggctattgctaagaaaaacagggatcttgcggacagactgttgaatcgaccaccaacttacaagcttgataggctggtccttgaaagatatcctgcatttgttgatgctcttcgagacttggatgactgccttacattggttcatctgtttgcggcattacctgctgttgatggtgaacgtgttgaagtcaaacggatccatagctgccgcaggttaagccatgaatggcaagcatacatatccagaactcattccctgaggaagacatttatttctgtgaagggcatatattaccaggctgaagttcaaggacaaaagatcacttggttaactcctcatgctcttcagcaagtattaactgatgatgttgacttcaatgtgatgcttagttttttggaattctacgagactcttcttggatttgtaaacttcaagctctaccattcaattaatgtaaattatcccccaattttggatcctcgcttggaagctttagctgctgagctctatgcactatgccgatacatctccactggttctgggagagtgactggaaattcagaatctgatggagtaaaggaaaaagagtctggtggagcaatcaaggaaaaagaggatgaaaacaacaaagcaagctcaaaagctgatgagtctgaactcagattggcacagcttcagcatcagctgcctgctaatgaacctggtgcactaatgcatcttgtagaagaatcgactgctattgacacagatgacgatgagaccaaagaatgtaaaagtttatttaagaacttaaaattctacttgagtcgggaggtgcctagggagtcccttttatttattatcccggcatttggaggaactgtttcatgggaaggagaaggagctccattcaacgaagtagatgaagacatcactcatcagattgttgataggccaacacaaagccatgttttcctctctagggagtatgtccaaccacagtgggtatttgattgtgtaaatgctcgcatcatattgccgacagaggggtatcttgttggaagaatacctccaccacatctgtctccttttgtggacaacgacgcagagggttacattcctgagtatgctgagacaataaagaggctgcaagccgctgctcgcaatgagatcttgcctctgccaggtgatgaagatctggacaattcgttggtaacagcaatgatggatcgaacagagtcaaacgaagctgctgaaaagaagatgaagcttgagatgctagagaagcaataccacgatgagctgaagatggaaatagatggcattactttctctaatctgtcaaataagaaagcagataagtcactggacaccacagacaaggatgatacaaagtcagatcacgaggacgatgagaagaagcaagctgagaaggatagtgctgacatttcaacggctctcatgtctcgaaagcagagaggcctttataaagcaattgagattggcaaggaaaggaaacgcgacaaagttgagctactgaagaagagaaaaaaggacgccgattctagcgcttctgctaagcgacgctgagtctccaagttcatcagcgtggcatgtatctgtttggtgtagcattttgtagcggcgctgccatgatcagcattgcgtgatgcctttttgatagctatgttgtttttctatgtttgacttggagatatctatgctgttcaaaatgggctttaaccatgtgaccaggatacttgaatacaacaattttgattattttacttggtgtcgtgtacctgcatcatcgctgtgcagcgtgacttgtgcaacatctaatacgcgatgacggcgagcagagctcgtccatggagaccgcttaggctgccggagcaatcccttcaggagaccaggacccttgacacgagccacgacggcaaagcatatacaccttctagtctcgcggcgagcagctggctgcctgcgttctccttgacacgagcagcacggcggagaatccagggctctggccggcgccgtcagcggcaggtgcgccgcctacttcgtcctcactcgcggaacggcggaaggccggctttggcttggcgagacgtgcaggaggcgtgccgcgtctacagttttagcttcgaggatggcagcacgactgtgatggatcggacgagctcccgaccggcgccggatgggataacaacacgctcatgacatggctcgcgcgctcgcgccccggccttccgccatagctgccatggaattgattttattgatgtgagctccattgaaacgataagttaagggatgtgtagcttgcagctgaaccattttttcatcagggacagaaggtacagtcctttgttgggattccttaccaagttaccatggccacaatcgacgaaccagctgatgtgttttgctgccatggatggaaaggttagtgcagccaagagcagcagccg

SEQ ID NO: 5600 - DNA, 2180 bp, Setaria italica
ctcttttcccctccccttcccggtccgaggagcgacctccgccgccgccgccatgccgaagcactaccgccctgcgggcaagaagaaggaggggaatgcggcgaagtacatcacgaggaccaaggcggtcaactacctgcaagtcagccttgcaatcttcaggaaactatgcattctcaaaggtgtttttcctcgtcagccgaagaagaaagtggaaggaaaccacaagacctactaccacatgaaggatatcgcttttcttgctcatgaccctttgatcgagaaattcaggcaaattaaggtccacaggaaaaaggttaagaaggctgttgctaagaaaaacagggatcttgcggacagactgttgaatcgaccaccaacatacaagcttgataggctggtccttgaaagatatccaacgtttgttgatgctcttcgagacttggatgactgccttacaatggttcatctgtttgcggcattacctgctgttgatggtgaacgtgttgaagtcaaacggatccataactgccgcaggttgagccatgaatggcaagcatacatatccagaactcattccctgaggaagacatttatttctgtgaagggcatatatttccaggctgaagttcaaggacaaaagatcacttggctaactcctcatgctcttcagcaagtattaactgatgatgttgacttcaatgtgatgcttagttttctggaattctacgagacgcttctgggatttgtaaacttcaagctctaccattcaattaatgtaaattatccccctattctggattctcgtttggaagctttagctgctgagctatatgcattgtgccgatacatgtctactggttctgggaaagtgattcgaaactcagaatctggtggagcaatcaaggaaaatgaggatgaaaacaataaaacaagctcaaaagcagatgagactggtggagcaatcaaggaaaatgaggatgcaaacaataaaacaagctcaaaagcagatgagtctgaactcagattggcacagcttcaacatcagctcccagctaatgaacctggtgcactaatgcatcttgtagaagaaacgactgctgttgacacagatgatgatgagaccaaagaatgtaaaagtttatttaagaacttaaagttctacttgagtcgggaggtgcctagggagtccctgttatttattatcccggcatttggaggaactgtttcgtgggaaggagaaggagctccatttactgaagtagatgaagacatcactcatcagattgttgataggccgacacaaagccatgttttcctcactagggagtatgtccaaccacagtggatatttgattgtgtaaatgctcgcatcatattgccgacagaagggtatattgttggaagagtacctccaccacatttgtctccttttgtggacaacgatgcagagggttacattcctgagtatgcagaaacaataaagaggctgcaagctgctgctcgcaatgaggtcttgcctctgccaggtgatgaagatctggacaattcgttggtagcagcaatgatggatcgaacagagtcgaacgaagctgctgaaaagaagaggaagctggagatgctagagaagcaataccatgatgagctgaagatggaaattgatggcgttactttctcaaatctgtcaaataagaaagcagataagtcaccagacaccatggacaaggatgatacaaactcagaccacgtggatgatgagaagaaacaagctgagaaggatagtgctgacatttctacggttaccatgtctcgcaagggaagaggcctgtataaggcaatgaagattggcaaggaaaggaaacaagacaaagttgagatactgaagaagagaaaaaagagcgctgagtctagcgcgtctgctaagcaacgctgagtctccatgttcatcagcgcggcatgtatctgcttgggccttactggcatcagccttgggtagcatttcttgtagtgacgctgccacgatcagcactgtgtgatggtggtcgccttttgatagctatgttgtttttatttgtttgacgtaaagatatctatgctgttcaatctgggcttaacgatgtgcaccaggatacttgaagacaacatacttgatatattttacttgttgcattattgtggga

SEQ ID NO: 5601 - DNA, 2090 bp, Echinochloa colona
ctctcttttcccctccctttcccggcccgaggagcgacctcctccgccgccgccatgccgaagcactaccggcctgcgggcaagaagaaggaggggaatgcggcgaagtacatcacgaggaccaaggcggtcaactacctgcaagtcagccttgcaaacttcaggaagctatgcattctcaagggtgttttcccacgccagccaaagaagaaagtggaagggaaccacaagacctactaccacatgaaggatattgcctttctcgctcatgaccctttgattgagacgttcaggcaaatcaaggttcacaggaagaaggttaagaaggctattgctaagaagaacagggatcttgcggacagactgttgaatcgaccaccaacttacaagcttgataagctggtccttgaaagatatccaacgtttgttgatgctcttcgagacatggatgactgccttacaatggtccatttgtttgcggcattacctgctgttgatggtgaacgtgttaaagtcaaacggatccataactgccgtaggttaagccatgaatggcaagcatacatatcccgaactcattccctgaggaagacatttatttctgtgaagggcatatattaccaggctgaagttcaaggacaaaagatcacatggctaactcctcatgctcttcagcaagtattaactgatgatgttgacttcaatgtgatgcttagttttttggaattctacgagactcttcttagatttgtgaacttcaagctctaccattcaattaatgtaaattatcctcctattctggatcctcgtttggaagctttagctgctgagctctatgcattgtgccgatacatgtctgctggttctgggagagtgattggaaattcagaatctggtggagtaaccaaggaaaaagaggatgaaaataataaagcaagctcaaaagcagatgagtctgaactcagattggcacagcttcaacatcagctcacagcaaacgaacctggtgcactaatgcatcttgtggaagaattgactgctgttgacgcagacgatgatgatactaaagaatgtaaaagtttatttaagaacttaaagttctacttgagtcgtgaggtccctagggagtccctgctatttattatcccagcatttggaggaactgtttcatgggaaggagaaggagctccatttaacgaagtagatgaagctatcactcaccagattgttgataggccaacacaaagccatgtttttctatctagggaatatgtccaaccacagtgggtatttgattgtgtaaatgctcgaatcatattgccaacagaagggtatcttgttggaagagtacctccaccacatttgtctccttttgtggacaatgatgcagagggttacattcctgagtatgcagagacaataaagaggctgcaagctgctgctcacaatgaggtcttgcctatgccaggtgatgaagatctggacaattcgttggtagcaatgatggatcaaacagagtcaaacgaagctgctgaaaagaagaggaagctggagatgctagagaagcaataccatgatgaactgaagatggaaattgatggtgttactttctctaatctgtcgaataagaaagcagacaggtcgccagacaccatggacaaagatgatactcagtcagatcatgagaaggatgagaataaacaagccgagaaagataacactgatatttctacagctctcatgtctcgcaggcggagaggtctgtacgaggcaatgcagcttggcaaggaaaggaaacaagacaaagttgagctactgaagaagagaaagaagaaggctgagtctagcgcttctgctaagcgacgctgagtcatcaagttcatcagcgtggcatgtatctgttttggcctactggcatcagccttggtgtagcatttcttgtagcgatgctgccatgatcatcagcattgcgtgattgtggtcgccttttaatagctatataatgtttctcactagagatatctatactgttcaaggattcaagatgggctttaacgatgtgcgcctggaaccttgaatataacaatttt

SEQ ID NO: 5602 - DNA, 2092 bp, Echinochloa colona
tgccgaagcactaccggcctgcgggcaagaagaaggaggggaatgcggcgaagtacatcacgaggaccaaggcggtcaactacctgcaagtcagccttgcaaacttcaggaagctatgcattctcaagggtgtttttccccgacagccaaagaagaaggtggaagggaaccacaagacatactaccacatgaaggatattgcctttctcgctcatgaacctttgattgaggagttcaggcaaataaaggtttacgagaagaaggttaagaaggctattgctaagaaaaacagggatcttgtggacagactgttgaatcgaccaccaacctacaagcttgataggctggtccttgaaagatatccaacgtttgttgatgctcttcgagacatggatgactgccttacaatggtccatttgtttgcggcattacctgctgttgatggtgaacgtgttgaagtcaaacggatccataactgccgtaggttaagccatgaatggcaagcatacatatcccgaactcattccctgaggaagacatttatttctgtgaagggcatatattaccaggctgaagttcaaggacaaaagatcacatggctaactcctcatgctcttcagcaagtattaactgatgatgttgacttcaatgtgatgcttagttttttggaattctacgagagtcttcttggatttgtgaacttcaagctctaccattcaattaatgtaaattatcctcctattctggatcctcgtttggaagctttagctgctgagctctatgcattgtgccgatacatgtctgctggttctgggagagtgattggaaattcagaatctggtggagtaaccaaggaaaaagaggatgaaaataataaagcaagctcaaaagcagatgagtccgaactcagattggcacagcttcaacatcaactcacagcaaatgaacctggtgcactaatgcatcttgtagaagaattgacttctgttgacgtagatgacgatgatactaaagaatgtaaaagtttatttaagaacttaaagttctacttgagtcgtgaggtgcctagggagtccctgctatttattatcccagcatttggaggaactgtttcatgggaaggagaaggagctccatttaacgaagtagatgaagctatcactcaccagattgttgataggccaacacaaagtcacgtttttctctctagggaatatgtccaaccacagtgggtatttgattgtgtaaatgctcgcatcatattgccaacagaagggtatcttgttggaagagtacctccaccacatttgtctccttttgtggacaatgatgcagagggttacattcctgagtatgcagagacaataaagaggctgcaagctgctgctcgcaatgaggtcttgcctctgccaggtgatgaagatctggacaattcgttggtagcaatgatggatcaaacagagtcaaacgaagctgctgaaaagaagaggaagctggagatgctagagaagcaataccacgatgagctgaagatggaaattgatggtgttactttctctaatctgtcaaataagaaagcagacaggtcaccggacaccatggacaaagatgatactcagtcagatcatgagaaggatgagaataaacaagctgagaaagataatgctgatatttctacggctctcatgtcccgcaggcagagaggcctgtacgaggcaatgcagattggcaagggaaggaaacaagacaaagttgagctactgaagaagagaaaaaagaaggctgagtctagcgtctctgctaagcgacgctgagtcatcaagttcatcagcgtggcatgtatctgttttggcctactggcatcagccttggtgtagcatttcttgtagcgatgctgccatgatcatcagcattgcgtgattgtggtcgccttttaatagctatataacgtttctcacatagagatatatcaatactgttcaaggattcaggatgggctttaacgatgcgcgccaggaaccttgaatataacaattttgattgtccttactgtgtgaactctggatgtgctcgtctttattcgtagtcctga

SEQ ID NO: 5603 - DNA, 2577 bp, Panicum virgatum
cggcactttcagcaacacacccttcctccagcccaagcaccgccagccgccatataaaccaaaaccctaaaacccatctccccctctcttttcccctccctcttcccggtccgaggagcgacctccgccgccgccgccatgccgaagcactaccgccctgcgggcaagaagaaggaggggaatgccgcgaagtacatcacgaggaccaaggcggtcaactacctgcaagtcagccttgcaattttcaggaagctatgtattctcaagggtgtttttcctcgtcaaccgaagaagaaggtggaaggaaaccacaagacatactaccacatgaaggatattgccttcatcgctcatgaccctttgatcgagaagttcaggcaaatcaaggtccacagaaagaaggttaagaaggctattgctaagaaaaacagggatcttgcggacagactgttgaatcggccaccaacatacaagcttgataagctggtccttgaaagatatcctacatttgttgatgctcttcgagacttggatgactgccttacattggttcatctgtttgcggcattacctgctgttgatggtgaacgtgttgaagtcaatcggatccataactgccgcaggttaagccatgaatggcaagcatacatatccagaactcattccctgaggaagacatttatttctgtgaagggcatatattaccaggctgaagttcaaggacaaaagatcacttggttaactcctcatgctcttcagcaagtattaactgatgatgttgacttcaatgtgatgcttagttttttggaattctacgagactcttcttggatttgtaaacttcaagctctaccattcaattaatgtaaattatcccccaattctggatcctcgattggaagctttagctgctgagctctatgcactgtgccgatacatctctactggttctgggagagtgactggaaattcagaatctggtggagcaatcaaggaaaaagaggatgaaaacaaaaaagaaagctcaaaagctgatgagtctgaactcagattggcacagcttcaacatcagctcccagctaatgaacctggtacactaatgcatcttgtagaagaatcgactgctgttgacacagatgatgacgagaccaaagaatgtaaaagtttatttaagaacttaaaattctacttgagtcgggaggtgcctagggagtcccttctatttattatcccggcatttggtggaactgtttcatgggaaggagaaggagctccattcaacgaagtagatgaagacatcactcatcagattgttgataggccaacacaaagccatgttttcctctctagggcatatgtccaaccacagtgggtatttgattgtgtaaatgctcgcatcattttgccaacagaggggtatcttgtgggaagagtacctccaccacatttgtctccttttgtggataacgacacagagggttacattcctgagtatgctgagacaataaagaggctgcaagctgctgctcgcaatgagatcttgcctctgccaggtgatgaagatctggacaattcgttggtagctgcaatgatggatcgaacagagtcaaatgaagctgctgaaaagaagatgaagcttgagatgctagagaagcaataccacgatgagctgaaaatggaaatagatggcattactttctctaatctgtcaaataagaaagcagataagtcactggacaccatggacaaggatgattcaaagtcagatcacgaggatgatgagaagaagcaagctgagaaggatagtgctgacatttctacggctctcatgtctcggaagcagagaggcctttataaggcaattgagattggcaaggaaaggaaacgcgacaaagttgagctactgaagaagagaaaaaagaactctgagtctagtgcttctgctaagcgacgctgagtcaagttcatcagcgcggcatgtatcagtttggtgtagcatttcatgtagcggcgctgccgtgatcagcattgcgtgatgccttttgatagctatgttgtttttctatgtttgacttagagatatctatgctgttcaaagtgggctttaaccttgtgcaccaggaatacaggatacttgaaatacaattttgataattctacttggtgtagtcattgtgagatgtgcctgtcttatattcagacaattgtattctcagtccttgatctgtcgatgaattttttcttgcccctgcttggcttctagtctcgcggcgagctgctggctgcctgcgttcttctggacaatagtacacgaacacgacggagcaacacggcggagagtcgagggctcggctttggccggcgccatgcccgtggagatgagcgcgctcgaacgggaagtggatccgcggtaggtttatgaggtatgcccgaaccctgctagaccgtgccctgttccttgggtgccctaccagcttcgccgtggacgccccgcggttcaccggcgccgttagcggcaggtgcgctgcctacttcgtcccagctcgcggaacggcggaagaaggctggctttgacgac

SEQ ID NO: 5604 - DNA, 2138 bp, Pennisetum glaucum
caccgccacgaccgccatataaaccaaaaccctaaaacccatctcctcctttcttttcccctccccttcccggtccgaggagcgacctccgccgccgccgtcatgccgaagcactaccgccctgcgggcaagaagaaggaggggaatgcggcgaagtacatcacgaggaccaaggcggtcaagtaccttcaagtcagccttgcaaacttcaggaagctatgcattctcaagggtgttttccctcgccaaccgaagaagaaagtggaaggaaatcacaagacctactaccacatgaaggatatcgcttttcttgctcatgagcctttgatcgagacattcaggaaaattaagcgtcacagggctaaggttaagaaggctgttgctaagaaaaacagggatcttgcggacaggctgttgaatcgaccaccaacgtacaagcttgataggctggtccttgaaagatatccaacgtttgttgatgctctccgagacatggatgactgccttacaatggttcatctgtttgcggcattacctgctgttgatggtgaacgtgttgaagtcaaacggatccataactgccgcaggttgagccatgaatggcaagcatacatatccagaactcactccctgaggaagacatttatttctgtgaagggcatatattaccaggctgaagttcaaggacaaaagatcacttggctaactccacatgctcttcagcaagtattaactgatgatgttgacttcaatgtgatgctcagttttctggaattctacgagactcttcttggatttgtaaacttcaagctctaccattcaattaatgtaaattatcccccaattctggatcctcgtttggaagctttagctgctgagctctatgcattgtgccgatacatgtctactggttctgggaaaatgattggaaactcagaatctggtggagcaatccaggaaaacgaggatgaaaacaataaaacaagctcaaaagcagatgagtctgaactcagattggcacagcttcaacatcagctcccagctaatgaacctggtgccctaatgcatcttgtagaagaaacgactgctgttgacacagatgatgatgagaccaaagaatgtaaaagtttatttaagaacttaaagttctacttgagtcgggaggtgcctagggagtccttgctgtttattatcccagcatttggaggaactgtttcatgggaaggagaaggagctccatttactgaagtagatgaagacatcactcatcagattgttgataggccaacacaaagccatgttttcctcactaggcagtatgtccaaccacagtggatatttgattgtgtaaatgctcgcatcatattgccgacagaagggtatattgttggaagagtgcctccaccacatttgtctccttttgtggacaacgatgcagagggttacattcctgagtatgctgagacaataaagaggctgcaagctgctgctcgcaatgaggtcttgcctctgccaggtgatgaagatctggacaattcgttagtagcagcaatgatggatcgaacagagtcggacgaagctgctgaaaagaagaggaagctggagatgctagagaagcaataccatgatgagctgaagatggaaattgatggcattactttctctaatctgtcaaataagaaagtggataagtcaccagacaccatggacaaggatgatacaaactcagatcacgaggaggatgagaagaaacaagctcagagggatagtgctgacatttctaaggctctcatgtctcgcaagaaactaggcctgtatgaggccatggagaaaggcaaggcaaggaaacaagacaaagttgagatgctgaagaagagaaaaaagaacgccgagtctagtgcgtctgctaagcgacgctgagtatgttgattggcgcggcatgtatctgcttgggccttactggcataagccttggtgtagcgtttgtagtgactgctgccatgatcagcattgcgtgatggtagccgccttttgatagttttcctttgtttgtcgtaaagatctatgctgttcaagctgggctttatcgatgcgcaccatttacttgaatacaacaattttgatatgatgcgttattg

SEQ ID NO: 5605 - DNA, 2109 bp, Cenchrus ciliaris
cttcccggtccaaggagcgacctccgccgccgccgccatgccgaagcactaccgccctgcgggcaagaagaaggaggggaatgcggcgaagtacatcacgaggaccaaggcggtcaagtacctgcaagtcagccttgcaaacttcaggaagctatgcattctcaagggtgtttttcctcgccaaccgaagaagaaagtggaaggaaaccacaagacctactaccacatgaaggatattgcttttcttgctcatgaacctttgattgagaaattcaggcaaattaaggtccacaggaagaaggttaagaaggctattgctaagaaaaacagggatcttgcggagagactgttgaatcgaccaccaacgtacacacttgataggctggtccttgaaagatatccaacgtttgttgatgctctccgagacatggatgactgccttacaatggttcatctgtttgcggcattacctgctgttgatggtgaacgtgttgaagtcaaacggatccataactgccgcaagttgagccatgaatggcaagcatacatatccagaactcactccctgaggaagacatttatttctgtgaagggcatatattaccaggctgaagttcaaggacaaaagatcacttggctaactcctcatgctcttcagcaagtattaactgatgatgttgacttcaatgtgatgctcagttttctggaattctatgagagtcttcttacatttgtaaacttccagctctaccattcaattaatgtaaagtatccccctattctggatcctcgtttggaagctttagctgatgagctctatgcattgtgccgatacatgtctactggttctgggaaaatgagtggaaactcagaatctggtgcagcaatcaaggataatgaggatgaaaacaataaaacaagctcaaaagcagatgagtctgaactcagattggcacagcttcaacatcagctcccagctaatgaacctggtgccctaatgcatcttgtagaagaaacgactgctgttgacacagatgatgatgagaccaaagaatgtaaaagtttatttaagaacttaaagttctacttgagtcgggaggtgcctagggagtccttgctgtttattatcccagcatttggaggaactgtttcatgggaaggagaaggagctccatttactgaagtagatgaagacatcactcatcagattgttgataggccgacacaaagccatgttttcctcactagggagtatgtccaaccacagtggatatttgattgtgtaaatgctcgcatcatattgcctaccgaagggtatattgttgggagagtacctccgccacatttgtctccttttgtggacaacgatgcagagggttacattcctgagtatgcagagacaataaagaggctgcaagctgctgctcgcaatgaggtcttgcctctgccaggtgatgaagatctggacaattcattggtagcagcaatgatggatcaagcagagacgaacgaagctgctgaaaagaagaggaagctggagatgctagagaagcaataccacgatgagctgaagatggaaattgatggtgttactttctctaatctgtcaaataagaaagcagacaagtcaccagacaccatggacaaagatgatacaaaatcagatcacggggaggatgagaagaagcaagctgagaaggatagtgctgacatttctacggcaagggctctcatgtctcgcaagcaattaggcctgtatgatgcaatgaagattagcaaggaaaggaaacaagacaaagttgagatactgaagaagagaaaaaagaacgccgagtctagcgcgtctgctaagcgacgctgagtatgttcatcagtgtggcattgtatctgcttgggccttactggcacaaggccttggtgtagcatttctcgtagtgacgctgccatgatcagcattgcgtgatagtattcgccttgtggtagctatgttgtttttctttgtttgacgtaaggttttataaatgctgttcaagctgggctttaacgatgtgcaccatgatactcgaatacatcaattttgatatattttacttgatgcattatcgtggt

SEQ ID NO: 5606 - DNA, 2142 bp, Oryza sativa
cttcggcctctcctttcccccgctccccttccccgaggagccacgccgccgccgccgccgccgccatgccgaagcactaccggcctgcgggcaagaagaaggaggggaacgcggcgaagtacatcaccaggaccaaggcggtgaagtacctgcagattagcctcgcaaccttcaggaagctatgcattctcaagggcgtctttccccgggatccaaagaagaaggtggaagggaaccacaagacctactaccacatgaaggatattgccttcctggcccatgatcccttgattgagaagtttagagaaatcaaggtccacaggaagaaggtcaaaaaggcgtttgctaagaaaaataaagatcttgcagacagattattgaaccgaccaccaacttacaaacttgacaggcttattcttgaaagatatccaacttttgttgatgctcttcgtgacttggatgattgcctaacaatggtgcatctttttgctgcgttgcctgctgttgaaggtgaacgtgtgcaagttcagcggattcataattgccgcaggttgagccatgaatggcaagcatatatatctcgaactcattccctgcgaaagacatttatatccgtcaagggcatatattatcaagctgaagttcaaggtcaaaagatcacctggctaactccacatgctcttcagcaagttttaactgatgacgttgacttcaatgtgatgcttacctttttggaattctatgagacacttctgggatttataaacttcaagctttaccattcgataaatgtaaattatcctcctgttctggatcctcgtttggaagctttagcttctgagctctatgcgttgtgccggtacatgtcttctggaagagtacctggaaattcagaacctgctggactaattgaagacaaagagggtgaagacaataaagagagctcaaaaacagatgagtctgaactcagattggcacaacttcaacaccagctcccaactaatgaacctggagcgctgatgcatcttgtacaagaatctactgctgctgatgcagacgacgctgatgccaaagaatgcaggagtttattcaaaaacctgaagttctacctaagtcgtgaggtgcctagggaatctctcttatttatcattccagcatttggtggtaccgtttcatgggaaggagaaggagctccttttgatgagacagatgaagacatcactcatcagattgttgatagaccgacccaaagccacgttttcctctctagggagtatgttcaaccacagtggatatatgattgcgtgaatgctcgcatcatattgccgacagaaggttatattgtcgggagggtgcctccaccacatttatctccctttgtggacaatgatgcagagggttacattcctgagtatgcagagaccattaagaggctgcaagctgctgctcaaagccaggtgttgcctctgccaagtttaggggacgaagatatggaaaattcactggtagaggcaattattgatcgatcagagtctaatgaaattgctgacaagaagaggaagttggagatgctagagaagcagtaccacgatgagctgaggatggaatacgaaggaaagaccttctcaaataggacggcagataaccaaccagatgttgtggacaaaagtgatactaaagaagctgacgatcatatggaggactctcataaacaagccgagaaggatgctgctgacatttccaagacccttatgtctcgcaagcagagaggccttcttcaagcaattgagattaaccaggaaaggaaaaaggacaaggtgaacttgctgaagaaaaggaaaaagaatgctgattccagtgcttcggccaaaggtcgctgaggctcgaacttcatttgctccatgctgtatctgttttgacaaattgttcatcggtcgctgcttctgtggagttgctgccatgatctgcacacctacgtattcttatgcatgataagcagctccattttgatgtttaggtgttttacatgggctttaagaatatgcccagatacctcagtagaaaattttgagctatttacctagtgtccaaagtgtgttccctgatgattagtagctattactcttccaaattttgacgcgg

SEQ ID NO: 5607 - DNA, 2198 bp, Oryza sativa
ctcttcggcctctcctttcccccgctccccttccccgaggagccacgccgccgccgccgccgccgccatgccgaagcactaccggcctgcgggcaagaagaaggaggggaacgcggcgaagtacatcaccaggaccaaggcggtgaagtacctgcagattagcctcgcaaccttcaggaagctatgcattctcaagggcgtctttccccgggatccaaagaagaaggtggaagggaaccacaagacctactaccacatgaaggatattgccttcctggcccatgatcccttgattgagaagtttagagaaatcaaggtccacaggaagaaggtcaaaaaggcgtttgctaagaaaaataaagatcttgcagacagattattgaaccgaccaccaacttacaaacttgacaggcttattcttgaaagatatccaacttttgttgatgctcttcgtgacttggatgattgcctaacaatggtgcatctttttgctgcgttgcctgctgttgaaggtgaacgtgtgcaagttcagcggattcataattgccgcaggttgagccatgaatggcaagcatatatatctcgaactcattccctgcgaaagacatttatatccgtcaagggcatatattatcaagctgaagttcaaggtcaaaagatcacctggctaactccacatgctcttcagcaagttttaactgatgacgttgacttcaatgtgatgcttacctttttggaattctatgagacacttctgggatttataaacttcaagctttaccattcgataaatgtaaattatcctcctgttctggatcctcgtttggaagctttagcttctgagctctatgcgttgtgccggtacatgtcttctggaagagtacctggaaattcagaacctgctggactaattgaagacaaagaggatgaagacaataaagagagctcaaaaacagatgagtctgaactcagattggcacaacttcaacaccagctcccaactaatgaacctggagcgctgatgcatcttgtacaagaatctactgctgctgatgcagacgacgctgatgccaaagaatgcaggagtttattcaaaaacctgaagttctacctaagtcgtgaggtgcctagggaatctctcttatttatcattccagcatttggtggtaccgtttcatgggaaggagaaggagctccttttgatgagacagatgaagacatcactcatcagattgttgatagaccgacccaaagccacgttttcctctctagggagtatgttcaaccacagtggatatatgattgcgtgaatgctcgcatcatattgccgacagaaggttatattgtcgggagggtgcctccaccacatttatctccctttgtggacaatgatgcagagggttacattcctgagtatgcagagaccattaagaggctgcaagctgctgctcaaagccaggtgttgcctctgccaagtttaggggatgaagatatggaaaattcactggtagaggcaattattgatcgatcagagtctaatgaaattgctgacaagaagaggaagttggagatgctagagaagcagtaccacgatgagctgaggatggaatacgaaggaaagaccttctcaaataggacggcagataaccaaccagatgttgtggacaaaagtgatactaaagaagctgacgatcatatggaggactctcataaacaagccgagaaggatgctgctgacatttccaagacccttatgtctcgcaagcagagaggccttcttcaagcaattgagattaaccaggaaaggaaaaaggacaaggtgaacttgctgaagaaaaggaaaaagaatgctgattccagtgcttcggccaaaggtcgctgaggctcgaacttcatttgctccatgctgtatctgttttgacaaattgttcatcggtcgctgcttctgtggagttgctgccatgatctgcacacctacgtattcttatgcatgataagcagctccattttgatgtttaggtgttttacatgggctttaagaatatgcccagatacctcagtagaaaattttgagctatttacctagtgtccaaagtgtgttccctgatgattagtagctattactcttccaaattttgacgcggttgctgctcaagtgctcatctagctacataattcttaatcaggagtttagggcc

SEQ ID NO: 5608 - DNA, 2911 bp, Glycine max
aatagtactagcttgccaaatactatgtttaaaagttaaaactgatcagtgttgtgcttctatgcgctactcgaatgggaatttgcagtttcctcaaataaagttcagctgaataacaagcgaatttttaaaaatctcttcacaacctccacatttttgcaactaattcattcatgaaaagcacgaggaaggactcctccaaacaaagccataaaaatgttgtatcgcttgcctgagcatattcaaacagcattagtacaatggatttaatgtgcttgatgagcatttccaaaagcattagtacaaacagcatagcttgcctgtacaaacagcattagtgttggttagggagaagagcaccctataattaatggtgacaaaataaatggattggataaaaaaaatctattaatttactttgatctatttaaaaaaaatccaaactaaataacctaattttgctttttaaaataaaaataaatcaaatttctctttcaagagatattaaatatgttatgcatgagaattcaacacgatgacagaggatttccaacaagttagacaggaagcaagtgttgttccccctcataaacccaacaacagcggcggttgaaaggaagtcagtagcatagaagagaagagaaaagggtttgctatggagaagccagctgaagcagagaacgttctggtccttccccctcataaacaacccgacaacgacgacaacaacaacaacaataggccaaagccaaagccaaagcgtttcgtgaaaaaccaaatcccggagtcaatccttaacgatcctgttctgaacgccgcaatctccgtgctcccttcgaactacaacttcgaggtccacaagtgcgtttggcgtgtactctccagcggagcaaagcgcgtggcactccagttccctgagggcctcctcatgtactcgctccccctctccgacatcctcacctccttcgccgccgtcacccactgctacgtcctcggcgacgttacctacggcgcttgctgcgtcgacgacctcgctgcctccgccctcggcgccgaccttctcatccactacggccacagctgcctcgtccccatcgactccaccacaatcccctgcctctacatcttcgtcgacatcaaaatcgacgtcccccacttcgtcgataccctcatcttaaacctccacaaagccaaaacgctcgtcatcgccggaaccattcaattcgcctccgcaattcgcaccgccaagccccaattggaggaactagggtttagggttttgattcctcagtccaagccgctctccgcaggcgaggttctgggttgcactgcgcccaaggtatcgtcgaaattgctcggtgatgatggtgagagtagtgttttggtttttgtggcggatggaaggtttcacttggaggcgttcatgattgcgaatccggggattagggcattcaggtatgacccttacatggggaagttgtttctggaggaatatgatcatttgggtatgaagaggtccaggaaaaatgcgatttttaaagccagggaggaggctcggagttggggtctggttttggggacgctggggaggcaagggaatccaaggattttggagaggttggagaagatgatgagggatagaggctttgattatactgtggttttgatgtcggagatgagtcctgccaggattgctctctttgaggattctatcgatgcttggattcagattgcgtgtcctaggttgtccatcgactggggggaggcttttgtgaaaccggtgcttactccttttgaggccgatattgcgctgggagtgatacctgggtggtgggagaagaataatgaggtggtttgttgcaataagagtggctcttgttgtggggatgcaaagggaggaggagaagattttggtggagattatcccatggattactatgctcaagatggtggggagtggaattcatcttatgtgataaagtctactcgtcctcctgccaggagagttttcgttgtgtcgtctgttgctgatactactgccatttcccaacagccttagatttgctgcttatcagttacaagtccaaggttttaaaaagacagataggatggatcgtgacatcagcctcagcgttaagatttgtgtcgtggctatatttgtctgtgatttctcgcgattgcaattggactgctactgcaattacaattaataaaaccttggtcataactaacgattttttgctctggaaggatagagtctatagtctattgttttcttttgtttttagttttgtcttatttaggataaattttgtaggatgaatgtttgggggagaagaaaacatgctgaactgttcttttctttggtctgatatgagagtgaagaagatggaatgtgataagctcacgtagccaccaagcttttttggtgattaattggtttgtgccttctttggtgacacctcagtaaccactactcttgcatggaatgttgtatgttaatgtgagtgttggaatttaggaatcagagagaaacaagttcttttgtatgacgtgtatcttttaaaattaataataataggctctgttatacctaaatgtgaccgagtctcttgttaggttcttgccaatcttaagaatagctcacaaattacagcaggcactcgtttccactttgtttgtttctctctcattgagtatgcaatcaaagcagcaaagcacttgccttctcatccttctacaactcattttcattttttggtggcgtagctttcatgtgccatatttctcttctttagtacttctagtcatgattttatctacttccgaaaatttgaacacactagtaattatttcatgctctatgactttatgtttttaattaatgggagatgtctttgtactgtttgat

SEQ ID NO: 5609 - DNA, 2578 bp, Glycine max
gaaaagcacgaggaaggactcctccaaacaaagccataaaaatgttgtatcgcttgcctgagcatattcaaacagcattagtacaatggatttaatgtgcttgatgagcatttccaaaagcattagtacaaacagcatagcttgcctgtacaaacagcattagtgttggttagggagaagagcaccctataattaatggtgacaaaataaatggattggataaaaaaaatctattaatttactttgatctatttaaaaaaaatccaaactaaataacctaattttgctttttaaaataaaaataaatcaaatttctctttcaagagatattaaatatgttatgcatgagaattcaacacgatgacagaggatttccaacaagttagacaggaagcaagtgttgttccccctcataaacccaacaacagcggcggttgaaaggaagtcagtagcatagaagagaagagaaaagggtttgctatggagaagccagctgaagcagagaacgttctggtccttccccctcataaacaacccgacaacgacgacaacaacaacaacaataggccaaagccaaagccaaagcgtttcgtgaaaaaccaaatcccggagtcaatccttaacgatcctgttctgaacgccgcaatctccgtgctcccttcgaactacaacttcgaggtccacaagtgcgtttggcgtgtactctccagcggagcaaagcgcgtggcactccagttccctgagggcctcctcatgtactcgctccccctctccgacatcctcacctccttcgccgccgtcacccactgctacgtcctcggcgacgttacctacggcgcttgctgcgtcgacgacctcgctgcctccgccctcggcgccgaccttctcatccactacggccacagctgcctcgtccccatcgactccaccacaatcccctgcctctacatcttcgtcgacatcaaaatcgacgtcccccacttcgtcgataccctcatcttaaacctccacaaagccaaaacgctcgtcatcgccggaaccattcaattcgcctccgcaattcgcaccgccaagccccaattggaggaactagggtttagggttttgattcctcagtccaagccgctctccgcaggcgaggttctgggttgcactgcgcccaaggtatcgtcgaaattgctcggtgatgatggtgagagtagtgttttggtttttgtggcggatggaaggtttcacttggaggcgttcatgattgcgaatccggggattagggcattcaggtatgacccttacatggggaagttgtttctggaggaatatgatcatttgggtatgaagaggtccaggaaaaatgcgatttttaaagccagggaggaggctcggagttggggtctggttttggggacgctggggaggcaagggaatccaaggattttggagaggttggagaagatgatgagggatagaggctttgattatactgtggttttgatgtcggagatgagtcctgccaggattgctctctttgaggattctatcgatgcttggattcagattgcgtgtcctaggttgtccatcgactggggggaggcttttgtgaaaccggtgcttactccttttgaggccgatattgcgctgggagtgatacctgggtggtgggagaagaataatgaggtggtttgttgcaataagagtggctcttgttgtggggatgcaaagggaggaggagaagattttggtggagattatcccatggattactatgctcaagatggtggggagtggaattcatcttatgtgataaagtctactcgtcctcctgccaggagagttttcgttgtgtcgtctgttgctgatactactgccatttcccaacagccttagatttgctgcttatcagttacaagtccaaggttttaaaaagacagataggatggatcgtgacatcagcctcagcgttaagatttgtgtcgtggctatatttgtctgtgatttctcgcgattgcaattggactgctactgcaattacaattaataaaaccttggtcataactaacgattttttgctctggaaggatagagtctatagtctattgttttcttttgtttttagttttgtcttatttaggataaattttgtaggatgaatgtttgggggagaagaaaacatgctgaactgttattttctttggtctgatatgagagtgaagaagatggaatgtgataagctcagtttctgtttcaatttggttgacgtagccaccaagcttttttggtgattaattggtttgtgccttctttggtgacacctcggtaaccactactcttgcatggaatgttgtatgttaatgtgagtgttggaatttaggaatcagagagaaacaagttcttttgtatgacgtgtatcttttaaaattaataataataggctctgttatacctaaatgtgaccgagtctcttgttaggttcttgccaatcttaagaatagctcacaaattacagcaggcactcgtttccactttgtttgtttctctctcattgagtatgcaatcaaagcagcaaagcacttgccttctc

SEQ ID NO: 5610 - DNA, 1663 bp, Glycine max
ctttttaaaaccttggacttgtaactgataagcagcaaatctaaggctgttgggaaatggcagtagtatcagcaacagacgacacaacgaaaactctcctggcaggaggacgagtagactttatcacataagatgaattccactccccaccatcttgagcatagtaatccatgggataatctccaccaaaatcttctcctcctccctttgcatccccacaacaagagccactcttattgcaacaaaccacctcattattcttctcccaccacccaggtatcactcccagcgcaatatcggcctcaaaaggagtaagcaccggtttcacaaaagcctccccccagtcgatggacaacctaggacacgcaatctgaatccaagcatcgatagaatcctcaaagagagcaatcctggcaggactcatctccgacatcaaaaccacagtataatcaaagcctctatccctcatcatcttctccaacctctccaaaatccttggattcccttgcctccccagcgtccccaaaaccagaccccaactccgagcctcctccctggctttaaaaatcgcatttttcctggacctcttcatacccaaatgatcatattcctccagaaacaacttccccatgtaagggtcatacctgaatgccctaatccccggattcgcaatcatgaacgcctccaagtgaaaccttccatccgccacaaaaaccaaaacactactctcaccatcatcaccgagcaatttcgacgataccttgggcgcagtgcaacccagaacctcgcctgcggagagcggcttggactgaggaatcaaaaccctaaaccctagttcctccaattggggcttggcggtgcgaattgcggaggcgaattgaatggttccggcgatgacgagcgttttggctttgtggaggtttaagatgagggtatcgacgaagtgggggacgtcgattttgatgtcgacgaagatgtagaggcaggggattgtggtggagtcgatggggacgaggcagctgtggccgtagtggatgagaaggtcggcgccgagggcggaggcagcgaggtcgtcgacgcagcaagcgccgtaggtaacgtcgccgaggacgtagcagtgggtgacggcggcgaaggaggtgaggatgtcggagagggggagcgagtacatgaggaggccctcagggaactggagtgccacgcgctttgctccgctggagagtacacgccaaacgcacttgtggacctcgaagttgtagttcgaagggagcacggagattgcggcgttcagaacaggatcgttaaggattgactccgggatttggtttttcacgaaacgctttggctttggctttggcctattgttgttgttgttgtcgtcgttgtcgggttgtttatgagggggaaggaccagaacgttctctgcttcagctggcttctccatagcaaacccttttctcttctcttctatgctactgacttcctttcaaccgccgctgttgttgggtttatgagggggaacaacacttgcttcctgtctaacttgttggaaatcctctgtcatcgtgttgaattctcatgcataacatatttaatatctcttgaaagagaaatttgatttatttttattttaaaaagcaaaattaggttatttagtttggat

SEQ ID NO: 5611 - DNA, 1841 bp, Cajanus cajan
ggcagtggagcgaaagaaagatggagtggtcggagcaagcgaaggcagaagcagaggtcctcctcgtaaatcctcctaagccaaaggcaaagccaaagcgtttcatcaaaaaccaaatccccgactcaatcctaaacgaccctcttctgaacgccgccatatccgtcctcccttccaactacaacttcgaggttcacaagtcggtgtggcgcatcctctcctccggcgccaagcgcctcgcccttcagttccctgagggcctcctcatgtactccctccccctctccgacatcttcaccaccttcgccaatgtcacccactgctacatcctcgccgacgtcacctacggcgcctgctgcgtcgacgacttcgccgcctccgccctctccgccgacctcctcattcactacggccacagctgcctcgtccccatcgactccaccaccctcccctgcctctacgtcttcgtcgacatcaaaatcgacgtcccccacttcctccacaccctaaccctaaacctccattccaaaaccctcgtcctcgccggcaccatccaattcgcctccgcgattcgcgccgccaaaccccaattggaggaattagggtttagggttttgatcccgcaggcgaagccgctctccgccggggaggttctgggctgcaccgcgcccagggtgtcgtcgaatttgcttggtgagagcgttctggttttcgtggcggatggcaggtttcatctggaggcgttcatgattgcgaatcccgggattaaggcgtttaggtatgacccttacttggggaagttgtttctggaggagtatgatcatttgggtatgaagcggtcaaggaaaaatgcgatttttaaagcgagggaggctcggagttggggtcttgttttggggactcttgggaggcaagggaatccgaggattcttgagaggttggagaagatgatgagggagaaagggtttgattatacggtgggtttgatgtcggagttgagtcctgggaggattgcactctttgaggattctgttgatgcttggattcagattgcgtgtccgaggttgtccattgattggggggaggcttttgtgaaaccggtgcttactccttttgaagcagaggttgctttgggagcgatacctgggtggtgggagaagaatgaggtttgcgaagaggatggtgtgggttgttgcaagaagagtggttcttgttgtggtggggatgagaacgattttggtggagattatccgatggattactatgctcaggatggtggggagtggaattcatcttatgtgaaaaaatcttctcgtcctgtcaggagagtttctattgctgatagtgccatttcccaatagccatagatttgcttggttatttgtccaaggttttaaaaaacaggctactattgcgacttcagccacaatgtcaaggtttttagaatctctgcaacaacaatgcaatcacaattctagctgcatttgtccagaatttcctgcaatatcaaagacttcaactgcgactacaatttaaaactttggttataacgatttattctgaaagggtataaactatattgttttcttttgtttttaggtgtcttatttaagatattttttgttcgaaaaatgtttttgggagaagaaaacatgctgaagtgttcttttctttgatctgatatgagagtgaagaagaaggaatgtgataaggtttgtctttcatggcctgattggaaaaaaattttgatacaatttttgaacaattttgcagttaacagtttctgattgaggatgtaaaagtatttacccggctaattgtgattttatattagttgcttt

SEQ ID NO: 5612 - DNA, 1302 bp, Brassica napus
ggaaaactcctctgaactacttactattctctagtctctttgtatttttcttttatgggccggtcttgggctatgggccgaagatagattgggcaatgtcctacgtgtatctttttctgttctagtgtctctttctctgggaaatgaaatggagcttaccatctgaggaaactcaatcatcaaagctttggccggtgatccatttacgatgggatcagcgttccgtgatcgtacggcggagtttcgttcactctcccaaacgttgaagaagatcggagcggcgattccgtccgttcatcaagccgaaagtgatccgacatcctccaaacggtcgccgccgggatcttcgagatccgagttcaacaagaaggcttcccagatcggtctgcgtatccacgaaacgtctcagaagacagcaaggctcgctaaattggcaaaagaatcatcgattttcaatgaccggactttggagatacaggagctaaccgtgttgatcaggaacgacatcacagggctgaacatggctctctctgatctgcagacccttcagaacatggagatcgccgatgggagctattcgcatgacaaagttggtcactacacagctgtttgcgatgacttgaaaaccaggctcatgggagctacaaagcagtttcaagacgttctaactgccagatcagagaacatgaaggctcatgaaaaccggaaacaactcttttccgcaaaaaacgcagcagtagataatcagaataatgcaaaagctgtacctgagcctcctccttggtcaagttcatcagttccttccgggaatttacaacaacagccactattgccgccagttaatagtggagcttcttcaggtagccagcttagacgcagatctgctattgagaatgcaccatcgcaacaaatggagatgtctatgttacagcaaacagtcccaaggcaggagaattatagccaaaaccgagctgttgcgcttcacagtgtggaatcaacgataacagagctcagtggaatattcacgcatctagctacgatggttactcaacagggagagctagctatcagaatcgatgacaatatggatgaatcgttagttaacgtagagggagcacgcagcgctcttctgcagcatctcactcgaatttcgtcaaatagatggctcatgatcaagatcttcgctgttatcatattgttcctcattgttttcctcttctttgtggcttgaaacaattacctttatatattttttgatcttgttgcatcaaaaccaaagttaaaggttacatctatacacat

SEQ ID NO: 5613 - DNA, 1292 bp, Brassica rapa
caagtcgttccatgttagaacaagaaaacgacacgcagggtttctttagttaccttttttctgttctagtgtctcgttctctgggaaatgaaatggagcttaccatctgaggaaactcaatcatcaaagctttggccggtgatccatttacgatgggatcagcgttccgtgatcgtacggcggagtttcgttcgctctcccaaacgttgaagaagatcggagcggcgattccgtccgttcatcaagccgaaagtgatccgacatcctccaaacggtcttcgccgggatcttcgagatccgagttcaacaagaaggcttcccagatcggtctgcgtatccacgaaacgtctcagaagactgcgaggctcgctaaattggcaaaagaatcatcgattttcaatgaccggactttggagatacaggagctaaccgtgttgatcaggaacgacatcacagggctgaacatggctctctctgatctgcagacccttcagaacatggagatcgccgatgggagctattcgcatgacaaagttggtcactacacagctgtttgcgatgacttgaaaaccaggctcatgggagctacaaagcagtttcaagacgttctaactgcgagatcagagaacatgaaggctcatgaaaaccggaaacaactcttttccgcaaaaaacgcagcagtagataatcagaataatgcaaaagctgtacctgagcctcctccttggtcaagttcatcagttccttccgggaatttacaacaacagccactattgccgccagttaatagtggagcttcttcaggtagccagcttagacgcagatctgctatcgagaatgcaccatcgcagcaaatggagatgtccatgttacagcaaacagtgccaaggcaggagagttatagccaaaaccgagctgttgcgcttcacagtgtggaatcaacgataacagagctcagtggaatattcacgcatctagctacgatggttactcaacagggagagctagctatcagaatcgatgacaatatggatgaatcgttagttaacgtagagggagcacgcagcgctcttctgcagcatctcactagaatttcgtctaatcgatggctcatgatcaagatcttcgctgttatcatattgttcctcattgttttcctcttctttgtggcttgaaacaattacctttatatattttttgatcttgttgcatcaaaaacaaagcgaaaggttacatctatacacatgttaaagtttggaagcttcaagagttcaaaaaagtttgaatttttt

SEQ ID NO: 5614 - DNA, 1211 bp, Raphanus sativus
ggggggaatggagctcaccctctgaggaaactcatcaagctttttttttcccgtgatcctgatccaattacgatgggatcaacgttccgtgatcgcacggcggagtttcgttcgctctcccagacgttgaagaagatcggagcgatcccgtcttccgtccatcaagccgaaagtgatccaacaacatcctccaccaaacggtcgccgccgggatcttcgagatccgagttcaacaagaaggcttcccagatcggtctgcgtatccacgagacgtctcagaagaccgcgaggctcgctaaattggggaaagaatcgtcgattttcaatgaccggactttggagatacaggagctaaccgtattgatcaggaacgacatcacggggctcaacatggctctctctgatctgcagacacttcagaacatggagatcgctgatgggagctattcccatgacaaagtcggtcactacacagctgtttgcgatgacttgaaaaccaggctcatgggagctacaaagcaatttcaggacgttctaaccgcgagatcagagaacatgaaggctcatgaaaacaggaaacagctcttctccgcgaaaaacgcagcagtggataataatcagaataatgcaaaagctgtacctgagcctcctccttggtctagctcatcagttccttccgggaatttacaacaacagccactgttgccgccagtaaatagtggagctccttcaggcagccagcttagacgcagatctgctatcgagaatccaccatcgcagcaaatggagatgtctatgttacagcagacagtcccgaggcaggagaattatagccaaaacagagctgttgcgcttcacagcgtggaatcaacgataacagagctgagtgggatattcacacatctagctaccatggtcactcaacagggagagctagctatcagaatcgatgataatatggatgaatcgttagttaatgtagagggagcacgcagcgctcttctgcagcatctcactcgaatttcatcgaatagatggctcatgatcaagattttcgttgttatcatattgttcctcattgttttcctattcttcgtggcttgaaacaatacctttatatcttgttgcatcacatccacagctaaaagcatctatacgcatgttaagcttgcaattgcaagcttcaaaagtccaaaagttttttttcctac

SEQ ID NO: 5615 - DNA, 1198 bp, Brassica oleracea
ttctccgggaaatggagcttaccatctgaggaaactcaatcatcaggagctttggccggtgatcctgaatccaattaacgatgggatcaacgttcagagatcgcacggcggagtttcattcactctcccaaacgttgaagaagatcggagcggcgattccgtccgtccatcaagccgaaagtgatccgacatcctccaaacggtcttcgccgcctggatcttcgagatccgagttcaacaagaaggcttctcagatcggtttgcgtatccacgaaacgtctcagaaaaccgctaggctctctaaattggcaaaagaatcgtcgattttcaatgaccggactttggagatacaggagctgaccgtgttgatcaggaacgatatcacgggtctgaacatggctctctctgatctgcagacccttcagaacatggagatcgctgacgggagctattcgcatgacaaagtcggtcactacacagctgtttgtgatgacttgaaaacaaggctcatgggagctacaaagcagtttcaagacgttctaactgcgagatcagagaacatgaaggctcatgaaaacaggaaacaactcttttctgcaaaaaatgcagcagtagataatcagaatcatgcaaaagctgtacctgagcctcctccttggtcaagttcatcaactccttccgggagtttacaacaacagccacttttgccgccagttaatagtggagctccttcaggtagccagcttagacgcagatctgctattgagaatgcaccatcgcagcaaatggagatgtctatgttacagcaaacagtaccaaggcaggagaattatagccaaaaccgagctgttgcgcttcacagtgtggaatcaacgataactgagctcagtggaatattcacgcatttagctacgatggtcactcaacagggagagctagctatcagaatcgatgacaatatggatgaatcgttagttaacgtagagggagcacgcagcgctcttctgcagcatctcactagaatttcgtctaatcgatggctcatgatcaagatcttcgctgttatcatattgttcctcattgttttcctcttctttgtggcttgaaacagttacctttatatattttttgatcttgttgcatcaaaaccaaagcgaaaggttacatctatacacatgttaaagtttggaagcttcaa

SEQ ID NO: 5616 - DNA, 1079 bp, Brassica napus
agctttggccggtgatcctgaatccaattaacgatgggatcaacgttcagagatcgcacggcggagtttcattcactctcccaaacgttgaagaagatcggagcggcgattccgtccgtccatcaagccgaaagtgatccgacatcctccaaacggtcttcgccgcctggatcttcgagatccgagttcaacaagaaggcttctcagatcggtttgcgtatccacgaaacgtctcagaaaaccgctaggctctctaaattggcaaaagaatcgtcgattttcaatgaccggactttggagatacaggagctgaccgtgttgatcaggaacgatatcacgggtctgaacatggctctctctgatctgcagacccttcagaacatggagatcgctgacgggagctattcgcatgacaaagtcggtcactacacagctgtttgtgatgacttgaaaacaagactcatgggagctacaaagcagtttcaagacgttctaactgcgagatcagagaacatgaaggctcatgaaaacaggaaacaactcttttctgcaaaaaatgcagcagtagataatcagaatcatgcaaaagctgtacctgagcctcctccttggtcaagttcatcaactccttccgggagtttacaacaacagccacttttgccgccagttaatagtggagctccttcaggtagccagcttagacgcagatctgctattgagaatgcaccatcgcagcaaatggagatgtctatgttacagcaaacagtaccaaggcaggagaattatagccaaaaccgagctgttgcgcttcacagtgtggaatcaacgataactgagctcagtggaatattcacgcatttagctacgatggtcactcaacagggagagctagctatcagaatcgatgacaatatggatgaatcgttagttaacgtagagggagcacgcagcgctcttctgcagcatctcactagaatttcgtctaatcgatggctcatgatcaagatcttcgctgttatcatattgttcctcattgttttcctcttctttgtggcttgaaacagttacctttatatatt

SEQ ID NO: 5617 - DNA, 1332 bp, Eutrema parvulum
tgttttactgtccctttctccgattatctatcgttactctggaaatggagttcaccatctgaggacattcatcaagcttttggccggtgattctgatccatttctgaccctacgatgggatcgacgttcagggatcggacggcggagttttattcactgtcccaaacgttgaagaagatcggagcgatcccgtccgtcaatcaagttgaaggtgatccgacaacctccaaacggtcgccgccgggatcttcaagatcggaatttaacaagagggcttcccagatcggtctacatatccacgaaacgtctgagaagatcgcgaggctcgctaaattggcaaaacaatcgtcgattttcaatgaccggactgtggaaatacaagagttaactgtgttgatcaggaacgatatcacggggctgaatactgctctctctgatctgcagacccttcagaacatggagatcgctgatgggaactattcacaggacaaagttggtcactacacagctatttgtgatgacttgaaaaccagactcatgggagctacaaagcaacttcaagatgttcttactacgagatcagagaatatgaaggctcatgaaaaccggaaacaactcttttccacaaaaaacgcagcagttgatagcccgcctcagaataatgcaaaatctgtacctgagcctcctccttggtcaagttcatcaaatccttccgggaatttacaacaaccactattgccgccattaaatagtggagctcctacaggtagccagctcagacgcagatctgcgatcgagaatgctccatcgcagcaaatggagatgtccatgttacagcaaacagtcccaaggcaggagaactatagccaaaaccgagctgttgcgcttcacagtgtcgaatcaacaataacagagctcagtggaatattcacgcatctagctacgatggtcactcaacagggagagctagctatcagaatcgatgacaatatggatgaatcgttagttaatgtagagggagcacgcagcgctcttctgcagcatctcactagaatttcatcaaatagatggctcatgataaagatcttcgctgttatcacattgttcctcattgttttcctcatctttgtggcttgaaacgaaaccgttatatttcttgatcctggtgtatcaaaaatccagagctaaagcttcaagtatacgcatgttaagcttgcaagcttcaaggactcctttttgtgtgtgttgtggatattggagtgccaaaagtttcatttttttctacaagattcaaattgattttaccaggaaaagtttgatgtaataaagaat

SEQ ID NO: 5618 - DNA, 1123 bp, Arabidopsis lyrata
gaggaaattcatcaaatttgccggtgattttgatccaagtctgaccctacgatgggctcgacgttcagggatcggacggtggagtttcattcattgtcccaaacgttgaagaagatcggagcgatcccgtccgttcatcaagatgaagatgatccggcatcatccaaacggtcgtctccgggatccgaattcaataagaaggcttcccggatcgggttaggaatccacgaaacgtctcagaagatcgcgaggctcgctaaattggcaaaacaatcgtcgattttcaatgaccggactgtggaaatacaggagttaactgtgttgatcaggaacgatatcacggggctgaatatggctctctcggatttgcaaacccttcagaacatggagattgctgatgggaattattcacaggacaaagttggtcactacaccgctgtttgtgatgacttgaaaaccagacttatgggagctactaagcaacttcaagatgttctaactaccagatcagagaacatgaaggctcatgaaaaccggaaacaactcttttccacaaaaaatgcagtagatagtccgcctcagaataatgcaaaatctgtacctgagcctcctccttggtcaagttcatcaaatccttacgggaatttacaacaaccactattgccgccagtaaatactggagctcctccaggtagccagctcagacgcagatctgcgatcgagaatgctccttcacagcaaatggagatgtccatgttgcagcaaacagtccctaggcaggagaactatagccaaagccgagcagttgcacttcacagtgttgaatcaacaataacagagctcagtggaatattcacgcatctagctacaatggtcacacaacaaggagagctagcaatcagaattgatgacaatatggatgaatcgttagttaatgtagagggagcacgcagcgctcttctgcagcatctcactcgaatttcgtcaaatagatggctcatgatgaagatctttgctgttatcatcttgttcctcattgtctttctcttctttgtggcttgaaacaatgccatttaatctcttgttcctggtgtatcaaatctcttgttccttgccgattttc

SEQ ID NO: 5619 - DNA, 1398 bp, Eutrema halophilum
catgatgtttcaagtcaaaacataataacgacacgcggttttcttcaatttccttttctgtttctctgctcattctccgattgatagataaatctcacgttactctgaagatggaactcaccatctgaggataattcagcaagcgttgcctgtgatctcgagccaattctgaccctaagatgggatcgacgttcagggatcggacggctgagttttattcactgtcccaaacgttgaagaagatcggagtggtcccgtctgtccatcaagctgaagatgatccggcaacctccaaacgatcgccgccgggatcttcaagatccgaattcaacaagaaggcttcccagatcggtgtacgtattcaggaaacgtttcagaagatcgcgaggctcgttaaattggcaaaacaatcgtcgattttcaatgaccggactgtggaaatacaggagttaactttggtgatcaggaacgatatcacggggctgaatatggctctctcggatctgcaaacccttcagaacctggagattgctgatgggaattattcacaggacaaagttggtcactacacagctgtttgtgatgacttgaaaaccagacttatgggagcgacaaagcaacttcaagatgttctgactacgagatcagagaacatgaaggctcatgagaaccggaaacaactcttttccacaaaaaacgcagtagtagatagtcctcctcagaataatgcaagatctgttgtacctgagcctcctccttggtcaagttcatcaaatcctaccggaaatttacaacaaccactattgccgccattaaatagtggagctccttcaggtagccaactcagacgcagatctgcaatcgagaatgctccttcgcagcaaatggagatgtccatgttacagcaaacagtcccaaggcaggagaattatagccaaggccgagctgttgcgctgcacagtgtcgaatctacaataacagagctcagcggaatattcacgcatctagctacgatggtcactcaacagggagagctagctatcagaatcgatgacaatatggatgaatcgttagttaatgtagagggagcacgcagcgctcttctgcaatatctcactcggatatcatcaaatagatggctcatgatcaagatcttcgctgttatcatcttgttcctcattgttttcctcttctttgtggcttgaaagttgaaacgacaaggttgcatctcttgagagatcctgtggtgtatcaaatccagcgctaaaacttcagctatacacatgttaagcttgcaagcttttagggctccttttattcttttgtttgtaaagtttcaatttttttgcaagattcgattggattttaccaggaaacttttgatgatataaaaattta

SEQ ID NO: 5620 - DNA, 1157 bp, Brassica napus
aaatcatcaaagctttggccggcgatcctgaatccaattaacgatgggatcagcgttccgtgatcgcacggcggagtttcgttcactctcccaaacgttgaagaagatcggaggggcgattccgtccgttcatcaagccgaaagtgatccgacatcctccaaacggtcttcgccgggatcttcgagatctgagttcaacaagaaggcttcccagatcggtctgcgtatccacgaaacgtctcagaagactgcgaggctggctaaattggcaaaagaatcgtcaattttcaatgaccggactttggagatacaggagctgaccgtgttgatcaggaacgatatcacggggctgaacatggctctctctgatctgcagacccttcagaacatggagatcgccgatgggagctattcgcatgacaaagtcagtcactacacagctgtttgcgatgacttgaaaaccagactcatgggagctacaaagcagtttcaagacgttctaactgcaagatcagagaacatgaaggctcatgaaaacaggaaacaactcttttccgcaaaaaacgcagcagtagataatcagagtaatgcaaaagctgtacctgagcctcctccttggtcaagttcatcagtttcttccgggaatttacaacaacagccactattaccgccatcaaacagtggagctccttcaggtagccagcttagacgcagatctgctattgagaatgcaccatcgcagcaaatggagatgtctatgttacagcaaacagtgccaaggcaggagagttatagccaaaaccgagctgttgcgcttcacagtgtggaatcaacgataacagagctcagtggaatattcacgcatctagctaccatggtcactcaacagggagagctagctatcagaatcgatgataatatggatgaatcgttagttaacgtagagggagcacgcagcgctcttctgcagcatctcactagaatttcgtcgtaatcgatggctcatgatcaagatcttacgctgttatcatattgttcctcattgttttcctacttctttgtggtcttgaaacagttacctttatatattttttgatctttgttgtcattcaaaaaacaaagtcgaaaggtttactatacttatactactatttgtt

SEQ ID NO: 5621 - DNA, 1324 bp, Arabidopsis thaliana
atatgtttctcagtctctttctccgattgatacatctctcgttactctcgaaataaagctcatcatctgaggaaattcatcaatttgccggtgactttagttcaattccgaccctccgatgggctcgacgttcagagatcggacggtggagcttcattcactgtcccaaacattgaagaagatcggggcaatcccgtccgttcatcaagatgaagatgatccggcatcatccaaacggtcgtctccgggatccgaattcaataagaaggcttcccggatcgggttaggtattaaagaaacgtcacagaagatcacgaggctcgctaaattggcaaaacaatcgacgattttcaatgaccggactgtggaaatacaggagttaactgtgttgatcaggaacgatatcacggggctgaatatggctctctcggatttgcaaacccttcagaacatggagcttgctgatgggaactattcacaggaccaagttggtcattacactgctgtttgtgatgacttgaaaaccagacttatgggagctactaagcagcttcaagatgttctaactacgagatcagagaacatgaaggctcatgaaaaccggaaacaactcttttccacaaaaaatgcagtagatagtccgcctcagaataatgcaaaatctgtacctgagcctcctccttggtcaagttcatcaaatcctttcgggaatttacaacaaccactattacctccattaaatactggagctccgccaggtagccagctcagacgcagatccgcgatcgagaatgctccttcacagcaaatggagatgtccttgttgcagcaaacagtcccaaagcaggagaactatagccaaagtcgagcggttgcacttcacagtgttgaatcaagaataacagagctcagtggaatattcccgcagctagctacaatggtcacacaacaaggagagctagcaatcagaatcgatgacaatatggatgaatcgttagttaatgtagagggagcacgtagcgctcttctgcagcatctcactcgaatttcgtcaaatagatggctcatgatgaagatctttgctgttatcatcttgttcctgattgttttcctcttctttgtggcttaaaacaataccattttatctcttgttcctgggggtatcaaatctatacatatgttaagcttgtaagcttctagggctccttttttttgtgtggatagtggagtgtcaaaaagtttaatttttctgcaagactcagttgtattttaccaggaaacttctgatgtaatagcatttaactcaagtaaaaattcaaagcaa

SEQ ID NO: 5622 - DNA, 802 bp, Vigna unguiculata
ggatcgcaataaaccagttgcaatttctagggaagaatagaagcaagaaacgcaaaggcgatcgagttgtgactcagtgagttccgagttacaagttagaaatggcgagcgtgctccggaacgtgaaggtgcttccgaactcggcgagtgtggaggaggcgcgtcagcgcgtgttcgaattcttcagagtagcgtgccgttctctaccctccgtcatggaaatctacaacctatacgatgtcacttctgtcgcccagcttcgttccaccatcgcctctgagatccgcaagaacatcaacctcagcgatccaaaagtgatcgatatgctgcttttcaaagggatggaagagctgaagaacgttgtgaaccattcaaagcagaggcatcatatcattggtcagtacgtggttggtcagcaaggccaagtgcaggattcagcctcaaaagatccaggcacctctccctttctgaagaatttctacagcagcaactacttttgaaacttggccataagctgttctgtttcctcaaataaagagttatcttaaaatgtttttgtatatcagtactggatgagataatgcttttggttttggatcaaactactgcattcattcttcctggcttaagttaagaaagtgatgttttttgctgattgttgtgcattcttgcacactgctgaaaatattatgacgtgtaagtctattttacatcattccatatgaatacattgggtagcatgttagagaaataatactgtatttttgtgtaataattccatgatattgggtctcaccacaat

SEQ ID NO: 5623 - DNA, 1416 bp, Glycine max
agagatagagtaaaccaaaacgaaaggcaaagtgagtagcaggaggagtacggaaatggcatgtggctctgttctttcatcttttcttcacataacgaactccatggccatcaagggtgtcctctccttcgcaccaaatcctcctctgcttcttcgtctccccaaagctgtcacctttctttccttttctgcttccactaaatcccccactaagtcttttcaagtgagatcaattgctggtactacagaagctgcatcggggtttgatgagatggtttctgggactaagaggaagtattacatgctaggtgggaaagggggagtagggaagacaagctgtgctgcttcacttgctgttaaatttgccaataatggacaccctactctcgtggtttccaccgatccagcgcattctttgagtgattcttttgctcaggatttgacagggggtgcattggtgccagtagaaggacctgattatcctctttttgctcttgaaataaaccctgagaagtctagggaagagtttcgaaatgccgcccagaaaaatggtggaactggagtcaaagacttcatggatggcatgggtcttggaatgattgcagaccagttgggagaactaaaactgggagaattactggattctcctcctcctggactggatgaagctattgcgatctccaaggttatgcaatttcttgaatcacaggaatatagcatgtttactcgaatagtatttgatacagcacctacgggtcacacattacgattattgtccttacccgatttcttggatgcatccattggaaagatactgaagctaagacaaaaaatagcttctgctacctcagcaattaaatccgtgtttgggcaagaagaaacccgacagaatgctgctgacaaattggagaaactcagagagaggatgataaaagtgcgcgaactctttcgtgatactgattcgaccgaatttgtcattgttacaatccccacggtgatggcaattagtgagtcatctagattgagtgcttccctgaagaaggaaaatgttcctgtgaagagacttattgtcaaccagattcttccaccatctacatctgattgcaagttttgtgctatgaaaagaaaggatcaaatgcgtgctcttgatatagttcagaacgatccagaactctccagcttattgatgatccaggcaccactcatagatgttgagataagaggtgttccagctctcaaatttctgggtgacattatttggaaatgatttacacacagttactcaagcaatgattaggttaaatttagtaatttgctgaagttggtagttgaaaccatagacacatggcatgacatcaaggctcatcagattttatatgatgaatttgtggagcacttgagatgttcagattccgg

SEQ ID NO: 5624 - DNA, 1737 bp, Glycine max
ggtgaagagtgaaagagacagagatagagtaaaccaaaacgaaaggcaaagtgagtagcaggaggagtacggaaatggcatgtggctctgttctttcatcttttcttcacataacgaactccatggccatcaagggtgtcctctccttcgcaccaaatcctcctctgcttcttcgtctccccaaagctgtcacctttctttccttttctgcttccactaaatcccccactaagtcttttcaagtgagatcaattgctggtactacagaagctgcatcggggtttgatgagatggtttctgggactaagaggaagtattacatgctaggtgggaaagggggagtagggaagacaagctgtgctgcttcacttgctgttaaatttgccaataatggacaccctactctcgtggtttccaccgatccagcgcattctttgagtgattcttttgctcaggatttgacagggggtgcattggtgccagtagaaggacctgattatcctctttttgctcttgaaataaaccctgagaagtctagggaagagtttcgaaatgccgcccagaaaaatggtggaactggagtcaaagacttcatggatggcatgggtcttggaatgattgcagaccagttgggagaactaaaactgggagaattactggattctcctcctcctggactggatgaagctattgcgatctccaaggttatgcaatttcttgaatcacaggaatatagcatgtttactcgaatagtatttgatacagcacctacgggtcacacattacgattattgtccttacccgatttcttggatgcatccattggaaagatactgaagctaagacaaaaaatagcttctgctacctcagcaattaaatccgtgtttgggcaagaagaaacccgacagaatgctgctgacaaattggagaaactcagagagaggatgataaaagtgcgcgaactctttcgtgatactgattcgaccgaatttgtcattgttacaatccccacggtgatggcaattagtgagtcatctagattgagtgcttccctgaagaaggaaaatgttcctgtgaagagacttattgtcaaccagattcttccaccatctacatctgattgcaagttttgtgctatgaaaagaaaggatcaaatgcgtgctcttgatatagttcagaacgatccagaactctccagcttattgatgatccaggcaccactcatagatgttgagataagaggtgttccagctctcaaatttctgggtgacattatttggaaatgatttacacacagttactcaagcaatgattaggttaaatttagtaatttgctgaagttggtagttgaaaccatagacacatggcatgacatcaaggctcatcagattttatatgatgaatttgtggagcacttgagatgttcagattccggtactggcagttcttaaagagatactggcttccaatattcacacgctagagtttcaaaacaccagacaacttttttgatttttcacattataaatattgttattgtaaatttatttctccagtacttgtatctgactatttttttagttctaatccccttattttgaccttttttgttgagggctataatggtctttatgttttgaagtgttgactgagatattgttgatgcacacatgaaacatacaagaaaagttacatttcaaatgttgattatcaatttatcatcaacaaatatatttg

SEQ ID NO: 5625 - DNA, 1769 bp, Cajanus cajan
agtgtttgcaaagcattgggctcctctttcttcatttatctatttatcgataaaaagagaaacctgtcacggcgctgtgcaagtgaaccaaaacgaaaggcaaagtgagtttcgattacgaaaaatggcgtgtcgctctgtcatttcatcttctcttcacataactaactccatggccataaagggtgttctctccttcgcgcccaaccctcctcttcttcatcgtctccccaaagctgtcacctttgtttccttttctgcttccactaaaccccccactaagtcatttcaagtgagatcagtggcttctactacagaagctgcatcagggtttgatgagatggtttctgggactacgaggaagtattacatgctaggagggaaagggggtgtagggaagacaagctgtgcagcttcactcgctgttaaatttgccaataatggacaccccactcttgtggtttccactgatccagcacattctttgagtgattcttttgctcaggatttgacagggggtgcgttggtgcctgtggaaggacctgattatccactttttgctcttgaaataaaccctgagaaatctagggaagagtttcgaaatgctgcccaaaaaaatggtggaactggagtcaaagacttcatggatggcatgggtcttggaatgattgcagaccagttgggagagctaaaactgggagagttactggattcacctcctcctggactggatgaagccattgcaatctccaaggttatgcaatttcttgattcacaggagtatagcatgtttactcgaatagtatttgatacagcacctacgggtcatacattgcgattgttgtcattgcctgatttcttggatgcatccatcgggaagatactgaagctaagacaaaagatagcttccgctacctcagcaattaaatccgtgtttgggcaagaagaaacccggcagaatgcgtctgacaaattggagaaacttagggagaggatgataaaagtgcgggatctctttcgtgatactgattcaactgaatttgtcattgttacaatccccacggtgatggcagttagcgagtcatctagattgagtgcttccttgaagaaggaaaatgttcctgtgaagagacttattgtcaaccagatccttccaccgtctacatccgattgcaagttttgtgctatgaaaagaaaggatcagatgcgtgctcttgatattattcagaatgatccagatctctccagcttattgatgatccaggcaccactcgttgatgtagagataagaggtgttccagctctcaaatttctgggtgacattatttggaaatgactaccacacagttactcaagtagtgattaggttaaatttagtaatttgctgaagttggcagttgaaccatagattgatcgcatgacacaagcttatcagatttatataatgaagttgtagagagagcatttgagatgttcaaattccgatactggcagttcttaaagaggcactggcttccattatttacaagctagagtttcaaaacagcagaaaactttttttgtttttcacattataaacagtgttattgtatatttattgctccagtacttgtattgtatctatactattttttagttctctccacatttggtccttttatgttggggattgtgatcttttatgtttataagtgctgactgttcttgatgcacaaatgaaacaacataagaaaagttacatttcacatagtgattattcatttcaaata

SEQ ID NO: 5626 - DNA, 1659 bp, Phaseolus vulgaris
ctttgagggatgagagtgaaagagtgagagatagagtaaacgaaaccaaaggtgagtagagaaagaaatggcatgtcgctctgttgtttcgtcttcccttcacatgacaaacttcatggctgttaagggtgttctctcttttgcacctaaccctcctctgtttcatcatctccccaaagtcgtcacctttgtttccctttctgcttccgttaaactccccacaaagtcatttcaagtgagatcggtggttggtactacagaagctgcatcagagtttgatgaaatggtttctgggactaagaggaagtattacatgctaggtgggaaaggaggggttgggaagacaagctgtgctgcttcacttgctgttaaatttgccaataatggacacccaactcttgtggtttccactgatccagcacattctttgagtgattcttttgctcaggatttgacagggggggcattggtgccagtggaaggacctgattttccactttttgctcttgaaataaaccctgagaagtctagggaagagtttcgaaatgccgctcaaaaaaatggtggaactggagtcaaagacttcatggatggcatgggtctcggaatgattgcagatcagttgggagagctaaaacttggagaactactggattcaccacctcctggactggatgaagctattgcaatctccaaggttatgcaatttcttgaatcacaggaatatagcatgtttactcgaatagtatttgacactgcacctacgggtcatacattacgattgttgtccttgcctgatttcttggatgcatctattggcaagatactaaagctaagacaaaagatagcttctgctacatcagcaattaaatctgtgtttgggcaagaaaatacccaacagaattctgctgacaaattggagaaacttagggagagaatgttaaaagtgcgtgaactttttcgtgacactgattcgactgaatttgtcattgttacaatccccacggtgatggcagttagcgaatcatctagattgagtgcttccctgaagaaggaaaatgttcctgttaagagactggttgtcaaccagattcttccaccatccccatctgattgcaagttttgtgctatgaaaagaaaggatcagatgcgtgctcttgatttaattcagaatgatccagaactttccagcttattgatgattcaagcaccactagttgatgttgagataagaggtgttccggctctcaaatttcttggtgacattatttggaaatgacttacacacatatactcaagtaatgattaggttaaatttaggaatttgctgaagaaggccgttgagttatagacacgtgagatgacataaaggttcatcaaatttatgtaccgaaagctgcaaagcatgagagcggattctggtactggcacttcttacataggctagccactgccttccaatatttacaagctacagtttcaaaacattataacattttggtttttcacgttataaatattgttattgtaaatttattgttccagatcttgtatctctactatttttttagctcgcccatttgttgccagcaataatgatatttatgtttttgaaggcaatttcttctttcaacctccataaatctttcaattccaaaa

SEQ ID NO: 5627 - DNA, 1572 bp, Trigonella foenum-graecum
gtttgccgtggcagtatttgaatcaaagaaatcagttatattaagcaaaacttggtgacggtgtgagaagaaagagagtaaactaaaaatcatacataacagaaagaaagattacaagaattgaattgaaattgaaattgaattgaagtgaagtgaagaaataatggcatgctattctgcaatttcatcttctcttcgtataacaaattcaatggcggtaaagggtgttctctccttccctcccaccccttctcatctccttcccttcaacaaagccttcacctttgtttctttgcgcgcttccactaagtcacccatcaagtcttttcaagtgagatcggtggctgctcctacagaatctatagcgggatttgacgacatggttgctgggactgagaggaagtattacatgctaggtgggaaaggaggggtagggaagacaagttgtgctgcttcacttgctgttaaatttgcaaataatggacacccgactcttgtggtttccactgatccagcgcattctttgagtgattcttttgctcaggatttgacagggggagcattggtacaggtggatggacctgattatccacttttcgctcttgaaataaaccctgagaaggctcgggaagattttcgagatgcagctaagcaaaatggtggaactactggagtcaaagatttcatggatggcatgggtcttggaatgatagtagaccagttaggagagctaaaactgggagagttactggatacacctcctcctggactggatgaagctattgcgatttccaaggttatacaatttcttgaatcgcaggaatataatatgttcactagaattgtatttgatacggcacctaccggtcatacattacgtttattgtccttgcctgactttttggatgcatccatcgggaagatactaaagctaagacaaaagatagcttctgctacctctgcaattaaatccgtgtttgggcaagaaatactcgtcaagatgctgctgacaaattggagaagcttagggagaggatgataaaagttcgcgagctttttcgcgacactgattcgacagaatttgttattgttacaatccccacggtgatggcagttaatgagtcatctagattaagtgcatccttgaagaaagaaagtgttcctgtgaagagactcattgtcaatcagcttcttccagcatccgcgtctgattgcaagttttgtgctatgaaaagaaaggatcaaacacgtgctcttgatatgattcagagtgatccagaactctctagcttatcgatgatccaagcaccacttgttgatgttgagataagaggtgttcctgctctcaaatttctgggtgacattatctggaaatgactaatcacacagttattcaaatttgtgaagaacccataacaagagcacacaggacatgaaggcttatcagatttatacagtcaagtggtagctgctggaggagccagtaaagttttttttttattttttaatacatacatttctaaaagaaaaggaactagttattgtatattccctaatcaactaacttgtata

SEQ ID NO: 5628 - DNA, 1754 bp, Cicer arietinum
cgtatctgaatcaaagaaatgaacgtaataagcaaaacttggtgtgtgttagagtaaacgaaaagtgaagaagttatggcatgctattctacttcttctgtttcttcttctcttcgcataacaaattcaatggctatgaatggtgttctctcattccctcccacttcatctcctattcttcctttcaacaaagcctttacctttgtttctatgcgtgcttcaattaagccacccaccaactcatttcaagtaagatcagtggctactcctacagaatctgttgcggggtttgacgacatggttgctggaactgagaggaagtattacatgctaggtgggaaaggaggggtagggaagacaagttgtgctgcttcacttgctgttaaatttgcaaataatggacacccgactcttgtggtttccaccgatccagctcactctttgagtgattctttcgctcaggatctgacaggtggggcattggtaccagtggatggacctgattatccactttttgctcttgaaataaaccctgagaaggctagggacgattttcgcgatgcatctaaacaaaatggtggaactggagtcaaagatttcatggatggcatgggtcttggaatgatagtagaccagttaggagagctaaaactgggagagttacttgatacacctcctcctggactggacgaagctattgcgatttccaaggttatgcaatttcttgaatcacaggaatataacatgttcactcgaattgtatttgatacggcacctacaggtcatacattacgtttattgtccttgcctgatttcttggatgcatccatcgggaagatactaaagctaagacaaaagatagcttctgctacctctgcaattaaatccgtgtttgggcaagaacaaaatcgtccagatgctgctgacaaattggaaaaacttagggagaggatgataaaagtgcgcgagcttttccgtgacactgattcgacagaatttgttattgttacaatccccacggtgatggcagttagtgagtcatctagattaagtgcctcattgaagaaggaaaatgttcctgtgaagagactcattgtcaatcagattcttccaccatccgcatccgattgcaagttttgtgctatgaaaagaaaggatcaaacgcgtgctcttgatatgattcaaaatgatccagaactctccagcttatcgatgatccaagcaccactcgttgatgttgagataagaggtgttcctgctctcaaatttctgggtgacattatctggacatgactaatcacacatttattcaagtaatgatttggttaaatttactggagttggcagttttgtgaagaacccatcacttgagcgcatggcatcaaggcttatcagatggatacagtgaagtggtagctgctggaggaaccagaagtgtttttttttttttacatttcaaaaagaaagaaactacttattgtatattccctgatccactaatttatatctgaagctactttttagctctcattccccatacatatgggttttttagtgcttctttttttagggagaaatttctctaccccaacatgatttcgaatgtacacattgagaaaaatataaattgtgtcatctgaaaatatactttcaaacaaattatgccggttgaaaatacatttcgagttagtttatatttgtgatatttatttggttatgaatgaagagtgaagtgggctaagtatatagtctag

SEQ ID NO: 5629 - DNA, 1524 bp, Arachis hypogaea
ttcaacaactcatggcttctcacactctcatatcctcttcttctcttcgcatcacaaattcaatgcccatcaagtgtgttccctcctccttcactcccactaaagccttctcctttctctcactctctctttccacaactacaacaacaatccctactaaatcattccaagtgaggtcagttgctgctccaacagaatctgtagcagggtttgatgacatggtttctggcactcagaggaagtattacatgctaggcgggaaagggggagttgggaagacaagctgcgccgcttcgcttgctgtaaaattcgctaataatggacaccccacactcgtggtttccactgatccggcacattctttgagtgattcttttgctcaggatctgactgggggacaattggtgccggtggaaggacctgattatccactttttgctcttgaaataaacccagagaaggctagggaagagtttcgcaatgcaaccaagaaaaataggtggaactggagtcaaagactttatggatggcatgggtcttggaatgattgtagagcagttaggagagctaaaactcggagaattgttggatacaccacctcctggattggatgaagccattgcaatttcgaaggttatgcaatttcttgaatcacaggaatataatatgtttactcgaatagtatttgatacggcacccacgggtcatacattacggctcctttccttgcccgatttcttggatgcatccattgggaagatactaaagctacggcaaaagatagcttctgctacctcagcaattaaatcggtgtttggtcaagaggaaactcaacaagccgccgctgataaattggagaaacttagggagaggatgataaaagtgcgtgaactctttcgtgacactgatgcaacagaatttgttattgtcacaatccccacggtgatggcagttagtgaatcgtctagactgagtgcctccttaaagaaggaaaatgttcccgttaagagacttatcgtcaatcagattcttccgccctcagcatccgattgcaagttttgtgctatgaaaagaaaggatcaaatgcgagctcttgatatgatccagaatgatcctgagctagccagcctaacaatgatccaggcaccgcttgttgatgtcgagataagaggcgttccagctctcaaatttttgggtgacattatttggaaatgactataacatagttctaaatgcaatgatttccgatttccggccgagatgtaaaagttccggtactggaagtcctttagatgcaatgcactgtcttagaacagttatacaagctagagcttcagaaactgaaaacaacttgttaatacttgtgtaaatttccatcttctttagatctttttctttgatcattattttgaggaagagagccaaaacgagaggggggagggggtctcaatcatgtgtaagttttcactgtatactagcaagaaatatcagttatcggagcaacaattgcaaatgcaatagtgg

SEQ ID NO: 5630 - DNA, 1341 bp, Trifolium pratense
acggtgtgagaaacaacatagtaaaccaaaaccaaaactagtttgtttgtactttgtagtaatcataacagaaacaattgaagaagaaagaaaatggcatcttctactgcaatttcatcttctcttcgcataacaaattcaatggccataaagggtcgtctctctttccctcccactccatctcctctccttcctttccacaaagcctctacctttatttctttacgtgcttccaataagccacccaccaagtcttttcaagtgagagcagtggcaactcctacagaatctgtagcggggtttgacgacatggttgctgggactgagaggaaatattacatgctaggtgggaaaggaggggtagggaagacaagttgtgccgcttcacttgctgttaaatttgcaaataatggacatccgactcttgtggtttccactgatccagctcattctttgagcgattcttttgctcaggatttgacagggggagcattggtacaggtggatggacctgattatccactttttgctcttgaaataaaccctgagaaagctagggatgattttcgagatgcagctaaacaaaatggtggaagcaccggcgtcaaagatttcatggatggcatgggtcttggaatgatagtagaccagttaggagagctaaaactgggagagttactggatacacctcctcctggactggatgaagctatagcgatttccaaggttatgcaatttcttgaatcacaagaatataaaatgttcactcgagttgtatttgatacagcccctacaggtcatacattacgtttattgtccttgcctgatttcttggatgcatcaattgggaagatactaaagctaagacaaaagatagcttctgctacctctgcaattaaatccgtgtttgggcaagaaaagaatcctcaagatgctgctgacaaattagagaagctcagggagaggatgataaaagtgcgtgacctttttcgtgacactgattcgacagaatttgttattgttacaatcccaacggtgatggcggttaacgagtcatctagattgagtgcttccttgaagaaggaaagtgttcctgtgaagagactcatcgtcaatcaaattcttccaccatccgcatctgattgcaagttttgtgctgtgaaaagaaaggatcaaacgcgtgctcttgatgtgattcggagtgatccagaactctccagcttattgatgatccaagcaccacttgttgatgttgagattagaggtgttcctgctctcaaatttctaggtgacattatctggaaatgactcattacacagtttttcaagtaatgatcagtt

SEQ ID NO: 5631 - DNA, 1581 bp, Trifolium pratense
ctacttcaatttcatcttctcttcgcataacaaattcaatggccataaagggtcttctctttttccctcccactccatcccctctccttcctttccacaaagcctccacctttatttctttgcgtgcttccaataagccacccaccaagtcttttcaagtgagagcagtggcaactcctacagaatctgtagcggggtttgacgacatggttgctgggactgagaggaaatattacatgctaggtgggaaaggaggggtagggaagacaagttgtgccgcttcacttgctgttaaatttgcaaataatggacatccaactcttgtggtttccactgatccagctcattctttgagcgattcttttgctcaggatttgacaggcggagcattggtacaggtggatggacctgattatccacttttcgctcttgaaataaaccctgagaaagctagggatgattttcgagatgcagctaaacaaaatggtggaagtactggagtcaaagatttcatggatggcatgggtcttggaatgatagtagaccagttaggagagctaaaactgggagagttactggatacacctcctcctggactggatgaagctattgcgatttccaaggttatgcaatttcttgaatcacaggaatataaaatgttcactcgagttgtatttgatacagcccctacaggtcatacattacgtttattgtccttgcctgatttcttggatgcatcaattgggaagatactaaagctaagacaaaagatagcttctgctacctctgcaattaaatccgtgtttgggcaagaagaaaaatcctcaagatgctgctgacaaattggagaaacttagggagaggatgataaaagtgcgtgacctttttcgtgacactgattcgacagaatttgttattgttacaatcccaacggtgatggcggttaacgagtcatctagattgagtgcttccttgaagaaggaaagtgttcctgtgaagagactcatcgtcaatcaaattcttccaccatccgcatctgattgcaagttttgtgctgtgaaaagaaaggatcaaacgcgtgctcttgatgtgattcggagtgatccagaactctccagcttattgatgatccaagcaccacttgttgatgttgagattagaggtgttcctgctctcaaatttctaggtgacattatctggaaatgactcattacacagtttttcaagtaatgatcaggttaaatttagtaatttactgaagttggcagttttgtgaagaactcataacttaagcacatgacatcaaggcttatcagattttatacagtgaagtggtagctgctggaggaaccagatatttctttaatacatttcacaaagaaaagaaactagttattgtatattccatgatccagtagcttgtatttgaaactatttttagctctcattcccacattttggatttttcttgcttatctttttatcccatatgaaatgtaaatttcactgtatatttttgttatgcttttttgaagctgagttaatgcaacaccatcatccttttagtattacatggttgat

SEQ ID NO: 5632 - DNA, 1384 bp, Trifolium pratense
tgaagtaataacagaaagaagaaaatggcttcttacacttcttcttctgcaatttcatcatcttctcttcgcataacaaattcaatgcccataaagggtcttctctccttccctcccactccatctcctctccttccttttcacaaagcctctacctttatttctttgcgtgcttccaataagccactcaccaagtcttttcaagtgagagcagtggcaactcctacagaatctgtagcggggtttgatgacatggttgctgggactgagaggaagtattacatgttaggtgggaaaggaggggtagggaagacaagttgtgccgcttcacttgctgttaaatttgcaaataatggacacccgactcttgtggtttccactgatccagctcattctttgagcgattcttttgctcaggatttgacaggaggagcattggttcaggtggatggacctgattatccacttttcgctcttgaaataaaccctgaaaaagctagggatgattttcgagatgcagctaaacaaaatggtggaagtactggagtcaaagatttcatggatggcatgggtcttggaatgatagtagaccagttaggagagctaaaactgggagagttactggatacacctcctcctggactggatgaagctattgcgatttccaaggttatgcaatttcttgaatcacaggaatataaaatgttcactcgagttgtatttgatactgcccctacaggtcatacattacgtttattgtccttgcctgatttcttggatgcatcaattgggaagatactaaaactaagacaaaagatagcttctgctacctctgcaattaaatccgtgtttgggcaagaaaaaatcctcaagatgcggctgataaattggagaaacttagggagaggatgataaaagtgcgtgacctttttcgtgacactgatgcgacagaatttgttattgttacaatcccaacggtgatggcggttaatgagtcatctagattgagcgcctccttgaagaaggaaaatgttcctgtgaagagacttattgtcaatcagattcttccaccatccgcatctgattgcaagttttgtgctgtgaaaagaaaggatcaaacgcgtgctcttgatgtgattcggagtgatccagaactctctagcttatcgatgatccaagcaccacttgttgatgttgaaataagaggtgttcctgctctcaaatttctgggtgacattatctggaaatgactcattacagtttttcaagtaatgattagttggcagttttgtgaagaagaagaaagaacacataacttgagcacatgacatcaaggcttatcagatttatacagtgaagtggtagctgctggaagaaccaaaag

SEQ ID NO: 5633 - DNA, 1588 bp, Arachis hypogaea
cattctataaagtgctggtggcggtgagttaagcgtggaacggaaccacttctaactcccaagtcccaacttgtaaaagcagagcatgccattgttgctgggtattcaacaactcatggcttctcacactctcatatcctcttcttctcttcgcatcacaaattcaatgcccatcaagtgtgttccctcctccttcactcccactaaagccttctcctttctctcactctctctttccacaactacaacaacaatccctactaaatcattccaagtgaggtcagttgctgctccaacagaatctgtagcagggtttgatgacatggtttctggcactcagaggaagtattacatgctaggcgggaaagggggagttgggaagacaagctgcgccgcttcgcttgctgtaaaattcgctaataatggacaccccacactcgtggtttccactgatccagcacattctttgagtgattcttttgctcaggatctgactgggggacaattggtgccggtggaaggacctgattatccactttttgctcttgaaataaacccagagaaggctagggaagagtttcgcaatgcaaccaagaaaaatgggggaactggagtcaaagactttatggatggcatgggtcttggaatgattgtagagcagttaggagagctaaaactcggagaattgttggatacaccacctcctggattggatgaagccattgcaatttccaaggttatgcaatttcttgaatcacaggaatatagtatgtttactcgaatagtatttgatacggcacccacgggtcatacattacggctcctttccttgcccgatttcttggatgcatccattgggaagatactaaagctacggcaaaagatagcttctgctacctcagcaattaaatcggtgtttggtcaagaggaaactcaacaagccgccgctgataaattggagaaacttagggagaggatgataaaagtgcgtgaactctttcgtgacactgatgcaacagaatttgttattgtcacaatccccacggtgatggcagttagtgaatcgtctagactgagtgcctccttgaagaaggaaaatgttcccgttaagagacttatcgtcaatcagattctgccgccctcagcatctgattgcaagttttgtgccatgaaaagaaaggatcaaatgcgagctcttgatatgatccagaatgatcctgagctagccagcctaacaatgatccaggcaccgcttgttgatgtcgagataagaggcgttccagctctcaaatttttgggtgacattatttggaaatgattataacatagttctaaatgcaatgatttccgatttccgatttccggtcgagatgtaaaagttccggtactggaagtcctttagatgcaatgcactgtcttagaacacttatacaagctagagcttcagaaactgaaaacaacttgtcaatacttgtgtaaattttccatcttctttaaatctttttctttgattcattatttgaggtaagagagccaaaacgagagggggaggggtctcaatcatgtgtaagttttcactgtatactag

SEQ ID NO: 5634 - DNA, 1467 bp, Medicago truncatula
ctaaaaacgaaagaaagaaagaaagaaagaaaggattgaagatgaatatggcgtgccactcttcttctgcttcttctctccgcataacaaattcaatggctatcaagggtgctctctccttctctcccaccccatctcctctctttcctttccacaaagcttcctcctttgtttctttacgcttttccactaaaccacccaccaagtcttttcaagtgaaatcagtagctgctcctacagaatctatatcagtgtttgacgacatggttgctgggactgagaggaagtattacatgctaggtgggaaaggaggggtagggaagacaagttgtgctgcttcacttgctgttaaatttgcaaataatggacacccgactctcgtggtttccactgatcctgcacattctttgagcgattcttttgctcaggatttgacagggggagcattggtacaggtggatggacctgattatccacttttcgctcttgaaataaaccctgagaaggctagggaagattttcgagatgtagctaaacaaaatggtggaagtactggagtcaaagatttcatggatggcatgggtcttggaatgatagtagaccagttaggagagctaaaactgggagagttactggatacacctcctcctggactggatgaagctattgcgatttccaaggttatacaatttcttgaatcacaggaatataatatgttcactcgaattgtatttgatacggcacctactggtcatacattacgtttattgtccttgcctgatttcttggatgcatccatcgggaagatactaaagctaagacaaaagatagcttctgctacctctgcaattaaatctgtgtttgggcaagaaaatcctcgtcaagatgctactgacaaattggagaagcttagggagaggatgataaaagtgcgcgagctttttcgtgacactgattcgacagaatttgttattgttacaatccccacggtgatggcagttaatgagtcatccagattgagtgcctcattgaagaaagaaagtgttcctgtgaagagactcattgtcaatcaacttcttccaccatctgcatctgattgcaagttttgtgcaatgaaaagaaaggatcaaacacgtgctcttgatatgattcagagtgatccagaactctccagcctatcaatgatccaagcaccacttgttgatgttgagataagaggtgttcctgctctcaaatttctgggtgacattatctggaaatgactaatcacacagttattcaattttgtgaagaacccataacaagagcacacaagacatgaaggcttatcagatttatacagtcgagtggtagctgctggaggagccagaaagttttttttttttttaatacatacatttataaaagaaaagaaactagttattgtatattccctaatcaactaacttgtatatgaaactatttttt

SEQ ID NO: 5635 - DNA, 1406 bp, Arachis hypogaea
attcaacaactcatggcttctcacactctcatatcctcttcttctcttcgcatcacaaattcaatgcccatcaagtgtgttccctcctccttcactcccactaaagccttctcctttctctcactctctctttccacaactacaacaacaatccctactaaatcattccaagtgaggtcagttgctgctccaacagaatctgtagcagggtttgatgacatggtttctggcactcagaggaagtattacatgctaggcgggaaagggggagtcgggaagacaagctgcgccgcttcgcttgctgtaaaattcgccaataatggacaccccacactcgtggtttccactgatccagcacattctttgagtgattcttttgctcaggatctgactgggggacaattggtgccggtggaaggacctgattatccactttttgctcttgaaataaacccagagaaggctagggaagagtttcgcaatgcaaccaagaaaaatggtggaactggagtcaaagactttatggatggcatgggtcttggaatgattgtagagcagttaggagagctaaaactcggagaattgttggatacaccacctcctggattggatgaagccattgcaatttcgaaggttatgcaatttcttgaatcacaggaatataatatgtttactcgaatagtatttgatacggcacccacgggtcatacattacggctcctttccttgcccgatttcttggatgcatccattgggaagatactaaagctacggcaaaagatagcttctgctacctcagcaattaaatcggtgtttggtcaagaggaaactcaacaagccgccgctgataaattggagaaacttagggagaggatgataaaagtgcgtgaactctttcgtgacactgatgcaacagaatttgttattgtcacaatccccacggtgatggcagttagtgaatcgtctagactgagtgcctccttgaagaaggaaaatgttcccgttaagagacttatcgtcactcagattctgccgccctcagcatccgattgcaagttttgtgctatgaaaagaaggatcaaatgcgagctcttgatatgatccagaataatcctgagctcgccagcctaacaatgatccaggcgccgcttgttgatgtcgagataagaggtgtccggctctgaatttaggggtagacattattggaatactataacatagtctaatgacaatgttgacagtattaccgtagtttccggtcgagtatagtaaacgttccggtactaggtaagtacttagtatgacaatagctactgtcttagtaactacttaatactaagacgtagtacgtcttacaacgtaaacgtaagtaaaactaacttagtactaacttacgttagttaacg

SEQ ID NO: 5636 - DNA, 1566 bp, Trifolium pratense
tgaagtaataacagaaagaagaaaatggcttcttacacttcttcttctgcaatttcatcatcttctcttcgcataacaaattcaatgcccataaagggtcttctctccttccctcccactccatctcctctccttccttttcacaaagcctctacctttatttctttgcgtgcttccaataagccactcaccaagtcttttcaagtgagagcagtggcaactcctacagaatctgtagcggggtttgacgacatggttgctgggactgagaggaaatattacatgctaggtgggaaaggaggggtagggaagacaagttgtgccgcttcacttgctgttaaatttgcaaataatggacacccgactcttgtggtttccactgatccagctcattctttgagcgattcttttgctcaggatttaacagggggagcattggtacaggtggatggacctgattatccacttttcgctcttgaaataaaccctgaaaaagctagggatgattttcgagatgcagctaaacaaaatggtggaagtactggcgtcgtcaaagatttcatggacggcatgggtcttggaatgatagtagaccagttaggagagctaaaactgggagagttactggatacacctcctcctggactggatgaagctatagcgatttccaaggttatgcaatttcttgaatcacaagaatataaaatgttcactcgagttgtatttgatacagcccctacaggtcatacattacgtttattgtccttgcctgatttcttggatgcatcaattgggaagatactaaagctaagacaaaagatagcttctgctacctctgcaattaaatccgtgtttgggcaagaaaacaatcctcaagatgctgctgacaaattagagaagctcagggagaggatgataaaagtgcgtgacctttttcgtgacactgattcgacagaatttgttattgttacaatcccaacggtgatggcggttaacgagtcatctagattgagtgcttccttgaagaaggaaagtgttcctgtgaagagactcatcgtcaatcaaattcttccaccatccgcatctgattgcaagttttgtgctgtgaaaagaaaggatcaaacgcgtgctcttgatgtgattcggagtgatccagaactctccagcttattgatgatccaagcaccacttgttgatgttgagattagaggtgttcctgctctcaaatttctaggtgacattatctggaaatgactcattacacagtttttcaagtaatgatcaggttaaatttagtaatttactgaagttggcagttttgtgaagaactcataacttaagcacatgacttcaaggcttatcagatttatacagtgaagtggtagctgctggaggaaccagatattttttaatacattacacaaagaaaagaaactagttattgtatatttttatcttgcttttctttttatcccatcatccttttagtagtgttacatggttgatgacatcttaaacaaatgtgatttcaaattgacaatcatgtgctttgatatttaacattcc

SEQ ID NO: 5637 - DNA, 1307 bp, Castanea mollissima
gtttttaatttccagagtccaaagccgaaggatagtttctagtttctaccagaaaaaactatggctactcgtcttgtttcctccactttttcagctcctcttcacagcttagcttcaagaagctccatggccatggtgggtttggtctcttgctcacccaagacccttacaccattttctctcaccaaaagcttcaactttatctcactctccaccacaaggaaacctctcacaaaatcactccaagtgagatcagtgtctactcctgctgaaggtgttactgtgtttgatgatatggtttctgggaccaagcggaagtattacatgctaggcggaaagggaggggtagggaagacgagttgcgctgcctcacttgcagtaaaatttgctaacagtgggcaccccactctagtggtttccactgatcctgcacactccttgagtgattcttttgctcaggatttgactggagggacactggtaccagttgaaggacctgaatctccattgtttgctcttgagataaaccctgagaaggctagggaagaattccgcagtgcaactcagaaaaatggcggaactggggttcaggatttcatgaatggtatgggccttggaatgcttgccgatcagttaggagagctaaaactaggagagctgcttgaaacacctccccctggtttggatgaagctatggcaatatccaaggttattcaatttctggaatcacaagaatataacatgtttactcgtatagtttttgatactgcacccacgggtcatactttgcgccttttgtccttgccagacttcctggatgcatccataggcaagatattgaagctcagacagaaaatagcttcagccacctcagccatcaaatctgtttttgggcaagaagaaacccggatggatgcggctgacaagttagagaaactgcgggagaggatggtaaaagtgcgtgagctttttcgtgacacagattcaactgagttcgtcatagtaacaatccccacggtaatggcggttagtgagtcttctaggttgcgtgcctccttgaagaaggaacatgttcctgtaaagaggcttattgttaatcagatcctccccccttctgcctcagactgcaagttttgtgcaatgaaaagaaaggatcagtcgcgtgctcttgatatgattcgggatgatacagaactctccagcttggaattgatccaggcaccactagtagatgtagagattagaggtgttccagctcttaaatttttgggagacattatttggaaatgacaatctgcaatatgata

SEQ ID NO: 5638 - DNA, 1899 bp, Quercus alba
tttctaccaaaaaaactatggctactcgtcttgttccctctactttttcagcttctcttcacagcttagcttccagaagttccatggctatggtgggtttggtttcttgctctcccaagaccctcacaccattctctctcaccaaaagtttcaactttatctcactttccaccacaaggaaacctctcacaaaatcactccaagtgagatcagtgtctactcctgctgaaggtgttactgtgtttgatgatatggtttctgggaccaagcggaagtattacatgctaggtggaaagggaggggtagggaagacgagttgcgctgcctcacttgcagtaaaatttgctaacagtgggcaccccactctagtggtttccactgatcctgcacactccttgagtgattcttttgctcaggatttgactggaggaacactggtaccagttgaaggacctgattctccattgtttgctcttgagataaaccctgagaaggctagggaagaattccgcagtgcaactcagaaaaatggtggaactggggttcaggatttcatgaatggtatgggcctcggaatgcttgccgaccagttaggagagctaaaactaggagagctgcttgagacacctccccctggtttggatgaagctatggcaatttccaaggttattcaatttctggaatcacaagattataacatgtttactcgtatagtttttgatactgcacccacgggtcatactttgcgtcttttgtccttgccagacttcctggatgcatccataggcaagatattgaagttcagacagaaaatagcttcggccacctcagccatcaaatctgtttttgggcaagaagaaacccggctggatgcggctgacaagttagagaaactgcgggagaggatggtaaaagtgcgtgagctttttcgtgacacagattcaactgagttcgtcatagtaacaatccccacggtaatggcggttagtgagtcttctaggttgcgtgcctccttgaagaaggaaaatgttcctgtaaagaggcttattgttaatcagatcctccccccttctgcctcagactgcaagttttgtgcaatgaagagaaaggatcagtcgcgtgctcttgatatgattcggaatgacacagaactctccagcttggaattgatccaggcaccactagtagatgtagagattagaggtgttccagctcttaaatttttgggagatattatttggaaatgaccatctgcaatatgataagcaatgacagtcactcttgattgtatggcttggcatgttgatgtagtcaagagttgtggcgcatccaagttataggaagctgttcagttaacaaagatcccgaagtctgaactttgggatgtcaaaaaaaagggtggcaccaatatgaatttgggatggattgcatgaccccactgtacttcttgcccccaaaatgtttggacagagtatagaaacttttttccattaaaaaaaattccaaaaatgtatttattcggcatgaattttactagcaattgagagtcataagtcttgcatatattctcaacgaaaaatgacgaccccaatatcttatggtttctttcagccagcctggtttataaagaaaaaggggaagaaaagtggacacaaatttcccaataaatttacctcaggaatttgataatgtcacaagtgttatattatttattcacataaaagtggctttagatatgttcaattcatcacaggaaagaagatatataatggttgatgctcaatcatcttatatccctttgtttggattccagtatattgttattgaagcaaccaattgcaatttttatccagcaagttcttaactttcctgttcttctaatttacaaactcgcgatat

SEQ ID NO: 5639 - DNA, 1340 bp, Citrullus lanatus
gaaaactactttcattcactagagaagccatagccatgggaagcttgtgtcttccttctactttccctcctcgtattcgcagcttaactgcaagaaattccatggcaatggcagctttcttctctcatcaccccaagattttgcctcaacccttcctcgccaaaaccttccgcttcatttctctttcaacttcgacaaaaccgcccagaaagcttttccaagtgaggtcagtggctacccctgcagaaggtattgcagggtttgagagcatgatctctggaaccgagcggaagtattacctgttaggtgggaaaggtggtgttgggaagacaagttctgctgcctctctagctgtgaagtttgcaaatagtggccaccccacgcttgttgtttctactgatccagcacattcgttaagtgattcatttgctcaggatttgactggtggtacactggtgccagttgaaggtcctgactctccattatttgcccttgagataaaccctgaaaaggctagggaggaattccgcagtacagctcaaaaaaatggtggaactggcgtaaaagatttcatggatggcatgggccttggaatgcttgtagaccagttaggagagctgaaactcggagaattgctggacacaccacctcctggtttggatgaagctatagcaattgcgaaggtcattcaatttcttgagtctccagagtataacatgtttactcgcatagtttttgacactgcacctacgggtcatactttgaggcttctatccttgccagacttcttagatgcttccataggcaagatattgaagcttagacaaaaaatagcttcagcaacctcagccattaaatctgtatttggacaagaagaaaagcggcaagatgcagctgacaaattagagagattaagagagagaatggtaaaagttcgtgagctttttcgtgacaaggaatctacggaatttgtcatagttacaatccccacggttatggctgtgaacgaatcatcaagattgcatgcttctctgaaaaaggaatctgtccctgtcaagaggcttattgtgaatcagattcttcctccgtcagcatcagattgcaagttttgtgcaatgaaaagaaaggatcaacttcgcgctttggatctcatccgaaacgatccagaactctcgagcttgttggtgattgaggcaccattagtcgatgtggagattcgaggtgttccagctcttaaatttctcggagacatcatttggaaatgactgtattgtccaagaaaccacaaagcgatttgcaggtaacttttttgttacccacttttatggttcttaactttt

SEQ ID NO: 5640 - DNA, 1664 bp, Euonymus alatus
ggctactcttcgtttaattaccagaaagtgaaagaaggcaacagaatatggcagcttctcctgcttgttgtagagtcccttctatatgttcacctttgctgcccgccaaaagcaaaaactccattgcaccgttgggttctttctctttctctcctaaagcccaccggcgaataccatcgcttgccactggcttcgtctctccctctatcaagaacaagcgtcaccgatgtccacttcaagttagatcagtggctgttcctgctgaagctgctgttgggtttgatgaaatggtttctgggacgcaacgcaaatattatttgcttggtggaaagggtggtgtagggaagaccagctgtgctgcttcacttgctgtaaaatttgccaacaatggtcatgcaactcttgtggtttcaaccgatccggcacattcattgagtgattctttttctcaggatttgactggagggacactaatacaagttgaagggcccgattcaccactgtttgctcttgagataaacccagagaaggcaagagaagaattccgaaatgtttctcagaagaatggtggaactggagtcaaagattttatggatggcatgggccttggaatgattgtagaacagttgggagagttgaaacttggagagcttctggacacacctcctcctggtttggatgaagctattgcaatttccaaagttatagaatttcttgaatcggaagaatatagtatgtttactcgaataatttttgatacggctcccacgggtcatacattgcggcttttgtctttgccagatttcttagatgcatccataggcaagatattgaagcttagacagaaaatagcttcagccaccaatgctatcaagtctgtttttggccaagaagaaactcggcaggatgctgcagataaattggagaagctgagggagaggatgataaaagtgcgcgagctttttcgtgatacagattctacagagttcgtcatagtaacaatacccacggttatggccatcagcgagtcatccaggctacatgcctccttaaagaaggagaatgttcctgtcaagaggcttattgttaatcagattgtacccccttctgcttcagactgcaagttttgtgcaatgaaaaggaaggatcaaatgcgtgctctagatatggtaaacggtgatccagaactctctagcttgacgttgatccaagctcccttagttgacgtcgagattagaggtgttccagctcttcaatttatcggtgatattatctggaaatgaccatctgttcccttatacacaataatgcagggctccatcaagttccatcacagttctatatggagcttaacctcaaaatctaccaatcaagatctggagcatgagatgacaccctgctgaggaagtttgatttcaatattattttttcccgtctacattttctgtaatgcttgtaaattgagggaaaaaaggggtgtaagagtacagattggaattcagtactaaattttgctgccaaggcttgtggctagtcataggaaatgaagctgaaagatttttttttaatcataattttatctttcctgaactttctttcctgtaattgtccagttgatggacccccaactcttattcaatgagaatagaacacagtatttgtgc

SEQ ID NO: 5641 - DNA, 1614 bp, Ricinus communis
aaaaaacacgcctctgtccatcaccagaaaacacaaaagaaaagaatacaatggccactatcgcttcctgtatcgtaactcattctacttcttccttttctcttcacaatctattcactccaagaaactctatgtcagcggtgggtttgctctcttttgcaccaagaacccgcacctctccctctcttgctacaagccttatcgctttctctgtcaagcaaaagcctggcaggaattcacttcaagtgagatcagtggctgctccagcagaagatgttgctggatttgatgagatggtttctggcacacaacggaagtattacatgcttggtggaaagggaggagtaggaaagacgagctgtgctgcttcacttgctgtgaaattcgcaaataatgggcaccccactttagtggtttcaactgatccagcacattccttgagtgattcgtttgctcagaatttagctggagggacattagtaccagttgaaggacctgattatccactgtatgcacttgagataaaccctgaaaaggctagggaagaatttcgcggtgctagtcagaaaaatggaggaactggggtcaaagatttcatggaaggcatgggcctcggaatgattgttgaacagttaggagagttgaaattgggagagctactggacacaccgcctcctggtttggatgaagctatagcaatttcaaaagtgatgcaatttctagaatcacaagaatataaaatgtttactcgaatagtttttgacactgccccaacgggacatacattgcgactgttgtccttgccagacttcctggatgcatccataggcaagatattgaagcttaaacaaaaaatatcttccgccacatctgccatcaaatctgtttttggacaagaagaaactcgacaggatgctgctgataagttggaacggctgagggaaaggatgataaaagtccgtgagctttttcgtgatactgactccactgagtttgtcgtagtaacaattcccacggtaatggcaattagtgaatcatctaggttgcatgcctccttgaagaaggagaatgtcccagttaagagacttattgttaatcaaattcttcctccatctgcctctgactgcaagttctgtgcaatgaaaagaaaggatcagacgcgtgctcttgatatgatacaaagcgatccagaactctccagcttgacattgatacgggcgcccttagttgatgtagagatcaggggtgttccggcgcttcaatttttaggagacattatatggaaatgagtatctgtaaaatatgtagcaatatattgttggacattttaatctctggtaggctttaatacacatagaatcaaatcatccatacaaaatcaaaatattgatgttcacacgaaccagatcttccagctacacttttttagcaacttacatgggaagcaattttttccagtggaaattacaaaacatggaagaaggtgaatcccccaatatggcaagttacagttgatccagatggtatatttgcttggtgcaaacccatctcgagggatctgaaggagaagcatctcattgtcttaaactttgctttgaccttttatctttagtt

SEQ ID NO: 5642 - DNA, 1288 bp, Cucumis sativus
gaagaaaactactttcattcactagagaagccatagccatagtcatggggagcttctgtcttccttctactttctcttcttgtattcgcagttccgctgcaacaaattccatggcaatggcagcttttctctctcatcaccccaagattttacctcaacccttcctctccacaaccttccgcttcatttctctttcaacttcaacaaaaccgcctcgaaaacttttccaagttagatcagtggctacgcctgcggaaggtattgcagggtttgagagtatgatctctggaaccgagcggaagtattacctgttaggtgggaaaggaggtgttgggaagacaagttctgctgccgctctagctgtgaagtttgcaaatagtggccaccccacgcttgttgtgtctacggatccagcacattcgttaagtgattcatttgctcaggatttgactggcggtacactggtaccagttgaaggtcctgactctccattatttgcccttgagataaaccctgagaaggctagggaggaattccgcactactgctcaaaaaaatggtggaactggcgtaaaagatttcatggatggcatgggccttggaatgcttgtagaccagttaggagagttgaaactcggagaattgctggacacaccgcctcctggtttggatgaagctatagcaattgcaaaggtcatccaatttcttgagtctccagagtataacatgtttactcgcatagtttttgacacagcacctacgggtcatactttgaggcttctatccctcccagacttcttagatgcttccataggcaagatattgaagcttaggcaaaaaatagcttcagctacctcggccattaaatctgtatttgggcaagaagaaaagcggctggatgcagctgacaaattagagagattaagagaaagaatggtaaaagttcgcgagctttttcgtgacaaagaatctacggaatttgtcatagttacaatccccacggttatggccgtaaatgaatcatcaaggttgcatgcttctctgaaaaaggaatctgtccctgtcaagaggcttattgtgaatcagattcttcctccgtcagcatcagattgcaagttttgtgcaatgaaaagaaaggatcaattgcgtgctttggatctcatccgtaacgacccagaactctcgagcttgttggtgatcgaagcaccattagtcgatgtggagattcgaggtgttccagctcttaaatttcttggagacatcatttggaagtgaatgttttgctggta

SEQ ID NO: 5643 - DNA, 1553 bp, Trigonella foenum-graecum
ctcttcgcatttgcattagtagccctctgcgcaaaactccgtcttcctagtgccgaccaccatcatcttcaccgtcgaacatctcagctcgtcgtagcccctatcgttccatatctctggtacagaaacagcaatggacgagaacgacgtatccaacgaagttgtgaaagggaagaagaaagggaaacacgataaaccaaaaccatgggatgacgatcctaacatcgaccactggaaggttgagaaattcgatccatcatggaatgaaagtggaatgcttgaagtcagttccttctccactcttttccctcaataccgcgaaaaatatcttcaagaagcttggccactcgttaaatcctcactcaaagaatttggtatctctgcagaactcaatttggttgaaggttcaatgacagtttcgacaaccagaaagactagggatccttatattattgttaaagctagggatcttatcaggcttctttctcggagtgttcctgctccacaggcaataaaaataattgacgatgaaatgcaatgcgacatcattaaaattagtgggttggttcgcaacaaggagcgattcgtaaaaagaaggcaacatcttgtgggtcccaattcttccaccttgaaggctcttgaaatactcacaggttgttacattctcgtccagggaaacactgtttctgtgatgggttcgtacaaaggtttgaagcaagtccgaaggattgttgaggaatgcatgctgaataaattgcaccctgtctacaacattaagatacttatgatgaagaaggaacttgaaaaagatcctgcacttgctcaagagaactgggataggtttctcccaaagtttaacaataaaaatgtaaagcaaaagaaggttaccgctaaaccgaagaaaccatatactcctttccctcctcctcagcagcctagtaaggttgatatacaattagaaactggagaatactttatgagtgacaaaaagaaatcagcaaagaaatggcaagagaggcaagtgcagcaggcagaaaaaactgctgaaaacaaaagaaaaagagacgagtcctttatcccacccaaggaacctacaaaactggtggataactctgaggatgctaataatgtagctgaaataacattgtccttaaaggaaaaagctaggaagtttgggaagcgcaaatctgaagaaaatataaatgctgagacatatattatggggtcatcagaacaaccatcaaaaaagaaatctaagaagcaaaagtcttaacctgatcttcattctagagatggaatatgcgcgcatgtgatgcaaatttaatccagaaattttgatccaatgtctttaacatgtcacttctggtccttatacaacttttccctttcaaaatcggtgtcgcacacttgcgtataatatccaatgtcttcttgagtaactgatgacatatatttggtttatttggtaaatttggtgttgtaccattttgggagttgtggaagtagaatccaaacattttaatcagaagtttgcttatttacacaccctatca

SEQ ID NO: 5644 - DNA, 1546 bp, Trifolium pratense
aaaccctaacaaacattcaacattttactctctcccccgtccggcccctacccgtcgcatatatcactcctccgccgtcacactcaccggaccccgcccctactccaccgcaatggacgaaaacgacgtaacaaacgaagtagtgaaaacaaagaagaaaggtaaacacgataaaccaaaaccatgggacgatgatcctaacatcgaccattggaaagttgagaaattcgatccatcatggaacgaaggtggaatgcttgatgtaagttcattctccactctcttccctcaatatcgtgaaaagtatcttcaagaagcttggccactcgttaaatcgtcgctcaaagaatttggtatctctgctgaactcaatttggttgaaggttcaatgacagtttcaacaactagaaaaactaaggatccttatattgttgttaaagctagggatcttatcaggcttctttctcggagtgttcctgcaccgcaggcaataaaaatacttgatgatgaaatgcaatgtgacatcattaaaattagcgggttggttcgcaacaaggagcgattcgtaaaaagaagacagcatcttgtgggtcccaattcttccaccttgaaggctcttgaaatactcacaggctgttacattctcgtccagggaaacacggtttctgtgatgggttcatacaaaggtttgaagcaggtcagaaggattgttgaggaatgtatgttgaataaaatgcaccctgtctacaacattaagattcttatgatgaagaaggaacttgaaaaagatcctgcacttgcccaagagagctgggataggtttctcccaaagtttaacaagaaaaatgtaaaacaaaagaaggttagcgctaaacagaagaagccatatactcctttccctcctcctcaacagcctagtaaggttgatatacaattagaaactggggaatactttatgagtgacaaaaagaaatccgcaaagaaatggcaagagaggcaggagaagcaggcggaaaaaactgctgaaaacaaaagaaaacgagacgaatcctttatcccacctaaggaacctacaaaactggtggataattctgaggatgctaataataatgtatctgaaatggcaatgtccttaaagaaaaaggcaaagaagtttgggaagagcaaatccgaagaaaatataaatgctgaggcatacattatagggtcatcagaccaaccatcaagaaagaaatctaagaagcaaaggtcttagcatgatattcattataaagatggaagatgcacatgtgatgtgattttcatccataaattttgatccaatgactgtaatgtctgtaacatgtatacttctgttccctatacaacttttcgtctctttcaaaatcattgccagattcgtacgtataatatccatggattcttgagttactgataaactatatttcatttgctaaatttggtgtaataccattcttctgggagtagtgggggaagaatggaaacattttaatatagcagtggtgcaacgcaatgtggtatttgt

SEQ ID NO: 5645 - DNA, 1471 bp, Trifolium pratense
cccgtcgcatacatcactgctccgccgtcacactcaccggacctccgccctcactccaccgcaatggacgaaaacgacgtaacaaacgaagtagtgaaaacaaagaagaaaggtaaacacgataaaccaaaaccatgggacgacgatcctaacatagaccgttggaaagttgaaaaattcgatccatcatggaacgaaggtggaatgcttgaagttagttctttctccactctcttccctcaatatcgtgaaaagtatcttcaagaagcttggccactcgttaaatcttcgctcaaagaattttgtatctctgctgaactcaatttggttgaaggttcaatgacagtttcaacaactagaaaaactaaggatccttatattattgttaaagctagggatcttatcaggcttctttctcggagtgttcctgctcctcaggcaataaaaatacttgacgatgaaatgcaatgcgacatcattaaaattagcgggttggttcgcaacaaggagcgattcgtaaaaagaagacagcatcttgtgggtcccaattcttccaccttgaaggcgcttgaaatactatcaggctgttacattctcgtccagggaaacacggtttctgtgatgggttcatacaaaggtttgaagcaagtcagaaggattgttgaggaatgtatgttgaataaaatgcaccctgtctacaacattaagattcttatgatgaagaaggaacttgaaaaagatcctgcacttgcccaagagaactgggataggtttctcccaaagtttaacaagaaaaatgtaaaacaaaagaaggttagcgctaaacagaagaagccgtatactcctttccctcctcctcaacagcccagtaaggttgatatacaattagaaactggagaatactttatgagcgacaaaaagaaatcggcaaagaaatggcaagaaaggcaggagaagcaggcagaaaaaactgctgcgaacaaaagaaaacgagacgagtcctttatcccacccaaggaacctacaaagcctgtggataactctgaggatgctaataataatgtagctgaaatggcaatgtccataaagaaaaaagcaaagaattttgggaagcgcaattctgaagaaaatatagatgccgagacatacattatggggtcatcagaacaaccatcaagaaagaaatctaagaaacaaaagtcttagcatgatcttcattctgaaagatggaagatgttcatccataaattttgatcctatgttgtctgtaacatcgtcacttctcatccctatacaatttttcccttacaaaatcgttgccgccagacacttaagtataatatccaatgtcttgagttactgataagctatatttgattcatttgctaaatttggtacagtactatcttgggtgttttgggagaaattgtaacattttaatataggttgataccttttaagtttacttctt

SEQ ID NO: 5646 - DNA, 1615 bp, Trifolium pratense
aggaatcataaattgaacggaaaccctaacaaacattcaacattttactctctcccccgtccggcccctacccgtcgcatatatcactcctccgccgtcacactcaccggaccccgcccctactccaccgcaatggacgaaaacgacgtaacaaacgaagtagtgaaaacaaagaagaaaggtaaacacgataaaccaaaaccatgggacgatgatcctaacatcgaccattggaaagttgagaaattcgatccatcatggaacgaaggtggaatgcttgatgtaagttcattctccactctcttccctcaatatcgtgaaaagtatctccaagaagcttggccactcgttaaatcgtcgctcaaagaatttggtatctctgctgaactcaatttggttgaaggttcaatgacagtttcaacaactagaaaaactaaggatccttatattgttgttaaagctagggatcttatcaggcttctttctcggagtgttcctgctcctcaggcaataaaaatactcgacgatgaaatgcaatgcgacatcattaaaattagcgggttggttcgcaataaggagcgatttgtaaaaagaagacagcatcttgtgggtcccaactcttccaccttgaaggctcttgaaatacttacgggctgttacattctcgtacagggaaacacggtttctgtgatgggttcatacaaaggtttgaagcaagtcagaaggattgttgaggaatgtatgttgaataaaatgcaccctgtctacaacatcaagattcttatgatgaagaaggaacttgaaaaagatccagcacttgcccaagagagctgggataggtttcttccaaagtttaacaagaaaaatgtaaagcaaaagaaggttaatgctaaacagaagaagccgtatactcctttccctcctcctcaacagcctagtaaggttgatatacaattagaaactggggaatactttatgagtgacaaaaagaaatcggcaaagaaatggcaagagaggcaggagaagcaggcggaaaaaactgctgaaaacaaaagaaaacgagaccaatcctttatcccacctaaggaacctgttaaaccggcggataactcagaggatgctaataataatgtatctgaaatggcaatgtccttaaagaaaaaggcaaagaagtttgggaagagcaaatctgaagaaaatataaatgctgaggcatacattatagggtcatcagaccaaccatcaagaaagaaatctaagcagcaaaggtcttagcatgatcttcattattaagatggaagatgtgcatgtgattttcatccataaattttgatccaatgtctgtaatgtctgtaacatgtatacttctgctccctatacaacttttcgtccctttcaaaatcattgacagattcgtacttttaatatccatgtattcttgagttactgataacctatatttgatttgctaaatttgctgtaataccattctgggagttgtcggagaagaatggaaacattttaattgataccttttaaatttacttattttcaatgaaactaaagtgagtacacaacaaatgttgttgcaatgaatagatatttttgaaaaatg

SEQ ID NO: 5647 - DNA, 1738 bp, Cicer arietinum
cttttttaattttaattgaaaaaaaaaaaagaaaaaagaatcaaaggcagccctaactcacacgaaccatatcatacatcacagagctccgccgcaccggctaactgattcgccgttcccgaaagcgaaatggacgagaacgaattaagaaacgaagtagtagtgaaagagaagaagaagaaagggaaacacgataaaccaaagccatgggacgatgatccgaacatagaccactggaaagtcgagaaattcgatccatcatggaacgaaggtggaatgcttgaagtaagttcattctcaactctctttcctcagtatcgcgaaaagtatcttcaagaagcttggcctctcgttaaatcttcgctcaaagatttcggtatctctgctgaactcaatttggttgaaggttcgatgacagtttcaacaactagaaagacgaaggatccttatattattgttaaagctagggatcttatcaggcttctttctaggagtgttcctgctcctcaggcaataaaaatacttgacgatgaaatgcaatgcgacatcattaaaattagtgggatggttcgcaataaggagcgattcgtaaaaagaagacagcatcttgtgggtcccaattcttctaccttgaaggctcttgaaatactctcaggctgctacattctcgttcagggaaacacagtttctgtgatgggttcattcaaaggtttgaagcaagtcagacggattgttgaggaatgcatgttgaataaaatgcaccctgtttacaacatcaaggttcttatgatgaagaaggaacttgagaaagatccagcactcgccgaagagaactgggataggtttcttccaaagttcaacaagaaaaatgttaagaaaaagaaggctaactctaaacagaagaagccttatacacctttccctcctcctcaacagcccagtaaggtcgatatacaattagaaactggagaatactttatgactgagaaaaagaaatcggcaaagaaatggcaagagaggcaggaaaagcaggcagaaaaaactgctgaaaacaaaagaaaacgagaagaggcctttatcccacccaaggaacatgcaaagccggtggataactctgacgatgctactaataatgtatctgaaatggcaatgtccttaaagaaaaaagccaagaagtttgggaagcgcaaatcggaagaaaatataaatgctgagacatatattatggggtcatctgaacaaccatcaaaaaagaaatctaagcagcataggtcttaacataatcttcattctatagatggaaggtgtgcatgtgacgtgaattccatccagaaattttgatccaatgactgtaatgtagcatgtatacttctggttttcaaacgacttatccctttcaaaactgttgccagatacctataatagatccaatggattcttgagttatggacgagctatatttaattcatttgctaaatttggagcagtatcaattgggttagataagaagaaatgaacattttaatctaggttgttacatttttagtttacttatgttttcagtgaaactaagatgaatatataatgaaaatcactgataaaaaagtgggactttagtctagttgctaaactccaatggtttaatctagtggtaaaaataaagatatttgatccactagttgtggcattcggtctgataagctagttgtggcattcggtctgattagtttcatttgag

SEQ ID NO: 5648 - DNA, 1712 bp, Cicer arietinum
gcttctttttcaacttttattaaaaaaaaaaaaaaaaaaagatagaagaaaaataataaacaaaagcacacagcccttgctcacacaaaccacatcatctatcataaacctccgccgcaccggctaactgatccgccgtaacctttccagaaagcgaaatggacgagaacgaattaagaaacgaagtagtgccaaaagagaagaagaagaaagggaaacacgataaaccaaaaccatgggacgacgatccgaacatagaccactggaaagtcgagaaattcgatccatcatggaacgaaggtggaatgcttgaagtaagttcattctcaactctcttccctcagtatcgcgaaaagtatcttcaagaagcttggcctctcgttaaatcttcgctcaaagatttcggtatctctgctgaactcaatttggttgaaggttcgatgacagtttcaacaactagaaagacgaaggatccttatattattgttaaagctagggatcttatcaggcttctttctaggagtgttcctgctcctcaggcaataaaaatacttgacgatgaaatgcaatgtgacatcattaaaattagtggaatggttcgcaacaaggagcgattcgtaaaaagaagacagcatcttgtgggtcccaattcttccaccttgaaggctcttgaaatactctcgggctgctacattctcgttcagggaaatacggtttctgttatgggttcattcaaaggtttgaagcaagtcagaaggattgttgaagaatgcatgttgaataaaatgcatcctgtttacaacatcaaggttcttatgatgaagaaggaacttgaaaaagatccagcactcgccgaagagaactgggataggtttcttccaaagttcaacaagaaaaatgtaaagaaaaagaaggctaactctaaacagaagaagccttatactcctttccctcctcctcaacagcccagtaaggtcgatatacaattagaaactggggaatactttatgactgagaaaaagaaatcggcaaagaaatggcaagagagacaggaaaagcaggccgaaaaaactgctgaaaacaaaagaaaacgagaagaggcctttatcccacccaaggaacatgcaaaaccagtggataactctgaggatgctaataataatgtatctgaaatggcaaagtccttaaagaaaaaagccaagaaatttgagaagcgcaaatctgaagaaaatataaatgctgagacatatattatggggtcatctgaacaaccatcaaaaaagaaatctaagcagcataggtcttaacataatcttcattctatagatggaaggtgcgcatgtgatgtgaattccatccagaaattttgatccaatggctgtaacatactcctggttcataaatgacttttccctttcaaaattgttgccagacacttactcataatatatccaatggattcttgagttatgggcgacctatatttgattcatttgctaaacatgctgcagtatagttttgagtgtagttggattagaagaaatgaaacattttaatctaggttgttacattttaagtttacttaattttttgtgaaactaaaatgaatacacaatcaatcacagtaaaaaggcagatcttagtctagtgccaaaactccaaaggattagtctagttgtaaaaataaagatcttttattcacatattgtcag

SEQ ID NO: 5649 - DNA, 1244 bp, Glycine max
aacagaagaaagtgcaccggaaagaaagcagaaagcagaaagcagcgatggaaatccactcagaggaggagaatggcgtagcgaacgagtcacaagcacttgagcagaaggagaagcgaaaggggaagcacgacaagcccaagccatgggacgacgacccaaacatcgaccactggaagatcgagaagttcgacccttcatggaacgacggcggcatgctcgaagtgagctccttctccactctctttcctcagtaccgcgaaaagtacctccaagaagcttggcccatggtcaaatccgctctcaaggaattcggcgttgcttgcgaactcaacctcgttgagggttctatgacagtttcaacaaccagaaagactagggatccctatattatcatcaaagccagggatcttatcaagcttctatcacgaagtcttcctgctcctcaggcgataaaaatacttgacgatgaaatgcaatgtgacatcattaaaatcagtggcatggttcgcaataaggagcgatttgtaaaaagaagacaacatcttgtgggtcccaattcttccaccttgaaggctcttgaaatactcactggctgctacattctcgtccagggaaacacagttgctgctatgggttcattcaaaggcttgaagcaagtcagaagaattgttgaagaatgcatgctgaataaaatgcatcctgtatacaacattaaggttcttatgatgaagaaggaacttgaaaaggacccagcacttgcccaggagaactgggacaggttccttccaaaattcaagaagaaaaatgttaagcaaaagaaggttaacactaaacagaagaaaccatacactcctttccctccacctcaacagcccagtaagattgatatacaattagagactggagaatactttttaagtaacaagaggaaatcagcaaagatatggcaagagaagcaggagaagcaggctgaaaaaactgctgaaaacaaaaggaaaagagaagaggcctttatcccacccaaggagcctgcaaacctggtggataaatctgaggatgctaacagtaatgtagctgacatggcaatgtccttaaagaaaaaaacaaagaagtttgggaagcgtaaatctgaagaaaatataaatgccgagacatatattataggatcatcagaacaagcatcgggaaagaaatccaagaagcaaaggtcttaaacataatcttcattttggagatgaaaa

SEQ ID NO: 5650 - DNA, 1627 bp, Glycine max
cgatttagcgtcccacaaaacctgaaaacctaacagaagaaagtgcaccggaaagaaagcagaaagcagaaagcagcgatggaaatccactcagaggaggagaatggcgtagcgaacgagtcacaagcacttgagcagaaggagaagcgaaaggggaagcacgacaagcccaagccatgggacgacgacccaaacatcgaccactggaagatcgagaagttcgacccttcatggaacgacggcggcatgctcgaagtgagctccttctccactctctttcctcagtaccgcgaaaagtacctccaagaagcttggcccatggtcaaatccgctctcaaggaattcggcgttgcttgcgaactcaacctcgttgagggttctatgacagtttcaacaaccagaaagactagggatccctatattatcatcaaagccagggatcttatcaagcttctatcacgaagtcttcctgctcctcaggcgataaaaatacttgacgatgaaatgcaatgtgacatcattaaaatcagtggcatggttcgcaataaggagcgatttgtaaaaagaagacaacatcttgtgggtcccaattcttccaccttgaaggctcttgaaatactcactggctgctacattctcgtccagggaaacacagttgctgctatgggttcattcaaaggcttgaagcaagtcagaagaattgttgaagaatgcatgctgaataaaatgcatcctgtatacaacattaaggttcttatgatgaagaaggaacttgaaaaggacccagcacttgcccaggagaactgggacaggttccttccaaaattcaagaagaaaaatgttaagcaaaagaaggttaacactaaacagaagaaaccatacactcctttccctccacctcaacagcccagtaagattgatatacaattagagactggagaatactttttaagtaacaagaggaaatcagcaaagatatggcaagagaagcaggagaagcaggctgaaaaaactgctgaaaacaaaaggaaaagagaagaggcctttatcccacccaaggagcctgcaaacctggtggataaatctgaggatgctaacagtaatgtagctgacatggcaatgtccttaaagaaaaaaacaaagaagtttgggaagcgtaaatctgaagaaaatataaatgccgagacatatattataggatcatcagaacaagcatcgggaaagaaatccaagaagcaaaggtcttaaacataatcttcattttggagatgaaaaatgagcatgtgatgtctatgttaattcaatcaagatcttctgcatccaatgtctttgcagtaacagttttgacaccaatgtattttgaggcatagttgttcattccatttgtcatggagatgagtgcgtggcattgtgtatcttattgtacttgccaatagacagtaagtcagtatcatgtacactacctgttatttaagttttacatcttttccatttcaaaaacattgtccgacacacatggtgatgctatatctgtagttttgactatgatttatttgttatattttttctagtcccaaagaaaagggaaaaagaatcagaaaacatttattcgagcgttaaaaaaaaa

SEQ ID NO: 5651 - DNA, 1508 bp, Lotus japonicus
atccaattcccaaattcttcaccgacaagcatccatcattggaggcggaaactctggttctcttcccctcaccggagccaccgtcatccctcaccggagccacgtccgtccaccattcttcaccggagctacaattctccatttctcttcccgactcatcactcaccaccatctcagccatggctgaagaagactacaacaacggcgcaaccaacgaagcaccgaaggagaacaccaagcggaaggggaagcacgacaagccgaagccatgggacgacgaccccaacatcgaccggtggaaggtcgagaagttcgatccttcatggaacgaaggcggcatggtcgaagtgagttccttctccacactcttccctcagtatcgcgagaagtatcttcaagaagcatggcctctcgtgaaatcttctctcaaagaattcggcgtctcctgcgaactcaatttggttgagggttcgatgacggtttcgactaccagaaagactagggatccttatatcattgtcaaagctagggatcttattaagcttctttcgcgaagcgttcctgctcctcaggctataaagatacttgatgatgaagtgcaatgtgacattattaaaattagcgggatggttcgcaataaggagcgatttgtgaaaagaaggcaacaccttgtgggtcccaattcttccacattgaaggctctcgaaatactcactggctgctacattctcgtccagggaaacactgtttctgctatgggttcattcaaaggtttgaaacaagtcagaaggattgttgaagaatgcatgctgaataaactgcatcctgtttacaacattaagattcttatgatgaagaaggaacttgaaaaggatccagctcttgcccaagagaactgggatagatttcttccgaagttcaagaagaaaaatgttaagcaaaagaaggttaaagctaaagagaagaaaccatacactcctttccctccacctcaaccgctcagtaaggaagatgagcaattgttaactggagaatactttatgagtgacaaaaggaaatcagcgaagaaatggcaagagaggcaggagaagcaggcagaaaaaactgctgaaaacaaaagaaaaagagacgaggcctttatcccacccaaggaacctgcaaaaccgctggataaatctgaggatgctaatgataatgtagctgacatggcaatgtccttaaagaaaaaagcgaagaagtttggggagcgcaaatcgggagaaaatgtagatgctgaggcttacattatgggatcatctgaacaagcatcaggaaagaaatccaagaagcaaaggtcttaagcatgatcttgattttggagatggaatatgagcatttcatgtgaatcctatccagaaattatgtattctaaacactaatgcaaggaggcattttgtatctctcttgaacgtttcaattagactaaatgtacaattttgctgaaaactttctccaatatagtttggctg

SEQ ID NO: 5652 - DNA, 1907 bp, Arachis hypogaea
tccaccaatagttgtcgcggtctgtcggagtgagagactgctgccgccgcccatcgcattcaagaacttccgtcttcgtgctctcgggcctctcgccggatcctccacgttgggtgctcgcatctcgccgttctcctctgtgctcggctgctcgcgcctccctccgccagtgagtgctcgagctgtgcgtgttggttgctgctcgtcgtccgtggttgtctctgctcgattctgcctcccagtctcactcgagtcttgtctcagtcactggcatctcgtggttcgtctgtctcgttgccggcggcagaagcaactcgtggggttgtctcttgcttcgtcgccttccgtggggtggtcgccgacacgccgtcgaccgttggtttgagagagttaaaaaagaacagaataaccatcaaatagtactcctctccacttattccagcagccactgaaccctccaaaaccctcgaaacctcccaccgcggctccaccgcaaacccctaacacccaccatggtacgcgatggcgacgcgacggaccaaaacggcgacgctttggtaccaccacttccaaccaacgagaagcggaaggggaagcacgacaagccaaagccatgggacgaggaccctcacatcgatcattggaaggtcgagaagttcgatccttcttggaacgaaggcggcatgcttgaggttagctcgttctccactcttttccctcagtaccgggagaagtaccttcaggaagcttggcctttggtgaagtctgcgctcaaggaatttggcatctcttgcgagctcaacttggttgagggttcaatgacggtttccacgaccaggaagacgagggatccttacattattgtcaaagctagggatcttattaagcttctttcacgaagtgttcctgctcctcaggcaatcaaaatacttgacgatgaagtgcaatgtgacatcattaaaattagtggcttggttcgcaataaggagcgttttgtaaaaagaagacaacatcttgtgggtcccaattcttccacattgaaggcccttgaaatactcacaggttgctacattcttgtccagggaaatacagttgctgcaatgggttcatttaaaggcttgaagcaagtaaggaggattgttgaagaatgcatgctgaataaaatgcatcctgtgtacaacattaaggttcttatgctgaagaaagaacttgaaaaggatccggcccttgcacaagaaaactgggataggtttcttccaaagttcaagaagaaaaatgttcagcaaaagaaggttaaatctaaagaaaagaagccatatactcctttcccgcctcctcaacagcccagtaaggttgatattgaattagaaactggagaatacttcttaagtgctaagaagaaatcagcaaagaaatggcaagagaagcaggagaagcaagcggaaaaaactgctgagaacaaaagaaaaagagaagaggccttcattccacccaaggaacctgcaaagccggtggataaatctgaagatgctaataataataatgtagctgacatggcaaagtccttaaagcaaaaagcaaagaagctagggatgcgcaaatccgaagaaaacataaatgctgagacatacatcataggatcatcagaacaaccatcaggaaagaaatcaaagaagcaaaaatcttagttaacatctgatcctttggagatggaagatgggcttgtggattgaaatcgatcccaaaaattcgtctcttagaaaagttttgacactagtgtgcaagtctatggacattgctgccgcaatttgtcgagaaagtgtgagtgggttgcattgtgtctcactcgttcttgcctaattagattgtaacatgtacgacaatgatcccttttcaaaatgtattgg

SEQ ID NO: 5653 - DNA, 1458 bp, Arachis hypogaea
gcaccaccacttccaaccaacgagaagcgggaggggaagcacgacaagccaaagccatgggacgaggaccctcacatcgatcattggaaggtcgagaagttcgatccttcttggaacgaaggcggcatgcttgaggttagctcgttctccactcttttccctcagtaccgggagaagtaccttcaggaagcttggcctttggtgaagtccgcgctcaaggaattcggcatctcttgcgagctcaactcggttgagggttcaatgacagtttccacgaccaggaagacgagggatccttacattattgtcaaagctagggatcttattaagcttctttcacgaagtgttcctgctcctcaggcaatcaaaatacttgacgatgaagtgcaatgtgacatcattaaaattagtggcttggttcgcaataaggagcgtttgtaaaagaagacaacatcttgtgggtcccaattcttccacattgaaggcccttgaaatactcacaggttactacattcttgtccagggaaatacggttgctgcaatgggttcatttaaggcttgaagcaagtaaggaggattgttgaagaatgcatgctgaataaaatgcatcctgtgtacaacattaaggttcttatgctgaagaaagaacttgaaaaggatcggcccttgcacaagaaaactgggataggtttcttccaaagttcaagaagaaaaatgttcagcaaaagaaggttaaatctaaagaaaagaagccatatactcctttcccgcctcctcaacagcccagtaaggttgatattgaattagaaactggagaatacttcttaagtgctaagaagaaatcagcaaagaaatggcaagagaagcaggagaagcaagcggaaaaaactgccgagaacaaaagaaaaagagaagaggccttcattccacccaaggaacctgcaaagccggtggataaatctgaagatgctaataataataatgtagctgacatggcaaagtccttaaagcaaaaagcaaagaagctagggaagcgcaaatccgaagaaaacataaatgctgagacatacatcataggatcatcagaacaaccatcaggaaagaaatcaaagaagcaaaaatcttagttaacatcgatcctttggagatggaagatgggcttgtggattgaaatcgatcccaaaaattcgtctttagaaaagttttgacactagtgtgtaagtctatggacattgctgctgcaatttgtcgagaaagtatgagtgggttgcattgtgtctcactcgttcttgcctaattagattgtaacatgtaccacaatggtcccttttctaatgtattggccaaaatggatcttacaattttccttttaattggtgttattaagcgtgatttttaacaaaaaaaagaaaaaaaacaaaagtactctgcgttgataccactagcttgtactagacg

SEQ ID NO: 5654 - DNA, 1381 bp, Lupinus angustifolius
aagagataagaaaacaataaccagaagcgagaaaatcaaatcaaacagtgttgatggatgatgaaattgacgctaatggcacaataaccaaagaagaaaacgcaccgaaagagaagcgaaaggggaaacacgataagccaaagccatgggatgatgatccaaacatcgatcactggaaggtagacaaattcgatccctcttggaacgaaggaggcatgctcgaagtgagttccttctccactctcttccctcagtatcgcgaaaagtatcttcaacaagcttggcctctcgtcaaatcttctctcaaagaattcggtgtttcttgtgaactcaatttggttgaaggctcaatgactgttacaactaccagaaaaactagggatccttatatcattatcaaagctagggatcttattaagcttctttctagaagtgttcctgctcctcaggcgattaaaatactcgacgatgaagtgcaatgtgatattattaaaatcagtggcatggttcgcaataaggagagatttgttaaaagaagacagcatctcgttggtcctaattcttccaccttgaaggcacttgaaatactcactggctgctacatccttgttcagggaaacacagttgctgctatgggttcatttaaaggcttgaagcaagtcagaaggattgttgaggaatgtatgctgaataagttgcatcctgtatacaacattaagattcttatgatgaggaaggaacttgaaaaggatccagcacttgctcaagagaactgggataggtttcttccaaaattcaaaaagaaaaatgttaagcaaaagaaggttaacaccaaacagaagaagccctacactcctttccctccacctcaacctcccagtaaggttgatattcaattggaaactggagaatactttttaagcgaccgaaagaaatcacaaaagaaatggcaagagaagcaagaaaagcaggcagaaaaaactgctgaaaacaaaaggaaaagagatgaagctttcatcccacccaaggaaccagcaaaactggcagataaatccgaggttgctaataacaatgtagctgacatagcaatgtccttaaagaaaaaggcgaagaaatttggtgagcgcaaatctgaagaaaatttgaatgcggagacatatattattggatcatcagaacaagtatcaagaaagaaatctaagaagcaaaggacttagcatgacttaaagatggatcaataatgtgaaatggattgatccagaagtctttgtatccaatgtctcttaactaacatctgtgataatactacacaacttttataagtgatattttagtacattttgtacaatttttgatattcttactcaattttattactttt

SEQ ID NO: 5655 - DNA, 1409 bp, Glycine max
aacaaagcagaaagcagaaagcagaaagcagggatggaaaagcactcagatggggagaatggcgtagaagaagaacctcgatcacttgagcagaaggagaagcgaaaggggaagcacgacaagccaaagccatgggacgacgacccaaacatcgaccactggaagatcgacaagttcgacccttcgtggaacgacggcggcatgctcgaagttagctccttctccactctcttccctcagtaccgcgaaaagtacctccaagaagcttggcccatggtcaaatcctcactcaaggagttcggtgttgcttgcgaactcaacctcgttgagggttccatgactgtttcaaccaccaggaagactagggacccctatattatcatcaaagccagggatcttatcaagcttctatcacgaagtattcctgctcctcaggcgataaaaatacttgacgatgagatgcaatgtgacatcattaaaatcagcggcatggttcgcaataaggagcgatttgtaaaaagaagacaacatcttgtgggccccaattcttccaccttgaaggctcttgaaatactcactggctgctacattctcgtccagggaaacacagttgctgctatgggttcattcaaaggcttgaagcaagtcagaagaattgttgaagaatgcatgctgaataaaatgcatcctgtatacaacattaaggttcttatgatgaagaaagaacttgaaaaggatccagcacttgcccaggagaactgggataggttccttccaaaattcaagaagaaaaatgttaagcaaaagaaggttaacactaaacagaagaaaccatacactcctttccctccacctcaacagcccagtaagattgatatacaattagaaactggagaatactttttaagtaacaaaaggaaatcagcaaagatatggcaagagaagcaagagaagcaggctgagaaaactgctgaaaacaaaaggaaaagagaagaggcctttatcccacccaaggagcctgcaaatctggtggataaatctgaggatgctaacaataatgtagctgacatggcaatttccttaaagaaaaaaacaaagaagtttgggaagcgtaaatctgaagaaaatatagatgccgagacatatattgtaggatcatcagaacaagcatcgggaaagaaacccaagaagcaaaggtcttaaacataatcttcattttggagacgaaagatgagcatgtgatgtggatgtgaatttaatcaagatcttctgtatccaatgctttggcagtaacagttttgacataaatgtatgaggcgtagttgttcgttccatttgtcatggaggatgagtgcgtggcattctgtatcttatttgtagttgccaatagacattaagtcagtaacgtg

SEQ ID NO: 5656 - DNA, 1688 bp, Glycine max
gtgatttggttgaaacaataggccaataggcattagcatcccacaaaacctgaaaacctagcagaagcaagtgcacaggaaacaaagcagaaagcagaaagcagaaagcagggatggaaaagcactcagatggggagaatggcgtagaagaagaacctcgatcacttgagcagaaggagaagcgaaaggggaagcacgacaagccaaagccatgggacgacgacccaaacatcgaccactggaagatcgacaagttcgacccttcgtggaacgacggcggcatgctcgaagttagctccttctccactctcttccctcagtaccgcgaaaagtacctccaagaagcttggcccatggtcaaatcctcactcaaggagttcggtgttgcttgcgaactcaacctcgttgagggttccatgactgtttcaaccaccaggaagactagggacccctatattatcatcaaagccagggatcttatcaagcttctatcacgaagtattcctgctcctcaggcgataaaaatacttgacgatgagatgcaatgtgacatcattaaaatcagcggcatggttcgcaataaggagcgatttgtaaaaagaagacaacatcttgtgggccccaattcttccaccttgaaggctcttgaaatactcactggctgctacattctcgtccagggaaacacagttgctgctatgggttcattcaaaggcttgaagcaagtcagaagaattgttgaagaatgcatgctgaataaaatgcatcctgtatacaacattaaggttcttatgatgaagaaagaacttgaaaaggatccagcacttgcccaggagaactgggataggttccttccaaaattcaagaagaaaaatgttaagcaaaagaaggttaacactaaacagaagaaaccatacactcctttccctccacctcaacagcccagtaagattgatatacaattagaaactggagaatactttttaagtaacaaaaggaaatcagcaaagatatggcaagagaagcaagagaagcaggctgagaaaactgctgaaaacaaaaggaaaagagaagaggcctttatcccacccaaggagcctgcaaatctggtggataaatctgaggatgctaacaataatgtagctgacatggcaatttccttaaagaaaaaaacaaagaagtttgggaagcgtaaatctgaagaaaatatagatgccgagacatatattgtaggatcatcagaacaagcatcgggaaagaaacccaagaagcaaaggtcttaaacataatcttcattttggagacgaaagatgagcatgtgatgtggatgtgaatttaatcaagatcttctgtatccaatgctttggcagtaacagttttgacataaatgtatgaggcgtagttgttcgttccatttgtcatggaggatgagtgcgtggcattctgtatcttatttgtagttgccaatagacattaagtcagtaacgtgtacaacacttctagtcctctaagttttacatcttttcccttttaaaaacgttgtccgacacatgttgatactatagctatagttttgacattgagatttatttgttaaatttggtctggtcccaaaaataaaagggaaaaagaatcagaaacacatttattcgagtttgccacttgagttgttttcaacgaaaccaaaa

SEQ ID NO: 5657 - DNA, 1737 bp, Trifolium pratense
aatgtctaactcagcctggaaaggagaacagacagaaaacgagaatgttaacaaaaaggaatcataaattgaacggaaaccctaacaaacattcaacattttactctctcccccgtccggcccctacccgtcgcatatatcactcctccgccgtcacactcaccggaccccgcccctactccaccgcaatggacgaaaacgacgtaacaaacgaagtagtgaaaacaaagaagaaaggtaaacacgataaaccaaaaccatgggacgatgatcctaacatcgaccattggaaagttgagaaattcgatccatcatggaacgaaggtggaatgcttgatgtaagttcattctccactctcttccctcaatatcgtgaaaagtatctccaagaagcttggccactcgttaaatcctccctcaaagaatttggtatttctgccgaactcaacttggttgagggttcaatgacagtttcaacaaccagaaagaccaaggatccttatattattgttaaagctagggatcttatcaggcttctttctcggagtgttcctgctcctcaggcaataaaaatacttgacgatgaaatgcaatgcgacatcattaaaattagtgggttggttcgcaataaggagcgattcgtaaaaagaagacagcatcttgtgggtcccaactcttccaccttgaaggctcttgaaatacttacgggctgttacattctcgtacagggaaacacggtttctgtgatgggttcatacaaaggtttgaagcaagtcagaaggattgttgaggaatgcatgctgaataaaatgcaccccgtctacaacatcaagattcttatgatgaagaaggaacttgaaaaagatccagcacttgcccaagagaactgggataggtttcttccaaagtttaacaagaaaaatgtaaagcaaaagaaagttaacactaaacagaagaagccatatactcctttccctcctcctcaacagcccagtaaggttgatatacaattagaaactggtgagtactttatgagtgacaaaaagaaatcggcaaagaaatggcaagaacggcaggagaagcaggcagaaaaaactgctgcgaacaaaagaaaacgagacgagtcatttatcccacccaaggaatctacaaagtctgtggataactctgaggatgctaataataatgtagctgaaatggcaatgtccttaaagaaaaaagctaagaattttggaaagcgcaagtcggacgaaaatataaatgccgagacatacattatggggtcatcagaacaaccatcaagaaagaaatctaagcaacaaaagtcttagcatgatcttcattctggaagatggaagatgttcatccataaattttgatcctatgttatttgtaagactgtaacatgttcacttctggtccctatacaattttttgctttcaaaatcgttgccagacacttaagtataatatccaatgtcttgagttactgatgagttatattagattcatgtgctaaatttggtacagtactatcttgggtgttatgggagaaattgtaacaatttaatcttggttgataccttttaagtttattacttctttacatttaaattactgatttagtttttttaaaggatgtaaactttaaatgattaaactacagttcaaaatatggcgatccattgaactatacagtacagcaatatccaagggtgaactatacagtactttgtt

SEQ ID NO: 5658 - DNA, 1468 bp, Vigna unguiculata
acggattagaagccgccaccgcgcacgtcccagcccactgccatccctcttcgctgtcaaacccaccgttgcaggcaccaagagataaccagatacgtagtgatgaaaaaccttgaagaggatgagaatggagtggtgagggaagaatcgcagatgaaggagaagagaaaggggaaacacgataaaccgaagccatgggatgatgatcctaatatcgatcattggaaggtggagaagttcgacccttcttggaatgaaggtggcatgctcgaagtcagttccttctccactctctttcctcagtaccgcgagaagtacctccaagaagcatggcctacggtcaaatccgctctcaaacaatatggcatcgcatgcgaactgaatctcgttgagggttccatgacggtttcaaccacaagaaagactagagatccctatattatcgtcaaagccagggatctcatcagacttctctcaagaagtgtgtctgctcctcaggccataaaaatacttgacgatgaaatacaatgtgatatcatcaaaatcagtggtttggttcgcaataaggagcgatttgtaaagaggagacaacatcttgtgggtcccaattcagccacattaagagctcttgaaatactcactggttgctacattctcgtccatggaaacacagttgctgctatgggttcgtttaaaggtttgaaacaaatcagaaggattgttgaagaatgcatgctgaacaaaatgcatcctgtatacaacattaagattcttatgatgaagaaagaacttgaaaagaacccggaccttgccaatgagaactgggataggttccttccaaaattcaagaagaaaaacgttaagcaaaagaaggctaactctaaacaaaagaaaccatacactccattccctccaccacaacagcccagcaagattgatatacaattagaaactggagaatactttttaagtaacaagagaaaatcggcaaagatatggcaagagaagcaggagaagcaggctgaaaaaactgctgaaagcaaaaggaaacgagaagaggcctttatccctcccaaggagccggtaaagcctgtggataaatcagaggatgctgccaataacgtagctgatattgcaaagtccttaaagacaaagacagagaagtttgggaagcgtaaatctgaagaaaatctcaatgcagagacatatatcatgggatcctcggaacacgcatcaaggaagaaatccaagaaacaaaagtcttcggcataatgttcattttgaatttaaattaattattgttaaattgtgttttattttttatttactttgcctagattagatgattcgaattcatttgaagaggtgagaactggttttatgcttcgttaaggcctatgctcaatgattcacagtttggtttaggaagttccacaaccaacacattttggtaaaaaaaaaaaaaaaa

SEQ ID NO: 5659 - DNA, 1646 bp, Phaseolus vulgaris
ggtggaaacaagacagcatcgcacacaaactcgaaaacctaacggaagcaactgcagagggataaccggagaggtagcagcgatgaaaaaccttgaagaggatgagaatggcgtggagcaggaagaattgcagaagaaggagaagagaaaggggaagcatgataaaccgaagccatgggacgatgaccctaacatcgaccactggaaggtcgagaagttcgacccttcatggaacgaaggtggcatgctcgaagtcagttccttctccaccctcttccctcagtacctcgaaaagcatctccaagaaatatggcctactgtcaaatccgctctcaaacaatacggcatcgcttgcgaactcaacctcgtcgagggctccatgacggtttcaaccaccagaaagacccgagacccctatattatcatcaaagccagggatctcatcaagcttctcgcaagaagtgttactccaactcaggcgataaaaatacttgacgatgaagtacaatgtgatatcattaaaatcagtggcttggttcgcaataaggagcgatttgtaaaaaggagacaacatcttctgggtcccaattcttccaccctgaaggctcttgaaatactcactggctgctacattctcgtccagggaaacacagtttctgctatgggttcatttaaaggtttaaaacaagtcagaaggatcgttgaagaatgcatgctgaataaaatgcatcctgtatacaacattaaggttcttatgatgaagaaagaacttgaaaaggatccgtcacttgcccaggagaactgggataggttccttccaaaattcaagaagaaaaatgttaaacaaaagaaggttaactctaaacagaagaaaccatacactccattccctccaccacaacagcccagcaagattgatatacaactagaaactggagaatactttttaaataacaaaagaaaatcggcgaagatatggcaagagaagcaggagaaacaggctgaaaaaactgctgaaaacaaaaggaaacgagacgaggcctttatcccacccaaggagcctgtaaacccggtggataaatcggaggatgctaacaataaagtaactgacattacaatgtccttaaagaaaaaaacagagaagtttgggaagcgtaaatctgaagaaaatataaatgcggagtcttatattatgggatcatcagaacaaacatcaggaaagaaatccaagaagcaaaggtctttagcataatcttcattttggagatggaacatgaccgtgtgatgtgaattcagtccagatcttctgaatccaatgtccttgcagttaacagttttgacattattgttgtacgaggcttcgtttttcttaccattttgtcatggagttgagtgcgtgtaacgtagcagtacttggcactagactatgtacaccctgtggtcctttcaaaaacattgtccgacacactctgacaatatgatttggcttcacgagttggtgccatatatatatagtttagactgcatgtttcatttgcaaaatctggtccagtcccaaaagaagaaaagagcaatcagaaactgtttttctttttcgactttttcgatagtcctttaatgaaagtgaatatttatcttccacgaaa

SEQ ID NO: 5660 - DNA, 2441 bp, Trifolium pratense
atgagcggtgatcctcctgtagagtcaccaacttcagttctagaagaagaggaagtggaagtgaaatcggaggaagaggtggttgcagatgatggatcttcttctcttgtgttgaaatcaatggtggaggaagaagagaagttgcttaaagctagtgctaaggaagaagaggaactgtgtgaggaggcgccgaatcttaatgatacacagtttaataagttggatgaacttttaactcaaactaaactctactcagagtttcttttggagaaaatggatgatatcacattgaatccgggtgaacaagagaatcaggacgaggaagagagtcagccaagtgtgaaaaagaagggccgtggggcaaaacgaaaggcggctacccaatgcaatactaggaaagccaaaaaggcggttgaagccatgattacaagatctaaagaaaatgtgaagactgaagatgtgaatttgactgaagaggaaagaactgagaaagagcagaaggagctgatgcctttgcttactggtggaaaattgaagtcttatcaactgaagggtgtaaagtggttgatttccttgtggcaaaatggattgaatgggattctagctgatcaaatgggtcttgggaagacaatccaaacgattggctttatttctcatctaaaatcaaaaggactggatgggccatatatgataattgctcctctatcaaccctctccaattgggtgaatgagataactaggtttacaccatcgctccctgttgttatctaccatggtgacaaaaaactgagagatcaaatcagaaggaaacatatgcctagaactgttggcccaaaatttcccatagtaataacttcctatgagattgcgatgaatgatgctaggaaatgtttcgggtcatacagttggaaatatcttgttgtggacgagggacacaggctcaaaaattcaaactgcaaattagtgaacatgttgagatacattaaggttgaaaataagcttcttttgactgggacacctctccagaataatttggcagaactttggtcattgttgaacttcatcttacctgatatattctcatctcttgaagaatttgagaaatggtttaatctgtcaggaaagtgcactaatggagcaacaatggaagaaatggaagagaaaagaagaaatcaagtagtggccaagcttcatggaattcttaggccatttcttttgcgtaggatgaagtctgatgttgagctaatgttgccacggaaaaaagagatcattatttatgctaacatgactgagcatcagaagagtttgcaggatcatttaattaacgagacactggggaaatatttggacgcgaaactatcagttggacgtgctgcaacgaagcttaataatttggttattcagcttaggaaagtctgtaaccatcccgatctcttagaatcagcctttgatggttcatatttgtatcctccggtgaatgagataatcgaacaatgtggaaagtttcacttgctcgatagattgttgcagcggctatttgcacgtaatcacaaggttctgatcttcagtcagtggactaaagtgctagatataatggattactattttagtgaaaagggttttgaagtttgcaggattgatggttcggtgaaattggatgataggaaacgtcagatcgagaacttcaacgatacaaacagcaattgcagaatctttctcctttctactagggctggcgggttgggaataaacctcactgcagctgacacttgcattctttatgacagtgactggaatcctcaaatggatttacaggccatggatagatgtcatagaatcggtcaaacaaagcctgttcatgtttacaggctcgcaactgcacaatcagtagagggtcggatgttgaaaagagctttcagcaagttgaaacttgagcatgtggtgatagagaaaggacagtttcatcaagagcgtgtaacgccttccattgcggatgaaatggagggagaggatattttggcattgcttcgagatgaagaaacagcagaggacaaaatgatacagaaagatatcagcgatgaagacctggagaagctcttggatcgcagcgatcttgttatcaacagctcaactgatgataaagctccagtaagtacctttcccgttaaagggcctggatgggaggtggtgattccaactgcgtctggcggcatgctttctactcttaacagctaaattttcgtatctgcgacaaaactttttatttctaaatatttttgaaaaaattactttttgtggtatgagaagaaattgactttttgagacgatctcagccagtggtgtcaattgtcaggtaatgtcctagagggcattcaattttgtaaagtctactataacggaactagaagtagaaatgaagttacacagtgccagcgatcatg

SEQ ID NO: 5661 - DNA, 2676 bp, Cicer arietinum
ctattttcaattttttatattattattatcgctccacactcacacaacaaaaacaacaacaacacccattatttttcgcgctcctttcatcttccctcaactcaacttcaaaacaaaaatctcattcccattttctctctctcacgctttcatttctcttcgaggttcgaaatggaagtgaagaacaaagagaagaacgacgatcctacagttgaatcaccaacttcggtactagaagaagagttggaagaggtggttgttgccgatgatggtgttgtatcgaaatcaatggcagaggaggaagagaagttacttaaagctcgtgttgaggaagagaaggaacagtgtgaagaagcgcctaatcttaacgacacacagtttaacaagttagatgaacttttaacacaaacgaaactgtactctgagtttcttcttgagaaaatggatgatatcacattgactgcgggtgaacaagagaaacaggatgaagaagagagccaaccagttgcaaaaaagaacggccgaggatcaaaaagaaaggcagcttcacaatgcaatactaggaaagccaaaagggcagttgaagccatgattacaagatctaaagaaaacgtgaagactgaagatgtgaatttgagtgaggaagaaaaaactgagaaagagcagaaggagcttatgcctttactaactggtgggaaattgaagtcttatcaactgaagggtgtaaagtggttgatttccttgtggcaaaatggattgaatgggattcttgctgatcaaatgggtcttgggaagacgatccaaacgattgggtttctttctcatctgatagcaaaaggtttgaatggtccatatatgataatttctccactatcaaccctctccaattggatgaatgagatttctaggtttgcaccatcactccctgctattatctaccatggtaacaaacaacagagagatgacatcagaaggaatcatatgcctagaacagttggcccaaaatttccaattgtaataacttcttatgagattgcgatgaatgatgctaagaaatgcttcaggtcatacaattggaaatatcttgttgttgacgagggacacaggctcaaaaactcaaaatgcaaattagtgaaggaattgaaatacattaaagttgaaaataagcttcttttgactgggacgccgcttcagaataacttggcagagctatggtcattgttgaacttcatcttacctgatatattctcatcccttgaagagtttgagtcatggtttaatctgtcaggaaagtcttgtaatggagcaaccatggaggaattagaagagaaaagaagagcccaagtagtagcaaagcttcatgcaattcttaggccatttcttttgcgtagaatgaagtctgatgttgagctaatgttgccacggaaaaaagagatcattgtatatgctaacatgaccgagcatcagaagagcttgcaggaacatttaattaatgagacactagggaaatatttgaatgacaaactttcaattggacgctctgtgacaaagctcaataatttggttcttcaacttaggaaagtctgtaaccatcctgacctcctagaatcagcttttgatcgttcatatttttatcctcctgtgaatgagatcattgaacaatgtggaaaattccatttgctcaaccgattgttggaacggctatttgcacgaaatcacaaagttctgatcttcagtcagtggactagagtgttggatataatggattattatttcagtgaaaaaggctttgaagtttgcaggattgatggttcagtgaaactggaggataggaaacggcagatccaggacttcaatgatacaaacagcaattgccgaatcttccttctttctactagggctggtggattgggaattaacctcactgcagctgacacttgcattctttatgacagtgactggaatcctcaaatggatttacaggccatggatagatgtcatagaatcggtcaaacaaagcctgttcatgtttacaggctcgcaactgctcaatcagtagagggtcgaatgttaaaaagagctttcagcaagttgaagcttgagcatgtggtgatagagaaaggacagtttcatcaagagcgtacaaagcctgccattgtggatgagatggaggaagaggatgttttggccttgcttcgagatgaagaaacagctgaggacaaaatgatacaaaaagatattagtgatgaagacctggagaagatattggatcgcagtgatcttgttatcaatggttccggcgatgataaagctccagctagtacctttccccttaaagggcctggttgggaggtggtaattccaactgcaactgggggcatgctttccactcttaacagttaaatattttttaaaatttgctttttgtggtaagtgatgtaattgactatcaatcgtcacagagggaatgtcctgggagggcattcatttttgtaaagtcgactaacggaactacatttagaaatgaaactacttagcggtcatgttttgtatgaactattcacaagtccaatataggtgtatccattcaatttgaacgcagcttgtaactatagctgaatattgttggactatattgatccaaaggcttttgttgtcatttttttggtggctttg

SEQ ID NO: 5662 - DNA, 2586 bp, Trifolium pratense
ccggaaggatactctgtagtggccaagggtttgaaaaatggatgacaagaacaatgtggtgaacgttgatcctcctgtagagtcaccaacttcggttctagaagaagaggaagtagaagtgaaatcggaggaagaggtggttgcagatgatgggtcttcttcgcttgtgtcgaaattaatggcggaggaggaaaagaagttacttgaagctcgtgctaaggaagaagaggaaccgttggaggcgccgaatctcgatgattcacagtttaataagttggacgaactcttgacacaaacgaaactctactcagagtttcttttggagaaaatggacgatatcacaatgaatccgagtgaacaagagaaggaggacgaggaagagagccagccgagtgtgaaaaagaagggtcgtggagcaaaacgaaaggcggctaaacaatgcaatacgaggaaagctaaaaaggcagttgaagccatgattacaagatctaaagaaaatctgaagactgaagatgtgaatttgactgaagaagaaagaactgagaaagagcagaaggatctgatgcctttactaactggtggaaaattaaagtcttatcaactgaagggtgtaaagtggttgatttccttgtggcaaaatggattgaatgggattctagctgatcaaatgggtcttgggaagacaatccaaacaattggctttatttctcatctaaaatcaagaggattggatgggccatatatgataattgctcctctatcaaccctctccaattgggtgaatgagttttctaggtttacaccatcgctccgtgttgttatctaccatggtaacaaaaatcagagagatcaaatcagaaggaaacatatgcctagaacagttggcccagaatttcccatagtaataacttcatatgagattgcgatgaatgatgctaggaaatgttttgcgccatacagttggaaatatcttgttgtggacgagggacacaggctcaaaaactcaaattgcaaattagtgaagtcattgagatacattaatgttgacaataaacttcttttgactgggacacctctccagaataatttggcagagctttggtcattgctgaacttcatcttacctgatatattctcatcacttgatgaatttgagaaatggtttaatctgtcaggaaagtgcactaatggagcaacaatggaagaaatggaagagaaaagaagaaatcaagtggtagccaagcttcatggaattcttaggccatttcttttgcgtaggatgaagtctgatgttgagctaatgttgccgcgtaaaaaagagataattatttatgctaacatgactgagcatcagaagagcttgcaagatcatttaattaacgagaaactgggggaatatttggaaacgaaactatcagttggacgtggtgcgacgaagcttaataatttggttattcaacttaggaaagtctgtaaccatcccgatctcttagaatcagcctatgatggttcatatttctttcctccggtgaatgagataatcgaacaatgtggaaaattccacttgctcgatagattgttgcagcggctatttgcacgtaatcacaaggttctggtcttcagtcaatggactaaagtgctagatataatggaatactattttagtgaaaagggttttgaagtttgcaggattgatggctcggtgaaattggatgataggaaacgtcagatcgaggacttcaacgatacaaacagcaattgcagaatctttcttctttctactagggctggtggattgggaataaacctcactgcagctgacacttgtattatttatgacagtgactggaatcctcaaatggatttacaggccatggatagatgtcatagaatcggtcaaacaaagcctgttcacgtttacaggctcgcaactgcacaatcagtagagggtcgaatgttgaaaagagctttcagcaagttgaaacttgagcatgtggtgatagagaaaggacagtttcatcaggagcgtacagcaccttccattgtggatgaaatggagggtgaggatattttggcattgcttcgagatgaagaaacagccgaggacaaaatgatacagaaagatatcagtgatgaagacctggagaagcttttggatcgcagcgatcttgttatcaatagctcaaccgatgagaaagctccagttagtacctttccccttaaagggcctggatgggaggtggtgatttctgctgcgtctggcggcatgctttccactcttaacagctaaattttcgtatctgtgaaattaactttttatttctaaatatttttaaaaagattcctttttgtggtatgagatgtagttgactttttgagacgatctcagccagtgatgtcaattgttagaggtaatgtcctagagggcattcaattttgtaaagtctactaacggaactagatgtagaaatgaagctactcagcgccagtggtcatgtttttttgcttagaactattcacaaatccaatacattggtatctactcaacttacattggcttgtaatttagctgattagttcgtttaa

SEQ ID NO: 5663 - DNA, 3481 bp, Glycine max
aaaagagttattagcaatttgttttggaaaatgcaagtttgaaaaaagtgggaagcaagcaacaaaccaaaatgcggccagtcaatgacagcacgcgtcaccccttttcacgaaatttgggaaccaaaccaaaatgggcctttctttcagaaacgaccttactcaatgcttcagagatgagtcaaagtcaacaaacacttacgctcaccacacaggttttgatagtaaatattgccaaaaacggtggtcaataattcaattccactttcccgcccaattccatgccccatcaataaaataaaaccaaaaatatagaaaataataaattcccctctctcctttttaattggttcttgcttcacatttccacacttttctttcccccccgtccttccgtcttcccaacttctctgaaacctcaacccatactttttcgtttctttaccgtttcctctgccagggtttgaaatggaggcgaaggacaaagtgaagaacgaggattctgcagcggagtctccaacttcggtccttgaagacgaggatgtctgtgccctgaaagaggaagttaagttggaggaaatggtgactgcagacgttaaagatgacgggtcctctcttatatcgaaaacaatggtggaggaggaagagaagctacttgaagctaggataaaggaagaggaggtgcagtatgaggaggcagtagaccttaatgacatacagtttaacaaattggatgagcttttgactcaaaccagactgtactctgagtttctgctcgaaaaaatggatgacatcacacttgctgtgggtgaacaagagaacagggaagagcaagagagcaatccttctgcgaagaagggccgtggatcaaaaagaaaagttgcttcccagtacaatactaggaaggctaaaaaggcagttgctgccatgctgacaagatctaaagaaagtgagaagactgaagatatgaacatgactgaggaagaaagagttgagaaagagcagaaagagctcatgcctttactcacaggtggaaaattgaagaattatcaactgaaaggtgtaaagtggttgatttccttgtggcaaaatggattgaatgggattcttgctgatcaaatgggtcttgggaagacaatccaaacgattggatttctctcacatctaaaagcaaaaggtctggatgggccgtacatgataattgctcctttatcaaccctctcaaactgggtgaacgagatttctaggtttgcaccatcactccctgccgttatctaccatggtgacaagaaacagagagatgatatccggaggaaacatatgcccactagaacaattggcccgcaatttcctatagtcataacttcttacgagattgctttaaatgatgccaagaaatatttcaggtcatacaattggaaatatcttgttgttgatgagggacacagactcaaaaactcacaatgcaaattagtgaaggcattgaaattcataaatgttgaaaacaagcttcttttaactggaactcctcttcagaataacttggctgaactatggtctctgctgaacttcattttgcctgatatttttgcatcccttgaagaatttgagtcatggtttaatctgtcagggaagagcaataacggagcaaccaaggaagaactggaagagaaacgaagatcccaagtagtagcaaagcttcatgccattcttcggccctttcttctacgtaggatgaaatccgatgttgagattatgttgccacggaaaaaggagattattatctatgcaaacatgactgagcatcagaagaatttgcaggatcatttagttaataagacactggggaactatttaaaagaaaatatgtcaagtggacgttctgttcctgcaggtatgattcgtaatttggctattcaacttaggaaggtgtgtaaccatcctgatctccttgagtcagcatttgacgattcatatttgtatcctcctttagaagagatagttggacaatgtggaaaattccatttgcttgatcgattgctgcaacgtttatttgcaagaaatcacaaagttcttatcttcagtcagtggactaaggtgttagatataatggattattattttagtgaaaaaggctttgaggtttgcaggatagatggtggtgtgaaactggatgagaggaaacaacagatccaggacttcaatgatgtaaatagcaattgtagagtttttcttctttctactagggctggtggattgggaattaacctcactgcagctgatacttgcattctttatgacagtgactggaatcctcaaatggatttacaagccatggatagatgccacagaataggccaaacaaaacctgttcatgtttacaggctctcaactgctcaatctatagagggtcgcatgttgaaaagagctttcagcaaattaaagcttgagcatgtagtgattgagaagggacagtttcatcaagaacgtacaaaacctgccagtatggatgaaattgaggaagatgatgttttggcattgcttcgcgatgaagaaacagctgaagataaaatgatacatacagatattagtgatgaagacctggagaagctcttggatcgcagtgatcttatagtcaatgactttaacgatgataacttcaaagctccagtcagtgtgtttcctcttaaaggaccagggtgggaggtggtgattccaactgcgactgggggcatgctctctactcttaacagctagtttcatgtcactgtttatggctagagtttgaaaattttgctttttgtgggatgagatggaagggcttttctaaacagtctcatgtcacggtggtaatgccctggatggcattcattttttgtagatgcgtctaacggaactatgtttagaaatgaagctactctggccatgttttttgcgagtcggaattaaatattcaacttgttcagtggcgaaagtgattatcttatgtttgttctggaattcattttcaatgaaatgaattggtttggatatgataaaaccttaatttagcagtttattttcttctatgatttcaattaaaaattttgctttttgtgggatgagatggaagggcttttctaaacagtctcatgtcacggtggtaatgccctggatggcattcattttttgtagatgcgtctaacggaactatgtttagaaataaacagtttattttcttctatgaaattaattctagatattagcaaatcaaataatgcaaaccttaatatagggtctctactattaaagcaaagcttatgattaacgttactagttggctttatatttgcgaactttgtcctgaatttaattttaatgacaaaaacaccgcctctgaatagccttgatctttgaaagaaagatttggataacagatcaaatattttcttaacttcatcttactcatattcttacaacctggcaataacctttaggcttg

SEQ ID NO: 5664 - DNA, 3036 bp, Glycine max
cagagatgagtcaaagtcaacaaacacttacgctcaccacacaggttttgatagtaaatattgccaaaaacggtggtcaataattcaattccactttcccgcccaattccatgccccatcaataaaataaaaccaaaaatatagaaaataataaattcccctctctcctttttaattggttcttgcttcacatttccacacttttctttcccccccgtccttccgtcttcccaacttctctgaaacctcaacccatactttttcgtttctttaccgtttcctctgccagggtttgaaatggaggcgaaggacaaagtgaagaacgaggattctgcagcggagtctccaacttcggtccttgaagacgaggatgtctgtgccctgaaagaggaagttaagttggaggaaatggtgactgcagacgttaaagatgacgggtcctctcttatatcgaaaacaatggtggaggaggaagagaagctacttgaagctaggataaaggaagaggaggtgcagtatgaggaggcagtagaccttaatgacatacagtttaacaaattggatgagcttttgactcaaaccagactgtactctgagtttctgctcgaaaaaatggatgacatcacacttgctgtgggtgaacaagagaacagggaagagcaagagagcaatccttctgcgaagaagggccgtggatcaaaaagaaaagttgcttcccagtacaatactaggaaggctaaaaaggcagttgctgccatgctgacaagatctaaagaaagtgagaagactgaagatatgaacatgactgaggaagaaagagttgagaaagagcagaaagagctcatgcctttactcacaggtggaaaattgaagaattatcaactgaaaggtgtaaagtggttgatttccttgtggcaaaatggattgaatgggattcttgctgatcaaatgggtcttgggaagacaatccaaacgattggatttctctcacatctaaaagcaaaaggtctggatgggccgtacatgataattgctcctttatcaaccctctcaaactgggtgaacgagatttctaggtttgcaccatcactccctgccgttatctaccatggtgacaagaaacagagagatgatatccggaggaaacatatgcccactagaacaattggcccgcaatttcctatagtcataacttcttacgagattgctttaaatgatgccaagaaatatttcaggtcatacaattggaaatatcttgttgttgatgagggacacagactcaaaaactcacaatgcaaattagtgaaggcattgaaattcataaatgttgaaaacaagcttcttttaactggaactcctcttcagaataacttggctgaactatggtctctgctgaacttcattttgcctgatatttttgcatcccttgaagaatttgagtcatggtttaatctgtcagggaagagcaataacggagcaaccaaggaagaactggaagagaaacgaagatcccaagtagtagcaaagcttcatgccattcttcggccctttcttctacgtaggatgaaatccgatgttgagattatgttgccacggaaaaaggagattattatctatgcaaacatgactgagcatcagaagaatttgcaggatcatttagttaataagacactggggaactatttaaaagaaaatatgtcaagtggacgttctgttcctgcaggtatgattcgtaatttggctattcaacttaggaaggtgtgtaaccatcctgatctccttgagtcagcatttgacgattcatatttgtatcctcctttagaagagatagttggacaatgtggaaaattccatttgcttgatcgattgctgcaacgtttatttgcaagaaatcacaaagttcttatcttcagtcagtggactaaggtgttagatataatggattattattttagtgaaaaaggctttgaggtttgcaggatagatggtggtgtgaaactggatgagaggaaacaacagatccaggacttcaatgatgtaaatagcaattgtagagtttttcttctttctactagggctggtggattgggaattaacctcactgcagctgatacttgcattctttatgacagtgactggaatcctcaaatggatttacaagccatggatagatgccacagaataggccaaacaaaacctgttcatgtttacaggctctcaactgctcaatctatagagggtcgcatgttgaaaagagctttcagcaaattaaagcttgagcatgtagtgattgagaagggacagtttcatcaagaacgtacaaaacctgccagtatggatgaaattgaggaagatgatgttttggcattgcttcgcgatgaagaaacagctgaagataaaatgatacatacagatattagtgatgaagacctggagaagctcttggatcgcagtgatcttatagtcaatgactttaacgatgataacttcaaagctccagtcagtgtgtttcctcttaaaggaccagggtgggaggtggtgattccaactgcgactgggggcatgctctctactcttaacagctagtttcatgtcactgtttatggctagagtttgaaaattttgctttttgtgggatgagatggaagggcttttctaaacagtctcatgtcacggtggtaatgccctggatggcattcattttttgtagatgcgtctaacggaactatgtttagaaatgaagctactctggccatgttttttgcgagtcggaattaaatattcaacttgttcagtggcgaaagtgattatcttatgtttgttctggaattcattttcaatgaaatgaattggtttggatatgataaaaccttaatttagcagtttattttcttctatgatttcaattaaaaattttgctttttgtgggatgagatggaagggcttttctaaacagtctcatgtcacggtggtaatgccctggatggcattcattttttgtagatgcgtctaacggaactatgtttagaaataaac

SEQ ID NO: 5665 - DNA, 2588 bp, Cajanus cajan
ggtttgaaatggaggcgaaggataaagtgaaggaagaggataccgcagtggagtctccaacttctgtccttgaagacgaggatgtctgtgccacgaaagaggaagttaagtctgaagaagaggtgattgctgatgttaaagacgatggatcctcgcttatatcgaaaacaatggcggaggaggaagagaagttactcgaagccaggatgaaggaagaggaggtgcagtgtgaggaggcgctggacctaaatgacactcagtttaacaaattggatgagcttttaactcaaaccaagctgtactctgagtttctgatggagaaaatggatgacatcacacttaccgtgggtgaacaagagaatgaggaagagcaagaggccaatccttctgcaaagaagaagggccgtggatcaaaaagaaaagctgcttcacagtacaatactaggaaggccaaacaggcagttgctgccatgctgaccagatctaaagaaagtgaggagactgaagatacgaacatgagtgaggaagaaaaagttgagaaagagcagaaagagctcatgcctttactgacaggtgggaaattgaagccttatcaactcaagggtgtaaagtggctgatttccttgtggcaaaatggattgaatgggattcttgctgatcaaatgggtcttgggaagacaatccaaacaattggatttctctcgcatcttaaagcaaaaggtctggatgggccatacatgataattgctcctctgtcaaccctctcaaactggatgaatgagatttctagatttgccccatcactccctgccattatctaccatggtgacaagaaacagagagatgagatccgaaggaagcatatgcctagagccattggcccaaaatttcctatagtcataacatcttatgagattgctttaaatgatgcaaggaaatatttcaggccatacaattggaaatatcttgttgttgatgagggacacagactcaaaaactcacaatgcaaattagtgaaggaattgaaatacataaatgttgaaaacaagattcttctaacgggaactcctcttcagaataatttggcagaactatggtctctgttgaacttcattttgcctgatatttttgcatcccttgaagaatttgagtcatggtttaatctgtctggaaaatgcaataatgggacaaccaaggaagaactggaagacaagcgaagagctcaagtagtagcaaagcttcatgcaattcttcgaccctttcttttgcgtaggatgaagtctgatgttgagattatgttgccacggaaaaaggaaattattatctatgcaaacatgactgagcatcaaaagaatttgcaggatcatttaattaataaaacgttggagaactatttacaggaaaaatcattaaatggacatgctgtacgtaagattcataatttggttattcaacttcggaaggtgtgcaaccatcctgacctcatagcttcaccctttgatggttcatgtttatatcctcctgtaaacgagatagttgaacaatgtgggaagttcaatttgcttgatcgattgctgcaacttttatttgcaaggaatcacaaggttcttatcttcagtcagtggagtaaagtgttagatataatggattattattttagtgagaagggctatgaagtttgcaggattgatggtagtgtgaaactggatgaaaggaagcgacagatccaggaattcaatgatgcaaatagcaattgcagaatttttcttctttctacaagggctggtggattgggaattaacctcactgcagctgatacttgcattctttatgacagtgactggaatcctcagatggatttacaggccatggatagatgtcatagaataggccaaacaaagcctgtgcatgtttacaggctctcgacagctcaatccgtggagggtcgcatgttgaaaagagctttcagcaaattgaagctggagcatttagtgattgagaaaggacagtttcatcacgaacgttcaaaacctgtcagtacggatgaaatggaggaagaggatgtattggcattgcttcgagaagacgaaacagccgaagataaaatgatacaaacagatattagtgatgaagacctggagaagctcttggatcgcagtgatcttgtgatcaataactcgaacgatgataactgtaaagctccaagcagttcctttcctcttaaagggagagggtgggaggtggtgattccaactgccactgggggaatgctctctactcttaacagctagcttctcgtcactactaatggctttttgtagtatgatatgagatggaatggctttttgagacggtctcatgtcacggaggtattgtcctgcagggcattcatttttgtatatgcttttaaggtaactatgtttagaactgaagctactctggccatgctttttgcgacttggaattacacacttaatatattgagtggcgaaatttcatgttcaatgaaatgaattggtttggttacgataaaccttaacaattttttttttcactatcagattaattcaagatatttgcaaaatcaa

SEQ ID NO: 5666 - DNA, 3278 bp, Glycine max
gccaaaaatgcagccaatcacagcacgcgtcacccctttttcacgaaatttgggaaccaaatggacaacacaccgctggttagcatttgccgcagcatgggcctttctttcagaaacgaccttactcaatgcttcagacacgactcaagtcaaagtcaacaaacacaaacaggttttgatagtaaatatcgccaaaacccggggccaataattcaattccactttcccgcccaatcccatgccccatcaatacaattaaaccaaaaatatataataataaactcccctctctctctctctcctttgacactattttcattttccccggtcctttcttcctcccaacctctctgcaacctcattgcctcaactcatccattttcgttttccccattctgccctttccatttcttcaccgtttcctctaccagggtttgaaatggaggcgaagaacaaagtgaagatcgatgattctacagcggagtctccaacttcggtccttgaagacgaggctgtctgtgccccaaaagaagaagttaagttggaggaagaagtgactgcagacatcaaagatgatgggacctctcttatatcgaaaacaatggtggaggaggaagagaatttaattgaagctaggatgaaggaagaggaggtacagtgtgaggaggtacctgaccttaatgacacacagtttaacaaattggatgagcttttgactcaaaccaaactgtactctgagtttctgctggagaaaatggacgacatcacacttgctgtgggtgaacaagagaatagggaagagcaagagagcaatccttctgcaaagaagaagggctgtggatcaaaaagaaaagctgcttcccagtacaatactaggaaggccaaaaaggcagtcactgccatgctgacaagatcagaagaaagtgagaagactgaggatacgaacatgactgaggaagaaagagttgagaaagagcaaaaagagctcatgcccttactgacaggtggaaaattgaagacttatcaactgaagggtgtaaagtggttgatttccttgtggcaaaatggattgaatgggattcttgctgatcaaatgggtcttgggaagacaatccaaacgattggatttctctcacatctaaaagcaaaaggtctggatgggccatacatgataattgctcctctatcaaccctctcaaactgggtgaacgagatttctaggtttgcaccatcactccctgctgttatctaccatggtgacaagaaacagagagatgagatccggaggaaacatatgcctactagaacaattggcccggaatttcccatagtcataacttcttatgagattgctttaaatgatgccaagaaatatttcaggtcatacaattggaaatatattgttgttgatgagggacacagactcaaaaactcacaatgcaaattagtgaaggcattgaaattcataaatgttgaaaacaagcttcttttaactggaactcctcttcagaataacttggctgaactatggtctctgttgaacttcattttgcctgatatttttgcatcccttgaagagtttgagtcatggtttaatctgtcagggaagtgcaataatgaagcaactaaggaagaactggaagagaaacgaagatcccaagttgtagcaaagcttcatgccattcttcggccctttcttctacgtaggatgaaatctgatgttgagattatgttgccgcggaaaaaggagattattatctatgcaaacatgactgagcatcagaagaatttgcaggatcatttagttaataagacgttggggaactatttgaaagaaaatatgtcaagtggactttctgttcctgcaattatgattcgtaatttggctattcaacttaggaaggtgtgtaaccatcctgatctccttgagtcagcatttgatgattcatatttgtatcctcctttggaagagatagttggacaatgtggaaaattccatttgcttgatcgattgctgcaacgtttattttcaaggaatcacaaagttcttatcttcagtcagtggactaaagtgttagatataatggattattattttagtgaaaaaggctttgcagtttgcaggattgatggtagtgtgaaactggaagagaggaaacaacagatccaggacttcaatgatgtaaatagcaattgtagagtttttcttctttctactagggctggtgggttgggaatcaatctcactgtagctgatacatgcattctttatgacagtgactggaatcctcaaatggatttacaagccatggatagatgtcatagaataggccaaactaaacctgttcatgtttacaggctctcaactgcccaatctatagagggtcgcatgttgaaaagagctttcagcaaattgaagcttgagcatgtagtgattgagaaaggacaatttcatcaagaacgtacaaaacctgccagtatggatgaaattgaggaagatgatgttttggcattgcttcgtgatgaagaaacagccgaagataaaaagatacatacagatattagtgatgaagacctggagaagctcttggatcgcagtgatcttatagtcaacgactcaaacgatgataacttcaaagctccagtcagtgcctttcctcttaaagggccggggtgggaggtggtgattccaactgcgactgggggcatgctctctactcttaactgctagtttcttgtcactatttatggccggagtataaaaaacttgctttttgtggtataagatggaatggctttttgaaacattcttttatgtcacggtggtaatgccctggatggcattcattttttgtagatgcttctaacggaactatgtttagaaatgaagctactctggatatgttttttgcgagttggaattgaacattctacttgtgtagtggcgaaagtgaattggtttggatacaataaaccttaatttaacagtttattttcttctatgaaattaattcaagatattaacaaatcaaaaaatgctaaccttaatataggttgtctactattaacttggcaaagcttatgattaaggtgggtttactagtttccttctttaactttgccctgaattcagtcgtaagtctttcatgcacaaaatcatcaattttgaaaatatactgagaagtaagatgagacttactagaacaagaatattattcctgctttaagactcctatcaaaacctttcatctcaagaggtgttttctttttatagtttc

SEQ ID NO: 5667 - DNA, 2877 bp, Glycine max
caaacacaaacaggttttgatagtaaatatcgccaaaacccggggccaataattcaattccactttcccgcccaatcccatgccccatcaatacaattaaaccaaaaatatataataataaactcccctctctctctctctcctttgacactattttcattttccccggtcctttcttcctcccaacctctctgcaacctcattgcctcaactcatccattttcgttttccccattctgccctttccatttcttcaccgtttcctctaccagggtttgaaatggaggcgaagaacaaagtgaagatcgatgattctacagcggagtctccaacttcggtccttgaagacgaggctgtctgtgccccaaaagaagaagttaagttggaggaagaagtgactgcagacatcaaagatgatgggacctctcttatatcgaaaacaatggtggaggaggaagagaatttaattgaagctaggatgaaggaagaggaggtacagtgtgaggaggtacctgaccttaatgacacacagtttaacaaattggatgagcttttgactcaaaccaaactgtactctgagtttctgctggagaaaatggacgacatcacacttgctgtgggtgaacaagagaatagggaagagcaagagagcaatccttctgcaaagaagaagggctgtggatcaaaaagaaaagctgcttcccagtacaatactaggaaggccaaaaaggcagtcactgccatgctgacaagatcagaagaaagtgagaagactgaggatacgaacatgactgaggaagaaagagttgagaaagagcaaaaagagctcatgcccttactgacaggtggaaaattgaagacttatcaactgaagggtgtaaagtggttgatttccttgtggcaaaatggattgaatgggattcttgctgatcaaatgggtcttgggaagacaatccaaacgattggatttctctcacatctaaaagcaaaaggtctggatgggccatacatgataattgctcctctatcaaccctctcaaactgggtgaacgagatttctaggtttgcaccatcactccctgctgttatctaccatggtgacaagaaacagagagatgagatccggaggaaacatatgcctactagaacaattggcccggaatttcccatagtcataacttcttatgagattgctttaaatgatgccaagaaatatttcaggtcatacaattggaaatatattgttgttgatgagggacacagactcaaaaactcacaatgcaaattagtgaaggcattgaaattcataaatgttgaaaacaagcttcttttaactggaactcctcttcagaataacttggctgaactatggtctctgttgaacttcattttgcctgatatttttgcatcccttgaagagtttgagtcatggtttaatctgtcagggaagtgcaataatgaagcaactaaggaagaactggaagagaaacgaagatcccaagttgtagcaaagcttcatgccattcttcggccctttcttctacgtaggatgaaatctgatgttgagattatgttgccgcggaaaaaggagattattatctatgcaaacatgactgagcatcagaagaatttgcaggatcatttagttaataagacgttggggaactatttgaaagaaaatatgtcaagtggactttctgttcctgcaattatgattcgtaatttggctattcaacttaggaaggtgtgtaaccatcctgatctccttgagtcagcatttgatgattcatatttgtatcctcctttggaagagatagttggacaatgtggaaaattccatttgcttgatcgattgctgcaacgtttattttcaaggaatcacaaagttcttatcttcagtcagtggactaaagtgttagatataatggattattattttagtgaaaaaggctttgcagtttgcaggattgatggtagtgtgaaactggaagagaggaaacaacagatccaggacttcaatgatgtaaatagcaattgtagagtttttcttctttctactagggctggtgggttgggaatcaatctcactgtagctgatacatgcattctttatgacagtgactggaatcctcaaatggatttacaagccatggatagatgtcatagaataggccaaactaaacctgttcatgtttacaggctctcaactgcccaatctatagagggtcgcatgttgaaaagagctttcagcaaattgaagcttgagcatgtagtgattgagaaaggacaatttcatcaagaacgtacaaaacctgccagtatggatgaaattgaggaagatgatgttttggcattgcttcgtgatgaagaaacagccgaagataaaaagatacatacagatattagtgatgaagacctggagaagctcttggatcgcagtgatcttatagtcaacgactcaaacgatgataacttcaaagctccagtcagtgcctttcctcttaaagggccggggtgggaggtggtgattccaactgcgactgggggcatgctctctactcttaactgctagtttcttgtcactatttatggccggagtataaaaaacttgctttttgtggtataagatggaatggctttttgaaacattcttttatgtcacggtggtaatgccctggatggcattcattttttgtagatgcttctaacggaactatgtttagaaatgaagctactctggatatgttttttgcgagttggaattgaacattctacttgtgtagtggcgaaagtgaattggtttggatacaataaaccttaatttaacagtttattttcttctatgaaattaattcaagatattaacaaatcaaaaaa

SEQ ID NO: 5668 - DNA, 2326 bp, Trifolium pratense
cgtgctaaggaagaagaggaaccgttggaggcgccgaatcttgatgatacacagtttaataagttggatgaactgttaacacaaactaaactctactcagagtttcttttggagaaaatggacgatatcacaatgaatccgagtgaacaagagaatgaggacgaggaagagagccagccgagtgtgaaaaagaagggccgtggagcaaaacgaaaggcggctaaacaatacaatactaggaaagctaaaaaggcagttgaagccatgattacaagatctaaagaaaatctgaagactgaagatgtgaatttgactgaagaagaaagaactgagaaagagcagaaggatctgatgcctttactaactggtggaaaattaaagtcttatcaactgaagggtgtaaagtggttgatttccttgtggcaaaatggattgaatgggattctagctgatcaaatgggtcttgggaagacaatccaaacaattggctttatttctcatctaaaatcaagaggattggatgggccatatatgataattgctcctctatcaaccctctccaattgggtgaatgagttttctaggtttacaccatcgctccgtgttgttatctaccatggtaacaaaaatcagagagatcaaatcagaaggaaacatatgcctagaacagttggcccagaatttcccatagtaataacttcatatgagattgcgatgaatgatgctaggaaatgttttgcgccatacagttggaaatatcttgttgtggacgagggacacaggctcaaaaactcaaattgcaaattagtgaagtcattgagatacattaatgttgacaataaacttcttttgactgggacacctctccagaataatttggcagagctttggtcattgctgaacttcatcttacctgatatattctcatcacttgatgaatttgagaaatggtttaatctgtcaggaaagtgcactaatggagcaacaatggaagaaatggaagagaaaagaagaaatcaagtggtagccaagcttcatggaattcttaggccatttcttttgcgtaggatgaagtctgatgttgagctaatgttgccgcgtaaaaaagagataattatttatgctaacatgactgagcatcagaagagcttgcaagatcatttaattaacgagaaactgggggaatatttggaaacgaaactatcagttggacgtggtgcgacgaagcttaataatttggttattcaacttaggaaagtctgtaaccatcccgatctcttagaatcagcctatgatggttcatatttctttcctccggtgaatgagataatcgaacaatgtggaaaattccacttgctcgatagattgttgcagcggctatttgcacgtaatcacaaggttctgatcttcagtcagtggaccagagtgctagatataatgattactattttagtgagaagggttttgaagtttgcaggattgatggttcggtgaaattggatgataggaaacgtcagatcgaggacttcaacgatacaaacagcaattgcagaatctttcttcttttttactagggctggtggaatgggaataaacctcactgcagctgacacttgcattctttatgacagtgactggaatcctcaaatggatttacaggccatggatagatgtcatagaatcggtcaaacaaagcctgttcacgtttacaggcttgcaactgcacaatcagtagagggtcgaatgttgaaaagagctttcagcaagttgaaacttgagcatgtggtgatagagaaaggacaatttcatcaggagcgtacaacaccttccattgtggatgaaatggagggagaggatattttggcattgcttcgagatgaagaaacagccgaggacaaaatgatacagaaagatatcagtgatgaagacctggagaagcttttggatcgcagcgatcttgttatcaatagctcaaccgatgagaaagctccagttagtacctttccccttaaagggcctggatgggaggtggtgatttctgctgcatctggcagcatgctttccactcttaacagctaaattttcgtatctgcgaaattaactttttacttctaaatattaaaaaattactttttgtggtatgagatgtaattgactttttgagacgatctcagccagtgatgtcaatagtctgaggtaatgtcctagagggcattcaattttgtaaagtctactaacggaactagatgtagaaatgaagctactcagcgccagtggtcatgtttttttgcttagaactattcacaaatccaatacattggtatct

SEQ ID NO: 5669 - DNA, 2361 bp, Cicer arietinum
agtttgtttatgtctttgctagaagagaaaatacttataaaaaggccctcacctttttataattttcctgtccctcccattaaaccttctttaatctccacacaacaatatttttcatcttcactcttcagcacctagaaagtttattcctttataacttttctcaccttttgatcacatcccacaaacagaaatcttgaagaagaaaaaaccaaagaaagaaaaaatgataagtgctttagacttataccatgttctcacagcagtagtaccactctatgtagccatgattctagcttatggttcagtaaaatggtggaaaatcttcacaccagatcaatgttcaggcataaaccgttttgtagcactatttgctgttcctcttctttctttccatttcatttcaaccaacaatccttatgctatgaactacaggtttatagcagctgattcacttcaaaaagcaatagttttagcaatcctattcatttggtctagaacaagttcaagaggttcacttgaatggtccataacacttttctcactgtcaacacttccaaacacacttgtcatgggaattccattgcttaaagggatgtatggagataactctggtacccttatggttcaaattgttgttcttcaatgtatcatatggtacactttgatgttgttcctttttgaatatagaggtgctaggattctcattgtggaacagtttcctgatacagctggttctattatatctttcaaagttgattctgatattctttctttggatggtaaagaacctcttcaaactgaagctgaagttggtgaagatggtaaacttcatgttaaagttagaaaatcaacaagttcaaggtctgagattttctctagacgatctcatggacctaactctggtgtttcactaacaccaaggccttctaatttgacaaatgctgagatttattctcttcaatcttctaggaatcctacaccaagagggtctagttttaaccacactgatttttattctatggtgaatgggaggaatgttagtccaagagggtcaaattttggaaatttgggttttgatgaggaaaatgctgttggtaaagtcaatggtgttgttaatgctggaaatgggtatcctgctcctcatagtgctgggatattttcacctgtggctaagaaaaagggtaacggtggtggaggtgatggtggtaaagatcttcatatgtttgtttggagttcaagtgcttctcctgtttctgaaggtggaatccatgtctttagaggtggtggagattatggaaatgatcagcttaatggggtagctcaccaaaaagattatgatgaatttggtcacgatgagtttagcttcggaaacagaactgttgctaatggtgtggacaaagaaggaccagtgctttcaaagctaggttcaagctccacaactgaacttcaccctaaagctggacctcaaggtgaagctaagccaacaaacatgccacctgctagtgttatgacaagactcattttgattatggtttggagaaaacttattagaaatcctaatacttactccagccttattggtctcacttggtctttgatctcattcaagtggaatgttgttatgcctgcaattgttgcaaaatcaatttcaattttatctgatgctggccttggaatggccatgtttagccttgggttgttcatggcattgcaaccaaagataattgcatgtggaaactcagttgcttcatttgcaatggcagttcgtttcctaactggccctgctgttatggctgtttcttcaattgctgtaggactcaggggagttctgttgcacattgctattgtacaggctgcacttccccaaggaattgtcccttttgtgtttgccaaggaatacaatgttcatcctgacatacttagcactggggttatatttggaatgctaattgctcttcctattacattagtttactacattttgttgggccttttttgaagactaattggagttgattattaagctcttgtaatatgactataatttagttattttattttttttggagggccattatctaacaatgtagaaatttggaagttgagagttgcaattggaaacacatgtaattttagggctataagctagttagctactagaaggggaagaaaaatttgtattggttttttatgccttttttactttgaatcccaacttttgcatattttgcttggtttaatgaaaaagaggaaagtgaaggttgtttgtgtagttgtcgacactttttctttcttttcattacttttaattttctaggctaaaagggtgattgtgaaatctcaaatctgaactcgatg

SEQ ID NO: 5670 - DNA, 1833 bp, Trifolium pratense
ttcacttttcaaacacaccccttaaatttcactacaccccctttaactcaaaaaccaaacaaaatgataagtgctttagacttataccatgttctcacagcagtagtaccactctatgtagctatgatccttgcctatggttcagtaaaatggtggaaaattttcacaccagatcaatgttctggtataaaccgttttgtagcactttttgcagttccacttctctcatttcatttcatctcaaccaacaatccatacactatgaactacaaattcatagctgctgattcacttcaaaaatcaatcatcttaataatccttttcatttggtcaagaacaagctcaagaggttcattagaatggtctataacacttttctcactctcaacactccctaacacacttgttatgggtatacctttgttaaaaggaatgtatggtgatgattctggtactctaatggttcaaatcgttgttcttcaatgtatcatttggtatacattgatgttgtttctgtttgagtacagaggtgcaaggattctcattggtgaacagtttcctgatactgctggttctatcatctcattcaaagttgattctgatgttctttctttggatggtaaagagcctcttcaaactgaagctgaagttggtgaagatggtaaacttcatgtgaaagtaagaaaatcaacaagttcaagaagtgagattttttctaggccttctcatggtggtgtttctttgacaccaagaccttcaaatttgacaaatgctgagatttattcacttcaatcttcaagaaatcctacaccaagagggtctagttttaatcacagtgatttttactctatggttaatggaagaaatgttagtccaagacaatcaaattttggaagtttaggttttgatgaggaaagtggtgttggtaaagtaaatgggggtgcaaatagtggaaatggtggaaatgggtaccctacacctcatagtgctggaattttttcacctgtggctaataagaaaaagggtcatggtggtggtgatggaaaagatcttcatatgtttgtttggagttcaagtgcttcacctgtttctgaaggtggaattcatgtctttagaggtggaggtgattatggcaatgatcaacttaatggagcagctcaccaaaaagattatgaagaatttggtcatgatgaatttagcttcggaaatagaactgttgctaatggtgtagacaaagaaggaccagtgctttcaaagcttggttcaagttcaactactgagcttcatccaaaagctggttctcaaagtgattctaagccaacaaacatgccacctgctagtgttatgacaagacttatcttgattatggtgtggaggaaattgattaggaatcctaatacttattctagtcttattggtctcatttggtctttgatctcatttaggtggaatattgttatgcctgcaattattgctaagtcaatagcaattttatctgatgctggccttggaatggctatgtttagccttggattgttcatggcattacaaccaaggattattgcttgtggaaacacagttgcttcatttgcgatggcggttcgtttccttaccggcccggctgtgatggctgtttcttcaattgttgtaggacttaggggagtcctgttgcacattgctattgtacaggctgctcttccccaaggaattgttccctttgtgtttgccaaggaatacaatgttcatcctgacattcttagcaccggggttatatttggaatgctaatagctcttccaattacactagtttactacattttgttgggactttga

SEQ ID NO: 5671 - DNA, 2107 bp, Trifolium pratense
ggcttctcacaaagccaaaaccccttcacttcttccttaacacaacaatgtctcttatcaactcatagaaagtttcttcctttcacttttcccttcacttttcaaacacaccccttaaatttcactacacccccctttaactcaaaaaccaaacaaaatgataagtgctttagacttataccatgtcctaacagcagtagtaccgctctatgtagctatgatccttgcttatggttcagtaaaatggtggaaaatcttcacaccagatcaatgttctggtataaaccgttttgtagcactttttgcagttccacttctctcatttcacttcatttcaaccaacaatccatacactatgaactacaaattcatagcagctgattcacttcaaaaatcaatcatcttaatactccttttcatttggtcaagagcaagctcaagaggttcattagaatggtctataacacttttctcactttcaacacttccaaacacacttgttatgggtatacctttgttaaaaggaatgtatggtgatgattctggtactcttatggttcaaatcgttgttcttcaatgtatcatttggtatacattgatgttgtttttgtttgagtatagaggtgcaaggattctgataggtgaacagtttcctgatactgctggttctataatctctttcaaagttgattctgatgttctttctttagatggtaaagagcctcttcaaactgaagctgaagttggtgaagatggtaaacttcatgtgaaagttagaaaatcaactagttcaagaagtgagattttttctagaccttctcatggtggtgtttctttaacaccaagaccttcaaatttaacaaatgctgagatttattcacttcaatcttcaagaaatcctacaccaagagggtctagttttaatcattcagatttttactctatggttaatggaagaaatgttagtccaagacaatctaattttggaagtttaggttttgatgaagaaagtggggttggtaaagttaatggaggtgcaaatagtggaaatggtggaaatgggtaccctacacctcataatgctgggattttttcacctgtggctaataagaaaaagggtcatggtggtggtgatggaaaagatcttcatatgtttgtttggagttcaagtgcttcacctgtttctgaaggtggaattcatgtctttagaggtggtggtgattatggaaatgatcaacttaatggagtagctcaccaaaaagattatgaagaatttggtcatgatgaatttagcttcggaaacagaactgttgccaatggtgtggaaaaagaaggaccagtgctttcaaagcttggttcaagttcaactactgagcttcatcctaaagctagttctcaaggtgaatctaagccaacaaacatgccaccagctagtgttatgacaaggctaatcttgattatggtttggagaaaattgattaggaatcctaatacttattctagtcttattggtctcatttggtctttggtctgtttcaggtggaatgttgttatgcctgcaattgttgctaaatcaattgcaattttatctgatgctggccttggaatggctatgtttagtcttggcttgttcatggcattgcaaccgaggattattgcgtgtggaaacacggttgcttcatttgctatggcggttcgtttccttgtcggccctgtggtgatggctgcttcgtcgcttattgtaggactcaggggagttctgttgcacattgctattgtacaggctgcacttccccaaggaattgttccctttgtgtttgccaaggaatacagtgttcatcctgacattcttagcactggggttatatttggaatgttaattgctcttcctataacattggtttactacattttgttgggactttgaggacttgaagactaatttcagtggattaggctcttacttatcataactagactttagtgtttgattttttgggccattatctaacaatgtagaaatttgcaattagttaggtactctactagtagaagaaagaaaaaagttgtaatggttttttaaagccttttttacaatgaaacccac

SEQ ID NO: 5672 - DNA, 1789 bp, Lotus japonicus
atgataagcgcttctgacttgtaccatgttctcactgcggtggtgccactctacgtggctatgatcctcgcctacggctcagtgaaatggtggaaaatcttcagtccagaccagtgctctggcatcaaccgttttgttgctctgttcgcagttcctctgctttccttccacttcatctccaccaacaacccctacgccatgaactacaggttcatcgctgctgattctcttcagaaaaccatagtccttgcagttctgctaatctggtcaagaacaagctcaagaggctctctggaatggtccatcactctgttttccctgtcaacactgcccaacactctggtcatggggattccattgctgaaggggatgtatggtgatgcatcagggacattgatggtgcaaatcgtggtgcttcagtgtatcatctggtacactctgatgctgttcttgtttgaatacagaggagccaggcttctcattgtggagcagtttcctgacactgcagggtcgattatctcgttcaaggtggattctgatattctctcgcttgatgggaaagagcctctgcagactgaggctgaggttggagaagatggaaagcttcatgttactgtcaggaaatctaccagctcacgctctgagattttctctcggcgttctcatggaccaaactctggtgtttcactcactcctcgtccttcaaacttgaccaatgctgagatttactctctgcaatcttccaggaatccaactccaagagggtctagcttcaaccacactgatttctactccatggtgaatgggagaaacgtgagtccgaggcagagtaactttggtggaaccttgggttttgatgaggaaagtggaatgggtaaggctaatggtggtggtggcggtggtgggtaccctgctcctcacaatgcagggattttttctccggtgaccggcaagaagaaggccaacggtggcggcgctgatggcggcggaggaaaggatcttcacatgtttgtttggagttcaagtgcttcccctgtttctgaaggtggaatccatgtcttcagaggtgctgattatgggaatgaccagcttggtggggtagcttcacaccaaaaagattatgatgagtttggtcacgatgagtttagcttcggaaacagaactgttgctaatggtgtggacaaggaaggacctgtgttgtctaagcttggttcaagctccaccactgagcttcacccaaaagcacagggagaatccaaaactgccaccaacatgccacctgctagtgtcatgactaggctcattttgatcatggtgtggagaaagctgattaggaatcctaacacttactctagccttattggtctcacttggtctttggtctcattcaagtggaatgttgttatgccagcaattgttgctaaatcaatatcaattctatctgatgcaggccttggaatggcaatgtttagtcttgggttgttcatggcgttgcagccaaagatcattgcttgtggaaactcggttgctgcatttactatggcagttcggttcctcactggccctgcagtcatggccgttgcttcaattgttgtagggctcaggggtgttctgttgcacatagctattgtacaggctgctctgcctcaaggaattgtcccatttgtgtttgctaaggaatacaatgttcatcctgacattctcagcactggggttatatttggaatgctgattgctcttcccattactcttgtttactacattttgctggggctttgaagcaatgctg

SEQ ID NO: 5673 - DNA, 2332 bp, Phaseolus vulgaris
acaaaagcccccagcttttactcctttgtctcccatcataatgccataaactaaacccactctctctctctctctctctctcttctcacttctaaattctaactcctaacatctccaaccttctcaaaaccactcactcaaaccttattatttccaaacaaacaccacaatgataaccttgctggacctgtaccatgttctcaccgcggtggtgccgctctacgtcgccatgatcctcgcctacggttccgtcaagtggtggaagatcttcaccccggaccaatgctccggcatcaaccgcttcgtcgcgctctttgcggtgcccctactctccttccacttcatctccaccaacaatccctacgccatgaactacaagttcatagctgcggattcgcttcagaaaaccatagtccttgccgtgctcttcgtctggtccagaaccagctcacggggctctctggaatggtccatcacgctcttctccctctccacgctccccaacacgctcgtcatggggatcccattacttaagggcatgtacggggacgcatcggggaccctcatggtgcagatagtggtgcttcagtgcatcatctggtacactctgatgctgtttttgtttgagtataggggtgccaagcttctcatcgtggagcagtttcccgacactgcagggtccattatctcgttcaaggttgactctgatatcttatctttggatgggaaggaaccgcttcagactgaagctgaggttggtgacgatggcaagcttcatgttactgtcagaaagtccaccagttcgcgctctgagatcttctcgcggcgctcgcatggtcccaactcggtttcgttgactccgaggccttccaatttaaccaatgcagagatttactcgctgcagtcttccaggaatccaacgccgagagggtccagtttcaaccatacggacttctactcgatggtgaataatgggaggaacgtgagtccgaggcagagtagttttgggggcgtggcatttgatgaggagagtggtgtgagggttaatgggggtgcaggagggtaccctgcacctcacaatgcggggattttttctccggtggggaagaagaaaggtggtggtggtggtgaagggggagggaaggatcttcacatgtttgtctggagttctagtgcttctccggtgtcggaaggcgggattcatgtgttcagaggtggggattatggaaatgaccaacttcctgttggtggggtggctcacccgaaagactatgatgattttggtcacgacgagtttagcttcgggaacggaaccgtccctaatggagtggagaaggaagggccagtactttcgaagcttggctcaagttcgacggctgagcttcacccaaaagcacaagttgaatccaaagccacgtccatgccacccacaagtgttatgacaagactcattctgattatggtttggagaaagctgattaggaaccccaacacatattccagcctctttggtctcacttggtctttgatctcattcaagtggaatgttgttatgcctgctattgttgctcgatcgatatcaattttatctgatgctggccttgggatggcaatgtttagcctagggttattcatggctttgcaaccaaagattattgcatgtggaaactcggttgcttcctttgctatggcagttcgtttcctcactggacccgctgtcatggctgtcgcttcaatagttgtagggctcaggggagttctgttgcacattgctattgtacaggctgctctgccccaagggattgtcccttttgtgtttgccaaggaatacaacgttcatccagacatccttagcacaggggttatatttgggatgttaattgctcttcctatcacgctagtttactacattttgcttgggctttgaagcatgttgaggaggtggaaaaggagggaaagactaattgcagtggattacagtactaggcttttgttgttatatttataggttaatttttttggcatcctctaacaatgtagaatttgggaagttagtgagaggagaggagagggggtgagtgaggatgtaagaatggtggtggtggtgtgatgagagttggaagagaaggtgatattatattttagggctatagatagaggtaggtagccagtaggaacttttgttttggcggtttaagcctttttactgtgaaccccactctcttatattttgcttggtttaatgaaaaagagaaagtgaaacttgttggtagttgtggacacctttctctttcttttcacaagtacttctacttttctaggccaaaaggag

SEQ ID NO: 5674 - DNA, 1951 bp, Arachis hypogaea
gctttcccttctcctctgatctccggccacccaccaatgcccctctctccttttcagcaaagtctgcatctttgagctcttagaaccacaaaaatgataagcctttcggacttgtaccatgttctcactgcagttgttccactctatgtagccatgatcctagcttacggctcagtcaaatggtggaagattttcagccccgaccaatgctccggcataaaccgtttcgttgctctctttgcggttccacttctctcttttcacttcatctccaccaacaacccttacgccatgaattacaagttcattgcagcagactcactccaaaaagccattgttcttgtggtgcttgcaatatggtctagaataagctcaaggggttctttggaatggtccataacactcttctctctctcaactctccctaacacactcgtcatggggattccattgttgaagggtatgtatggtgattcatcagggagcctcatggttcagattgtggtgcttcagtgtatcatatggtacactctcatgttgttcttgtttgagtatagaggtgccaggttactcatagtggagcagttccctgatactgcagcctctattatctcattcaaggttgattctgatattatttctcttgatggcaaggaacctcttcacactgaggctgaggttggtgaagatggcaagttgcacgtcactgtgagaaagagcacaagttcaaggtctgacattttctctaggcgttcacatggtgctgtttcaatgactccacgcgcttctaacttgaccaatgccgagatatactctcttcaatcctctaggaaccctacacctagaggctctagcttcaaccacactgatttttattctatggtgaataatgggaggaatgttagtccaaggcaatcaaattttggcaacttggggtttgatgaggaaaatggtagagctgtgtattcttctcatgctggtggtggtggtggggtgtatcctggtcctacgagtgcagggatcttttcacctgtgacaggtcctggggccaagaagaaaggtggcggtggtgctgctgatggtgggggaaaggatcttcacatgtttgtatggagttcaagtgcttctcctgtctcagaaggtggaatccatgtcttcagaggtggagattatggaaatgatcatcttggtggggtagctcaccagaaagattatgaagagtttgggcacgatgagttcagctttggtaacagaacagttgctaatggtgttgacaaggaagggccagtgctttcaaagcttggttcaagttccacagctgagcttcaccccaaaaatggagctcaaggtgagtccaaaccagccaacatgccacctactagtgttatgacaagactcatcttgatcatggtttggaggaagctgattaggaatcccaacacttactctagcctaattggcctcacatggtctttgatctcattcaagtggaatgttgttatgcctgccattgttgccaaatcaatatcaattctatctgatgcaggccttggcatggccatgtttagccttgggctatttatggcattgcaaccaaagatcattgcctgcggaaacacggtcgcttcattcgccatggcggttcgtttcctcaccggccctgcagtaatggctgtagcatcaattgtggtaggactaaggggagttttgttgcacgttgccattgtacaggctgccctgcctcaaggaattgtaccctttgtgtttgctaaggaatacaacgttcatcctgatatattaagcacaggggttatatttgggatgctaattgctcttcctattactctagtttactatattttgttggggctgtgaagaagactaattgtagtggtgttacatttacatttacacccttttgttatattaatattattatagggtaattttt

SEQ ID NO: 5675 - DNA, 2274 bp, Lupinus angustifolius
accttcttcattcccaccttacctttttctcctttctctctctccatctctcattatccaactttcaacacttcaaaagataaaacctcttttggtctttaacatcaacaccttctaacttttctctctaaactccttcccttccataacttttatccaagttaacaaaaaggaaccatatcttgacaccaactttagttctttcaaatcacagaaagtcttttgtttttatcaacaaaccaaaaaatgattagtcttttagacttgtaccatgttctcactgctgttgtgccactctatgtggccatgatcctagcatatggctcagtaaaatggtggaaaatcttctctcctgatcaatgctcaggcataaaccgttttgttgcactttttgcagttccattactctcatttcacttcatctccaccaacaacccttacaagatgaattacaggttcatagctgcagattcattgcaaaaaaccatagtcttaacagttcttgcaatatggtcaaggttcagctcaaggggttcattagaatggtccataaccctgttctccctttctacactacccaacacacttgttatggggatacccttgcttaagggcatgtatggtgattcctctggtacccttatgattcagattgttgttcttcagtgtatcatatggtacactttgatgctgttcttgtttgagtataggggtgcaaggattttgatagtggaacagtttccagacactgcagggtccattatatctttcaaagttgattctgatattttatccttggatgggaaggaacctcttcagactgaagctgaagttggtgaagatgggaagcttcatgtgactgtgagaaagtcaacaagttcaaggtctgagattttctctagaaagtctcatggacctaattctggtgtttcactaacacaaaggccttctaacttaaccaatgctgagatttactctcttcagtcttctaggaaccctactcctagagggtcaagttttaaccactctgatttttattccatggtgaatggaaggaacatgactagtggtgtgagtccaaggcaatccaattttggaaacttgggttatgatgaagagagtggtggtaatgtttcaagaactaatggttatcctgctcctccaaataatgggatattttctcctgtgactggttccaagaaaaagggtaatggtggtgaaggtggaaaggatcttcacatgtttgtttggagttcaagtgcttctcctgtatcagaaggtggaatccatgtctttagaggtggtgattatggaaatgagcttggaggggtagctactaaccacaaagattacgatgagtttggccatgatgagtttagctttggaaacagaactgtggctaatggtttggacaaggaaggaccagtgctttctaagcttggttcaagctccacaactgaacttaaccccaaatgtgttcaaggtgaatccaaaccaacttcaatgccacctactagtgttatgaccagactcatcttgataatggtgtggagaaagttgattaggaatcctaacactttctctagcatcattggtctcacttggtccttgatctcattcaagtggaatgttgtgatgcctgcaattgttgctggctcaatatcaatcttatctaatgcaggccttggcatggcaatgtttagccttgggttattcatggcattgcagccaaggattattgcttgtggaaactcggttgcttcctttgctatggcggttcgtttccttaccggccctgcagtcatggctgttgcctcaattgttgtaggactaagaggagttctgttgcacattgctattgttcaggctgctctgccacaagggattgtgccctttgtgtttgctaaggaatacaaagttcatcctgacatattaagcactggggttatatttgggatgctaattgctcttccaattacgcttgtttactacattttgcttggactttgaagcaagtcgaggaggacatgaaatgaacctaattatgaaaaacagactaattgcaatggactattatacccttttgttattattattattatatattgggtagggtgttttattttttgccaacatctaacattgtagaattttggaaggcaatgagaaaggggaagataatatttttagtgactaggaaaacttgtattggcaatttttttcccttcttactctggatccaactcctattaaagaaaaaaaatttattttata

SEQ ID NO: 5676 - DNA, 2447 bp, Glycine max
gttataaaagcttgagaaaagcccccagcttttactcctttgtctacgcccttcataatgccttaaactaaacccttctcttctatctccggccaccgtttatcttttctcaataacctcaaaccttattatattattcggaaagagacacgacaatgataacgttgttggacttgtaccacgttctgacagcggtggtgccgctctacgtggcgatgatcctcgcctacggctccgtgaagtggtggaagatcttcaccccggaccaatgctcgggaataaaccggttcgtggcactcttcgcagtgcccctcctctccttccacttcatctccaccaacaacccctacgccatgaactacaagttcatcgccgcggacacactccaaaaagccatagtcctcgcagtgctcttggtgtggtccagaacaagctcaagaggctcacttgaatggtccataacactcttctctctctcaactctccccaacaccttggtgatgggtatcccgttgctgaagggcatgtacggtgatgactcgggaacactaatggttcagattgtggtgcttcagtgtatcatctggtatacccttatgttgtttcttttcgagtataggggtgcgaggcttttaatagtggagcagtttcctgatacagcgggttcgattatctccttcaaggttgattcggatattatttcgttggatgggaaggagccgcttcagacggaggcggaggttggtgatgatgggaagcttcacgtcacggtgagaaagtcggcgagttcgcggtcggagattttttctaggcgctcgcacggtggcctgaactcggtgtcgttgactccgaggccttccaacttgaccaatgcggagatttactcgctgcagagctccaggaaccccacgcccagaggctcgagttttaaccacacggatttttactccattgtgaatggtggtggtgggaggaacaacaacgtgagtgtgagtccgaggcagagtaatttcggggggtttgatgaggagagtggtgggggtatgagggtgaatggtgggtaccctgggcctgcgaatgcggggattttttctccggtggcgaagaagaagggtggtgagagtggtggtggtggtggtggaggagggaaggatctgcacatgttcgtgtggagttccagtgcttcgccggtgtcggagggtggtatccatgcctttagaggtggtggggattacgggagtgaccagcttcccgtttgtggggtggctcaccagaaagattatgatgagtttggtcacgatgagtttagcttcgggaacagaaccattgctaatggggttgacaaggaagggccagtgctttcaaagcttggttcgagttccacggctgagcttcaccccaaagcacaaggtgaatccaaacctacttccatgccacccacaagtgttatgacaaggctcattttgatcatggtttggaggaagctgattaggaaccccaacacatactccagcctctttggtctcacttggtctttgatctcattcaagtggaatgttgttatgccagcaattgttgctaaatcgatatcaattttatctgatgctggtcttgggatggcaatgtttagccttgggttattcatggcattgcagccaaagattattgcatgtggaaactcggttgcttcctttgctatggcagttcgttttcttactggtcctgcagtcatggctgttgcttcaatcgttgtagggctcaggggagttctattgcacattgctattgtacaggctgctctgcctcaagggattgtcccttttgtgtttgctaaggaatacaacgttcatcctgacatactaagcaccggggttatatttgggatgctaattgctcttcctattacgctagtttactacattttgcttgggctttgaagcatgttgaggaagcgaaaaaggaatcaagtcatgaagattaaaaaaaaagactaattgcagtgtggatcaaactacccttttgttatatttataggttaatttttttggcatcttctaacaatggtagaatttcgaaatgaagttagtgagagggggggagtgtgaccttgtaattaatctccaaacacaaaaacaatggtgagagttgaaatggaagcaaggagatagtagtatattttagggctatagctagctactaggaaacttttattttggtggttttagcctttttttactgtgaaccccactctcttatattttgcttcgtttaatggaaaaaaagaagagaaagtgaagcttgtttgtagttgtcgacacctttctctttcttttcacaagtacttctactttttataggccaaaaagagcatgaggccgatcgggaatctcaatctctatcctatgcaaagtataagaatatatatcaacaaacacaagtggtttttc

SEQ ID NO: 5677 - DNA, 2421 bp, Glycine max
tttgtctacgcccttcataatgccttaaactaaacccttctcttctatctccggccaccgtttatcttttctcaataacctcaaaccttattatattattcggaaagagacacgacaatgataacgttgttggacttgtaccacgttctgacagcggtggtgccgctctacgtggcgatgatcctcgcctacggctccgtgaagtggtggaagatcttcaccccggaccaatgctcgggaataaaccggttcgtggcactcttcgcagtgcccctcctctccttccacttcatctccaccaacaacccctacgccatgaactacaagttcatcgccgcggacacactccaaaaagccatagtcctcgcagtgctcttggtgtggtccagaacaagctcaagaggctcacttgaatggtccataacactcttctctctctcaactctccccaacaccttggtgatgggtatcccgttgctgaagggcatgtacggtgatgactcgggaacactaatggttcagattgtggtgcttcagtgtatcatctggtatacccttatgttgtttcttttcgagtataggggtgcgaggcttttaatagtggagcagtttcctgatacagcgggttcgattatctccttcaaggttgattcggatattatttcgttggatgggaaggagccgcttcagacggaggcggaggttggtgatgatgggaagcttcacgtcacggtgagaaagtcggcgagttcgcggtcggagattttttctaggcgctcgcacggtggcctgaactcggtgtcgttgactccgaggccttccaacttgaccaatgcggagatttactcgctgcagagctccaggaaccccacgcccagaggctcgagttttaaccacacggatttttactccattgtgaatggtggtggtgggaggaacaacaacgtgagtgtgagtccgaggcagagtaatttcggggggtttgatgaggagagtggtgggggtatgagggtgaatggtgggtaccctgggcctgcgaatgcggggattttttctccggtggcgaagaagaagggtggtgagagtggtggtggtggtggtggaggagggaaggatctgcacatgttcgtgtggagttccagtgcttcgccggtgtcggagggtggtatccatgcctttagaggtggtggggattacgggagtgaccagcttcccgtttgtggggtggctcaccagaaagattatgatgagtttggtcacgatgagtttagcttcgggaacagaaccattgctaatggggttgacaaggaagggccagtgctttcaaagcttggttcgagttccacggctgagcttcaccccaaagcacaaggtgaatccaaacctacttccatgccacccacaagtgttatgacaaggctcattttgatcatggtttggaggaagctgattaggaaccccaacacatactccagcctctttggtctcacttggtctttgatctcattcaagtggaatgttgttatgccagcaattgttgctaaatcgatatcaattttatctgatgctggtcttgggatggcaatgtttagccttgggttattcatggcattgcagccaaagattattgcatgtggaaactcggttgcttcctttgctatggcagttcgttttcttactggtcctgcagtcatggctgttgcttcaatcgttgtagggctcaggggagttctattgcacattgctattgtacaggctgctctgcctcaagggattgtcccttttgtgtttgctaaggaatacaacgttcatcctgacatactaagcaccggggttatatttgggatgctaattgctcttcctattacgctagtttactacattttgcttgggctttgaagcatgttgaggaagcgaaaaaggaatcaagtcatgaagattaaaaaaaaagactaattgcagtgtggatcaaactacccttttgttatatttataggttaatttttttggcatcttctaacaatggtagaatttcgaaatgaagttagtgagagggggggagtgtgaccttgtaattaatctccaaacacaaaaacaatggtgagagttgaaatggaagcaaggagatagtagtatattttagggctatagctagctactaggaaacttttattttggtggttttagcctttttttactgtgaaccccactctcttatattttgcttcgtttaatggaaaaaaagaagagaaagtgaagcttgtttgtagttgtcgacacctttctctttcttttcacaagtacttctactttttataggccaaaaagagcatgaggccgatcgggaatctcaatctctatcctatgcaaagtataagaatatatatcaacaaacacaagtggtttttctagggcaaaaaa

SEQ ID NO: 5678 - DNA, 2888 bp, Glycine max
ggaggttcattgtgtctttgcagcagcagaaaagagttataaaagcttgagaaaagcccccagcttttactccttgataatgccttaaacttaactcagcccttttccaacttgtcttttctccggccaccgctatcttcttctcttaaaccttattataacgatgataactttgtgggacttgtaccacgttctgaccgcggtggtgccgctctacgtggcgatgatcctggcctacgggtccgtgaagtggtggaagatcttcacccctgaccaatgctccggcataaaccgcttcgtggcactcttcgcagtcccactcctctccttccacttcatctccaccaacaacccttatgccatgaactacaagttcatcgccgcagactcgctccagaaagccatagtcctcgcagtgctcttggtgtggtcaagaactagctcaagaggctcacttgaatggtccataacactcttctctctctcaacactccccaacacgttggtaatgggtatcccattgctgaaggggatgtacggtgatgcctcgggaacactcatggttcagattgtggtgcttcagtgtattatttggtacacccttatgctgtttttgtttgagtataggggcgcgaggcttcttatagtggagcagtttcctgatactgcggcttcgattatttcattcaaggttgattcggatattatttcgttggatgggaaggagccgcttcagacggaggcggaggttggtgatgacgggaagcttcatgtgacggtgaggaagtcggcgagttcgcggtcggagattttctctaggcgctctcatggccccaactcggtgtcgttgactccgaggccttcgaatttgaccaatgcggagatttactcgctgcagagctcgaggaacccgactccgagaggctcgagttttaaccacacggatttttactccatggtgaatggtaagaacaacaacaacaacaacaacaacgtgagtatgagtccgaggcagagtaattttggaggctttgatgaagaaagtggtgggggtgtgagggtgaatggtggtgctggtgtaggtgggtaccctgggcctgcgaatgcggggattttttctccggtggcggcgaagaagaagggtggtgagagtggtggtggagggaaggatctccacatgtttgtgtggagttcgagtgcttcgccggtgtcggaaggtggaatccatgtcttcagaggtggtggtggggattatgggagtgaccagcttcctgttggtggggtggctcaccagaaagattatgatgagtttggtcacgatgagtttagcttcgggaacagaaccgttgctaatggggttgacaaggaagggccagtgctttcaaagcttggctcgagttccacagctgagcttcgccctaaagctcaaggtgaagccaaacctacttccatgccaccaacaagtgttatgacaaggctcattttgattatggtttggaggaagctgattaggaaccccaacacatattccagcctctttggtctcacttggtctttgatctcattcaaatggaatgttgttatgccagcaattgttgctaaatcgatatcaattttatctgatgctggtcttgggatggcaatgtttagccttgggttattcatggcattgcagccaaagattattgcgtgtggaaactcggttgcttcctttgctatggcagttcgttttcttactggtcctgcagtcatggctgttgcttcaatcgtagtagggctcaggggagttctgttgcacattgctatcgtacaggctgctctgcctcaagggattgttccttttgtgtttgctaaggaatataacgttcatcctgacatactaagcacgggggttatatttgggatgctaattgctcttcctattactctagtttactacattttgcttggactttgaagcatgttgaggacgtgaaaaaaggaaccaccaagtcacgaaaaaaaagagactaattgcagtggatattacactacccttttgttatatttataggttaatttttttggcatcctctaacaatggtagaatttcggaatgaagttagtgagagaggggggagtgacgttgtaattaatcaatctccaaaacacaaacaatggtgagagttgggaaggcaaggagatggtatattttagggctaatggctactactaggaaacttttgttttggcggttttagccttttttactgtgaaccccactcaactcttttattatatattttgcttcgttttaatggaaaaaagagaaagtgaagcttgtttgtagttgtcgacacctttctctttcttttcacaagtactatactactactttttctaaggccaaaaggagcatgaagccgattgggaatctcaatctctatcctatgccatgcaaagtgtataagaatatatatctatcaaccaacacaagtgatttttctagggcaaaaaaagtgggaccgaacagaaacttttgcttgcttgtctctttggtgctgttttttatttgaagcatttaacatcctttttgaatggcacaggttgtcatccacaaattttaatttattgagtaatgttggaaattgaagctattgcagggctatggctaaggttgctattatggtccctgctgtttgcaattactactataccactactactacatagcctagccgctaatcacagcttgctaaagtaaagattgcacatgcttctgcaccctggatagggtcttctttacttacctaaataatcttttatagttattgcacatcacgttgttggatcccttgagagaacaatagcacttattgcactatggtttagtgatccttcataaatac

SEQ ID NO: 5679 - DNA, 2897 bp, Glycine max
gtgtctttgcagcagcagaaaagagttataaaagcttgagaaaagcccccagcttttactccttgataatgccttaaacttaactcagcccttttccaacttgtcttttctccggccaccgctatcttcttctcttaaaccttattataacgatgataactttgtgggacttgtaccacgttctgaccgcggtggtgccgctctacgtggcgatgatcctggcctacgggtccgtgaagtggtggaagatcttcacccctgaccaatgctccggcataaaccgcttcgtggcactcttcgcagtcccactcctctccttccacttcatctccaccaacaacccttatgccatgaactacaagttcatcgccgcagactcgctccagaaagccatagtcctcgcagtgctcttggtgtggtcaagaactagctcaagaggctcacttgaatggtccataacactcttctctctctcaacactccccaacacgttggtaatgggtatcccattgctgaaggggatgtacggtgatgcctcgggaacactcatggttcagattgtggtgcttcagtgtattatttggtacacccttatgctgtttttgtttgagtataggggcgcgaggcttcttatagtggagcagtttcctgatactgcggcttcgattatttcattcaaggttgattcggatattatttcgttggatgggaaggagccgcttcagacggaggcggaggttggtgatgacgggaagcttcatgtgacggtgaggaagtcggcgagttcgcggtcggagattttctctaggcgctctcatggccccaactcggtgtcgttgactccgaggccttcgaatttgaccaatgcggagatttactcgctgcagagctcgaggaacccgactccgagaggctcgagttttaaccacacggatttttactccatggtgaatggtaagaacaacaacaacaacaacaacaacgtgagtatgagtccgaggcagagtaattttggaggctttgatgaagaaagtggtgggggtgtgagggtgaatggtggtgctggtgtaggtgggtaccctgggcctgcgaatgcggggattttttctccggtggcggcgaagaagaagggtggtgagagtggtggtggagggaaggatctccacatgtttgtgtggagttcgagtgcttcgccggtgtcggaaggtggaatccatgtcttcagaggtggtggtggggattatgggagtgaccagcttcctgttggtggggtggctcaccagaaagattatgatgagtttggtcacgatgagtttagcttcgggaacagaaccgttgctaatggggttgacaaggaagggccagtgctttcaaagcttggctcgagttccacagctgagcttcgccctaaagctcaaggtgaagccaaacctacttccatgccaccaacaagtgttatgacaaggctcattttgattatggtttggaggaagctgattaggaaccccaacacatattccagcctctttggtctcacttggtctttgatctcattcaaatggaatgttgttatgccagcaattgttgctaaatcgatatcaattttatctgatgctggtcttgggatggcaatgtttagccttgggttattcatggcattgcagccaaagattattgcgtgtggaaactcggttgcttcctttgctatggcagttcgttttcttactggtcctgcagtcatggctgttgcttcaatcgtagtagggctcaggggagttctgttgcacattgctatcgtacaggctgctctgcctcaagggattgttccttttgtgtttgctaaggaatataacgttcatcctgacatactaagcacgggggttatatttgggatgctaattgctcttcctattactctagtttactacattttgcttggactttgaagcatgttgaggacgtgaaaaaaggaaccaccaagtcacgaaaaaaaagagactaattgcagtggatattacactacccttttgttatatttataggttaatttttttggcatcctctaacaatggtagaatttcggaatgaagttagtgagagaggggggagtgacgttgtaattaatcaatctccaaaacacaaacaatggtgagagttgggaaggcaaggagatggtatattttagggctaatggctactactaggaaacttttgttttggcggttttagccttttttactgtgaaccccactcaactcttttattatatattttgcttcgttttaatggaaaaaagagaaagtgaagcttgtttgtagttgtcgacacctttctctttcttttcacaagtactatactactactttttctaaggccaaaaggagcatgaagccgattgggaatctcaatctctatcctatgccatgcaaagtgtataagaatatatatctatcaaccaacacaagtgatttttctagggcataaaaagtgggaccgaacagaaacttttgcttgcttgtctctttggtgctgttttttatttgaagcatttaacatcctttttgaatggcacaggttgtcatccacaaattttaatttattgagtaatgttggaaattgaagctattgcagggctatggctaaggttgctattatggtccctgctgtttgcaattactactataccactactactacatagcctagccgctaatcacagcttgctaaagtaaagattgcacatgcttctgcaccctggatagggtcttctttacttacctaaataatcttttatagttattgcacatcacgttgttggatcccttgagagaacaatagcacttattgcaccatggtttagtgatccttcataaatactctctctgtctccttttatg

SEQ ID NO: 5680 - DNA, 2107 bp, Cajanus cajan
tcttctgttctgaaaatgataacagccttggacctctaccacgtgctgaccgccgtggtaccactctacgtggccatgatcctggcctacggctccgtcaagtggtggaagatcttcacgccggaccaatgctccggcataaaccgcttcgtggcgctcttcgccgtccccctgctctccttccacttcatcgcggcgaacaacccctacgccatgaactacaagttcatagcggcggattcgctgcagaaagccatcgtcctgggcgtgctcttcctctggtcgaggaccagctcgagagggtccctggagtggtccatcacgctcttctccctctccacgctccccaacacgctcgtcatgggaatccccttgctcaagggcatgtacggcgacgcctcggggaccctcatggttcagatagtggtgctccagtgcatcatatggtacaccctcatgctctttctgttcgagtaccgaggggccaggcttcttatcgtggagcagtttcccgacaccgctggctccattatttccttcaaggtcgactctgatgttatcagtttggatgggaaggagccgcttcagactgaggctgaggttggtgacgatggcaagttgcatgtcaccgttcgaaagtccaccagctccaggtctgacattttctctcgccgctcccatggccccaactcgctttcgctcacgccacgcccttccaatttgaccaatgccgagatttactcgctccagagttcccggaatcccacgccgcgaggctccagttttaaccacaccgatttttattccatggtcaatggagggaggaatgtgagccccaggcagagtaattatgggtttgatgaggagagtggagggaggggtaatggctaccctgctcctgccaatgctgggatcttctctccggtggctaagaagaagggtgaccctgctgctgctgctgctgctgctgctgctgctgctgctggtggtggtggtggtggtggtggtggcaaggatcttcacatgtttgtgtggagttcaagtgcttctccggtgtccgaaggtggaatccatgtattcagaggtggggattttgggaatgaccagcttcctgctactggtgtccctcaccacaaagattatgatgaatttggtcacgacgagtttagcttcgggaacagaaccgtggctaatggtgtggacaaggaagggccagtactttcgaagattggttcaagttccacggctgagcttcaccccaaagctcaaggtgaatccaaacccacgtccatgccacccacaagtgttatgacaagactcattttgatcatggtttggcggaagctgattaggaaccctaacacatattccagcctctttggtcttgcttggtctttgatctcgttcaagtggaatgttgctatgcccgcgattgttgctcaatcaatagcaattttatctaatgctggccttgggatggccatgtttagcttggggttattcatggcattgcagccaaagattattgcatgtggaaactcggttgcttcctttgctatggcagttcgtttccttactggacctgcagtcatggctgttgcttcaatcgttgtagggctcaggggagttctgttgcacattgctattgtacaggctgctctgcctcaagggattgtcccttttgtgtttgctaaggaatataatgttcatccggacatactcagcactggggttatatttgggatgctaatcgctcttccaattacgctagtttactacattttgcttgggctttgaaggaatgatgaggacgtgaagggaaaagaaaaagaaggctaattgcagtggattacactagtcttttgttatattataggttaatttttttgctatcctctaacaatgtagaatttgggaagttagcgagagggggggagtgacattgtaatatctaaattctaaacacaatggtgagagctggaagagaaagatgaaatattttagggctatagctactaggaaacttttgttttagcctttttactgtgaaccccactcttttatattttgcttcgttaaatgaaaaaagagaaagtgaagcttgttt

SEQ ID NO: 5681 - DNA, 1819 bp, Manihot esculenta
aacccacaacaaacctcaaaatgatcagtatcacagacctctaccatgttctcacagctgttgtgccactttatgtggctatgatcttagcctatggctcagtgaaatggtggaagatctttagccctgaccagtgttcagggatcaacagattcgttgctctatttgccgtgcctttgctttcttttcactttatctccactaacaatccttacgctatgaactataggttcattgcagcggacactctccaaaaaatcatagttcttgtggttttagccatctggtctagacttagttctagaggctcccttgaatggtccatcactctcttttctctctccactctcccaaacactctggttatgggcatccctttgttgaagggtatgtatggggactcctcgggaacccttatggttcaaatagttgtccttcaatgcataatatggtacacgttgatgctttttctatttgaatatagaggagctagaatcttgattggcgaacagtttcctgacactgctggctctataatctccttcagagttgattctgatataatttctttagatggtagagagccattgcaaactgaagcagagcttggtgaggatggcaagctccatgttacagtgaggaaatcaaccagctcaagatcagaaatcttctctcgcagatcccatggtccaaattcaggcctatcattgactcctagaccatccaatctaacaaatgcagagatatattctctccaatcttcaagaaatccaacaccaagaggctcaagctttaaccacactgatttttactcaatggtgaatggcaaaaatgcaagcaatgtgagtcctagacaatcaaactttggtaacctgccatttgatgaagaaaatggaggaattggagtgtatggaaatgtttcaagagcaaatgggaatgcttatcctgctccaccaaatgctgggatattctctcctggaaccaagaagaaagcaaatggagctgataatggcagagacttgcacatgtttgtttggagttctagtgcttcaccagtttcagaaggtgggatacatgtcttcaggggaggagctactgattatgccaatgaacttggtggggcaactcaccagaaagattatgatgagtttggtcgggatgagttcagctttggaaacagacaggtagccaatggggtagacagggagggtccagtgctatccaagcttggttcaagctccacagcagagctccacccaaaggctggtgctgatggcgaacccaagcccactgccatgccacctgctagtgttatgacaagacttattctcattatggtttggagaaaacttataaggaatcccaatacttattcgagcctcattggccttacttggtctcttgtttctttcaaatggaacgtagagatgcctgcgattattgctcgttccatatctatcctatctgatgctggtcttggaatggctatgtttagccttggtttgtttatggcattacagccgaagatcattgcttgtggaaactcggtcgcgtcatttgcaatggctgttagatttctcactggtcctgcagttatggctgctgcttcaattgctgttggattaaggggagttctgttgcacattgccatagtacaggcagctcttccacaaggaattgtcccctttgtttttgcgaaggaatataatgttcatcctgacatattgagcactggggttatatttgggatgttaatagctcttcccattacactggtctattacatcttgctgggactttgaagattaagcaggagaag

SEQ ID NO: 5682 - DNA, 2646 bp, Ricinus communis
tttctctccctctctctctctcaatattcttcttcccattgtttctgctgcttcttcttattgtctttcttccctcctttttatttgcttctcctcttcaaggtttctatactagttatgggttaatttcgctattgcaatcctcaaatatagtctctactaactgtctaaaagttttatctctctttgtttgttaagggtttcttgctagtttgggaggaaagaaaacgaagggacatctggcaagaaactgcaagaaagtgatacaacatatcattttcttgcataatctgcagcaacccatctgggttttactgttgcttatatatattagctaaactcaacagaggaccctaaaaaccaaactcagaaaagagacaatgattagtgctacagacctctaccatgttctcacagcagttgtgccactttatgtggccatgatcttagcttatggctccgtgaaatggtggaagatttttagccctgatcagtgttcagggatcaacagatttgttgctctatttgcagttcctttgctttcttttcactttatttccaccaacaatccttatgccatgaactacaggttcattgcagctgacactcttcaaaaagtcatagtcttgtttgttttagccatctggtctagaaccagctccagaggctctcttgaatggtccatcacgctcttttctctttccactcttcctaatactcttgttatgggcatccctttgttgaagggtatgtatggggatgactcagggagtcttatggtccaaatagttgtccttcaatgcataatatggtatactttgatgctctttctgtttgaatatagaggagctagactcttgattggtgaacagtttcctgatactgctggctctataatatcctttagagttgattctgatatcatatctttagatggtagagaaccattgcaaactgaagctgaggttggtgaagatggaaaacttcatgttacagtaagaaaatcaactagttctagatcagaaatcttctctcgtagatcacacggtccaaattctggtctttcattgactcccagaccatctaatctaaccaatgtagagatttattctcttcaatcttcaagaaatccaactccaagaggctcaagttttaaccatactgatttttactcaatggttaatggaaaaaatgcaagtaatgttagtcctaggcaatccaactttggtaacttgccatttgatgaagaaaatggaggaattggagtgtttggaaatgtctcaaggacaaatggaagtgcttatcctgcaccacctaatgctgggattttctctcctggagctaagaagaaggcaaatggagctgaaaatggcaaggatttacacatgtttgtatggagttccagtgcttcaccagtatcagaaggtggaattcatgtcttcaggggtggggatcatggcattgaccttggtggggtagctcaccagaaagattatgatgagtttggtcgagatgagttcagctttggaaacagaccagtgccaaatggggtggacagggagggcccagtgctttccaagcttggctcaagctccacagcagagctacacccaaagactggtgttgatggtgaaccaagggctactgccatgccacctgctagtgttatgacaagactcattcttattatggtgtggagaaagctcataagaaatcctaatacttattccagcctcattggccttacctggtctcttgtctctttcaaattgcatatagaaatgcctgcaatcattgctggttctatagccatcctgtccaacgctggtcttggaatggcaatgtttagtcttggtttgttcatggcattacagccaaggatcattgcttgtggaaactcgattgctacttttgcaatggctgttagattcctaactggtcctgcagtaatggctgctgcttcatttgctgtcggattgcgcggagttctgttgcacatagccattgtgcaggcagctcttccacaagggattgtccccttcgtctttgcaaaagaatataatgttcatcctgacattttgagcactggggttatatttgggatgttaatagctcttccaatcacactggtctattatatcttgcttggactttgaaggtggaagcagtacttgaagctgataagagtagtaatagtagtattttttttacccatatggaatgtgggatttttggacgtggtctaacacaacaacttgaacccgaagattattattggcacttcaaaaattagagataatgaagcaagcaacaagtaggaagaagaggacttggaagggtgactaagagtactaccatttctcttcaaacatgaggtagtgagtgacaaaaggaggggaacaaagtgggaaatgaaaatatttgacaattgatggcttgagctttttgttctctttttgccttatttttgttcctctgagccttgtgccttcttttggcttttgttcttttgatgaggaaagtaaagcttgtttctagttaaagatgcttctatcctccttttgtttttgttttgttttttttttttttttcctgcaaggtcacaacattttaaccctcttggaatctacccaacaaaatctttat

SEQ ID NO: 5683 - DNA, 2569 bp, Prunus mume
ctctctctctctctctctctctaggtagagagagaataaaaaactctggtcattttccggcggttgctctcgttttcactgtacttaatatctcgcattttccatctttgtcattgactcttcacctgaaaatgggttgatattttgcgtccaaagtcacacgaaaactggttttcgtctgctttatcttaccttgggttctgccattaatcccattttcacatctgggttttcctcaaatcccaacacaacccatcaaaaacagagaaaggcgcgacctttattaagccaaaaaaaaaaacacacacacacacacaaacacaaacaaagaacaagaaaacatgatcagtttcacagacctctaccacgttctcacagctgttgtgccactctatgtggccatgatcttagcctacggctcagtgaaatggtggaagatcttcagccctgatcagtgttcgggcataaaccgctttgtggctctgtttgcagttcctctgctctctttccacttcatctccaccaacaatccatatgccatgaactacaggttcatagcagctgacactcttcagaaagtcatagtcttggtggccctagcagtatggtcaagaaccagctcaagaggctctctagaatggtccataactctcttttctctctccactctccccaacactctggtcatgggcatacccttgttaaagggcatgtatggagatgcctcaggcagcttgatggtccaaattgtggtcctccaatgcatcatttggtacacgctgatgctcttcttgtttgagtacagaggagctaggctcttgattggggaacagttcccagacactgctggctccatcatttccttcagggttgattctgatatcatttccttagatgggaaagagccgttgcaaactgaagctgaggttggtgaagatggcaagctccatgtcactgtcagaaaatctacaagctctcgctctgaaatctactccagaagatcccacggacccaactctggcgtttccttaactccaaggccttctaatctaacaaatgctgagatttacagccttcagtcttcaagaaacccaactcccagaggttcaagctttaaccacaccgatttctactccatggtgaacggcaagaacatgagcaatgcgagtccaaggcagtcaaattatggaaatgttgggtttgatgaagaggcaggaggagttgggatgagaggagcaaatggggtttatccgccggggaattcagggtatcccgcacctcctacagccggaattttctctccggtgacagggcccaatgcgaagaagaaacccaatggggctgatggcggtaaagatctccacatgtttgtttggagctcaagcgcctcacctgtgtctgaaggaggcattcatgttttcagaggtggagagtatggcaacgacattggtggggttgctcaccaaaaggattacgatgagtttggccgagatgagttcagctttgacaacagaccaaattcaaatggggttgaccgggaaggtcctgtgctttccaagttgggttcaagctccaccactgaactccatcccaagacagctcatggtgaaccaaaggccacagccatgcctcctgctagtgttatgaccagactgattcttatcatggtttggcgaaaactcattcggaacccaaacacttactccagccttattggcctcacctggtctttagtctcatataagtggcacgttgttatgcccgcaatcgtggcccgttcaatcgccattctgtcggatgcaggtcttggaatggccatgtttagtcttggcttgttcatggcattacaaccaaagatgattgcctgtggaaattcagttgcatcctttgccatggcagttcgattcctctctggtccggctgtcatggcggcagcctcaattgctgtaggactgcgaggtgttctgttgcacattgccattgtacaggcagctcttccacaagggattgttccctttgtctttgccaaggaatacaatgttcatcctgacatactaagcaccggggtaatttttggaatgctaattgctctgcctatcacattggtttactacatcctgcttggactgtgaaacagaatctcttaacttgttgagcaaacagtagtcataatgtagttctcaccattttggcattgggattttgctttttggctctctaacagaagaacagcatagattttcagaagaacgtggacaagaagatagagatgtgggaggaaatataatgacaagttctcttcgcacaaggtaggtagagagagagagagagagaagagagagaagaatcagagatggagaaatgagcttttaggaagctctgctacttttttattctcattttgcccttttctatgaaccctttgtgcctttgttttttgttcttttgatgaagtgaagcttgtttgtagttggagatgccctctactttctaaccttttaatttttcctaaggtcaaaaaggatttaatcccaattggaatctctatgctagaaatttaaagccaaac

SEQ ID NO: 5684 - DNA, 1816 bp, Prunus persica
aaaacatgatcagtttcacagacctctaccacgttctcacagctgttgtgccactctatgtggccatgatcttagcctacggctcagtgaaatggtggaagatcttcagccctgatcagtgttcgggcataaaccgctttgtggctctgtttgcagttcctctgctctctttccacttcatctctaccaacaatccctatgccatgaactacaggttcatagcagctgacactcttcagaaagtcatagtcttggtggccctagcagtatggtcaagaaccagctcaagaggctctctagaatggtccataactctcttttctctctccactctccccaacactctggtcatgggcatacccttgttaaagggcatgtatggagatgcctcaggcagcttgatggtccaaattgtggtcctccaatgcattatttggtacactctgatgctcttcttgtttgagtacagaggagctaggctcttgattggggaacagttcccagacactgctggctccatcatttccttcagggttgattctgatatcatttccttagatgggaaagagccgttgcaaactgaagctgaggttggtgaagatggcaagctccatgtcactgtcagaaaatctacaagctctcgctctgaaatctactccagaagatcccacggacccaactctggcgtttccttaactccaaggccttcgaatctaacaaatgctgagatttacagccttcagtcttcaagaaacccaactcccagaggctcaagctttaaccacactgatttctactccatggtgaacggcaagaacatgagcaatgcgagtccaaggcagtcaaattatggaaatgttgggtttgatgaagaggcaggaggagttgggatgagaggaggaacaaatggggtttatccgccggggaattcggggtatcccgcacctcctacggccggaattttctctccggtgacagggcccaatgcgaagaagaaacccaatggggctgatggcggtaaagatcttcacatgtttgtttggagctcaagcgcctcacctgtgtctgaaggaggcattcatgttttcagaggtggagagtatggcaacgacattggtggggttgctcaccaaaaggattatgatgagtttggccgagatgagttcagctttgacaacagaccaaattcaaatggggttgaccgggaaggtcctgtgctttccaagttgggttcaagctccaccactgaactccatcccaagacagctcatggtgaaccaaaggccacagccatgccacctgctagtgttatgaccagactgattcttatcatggtttggcgaaaactcattcggaacccaaacacttactccagccttattggcctcacctggtctttagtctcatataagtggcacgttgttatgcccgcaatcgtggcccgttcaatcgccattctgtcagatgcaggtcttggaatggccatgtttagtcttggcttgttcatggcattacaaccaaagatgattgcctgtggaaattcagttgcttcctttgccatggcagttcgattcctctctggtccggctgtcatggcggcagcctcaattgctgtaggactgcgaggtgttctgttgcacattgccattgtacaggcagctcttccacaagggattgttccctttgtctttgccaaggaatacaatgttcatcctgacatactaagcaccggggttatttttggaatgctaattgctctgcctatcacattggtttactacatcctgcttggactgtgaaacagagaatctcttaa

SEQ ID NO: 5685 - DNA, 2011 bp, Gossypium hirsutum
aacctttgtttcctaccgttggttcctttcctttatttaacaaatcccacaatgatcagtgcaacagacctttaccatgtcctcaccgccgttgtacctctctacgtagccatgattttagcttacggctcagtcaaatggtggaaaatcttcacccccgatcaatgttccggcatcaaccgtttcgtcgctttatttgccgtccctttactttcattccatttcatatcaactaacaatccatacaccatgaacttaaggttcatagccgctgatacccttcaaaaactcatcgtcctagtacttttagccatatggtcaagaactagctcaaggggttccttagaatggtccataaccttattttcactctcaacactccccaatactttagtaatgggcatccctttgttaaaaggcatgtatggggattattcagggagtttaatggttcaaatagtggttttacaatgtataatttggtacactttgatgttattcttgtttgaatatcgtggtgctaagctattaatagctgaacaattcccagatactgctggttctataatttcatttaaagttgattctgatgttttgtcattagatggtaaagaacctttacaaaccgatgctgaagtcggtgatgatgggaaacttcatgttactgtgaggaaatcaactagctcaagatcggaaatcttttctcgccggtcacatggtttgaattccggtatggggttaacaccaagaccttctaatttaaccaatgctgaaatttattcacttcaatcatctaggaatccaacaccaagaggttctagttttaaccatactgatttttattcaatggtgaatggggggaagaacaatgttagtccaaggcaatcaaattatgggacaggatttgatgaagagaatggcgttggggtgtttggtaataatggtataagatcaaatggtggttcatatcctgctccgacaagtgctgggatcttttctccggtgactgctcccaagaaggcaaacggtggcggtgatggtggtggaaaggatttgcatatgtttgtttggagttcaagtgcttcccctgtttctgaaggtggtatacatgttttcaaaggtggagattatggcaatgatcatcatcataaagattatgatgaatatggtagagacgaattcactttcggtaataaggcagcaacgaacggcggtgtcgatcgagaaggaccggttctttccaagcttggttcaagttccacgactgaacttaacccgaagattgaaacaaagccgaccgctatgcctccagctagtgttatgactagacttatattgatcatggtgtggcgaaaactaatccggaatcccaacacttactcgagtttgatcggtctcacttggtctctcgtttcgttcaagtggaatatccaaatgcctgccatagtagccggttcgatatcgattctttccaatgcaggtctcggaatggccatgtttagcctcggcttattcatggcacttcaaccaaggataattgcatgcgggaacacgatcgcgacctttgctatggcggttcggttcctaactggtcctgcggttatggcagctgcctcgatcgctgttgggttaagaggtgttcttctccgcattgctatcgtgcaggcagctcttccgcaagggatcgtacctttcgtctttgcgaaggaatacaatgttcatcctgatatattgagcacaggggttatctttggaatgctgattgcccttcccataacactggtttactacattctattgggactttgaagctgacaagagtaaagaaaaggagactgaccaaattaaccctcccatcattttgcaaacggcaacgttttggtgtttctcttcttaaaaaaatcactgttataattttgtccaactgatatggtgatttacagtgaaattatctgatcttttttatttatttatctttttgacaatatttaaaagaaaaacgtgcttggaa

SEQ ID NO: 5686 - DNA, 3023 bp, Quercus alba
tatatttcttatctatctcattctcatgtgccataaggattaaggacactatatataaattgcagaaagtgaagagaatcttgtgaagctctcctggtttctccttttctttcccttttcctcttacttctctctctttctctccgatgctgcttggtcttttccctctcactcacagactcacttttactttcctctgaggtgctcattcctctctctctctcatttttccaaatccaaaaaagaaaaggctgaaaagaaatagaaaaagaaaacaaaaaccttcagaaaagccctcagcttttatttctttgtctgccattaaaatgccataaatataaccgtttgcttctctttcccatccccactagctaccctctttctctttctctctctctctctctaaccctcgccggaaaataaccttccagtccttttccggcggtttcctctatttaccactatcactattttcccccttattttcttagctttgtttctttgagttttttaaaaaatgggttaactttatgtgcttattttcttctacatattttcctcagcatcaatactggactcttttaactcataaaagaactaactttcctaagctggactggttttccgaatagaaaacacaagaaaatctcagagaaaatccgggaaagttaacagtttttcttccactttttgcaaaaccccatctgggttttctctttgaccccgttttctcatctgggtatcactcaaaaccctcccaaagccccatctgacaaaagaaaaaaaaaatgattactctcacagacctctaccatgtcctcacagcggttgtgcctctctatgtggctatgatcttagcttacggttctgtaaaatggtggaaaatcttcagccctgaccaatgctcaggcatcaaccgctttgttgccctatttgcagtccctctgctttcctttcacttcatctccaccaacaacccctatgccatgaacttcaagttactagcagctgacactcttcaaaaagttatagtcttggtggtcctagccatttggtcaagggccagctcaagaggctcacttgaatggtccatcacgctcttctctctctcctctctccccaacacacttgtcatgggcattcctttactcaaaggaatgtacggtgatgcctcagggactctcatggttcaaatagttgtcctccaatgtatcatttggtacacactcatgcttttcttgtttgagtacagaggagccaggcttttaatcgttgagcaatttccagacactgctggctctatcatatctttcagagttgattctgatatcatttctttagacgggaaagaaccacttgaaacccaagctgaagtcggtgaagatggtaaactccatgtcactgttagaaaatccgcttcttctcgttcagaaatcttctctcgtcgctctcatggtccaaattctggtctttcactcactcctcgaccttcaaacttaacaaatgctgagatttactctctccaatcttcaagaaacccaactcctagaggttctagtttcaaccacactgatttttactccatggtgaatggtaagaatgctagcaatgtgagcccaaggcaatccaattttggaaacttgggttttgatgaagagagtggagtaaacgtgtttggaaacgcagggagagctaatggggcttatccagctcctcctagtgctgggattttctcacctggaactacaaagaagaaggctaatggtgttggtggtggtgagggaggaaaagaccttcacatgtttgtatggagctcaagtgcttcccctgtgtcagaaggtggcatccatgttttcagagggggagagtatgggaacgagcttggtgctggggttggtcaccaaaaagattatgatgagtttggtcgggatgagttcagctttgggaacaggccggtgacaaatggtgttgacagggaaggtcctgtgctttccaagcttggttcaagctctacaactgagcttcatcccaagactggcgctcatgttgaatcaaagctgacaaatatgccgcctgctagtgttatgaccagactcattttgattatggtgtggcgaaagctcattaggaatcccaatacatactccagcttgattggcctcacttggtctctggtttcattcaggtggaaaattgaaatgccggccatagtagctggttcaataggcattctctctagtgctggtctcggaatggccatgtttagtcttggtcttttcatggcattgcagccaaaaattattgcatgtgggaactccattgctgcctttgccatggctgttcgattcatcactggtcctgcggtcatggctgctgcctcatatgctattggactaagaggagttctgttgcacattgctattgtccaggctgctcttccccaagggattgtccccttcgtttttgcaaaggaatacaatgttcatcctgacattctcagcactggggttatatttgggatgctaatagctcttcctattacactagtttattacatcttgctgggactttgaagctgagacattgaagctactaaggaaatagttatggtagaatatgttgtaacccttttgaaaaggatggggtgttttttgtcattctctaacagatgaacaacatagaatttcatgactttagagagggaggaaggaagaaaaagtagggggaagcaaaaggaaagaagaacgagaaaattgaagccattggggagtgctctaattttttgttgtcattttgcctttcgtgctgaaccttgtgcttagtgccttactactgcttttgttcttttgccgaggaaagtgaagtgtattgtagctgtagtcttgtagatacgtctactttttactacctttttaaggtcaaaaaaagaattttaactcaattggaatctctatgcaaagaaaagtaccagcaaaaaactaaaaagtagcttttctttttcttagagagaaacgtgtgaaagt

SEQ ID NO: 5687 - DNA, 2268 bp, Gossypium raimondii
gtctgccatcaactcccttaaatattaactcctttccccttccctcctttttctctcccatcccatacccattatcgcctgaaaaccattttccgactcaccggaaaaccattcttatccatttccccttcttcttcccttataacccatcaaccccagcaccacaatgggctgaaaggaaccttttttttccccttctttaaccacttcaacccctcaaaataaccaaaacaacctgtttttcaccttggctttccatttttttttcaaaaatcccacaatgatcagtgcaacagacctttaccatgtcctcaccgccgttgtacctctctacgtagccatgattttagcttacggttcagtcaaatggtggaaaatcttcacccccgatcaatgttccggcatcaaccgtttcgtcgctttatttgccgtccctttactttcattccatttcatatcaactaacaatccatacaccatgaacttgaagttcatagccgctgatacccttcaaaaactcatcgtcctagtacttttagccatatggtcaagaactagctcaaggggttccttagaatggtccataaccttattttcactctcaacactccccaatactttagtaatgggcatccctttgttaaaaggcatgtatggggattattcagggagtttaatggttcaaatagtggttttacaatgtataatttggtacactttgatgttattcttgtttgaatatcgtggtgctaagctattaatagctgaacagttcccagatactgctggttctataatttcatttaaagttgattctgatgttttgtcattagatggtaaagaacctttacaaaccgatgctgaagtcggtgatgatgggaaacttcatgttactgtgaggaaatcaactagctcaagatcggaaatcttttctcgccggtcacatggtttgaattccggtatggggttaacaccaagaccttctaatttaaccaatgctgaaatttattcacttcaatcatctaggaatccaacaccaagaggttctagttttaaccatactgatttttattcaatggtgaatggggggaagaacaatgttagtccaaggcaatcaaattatgggacaggatttgatgaagagaatggcgttggggtgtttggtaataatggtataagatcaaatggtggttcatatcctgctccgacaagtgctgggatcttttctccggtgactgctcccaagaaggcaaacggtggcggtgatggtggtggaaaggatttgcatatgtttgtttggagttcaagtgcttcccctgtttctgaaggtggtatacatgttttcaaaggtggagattatggcaatgatcatcatcataaagattatgatgaatatggtagagacgaattcactttcggtaataaggcagcaacgaacggcggtgtcgatcgagaaggaccggttctttccaagcttggttcaagttccacgactgaacttaacccgaagattgaaacaaagccgaccgctatgcctccagctagtgttatgactagacttatattgatcatggtgtggcgaaaactaatccggaatcccaacacttactcgagtttgatcggtctcacttggtctctcgtttcgttcaagtggaatatccaaatgcctgccatagtagccggttcgatatcgattctttccaatgcaggtctcggaatggccatgtttagccttggcttattcatggcacttcaaccaaggataattgcatgcgggaacacgatcgcgacctttgctatggcggttcggttcctaactggtcctgcggttatggcagctgcctcgatcgctgttgggttaagaggtgttcttctccgcattgctatcgtgcaggcagctcttccgcaagggatcgtacctttcgtctttgcgaaggaatacaatgttcatcctgatatattgagcacaggggttatatttggaatgctgattgcccttcccataacactggtttactacattctattgggactttgaagctgacaagagtaaagaaaaggagactgaccaaattaaccctcccatcattttgcaaacggcaacgttttggtgtttctcttcttaaaaaaatcactgttataattttgtccaactgatatggtgatttacagtgaaattatctgatcttttttatttatttatctttttgacaatattaaaaaaaaacgtgcttggaatagacttttgtttttaatgttaattttttt

SEQ ID NO: 5688 - DNA, 2841 bp, Vitis vinifera
attttcttctgctttcagtatctcttggatgctgtttggttttttgccttctcacacacacaaagtacttttcctctttactcctctgagataccaatttctccctatgtctctgaaagtgtgaagaggtttctctttctcatccagaaagactataaaaaagcgtctgaaaagccctctgcttttacttctcttgtctgccattaaaatgccttaaatataactacgcttcacttccctcccacacaccccccttacgcttcttcgtctattctctctttctctggagctggtccggaggcaagctccgtccttttatccatcgtttttgtatcttctgttcccttcttctatttcgttttgtttgctctactgtctgtcatttttatgaaaatgggttgatttaagtgcttatactctttatggtactgtcaattttgcgtccatttcttactgcactagctcatcttatcagactagttttccggtgactgaaaaggttccgggagtttttcttcaattttctgcttatccatcttcactccattttctcatccgggcgttcctcgaaatccattttttaagtagagagtttctgcgaaggagggaaaagaaaaggcaagaaaacatgattagtattacggacctctaccacgtcctcacggctgtcgttcctctctatgtagccatgatattggcgtatgggtctgttaaatggtggaagatcttcagccctgatcaatgttccggtatcaaccggttcgtggcactgtttgctgtccctctgctttcgtttcacttcatctcctccaacaacccatatgccatgaactacagattcatagctgcagacactcttcagaaaatcatagtgttggtggttctagctatctggtccagaaccagctcaagagggtgtcttgaatggtccatcactctgttttcgctctcaactctgcccaacactctggttatgggcattcctttgttgaagggtatgtatggagaggcttcaggaaccttaatggtgcaaatagtcgttcttcaatgtataatatggtacactttgatgctgttcttgtttgagtacagaggagccaggctcttgatcgtagaacagtttccagatactgctgggtctattatttcattcagagttgattctgacatcatctctctggatgggaaagagcctctgcagaccgaggctgaagtcggtgaagatggaaaacttcatgttacagtgagaaagtccaccagttctcgctctgaaatattttccaggcgatcacacggccctaattcgggagtctccttgactccccggccttccaatttaacgaatgcggagatttactctcttcaatcatccaggaatccaactcccaggggttccagtttcaatcacactgacttctattcaatggtgaatggaaagaatatgaacaatgtgagcccgaggcaatcaaatttcgggaacttgacttttgacgaggaaaacggaattggcggattcccaaatcctcccagagcaaatggtgtctattcacagggtggtggttaccctgcaccgccgagtgccggaatcttctctccggtggcgggaccgggagcaaagaagaaggccaacggggcagacggagggaaggatcttcacatgtttgtttggagctccagcgcatcaccagtgtcggaaggaggcattcatgttttcagaggtggagactatgggaatgagcttggtggggtacctcacactaaagattacgatgagttcggtcaagatgagttcagcttcgggaatagagcgtctgtgaatgggggtgaccgagaagggccgaccatgtccaagctcggctccagctccaccacagagcttcaccccaaaactgctccccagtccaagccaacatccatgcccccggctagtgttatgaccagactcatcctgataatggtgtggagaaaactcattaggaatcccaacacttattctagcctcattggcctcacctggtctttggtctcttacaagtgggagattgaaatgcctgccatcatagctaagtctatatccattttatctgatgcaggtcttggaatggccatgtttagtcttggtttgttcatggctttacagcccaaaattattgcatgtgggaactcagttgcaacatttgccatggctgttagattccttactggtcctgcggttatggctgctgcttccattgcagttggattaagaggggttcttctacacattgccattgtacaggcagccctaccacagggaatcgtcccctttgtgtttgccaaggaatacaatgttcatcctgatatattgagcacaggggttatatttgggatgctaatagctttacccattacgctggtttactacattctgctggggctttgaagatggaaaccactgtcagatgaaaaagacttggtaccagacaccagttgccttagattttttacccttctggtatcagttgtttttttttttttttggcttctctaacagaacaaaatagaatttgagaagaacttaacagagcatagagagatggaagaggaaggcaagttgtcagggacacgaagggtgaaggaggagaatgcagaaatgagggatattttggagcatatgaccgttttagggttaagaatttttgtattcctttttggcttttctgaacacctctgtgcttttgcttttgttcttttcatctaaagaaagagcagtttgtttgtagctgagataccagttacttttgacatttttcaggtcaaaaagatttacccaactggaatccctatgcaatagagagattg

SEQ ID NO: 5689 - DNA, 2479 bp, Lactuca sativa
attttctctctcatcatcaaaagactataaaaaagctctcaaaaacatcagcttttatttccctgtctgccattaattcccataaatataacacatcacatcgccttcctttccccctcataccccctttctccttaaaatcagactcccttttcttcttccttcatttcctttcaggtttcatggaccaaaagacccacctcaaacctaaacctttttcttcttcatctttaaccttttctttagcataaatcacacttgggttttgacccttttgtagcttacattcttgttttatctgggttttgtttcgattttgaaaaacagaaaagaaaaatgatcaccggttccgatctttaccatgttctcacagccgttgtgccactctacgtagccatgatcttagcctatggctcagtaaaatggtggaagatcttcaccccggatcaatgttcaggaatcaacagatttgtggctctttttgctgttcctttgctttcgtttcatttcatctctaccaacaatccttacaccatgaacactcggttcatagccgctgacactctgcaaaaactcatagttcttgtggttcttgccatctggtcaagagttagcgctagaggctcactcgaatggtcgatcactttattctcactttcgactcttccaaacaccctcgtcatgggaatccctttgttgaaaggaatgtacggagatttttccgggagtttaatggttcaaatcgttgttcttcagtgtattatttggtacactttgatgttgtttttgttcgagtatagaggtgctcgtcttttgattgctgaacagtttccagacactgctggttcgattatttcattcagagttgattccgatattctgtcgttagacggaaaagagcctctgcaaacggaggcggaagttggagacgacggaaagcttcatgtcactgtgaggaaatccaccagttcccggtcggagatcttctcacggcggtcgcacggcggaatgaattccggggtttccttaacaccacgtccttcaaacttaacaaatgctgagatttactctcttcagtcatcaagaaacccaactccgaggggttcgagcttcaaccacaccgatttctactccatggttaatgggaagaatgctagcggtgttagcccacgagggtcgaattttgggaacgtagggtatgatgaagagagtggcaataacactgttagggtgaatggacagggaagtacagggtatcctgcaccaactaatgccggaatcttttctccggtgtcaggtccggcggggaagaagaaaggcggtggtggcgatggtggtggaaaagatcttcacatgtttgtttggagttcaagtgcttcacctgtttcagaaggagggattcatgtgtttagaggtggagagtatggtaatgatcttggaggtgtaccccacactaaagattacgacgattttggccggaacgagttcagtttcgggaaccaaccaggcccgaacggtgtggaccgcgaagcatcggttttgtctaaactcgggtcgagctcgactgctgagctccacccaaagtctagccctcatggtgaacctaaggcatcggctatgccaccggctagtgtcatgactcgactcattttaatcatggtgtggcgcaaacttattagaaaccccaacacttactcaagtctcattgggctcacatggtccttagtgtcattcaaatggcatgttcaaatgcccgcaatagttgcaaaatccattgcgattctctccgatgccggtcttggcatggccatgtttagtctcggtttattcatggcattgcaaccgaagattatagcgtgtgggaactcagttgcgactttcgccatggcggttaggtttttgactggacctgcggtcatggcggctgcatcgattgcggttggacttcaaggaactttgttacatgttgccattgtccaggcagctctcccacaaggaattgtcccttttgtgtttgccaaagaatacaatgtacatccggatatacttagcacaggggttatatttggaatgttgatagcgctaccaattactctggtgtactacattgtgttggggctttgaatggatgctgacttttgtcctgtttgaagaaggaagggtttttttgggggttctctaacatgtgaaattaccattttgttaacgtagtaaaagagaaaaagagagagaaattagaggggaggggtgggggtggagagggagagaaatgtaatttgataagaagaagacattgtctggtagtagaatcaatgtttgtctctccaagttcttttgtgtattccaacaagaaaagcagtgaaggctgagatgcttcttcttcttctacagttttactttacttcctttgcacttttggcagatatttagtacattggaatcccaatgcggcaatgctgcaacattttgtcttgtcaca

SEQ ID NO: 5690 - DNA, 2236 bp, Vitis vinifera
cttctttccatcttctctctttctctgaagctcactgtgagatctgcctaatattctatgatattggttgatttgtgtgctttttctctttctatactaacttatctcatactagtcttttaccatcgaactgattttgtggtaaggttttcgccggtctcccaggaactccggaggatttctctgaaggagggaaaagagcaggaaagaaagcatgattgctattacagacctctaccacgtcctcacatccgttgttcctctctatgtggccatgatattggcttatgggtctgtaaaatggtggaagatcttcagccctgatcaatgctccggtatcaacagattcgtagcactgtttgctgtccccctgctttcgtttcacttcatctccaccaacgacccatatgccatgaactacagattcatagctgcagacactcttcagaaaatcatagtgttggtggttttagctatttggtccagagtcagctcaagagggtgtcttgaatggtccatcactctgttctcgctctcaactctgcccaacactctggtcatgggcattcctttgttgaagggtatgtatggagaatattcgggaaccttaatggtgcaaatagttgttcttcaatgcataatatggtatactttgatgctgttcttgtttgagtacagaggagccaggctcttgattgtagagcagtttccagatactgctggttctattatttcattcagagttgattctgacgtcatctctctggatgggaaagagcctctgcagacggaggctgaagttggtgaagatggaaaacttcatgttacagtgagaaagtccactagttctcgctctgaaatattttccaggcgatcacacggccctaattcgggcgtgtccttgactccccggccttccaatttaacgaatgcagagatttactctctgcaatcatcaaggaatccaactcccaggggttccagtttcaatcacactgatttctattcaatggtgaatgggaaaaatatgagcaatgtgagcccgaggcaatcaaatttcgggaacttgacttttgatgaggaaaacggaattggcggattcccaaatcctcccagagcaaacggggtatattcacagggtggtggttaccctgcaccgccgagtgccggaatcttctctccggtggggggacctggagcaaagaagaaggcgaacggggcagatggggggaaggatcttcacatgtttgtatggagctccagcgcatcgccagtgtcggaaggaggcattcatgttttcaggggtggagattatgggaatgaggttgctggtggggtactacctcaaactaaagattatgatgagtccagacaagatgagttcagttttggaaacagaccggtcgcgaatggtggtgaccgagaaggggccatgatgtctaagctggggtccagctccaccgcagagctcaaccccaaggctgctgcccagtcaaagccaacatccatgccgcctgctagcgtcatgaccagactcatcctgataatggtgtggagaaaactcattaggaatcccaacacttattctagcctcattggcctcacctggtccttggtctctttcaagtgggggattgaaatgcctgctattatagccaagtctatatccattttatctgatgcaggtcttggaatggccatgttcagtcttggtttgttcatggcactgcagccaagaattattgcttgtgggaactccattgccacatttgccatggctgttagattcctcacaggtcctgcggtcatggctgctgcttccattgcagttggtttaagaggggttctcttacatattgccattgtacaggcggctcttcctcagggaattgtcccctttgtgtttgccaaggaatacaatgttcatcctgacattctgagcacaggagtaatattcggaatgctaatagctctacccatcacacttgtgtactatatcttactggggctatgaagatgaagcacttaaactgccatggtatcagggcttttgttttttagggcttctcaaacagagcaatgtaggatttcagaacttaaaagggctatagagagagagctggaagcggaaggcaagttgtcaatgacacacaggatgaaggctgatgaaaaatgcggaatatattcgaaatgtatgtcggattagggttaagaatttttgtatgcctcttttggc

SEQ ID NO: 5691 - DNA, 1827 bp, Malus domestica
cacctttaaccaaacatgatcagtttcacagacctgtaccacgtcctcactgccgttgtgccgctgtacgtggccatgatcttagcctacggctccgtgaaatggtggaaaatcttcagccccgaccaatgctcgggcatcaacaggttcgtcgctctgttcgcagttcctctgctctccttccacttcatctccaccaacaacccctacgccatgaactacaggttcatagcggctgacacccttcagaaaatcatcgtcctggcggtcctggctgtgtggtcgagaacaagcgccagaggctctctcgaatggtccatcactctcttctccctctccactctgcccaacactctggtcatggggataccacttttgaagggcatgtacggcgacgcctccggcagcctcatggtccaaatcgtcgtcctccagtgcatcatttggtacactctcatgctcttccttttcgagtatagaggtgcccgcctcctcattggtgaacagttcccggacaccgccggctccatcatttccttcagggtcgattccgacatcatatccttggacgggaaagagccgttgcagacagaggccgaggtaggagaagacgggaagctccatgtcactgtcagaaaatcgacgagcactcgctccgaaatccactccagaagatcccacggacccaactccggcgtgtccttaaccccaaggccttctaatctcaccaatgcggagatttatagccttcagtcttcgagaaacccgactcccagaggctccagctttaaccacactgatttttactccatggtgaacgggaaaaacatgagcaatgccagtccgagacaatcgcactacggcaatgtggggtctgatgaggaggccggaggagttgggggggccagaggacgagcaaatggggggaattcggggtatccggcgcctcccagtgccggaattttctctccggtgaccggacccgctgccggagccaagaagaaacccattggggctgatggtggcaaagaccttcacatgtttgtttggagctcaaacaattcgcctgcgtcggaaggaggcattcatgttttcagaggaggagaatatggcaatgaacttgctggggttgctccccactacaaagattatgatgagtttggccgaaatgagttcagctttgacaacaggccggcttcaaacgaggctgatcgggaaggtccggtgctttccaagttgggttcgagctccaccactgaactccaccccaagacagctaatggtggtgaatcaaagaccgcagccatgccgcctgctagcgttatgacccgacttattctaattatggtgtggcgaaaactgattaggaacccaaacacttactcaagcctcattggcctcacctggtctttggtctcctacaagtggcacattgttatgcctgcgattgtagcccgctcgattgccattctgtctgatgcaggtcttggaatggccatgtttagtcttggcttgttcatggctttacaaccaaggatgattgcttgcggaaatacaattgcttccttcgccatggcagttcgattccttacagggccggctgtcatggcggcggcctcaattgccgttggactgcgaggtgttctgttgcacattgccattgtacaggcagctcttccacaagggattgttccgtttgtctttgctaaggaatacaatgttcatccaaacatactaagcaccggggttatctttggaatgctaatcgctcttccgatcacattggtttactacatcttgctagggctttgaaacagagatctattt

SEQ ID NO: 5692 - DNA, 2899 bp, Populus trichocarpa
agaaatgaaagtgggagagtgagaatcttttttatgttaagctctgtttttcccttcttttttcactcccttctttttctctctgatatgctgctggctagtccttttcctctctcactccacgcacacacacaactacgctcttctcctcttcccccaccccaccctctctccagtacagggccttaggtatatagataccctctgtctttgaaaaaacagtactcttatttctgtttctaactagtttggcagcagggaaaacgagggaaaacctgagggaaaaagtgagaaaattatgaagggtctaatttgtcttgcataatctgcaaaacctctctgggttttactgctaactcaattttctcatctgggtactctttaaagctcccaaaacctctcttaaaaactaaacttgataaagcaacgatgatcagtataggagacctctaccatgtccttacagctgtggtacccctctatgtggccatgattttggcttatggttctgtcaaatggtggaaaatctttagccctgatcaatgttcagggatcaacagatttgttgctctgtttgcagtgcccttgctttcttttcacttcatttccaccaacaacccctatgctatgaacttaaggttcattgctgcagatactcttcaaaaaattattgtcttggtggttttagctatttggtccagagctagctccagaggctcccttgaatggtccattactttgttttcactctctagtctcccaaacactcttgttatgggcatccctttgttgaagggaatgtatggacattcctcagggagtctcatggtccaaatagttgttcttcaatgcataatatggtacacattgatgctgttcttgtttgagtatagaggagctagaatcttgattggtgaacagtttcctgacacagctggctctataatatccttcagggttgattctgatattctttctttagatggtagagagccattgcaaaccgaggctgaagtcggtgaagatgggaagttacatgttactgttcggaaatcaactagttcaagatcagaagttttttctcacatgtcccatggtctaaattctggtctttcattgactcctagaccatctaatttgaccaatgcagagatatactctctacaatcctcaaggaatcctaccccaagagcatcgagttttaaccataccgatttttattccatggttaatggcaagaatgcgagtccaagacactctaacttcactaacttgcaattcgatgaagaaagtggaggacttggggtatttggtaatgttccaagagcaaatggaagtgcttatcctgctccaccaaatgctggaatcttttctcctgggggtaaaaagaaggcaaatggggctgagaatggcaaggatttgcatatgtttgtttggagttcaagtgcctcaccagtatctgaaggtggcctccatgtctttaagggaggggattatggcaatgacctcggtggggtagctcaccataaagattatgatgagtttggtcgagatgagttcagctttggaaacagacctggacctaatggggtggatcgggatggtccagtgctttctaagcttggttcaggctctacagccgagctacacccaaagagtgctgctaatggtgaagccaagccaactgttatgcctcctacaagcgttatgacaagactcattctcattatggtgtggagaaaacttataagaaatccaaatacctattccagcctgattggcctcacctggtctcttgtttcattcaagtggaacataatgatgcccgcgatcattgctgattcaatagctattctatctaatgctggtctcgggatggccatgtttagtcttggtttgttcatggcattgcagcctaggattatcgcctgtggaaactcaattgcttcctttgccatgggtgttagattcctcacaggtcctgcagtcatggctgctgcttcgtttgccgttggtctacgaggagatctgctgcgcattgccatagtgcaggcagctcttccacaagggattgtgccctttgtctttgcaaaagaatataatgttcatcctgacatactgagcactggagttatatttgggatgctaattgctctacccatcacactggtttactacattttgctgggactttgaagggtgagggcatcacaggagctgatgagcatggcatcacaggagctgatgagctacaattagttattacagtagtagtacctaacacatctggccactgggaattttcgggcatcctctaacagaacatgaatcgaagttagaaagaaactagcgaggagaaggctttaggaagagttgttaggaaatggaacaaagtgtaattctctaatgaaataaccattggagggcctagaaatcttcaagtctttttgcctttttcccatctctaaagccgtgtgcttttgccttttgttcttctgatcaaagaaagtaaagcttgcttgtatttgagatgcccctgttgattaaccttctttaagttcaaaaaaataagattgctattaaattctgtatggaaagctcagtaaaaaatccgtgtccaccgcaacaaccaggaccaagtcatgggaaagcacacagggtttgcgggttctcagcctttgtggtcatggatctaaaaaggtagcaagggtgtaaagagcactagctgtcatgtcctgttcttgtctatgaactagcatacattttaagaccacacttgaaaagttggcaggcctatgagtctagacttaaaagggacctttataggatgtgtttggcagcatgacatagctttatgataatggcaacactaggaggctatcatgctcagtaggttttg

SEQ ID NO: 5693 - DNA, 2245 bp, Echinacea purpurea
cggccggggaacacatcacatctctgctttcccccttaaaaccagactcacttttcttcccaaaagatttcatggaccatcctttttaaccttgatctaacccaaatctttacaaatcccacctggcttttcttcctcaccttccgatttcacaccatgatcacaagttcggacctttaccatgttctcacagccgtggttccactctatgtagccatgatcttagcctatggttcagtgaaatggtggaagattttcacaccagaccagtgttctgggattaacagatttgtggctctttttgctgtgcctttgctttcttttcatttcatttctactaacaacccgtacactatgaactcaagattcatagctgctgacactcttcagaaacttatggttcttgtgggtttagcgttttggtcaagattgagtgctagagggtctttagagtggtcaatcactttgttctctttgtctacacttccaaacacacttgtgatgggaatcccactattgaaaggaatgtacggtgatttttctgggagtttgatggttcagattgtggttcttcagtgtattatttggtacactttgatgttgtttctgtttgaatacagaggtgctaggctattaatcgctgaacagtttccagacactgctggatcgataatttcattcagagttgattcagatgttttatcccttgatgggaaagagccattgcagacagaggctgaggttggggaagatggcaagcttcatgtgaccgtccggaagtcggccagttctcattcggagatcttttcgcgtcgatcgcacggtggaatgaactcgggtctttcattaactccccggccgtctaacttaacaaatgctgaaatttactctttacaatcatcaagaaacccgactccgaggggttccagttttaaccacactgatttttactcaatggttaatgggaaaagcggagcgagtccacgagggtcgaatttcgcagggtatgatgaggaaagtgggaatgctggtagggtgaatgggcatgggagtgcagggtaccctgccccggctaatgccggaatcttttctccggttggtgggaagcggggcggtggtggtgggaaagatcttcatatgttcgtgtggagttctagtgcttcaccggtttctgaaggtgggattcatgtgtttagaggtgggactggggagtatggtaatgatcttggaggggtgccccagactaaagaatatgatgaattcggccgaaacgagtttagttttgggaaccaaccgggcccgaacggagtggagcgtgaagcgtcggttctatccaaacttgggtctagctcaactgctgagctccacccaaaggctagcccacatgctgaaatcaagcccacttctatgccaccggctagtgtcatgaccagactcatcttgatcatggtgtggcgcaaacttattcgaaatcccaacacatattcaagcttaattggcctcacatggtccttggtctcattcaagtggaacgttgaaatgccagccatagttgcaaaatccatagccattttatctgatgctggtcttggcatggccatgtttagcctcggtttgttcatggcattgcaaccaaaaattatagcttgtggaaactcggttgcaacctttgccatggtggttcgtttcttgattggaccagcggtcatggttggtgcatcattggctgttggactacatggaactttgctacatgttgccatagttcaggctgctctccctcaaggaattgtcccttttgtgtttgctaaagaatataatgtccatccagatatacttagcactggggttatatttggaatgttgatagcactaccaataactctggtgtactacattgtgttggggctttaactgaatgggcttttgactcttgtcttatttgaagaagtgaagtttcttttggggattggttctctaacggcatgtgaaatgacctttttgtccaatttgttaagtttagtgaaagagtgaaaagagaggaaggttgaggggcacaattgtaactggacacgacattggcagcaagtaatatcagtgttatgtctccaattgtaattgtttcttgtatgtattctcccaagaaagtagtagtgatgcttctactttacacttttgacagagctcaagtacattggaatcccaatactctcactcttacttgaattctgaaattttacaattg

SEQ ID NO: 5694 - DNA, 2409 bp, Rosmarinus officinalis
cctcactctctctctcgcatccctcgccctatctcccctacccctcactgcgccagaatcaggcctcaaatccaacctccatcattacccctgcagcttcgtaccgccattaaaatgccctgaaaaaacgccgcccactttctttaccatacctcatattctcaacgcgggacgctctcttcttcactgagagcaaaagggccgtcaaaaagctcccattttgccgaacacgatgattacgatcaccgacctctaccacgtgctgaccgcggtcgtgccgctctacgtggccatgatcctcgcctacggctccgtgaagtggtggaagatcttcacgccggaccagtgctccggcatcaaccggttcgtggcccttttcgccgtcccgctcctctccttccacttcatctccaccaacgacccctacgctatgaactaccgcttcatcgccgccgacacgctgcagaagctcatcgttctcgccgtcctcgcagtgtggtcgagaatcagctcccgaggttcgctcgagtggtccatcaccctcttctccctctccaccctccccaacaccctcgtcatgggcatcccgttgctaaaaggaatgtacggcaacgactccggcagcttaatggtgcagatcgtggtgctgcagtgcatcatctggtacacgcttatgctcttcctgtttgaatacagaggcgccagaatgctcatcgccgagcagttccccgacactgccggctccatcatctccttccgcgtcgacaccgatatcatctctttagacgggaaggagccgctccaaactgaagcagaagttggacaagatgggaagcttcatgtaaccgtgaggaaatcgacgagctcgagatcggagatcttctcgaggaggtctcacgggcccaactccgggctttctcttactccgcggccctcgaatttgaccaatgcggaaatttactcgctgcagtcgtcgagaaatccgacgccgcgaggctcgagttttaatcacactgatttttactccatggtgaatgggaagaatgtgagccctaggcattcgaattatgggaactcagggtttgatgaggagaatcaataccgggctaatggcgtccatggacaggggaataatgcagggtaccctgcgcctgcgggcgccggaatattctctccagtatcggggccggcggcgaagaagaaggcgaatggggcggaagtcggcagcggcggaggaggaaaggatttacacatgtttgtgtggagttctagcgcgtcgccggtgtcggagggagggattcatgtgttcaaaggaggggaatatggtggtaccgagctcaacatcggagctcatccgaaagattacgaggatttcggtcgtgatgggttcagtttcggcaataaacagggcccgaatggggccgagcgcgacggaccagtgctgtcgaagctcggatcgagctcgacagctgagctcaacccgaaggctccggttgacaccaaggccacggccatgccccctactagtgtgatgactagactgattctgatcatggtgtggcgtaaactcatccgaaatccgaacacgtactcgagtttgattggtctaacgtggtccttggtatcattcaaatggcatgtcgagatgcctgcaattgttgcgaaatccattgctatactatctgatgccggtcttggaatggcaatgttcagtcttggtttgttcatggctctgcagcctaggatcatcgcttgtggcaaatcggtcgcagccttctcgatggccgtccggtttctcaccggcccggcagtcatggctgctgcctccattgccgttgggctccgaggcgttctcttgcatattgcaatcgttcaggcttctctgccgcaggggattgttccctttgtgttcgccaaggagtacaacgtccaccctgatatactcagcactggtgtgatatttgggatgttaatagctcttccaatcactctggtctactacattttgctggggctctgaagaagcagcagcagaagctaaaaactgcatacaactaacgcattttgccgtggaattgtttgggcttctaaccgaagagagaaattacaagtagtattggaaaaatattgcagaaaaaagcaccccaaatatcaagaattcccacataaaaagaagacatcattagacaagtagtatgtagtggtagtgctacaagataatacattttgtttttttgtctcttctttttctgaactctggcgccccaccgttattacttttcaatgaagaaagttgagcttctttctagtgttgtaattccatgatttgatgatggagtcaaaaaggattttcacctaagaagaatatctcagggtaataaattgagacacgaatttatttcacattag

SEQ ID NO: 5695 - DNA, 2277 bp, Citrus sinensis
tcccagcaaaatctcttcacttcacgctcattacacagtctctctctctccaacgccctctgtctccgtccaaatcttactggaaaacaaactatccggaagttcttttccgtctactcactcttttctcttttattctcctttctccattcctcaaagctttctctaataataatgggttgatttttccttctccgttctgttctgttataacactcatttacttcttcgccgactcttccgaaagaaagaaaaaaaaaaaaccaataaagaaaccatttttattcaaagctatcagcaatgatcagtgcaactgatctttaccatgttctcacagccgtggttccactctacgtggccatgatcctcgcctatggctctgttaaatggtggaaaatcttcacccctgatcagtgctctggcatcaaccgttttgttgccctctttgctgtccctttactctctttccacttcatctccaccaacgacccatattccatgaactttaagttcattctcgcagacactgttcaaaaaatcatagtcttgctgctcttagccatctggtcaaagcttagctcaagcggctcccttgaatggtcaatcactctgttttcactctccactctgcccaacactcttgtcatgggcatccctttgttgaagggtatgtatggtgactattctggcagcttaatggtgcaaatagttgtgcttcagtgcatcatttggtacacactgatgctgttcctgttcgagtacagaggagccaggatgttgattgcagagcagtttcctgacactgctgggtccattatctcctttaaggttgattctgatatcatttctttggacggaaaagagccgttgcaaactgaagctgaagttggtgaggatggcaagcttcacgtaacagtgaggaaatcagcaagttcaagatcagaaattttttctaggaggtctcatggtcctaactctggcgtttctttaaccccaaggccatcaaatttgactaattgtgagatttactctcttcaatcatcaagaaaccatacccccagaggctctagttttaaccacactgatgttttttccatggtaaatggcaagaacatgtccaatgtgagtccaagacaatcgaactttggtaacttggggtttgatgaagagaatggagttggtgttttcggtaatgtgaatagagccaatggaggtccctatcccgttccaacaaccgccggaatcttttctccggtgtcgggtgcaatgaggaaggccaatggggctgaaaatggcaaggatttgcatatgtttgtttggagttcaagtgcttctcctgtatctgaaggtgggcttcatgtattcagaggtggagatgatcttggtggggtacaccaaaaggattacggtgagtttggtagggatgagtttagtttcgggaacaggcctgttacgaatggggttgaaaacgaagggccagttctttcgaagcttggttcaagctcaacaactgagctcaaccctaagtctgttgcacaaggtgaacccaagccaactgctatgccacctaccagtgtcatgaccaggctcattctgatcatggtgtggaggaaacttatcaggaatcccaacacatactccagtctcattggtctcacctggtctctagtttccttcaggtggcatgttgagatgccggcgataattgctcgttcaatagccattttgtctgatgcagggcttggaatggccatgtttagtctcggtttattcatggcattgcagccaaggattattgcttgtggaaacacaattgctacctttgccatgggtgttcgattccttgttggtcctgctgtaatggctgctgcctcaatggccgttggcttgcgtggatctctcttgcatgttgccatagtgcaggctgctcttccacaagggattgtaccctttgtctttgccaaggaatacaatgttcatcctgacatattgagcacagcggtcatatttgggatgctagtagctcttcctattactcttgtttactacatcttgcttggactttgaagccgaagctcttagaagctgataatgcaaaacttagtgttagtagtagaacccattgtgaatgtgggattttttttttcttttgacttctttgactgagggatatagcatttcacaactctagagaagagaagaaacaaggaagaaactgggaggaaggaaagcaagcaagtttcacattccgtttcacacaaaagatgacatgttctt

SEQ ID NO: 5696 - DNA, 2398 bp, Rosmarinus officinalis
cctccctatatctcacctctccctctcactactgcgcagcagctcccgaattcagcctcaaaatcaggcctcaaatccaccctacaccattacccctgcagcttcgtaccgccattaaaatgccctgaaaaaacgccgcccactttctttaccatacctcatattctcaacgcgggacgctctcttcttcactgagagcaaaagggccgtcaaaaagctcccattttgccgaacacgatgattacgatcaccgacctctaccacgtgctgacctcggtcgtgccgctctacgtggccatgatcctcgcctacggctccgtgaagtggtggaagatcttcacacccgaccagtgctccggcatcaaccggttcgtggcccttttcgccgtaccgctcctctccttccacttcatctccaccaacgacccctacgctatgaactaccgcttcatcgccgccgacacgctgcagaagctcatcgttctcgccgtcctcgcagtgtggtcgagaatcagctcccgaggttcgctcgagtggtccatcaccctcttctccctctccaccctccccaacaccctcgtcatgggcatcccgttgctaaaaggaatgtacggcaacgactccggcagcttaatggtgcagatcgtggtgctgcagtgcatcatctggttcacgcttatgctcttcctgtttgaatacagaggcgccagaatgctcatcgccgagcagttccccgacactgccggctccatcatctccttccgcgtcgacaccgatatcatctctttagacgggaaggagccgctccaaactgaagcagaagttggacaagatgggaagcttcatgtaaccgtgaggaaatcgacgagctcgagatcggagatcttctcgaggaggtctcacgggcccaactccgggctttctttgactccgcggccctcgaacttgaccaatgcggagatttactcgctgcagtcgtcaaggaatccgacgccgcgaggctcgagttttaatcacactgatttttattccatggtgaatgggaagaatgtgagccctaggcattcgaattttgggaattcagggtttgatgaggagagcggttatggaaatcaatcgcgggctaatgcagggtaccctgcgccggcgagcgcgggaatattctccccggtggcgggaccggcggcgaagaagaaggctaatggggcggatggtggtggaggaggaaaggatctgcacatgtttgtgtggagttctagcgcgtcgccggtttctgaaggagggattcatgtcttcaggggaggggaatatggtggtacaaccgagctcagaatcggagcgaatccgaaagattatgacgattttggtcgggatgggtttagtttcggcaataaaccgggctcaaatggggccgagcacgacggaccggttctttcgaagctcggatcgagctcaacggccgagctaaacccgaaggctccggttgataccaaggccacaaccatgccccctactagtgtgatgactaggctgattctgatcatggtctggcggaaactcatccgaaatccgaacacttactcgagtttgattggtctaacgtggtccttggtatcattcaaatggcatgttgagatgcctgcgattgttgcgaaatccattgctatactgtctgatgccggtcttggaatggcaatgttcagtcttggtttgttcatggctctgcagcctaggatcatcgcttgtggcaaatcggtcgcagccttctcgatggccgtccggtttcttaccggcccggcagtcatggctgctgcctccattgttgttgggcttcgaggcgttctcttgcatattgcaatcgttcaggcttctctgccccaggggattgttccctttgtcttcgctaaggagtacaacgtccaccctgatatactcagcactggtgtgatatttgggatgttaatagctcttccaatcactcttgtctactacattttgctggggctctgaagatgaagctgcaaaagctaaaaactacatacaactaacgcattttgctgtggaattttttgggcttctaaccgaagaaagaaattagaagtattattggaaaaatattgcagaaaaaagcaccccaaatatcaagaattcccatataaaaagaagacatcattagacaagtagtatgtagtggtagtgctacaagataatacattttgttttttgtctcttctttttctgaactctggcgccccaccgttattacttttcaatgaggaaagttgagcttctttctagtgttgtaattccatgatttgatgatggagtcaaaaaggattttcacctaagaagaatatctcagggtaataaattgagacacgaatttatttcacattag

SEQ ID NO: 5697 - DNA, 2199 bp, Daucus carota
agcactgcaactagtctatacagtactaaaaagctttcttgaacagactcagccttttatttctcttgtctgccatctattcttaataaatactcccgtctctttgttttcttccctctcatctctctctgggggaatcagtttgaaaacccattttacaatcttggtatttctcaaaatttcttaaaacccacataaaccctttgttgaaccaagaaagatgataactttaacagatttttaccatgttcttacagctgtggttccactctatgtggccatgatattagcttatggttcagtgaaatggtggaaaatcttcacacctgatcagtgttcaggcatcaacagatttgtggctctctttgcagtccctttgctctcttttcatttcatctctacaaacaatccttacacaatgaacttcaggttcatagctgcagacactcttcagaaactcatagttcttggggttttagccatttggtcaagaaccagctctagaggctctcttgaatggtccatcactttgttctcactctccacactccccaacactcttgtgatggggatcccccttttgaagggcatgtatggtgaggcctcagggagcctaatggtgcaaattgttgttttacagtgtattatttggtacactttgatgttgttcttgtttgagtataggggagctaggcttctcattgctgagcaatttcctgataatgctaactctattatatcatttcgagttgattctgatgttttatctttagatggtaaagagccattgcagactgaggctgaggttggggaagatgggaaaatacatgtcactgtgagaaaatcagctagctcaagatcagagattttctcaaggaggtcacatgggcatcactctggtgtttcttacacaccaaggccatccaatttgagcaatgctgagatttattctcttcaatcctcaagaaatccaacacctagaggctccagttttaatcacagtgatatctattcaatgatgaatggaaagaatgctactaatgcgagtccaaggcaatcaaattttgggaatttgggtttcgatgagactaagggtaatggggcttatggccaggggaatgcagggtaccctgcaccgcctagtgctgggattttttcgcctgtttcgggaccgggagccaagaagaaggctaatggggcagatgggggaaaagatcttcacatgtttgtttggagttcgagtgcttccccggtttctgaaggagggattcatgtgtttagaggaggggagtatggcaatgatctcaatggagctgctcatgctaaagattacgatgaattccgtcgagatgagtttagctttgaaaaccgacaagtccagattggagttgagagggaaggccctatgctaccgaagcttggttcaagttcagctgagttgaatcctaaatcattggccaatggggaaatcaagcctgtgcccatgccacctactagtgtcatgaccagacttatcttgatcatggtgtggaggaaacttattcggaatccaaacacgtactccagccttttcggtctcacatggtcattggtctgctacaaatgggatgtcgaaatgcctgctataattgcaaagtcaatagccatactttctgatgctggtcttggaatggcaatgtttagtcttggtttgtttatggcattgcagcctagaattattgcttgtggaaacaaagtggctacctttgctatggctgttagattcctcatgggtcctgctgtcatggctgcttcctcaattgtggttggtttgagaggagttctgctgcatattgccattgttcaggcagcccttccacaaggaattgtcccgtttgtctttgctaaggagtacaatgttcatcccgacatcctgagcaccggggttatatttggaatgctgatagcacttccgatcacactggtttactacatcttgctgatggtgtgaaattgaagccctgttcttgctgcagtccaaaaagaagtaaccttttggaaaactaacccctgttaaccggttaagtgatgtttattttagtagtatatttttgggtggcatctaactaagaagatagaatatggagctgacttggtagagcaaagggatgtgaaagtatggagaagaagcaatattgtattttgaaagtttaatagcag

SEQ ID NO: 5698 - DNA, 2275 bp, Citrus clementina
tcccagcaaaatctcttcacttcacgctcattacacagtctctctctctccaacgccctctgtctccgtccaaatcttactggaaaacaaactatccggaagttcttttccgtctacgcactcttttctcttttattctcctttctccattcctcaaagctttctctaataataatgggttgatttttccttctccgttctgttctgttataacactcatttacttcttcgccgactcttccgaaagaaagaaaaaaaaaaccaataaagaaaccatttttattcaaagctatcagcaatgatcagtgcaactgatctttaccatgttctcacagccgtggttccactctacgtggccatgatcctcgcctatggctctgttaaatggtggaaaatcttcacccctgatcagtgctctggcatcaaccgttttgttgccctctttgctgtccctttactctctttccacttcatctccaccaacgacccatattccatgaactttaagttcattctcgcagacactgttcaaaaaatcatagtcttgctgctcttagccatctggtcaaagcttagctcaagcggctcccttgaatggtcaatcactctgttttcactttccactctgcccaacactcttgtcatgggcatccctttgttgaagggtatgtatggtgactattctggcagcttaatggtgcaaatagttgtgcttcagtgcatcatttggtacacactgatgctgttcctgttcgagtacagaggagccaggatgttgattgcagagcagtttcctgacactgctgggtccattatctcctttaaggttgattctgatatcatttctttggacggaaaagagccgttgcaaactgaagctgaagttggtgaggatggcaagcttcacgtaacagtgaggaaatcagcaagttcaagatcagaaattttttctaggaggtctcatggtcctaactctggcgtttctttaaccccaaggccatcaaatttgactaattgtgagatttactctcttcaatcatcaagaaaccatacccccagaggctctagttttaaccacactgatgttttttccatggtaaatggcaagaacatgtccaatgtgagtccaagacaatcgaactttggtaacttggggtttgatgaagagaatggagttggtgttttcggtaatgtgaatagagccaatggaggtccctatcccgttccaacaaccgccggaatcttttctccggtgtcgggtgcaatgaggaaggccaatggggctgaaaatggcaaggatttgcatatgtttgtttggagttcaagtgcttctcctgtatctgaaggtgggcttcatgtattcagaggtggagatgatcttggtggggtacaccaaaaggattacggtgagtttggtagggatgagtttagtttcgggaacaggcctgttacgaatggggttgaaaacgaagggccagttctttcgaagcttggttcaagctcaacaactgagctcaaccctaagtctgttgcacaaggtgaacccaagccaactgctatgccacctaccagtgtcatgaccaggctcattctgatcatggtgtggaggaaacttatcaggaatcccaacacatactccagtctcattggtctcacctggtctctagtttgcttcaggtggcatgttgagatgccggcgataattgctcgttcaatagccattttgtctgatgcagggcttggaatggccatgtttagtctcggtttattcatggcattgcagccaaggattattgcttgtggaaacacaattgctacctttgccatgggtgttcgattccttgttggtcctgctgtaatggctgctgcctcaatggccgttggcttgcgtggatctctcttgcatgttgccatagtgcaggctgctcttccacaagggattgtaccctttgtctttgccaaggaatacaatgttcatccagacatattgagcacagcggtcatatttgggatgctagtagctcttcctattactcttgtttactacatcttgcttggactttgaagccgaagctcttagaagctgataatgcaaaacttagtgctagtagtagaacccattgtgaatgtgggattttttttttctttttgacttctttgactgaggaatatagcatttcacaactctagagaagagaagaaacaaggaagaaactgggaggaaggaagcaagcaagtttcacattccctttcacacaaaagatgacatgttctt

SEQ ID NO: 5699 - DNA, 2557 bp, Eucalyptus grandis
atttcccctgtctgccacccagaaactcacaaagcctttaataatattcactctcctctttcccccactctcctcattcctctctctctgcttttctattcgaagctgaaagctccgaaccaagcccaaagctctcagggtgtctctccagtaatgggttgattcttgaaccctcgctctctcctcaagcattgaccttttcccctcagaaagcttcgctacagcagaactcggtgacccggctgagcagacttcgcctgcatttttgcttttgagtcccgttcttcgaaccccccctcgcaaaacccagaacagaggaaaaggaaaaacagagctccggagatgatcaaggcttcggacctgtaccacgtgctgacggcggtggtgccgctgtacgtggccatgatcctggcctacggctccgtcaagtggtggaagatcttcagccccgaccaatgctcggggatcaatcgcttcgtggccctcttcgccgtccccctcctatccttccactttatctccctcaacaacccgtacaagatgaactaccgcttcatcgccgccgataccctccagaagctcatcgtcctcgccgtcctcgccgtctggtcccgcgtcagccgccgcggctccctggagtggtccatcaccctcttctccctctccaccctccccaacaccctcgtcatgggcatccccttgctgcagggcatgtacggccccgagtccaagagcctcatggtccagatcgtcgtcctccagtgcatcatctggtacaccctcatgctcttcctcttcgagtaccggggcgccaggctcctcatcgccgagcaattccccgacaccgccgcctccatcatctccttccgcgtcgactccgacatcatctccctcgacggcaaggagcccctccagaccgaggccgcggtcggcgacgacggcaagctccacgtcaccgtccgcaagtccaccagctcccgctccgaggtcttctcccgccgctcgcacggccccaactcgggcctctccctcaccccgaggccgtccaacctgaccaatgccgagatttactccctccagtcgtcgcggaacccgaccccccgggggtccagcttcaaccacaccgacttctactccatggtgaacggcaagggcatgagcggcgtgagcccgcggcagtccaacttcgggggcctgggcttcgacgaggagagcggcgtccccccggtgtacggcaacggggcgagggccaatggcggcggagcgtaccccgcgccgccgaatgcggggattttctcacccgtggcggcggcggctgcgaagaagaagggaggcgatgggaaggacctgcacatgttcgtctggagctccagcgcctcgccggtgtcggagggcggccttcacgtcttccgaggcgggggcgactacgggaatgagctcggcgttggtggtgggggtggggtggctcaccagaaagattatgacgagtttgggagggatgagtttagcttcgggaacaggcaggtcccgaacggggtcgaccgtgatgggccggtgctgtccaagctggggtcgagctccacggcggagctccatcccaaggcggccgtggacggcgaggccaagctgacttccatgcctccggctagcgtgatgaccaggctcatcctcattatggtgtggaggaaactcatcaggaaccccaacacatactccagtctctttggcctcacttggtccttggtttcgtgcaggtggaatttggctatgccggccataattggcaagtcgattgctatattgtcggatgcaggtcttgggatggcaatgttcagtcttggtctgttcatggcattacaaccgaggataattgcttgtggaaactcgatagcggccttttcgatggccgtgcgctttctcactggtccggctgtcatggcagccgcatccattgccgttggtctaaaacataacctgttacacatagccatcgtgcaggctgctcttccccaaggaattgtgcccttcgtatttgccaaggagtacaacgttcatccggacattctgagcacaggggtcatatttgggatgctaattgctcttcccatcaccctggtctactacatctttctccaactgtgaagacacccatgcaagaaaagctctccgattgatatggactcgagctaaaaaaagatgaagtgcctccattttgactggtttttctatttcttttttttggcttttgcccttctcatctaaccagaagaaagcaaacatcggacaagaatccaaggaggaggaggaggagaaagacggttgacagagttaaaggaggtggtctttttgcggagcaaaagaggtggatgagtccatgggacatcattaggcttaggactaatttttcttttttggggcctttttgttgatctcgacttgaaaatctccctttctctctctgatcttttcgtgaacctggggctgtgttctttttgatgaagaaaagtgaaaaagatttgttcatggtacggagctttaactttctgcgctttcccgt

SEQ ID NO: 5700 - DNA, 2090 bp, Conyza canadensis
ataacacatcacatcccccctctgttttccctcttaatctcatctttcaattccctgaaaataagtcttcacttttcatcttttcctaaaaagattgcttcatttctttatggaccatcttcaaattcacttctacatattaaccaagatttaaccacagtttttacaaatcctttctgggtattttttagattttgaaaaagatgattactggttcagatctttaccatgttcttactgctgttgtgccactttatgttgctatgatcttagcttatgggtcagtaaaatggtggaaaatttttaccccagatcaatgttcaggaatcaacagatttgtagctctttttgctgttccattactttcttttcatttcatatcaactaacaatccttacactatgaatacaagattcatagctgctgatacacttcaaaaactcatggttcttgttgttttagccttttggtcaagactaagtgctagaggttctttagaatggtctattacacttttttcattgtcaacccttcctaacacacttgttatgggaatcccacttttgaaaggaatgtatggtgatttttcagggagcttaatggttcaaattgtggttttacagtgtattatttggtacactttgatgttgtttttgtttgaatatagaggtgctaggttactaattgctgaacagtttccagacactgctggctctataatctcattcagagttgattcagacattttgtcacttgatggtaaagagcctttacaaacagaagctgaagttggtgatgatggtaaactacatgtgactgtaagaaagtcctctagttcaagatcagaaattttttcaagaagagggtcacatggaggtatacatacaggtgtatctataactccaagaccatctaacttgacaaatgctgaaatttacagcttacaatcatcaagaaacccaactccaagagggtctagctttaaccatactgatttttactccatggtaaatggtaaaaatggtgttagtccaagagggtcaaattttggtggatatgatgaagaaagtgggactattaataatgttagggtggctaatgggcaaggaagtgcagggtaccctggtcctaatgccggaatcttttctccggtgaccggaccggcagccaagaagaaaggtggtgatggtggcaaagacttgcacatgtttgtttggagttcaagtgcttcacctgtttctgaaggtgggattcatgtgtttagaggtggggagtatggtaatgatcttggaagtgtgccccacacaaaagattatgaggacttcggccgaaatgagttcagttttgagaaccaacctggcccgaatggagtggaccgtgaggcatctgttttatctaaacttgggtccagctcaactgccgagctccatccgaaggctagcccacatggtgatgcaaaggccacttcaatgcccccagctagtgtcatgacccgactgattttgatcatggtgtggcgcaaacttatcagaaacccgaacacatattccagcctcattggcctcacttggtccttggtctcattcaaatggcacgttgaaatgcctgctatagttgcaaaatccatagcaattttatcagatgctggacttggcatggctatgtttagccttggactattcatggctttgcaaccaaaaattatagcttgcggaaactctattgcaaccttcgccatgggggttcgtttctttattggaccagcggtaatggcagcagcatcatacgccgttggcctacaaggagcgctactacatgttgccattgttcaggctgctctacctcaaggaattgtcccctttgtgtttgctaaagaatacaatgtccatccggatatacttagcaccggggttatatttggaatgctgatagcactaccaatcactctagtgtactacatattgttggggctttgaatgaagcatgctttgactcttgtcttatttgaagaagttttttggccgtttgttcccttttgtttaggatttcaaattgcagtttgtaacttaaatgtattatagcattggctg

SEQ ID NO: 5701 - DNA, 2315 bp, Populus trichocarpa
tactccttttttgtttataactagtttggaagcagagaaaacgagggaaaacctgagggaaagttataaagggtacatacaatctttgtaagcataatctgcaaaacctcatctgggtttttctgttcaatcaaatttctcatctgggcactcctttacccccaaaaacctctctaaaaaactaaacttgagaaggcatcaatgatcagtctcacagacctttaccatgttctcacagctgtggtaccactttatgtggccatgattttggcttatggttcagtcaaatggtggaaaatatttagccctgaccaatgttcagggatcaacagatttgtggctctattcgctgtacctttgctttcttttcacttcatttccaccaacaacccctatgctatgaactacaggttcattgcagcagatactcttcaaaaaatcatagtcttggtggttttagctatttggaccagagttatctctagaggctcccttgaatggtccattactttgttttcactctctactctcccaaacactcttgttatgggcatccctttgttgaagggtatgtatggagaagcctcagggagtcttatggtccaaatagttgttcttcaatgcataatatggtacacattgatgctgttcttgtttgagtatagaggagctagaatcttgattggtgaacagtttcccgatactgctggttctataatatcattcagggttgactctgatattctttctttagatggtagagagccattgcaaactgatgctgaagtcggtgaagatgggaagttacatgttactgttaggaaatcaactagctcgagatcagacgtgttttctcggatgtctcatggtctaaactcgggcctttcaatgactcctagaccgtctaatttaaccaacgcagagatatactcccttcaatcttctaggaatcctaccccaagagcctccagttttaaccatactgatttttattctaagaatgcaagcaatgccagtccaagacactcgaacttcagtaacctgcaatttgatgaagaaagtggagggcttggggtgtttggtaatgttccaagagcaaatggaagcgcttatcctactccacctaatgctgggatcttttctcccgggggtaaaaagaaggcaaacgggactgagaatggcaaggatttgcatatgtttgtttggagttcaagtgcttcaccagtatcagaaggtggcctacatgtctttaggggaggggattatggcaatgaccttggtggggtagctaaccaaaaagattatgaagaatttggtcgagatgagttcagctttggaaacagacctgtacctaatggggtagaccgtgacggtccagtgctttctaagcttgcttcaagctccacagctgagctgcacccgaagagtgctgctaatggtgaaccgaagccaactgccatgcctcctactagcgttgtgacaagactcattctcattatggtgtggagaaaacttatcaggaatcccaatacttattccagtctaattgggctcacatggtctcttgtttcgttcaagtgggacttggagatgcctcaaataattgctcattctatatctattctatccgatgctggtcttggaatggccatgtttagtcttggtttgttcatggcattgcagcctaggattattgcttgtggaaactcagttgctgcctttgccatgagtgttagattcctcactggtcctgcagtcatggctgctgcttcatttgctgttggactacgaggagttctactgcacattgccatagtgcagtcagctcttccacaagggattgtgccctttgtctttgcaaaggaatacaatgttcatcctgacatactgagcactggagttatatttgggatgctaattgctttgccaatcacactggtttactatattttgcttggactttgaaggtgagggcatccctggagctgatgagcaatgattagttacttacgtaggtgtacctaacacatttggcctatgggattttttgggcattctctaacagaacgtgaacttgaagggaaactagggagagggatttaggagtaggaaatgcaacaatatgtaattgtctaattgaaagaaatcttttctagtcattttgccttattctcatctctaaagcctttttgccttgctccccctctgattaaagaaagtgaagctagtattttgaggttccactgcttattatttattaacccttttcaatattacaaaaaagaagaagattgtcatggaaatctggatggaag

SEQ ID NO: 5702 - DNA, 3002 bp, Petroselinum crispum
gcttgtcaaaagactcaggcttttatttctcttgtctgccattgtttcctcataaatactcacttcactttcttttgtttcccactcctctctctctcccccaccggcaaatcagctcccacgccgttcgccggcagcgtgctcttacagtcccatcttcattattatctctctacattacacactctctcatctagcttctactctatattgtgggctggtttttaatcttcttctatacaaggtattattactcactacacatttcaacactcatataatatttatatctctctgcattatactaaatcttttgagttcttgctcaactgttttcttgcttctctccatttctctcttctgggtatttcttaaaacccacaaaaacccttttttaagccaagaaagatgatcactctctcagatttttaccatgttttaactgctgttgttcctctttatgttgctatgatcttagcttatgggtctgtgaaatggtggaaaatatttacccctgatcaatgctcaggtataaacagatttgttgctctctttgctgtgcctttactgtcatttcattttatatctaccaacaatccttatgctatgaactttagattcatagctgctgatactcttcaaaagttgatagttttgggtgttttagctgtttggtcaagagttagtgctagagggtctcttgaatggtctattactttgttttcactgtctacactgcctaatactcttgttatggggatccctttgttgaagggtatgtatggtgaggcctcagggagtcttatggttcagattgttgtgttgcagtgtattatttggtacactttgatgctgtttttgtttgagtatagaggtgctaggcttttgattgctgagcagtttcctgataatgctgctatgatatcatcttttagagtagataatgatgttttgtcattagatggtaaggagcctttacagactgaggctgaggttggtgaggatgggaagattcatgttactgttaggaaatccactagttccaggtctgagattttctccaggatgtcacatgggcctcattcgggtgtttctttgacacctaggccttcgaatttgaccaatgctgagatttattcacttcagtcgtcgagaaatccgacacctaggggttctagttttaatcataatgatatatattctgtgatgaatgggaagaatgctagtaatgtgagtcctaggcagtcgaattacggaaatttggggtttgatgaggagagtggagcagggggatatggtagtcataccaaggggaatgttgcttatcctgcacctcctagtgctgggattttttctcctgttgctgggcctggagcaaagaagaaggccaatggggctgatggtggtaaagatcttcatatgtttgtttggagctccagtgcttcgccagtttctgaaggaggtattcatgttttcaggggaggagagtatggcaatggccttaacggggttcctcatgctaaagattacgatgaatatcgccgagatgaatttagctttggaaacaaacagaatggagtggaacgggaagggcctatgctatcaaagcttggttcaagttccaccactgagttgcatcccaagtccctggctaatatggaaattaaggccactgccatgccgcctgctagtgtcattaccagactcattctgattatggtgtggcgaaaactaattaggaatcccaacacatactccagcgtcataggtcttacctggtctttggtatcgtacaaatgggatgtggaaatgcctgccataattgcaaaatcaattgcaattctatctgatgctggccttggaatggcaatgttcagtctcggtctatttatggcattacagccaagaatcattgcatgtgggaactctgttgcaacctttgctatggctgttcggtttctcacaggtcctgcagtcatggctgcttcctcaattgctgttggtttgagaggagttctactgcatatagccattgttcaggcagccctgccacaaggaattgtcccttttgtctttgctaaggagtacaatgttcatcctgacatactaagcactggggttatatttggaatgctgatagctcttcccatcacactggtttactacatcttgctgatggtgtgagattgaatctcttattgctgctgctgtctactaaaccagccctacaaaaaactaaccacttctaaaaaagtaaagttgtatgcaatgttttcatattttgatggcatctaactaagatagatactatatgtagtgactttgtagagtcaagtagggttgttagatggagaagatcattagccagtttagtagtagctttttgttgttgtttctcctctactgtggaaaaagtgaagcttgtgttgtgttgctagtgggaagatggccctttgttttaatcatgtggaagaagttaatggtaatatatttataaatttgtctgcgctgtctgctcaaagtataaagtttagatgggaaattaactgttttcctatgtatcttatttgtttaattgttcaataatggactgagcttagtggcaaactaccaatcagtacagaaggaaaaaagaggcaaagggtgtaaactggcaggcaatttattgacttttgtgtttgtagaatactattatctttgtgaataggagtaattatttctccacatttgggaattaaggttggtttaggtaaacttttaatgcacagatatatgattatgtgattatttatgagaaagtttagacgtgttttctttgtgaaggttaaaactaacgattttaattagccgaagaaacaagggaattaagtaataaaaaccaagacagaataaaatttgaagaaatttttgagaaatttttgaaataaggcggtaatccatttctctccataactataaacacagctctgcaatttatagaaagaggtgattcttagtacttg

SEQ ID NO: 5703 - DNA, 2451 bp, Solanum phureja
cacactctcccttttaaaaacactagtagcaagtagctcttttctagctatatctttctttaaactaagaaggtttctcccatttcttagtatttatgatttagaggtgagaaagaaggagaaaaactgaagtggggttttgtacttgaaggaaagtttggatctttttgtgttcttgaaataccccatgtgagttttgtgatcaaaaatccattttctgatctgtactttgttttgtgtagggaaagtttgaatctttttgtgttcttgcataaccccatgtgagctttgtgatcaaatatccatttcttgatctgtactttgttttgtgaagtgaaaagtttgaatctttgtaagaaaaaaaatgatatcactttcagacctttaccatgttcttactgctgtagttccactgtatgtagcaatgatcttagcttatggttcagtaaaatggtggaaaattttcagccctgaccaatgttctggaatcaatagatttgttgctctttttgctgttccattgctatcttttcatttcattgcttccaacaatccatatgcaatgaactacaggttcatagctgctgacactcttcagaaaatcatagttctttttgttctagctatttggtcaagagttagctcaagggggtcccttgaatggtccattactttgttttcactgtccactttaccaaacactttagttatggggatccctttgttaaagggtatgtatggtgatgcctcaggaagcttaatggtccaaattgttgtgcttcaatgtatcatttggtacactttgatgcttttcttgtttgagtatagaggggcaagaatgcttattgcagaacagtttcctgacactggagggtccattatttcctttaaagtggattctgatattatttcattagatggtaaagagccattggaaactcaagctgaagttggtgatgatgggaaacttcatgtaactgttagaaaatccactagttcaaggtctgaaattttttcaagaagatcccatggtcctaattctggtctttcattaactcctagaccatccaacttaactaatgctgagatttattcattgcaatcttcaagaaatccaactcctagaggctcaagctttaaccatactgatttttactcaatggtgaatggaaaaaatgcaaatatgagtccaaggaattcaaattttgggaactatggtcatgatgaggagagtggtgttgctggatttgggagaggaaatggggtttatggacagggaaatgcagggtaccctgctcctaccaatgctggaatcttttctccagctactggaccagtgaccaagaagaaggctaatggtggtacagaaggtggaaaagatcttcacatgtttgtttggagttcaagtgcttcaccagtctctgaaggagggattcatgtctttaggggaggaggtgactatggtaatgagcttggtgttggagcccacccaaaagattatgatgaatttggccgagaagagttcacatttggaaacaaacagaacctgaatggaaatgaccgggaagggccagttgtgcgctcgagctccacaaccgagctccgtcccaagattgctcaagaagagaccaaggcaactgccatgccaccagctagtgtcatgaccaggctcattttgattatggtgtggcgaaaactaattaggaacccaaatacttactccagcctcattggcctaacttggtccttggtctctttcaagtggaatgttcaaatgcctgcgattatagccaaatcaatatcgattctttctgatgctggtctcggaatggcaatgtttagtcttggtttgttcatggcattgtcgcctagaatcattgcttgtgggaaaacaattgctctcttctcaatgggtgtgagattccttactggtcctgcagttatggctgctgcctccattgcagtcggacttcgaggtgtccttttgcatattgctatcgttcaggcagctctacctcagggaattgttccattcgtctttgcgaaggaatacggcgtccatcctgatatattgagcacaggggttatatttgggatgttagtagctcttcctataactttggtgtactacattttgctgggactttgaagctgatgttgaagaaccaagctgctgaagttttttgtaaaggaaaaaaactaaagacccttttggcatatggtcttttttgctactaacagaatatgaatttctcagaaaaaggagacaaaaatgaaagcaaagtggaattgtgaatggtcaattgttgggaacaaccaatagaggatttttagtggaaaattcttttgttgtctctttgtcctctctttacctttttgaacttttgtgctatcctaggcctacatgtcttttgcttcttttcaatgaagaaagtgatgtttattttttct

SEQ ID NO: 5704 - DNA, 2571 bp, Solanum lycopersicum
acacaaaacaccacttctttttttcacttctcaacactctccctttttatatacactagtagcaagtagctctttttctagctatatctttctttaagctaagaggggttctcccatttcttagtttttattatatagaggtgttgaaaaaaggagaaaaagtgaagtggggttttgttcttgaaggaaagtttggatctttttgtgttcttgaaaaaccccatgtgagtttgtgatcaaaaatccattttgttttgtgaagggaaagtttgaatctttttgtgttcttgcataaccccatgtgagttttgtgatcaaatacccatttcttgatctgtactttgttttgtgaagtgaaaagtttgaatctttgtaagaaaaaaaatgatatcactttcagacctttaccatgttcttactgctgtagttccactatatgtagcaatgatcttagcttatggttctgtaaaatggtggaaaattttcagccctgaccaatgttctggaatcaatagatttgtagctctttttgctgttccattgctatcttttcatttcattgcttccaacaatccatatgcaatgaactacaggttcatagctgctgacacccttcagaaaatcatagttctttttgttctagctatttggtcaagagttagctcaaggggatcccttgaatggtccattactttgttttcactatccactttaccaaacactttagttatggggattcctttgttaaagggtatgtatggtgatgcctcaggaagcttaatggtccaaattgttgtgcttcaatgtatcatttggtacactttgatgcttttcttgtttgagtatagaggggcaagaatgcttattgcggaacagtttcctgacactggaggttccattatttcctttaaagtggattctgatattatttcattagatggtaaagagccattggaaactcaggctgaagttggtgatgatgggaaacttcatgtaactgttagaaaatccactagttccaggtctgaaatattttcaagaagatcccatggtcctaattctggcctttcattaactcctagaccatcaaacttaactaatgctgagatttattcattgcaatcttcaagaaatccaactcctagaggctcaagctttaaccatactgatttttactcaatggtgaatggaaaaaatgcaaatatgagtccaaggaattccaattttgggaactatggtcatgatgaggagagtggtgttgctggatttgggagaggaaatggggtttatggacagggaaatgcagggtaccctgctcctactaatgctggaatcttctctccagccactggaccagttacaaagaagaaagctaatggtggtacagaaggtggaaaagatcttcacatgtttgtttggagttcaagtgcttcaccagtatctgaaggagggattcatgtctttaggggaggaggtgactatggtaatgagcttggtgttggagcccacccaaaagattatgatgaatttggccgagaagagttcacatttggaaacaaacagaacctgaatggaaatgaccgggaagggccagttgtgcgctcgagctccacaaccgagctccgtcctaagattgctcaagaagagaccaaggcaactgccatgccaccagctagtgtcatgaccaggctcattttgattatggtgtggcgaaaactaatcaggaacccaaatacttactccagcctcattggcctaacttggtccttggtctctttcaagtggaatgttcaaatgccagcgattatagccaaatcaatatcgattctttctgatgctggtctcggaatggcaatgtttagtcttggtttgttcatggcattgtcgcctagaatcattgcatgtgggaaaacaattgctatcttctcaatgggtgtgagattccttactggtcctgcagttatggctgctgcctccattgcagtcggacttcgaggtgtccttttgcatattgctatcgttcaggcagctctacctcagggaattgttccattcgtctttgccaaggaatacggcgtccatcctgatatattgagcacaggggtcatatttggtatgttagttgctcttcctataactttggtctactacattttgctggggctttgaagctgatgatgaagagccagaaccaagtgtaaaggaaaaaaactagagacccttttggcatatggtcttttttgctactaacagaacatgaaattctcagaaaaaaagagacaaaaatgaaaccaaagtggaattgtgaatggtcaattgttgggaacaaccaatagaggagttttagtggaaaattcttttgttgtctctttgtcctctctttacctttttgaacttttgtgctatcctaggcctacatgtcttttgcttcttttcaatgaagaaagtaatgtttattttttttcttctatatatatgtagatgtctaaattgtcttttaggagtaccttttcttttaaagctttcaaaaagctactactacttagtacttactaaccttaattaaacaca

SEQ ID NO: 5705 - DNA, 2224 bp, Nicotiana benthamiana
agggaaagtttgagtctttttcacttttctttcatttaatacaaaaccccatatgtgttttgtgatcaaatccattttctgatctgttccttttgttttgtgaagaaaaaagtttgaatctttaagaaaaaaatgatatcactttcagacctttaccatgttctcactgctgtagttccactgtatgtagcaatgatcttagcatatggttcagtaaaatggtggaaaatcttcaccccagatcaatgttcagggatcaatagatttgttgctctttttgctgttccattgctatcttttcacttcattgcttctaacaatccttatgcaatgaactacaggttcatagctgctgacactcttcaaaaaatcatagttctttttgttctagccatttggtcaagggcgagttcaagaggttcccttgaatggtccattactttattctctctttccactttaccaaatactttagttatgggaatccctttgttaaagggtatgtatggtgaagcctcaggaagtttaatggtccaaattgttgtacttcaatgtattatttggtatactttgatgcttttcttgtttgaatatagaggtgcaagaatgcttattgcagaacaatttcctgatactgctggggatattatttcttttaaagttgattctgatattatttcattagatgggaaagaaccattagaaactcaagctgaagttggtgaagatgggaagcttcatgttactgttagaaaatcaactagttcaaggtctgaaattttttcaagaaagtcacatggtggtcttaattctggtctttcattaacacctagaccatcaaacttaacaaatgctgagatttattcattacaatcttcaagaaatccaactcctagaggttctagctttaaccatactgatttctactcaatggtgaatggtaaaaatgcaaatatgagtcctaggacatcaaactttggaaactttggatttgatgaggagagtggaactgctggatttgggagaggaaatggggtttatgggcaggggaatgcagggtatcctgctcctactaatgccggaatattttctccggccaccgggccggtgacaaagaagaaggctaatggtgcagaaggtggaaaagatcttcacatgtttgtttggagttcaagtgcttcacctgtatctgaaggagggattcatgtctttaggggaggtgactatggcaatgagcttggagttggagcccacccaaaggattatgatgaatttggccgagaagagttcacgttcgggaacaaacagaacctgaatggaaatgaagggccggtactatcgaagattggctccacaacggagctccggccgaagatttctcaagaagagatcaaagctactgccctgccacctgctagtgttatgaccaggctcattttgattatggtgtggcgaaaacttattaggaacccgaacacttactccagcatcattggcctcacttggtcattagtctcattcaagtggaatgttcaaatgcctgcgattatagccaaatcaatatcaatcctttctgatgctggccttggaatggcaatgtttagtcttggtttgttcatggcattgtcacctagaatcattgcctgtgggaatacagttgctgctttctcaatgggtgtgagattcctcactggtcctgcagtcatggctgctgcctccattgctgttggtcttcaaggcgtgcttttgcatattgctattgttcaggcagctctacctcaaggaattgttccatttgtctttgccaaggaatatggtgtccatcctgctatattgagcacaggggttatatttggaatgttggtagctcttcctatcactttggtctactacattttgttggggctttgaagatcaagcactaatctgctgaagtttttgtaaaggaaaagttagagacccttttgccataggggtttttttgggcttttaatagaatatgaattctgatcagaaagtgaaagagagagagacaagaatgaaagcaaagtggaattgtgaatggttcattgttgggcaccacagccaatagaggaattttagtggaattcttttgttgtctctttgtcttctcttctacttttgaactttgtgctattctactaggcctacatgtcttttcttcttttccatcaagaatgttgaaagttcattttctatttta

SEQ ID NO: 5706 - DNA, 2452 bp, Petroselinum crispum
tctctctccatacattcttggttttcaatcttgataatttttaaaaccctcataaaccctaacttgaaccaagaaaaatgataactttaacagatttttaccatgtactcacagctgtggttccactttatgtagccatgatactagcttatggttcagtgaaatggtggaaaatcttcacacctgatcaatgttcaggcatcaacagatttgttgctctctttgcagtcccattgctttcttttcatttcatctctacaaacaatccttacacaatgaacttcaggttcatagctgctgatacacttcaaaaactcatagttcttgctgttttagccatttggtcaagaatcagttctagaggttctcttgaatggtctattactttgttctcactctccacacttcccaacactcttgtaatggggattccacttttaaaaggcatgtatggtgatgcctcagggagtcttatggtgcagattgttgttttacagtgtattatttggtacactttgatgctcttcttgtttgaatacaggggagctaggcttcttattgctgaacaatttcctgataatgctaactctataatatcatttaaggttgattctgatgttttatctttagatggtaaagagccattgcaaactgaggctgagcttggggaagatgggaaaatacatgtaactgttcgaaaatcgactagttcgaggtctgaaattttttccaggaggtcacatggacatcattctggtgtttcatacacaccaagaccatcaaatttgagtaatgctgagatttattctcttcagtcatcaagaaatccaacacctagaggttctagttttaatcatactgatatttattcaatgatgaatggaaagaatgctagtaatgtgagtccaaggcaatcgaatttcgggaatttgggtttcgatgagagtggaggaacagggggatttgggaatcagagtaagggtaatgttgtttatggacaggggaatgcagagtaccctgcaccacctagtgctggaattttttcacctgtttctggaccaggagcaaagaagaaggcaaatgggatagatggtggtaaagatcttcatatgtttgtttggagttcgagcgcttctccggtttctgaaggagggattcatgtgtttagaggaggagagtatggcaatgatcttaatggggctgctcacgcgaaagattacgatgaatttcgtcgggatgagtttagctttgaaaacagacaagtgcaaattggagttgaacgggaagtccctatgctaccgaagcttggttcaagctctgttgagttgcatcctaaatccctgaccaatggggaaatcaagcctatagccatgccacctactagtgtaatgaccagacttattttgatcatggtatggaggaagctcatccgcaatccaaacacatactctagccttttcggcctcgcctggtctttggtctcatacaaatgggatgtcgaaatgcctgctataattgcaaaatcaatagccatactttctgatgctggtcttgggatggcaatgtttagtcttggtctatttatggcattgcagcctagactgattgcatgtgggaagaaagtggccaccttctctatggctgttagattccttgcaggtcctgcagtcatggctggtgcttctatcgtggttggtttgagaggtgttctgctccatattgccattgttcaggcagcccttccacaaggaattgtccctttcgtctttgccaaggagtacaatgttcatcctgatatacttagcactggggttatatttggaatgctgatagctcttcccattacactagtttactacatcttgctgatggtgtgaattcaaaccactcttctttctgctgtctgaaaaagaagtaacccttttgaaatctaattacctgttaacaagtgaatgtaatatgggatgtcttcttatatattttggtggcatctaacaaacaagatagaatgtgtagctgactgacttggtagaagagagtatgtagaagaagctatatggaaaattgaaaaaagaaagtctgctgtggttagcgagaacagaacaatgtatttgaaagattaatagtacctaagtgtaattttcatgcatctcttttcctttgctctaaaggaagtgaagctaagaaaaaaggtttatgattacttgagtacacaaacaaataatgccatgcaatttttcataaattatttagcaagttgcctaaattgaaatggttaaagtgaatctggaatctccttctgattcagttacactctctccgtttcaaaatatatgttcattttagaaaaagaaatttgttccaaatcagttgtcaacttcaattttcaatgcaagtttatattttgaaaatcaaccctatactacatatttctaatttatatttccaatat

SEQ ID NO: 5707 - DNA, 2060 bp, Nicotiana benthamiana
ttattttgtgaagggaaaagtttgaatctttaagtaaaaaatgatctcactttcagacctttaccatgttctcactgctgtagttccactgtatgtagcaatgatcttagcttatggttcagtaaaatggtggaaaatcttcaccccagatcaatgttcagggattaatagatttgttgctctttttgctgttccgttgctttcttttcatttcattgcttccaacaatccttatgcaatgaactacaggttcatagctgctgacactcttcaaaaaatcatagttctttttgttctagccatttggtcaagaatgagttcaagaggttcccttgaatggtccattactttattctctctttccactttaccaaatactttagttatgggaatccctttgttaaaaggtatgtatggtgaagcctcaggaagtttaatggtccaaattgttgtgcttcaatgtattatttggtatactttgatgcttttcttgtttgaatatagaggtgcaagaatgcttattgcagaacaatttcctgatactgctggggatattatttcttttaaagtggattctgatattatttcattagatggtaaagaaccattagaaactcaagctgaagttggtgaagatgggaagcttcatgttactgttagaaaatcaactagttcaaggtctgaaattttttcaagaaagtcacatggtggtcttaattctggtctttcattaacacctagaccatcaaacttaacaaatgctgagatttattcattacaatcttcaagaaatccaactcctagaggttctagctttaaccatactgatttttactcaatggtgaatggtaaaaatgcaaacatgagtcctaggacatcaaactttggcaactttggatttgatgaggagagtggaactgctggatttgggagaggaaatggggtttatggacaggggaatgcagggtatcctgctcctactaatgccggaatcttttctccggccaccggaccggtgacaaagaagaaggtaaatggtgcagaaggtggaaaagatcttcacatgtttgtttggagttcgagtgcttcacctgtatctgaaggagggattcatgtctttaggggaggtgactatggcaacgagcttggagttggagcccaccctaaggattatgatgaatttggccgagaagagttcacgttcgggaacaaacagaacctgaatggaaatgaaaggccagtgctatcgaagattggctccacaaccgagctccgtccaaagattgctcaagaagagatcaaggctactgccctgccacctgctagtgttatgaccaggctaattttgattatggtgtggcgaaaacttattaggaacccaaacacttactccagcattatcggcctcacttggtcattggtttcattcaagtggaatgttcaaatgcctgcgattatagccaaatcgatatcgattctttctgatgctggcctcggaatggcaatgtttagtcttggtttgttcatggcattgtcacctagaatcattgcctgtgggaatacagttgctgctttctcaatgggtgtgagattcctcactggtcctgcagtcatggctgctgcctccattgctgttggtcttcaaggcgtgcttttgcatattgctattgttcaggcagctctacctcagggaattgtgccatttgtctttgccaaggaatatggtgtccatcctgctatattgagcacaggggttatatttggaatgttggtagctcttcctatcactttggtctactacattttgttggggctttgaagttaatcaagcactaatctgctgaagtttttgtaaagggaaagttaaagacccttttgccatagggttttttggcttttaatagaatatatgaattctgatcagaaagtgaaaaagtgggagagacaagaatgaaagcaaagtggaattgtgaatggttcattgttgggcaccacagccaatagaggaattttagtggaattcttttgttgtctctttgtcttctcttctacttttgaac

SEQ ID NO: 5708 - DNA, 2129 bp, Chrysanthemum coronarium
tcatctccttgcccttttctccgctcatcccttaaaaccagactcactttttcaaaacactcattatctttttaaccttttaaaaacaatcattttacttcatatttttacaaatccttctaagggttttgtttttcacactcttacctcatctgggtgatatttaaacttctagaaagatgataactggttcggatctttaccatgttttcactgctgttgttccactctatgtggccatgatcttagcttatggttcagtcaaatggtggaaaattttcacaccagaccagtgttctggtatcaacagatttgtagctctttttgctgttccattactatcttttcacttcatatcaaccaacaatccctacactatgaacacaaagttcatagctgcagacacattgcaaaagctaatagtactagttattctaggcatatggtcaagaatgagtgctagaggctcacttgaatggtccatcactttattctcactatccacacttccaaacacacttgttatgggaataccacttttaaaaggaatgtatggtgatttttcagggagtttaatggttcaaatagttgttttacaatgcattatttggtacactttgatgttgtttttgtttgagtatagaggtgctaggttattaatagctgaacagtttccagatactgctggtagtattatttcatttagagttgattcagatatcttgtcattagatggaaaggagcctttacaaactgaggctgaagttggtgacgatggtaagttgcatgtaactgttaggaagtcaactagttctaggtcagaagtgttttcaaggtcacatggtgggatgaacactggtgtatctttaacacctagaccttcaaacttaactaatgctgaaatatactctttgcaatcatctagaaaccctactccaagagggtctagttttaaccatactgatttctttgggatggttaaaagtggaagtggtgccagtccaagaagttccaactttggaaacaatgttggaggtgatgaggaaactagggtgaatggtagtcaacaagggtaccctgggccgactagtgccggaatattctctccggtggccggaaagaggaagggtggtggtggagatggtaaagatcttcatatgtttgtgtggagttcaagtgcttcacctgtttctgaacgtgggattcatgtgtttagaggtggtgaatatggtagtgatcttgctggtgtgccccatactaaagattatgatgattttgggcgaaacgaattcagttttggaaatcagcccggccagaatggagctgaccgtgaagcctcggttctatctaaacttgggtctagttctacggccgagcttcacccaaaggctatccctcatggtgaaataaaggcaactgctatgccgcctgctagtgtcatgactcgactcattttgatcatggtgtggcgcaagcttatcagaaacccaaacacttactcaagcctcattggccttacatggtcgttggtctcattcaaatggcatgttgagatgcctgcaatagttgcaaaatccatagcaattctctcggatgctggtcttggcatggccatgtttagtctcggtttgttcatggctttgcaacctaaaattatagcttgcggaaactcaactgcaacttttacgatggtgattcgttttttggctggacccgcagtcatgttagctgcatcaatggctgttggattacaaggaacattgctacatgttgccattgttcaggctgctctaccacaaggaattgtcccttttgtgtttgctaaagagtacaatgtacacccagacatactttccactggggttatttttggtatgctgatagcactacctatcacactagtctactatattgtgcttgggcttataaagtgagagcattactttgactattgtcttatttgaaggtttttggggaggttctctaacaatatgaaattaccattttgttaacttagtgaaactaaaagtagaggtacttagagagcaaaagtagtatgttgagggagaaatgtgtaatttgataactagacatttgcagcaagtaaattcaatgtttgtctctctaat

SEQ ID NO: 5709 - DNA, 2342 bp, Mimulus guttatus
ccccccactttctctctcctctcaaattcagccacaaaatccggccacaaaaagccattccctggccttcttccatcaccacagtataaccagtttctctctctctctccatcttcaaccaccattaaaaaaaatggagtaagtactgaaaactaaaaccctagagagagaaagtaaaaaaaaagtgtttgaattaaccaatttccgtttcaattgaagagagaggagagatgatctcgttaacagacctgtaccacgtgctcaccgccgtggtcccactctacgttgccatgatactcgcgtacggctccgtcaagtggtggaagatcttcacccccgaccagtgctccggcatcaacagattcgtcgcgttgttcgccgtcccgctcctctcgttccacttcatctcctccaacaacccctacgccatgaactaccgcttcatcgccgccgacacgctccagaaactcatcgtcctcgccgtgctcgccgtctggtcgagaaccagcgccaggggctccctcgagtggtcgatcaccctcttctctctctccacgctccccaacacactcgtgatggggatcccactcctgaaagggatgtacggcgagaactccggcacgctgatggtgcagatcgtcgtgctgcagtgcatcatctggtacacgctgatgctgtttttattcgagtacagaggcgcgcgtatgctcatcgccgagcagttccccgacaccgccgcgtccatcatctccttccgagtcgactcggacatactatcgctcgacgggaaggagcctctccagacggaggccgaagtcggcgacgacgggaaactacacgtcaccgtgaggaaatccacaagctcgagatcggagatcttctccagaaggtcccacggccccaactccggcgtctcgttgaccccgcgcccctccaacttaaccaacgccgagatttactcgctccagtcatcgaggaacccaactccacgtggctccagcttcaaccacaccgatttctattcaatggtgaacgggaaaaacgcgagtaatactaatatcagcccgcggcaatcgaactacggcaacttcgacgaggagaacggcggctatggaaatcagccgaggcaggggaatatcaatacggcgtaccctgcacctgctagcgccggaatattctctccggtggcggggcccgccgccgccgcggcggcgaagaagaaacctaatgggaatgaaggtggcgggaaagatcttcacatgtttgtttggagctcgagtgcttcgccggtttctgaaggtgggattcatgttttccggggaggtgattatggtaatgaactcaacgttggagctcaccccaaagattacgatgatttcgggccggatcgaaacgggccggttctgtctaagctcggttccagctccaccgcggagctccaccccaagaacgggggtttagatgctaaatccactgccatgccgccagcgagtgtgatgacgaggctgattctgatcatggtgtggcggaaactgatcagaaatcccaacacttactcgagcctcgtcggcctcacttggtctttggtctcatacaagtggcatgtggagatgcctgcgattatagcgaaatcgatatcgattctgtccgatgctggtcttggaatggcaatgttcagcctcgggctgtttatggcattgcagccaagaattattgcgtgtggaaaatcggtagctgcattctcgatggctgttcgttttttaacggggcccgcagttatggctgctgcttcgattgctgttggtcttcgaggggtccttctgcatatcgcaattgttcaggcagcgctcccgcaaggtatcgtaccgttcgtcttcgcaaaggaatacaatgttcatcccgatatacttagtaccggggttatttttggaatgctagtggcactgccaatcactttagtctactacatcttgctgggactttgaagatgggaattaattaattatcaccaaagaaaaaaaaattaatgtgtttttatttattttattttattttattttgctatggtaaattgttttttggggggtttctaacagatagaaaaatctagcagcagaaattgcaatcttaaaaaaatcaaagagattattgcaggggtaggtagtatttaattaagtggtagttgtaataggagataattattttaattttgtgctttactgcttcttttgtgaagttactattctgccccccctctttctctcttattacttttgttagttttcatgaagaacaagaagtgtgtattgactattgagaatgtgataaaagattaaagtttt

SEQ ID NO: 5710 - DNA, 1849 bp, Aquilegia formosa
ttcaaaacttgaaaaaaaaaatgattactggaactgacctataccatgtttttacagcagttgttcctctctatgttgctatgatcttagcttatgggtctgtgaaatggtggaaaatctttagtcctgatcaatgttctggtatcaatcgttttgttgctctttttgctgttcctttgctttctttccatttcatctctagtaatgatccatatcacatgaacttcagattcattgcagctgatactcttcagaagataatagttttagttgttcttgctatttggtctagatttagtgctagaggatctcttgagtggtctattacactcttttcactctctacacttccaaacactcttgttatgggaatccctcttttgaaagggatgtatggtgatgcttcaggaactttaatggttcaaattgttgttctccagtgtattatttggtacactttaatgctcttcttgtttgagtatagaggagctaagcttcttattaatgaacaatttccagatactgctggttctattatttcctttagagtagactctgatattctctctttagatggaaaagaaccacttcagactgaagctgaagttggggaagatggtaaacttcatgttactgtaagaaaatcaactagttcaagatctgagatcttttccaggagatcccatggaccaaattcaacagtttcattaacaccaaggccttctaatttgacaaatgcagagatttactctcttcagtcttcaaggaatccgacgccgagggggtctagttttaatcatactgatttctattcaatggttaatggaaggaacatgaacaatgctagtcccaggcaatcaaattttggaaacatgggtttcgacgaggagagtggactcaatgggttttcgaatcctccttccaaggccaatggtgttcagggtaatgcatatccagcaccaccaagtgctggaatattttctcctgcagctggtccaggagcgaagaagtcgacaccaaatggaactgatgggaaggatcttcacatgtttgtttggagctcaagtgcttctccagtctctcaaggaggtcttcatgtttatagagagtttgaacatggtggtgtagcaccacaaacagctcatcatattgatactcacaccaaagaatatggagagtatggtggagatgagttcagctttggaaacaaaaaggctggagaggttgctgatcgagatggacctaccctatctaagcttggttccagctctacaactgagcttcatcccaagagtggtgttcatggagactcaaaaaacacttcaatgcctccagccagtgtaatgactagactaattctgattatggtttggagaaagctcatcaggaatccaaatacatattcaagtctcattggtctcacatggtctcttgtgtctttcaggtggggaatccaaatgccaatcattatagcaaagtccatatcaattctgtctgatgctggtctggggatggcgatgtttagtcttgggttgtttatggcgttgcaaccgcgaattattgcctgtggtaaatctgtcgctgcattttccatggctgttaggtttctcacaggtcctgctgtcatggcggcagcctcaattactgttggattgcggggtgtactcttacacattgcaattgtacaggcatctcttcctcaaggcattgttccctttgtctttgccaaagaatacaatgtgcaccctgatatactaagcacgggggttatctttggaatgttaatagctcttcccattacactagtttactacattctacttggactttgaagctgaaggaggactta

SEQ ID NO: 5711 - DNA, 2630 bp, Papaver somniferum
ccttcactttcactgtttttatgtgttcatcattcttgctttaaagtacgactcacctgtaaaaaaatctctgtttttaaaaagaaagaaataatcagatattttgtttacttctcattaggatctctatacactttatccagctaaaacccagtgattctcttcttgttttaagctcacatcagacttgtagctatcaaacataaaacccattcaaacaagtaaaaccaaaaaggaatctatctcacacatttcctcaacccatctataaaaaccctcatctgggttttgtgttcaatcagattctcctaacttgggttccttacaaaactattcaaaatgattacaggaactgatctctaccatgttttcactgctgtggttcctctctatgtagctatggttctagcttatggttcagtgaaatggtggaaaatctttactcctgatcaatgttctggtatcaatagatttgttgcactctttgctgttcctttactatcatttcacttcatatcaagcaacaatccttacacaatgaacttgagattcatagctgctgattctcttcaaaagattatagtcttggttgttctagccttttggtctagatgtagtgcaaatggttctcttgaatggtctattacgttattttcactctctacacttcctaatacacttgttatgggcatccctcttttgaaaggaatgtatggagagttctctggaagtttaatggttcagatagttgtgcttcaatgtatcatttggtatactctcatgttattcctgtttgagtacagaggagctaaacttcttattgttgaacagtttcctgatactgctggttctatcatatcattcagagtagattctgatattctgtctctggatgggaaagaaccattacaaactgaagctgaagttggtgaagatggtaaacttcatgttactgttaggaaatctactagttctcgttctgaagtgttttctaggagatctaacaatggtccacattcaggggtttctttaactcctagagcttcaaacttaactaatgctgagatttattcacttcaatcttccagaaacccaactcctagaggatcaagttttaatcatactgatttttactcaatggtcaatggaagaaatgtgagcagtactagtcctagacagtctaattttgggaacatgggttttgatgaggaaaatggaaatgcaggagggtttccaaggaatactacacagcaaggtagtggttatcctgcacctaatactggtatgttttctcctgttgggaagaagaaaatgatggagcaaaagatcttcatatgtttgtttggagttctagtgcttcacctgtttctgaaggagggcttcatgtcttcagaggaggtgctgattatggtcatgaaaatggtgggattggagctcatcagattgaacctaacccaaaagagtttgaagaataccgccgagatgatcaattcagttttggaaataggcaagccataaatggtggtgaacgagaagcaccaaatttgacaaagcttggttctagctcaactactgagcttcaccctaaagctgcttatggtgaaaccaaggccactactatgccacctgctagtgttatgacaaggctcattttgatcatggtatggcgaaaactcatcagaaatcccaacacctactcgagtctcattggtctcacctggtctctagtatctttcaggtggaatatcatcatgcctgcaatcatagctaaatcaatatcgattctatctgatgctggtcttggaatggctatgttcagtcttggcttgtttatggcgttacaaccacgtatgattgcttgtggaaacaaggttgctacattttctatgggtgttcgcttcctaactggtcctgctgtcatggctgcggcctcttttattgttggattacgtggtgatcttctgcgcattgctattgttcaggctgctcttccccaaggaatagttccctttgtgtttgccaaggaatacaatgtccatcctaaaatcttaagcactggggttatctttggaatgctgatagctcttcccatcacactagtttactatatcttacttgggctctgaagggaacagctcgccacgcctttttttgggaacatactgtacattttttgccccttgttgctgatagggaattttgctagcagctgataatatttcatgaagtagtcaccaccagtgtagaaggagaaagaaagaacagaatctggaatatgcttacatcaactgacttagataaaatgaagagagaaatttgaccgttgggtagattttttttttgtttaatttgaatctcaattctctcttttaaattgtaaaacagctattagcctgtgttacttagttgggatcaaaacagatgctactacttttgctgcaagcttcaaaggaattagtggttaactttcttgtcaattcatattttggtgcatattcctttttatttccttgtggtttgatgcttggatagcatgacactccttggtcgtatcttagttggagatatctttcttgtcaggcattcctttttttaaggatttggcagaatcttgtcatataaaatgttgg

SEQ ID NO: 5712 - DNA, 1795 bp, Nicotiana benthamiana
aaaaatgatctcactttcagacctttaccatgttctcacagctgtagtaccactctatgtagccatgatattggcttatggttcagtaaaatggtggaaaattttcagccctgatcaatgttcaggaatcaacagatttgtggctctttttgctgttccattgctgtcttttcacttcattgcatccaacaatccttatgccatgaactacaagtttatagctgctgacactttgcaaaaagtcatagttcttgttgttttagccatttggtcaagaattagctcaagggggtcccttgagtggtccattactttgttttctctttccactttgccaaacactttagttatgggcatccctttgttgaagggtatgtatggtgaagcttctggaagtttaatggttcaaattgttgtgcttcaatgtatcatttggtatactttgatgcttttcttatttgagtatagaggtgcaagaatgcttattgctgagcagtttcctgatactgcaggggatattatttcgtttaaaattgactctgatgttatttcattagatgggaaagaaccattggaaactcaagctgaagttggtgaagatggtaaacttcatgtaactgttagaaaatcctgtagttcaaggtctgaagttttttcaagaatgtcacatggacttaacactggtgtttcattaacccctagaccatcaaacttgtcaaatgctgagatttattcgttacaatcttcaagaaacccaacccctagaggttcaagctttaaccacactgatttatactcaatggtgaatgggaaaagtgcaaatatgagtcctaggacatcaaattttggtaacatgggatttgatgaggagagtggatttggtgggagggcaaatggggtttatggacaggggaatgtggggtaccctgcacctgctaatgctggaatcttttcacctgctactggacctggggctaaaaagaaggctaatggaactgagggtggtaaagatcttcacatgtttgtttggagttcaaatgcttcaccagcttctgaaggtggaattcatgtgttcagaggaggagaatgtggtaatgagcttggtgttggagctcacccaaaagattacgatgattttggccgagaagagttcacttccagtagcaagaaccctaatggatgtgatcgagaaggaccggtgctaaaaaagcttggctcaagctctacggttgtgctgtttcccaagactgctaatgatactaaggctaatgctatgcctcctgctagtgttatgaccaggcttattctgattatggtctggcgaaaacttgttaggaacccaaatacttattccagtctcattggcctcacttggtccttggtctcattcaggtggaatgttgagatgcctgtgattatagccaaatcaatatctattttgtctgatgctggtcttggaatggcaatgtttagtcttggtttgttcatggcattgcagcctagaatgattgcctgtggaaaaacaattgcttccttctctatggcagtgagattcatcactggtccagcagtcatggctgcagcctccatcgctgttggacttcgaggtgttcttttgcacattgcaatagttcaggcagctctacctcaagggattgttccttttgtctttgcaaaagaatacaatgttcatcccgatatactgagcacaggggttatatttggtatgttaatagcccttccaatcactttggtctactacattttgctggggctttgaagctgaagacactaa

SEQ ID NO: 5713 - DNA, 1873 bp, Cucumis sativus
ccccccccaaaattcccaacatgatctctgtttctgatctctatcatgtcctcactgccgtcgtccctctctacgtcgccatgatccttgcctacggctccgtcaaatggtggaaaatcttctctcctgaccaatgctccggcatcaaccgtttcgttgctctctttgccgtcccccttctctccttccatttcatttcctccaacaaccctttctctatgaacttacgtttcatcgccgccgatacgcttcagaaacttatcgtcctcgtcgccctagctgtttggtctcatctctcttctaaaggctctttagaatggtcgatcactctgttttctctgtccactctgcctaacactctggtaatgggaattcctctgttgaagggaatgtacggcgactccactggtactttaatggttcaaatcgttgttcttcagtgcatcatttggtatacattgatgttgttcttgttcgagtacaggggggctagattgttgattgcagagcagtttccggatactgcaggggagattgtttcgtttagagttgattcggatattctgtctttagatgggaaagagccgttacagacggaggcggagattggcgaagatggaaagttgagagtggtggtgaggaagtctacgagttctcgatcggaggttttttctcggcggtcacacggtggtggaggtggggtttcattaacgccgcggccgtcgaatttgacgaatgccgagatatattctttgcagtcctcgaggaatccgacgccgagaggatcgagttttaatcattcggatttctttttggggaatgcgagtccgaggcattcgaattttgggaattttgggaattttgatgaagaaaatgggggaatgaaaggcagaggaattagtggtaatgtcaatgggatttttccgagcgctaatgggtatccggcgccggcgagtgggggtcttttctcgccggtgaccggaccggcagcgacgaagaagaggaatggtggtgatgggggaaaggatttgcatatgtttgtttggagttcgagtgcgtcgccagtttccgagggtggaatcaacgttttccgtagtggagattacgacgcccccggcgccggtgggatgaacccgaaagatttcaacgagtatggtggggatgagttcagctttgggaacaaatccgccgtgaacggcgggggacacgacggaggccctgtactgtccaagcttgggtcaagctccactgctgaactccacccgaaacatggcgatgacacagcggagtctaagcccacctcaatgcccccggctagtgtgatgacaaggttaattttaatcatggtttggaggaagctgattagaaatcctaatacatattcaagcttgattggccttgcttggtctttgatctcttttaggtggaatattgcgatgccagcaatcgttgctcgatcaatcgctattttatccgatgccgggcttgggatggcgatgtttagtcttgggttgttcatggcattgcaacctaaaatcattgcttgtggaaataccattgcttcatttgccatggcggttcggttcatcactggaccggcggtgatggcagctgcctccatcgctgttgggctcagaggagttctcttgcacattgctatagttcaggctgccctacctcaagggattgtcccttttgtgtttgcgaaagaatacaatgttcatcctgacattttgagcactggtgttatatttgggatgctgatagctctaccaataactttggtttattacattttgttgggactttgaagatgcaaaacagtgaaaggtgcaacattgggagggacaaagattggtctttttctctctct

SEQ ID NO: 5714 - DNA, 2125 bp, Citrullus lanatus
acttccccttcttcctcccaaatgggttaacaccagaacagaaaacagggcaaagaatcataatccccccccaaaaaaccaaaatgatctctgtttctgacctctaccatgtccttaccgccgtcgtcccgctctacgtcgcgatgatcctagcttacggctcggtcaaatggtggaagatcttctccccggaccaatgctccggtatcaaccgttttgtcgccctcttcgccgtccctcttctctccttccatttcatttccaccaacaaccctttctctatgaacttacggttcatcgctgccgatactcttcagaaacttcttgtccttgccgccctcgccgtatggtctcatctctcctctaaaggctctctagaatggtcaattactctgttttccctctctactctgcccaatactctggtaatgggaattcctctgttgaagggaatgtacggcgactccaccggtactttaatggtccaaatcgttgttcttcagtgtatcatttggtatactttgatgctgtttttgttcgagtacaggggagcaagattgttgattgcagagcagtttccggatactgcaggggagattgtttcgttcagagttgattcggatattctgtctttagatgggaaagagccgctgcagacggaggcggagattggggaagatgggaagttgagagtggtggttaggaagtcgacgagttctcgatcggaggttttttcgcggcggtcgcacggcggtggaggtggtgtttcgttgacgcctcggccgtcgaatttgacgaatgcagagatatattctttgcagtcgtcgaggaatccaacgccgagagggtcgagttttaatcattcggatttctttttggggaatgccagtccaaggcattctaatttcgggaattttgatgaagaaagtggagggctgaaaggaagaggaattagtggtaatgttaatgttaatggggtttttccgagctctaatgggtatccggcgccgacgagtggtgggcttttttcgccggtgaccggaccggccgcggcggcggcgaagaagagggtcaatggcggagatgggggaaaggatttgcacatgtttgtttggagttccagtgcgtccccggtttccgagggtggaatcaacattttccggagtggggactacgacggtgccggcgccggcgggatgaaccagaaagatttcgatgagtttggtcgggatgagttcagctttgggaacaaatccgccgtgaacggcggcggacacgacggcgggccggtactatccaagctgggatcaagctccactgccgaactccacccgaaaaatggcgacgacacggcggagtctaagccgaccgccatgccgccagcgagtgtgatgacaaggttgattctgatcatggtttggaggaagctgattagaaatcccaatacttattcgagcttgattggactagcttggtctctgatctcgtttaggtggaacattgtaatgccagccattgttgctcgatcgattgctattttatccgatgctgggctcgggatggcgatgtttagtcttgggttgttcatggcattgcagcccaagatcattgcttgtggaaataccattgcttcctttgccatggcggttcggttcatcaccggtccagctgtgatggcagctgcctccattgctgttgggcttagaggagttctcttgcacattgccatagttcaggccgcattgcctcaagggattgtcccatttgtgtttgctaaggaatacaacgttcatcccgatattttgagcaccggggttatatttgggatgctgatagctctaccaataactttggtttattacattttgttgggactttgaaagctgctaaacaactgaagggcgcaacaacgggagggacaaagattggtctttttctctccctagaaacacaatttttagctaactaaacaagaaaaagatttgttgatggggaaaagagggaaaaaagtgttttttttttttttttttttgttttttgtaattttttggcctctttttgtgctcaatttcttttgttcttttgatggggaagtaaatgaaagctttttcggattgtctctcaa

SEQ ID NO: 5715 - DNA, 2390 bp, Phalaenopsis aphrodite
cctcctgccttgctgtccgccacctgtgttggtccatctctgttccagctcttggattctgaaagaaaaaccagctgtctcagctccctgcttcctttcgtaccctaaagacgccaatttttttcagttacagtcgtactccgcttgttctccctcacactgctacccttctctatttcaccgaaacggcttaaagcccggctcttcgcctccccttcttcactttaaaaacttaatctttctcccaaaatgatcacagcggctgatttctatcatgtcctcaccgctgtggttcctctctatgtcgccatgatcctcgcttacggctctgtcaagtggtggaagatcttctctcctgaccagtgctccggcatcaatcgcttcgtcgctctcttcgccgttcctctactctccttccacttcatatccaccaacaacccttacgcaatgaactaccgctttatcgccgccgacactctgcagaaactcatcgtcctcagtgctctcactttctgggctaatctaagccgccgcggctgccttgagtgggctatcactctcttctccctctccactctcccaaacaccctcgtgatgggcattcctcttctcaaaggaatgtacggaccggactctggaagcctaatggttcagattgtcgttctccagtgcatcatttggtatactctcatgctcttcctatttgagtacaggggagctcggcttctcatcgcagagcagtttccagacacagccggatccattatctccttccgagttgactcagacattatatcgttagacggtaaggagccgcttcaaaccgaggccgaggttggagaagacggtaagctccgtgtaacagttcgcaagtccacaagctctcgctctgagatcttctcaaggcgctcacatggtatgaactctgttactccccggccatctaacctcacaaacgctgagatttactctctgcaatcttctcggaatccaacgccgaggggctccagtttcaatcacacagatttctactccatggtgaatggaaagaacttagcaggtgtcagcccacggcattcaaattttggaaacttgggttttgatgaagaagctccggcgacgagagtgaatggtgttccggcggtgtatcctcctccaccggctagtggcttattctcgccggtaggggctaagaagaaggggaactcatgcgaaggaggaaaagatttgcatatgtttgtttggagctcaagtgcgtctcctgtctcggagggcggcatccatgtctttcgtggcggagattttgcaggggagcacgcaagagtggctcaaatgggcgaccaccgtcaccagaaagatggaagcgatgcttataatgagtatagcagagaagatttcagtttcagaaaccaaccgactgcccatggtgctgatgctttagagcgagacatgccgagcttgtcgaaattgggatcaaactcgaccacagagctgcacccgaagacaggtggtggcggggagttgaaaccggctgcaatgccgccaaccagtgtaatgaccaggttaattctgataatggtctggaggaagctcatcaggaatcccaatacctactccagtcttattggtctcacttggtccttggtttctttcaggtgggagattgagatgcctgccatcattgctcgatcgatatcgatactctctgatgcaggacttgggatggcaatgtttagccttggattgttcatggctttgcagccaaggattattgcttgtgggaatggagttgcttcatttgctatggctgttcgatttgtgactggcccagcggtgatggcggcggcatccattgctgttgggcttagaggtgttctcctgcatattgctattgtgcaggctgctctaccacaagggattgttccttttgtctttgcaaaggagtacaatgtgcatcctgacatcctgagcacaggggttatatttggcatgcttattgctcttcctatcacactagtctactatatattactgggcctttgaagcagaagaaacttgctgtattgaagcagatgaaacgccaatcgttaaaagttcaaccctttttttgtgtttttgattgtattttttaaagtattctatgtagaagtttatttttgactaatctgactgaagtaggctaagctgtaactctgtttctgataacttcagtatagctgtggaaatggctagttggaagttcctgttgatgtcaattgaaactgaggcctcaaatagtttgcgttcagagtttccttctcttgtatcactgaagcatttcatgaagtaattaccaattctgctatttgaagcaaaaaaaaaaaactacgacacccacaggaggtagcgag

SEQ ID NO: 5716 - DNA, 736 bp, Zea mays
cccacttccgcccaaatccaccaccgccataccagcgtgtccgcgattccgtcgagtagactgggcgagagagtagtctcggacgagaagaggcgaatatgagttccggcggcggcaggggcaagcccaaggggtccaaggctgtgtcgcggtcgaccaaggccgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggcaacgcggcgcgcgacaacaagaagaaccgcatcgtgccgcgtcacatccagctcgccgtgcgcaacgacgaggaactcagcaagctgctcggagctgtcaccatcgccgccggaggtgtgttgcccaacattcatcagacgctgctgcccaagaaggccggtgggaagggcaaggccgacatcggttccgcatcccaggagttctaagcggccgcggcggcggttgcaggtttctctgacttgttcgaactggagctccaacatgcatgaagtccccccgtcgctcaagtttcgtcgattagtagtgttagggtgttttctatctttggttaggtttagattgtctgatggatggtttatcagacgaaagtttggtgatcgagggcttcctgtatgtatcaatcaatcttgctggaatggaacaaatcgttggt

SEQ ID NO: 5717 - DNA, 684 bp, Cynodon dactylon
attcacctcgactcgtctcgtctcgtctcgtctcgtctcacaccaccaccagcaagtccttccggcggcgactcccactacttggacgagccaagatgagttccggcgcgggacgcggcaaggccaagggcaccaaggcggtgtcgcggtcgtccaaggccgggctgcagttccccgtcggccgcatcgcgcgctacctcaaggtcggcaagtacgcgcagcgcgtcggcgccggagcgccagtctacctctccgccgtcctcgagtacctcgccgctgaggtgctggagctggcgggcaacgcggcgcgcgacaacaagaagaaccgcatcgtgccgcgccacatccagctcgccgtgcgcaacgacgaggagctcagccgcctgctcggcgccgtcaccatcgccgcgggaggggtgctgcccaacatccaccagacgctgctgcccaagaaggccggcagcaaggacaaggccgacatcggctccgcgtcccaggagttctaggtccctttccgatctgaacccgcccggaagaagttggagcttcttcgtccctcggtagtagtagcagtacttgtgtttcttgcctaggttaggttgtgttagattttgtaatgggttgtcgttttgtctggttcgtcgtgactgaatgttggaatgtatctatctgtcagttaatctt

SEQ ID NO: 5718 - DNA, 861 bp, Pennisetum glaucum
ccacttccccccatcctccaccgcatttccaccgcatcgattccggcgatctcgaaggcctagctgtcccatcggaaggaaggaaaggaagggagaagatgagttccggcggcggcaggggcaagccaaagggcaccaaggcggtgtcgcggtcgtccaaggccggcctccagttccccgtcggccgcatcgcgcgctacctcaagacgggcaagtacgccgagcgcgtcggcggcggagcccccgtctacctctccgccgtcctcgagtacctcgccgccgaggtgctggagctcgctggcaacgccgcgcgcgataacaagaagaatcggatcgtgccgcgccacatccagctcgcggtgcgcaacgacgaggagctcagcaagctgctgggcgccgtcaccatcgctgccggaggggtcctgcccaacatccaccagacgctgctccccaagaaggccggcggcaagggcaaggccgatatcggatccgcatcccaggagttctaggcggtggcggcagcggcggcgtttcgcgggcctggcggatggcttacccagtcgggaacccaacttcggtcggtcgcagcccctgttttggcttcctttggttcgtcagtggcaccagtagtgtttctagtatcttgtttatctaggctaggttaggttttgcagtgggggatttgttatggatcaacctttgcctgtatctatgaatcaatcttgctggaatggaaggactggttggttgcttgttatgattctggaatgtgaagtctgaatctgttggcctgaatgctgccatttctgaatgtgttgtaactttctgatcagtttacctgttcgattggataaaaaaaaa

SEQ ID NO: 5719 - DNA, 681 bp, Avena sativa
cttccgatctcaagtctcagcgtgccatcccctacaccgtctcacacactccgaccatctctcaggcgaccaccaccacaagaccagcacgtccgccgttcgatcccatcctccgaagatgagttctgccggcgccgggaggggcaaggcgaagggctccaaggccgtctcgcggtcgtccaaggccggactgcagtttcccgtcggccgcatcgctaggtacctcaagatcggcaagtacgcccagcgcgtcggcgccggcgcccccgtctacctctccgccgtcctcgagtacctcgccgccgaggtcttggagctcgccggcaacgcagcgcgcgacaacaagaagaaccggatcgtgccgcgccacatccagctggcggtccgcaacgacgaggagctcagccggttgctcggcgcggtcaccatcgccgcaggcggcgtcctccccaacatccacaccacgctgctccccaagaaggccggcaaggccaagggcgacatcggatccgcttcccaggagttctagagccttccagaccgaacaagcatggctgtctgaccgacgatttgagggctctgtctggtttactattatgaggatgctctaggttgttagattagtttcttggtgaatgtcttggtttggtgtatcaatgttgaatctggttggaatggaat

SEQ ID NO: 5720 - DNA, 682 bp, Avena sativa
gcgtgccatcccctacaccgtctcacacactccgaccatctctcaggcgaccgccaccacaagaccagcacgtccgccgttcgatcccatcctccgaagatgagttctgccggcgccggtaggggcaaggcgaagggctccaaggccgtctcgcggtcgtccaaggccggactgcagtttcccgtcggccgcatcgctaggtacctcaagatcggcaagtacgcccagcgcgtcggcgccggcgcccccgtctacctctccgccgtcctcgagtacctcgccgccgaggtcctggagctcgccggcaacgcagcgcgtgacaacaagaagaaccggatcgtgccgcgccacatccagctggcggtccgcaatgacgaggagctcagtcggttgctcggcgcggtcaccatcgccgcaggcggcgtcctccccaacattcacaccacgctgctccccaagaaggccggcaaggccaagggcgacatcggatccgcttcccaggagttctagagccttccagaccgaacaagcatggccatctggccgaagatttcagggctctgcccggtttactgttatgaggatgctctaggttgttagattagtttcttggtgaatgtcttggtttggtgtatcaatgttgaatctggttggaatggaatgcaactagtctggttcctgg

SEQ ID NO: 5721 - DNA, 947 bp, Sorghum bicolor
gccgcctcctgcctcatctccactctcccacccaaaccagaaaatcagaaaatcccaccaccggcgccagccagccagccatcgattccgtcgaggaaggccagtcccggaagagaagaggcggcgaggatgagttccgtcggcggcaggggcaagcccaagggcaccaagtccgtgacgcggtcggccaaggccgggctgcagttccccgtcggccgcatcgcgcgctacctcaaggccggcaagtacgccgagcgcgtcggcggcggcgcccccgtctacctctccgccgtcctcgagtacctcgccgcggaggtgctggagctggcgggcaacgcggcgcgcgacaacaagaagaaccgcatcgtgccgcgccacatccagctcgccgtgcgcaacgacgaggagctcagcaagctgctcggcgccgtcaccatcgccgccggcggggtgctgcccaacatccaccagacgctgctgcccaagaaggccggcggcaagggcaaggccgacatcggatccgcgtcccaggagttctagggcgggcggccgcccgcaccgcggtggctgcaggcttcccctccctgcttcgaatcaagattgaacatgaaagggccagcccccgccgctcaagtttcgtcgattagtagcagtgttagcgtcttgtctatgtttcgttaggtttaggttctgtgatggatggtgtgtcaggtgaaaggttgtggtgaatcagagctgcttgtatgtatcaatctatcaatcttgctggaatggaagaaatggtcggttgctgttacttgctttgctcttgtctctgatttttgttcttgattttgattttattcagttgaagttggtatggattgtgctcggtgggtgtgtttgttttttgattgtgatactgcacgctgaaattcttctgtttcatttagtacatgtgatcctca

SEQ ID NO: 5722 - DNA, 800 bp, Saccharum officinarum
atccaccaccgccggcgccacaccagcgattccgtcgagtagaccagacgaggggagagactagtctcggaagagaagaggcgagcgaggatgagttccggcggcggcaggggcaagcccaagggcaccaaggccgtgacgcggtcgaccaaggccgggctgcagttccccgtcggccgcatcgcgcgctacctcaaggcgggcaagtacgccgagcgcgtcggcggtggcgcgcccgtctacctctccgccgtcctcgagtacctcgccgcggaggtgctggagctggcgggcaacgcggcgcgcgacaacaagaagaaccgcatcgtgccgcgccacatccagctcgccgtgcgcaacgacgaggagctcagcaagctgctcggcgccgtcaccatcgccgccggcggggtgctgcccaacatccaccagacgctgctgcccaagaaggccggcggcaagggcaaggctgacatcggatccgcgtcccaggagttctaggcggcggtggccgcggcggttgcaggcttcgaacaatgcccgctcaagcttcgtcgattagtagcagtattagcgtcttgtctatgtttggttaggtttgggcaggttctgtgatggatggtttgtcaggtgaagtttgtggtgaatgaaagctgactgtgtgtatcaatcaatcttgctggaatggatgaaatggtcggctgctgttacttgatgaggtccaatctctgatttttgttgatggattagtttctgttcaattaaacttgctactgattgtgatcaattcccggatagac

SEQ ID NO: 5723 - DNA, 738 bp, Saccharum officinarum
cacaccgccacacccgcagagcctcacagacttccggcgatcgatacaacgagtagaacaggcggcgagcaatctcggaaggagaagatgagttccggtggcggcaggggcaagcccaaggggactaaggcggtgtcgcggtcgtccaaagccggactgcagttccccgtcggccgcatcgctcgctaccttaagacgggcaagtacgccgagcgcgtgggcggcggcgcgcccgtctacctctccgcggtcctcgagtacctcgcggcagaggtcctagagctggcgggcaacgcggcgcgcgacaacaagaagaaccggatcgtgccgcgccacatccagctcgctgtgcgcaatgacgaggagctgagcaagcttctgggtgcggtcactatagccgccggcggggtgttgcccaacatccaccagacgctgctgcccaagaaggctggcggcaagggtaaggccgagatcggctccgcctcgcaggagttctagactggcagctgcagccttttctctggttcacactcagcttgaatttgaaggggaccgctgctgaagcttcttagattagtactgtaccaactagcaatactagtgtcttgcctaggttagggtaggttctgtgatggatgttttatcaggttaagtttgtggtgaatgaaagttggctgtatctatcaatcattcttgctggaatgaacggaatggctacttgctgtgatcttgttgctc

SEQ ID NO: 5724 - DNA, 652 bp, Oryza sativa
ctccaatctcgaagagttccagaagcttccaaccttcggcggcgagatgagttcctctcagggaggcggcggccgcggcaaggcgaagacgacgaaggcggtgtcgcggtcgtccaaggccgggctccagttccccgtcggccgcatcgcccgctacctcaaggccggcaagtacgcggagcgcgtcggcgccggcgcccccgtctacctctccgccgtcctcgagtacctcgccgccgaggtgctggagctggccgggaacgcggcgagggacaacaagaagaacaggatcgtgccgcggcacatccagctggcggtgcgcaacgacgaggagctgagcaggctgctgggcaccgtcacgatcgccgccggcggcgtgctgcccaacatccagcaggtcctgcttcccaagaagggcggcggcaagggcgacatcggctccgcctcccaggagttttgagcgggtttttctcatcgggtggatgaagaggggatcgccctttcgccaatctcttgtctggatcgttcatgcgatgcttttttttgcccatgtttccgtgtggttgggggtgtttgaacttcgtggcatgtaaaaaactctgggttcattaaaggtggatgaatagatgatataaacaagaaagaaatgatg

SEQ ID NO: 5725 - DNA, 699 bp, Oryza sativa
ccactctctctctctctctctctctctctctctctccaatctcgaagagttccagaagcttccaaccttcggcggcgagatgagttcctctcagggaggcggcggccgcggcaaggcgaagacgacgaaggcggtgtcgcggtcgtccaaggccgggctccagttccccgtcggccgcatcgcccgctacctcaaggccggcaagtacgcggagcgcgtcggcgccggcgcccccgtctacctctccgccgtcctcgagtacctcgccgccgaggtgctggagctggccgggaacgcggcgagggacaacaagaagaacaggatcgtgccgcggcacatccagctggcggtgcgcaacgacgaggagctgagcaggctgctgggcaccgtcacgatcgccgccggcggcgtgctgcccaacatccagcaggtcctgcttcccaagaagggcggcggcaagggcgacatcggctccgcctcccaggagttttgagcgggtttttctcatcgggtggatgaagaggggatcgccctttcgccaatctcttgtctggatcgttcatgcgatgcttttttttgcccatgtttccgtgtggttgggggtgtttgaacttcgtggcatgtaaaaaactctgggttcattaaaggtggatgaatagatgatataaacaagaaagaaatgatggcttcttatgcaaa

SEQ ID NO: 5726 - DNA, 694 bp, Panicum virgatum
cggtgccggcgatcttgggcccccctcggaaggaagggaggaagggaagggacgagaagatgagttccggcggcggcggcggcagcggcaggggcagggccaagggcaccaagtcggtgtcgcggtcttccaaggccggcctgcagttccccgtcggccgcgtcgcgcgcttcctcaagacgggcaagtacgccgagcgcgtcggcggcggcgcgcccgtctacctcgccgccgtcctcgagtacctcgccgcggaggtgctggagctcgccggcaacgcggcgcgcgacaacaagaagaaccggatcgtgccgcgccacatccagctcgccgtgcgcaacgacgaggagctcagcaagctgctgggggccgtcaccatcgccgccggaggggtgctgcccaacatccaccagacgctgctgcccaagaaggccggcggcaagggcaaggccgacatcggatccgcctcccaggagttctagccgccggcgccctccccctccctccttcggggcgcggccttagtcgcagccgccgatgctgcggcttcttcttggctccaccagtagtagttctagtatctcgcctaggctaggttaggttttgcaatggatggcttaccatgggaagtttgctgtatctatcaatcaatcttgcttgaatggatgaaatggtcggttgctatgaatggatg

SEQ ID NO: 5727 - DNA, 548 bp, Trifolium pratense
tacagggggtactcgccttctcaattctcaatttgcaacagcattcaaatcgcataatcaaaggtttagggtttcggatttcatctccgatctgaaaatgagttccaccggtactaccaagggcggaagaggcaagccaaaggctgccaaatcagtttctagatcatctaaagccggtcttcaatttcccgtcggaagaatcgcaagattcctcaaggctggtaaatacgccgaacgtgtcggtgccggtgctccggtctatctctccgccgtccttgagtatctcgctgctgaggttttggaattggctggtaacgctgctagggataacaagaagaatcgtattgttccaagacacattcagcttgcagtgaggaacgatgaagaacttagcaagcttttgggagcagtaaccattgctaatggtggtgttttgcctaatattcatcagactctgctccctaagaagactggaaagggaaaaggagatataggatctgcttctcaagaattttagggtttatgagttcttttccgaatagatctta

SEQ ID NO: 5728 - DNA, 1057 bp, Trifolium pratense
tcttctccgatcagaaaaatgagttccaccggtacaaccaagggcggaagaggcaagccaaaggccgccaaatcagtttccagatcatctaaggccggtcttcaattccccgttggaagaatcgctagattcctcaaagctggaaaatacgccgaacgtgtcggtgccggtgctccggtctacctctccgccgtcctcgagtatctagctgctgaggtgttggaattggccgggaatgctgctagggacaacaagaagaatcgtattgttccaagacacattcaacttgctgtgaggaacgatgaagaactgagcaagcttttgggagcagtaaccatcgctaatggtggtgttttgcctaatattcatcagactttgctccctaagaaagttggaaagggaaaaggagatattggatctgcttctcaagaattttagggtttatgtgctctgtttttgagtagatcttagttttaacatgcctcagttgtaacatacatgtttcatttctagtcgattaaattaaaaggataaatgtttaccaatggatctgtttgttataatcattttgtgtgataagcttgattttattctgaaatttacaaaactattctaaagtgaaattcaatttaattgataaattgatacttgctagagaacaatttgtttaaactgtgaatctaagtgaacaacttttatgatttgtgaacaacttgttttcggcgtagttattgaacccacaattaaggacatagttcctccctgagcataaacacttgaagaaaaaacaatcactcttgtataaaagatgattactaccttactagccgattaaggttaatttttaaatgcctgtttgaaaatagcttaagcaaataattaatttttggctaaattgtacaattaatcgcttaacttgtttatttgtttcatattagtcttttaactaattaaaattacaaattggttctttaattaattaacgtcacaaattgatttattaactttaattatgttagtcatactcatcctttttaatagattgatagtgtattta

SEQ ID NO: 5729 - DNA, 1370 bp, Trifolium pratense
tcttggaaattccaactttgaccctagaagccacagtcttaatttttaaaaatttaaaaatcaaatagcaagccgtgaaatgcaaatcatatggcgcgccgcgcctacttcaaacttaattttgatttctcgatttctcaaaaattaaccgcgaatatgagtgggaatgccacgctggcaatccgtgcctcaccctctcaaccaatcagctgagagcctgtgttcctatataataacattccaccgagaaacctaacaatctgtacccactcactcttcttcccaatcttcgctttttgaaatccaatttcgtcttctccgatcagaaaaatgagttccaccggtacaaccaagggcggaagaggcaagccaaaggccgccaaatcagtttccagatcttctaaggccggtcttcaatttccagtcggaagaatcgctagattcctcaaagctggaaaatacgccgaacgtgtcggtgccggtgctccggtctacctttccgccgttcttgagtatctcgctgccgaggttttggaattggctggtaatgctgctagggataacaagaagaatcgtattgttccaagacacattcaacttgcagtgaggaacgatgaagaacttagcaagctattgggagcagtaaccatcgctaatggtggtgttttgcctaatattcatcagactttgctccctaagaaagttggaaagggaaaaggagatattggatctgcttctcaagaattttagggtttatgtgctctgtttttgagtagatcttagttttaacatgcctcagttgtaacatacatgtttcatttctagtcgattaaattaaaaggataaatgtttaccaatggatctgtttgttataatcattttgtgtgataagcttgattttattctgaaatttacaaaactattctaaagtgaaattcaatttaattgataaattgatacttgctagagaacaatttgtttaaactgtgaatctaagtgaacaacttttatgatttgtgaacaacttgttttcggcgtagttattgaacccacaattaaggacatagttcctccctgagcataaacacttgaagaaaaaacaatcactcttgtataaaagatgattactaccttactagccgattaaggttaatttttaaatgcctgtttgaaaatagcttaagcaaataattaatttttggctaaattgtacaattaatcgcttaacttgtttatttgtttcatattagtcttttaactaattaaaattacaaattggttctttaattaattaacgtcacaaattgatttattaactttaattatgttagtcatactcatcctttttaatagattgatagtgtatttat

SEQ ID NO: 5730 - DNA, 1057 bp, Trifolium pratense
tcttctccgatcagaagaatgagttcaaccggtacaaccaagggcggaaggggcaaaccaaaggccgctaaatcagtttccaggtcatctaaggccggtcttcaattccccgtcggaagaatcgctagattcctcaaagctggaaagtatgctgaacgtgtcggtgccggtgctccggtctacctctccgccgtccttgagtatctcgctgctgaggttttggaattggctggtaacgctgctagggataacaagaagaatcgtattgttccaagacacattcagcttgcagtgaggaacgatgaagaacttagcaagcttttgggagcagtaaccattgctaatggtggtgttttgcctaatattcatcagactttgctccctaagaaagttggaaagggaaaaggagatattggatctgcttctcaagaattttagggtttatgtgctctgtttttgagtagatcttagttttaacatgcctcagttgtaacatacatgtttcatttctagtcgattaaattaaaaggataaatgtttaccaatggatctgtttgttataatcattttgtgtgataagcttgattttattctgaaatttacaaaactattctaaagtgaaattcaatttaattgataaattgatacttgctagagaacaatttgtttaaactgtgaatctaagtgaacaacttttatgatttgtgaacaacttgttttcggcgtagttattgaacccacaattaaggacatagttcctccctgagcataaacacttgaagaaaaaacaatcactcttgtataaaagatgattactaccttactagccgattaaggttaatttttaaatgcctgtttgaaaatagcttaagcaaataattaatttttggctaaattgtacaattaatcgcttaacttgtttatttgtttcatattagtcttttaactaattaaaattacaaattggttctttaattaattaacgtcacaaattgatttattaactttaattatgttagtcatactcatcctttttaatagattgatagtgtattta

SEQ ID NO: 5731 - DNA, 544 bp, Cyclamen graecum
caaaaccctaatctctctctatcttgatctcgctaggttacgatgagttcacagggagcaacgaaaggcggtcgggggaagccgaaggctaccaaatcggtgtcgagatcgagcaaggcgggtctccagttccccgtcggaaggatcgcgcggttcctcaaggccggaaagtacgcggagagagtcggggctggcgccccggtctacctttccgccgtcctcgagtaccttgcagccgaggttcttgaacttgcaggaaatgctgctagggataacaagaagaatcgcattgtgccgaggcacatacaactcgctgtgaggaatgacgaggagttaagcaagcttttgggggctgtgaccattgctaatggtggcgtgttgccaaatattcaccaaaatctgttgccaaagaagactgggaaagacaagggtgatattggatctgcatcacaagagttttagggtattaacaaaagtatgagggtgttatataatcaaggaggaccttatcagttgttgctatctttagcattttgagagattt

SEQ ID NO: 5732 - DNA, 862 bp, Setaria italica
cttttccacctcccacttctccatcccgcattccccacgtccccaccgcatcgattccggcgatctcgaaggcctacctcgatcctcggaggactcctcgcaaggaagggaggagaagatgagttccagcggcggcaggggcaagcccaagggcaccaaggcggtgtcgcggtcgtccaaggccggcctgcagttccccgtcggccgcgtcgcgcgctacctcaagacgggcaagtacgccgagcgcgtcggcgggggagcccccgtctacctctccgccgtcctcgagtacctcgccgccgaggtgctggagctcgccggcaacgcggcgcgcgacaacaagaagaaccggatcgtgccgcgccacatccagctcgccgtacgcaacgacgaggagctcagcaagctgctgggggccgtcaccatcgccgccggaggggtgctgccaaacatccaccagacgctgctgcccaagaaggccggcggcaagggcaaggccgacatcggatctgcctcccaggagttctagacggcggatgactcctccggtcggaaacccaacttcaatcggagccgctgttttggcttcttggttcgtcagtaggaatagtagtacttccagtatcttgtctatctaggttaggttaggttttgcaatggtggtttatcaggggaagtttgtgatggatggatgaaagtttgctgtatctatcaatcaatcttgggatggatgaaatggtcggttatgttgcttgctatgattcttgaatgtgaatcccgaatctgtgtcctgcggatgctccatttgtgtatggatttcctgaatgtttccattctgaatgtgttgtaattttcagaggaa

SEQ ID NO: 5733 - DNA, 745 bp, Gnetum gnemon
taaggccaagtcttccaaatctgtgtcgcgatcgcacgcgtttttccgattcgtttcgtacctaggacgaccgagcgtgagtctgtgtctgcaaccttttcggcggagattttacctatcgcattttgcgttttcgtagcagcggcaagaaaatgagttccacaggaggtgccaagggaggtcgcggtaaggccaagtcttccaaatctgtgtcgcggtcgcagaaggcagggctgcagtttccagttggtaggattgccaggttcctcaaggcaggcaagtatgccgagcgtgttggtgctggtgcgcctgtgtatcttgccgctgttcttgaatatctcgctgctgaggttcttgaacttgctggaaatgctgctcgagacaataagaagaaccgtattgttcctaggcacattcagctagctgttagaaacgatgaggagttgagcaagctgctgggtgctgttacaattgccaatggtggagttctgcctaatattcatcaggtgctgctgcccaagaaggctggcaaggacaagggagatattggttctgcatctcaagagttctagatttgatgttagtgttttgaatttgtcacattatggatgaaatttttgttgatgtaaattggagccctattcatcgtagggccatataatctggtcagcggttcaaaaatgaaaatttggcaatgccattggatatgatgatttcatgctttaacacgaaaagtgttgatcga

SEQ ID NO: 5734 - DNA, 684 bp, Zea mays
atccctccattctcctaccaaaaatcgcagcgccgcccgcaccaatctcgaagtgttcgaaagtttccagacccccaaaaggcgaagcggcgatgagttccaccggaggcggcggccgcgggaaggcgaagccagcgaccaagtcggtgtcgcggtcctccaaggctgggcttcagttccccgtcggtcgcatcgcgcggtacctcaaggccgggaagtatgcggagcgcgtcggcgccggggcccccgtgtacctctccgccgttctcgagtatctcgccgccgaggtgctggagctggccgggaacgctgctcgggacaacaagaagaaccgtatcgtgccgcgccacatccagctggcggtgcggaacgacgaggagctgagcaagctgctgggcactgtgacgatcgcggccggcggcgtgatgccgaacatccatcagaccctgctgcccaagaaagctggtcagaagggggacatcggctctgcctcccaggagttctaagcgtttcggcggaatgaggagagggaccgccccctgtttctgtctcgtccgcgtggttgtgtttcagctctgcggtttttgggggagtgctgtcgatgagttgggattgatatgggttgtggggatgtaaacaaacgcagcgcgttgtttcatgaatgaatgatggatagaaggaaca

SEQ ID NO: 5735 - DNA, 665 bp, Scabiosa columbaria
acatacttatctctctctcgcttccttctcgaatattcatctcaaaatctagggttagggtttgccaaaatttgtcatttttgtcttagatttcaaatcctaaaacaatgagttcaccaaccaagggaggaagaggaaagccaaagtcttcaaagtcggtatctcgatcatccaaagccggactccagtttccggtcggtaggatcgctaggtttctcaaagccggaaagtatgctgaacgtgtcggcgccggtgctcctgtctacctctccgccgttctcgagtacttggctgctgaggtattggaattagcagggaatgcagcaagggataataagaagaacagaattgtgcctagacacatacagcttgctgtaaggaatgatgaagaactaagtaaattgttgggggcagttacaattgccaatggtggtgttttgccaaacattcatcaaacactattgccaaagaaggttggaaaaggcaagggtgaaattgggtctgcttctcaggagttttagatcttgctttgttttgttttccagtataagacatgagagattaggggctttatgcaaatacatatatatgatgttctgttttggtcttcttgttttcaatggaaatgtaaggatgctttctagttggttgtaaactttggatgc

SEQ ID NO: 5736 - DNA, 879 bp, Triticum aestivum
caatcacgcaccacctcctccttctatataatcacaccaccgcccccgccggcacaccatctccacattccctctctcgacaatctgtccgactccggccatctctgcggcaaccaccgtatccgcgcgtccaccgttcgtagcgacgagaagatgagttctgccggcggcgggaggggcaagggcaaggcggtgtccaagaccgtctcgcggtcttccaaggccggcctccagttccccgtcggccgcatcgccaggtacctcaagatcggcaagtacgcccagcgcgtcggcgccggcgcccccgtctacctctccgccgtcctcgagtacctcgccgctgaggtcctggagctcgccggcaacgctgcgcgcgacaacaagaagacccggatcgtgccgcgccacatccagctggcggtccgcaacgatgaggagctgagccggcttctgggcgcggtcaccatcgccgccggtggtgtgctgcccaacatccacaccacgctgctccccaagaaggtcggcaagggcaagggcgacatcggctccgcgtcccaggagttctagagcctcgcagatcaaaccagcatcatcacagaagatttgaggactctgttctttttctagtatggcgatgctttaggttgttagattagttctcggtcaatgatctggttggtgtatcaatgatgaatctggttggaatgaaatactagcaatctggttcttgttattattcatcgtgatatgtcaacgtgaaaacatcttattgatgtctatgatgcggaatgaatggtgaaaacatgtttttacagtttgagtctgaatgctgttccagagagcattttctggcagtacaatgtactccctctgttccaa

SEQ ID NO: 5737 - DNA, 601 bp, Euonymus alatus
aaccaagcaaagtgcgcaaggctaatcgctcttcaccgaggaagaagttctagggttgatactttttattttcttttctttccactcgatcgaaggatgagttccactggtggcggctcgacgaagggaggaagaggaaagccgaaggcaacaaagtcagtttcacggtcgtcgaaggcggggctccagttccccgtcgggagaattgccaggtttcttaaggctggaaagtatgctgagcgtgtcggcgctggagctccggtctatctatctgctgttctcgaataccttgctgccgaggttttggaactggcagggaacgcagcaagagataacaagaaaaatcgtatagtgccgagacacattcagcttgctgttaggaacgatgaagagctgagcaaacttttgggatcagtgaccatagcaaatggtggtgtgttgcccaacattcaccagactcttctccccaagaagatgggcaagggcaaaggcgatattggatctgcatctcaagagttctagatctctctgttttttcgttataaattctacagttgtaatattcgactttcatgttaatctttttgcagacttaatgaaa

SEQ ID NO: 5738 - DNA, 643 bp, Manihot esculenta
attctcaaaaggaaagcgtcttctataactgttgtttctctttcaccgtgttcataatctggttagggtttggttttgtgcgatatttctacggattagtgaaaatgagttctaccgggcgaccgacaaagggaggaagaggaaagcctaaggcgtcgaagtctgtgtcgcgatcgcagaaggctggcttgcagtttccagtcgggaggatcgctaggtttctcaaggccggaaagtatgccgagcgtgtcggtgctggagctcccgtctatctttctgcagtccttgaataccttgctgctgaggtattggagcttgctggcaatgcagcaagggataacaaaaagaatcgtattgtgccaaggcacattcaacttgctgtgaggaatgatgaggaactgagcaagcttctgggctctgttactattgccaatggtggtgtgttgcctaacattcaccagactctccttcctaagaagatgggcaaggacaaaggcgatattggatctgcttctcaagagttttaggacttttcctcaagtctcctgttgttttgtttagggattctacatgttgtaaaatattcaattttggctttctactgggtcgactggtatcttttgagtaaagcagctttggaatc

SEQ ID NO: 5739 - DNA, 671 bp, Manihot esculenta
aaacattctcaaacgtagagcgtcttctaccaacttcttcttcacatcgttcactgtctgccaaatcaaagtaggtttgagttcgtggtttattttggagattggtgaaaaatgagttctactggtggatcaaccaagggaggaagaggaaagcctaaggcgtcaaagtctgtatcgcggtcgcagaaggctggattgcagttccccgtggggaggatcgccagatttctcaaggcaggaaagtatgccgagcgtgttggcgctggtgcaccagtctatctatccgctgtcctcgagtacctcgctgccgaggtactggagcttgcggggaatgcagcaagagataacaagaagaatcgcattgtgccgaggcatattcaacttgctgtaaggaacgatgaggagctgagcaagctcttaggttctgtcaccattgccaatggtggtgtgttacctaacattcaccagactcttcttcctaagaaggttggcaaggggaaaggtgacataggatctgcttctcaggagttctaggctttatttaccattagtttttgctgttttgttgagaattctacagttgtaaaatattcctttttggattttttctacttggatttcaatgatatcttttgagtaaagcagatgttaatatattgttgtcttcgtta

SEQ ID NO: 5740 - DNA, 779 bp, Citrus clementina
attccacaaaagtactcaaaagcaatttcaccgatcttttgtgtggcttcactttcaatcgcttcaaaccaaaccgaaatctagggttagggtttttctgtaataagaatgagttcaactggagggtcaacgaagggcggcaggggtaagccgaaggcttcgaaatcggtctcgcggtcgcataaggcgggccttcagttcccggtgggcaggatcgctaggtttttgaaggccggaaagtacgctgagcgagtcggcgccggagctcctgtttacctctctgccgtgcttgagtacctcgctgctgaggttctggagcttgctggcaatgcagcaagggacaacaagaagaaccgtatagtgccaaggcatattcagcttgcagttcgaaatgatgaggaattgagcaagctgctgggctcggttaccattgccaatggaggtgttttacccaacattcaccagacgctgcttcccaagaaggtggggaaaggaaagggtgacattggttctgcttctcaagagttctagactctgctctgtcagaattttactagtatctgtaaaaaaagaaaaaaaaggaaaaatggttatgagtttttttcttatggtaacagagattgcatttgctaatctttttcactatgtgtaacttaatgagattattccattgctttccacatgttatttgttatcgaacaatatagaacctagattaattctcctgatagggcattctctattgaatcaatacaagagccaatagatcttcccaatgc

SEQ ID NO: 5741 - DNA, 649 bp, Cucumis sativus
ctcattctcaaaccttcatcgctctccaaaaaccccaacttagggttcctgattttcatctttttctctcaaagtccctcgaattttcccgattcgacgatgagttccactggcggttccaccaaaggcggtagaggaaagcccaaagctaccaaatctgtttcccgatcgcacaaagccggactccagttccccgttggtagaatcgcaaggtttctcaaggctggtaaatacgctgaacgtgtcggcgctggtgctccggtctacttatctgccgtccttgaatatctcgctgctgaggttttggagcttgctggtaatgctgctagagacaacaagaagaatcgtattgtgccgagacatattcagcttgctgtgagaaacgatgaggaattgagtaagcttttgggatctgtaacaattgctaatggtggtgttttacctaatattcaccagactcttttgcctaaaaaggttggtaaagataagggtgatattggttctgcatcacaagaattctagaggttttagggtttttttttgggtaaggtttgtttcattactagagatgacaatgttttgatatgtgaaaatggatgtgtggttttgcatctatgacattcgcttcctcttttgtactttgtcatct

SEQ ID NO: 5742 - DNA, 796 bp, Eucalyptus grandis
atcaccgagtcaaaacccccgcgctctctctctctctctctcatattcgccgtctgtccgtttaaccggctccttcaccggcgagaatctccggcttccggcggatctagggttttctgatcttctcctttctccttcgtgggacgccagcatgagttcgaaggaaggaggcaaggggggcaggggcaagcccaaggccaccaagtccgtctcgaggtcgcacaaggcgggcctccagttccccgtcggcaggatcgcccggttcctcaaggccggcaagtacgccgagcgcgtcggcgccggggccccggtctacctctccgccgtcctcgagtacctcgctgctgaggtgctggagctggctgggaacgcggcgagggacaacaagaagaacaggatcgtgccgcgccacatccagctggcggtgaggaacgacgaggagctgagcaagctcctgggctccgtgaccatcgccaacggcggcgtcctccccaacatccaccagacgctgctgccgaagaagaccggcgggaaggggaagggcgacatcgggtccgcttctcaggaattctaaggggcttccgccatctccccgccttccttctttcaattttttttttttaatttttatattttgggtgggttcttcttcgatcttggtgtaggactttagggtttgatctttgcaatatacgtctgcaatttcttttttctttttttccttaccctttttgggttgctatgttaaaccaagaaaagtagtaaaaaggagcgatttttcatttctcggttcaaa

SEQ ID NO: 5743 - DNA, 665 bp, Jatropha curcas
gagaagatcatagcgtctacaatttctttttgcttgcttttcgttttgtgctaaaatactagggttagggtatctgtgacattttttgtattagtaaagatgagttcaactggaggatcgaccaagggcggcagagggaagccaaaatcttcgaagtcagtgtcgcggtcttcgaaggctgggttgcagttcccggttgggagaatcgctaggtttcttaaggctggaaagtatgccgagcgtgttggtgctggggctcccgtctatctctctgctgttctcgagtatcttgctgctgaggtattggagcttgctgggaatgcagcgagagataataagaagaatcgtattgtgccaaggcatattcagcttgctgtgaggaatgacgaggagctgagtaaacttctgggctcagttaccattgccaatggtggtgtattgccaaatattcaccagacactccttcctaagaagatgggcaagggcaaaggcgaaattggatctgcttctcaggaattctagacttctaatctttttttgtctagtttctggtggtttgatttagggatgctacagttgtaaaatactttttcattttggttttctgctttgcacttgaaatactgctcatcttttctgagtaaatgaatcggttgatcaatcaa

SEQ ID NO: 5744 - DNA, 783 bp, Cucumis melo
gtctcaagtaaaccttcatcgctctaccaaaaaccccaaattagggttcctaagtttcatttctttctcttaaagtccctcaaattttccagattcgacgatgagttccactggcggttccaccaaaggcggcagaggaaagcccaaagccaccaaatccgtctcccgatcgcacaaagccggcctccagtttcccgttggcagaatcgcgaggtttctcaaggccggaaaatacgccgaacgcgtcggcgctggtgctccggtctacttatctgctgtccttgaatatctcgctgctgaggttttggagcttgctggtaatgctgctagagacaacaagaagaatcgtattgtgccgagacatattcagcttgctgtgagaaacgatgaggaattgagtaagcttttgggatccgtaacaattgctaatggcggtgttttgcctaatattcaccaaactcttttgcctaaaaaggttggtaaagataagggtgatattggttctgcatcacaagaattctagagcttttaggggttttttttgtaaggtttgtttcattactagagatgacaatactctgatatgtgaaaatggatggatggttttgcatcgatggcatttgcttcctcttctgtactttgtcatcttgattttagtttagatgcatatatttttatatcaatgtgaggttgttggtggatttgattcaaggatgatgatgaccaactccttcttacagttagaagttaaatgaaacatggctctttttttgctaaaaaaaa

SEQ ID NO: 5745 - DNA, 775 bp, Citrus sinensis
attccacaaaagtactcaaaagcaatttcaccgatcttttgtgtggcttcactttcaatcgcttcaaaccaaaccgaaatctagggttagggtttttctgtaataagaatgagttcaactggagggtcaacgaagggcggcaggggtaagccgaaggcttcgaaatcggtctcgcggtcgcataaggcgggccttcagttcccggtgggcaggatcgctaggtttttgaaggccggaaagtacgctgagcgagtcggcgccggagctcctgtttacctctctgccgtgcttgagtacctcgctgctgaggttctggagcttgctggcaatgcagcaagggacaacaagaagaaccgtatagtgccaaggcatattcagcttgcagttcgaaatgatgaggaattgagcaagctgctgggctcggttaccattgccaatggaggtgttttacccaacattcaccagacgctgcttcccaagaagatggggaaaggaaagggtgacattggttctgcttctcaagagttctagactctgctctgtcagaattttactagtatctgtaaaaaaggacaaaaagaaaaatggttatgagtttttttcttatggtaacagagattgcatttgctaatctttaactatgtgtaacttgatgagattattccattgctttccacatgttatttgttattgaacaatatagaacctagattaattctcctgatagggcattctctattgaatgaatacaagagccaatagatcttcccaatgc

SEQ ID NO: 5746 - DNA, 682 bp, Camellia sinensis
cattccaatcagcgtctgtgtcttccaaagaacccaaagcggtagaaagcgaaagctagggttagggtttgtgaagaaagaagaaaaagaagaagatgagttcaggtgggggatcaacgaagggtgggcgaggaaagcccaaggcatcgaagtctgtgtctcggtctcagaaggcgggtcttcagttccccgtcggtagaatcgctcgatttctaaaggccggaaagtatgccgagcgagtgggcgccggagctccggtctacctctctgctgtcctcgagtacctcgctgccgaggtgttggagctagctgggaatgcggcgagagataacaagaagaacaggatagtgccaaggcacatacagttagcagtgaggaatgatgaggagctgagcaagttgttggggtcagtgaccattgccaatggaggggttttgccaaacattcaccagactttgttgcctaagaaggtgggtaaagggaaaggggatattggttctgcttctcaggagttttaggagccacccagccttatgtgatgtacaatggttttttttttgggttttctttttaacaatgtattatgattttatgggtatagctcctcttggggcatatgaatcaaagttctacagttttgatggtggcaaaaaaaaaaaaaaaaacatgtcggccgcctcgg

SEQ ID NO: 5747 - DNA, 793 bp, Citrullus lanatus
aaactcatagccaaggctccatctctctcgaaaaccccgaattagggttcttgattttcctcccttttctctcaaattccatcacttttttccgattcaacgatgagttccaccggcggttccaccaaaggaggcagaggaaagcccaaagccaccaaatccgtctcccgatcgcacaaagccggcctccagttccccgtcggcagaatcgcaaggtttctcaaggccggaaagtacgctgaacgtgtcggcgctggagctccagtctacttatccgccgtcctcgagtatctcgccgctgaggttttggaacttgctgggaatgctgctagagacaacaaaaagaatcgtattgtaccgaggcatattcagcttgcagtgagaaacgatgaggaattgagtaagcttttgggatctgtaaccatcgctaatggaggtgttttgcccaatattcaccaaactcttttgcctaaaaaagttggtaaagataagggtgacattggttctgcatcacaggaattttagggttttctgtttctctttttggggtttgtttcattactagggatgacagttctttctgatatgtgaaatggatggggggttttgcttctgtggcatttgcttcctctactgtaccttgtcatcttgattttgtgtttagatgcatatattttatatccatgtgaggttgttggtagatttgattaaaaaatgatgatgatcaactcccttttacagttagaagttaaatgaaatgggtgtttcttgttgaaagaattcagttttggtt

SEQ ID NO: 5748 - DNA, 755 bp, Hordeum vulgare
atctccacattcatctctcagcaatctgtccgactccggccatctctccggcaaccaccgtatccgcgcgtccaccatccgtagcgaccagaagatgagttctgccggcggcgggaggggcaaggccaaggcggcgtccaagatcgtctcgcggtcttccaaggccggcctccagttccccgtcggccgcatcgccaggtacctcaagatcggcaagtacgcccagcgcgtcggtgccggcgcccccgtctacctctccgccgtcctcgagtacctcgccgctgaggtcctggagctcgccggcaacgctgcgcgcgacaacaagaagacccggatcgtgccgcgccacatccagctggcggtccgcaacgatgaggagctgagtcggcttctgggcacggtcaccattgccgccggcggtgtgctgcccaacatccacacgacgctgctccccaagaaagtcggcaagggcaagggcgacatcggctctgcgtcgcaggagttctagagcctcgcagatgaaaccagcatcatcacagaagatttgaggactcttctttttctagtatggcgatgctttaggttgttagattagttctcggtcaatgctttggttggtgtatcgatgatgaatctggttggaatggaatgctagcaatctggttctagttattgctccttgtgatatgccaaatcaaagtgaaaatatcttgttaatctgggtatgaatggtactgtcctgttgttcgagagta

SEQ ID NO: 5749 - DNA, 863 bp, Aristolochia fimbriata
tttttcgggggttcgtaagttgcaatttgtttccgcggcaatttttttgtctgacagagcgcttgttcgcgaatagtttgtctttctagatcggaggcgaagatgagttctgcagggtctacgaagggtggaagaggcaagcctaagtcgtccaaatcggtttctagatcccagaaggcggggctacagtttcccgtcggaaggattgcgaggtttcttaaggccggaaagtacgccgagcgggttggagccggtgctcctgtttacttgtctgctgttcttgagtatctcgctgctgaggttctcgagctcgctggaaatgcagcaagagataacaagaagaatcgaattgtacctaggcatatacagctcgcggtgagaaacgatgaggaattgagtaaactgctcggtgcggtgacaatcgcgaacggaggagttttgcctaatatacatcaaactctcttgccgaagaaacaaggcaaaggaaagggcgagcctgggtctgcttcgcaggagttttagggtgttgttttgtctgaatagtataagtctaggggtgggagtgatttggacatgaggggtgctttctgtcagcccgctgatgttggaaaaaccctaattttgtcttatgtcgaacataaacaatggaaatgatcataattttgatgtgtatagctctttcgttgtcaatcgaatggagttgaatttttttatttgttcttttgcctgtggttgctctgggtgttttcatttacttccgcgctcgactgctattctctggtttatgggcacgacgggtaacaatattacagattacatgttatatcttgtgtggttttcatttaatcctgaatttcgtttaa

SEQ ID NO: 5750 - DNA, 857 bp, Hordeum vulgare
caatcacgcaccacctcctccttctatataatcataccaccgcccacgcgggtacaccatctccacattcatctctcagcaatctgtccgactccggccatctctccggcaaccaccgtatccgcgcgtccaccatccgtagcgaccagaagatgagttctgccggcggcgggaggggcaaggccaaggcggcgtccaagatcgtctcgcggtcttccaaggccggcctccagttccccgtcggccgcatcgccaggtacctcaagatcggcaagtacgcccagcgcgtcggtgccggcgcccccgtctacctctccgccgtcctcgagtacctcgccgctgaggtcctggagctcgccggcaacgctgcgcgcgacaacaagaagacccggatcgtgccgcgccacatccagctggcggtccgcaacgatgaggagctgagtcggcttctgggcacggtcaccattgccgccggcggtgtgctgcccaacatccacacgacgctgctccccaagaaagtcggcaagggcaagggcgacatcggctctgcgtcgcaggagttctagagcctcgcagatgaaaccagcatcatcacagaagatttgaggactcttctttttctagtatggcgatgctttaggttgttagattagttctcggtcaatgctttggttggtgtatcgatgatgaatctggttggaatggaatgctagcaatctggttctagttattgctccttgtgatatgccaaatcaaagtgaaaatatcttgttaatctgggtatgaatggtactgtcctgttgttcgagagtattttttgccagtatgtttatcttcagtcacgcctaactttgcca

SEQ ID NO: 5751 - DNA, 1034 bp, Cicer arietinum
gccaaaccctctcaaccaattagcgcaaagtcttgggtcctatataataacattccaccgatacatctctcaacaattcatactcaccctctcacttctacgtctcaacgctctctgtttacaaatctcaaatacaagtttctagggtttcaatttctacttctatcagaaaatgagttccactgctacaaccaagggaggaagaggcaagccaaaggcctccaaatctgtttcaagatcttcaaaggccggtcttcaatttcccgttggaagaatcgctagattcctaaaggccggaaaatacgccgaacgtgtcggtgccggtgctcctgtttacctctccgccgttctcgagtatctcgctgctgaggttttggaattggctggaaacgctgccagagacaacaagaagaaccgtattgttccaaggcacattcaactcgctgtgaggaatgatgaggaactcagcaagcttttgggatctgtaaccattgctaatggaggtgttttgcctaatattcatcagactttgcttcccaagaaggttggaaagggaaagggtgaaattggatctgcttctcaagaattttaggggtttcattgcgacgttttgatctgatcatagtttattttgatgcagttgtaatatacatgtttaatttctttatttctgccatgaattgaaatgtatcactatgatatagtgaatggttttgtactgaacccttataactggtgatgaatggataacaaatttatcggtttatagaaacttctgttttaaagtgacttgattgtgtttttgttttgaggtgggtgtttcttggttctaactgcaaatgtgtctataacttgttttggtggtgaaatatggcttttcttaagctagattgtccaacttgtttgcacccttgtatacttatctgttgtaagccatcattgctcttttgaacttattttcttggtgtttgtttcaaaaccttaatgctcaagtaaattggaatgataaatacatgacaagaatgaatatcttt

SEQ ID NO: 5752 - DNA, 735 bp, Echinochloa colona
ctccccatcctaccaccgcaccaccgccaccgcgctcgactccggcgagccgacgactccccgctctcaccctcgaaggaaggaaggaaggaaagacgagaagatgagttccggcggcggcaggggcagggccaagggtaccaagtcggtgacgcggtcggccaaggccgggctgcagttccccgtcggccgcgtcgcgcgctacctcaagaccggcaagtacgccgagcgcgtcggcggcggcgcccccgtctacctctccgccgtcctcgagtacctcgccgccgaggtgctagagctcgccgggaacgcggcgcgcgacaacaagaagaaccggatcgtgccgcgccacatccagctggcggtgcgcaacgacgaggagctcagcaagctgctcggcgccgtcaccatcgccgccggcggggtgctgcccaacatccaccagacgctgctgcccaagaaggccggcggcaagggcaaggccgacatcgggtccgcctcccaggagttctagatgcatggggcttgggcttgctccgcccgaacccagctttagtgggagccaccgccggcggtggcggcttcttgcttcgtcggtactactactagttctagtgtctcgcctaggttaggttaggttttgtgatcgatggttgtttgcaaggggaacaagtttgttgaagatgaaagttggctgtatctattaatcgatctttgctcgaatggatgaaatgg

SEQ ID NO: 5753 - DNA, 597 bp, Echinochloa colona
gaagatgagttccggcggcggcaggggcagggcgaaggggaccaagtcggtgacgcggtcggccaaggccgggctgcagttccccgtcggccgcgtcgcgcgctacctcaagaccggcaagtacgccgagcgcgtcggcggcggcgcccccgtctacctctccgccgtcctcgagtacctcgccgccgaggtgctggagctcgccgggaacgcggcgcgcgacaacaagaagaaccggatcgtgccgcgccacatccagctggcggtgcgcaacgacgaggagctcagcaagctgctcggcgccgtcaccatcgccgccggcggggtgctgcccaacatccaccagacgctgctgcccaagaaggccggcggcaagggcaaggccgacatcggatccgcctcccaggagttctagatggggtccaaacccaactttagtgggagccgccgcggcggcggcttcttgcttcgtcagtacctactactagtagttctagtgtctcgcctaggttaggttaggttttgtgattgatggttgtttgcaaggggaacgaatttgttttggatgaaagttggatgtatctattaatcaatctt

SEQ ID NO: 5754 - DNA, 557 bp, Festuca arundinacea
ggcacgaggcaaaccccctccaccgtctcccacatcggccatctctccggcgacctcaacctcaagaccaccgcccgttcccatcctccgaagatgagttccgccggcggtaggggcaaggcgaagggctccaagtccaccacgcggtcgtccaaggccggcctccagttccccgtcggccgcatcgccaggtacctcaagatcggcaagtacgcgcagcgcgtcggcgccggcgctcccgtctacctctccgccgtcctcgagtacctcgccgccgaggtcctggagctcgccggcaacgcggcgcgcgacaacaagaagacccggatcgtgccgcgccacatccagctggccgtccgcaacgacgaggagctcagcaagctgctcggcgccgtcaccatcgccgccggcggcgtcctgcccaacatccacaccacgctgctccccaagaaggccggcaaggccaagggcgacatcggatccgcttcgcaggagttctagagcctttcagatcgaacaagcatggctctgtctgacccaagatttgagtcctctgt

SEQ ID NO: 5755 - DNA, 727 bp, Secale cereale
ctcaacaatctgtccgactccggccatccctcccgcaaccaccgtacctgcgcgtccaccgtccgtagcgaccagaagatgagttctgccggcagcgggaggggcaagggcaaggcggtgtccaagaccgtctcgcggtcctccaaggccggcctccagttccccgtcggccgcatcgccaggtacctcaagatcggcaagtacgcccagcgcgtcggcgccggcgcccccgtctacctctccgccgtcctcgagtaccttgccgctgaggtcctggagcttgccggcaatgctgcgcgcgacaacaagaaaacacggatcgtgccgcgccacatccagctcgcggtccgcaacgatgaggagctgagccggcttctgggcgcggtcaccatcgccgccggcggtgtgctgcccaacatccacacgacgctgctccccaagaaggtcggcaagggcaagggcgacatcggctccgcgtcccaggagttctagagcctcggagatcaaaccagcatcatcacagaagatttgaggactctgttctttttctagtatggcgatgctttaggttgttagattagttctcggtcaatgttttggttggtgtatcgatgatgaatctggttggaatggaatactagcaatctggttcttgttaaaaaaaaaaagaaaaaaaaagaaaaaaaaactaaacgagacgagcacgacgacacaggaggtagggggg

SEQ ID NO: 5756 - DNA, 801 bp, Sorghum bicolor
cgcccgcccctctcaccaatacctcttcattcttcaccgcgcccccaacctcgaagagttcggaagtttccagacccccaaaggcgaagcggcgatgagttccaccggaggcggcggccgcgggaaggcgaagccagcgaccaagtcagtgtcgcggtcctcaaaggctgggctccagttccccgtcggccgcatcgcgcggtacctcaaggccggcaagtacgcggagcgcgtcggcgccggggcccccgtgtacctctccgccgtcctcgagtacctcgccgccgaggtgctggagttggccggaaacgctgctcgggacaacaagaagaaccggatcgtgccgcgccacatccagctggcggtgcggaacgacgaggagctgagcaagctgctgggcaccgtgacgatcgccgccggtggcgtgatgcccaacatccactcgactctgctgcccaagaaggcgggtcaaaagggcgacatcgggtccgcctcccaggagttctgagcgcgtcggcggaaagaggagagagaccgtccctgcctttgtcttgtccgcgtggtgatgcttgagcttcgcgggttttggggtgttgtcgacgagttgggactgttttgggggtctgtgggatgtaaacaaacgcagcgcgttgtttcatgaatcaatgaatgaatataagagagtattattatgatttcctctctgcttgcattggaattcgatttgtttatcctatcgaatggcgcattgtatcaaactgcatcaaacatgatgatggaactgtttggattggttccgtg

SEQ ID NO: 5757 - DNA, 982 bp, Panicum virgatum
accgaaaccaaacccactcccgaaaaatttccgcgccccgccgcccgtgcgcccggaagaaatccgggccgtccgttccgagccccgcgcgcccgcccgctccccggatccgcggcgcccacgtcagcgatccgcgccgcctcccgctcggccaatcgcgggccgccgcggcctctacataacccaccgcgccctccctccggcctcctcctccaatctcaccgccaccagcgccaccgccgcaccggttccggcgatcttgggcccccctcggaaggaagggaggaagggaagggaagggacgagaagatgagttccggcggcggcaggggcagggccaagggcaccaagtcggtgtcgcggtcctccaaggccggcctgcagttccccgtcggccgcgtcgcgcgcttcctcaagacgggcaagtacgccgagcgcgtcggcggcggcgcgcccgtctacctcgccgccgtcctcgagtacctcgccgcggaggtgctggagctcgccggcaacgcggcgcgcgacaacaagaagaaccggatcgtgccgcgccacatccagctcgccgtgcgcaacgacgaggagctcagcaagctgctgggggccgtcaccatcgccgccggaggggtgctgcccaacatccaccagacgctgctgcccaagaaggccggcggcaagggcaaggccgacatcggatccgcctcccaggagttctagccgccggcgccgccggcgcggggggcctccccctccctccttcggggcgcggccttagtcgcagccgccgatgctgcggcttcttcttggctccaccagtagtagttctagtatctcgcctaggctaggttaggttttgcaatggatggcttaccatgggaagtttgctgtatctatcaatcaatcttgcttgaatggatgaaatggtcggttgctatgaatcgatgaaatggttctgtgctgtttcttttgtgtaaatttc

SEQ ID NO: 5758 - DNA, 930 bp, Panicum virgatum
ccccccctccgccctcgtccattcccccccctccccccaatctccagcctcaaaccccccggcagcgccaccgccgcgcctcaccgcttccggcgatctcgtgggcccctcggaaggaaggaagggacgagagaagatgagttccggcgccggcaggggcaagcccaagggcaccaaggcggtgtcgcggtcgtccaaggccggcctgcagttccccgtcggccgcgtcgcgcgttacctcaagacgggcaagtacgccgagcgcgtcggcggcggcgcgcccgtctacctctccgccgtcctcgagtacctcgccgcggaggtgctggagctggccggcaacgcggcgcgcgacaacaagaagaaccggatcgtgccgcgccacatccagctcgccgcgcgcaacgacgaggagctcagcaagctgctcggcgccgtcaccatcgccgccggaggggtgctgcccaacatccaccagacgctgctgcccaagaaggccggcggcaagggcaaggccgacatcggctccgcctcccaggagttctagccgccgccggcgcggatggcctccctccctccgcctgggcccggctttagtcggagccgccgatgcggcggcttcttcttggttcactagtagtagttctagtgtctcgcctaggctaggataggttttgcaatggatggcttatcgtgggaagtttgctgtatcaatcaatcaatcaatcttgctggaatggatgaaatggtcggtcgctgctgcttgcaatggttctgtgatctttcttttgtgtaaatttcacctctgaatcgcggcagacgaattcacctgcttgcttatgagatgaattttcatctgaatgtttccttgtctagatgtctggatcgtttgtgctgagttgctggtggaattaaacctccttttcaaaa

SEQ ID NO: 5759 - DNA, 697 bp, Trigonella foenum-graecum
actcttctgaaacccaatttctcccaaaatcgagttttaggtttttcgtttcttcttcaattcgaaaatgagttccacaggtacaaccaagggcggaaggggtaaaccaaaggccgccaaatcagtttccagatcttcaaaggccggtcttcaattccccgtcggaagaattgccagattcctcaaggccggaaagtacgccgaacgtgttggtgccggtgctccggtctatctctctgcggttctcgagtatctcgctgctgaggttttggaattggctgggaacgctgctagagacaacaagaagaatcgaattgttccaaggcacattcagcttgcggtgaggaatgacgaggaactgagcaagctattgggagctgtaaccattgctaatggtggtgttttgcctaatattcatcagactttgctcccaaagaaggttggaaagggcaaaggcgaaattggatctgcttctcaagaattttagggtttctgtgtttcgttctaaatagttatagtttatctttctgcagatgtagtataaatgtttaaattctataatactggcttgtgatgaaatgtagtactttgatgaagtgaatggttttgtactagttaattggagatgaatgacaaccagtattttataatatatacatgctgtttttgagaactgatgcaatggatctaagtattt

SEQ ID NO: 5760 - DNA, 765 bp, Vicia sativa
gccttctcagttttcagtcatttgtatctcagaaactagggtttaggttttccgatttcttctccgatcagaaaatgagttctactgctacaaccaagggcggaagaggcaaatcaaaggccgccaaatctgtttcaagatcctcaaaggccggtcttcaatttcccgtcggtagaatcgctagattcctcaaggcaggtaaatacgccgaacgtgttggtgctggcgctcccgtttatctctccgccgttctcgaatatctcgccgccgaggttttggaattggctgggaatgctgccagagacaacaagaagaatcgtattgttccaaggcatattcagcttgctgtaaggaacgatgaggaactgagcaagcttttgggaactgtaaccattgctaatggtggtgttttgcctaatattcatcaaactttgttacctaagaaggttggaaagggaaaagaagaaattggatctgcatctcaagaattctagggttttttcatttatcaaatgttagttgtaaaatacatgtttggttactccaaattggatgcactggttttgatcaactggtttttatcaagtgagagatgacacaaattaaattgctcgatagtgtgttgcactttggaatcttgctatttgttcaccgaaaagtgcaccaaataatggactttttagcaaaagttatatggggtatatggaacacttttggatgtttttaaactcttgtttatcatgaatgaaattagctgtgttccaa

SEQ ID NO: 5761 - DNA, 906 bp, Eucalyptus grandis
ccattaacggccaccgatctttctctccatctcgtatcggcgcttccgatctccgctcgcgatcgcccctcccaaaaatcgtacggcgtttttctagggtttcgcggttgttgtccagttcttctgtcgaatcggagaagatgagctcaaaggaaggcggcggcggcggcaagggagggaggggcaagcccaagtcctccaagtcggtgtcccggtcgcagaaggccggcctgcagttccccgtcggcaggatcgctcggttcctcaaggccgggaagtacgccgagcgggtcggcgccggagccccggtctacctctccgccgtcctggagtacctcgccgctgaggtgttggaacttgctggaaatgctgccagagacaacaagaagaacaggatcgtcccaaggcacatccagctcgcggtgaggaacgatgaggagttgagcaagctcctgggttccgtgaccattgctaatggaggagtgttgcccaacattcaccagaccctgttgccgaagaagatgggcaaagggaagggggacattggatctgcttctcaggagttttagggagtttttctcgtttgtagcttgggatcttgtatcagagattttgtcatgggatgatttctagtgtatatgtttgaatatgggtctttcggggttctctggctgggaattctaatatcatattaggatcatgtttgaatcaaatcaaaagggtttttctttgttcatgttttcatatgaatggatctattgatattgaaattggacaagtggtatcttcactaatgtgaatgtacaccaaattgagaccaaaagagggtcaatatcttgagtttgagacagtgcaatttgttgtcccaggtattgattacgaatgtccaaattcagtctagttgga

SEQ ID NO: 5762 - DNA, 640 bp, Euonymus alatus
accaagcaaagcgcatacatacaatcgttcttcacagagagagtttctagggtttatatttgatttcgtgtttttcgttcgattgaaagatgagttcaacgggtgcaggctcaacaaagggaggacgaggaaagccgaaggcgacgaagtcggtttctcggtcttcgaaggcgggactccaatttcccgtaggcaggattgccaggttccttaaggcgggaaagtatgccgagcgtgtcggcgctggagctccggtctatctctctgccgttcttgagtaccttgctgccgaggttctggagcttgcagggaacgcagcaagggacaacaagaagaatcgtatagtaccaaggcacatacagcttgcagtcaggaacgatgaagagctgagcaagcttttgggttcagtgactatcgcaaatggcggcgtgttgcccaacattcaccagactcttctccctaagaagttgggcaagggcaaaggcgatattggatctgcatctcaagagttctagatctttggttgtctgataatggtttttggttataaattctacagttatagtattcgactatcttgtatttctttttgaactttttgcagacttaatggaaatcaagatcaatacattattgtctt

SEQ ID NO: 5763 - DNA, 1226 bp, Olea europaea
ggtaactctgctaatcaggcaattgagttactcatacagaaaggtgttccagagtctcatattattttcctaaacctcatctccgcaccggagggaattcattgcgtttgtaaacgtttcccctcattaaaaattgtgacatcagagattgatgtggcactgaatgaagaatttcgcgtgataccaggtttgggagaatttggtgatcgttactttggcactgatgattgatccatacaggttcaatattgcgcgttacctgttggtctgctcattaactgtaaattaaggccgccagtctgtttatattcacacgttacgacgtgcccttgttttctggatgattatggggatcgcatatttttatggttatttactatttagcatcccttaaatctgaaggtaacaaaatcacgttacccaagtctgcgacgactgggacttcgaagcaatgatgttacaaaagcattttttatagttccaatttctaccttatcattttcctgaagcagtaaaacacaaatcttaaaatgagttcaacaggcggagcctccaccaagggcggcagagggaagccaaaggcctcgaaatccgtatcccgatctagtaaggctggcctccaattccccgttggcagaatcgctcgattcctcaaggccggaaagtacgccgaacgtgttggcgctggtgcccccgtctacctctccgccgtccttgaataccttgctgctgaggttttggagcttgcgggaaatgctgccagggacaacaagaagaacaggattgtgcctaggcatatacaactggccgtaaggaatgatgaagaattgagcaagcttctcggaaatgttacaattgcaaatggtggggttttgcctaatatacatcagaatttgttgccgaagaaagctggaggaaaagacaaagagattgggtctgcttcccaagagttctagagtttttatgtattatttttggcagttttgatgttcagatgtttggttgattaaaaacttatcttattttgctataatacacagaacatattcattaattataagagtctattacttaaacgtcattaatcagttattcttacattatgcaacttaagaagtagttgttctgtgtttttctatttgggcaattgccttgtctgcaatatgttggattgactctgattatcatttggcctataatttataaagaactaatcttttgaattc

SEQ ID NO: 5764 - DNA, 869 bp, Sesamum indicum
ccaaaacattttcgctcgaatcctctcagtggctagggtttctgaatcagtattcgcactcggaaatatgagttctaacgcagcagcctcaacgaagggcggtaggggcaagcctaaatcctcgaaatctgtctcccgttcgtcgaaagctggccttcaatttcctgttggcagaatagcgcgttttctcaaggctggtaaatacgcagagcgtgtcggcgctggcgcacccgtttacctctccgccgttcttgagtatcttgctgctgaggttttggagcttgcgggcaatgcggcaagggacaacaagaagaacagaattgtgccaaggcacatacagttggcggtgaggaatgatgaggaattaagcaagttgttggggaatgttacaattgcaaatggtggtgtgttgcctaacattcaccaaactctgttgccgaagaaggctggtggaaaagacaaagagattggatctgcttcacaagaattctagggcttcgttgtgaattaggcatattagttgctggttgcttttatgaagggtttggatcgactgagttgccatgatgtttggtccatgtaaaaccctagttttggagtgtttggagtacatatagtggtatggatgaacgatgattaatctctatatcaatagtattttaatttgcaatcccgtctctgatggccttgatttccaaacagtgtgcttccattttgcggaatatgtttatgttgattgattactttttggtctattcttatcatacggaatcacaaacttttcctgtacctaatgtttaacaactgcaaattctgttgctctaccctgccgtgaaccaaacgaatgcatttcttatgttcttccccag

SEQ ID NO: 5765 - DNA, 590 bp, Tripterygium wilfordii
agggagagaatttctagggtttatactttatttcgtgtttttaatcgatcgaaggatgagttccaccggtggaggctcgacaaagggaggacgaggaaagccgaaggcgacgaagtcggtttcgcgatcgtcgaaggcagggcttcagtttcccgtcggcaggattgccaggttccttaaggccggaaagtatgctgagcgtgtcggggctggagctccggtctatctttctgccgttcttgaataccttgctgccgaggttctggagcttgcagggaacgcagccagagacaacaagaagaatcgtatagtgccaaggcacatacagcttgcggtaaggaacgatgaagagctgagcaagcttttgggttcggtgaccatcgcaaatggtggtgtgttgcccaacattcaccagactcttctccccaagaagatgggcaagggcaaaggcgaaattggatctgcatcccaagagttctagatctttgtttgtctgttaatggtttttggttataaattctacagttgtagtattcgactctcttgtacttctttcgcaactttttgcagacttaatggaaatcaagatc

SEQ ID NO: 5766 - DNA, 792 bp, Glycine max
gcctgatttctcagttctctcacacactcattcggtgctccgaatctcagattctagggttagggttcccaatttctccaccgatcagaaaatgagttcaactggtggttctaccaagggcggaaggggcaagcccaaagcctccaaatccgtttcaagatcgcagaaagctggtctccaattccccgttggaagaatcgctcgattccttaaggctgggaaatacgccgagcgtgttggtgctggtgctcctgtgtacctctctgcagtgctcgaatatctcgctgctgaggttttggaattggctgggaatgctgctagggataacaagaagaatcgtattgttcctaggcacattcagcttgctgtgaggaacgatgaggaactgagcaagcttttggggtctgttaccattgccaacggaggtgtcttgccgaacattcaccagactctgcttcccaagaaggctggaaaggggaagggcgaaattggatctgcctctcaagagttttagggtttttgttttacccatttggactatagttttgattttattgcgtttgtaacatacatgtttcggttattttctacatgtcttctctgagaaattaggtgcttctcagtctgatgaactggatggtgtattatcacttttgaatcagatgtgaatgtgaagtgctatttggattatctgtcgaattaatttattttataacgatagtgtttcataagctggcgcacattgctttttgaactttgaacagtcaattgattattctatatctcctaaat

SEQ ID NO: 5767 - DNA, 535 bp, Glycine max
tttctcagttctctcacacactcattcggtgctccgaatctcagattctagggttagggttcccaatttctccaccgatcagaaaatgagttcaactggtggttctaccaagggcggaaggggcaagcccaaagcctccaaatccgtttcaagatcgcagaaagctggtctccaattccccgttggaagaatcgctcgattccttaaggctgggaaatacgccgagcgtgttggtgctggtgctcctgtgtacctctctgcagtgctcgaatatctcgctgctgaggttttggaattggctgggaatgctgctagggataacaagaagaatcgtattgttcctaggcacattcagcttgctgtgaggaacgatgaggaactgagcaagcttttggggtctgttaccattgccaacggaggtgtcttgccgaacattcaccagactctgcttcccaagaaggctggaaaggggaagggcgaaattggatctgcctctcaagagttttagggtttttgttttacccatttggactat

SEQ ID NO: 5768 - DNA, 673 bp, Glycine max
ctcagttctcacactcattccgtgctctaaatctcaaattctagggttagggttcccaatttctccgccaatcagaagatgagttccaccggtggttctaccaagggcggaaggggcaagcccaaagcctccaaatccgtttcaagatcgcagaaagctggtctccaattccccgttggaagaatcgctcgattccttaaggctgggaaatacgctgagcgtgttggtgctggtgctcctgtgtacctctctgcagtgctcgagtatctcgctgctgaggttttggaattggctgggaatgctgctagggataacaagaagaatcgtattgttcctaggcacattcagcttgctgtgaggaacgatgaggagctgagcaagcttttgggatctgttaccattgccaatggaggtgtcttgccgaatattcatcagactctgcttcccaagaaggttggcaaggggaagggcgaaattggatcagcttctcaagagttttagggtttttgttaggcctatttggactatagtttttattttattgcggttgtaatatacatgttttggttaatttttagatatctgctctgaggaattaagtgtttctcagtcttttgaactggatggtgtaatctcacttttgaatcggatgcgaatatgaagtggtatttgg

SEQ ID NO: 5769 - DNA, 446 bp, Aquilegia formosa
ttttacgaattaatttgaagaagatgagtaccaaagaaacaaccaaaggtggtcgtggaaagccaaaggcatcgaaatctgtatctagatcttcaaaagctggtcttcaatttcccgtcggaagaattgctaggtttcttaaagctggaaagtatgctgaacgtgttggtgctggagcaccagtttatctatctgctgttctcgagtatcttgctgctgaggttcttgaattagctggaaatgcagcgagagataataagaagaatcgaattgttccaaggcatattcaacttgcagtaaggaatgatgaggaattgagcaagcttttgggtgctgtgactattgctaatggtggtgttttgcctaatattcatcagactttgttgcctaagaaggctggaaagggaaaaggtgctgagattggatctgcttctcaagaattttag

SEQ ID NO: 5770 - DNA, 685 bp, Phaseolus vulgaris
atatgcacttctccctcacttcttttacactcctccaaattgaaagttctagggttagggtttccattttttgtaagcagattagaaaatgagttctactggtggttcaaccaagggtggaaggggcaagcccaaggcctccaaatccgtttctagatcacagaaagctggccttcaattccctgttggaagaatcgctcggtttctcaaagctggcaaatacgcagaacgtgttggtgctggtgctccagtttacctctctgcagtgcttgagtatctcgcagctgaggttttggaactggctggaaatgctgctagggataacaagaagaatcgtattgttcctaggcatattcaacttgcggtgaggaatgatgaggaactgagcaagcttttggggtctgtcaccattgcgaacggtggcgttttacccaatattcatcaaactcttcttcctaagaaggttggcaagggaaaaggcgaaattggatctgcttcacaagagttttagggttttaagggctcattttagactatagattaaatttcattttggttgtaatatacatggtttggtctatttctatatattttctgagaggttaagtgtttctcagtctgtggagctgaatcgtgtatttctttttggatgtataagaaatgagaatgggtgttttccgatgaa

SEQ ID NO: 5771 - DNA, 672 bp, Theobroma cacao
attccaatacacctccgcgtcaccatttccaaattcacaatcaaaatctagggttttgggattttcgaagatgagttctactggagcatcaaccaaaggagggagagggaagccgaagtcatcgaagtcggtgtcgaggtcgcagaaggctgggcttcagttccccgtggggaggatcgcgaggttcttgaaggctgggaagtacgccgagcgtgtcggcgctggagctccagtctatctctctgctgtgcttgagtacctcgctgctgaggttctagagcttgctggtaacgcagcgagagacaacaagaagaatcgaattgttccaagacacatccaactagcagtgaggaatgatgaggagctaagcaagcttttgggttcggttaccattgcaaatggaggtgttttgcccaacattcaccaaacccttcttccaaagaaaatgggaaagggcaagggtgatattggatctgcttctcaggagttttaggcctttttttcttggtcccttttttgtttttggggcttttttttgaacagttgtataatataggatggtttagttttagggttcttcgattttggggttttgagctcttttatggtatctttttgagcaaagcagtaatgtatcaagttaattttattgaatttacatggttctttttt

SEQ ID NO: 5772 - DNA, 685 bp, Gossypium hirsutum
aattcaagtttttgtctcttttcccgttttccatttcctatcttcacagcggaatttagggtttaggaattttgaatatgagctctacgggtggatcaacgaaaggagggagagggaaaccgaaggcatcaaagtcggtttcgaggtcgcacaaggccggtcttcaatttcctgtcgggaggatcgccaggttcttgaaagctggaaaatatgccgagcgtgttggcgccggagctcccgtctatctctctgccgtgcttgagtaccttgctgctgaggttctagaacttgctgggaatgcagcgagagacaacaaaaagacccgaattgttccaagacacatccaactggcagtaaggaacgatgaagagttgagcaagcttttgggttcagtcactattgcaaatggaggtgttttaccaaatattcatcaaactcttcttcctaagaaaatggggaaggataagggtgaaattggatctgcttctcaggagttttaggcctttagcttttttaattttaatatggaaaaatggtaaatagtagaatatgctgtttagggtttggggattttgataccgagctttgaattttgttttgtaatcttttgaacaaagctcttatatatcaaactattttgggcaaaagctgcttcatcttccgcttctttgtcattgattggata

SEQ ID NO: 5773 - DNA, 681 bp, Vigna unguiculata
ggctacaccttctgcctcacttctcttgcacacttcaaattgcaaattctagggttagggttttcatttctaagcatattagaaaatgagttctaccggtggttcaaccaagggtgggaggggcaagcccaaggcttccaaatctgtttctcgatcacagaaagccggccttcaattccctgttggaagaatcgctcgatttctcaaagctggcaaatacgcagagcgtgttggtgccggcgctccagtctacctctctgcagtgcttgagtatctcgcagccgaggttttggaactggctgggaatgctgctagggacaacaagaagaatcggattgttcctaggcatattcaacttgctgtgaggaatgatgaggaactgagtaagcttttggggtctgtcaccattgccaatggaggtgttttgcctaatattcatcaaactcttcttcccaagaaggttggcaagggaaagggcgaaattggatctgcttctcaagagttttaggattttgatggctctttttagaaaatagttttaatttcattctggttgtaatatacttggtttggtttatctctatatattttccctgagaggttgagtgtttctcagtccgatgagctaaatggtgtatgttcttttggattatatgagaaatgaaaattggtgtttttgat

SEQ ID NO: 5774 - DNA, 631 bp, Euphorbia peplus
tgcccttcaatttctgatagctcttccagagatttcaattagggttaggttactgatattactttctatctgcgaaaatgagttcaaccggcggatcgactaagggaggaagagggaagcctaaggcatcgaaatcggtgtcccgttcacacaaggcaggtttgcagttccccgtcggaagaatcgccaggtttcttaaggccggaaagtatgctgagcgtgttggcgctggagctcccgtctatctctctgccgtcctcgagtatcttgctgctgaggtattggagcttgcggggaatgcagctagggataataagaagaatagaatagttccaaggcatattcaacttgccgtgaggaatgatgaggagcttagcaaacttcttggctctgtgacaattgccaatggtggtgttttgccaaacattcatcagactcttctccccaagaaagctggtgctagcaaaggcgatattggttctgcttctcaggaattttaggtggtgtttgagatttaggatactacagttgtaatatattttctgcacttggaatatctgtttttaattaaagtggcctagggatgaaagtgccttaaaaatttccatctgttgattgatccatgctgctt

SEQ ID NO: 5775 - DNA, 620 bp, Euphorbia peplus
gcattagactgtgtcgtatcatctatcttcttcctgtcgctgagatttcaattagggttacgctttctcaatcggaaaatgagttcaaccggcggatctactaaaggcggcagaggtaagccaaagtcggcgaagtctgtgtcccgttcttccaaggctggtttgcagttccctgttggaaggatcgcccggtttctcaaagctggaaagtatgctgagcgtgtcggtgctggtgctcccgtgtacctatccgctgtcctcgagtatcttgccgctgaggtattggagcttgcagggaatgcggcaagggataataagaagaatagaatagtgccgaggcatattcagcttgctgtgaggaatgacgaggagctaagcaagcttcttgggtctgttacgattgctaatggtggtgtgttgccaaacattcatcagactcttcttccgaagaaagcgggtgcaagcaaaggcgacattggttctgcttctcaagaattttaggcttgtttttgttttaggactccacagttgtaatatatgccctttgttttccatggtgatttcggaatattatggtgcttttgacctaagcagcctttgaatgaaaatttcaatctgta

SEQ ID NO: 5776 - DNA, 852 bp, Panax ginseng
tggtatcaacgcagagtacatggggacggcaaacacatcctttctctctccttgggttttgctattcggtacagaacatttagattatcagatcgaagaaagatagagatgagttcaaaagaaggctcaaccaagggcggaagaggaaagccgaagtcctcgaagtctgtgacgcgatcttcaaaggccggtcttcagtttcctgttggtagaattgcccgttttctcaagaacggaaagtacgccgagcgtgtcggtgccggagctccggtatatctctctgccgtccttgagtatctcgccgctgaggtgttggagttggctgggaatgcagcaagagacaacaagaagaatagaatagtgccaagacacatacagcttgcagtgaggaatgatgaggagttgagcaagctcttgggtgctgtaacaattgccaatggaggtgttttgcccaatattcaccagaatttgctacccaaaaaggttggcaaagacaagggagacattggctccgcttctcaggagttctaggaagacattgtgcttagtagactaattagtttttctcaaaaattctatatttgttttgcagttaatgctttcagtacaagatttttaattgggaaacgcatttaaagttatatgatattggatggaatggtggtggttccctcaagaatgttccacccttaatgtgactttagagcatttccatcagctagactatttgatggactatatttagtccatatgacatcaacaaatgtcctttagtctttcatctttctagtagatggactatctgtggactataatataataagattaaaataatctgtgaattcaaaaaag

SEQ ID NO: 5777 - DNA, 936 bp, Panax ginseng
ccgtaacgtaacgacgtaggttaggttactaacgacgacgagtagtcgagtttgtttttttttttttaagttcagtggtatcaacgcagagtacgcggggacggcaaacacatcctttctctctccttgggttttgctattcggtacagaacatttagattatcagatcgaagaaagatagagatgagttcaaaagaaggctcaaccaagggcggaagaggaaagccgaagtcctcgaagtctgtgacgcgatcttcaaaggccggtcttcagtttcctgttggtagaattgcccgttttctcaagaacggaaagtacgccgagcgtgtcggtgccggagctccggtatatctctctgccgtccttgagtatctcgccgctgaggtgttggagttggctgggaatgcagcaagagacaacaagaagaatagaatagtgccaagacacatacagcttgcagtgaggaatgatgaggagttgagcaagctcttgggtgctgtaacaattgccaatggaggtgttttgcccaatattcaccagaatttgctacccaaaaaggttggcaaagacaagggagacattggctccgcttctcaggagttctaggaaaacattgtgcttagtagacttcttagtttttctcaaaaattctatatttgttttgcagttaatgctttcagtacaagatttttaattgggaaacgcatttaaagttatatgatgttggatggaatggtggtggttccctcaagaatgttccacccttaatgtgactttagagcatctccagcagtaagactatttgatggactatatttaatttatatgacatcaacaaatgtcctttagtctttcatctttctagtagatggactatctgtggactataatataataagattaaaataatctgtgaattcaaaaaagctccaatct

SEQ ID NO: 5778 - DNA, 659 bp, Gossypium raimondii
aagcagtcctttaaaatttgaaactcccgacttttacgtttccaattctgaaaagaaaaagttggttagggattttgaggatgagttccaccggaggatcagcgaaaggagggagagggaagcccaagtcatcgaaggcggtgtcgaggtcgcacaaggctgggcttcagtttcccgtggggaggatcgccaggttcttgaaagctggcaagtatgccgaacgtgtcggtgctggagctcccgtctacctctctgccgtgcttgagtacctcgctgctgaggtactagaacttgctggaaacgcagcgagagacaacaagaagaatcgaatagttccaaggcacatacagttagcagtgaggaatgatgaggagttgagcaagcttttgggttcagttacaattgcaaatggaggtgttttgcctaacattcatcaaacccttcttcccaagaaaatgggaaagggtaagggtgacattggctctgcttctcaggagttttaggccttagttttgatttttttttttttttttgttttttaatgcttgtataatataagcaggttttcttgatctccttttcttatattttgagcaaatgtagttgcttattgatgttaatataaatgtactttttttaaagaagttctttctcattga

SEQ ID NO: 5779 - DNA, 561 bp, Glycyrrhiza uralensis
agtgtgcgttcgctttctcagtcctcaacagtatttccgcgccctgatattgaatctcaaattctagggttagggttcccaaaatctccgacgatcagaaaatgagttccacaggtggttcaaccaaaggcggaaggggcaagcctaaggcctccaaatccgtttctagatcacagaaggccggtcttcaattccccgtcggtagaatcgctaggttcctcaaagccggaaaatacgccgaacgtgttggtgccggtgctcccgtgtatctctctgcagtgctcgaatatctcgccgctgaggttttggaattggctgggaatgctgcgagggacaacaagaagaaccgtattgttccgaggcacattcagcttgcggtaaggaatgatgaggagctcagcaagcttttgggatctgttaccattgcaaacggaggtgttttgccgaatattcatcagactcttcttcccaagaaggttggcaaagggaaaggcgaaattggatctgcttctcaagaattttaggtttttcataggtcatagttttattttgccgcagttg

SEQ ID NO: 5780 - DNA, 927 bp, Cajanus cajan
catcagcgcctgcttcctcacttctcacacactttccgtgctccaacatcgaatcgcaaattctagggttagggttttcaatttcttcctccatcagaaaatgagttccactggcggttcaaccaagggcggaaggggcaagcccaaagcctctaaatccgtttcaagatcgcaaaaagctggcctccaattccccgtcggaagaattgctaggtttctcaaggctggtaaatatgctgaacgcgttggtgctggtgctcctgtttatctctccgcggttctcgagtatctcgctgctgaggtgttggaactggctgggaatgctgctagggacaacaaaaagaatcgtattgttcccaggcacattcagcttgcggtgaggaatgatgaggagttgagcaagcttcttggatctgtcaccattgccaatggaggggttttgcccaatattcaccagactttgcttcccaagaaagctggcaagggcaagggtgaaattggatctgcttctcaagagttttagggtttttgatggatgggtttagactatagttttgattttatcgtggctgtaatatacgtggttttggtattttctatatatcttctctgagagattaagtatttctcagtcaggtgaactgaatggtgtatatcacttttgggtgggatatcaatgcgaagtcatgttttgatgaattataaatggatgccattaaaaaagcggtgttatgataatattttttctccatggttgatatttgctttgactggtacacactgttttggttttatgggctggcaagtgatgatgagatttagttttcaatatgagcctgcatgtttgctttgttgatgtttggctgctggaatttgtaggtgtacttttgctggcttgttgctccaactgatagttctggtaatgac

SEQ ID NO: 5781 - DNA, 680 bp, Sarracenia psittacina
tttttgtgttttcgactcgaagttgtgagcgaagaagatgagttcaggtggcgggtcgacgaagggtgggcgagggaagcctaaggcgtcgaagtcggtgtcccggtctcacaaggccggtctccagtttcccgttggcaggatagctcgtttcttgaaggccgggaagtacgccgagcgcgttggcgctggagctcccgtatacctctccgctgtcctcgagtacctcgccgccgaggttttggaactagctggaaatgctgcaagagacaacaagaaaaatcggatagtcccaaggcacatacagctagcggtgaggaacgatgaggaacttagcaagctattgggatctgtgactattgctaatggaggggttttgcccaacatccaccagactctgctgcctaagaaggtcggcaaaggaaagggcgaaattggttctgcttctcaagagttttaggagctcttttcgagttccctctctctcagttggaaaatgaatgtataatatacaatgctttgtttttgattttggggttttctgtattagagttttatggtgtagtagcagctccttcggggatatgaatctaaggactcaagttttaaaagcctttaactggtagtaattttgtggtagaatgcggtattttggaggagattaattatgttccgaaggc

SEQ ID NO: 5782 - DNA, 703 bp, Glycine max
atctgcgcctgatttctcagttctcacactcattccgtgctctaaatctcaaattctagggttagggttcccaatttctccgccaatcagaagatgagttccaccggtggttctaccaagggcggaaggggcaagcccaaagcctccaaatccgtttcaagatcgcagaaagctggtctccaattccccgttggaagaatcgctcgattccttaaggctgggaaatacgctgagcgtgttggtgctggtgctcctgtgtacctctctgcagtgctcgagtatctcgctgctgaggttttggaattggctgggaatgctgctagggataacaagaagaatcgtattgttcctaggcacattcagcttgctgtgaggaacgatgaggagctgagcaagcttttgggatctgttaccattgccaatggaggtgtcttgccgaatattcatcagactctgcttcccaagaaggttggcaaggggaagggcgaaattggatcagcttctcaagagttttagggtttttgttaggcctatttggactatagtttttattttattgcggttgtaatatacatgttttggttaatttttagatatctgctctgaggaattaagtgtttctcagtcttttgaactggatggtgtaatctcacttttgaatcggatgcgaatatgaagtggtatttggattatttttaatggg

SEQ ID NO: 5783 - DNA, 929 bp, Pinus taeda
atagcatcgggttagttttggagctgctgcctgttcgtattacattactcttcatttgacgggttgaggtagtggttcgttcctgtgaatcaacagtaaagaggggagttggcatcatgagttctgcaggaggtggcggtggccgagggaaagcgaagtcttcaaagtctgtttcgaggtctcataaggctggcctgcaatttccggttggaaggattgctcgtttcctaaagtcgggcaagtatgcagagcgcgtcggtgcaggggctccggtttatatggctgcggttttagagtatctagcagcagaggtgcttgagttggccggaaatgcagcaagggataacaagaagaacaggattgtacctcgacacattcagctagctgtcagaaacgacgaggagctcagcaaattgctaggtgctgtaacaattgccaatggtggtgtattgccgaatattcacggtgttttactacccaaaaaggttggaaagggaaagggagatgagattggcagcgcctctcaagagttttagactatgctcgactgttaattgatgcccacattttttgggggctcaatgctattgccaatcactgcctgcctgagtgccagaatctggcaaaatgccaattcttaaagcgttttaaccgttaaccttccattaagattatacagttttaggtggacgaagttatgttattttccattagaatgcactgtgaactgttaatcttccattaggattatagggtttttggtggacgacttttcaatagaccaatggaatacattgttttttagctttcagaagtaactgatagatatgttcttggcagaaggtcattattgatggatattcttggcagaagattattatggattattcttggcagaagattattatggataattctttacagaagat

SEQ ID NO: 5784 - DNA, 437 bp, Aquilegia formosa
ggtttttgaagaaaacaatgagttcaggtggatcaacaaagggtgggcgaggaaaacccaaatcggcaaaatcagtatctcgatcttcaaaagctggtcttcaattccctgttggtagaatcgctagattccttaaagctggaaagtatgctgagcgtgttggtgctggtgctcctgtttatctttctgctgttcttgaatacttagccgctgaggttttagaacttgctggaaatgctgctagagataataagaagaatcgaattgttccaaggcatatacaattagctgtgaggaatgatgaagagttgagcaagcttttgggaactgtgactattgctaatggaggggttttgccaaatattcatcagactttgcttcctaagaagactggaaaagggaaagatgatatcttatctgcatctcaggaattttag

SEQ ID NO: 5785 - DNA, 780 bp, Musa acuminata
cagcgctttcgcacgcctcgccattgatctcgttcgccgtctttgtcctcgttagggttttctaatcgatccgagaactaccagagatgagctccgcagcgccagcgaagggcggccgaggcaaggccaagtcgtcgaagtccgtatcccgatcgcagaaggctggcctccagttccctgttggccgcatcgcccggttcctcaaggccggcaagtacgccgaacgcgtcggtgccggcgcccccgtctacctcgccgccgtcctcgagtaccttgccgccgaggttttggagttggctgggaatgcggcgagggataataagaagaataggatcgtcccgaggcacatacagcttgctgtgaggaatgacgaggagttgagcaagcttttgggggctgtcacgattgctagtggtggtgtcttgcccaatatccatcagaccctactgcccagtaaggcggggaaagggaagggagatattggatctgcgtcacaagagttttagttttgtgaagacaatattgtggtgtgatgggaatatgatttgtggagtgtgcttgatgatgtagcaccttttggtattttgttcaatacactcatcgtagtatgagagggtaattccaaattatttcttttatatgggatctattttcccttgtcttcgatcttatgtgccatttaggtccaaagtatcactttctgtctccattcaattgaatcgtactggttgactgaatcagtgattcttgtgattactaattgataaagcctatttgaag

SEQ ID NO: 5786 - DNA, 731 bp, Manihot esculenta
ttaaaaccaacatcggaataccaaacgtcttcatttttcgtccttgtgtcaatcctttaacaagttaagccagccatgagttccgcaggatcaaccaagggaggcagaggcaagcccaagtcatccaaatccgtgtccagatctcagaaggccggtttacagttccccgtcggccgtattgcccgttttctcaaagctggaaagtacgcggatcgggtgggtgccggcgctcctgtctatctttccgccgtccttgagtaccttgctgctgaggttcttgaacttgctggtaatgcagcaagggacaacaagaagaaccgtattgttccaaggcacattcagctggctgtgaggaatgatgaggagctcagcaaactcttgggaacagttactattgcaaatggtggtgttttgcccaacatccatcagaatttgttgccaaagaaaattggaaaagggaagggtgatattggctctgcgtctcaggagttctaaagggtatttaatatgggatattaatgttttccaagatttcatatgttggttgagagtgagatcagagaccatcatctattagtttttgcctgtgaattgtcaacatatttttttgttggggttatggttgaatacaggaaagaagccattctgttatagcccatctatatgtgatggtattgaacttttgatttattaatattatcaatggaaattttgagtttatgttcttaaac

SEQ ID NO: 5787 - DNA, 877 bp, Cocos nucifera
gaacaatgggcgattcttgaaaccaaatccggagccgaggccgactcatttcccttcgcccctcccccgctctcccaacaaccacgctatgatcagaccacatgggaaaatctagtccttccacgctggcgatccgtggctgacccatcccaccaatggaagcgaacctctctctcgccctctcctaccctcacctatataactcccagcccccggttgtttccccgctcaagagcgcgcctcccttcgctatacgggtaaaaccggcctgcgatcctctcggcctccactgacggtttgggtttttccctcctcgatcttagaagaagaagaagaagaagatgagttccacggcatctaccaagggaggcaggggcaagcccaagtcctccaagtccgtctcccggtcccagaaggccggcctccagttccccgtcggccggatcgctcggttcctcaaggccggaaagtacgccgagcgcgtcggtgccggcgctcccgtctacctctctgccgttctcgagtaccttgccgcagaggttctggagttggctgggaatgctgcaagggacaacaagaagaataggatcgttccaaggcatatacagcttgcagtgaggaatgatgaggagctgagcaagcttctggggactgttacaattgccaatggtggtgttttgcctaatatccatcagactcttctgcctaagaaggcagggaaggagaagggagatcttggctctgcatcgcaggagttctagagttctattaatctcaaaactattcaggaaaggatgggggtattttccctttgggaccttcttgtcaggggtgttcataacttgatgtatgaactgggttgaccgatgtatttttt

SEQ ID NO: 5788 - DNA, 623 bp, Setaria italica
aacaccgctccagtctccgcagcgcccccaacctcaaaagagttcagaagtttccagacctccacaaggtgaagcggatatgagttcctccggcggccgcgggaaggcgaagccggcgaccaagtcggtgtcgcggtcctccaaggccgggctccagttccccgtcggtcgcatcgcgcggtacctcaaggccggcaagtacgcggagcgcgtcggcgccggggcccccgtgtacctctccgccgtcctcgagtacctcgccgccgaggtgttggagctggccgggaacgcggcgagggacaacaagaagaaccgcatcgtgccgcgccacatccagctggcggtgcggaacgacgaggagctgagcaagctgctgggcaccgtgacgatcgcggccggtggcgtgatgcccaacatccaccagacgctgctgcccaagaaggctggcggccacaagggggacatcggctccgcttcccaggagttctgagcgcgtctttgatgtttcttgcgggtttttggatgtttgggggttttttatggaactttgctggatgtaaacaaacgctgtgcgttggctcatgaatgaatgaatgaatgaatagaagagacatttaccatga

SEQ ID NO: 5789 - DNA, 886 bp, Vitis vinifera
ccgccgtctcattcacagccaaaattttagggttagggttttggattcgtttaaggtagagatttgagattgaagatgagttccacgggatcaaccaagggaggtagaggcaagccaaaggcctcaaagtcggtatcgcggtctcagaaggctgggcttcaatttccggtggggaggattgcaaggtttctcaaggccggaaagtatgccgagcgtgttggagccggcgcccccgtctacctgtctgctgttcttgagtatctcgcggccgaggttttggagcttgctggaaatgcagcgagggacaacaaaaagaatcgcattgtacctcgccacatacagctagcagtaaggaatgacgaggagctaagcaaactattggggtcagtaaccattgctaatggaggggttttgcccaacatccaccagactctgttgccaaagaagacgggtaaaggcaagggggagattgggtctgcttcccaggaattttagagagttgtgttaatggcctctccttgtcctttgtctttttgatagatatgtagtatacacatcttctcttccttctatggataaagttttgttcttctaaactctttggaacaaaatgaagttctaagctttttgaggtgctccatgtactcttttgattcatggaagacggagcggttgaatgggttttgttatgtgggtatgcctctcagatttcttagcacaattttgaagataagtgatggtcttgaatggttttaaaatcaattaaatgattaggttgcactgttcaattttgaaattgaatgctttctgcaagatgtattctggttcacctagagtttccttaatttctcacctgtgagtaagacagtgctttgattgtgaagga

SEQ ID NO: 5790 - DNA, 733 bp, Liriodendron tulipifera
cacacttcttcctcgttgggctagggttagggtttcaaaaccagagaagaaacagaagagtgaagatgagttctacagcaacgacgaagggcggtcggggcaagcccaaagcctcaaaatccgtctccagatctcacaaggccggcctccaattccctgttggcagaatcgccagattcctcaaggctggaaagtatgcagagcgcgttggtgccggcgctccggtctacctctctgccgtccttgaataccttgctgcagaggttcttgaacttgctgggaatgcggcaagggataacaagaagaatcggattgttccaaggcatatacagcttgcggtaagaaatgatgaggagctgagcaagcttttgggagctgttacgattgcaaatggtggggttttgcctaatatccatcagacactgctgccgaagaagcaagggaaaggaaagggggagattggatctgtttctcaggagttttaggtttctttttctttatggtttttgtcttcttcttcttcttttttggttcctgagatgtaaatgcatgttttggttttatttttacgtgtttcttttagggttctaatgggaaaggcttacatggcattggccatcatgtttttttgtcttaccatttccaaatccctgctctccattgtgcttactttggatgtaatgtacttcaattggtatccagctgttgatttggtatacatagaagatgtttt

SEQ ID NO: 5791 - DNA, 894 bp, Zea mays
aacactataaaattgcacggcgtcgcccgcctttcaccaatctactcctccattctccaccgcgccccaacctcgaagagttccgaagtttccacaccctcaaagcgaagcagcatgagttccaccggaggcagcggccgtgggaaggcgaagccagcgaccaagtctgtgtcgcggtcttccaaggctgggctccagttccccgtcggccgcatcgcgcggtacctcaaggccggcaagtacgcggagcgcgtaggcgccggggctcccgtgtacctctccgccgtcctcgagtacctcgccgccgaggtgctggagctggccgggaacgctgctcgggacaacaagaagaaccggatcgtgccgcgccacattcagctggcggtgcggaacgacgaggagctgagcaagcttctgggcactgtgacgatcgcggccggcggcgtgatgcctaacatccaccaaaatttgctgcctaagaaggctggtcacaagggggacatcggctccgcctcccaggagttctgaacgcgtcttcggaaggaggagagacgcgtggtgatgtttgggctttgcggttttggggctgttgtcgatgggtttgagactgatggtttgtgggatgtaaacaaatgcagcgcgttgtttcatgaatgaacggatgaagatgaatgatggatagaagaaagtatttattcatgatttcctccctgcttgcatttgaattcgatttgttgtttgtcctatcgtttggcacattgtatcagggctcatgatggaattggttggattggttctgtcaactgtgcatcctctggtttgtcagattactattcctgtaggaaaatgcagtccgaaaactctgtatcgtctggtcttgggcttccaccttcc

SEQ ID NO: 5792 - DNA, 1350 bp, Medicago truncatula
atcactttctcactcttcttctctcaaatccattttctcccaaaatcaagttttcatccgatcagaaaatgagttccactggaacaaccaaaggtggaagaggcaaaccaaaggctgccaaatcagtttccagatcttcaaaggcaggtcttcaattccccgtcggaagaatcgccagattcctcaaggccggtaaatacgccgaacgtgttggtgccggagctcctgtctatctctccgccgtccttgagtatctcgctgctgaggttttggaattggctggaaatgccgctagggacaacaagaagaaccgtattgtaccaaggcacattcagcttgctgttagaaacgatgaagaactcagcaagcttttaggaactgtgaccattgctaatggtggtgttctgcccaatattcatcagactttgcttcctaagaaggttggaaagggcaaaggagaaattggatctgcttctcaagaattttagggtttcttagttccgttctgagcagttatatcttatctttcttcatatgtagcataaatgataaatttctatctcattactccgataatgaaaaggataatattgaacaatgaattcgtttttttctatctcatctctctctctctctctctacaacttaactaaacaagttaccatgtattcggcaatgacaacataagagacgtcataggaaaaatatggtctacttagcctatatcttacttgaatcaaccaatccaatatcttttgcatgttgtttgtggccgaagagaactgttacatatcaatatcatacctttggcttgtgtaggcttggatccacattaaggatttgtttggattgatttatttttgagcttatgaaaaatagttttatgttaattcataagttagttttatcataaactacctcgacaaagttatgaatattgcataagctcaagttaatccatacgggatctaagtagtctcccaagtttgccaacatcaaacattatcattgtcttaaaagttgttgttctaaaaataaaaagtcaacatttttcaccagacatggtaaagatgaatttgaaacagccaaaaattaataacaagactcaacaaacgaagtagaacagagaagccaaaaattgatgaatcgttttgtaaatttatttggtgggtggaggagaaatctgctccaattgagaagaaaccatggtagtgagggattgtcgctctgagataacttttcagtgggatcttgacggaggagaggttattatcggagagtatggtcagatgtcaacttcaattccgagagttttggctaaataatggtgagatgaatgtcattgagttg

SEQ ID NO: 5793 - DNA, 772 bp, Medicago truncatula
tctcgctttgtcacacttctcaaatccattttgtcccaaaatcaagttttaggtttttcaatttctccaaatccgattagaaaatgagttccacaggcacaactaagggcggaaggggtaagccaaaggctgccaaatcagtttcaagatcttcaaaggcaggtcttcaatttcccgtcggaagaatcgccagattcctcaaggccggtaaatacgccgaacgtgttggtgccggagctcctgtctacctttccgccgtcctcgagtatcttgctgctgaggttttggaattggctgggaacgctgccagagacaacaagaagaaccgtattgtaccaaggcacattcagcttgcagtgaggaacgacgaggaactcagcaagcttttgggaactgtgaccattgctaatggtggtgttttgcccaatattcatcagactttgctccctaagaaggttggaaagggaaaaggagaaattggatctgcgtctcaagaattctagggtttctgggttctgttctagcagaaatgaaatgtagcactctgatgaagtgaatggttttgtactgcacttagttgaatatgaatggaaaacattatgaatatatacatgtagcttctattaagcttttattgttcattcgctttaatctgtaatctgtggttgttgatacttgaagtgagtctgagctttggaataaacaaaccataatttatctttagagttaatttttatgtaaaaagtgtatatgtcccttaatttttatcaag

SEQ ID NO: 5794 - DNA, 564 bp, Pennisetum glaucum
gctcccgtctccacagcgcccccaaacctcagaagagttccgaagtttccagaccccacaaggccaagcggcgatgagttcctccggcggccgcgggaaggcgaagccggcgaccaagtcggtgtcgcggtcctccaaggccgggctccagttccccgtcggccgtatcgcgcggtacctcaaggccggcaagtatgcggagcgcgttggcgccggtgcccccgtgtacctctccgccgtcctcgagtacctcgccgccgaggtgctggagctggccgggaacgcggcgagggacaacaagaagaaccgcatcgtgccgcgccacatccagctggcggtgcggaacgacgaggagctgagcaagctgctgggcaccgtgacgatcgctgccggcggcgtgatgcccaacatccaccagacgctgctgcccaagaaggctggcggccacaagggggacatcggctccgcctcccaggagttctgagcgcgtctatgatgtttcttgcgggtttttggatgttcgcggggatgagttggtgggggggctttgatggaactttgtcg

SEQ ID NO: 5795 - DNA, 1182 bp, Pinus taeda
acgtgcgaccttggctgtcactcagagcatcgggttagttttggagctgctgcctgttcgtattacattactcttcatttgacgggttgaggtagtggttcgttcctgtgaatcaacattaaagaggggagttggcatcatgagttctgcaggaggtggcggtggccgagggaaagcgaagtcttcaaagtctgtttcgaggtctcataaggctggcctgcaatttccggttggaaggattgctcgtttcctaaagtcgggcaagtatgcagagcgcgtcggtgcaggggctccggtttatatggctgcggttttagaatatctagcagcagaggtgcttgagttggccggaaatgcagcaagggataacaagaagaacaggattgtacctcgacacattcagctagctgtcagaaacgacgaggagctcagcaagttgctaggtgctgtaacaattgccaatggtggtgtattgccaaatattcacggtgttttactacccaaaaaggttggaaagggaaagggagatgagattggcagtgcctctcaagagttttagactatgctcgactgttaattgatgcccacattttttgggggctcaatgctattgccaatcactgcctgcctgagtgccagaatctggcaaaatgccaattcttaaagcgttttaaccgttaaccttccattaagattatacagttttaggtggacgaagttatgttattttccattagaatgcactgtgaactgttaatcttccattaggattatagggtttttggtggacgacttttcaatagaccaatggaatacattgttttttagctttcagaagtaactgatagatatgttcttggcagaaggtcattattgatggatattcttggcagaagattattatggattattcttggcagaagattattatggataattctttacagaagattattattgttattattctcacgagggagatgttcaattttaggtcgttaatgaaatgtgtatgactaaccgtcgtttttggggtgtgagtgcattaaacttgtatgtacactcttgtagcgttctgcttttcaattgagtaccattgagatgtgattctaagttttgagaaataggccctgttgaagggcaatcttgaatttaaccatatctgttaaggtttgcttacgt

SEQ ID NO: 5796 - DNA, 692 bp, Platanus occidentalis
gagataacaatcgaacgcacacaacggagagaaagggagcttcctgatcggatttcgtagcagttaagtttcgttttcatctaaaacacagacacgatgagttctgcagcgtcaacgaagggcggaagggggaagcccaaggcttccaaatcggtttccagatctcacaaggccggtctgcaattccccgtcggaaggatcgctagattcctgaaagctggaaagtatgccgagcgtgtcggtgctggtgcaccggtctatctctctgccgttcttgaatacctagcagccgaggttctggagcttgctggtaacgctgcaagagataacaagaagaatcgtattgttccgaggcatattcagcttgcagttaggaatgatgaggagttgagcaagcttctgggaactgttaccatcgctaatggaggtgttttgccgaacattcatcagacattgttgccaaagaagactggaaaggggaaaggcgagattggatctgcatcacaagagttttaggttcagtttaaaattttttgtctgtgttttgatgcggttagggacaggatgtctcctgttttacagttaaaagttgtaatatgttttatcactgaaaaaacctacatctacattttcgcccctcagataataattttgtgatgatctggtgtccataatacctatctaatggaaat

SEQ ID NO: 5797 - DNA, 691 bp, Platanus occidentalis
agggttttgaaattcccatcaaacaagagacgagatgagttctacagcttcaacgaagggtggccgagggaagcccaaggcttccaaatcggtgtctaggtctcataaggccggtctgcaattccccgtaggaaggatcgctaggttcctcaaagccgggaagtacgccgagcgtgttggtgccggtgctccggtgtatctctccgccgtgctcgagtatctcgccgccgaggttcttgagttggctggaaatgctgcgagggataacaagaagaatcgtattgtcccaaggcacattcaacttgcggtgaggaacgatgaggagctcagcaagcttttgggatctgttacaatagctaatggaggagttttacccaatattcatcagactcttttgccgaagaaggtgggaaaagggaagggtgagattggatcagcatctcaggagttttagttactctcctcttccacctttccttcgaatcagagatgtaatatatttttttgttcctttttctcttctgattttggacatcagcttttgacaaaaaaatgcatctttttgttgttagaaacataagtctctttaagagtgagaatggaattggggaaagtcgcctttctctggctctgaacgttgttgctgtaacagatgattccatttctatgaaaagcttgacgattaaaaagg

SEQ ID NO: 5798 - DNA, 668 bp, Sciadopitys verticillata
ctgctcgcctgcgagtggagatacgcatccgcagaggcgtggcgagttcctgctaaataggatatatatacattgcgtataatctccccgttttatttccaaggttttggttgcgatttgagcagaggcgaagatgagttcaacaggaggtggtcgcgggaagagcaagtcttcgaagtcggtgtcgaggtctcagaaggcggggttgcagttccccgtcggaagaattgctcgatttctcaaagctgggaaatacgccgaacgtgtgggtgccggggctcctgtctatatggctgctgttctcgagtatcttgcagcagaggttcttgagttggctgggaatgccgcacgggacaacaagaagaacaggattgttcctcggcatattcaattggctgtcagaaatgatgaagagttgagcaagttattaggttcagtgactattgcgaatggaggagtattgcctaatattcatggtcttctactacctaagaagtctggaaaggataagggggcagatattggcagcgcctctcaggaattttaggtgacaatagactaaggcagcagaaattaggagcgactttcagaagttttaaatgacaaaggctgagtttccgacgatttgtgcatttaaggggatttataatgcagtcatgagttgtaac

SEQ ID NO: 5799 - DNA, 932 bp, Sorghum bicolor
tctgctcccccgccagctcagctaatcgtccgccgccttggcctctacataacctgcctcgccgccgtcgccccctccatctcaatcccacactgccactcccgcagagcgtaacagacttccggtgatcgatacaacgtgtagagcaggcgacgagcaatctcggaaggagaagatgagttccggcagcggcaggggcaagcccaaggggaccaaggcggtgtcacggtcgtccaaagccggactgcagttccccgtcggccgcatcgcccgctacctgaagacgggcaagtacaccgagcgcgtaggcggtggcgcgcccgtctacctctccgcggtcctcgagtacctcgcggcagaggtcctagagctggcgggcaacgcggcgcgcgacaacaagaagaaccggatcgtgccgtgccacatccagctcgctgtgcgcaatgacgaggagctgagcaagcttctgggtgcggtcactatagccgccggcggggtgttgcccaacatccaccagacgctgctgcccaagaaggctggcggcaagggtaaggccgagatcggctccgcctcgcaggagttctagactggcagttgcaggcgacttgcatccttctctctagttcacactcagcacgaattggatggagaccgctgctgaagcttcttagaatagtagtaccaactagcaatactagcgtcttgcctaggttagggtaggttctgtgatgggtgttttatcaggttaagtttgtggtgaatgaaagttggctgtatctatcaaccattcttgcttcaatgaacggaatggttacttgctgtgatcttgttcctttgggtttgaagttgatactgattgtgatctgtggattggttgtacagttgtgctgatggtaacatcctcattgggagatcaacaaaattcttaccat

SEQ ID NO: 5800 - DNA, 855 bp, Panicum virgatum
aaccccgcctgagaaaaagggaagcattccatttcacacccgcccaagctgtctcgccacgtcaccgatccgcgcctccgaactcccagccaaccacagcccggctcccacccaaaccctaacgctataaaatcccaggcgccgcccgcggctcccaccaacacctctcctgcagtctccacagcgcccccagcctcgaagagttcagaagtttccagaccccaccaacgcgtagcggcgatgagttcctccggcggccgcgggaaggcgaagccggcgaccaagtcggtgtcgcggtcctccaaggccgggctgcagttccccgtcggccgcatcgcgcggtacctcaaggccggcaagtacgccgagcgcgtcggcgccggcgcccccgtgtacctctccgccgtcctcgagtacctcgccgctgaggtgctggagctagccgggaacgcggcgagggacaacaagaagaaccgcatcgtgccgcgtcacatccagctggcggtgcggaacgacgaggagctgagcaagctgctgggcaccgtgacgatcgctgccggcggcgtgatgcccaacatccaccagacgctgctgcccaagaaggccggcggccacaagggggacatcggctccgcctcccaggagttctgagcgcgtcggcgaaacggggagatggagcctcctgtctttgccgtgtcagcgtgatggcggtgatgtttctcgccggtttttgggatgtttgggaatgagttgggattggtggaactttgctggatgtaagcaaacgcagtgcgttggttcgcgaatcaatgaatagaagagaacatataccatgatttcatcttgtctgaaatg

SEQ ID NO: 5801 - DNA, 637 bp, Panicum virgatum
tctccagtctccacagcgcccccagcctcgaagatttcagaagtttccagaccccaccaacgcgaagcggcgatgagttcctccggcggccgcgggaaggcgaagccggcgaccaagtcggtgtcgcggtcctccaaggccgggctccagttccccgtcggccgcatcgcgcggtacctcaaggccggcaagtacgccgagcgcgtcggcgccggcgcccccgtgtacctctccgccgtcctcgagtacctcgccgctgaggtgctggagctggccgggaacgcggcgagggacaacaagaagaaccgcatcgtgccgcgtcacatccagctggcggtgcggaacgacgaggagctgagcaagctgctgggaaccgtgacgatcgccgccggcggcgtgatgcccaacatccaccagacgctgctgcccaagaaggccggcggccacaagggggacatcggctccgcctcccaggagttctgagcgcgtcggcggatggcggtgatgtttcttccggattttgggatgtttgggaatgagttgggattgatggaactttgctggatgtaaacaaacgcagtgcgttggttcgcgaatcaatgaatagaagagaacatttaccatgatttattctttc

SEQ ID NO: 5802 - DNA, 769 bp, Pinus taeda
attcgtattttcaagagtcaggagggtttcaggcgcaatcgagggtttgaattctacctgttgcaatacacttgtgagatctcagcattttgcgaggtgttgttcccgagtctaaatctttgcaaagatgagttcttctggtgcaaaaggaggccgtgggaaggccaagtctacaaagtccgtgtccaggtcgcagaaggccggcttgcagttcccggtaggaagaatcgccaggttccttaaggccggaaagtatgcagagcgtgtgggggctggagctccggtgtaccttgccgctgttcttgaatatctggctgctgaggttttggaacttgctggtaatgctgcccgggataacaagaagaatcgtatagttccaagacatattcagcttgccgttcgcaatgatgaggagctgagcaagttgctgggtgctgtaaccattgctaatggaggagtcctgcccaacattcaccaggttcttttgcctaagaaatctggaaaagacaagggggagattggatctgcttctcaggagttctgatcccgtggcgtgttgttgagcgatttagaatagtatttttgatctctttgtaaatgattggtcggttggtccttccgagtaagcatttgatgctcccctttccctaaagcggatggatttatttgttgaatgtgaacaacattgacagtttctgttgaacttatatacaagcttcgtgccatctcggcaccctggttaaaattttgttatacttttctcgatgtc

SEQ ID NO: 5803 - DNA, 789 bp, Abies balsamea
gtccgaagtcaatctgctgtgaaacgcttgaggggtttgagcatttcgtgaggtttagcttttgtgtcttaatctctgcaaacatgagctcctctggtgcaaagggtggtcgcgggaaggccaaatctacaaagtccgtgtccaggtcacataaggctggcttgcagttcccagttgggagaatcgcaaggtttcttaaggccggaaagtatgcagaacgtgttggggccggtgctcctgtgtaccttgctgctgttctcgaatatctcgcggcagaggttttggaacttgctggtaatgctgctcgggacaacaagaagaatcgtatagtgccaaggcatattcagcttgctgttcggaatgatgaggagctgagcaagttgctgggtgctgtgaccattgctaatggaggagtactgcctaacattcaccaggttctcttgcctaagaaatctggaaaagataaaggagagattggatctgcttcccaggagttctgatgtgggcaatctttgttaatgagagatctagaacattatttttgatctatttgtaaatgaattgccggatagttcttcccagtaagagtttgatgcttactttcctaaagcggttggatttattcgtcaactgtgaacttaattgatgtttcctattggacttatacaagctttgtgctatcttggcaccttggtcaagtttcacctttgcacttctggctctcgttgttaattatgttggttctggtctgttaataaatggtacattattgattgagtggattaaaaa

SEQ ID NO: 5804 - DNA, 624 bp, Malus domestica
gcaatcgcaccgtcgcttttcctctcgaattttcgcggctagggttgcggattccgatccgaatttcaaaattcgatatgagttctccgacctccaaaggcggcagaggcaagcccaaggcctccaaatccgtctcccgatcttccaaggccggcctccagtttcccgtcggtcgtatcgcgcggttcctcaaggccggcaagtacgccgagcgtgtcggcgctggcgcccccgtctacctctccgccgtcctcgagtatctcgctgctgaggtgcttgagcttgctggaaatgcagccagagacaacaagaagaaccgaattgtcccgaggcacattcagctggctgtgcggaacgacgaggagctgagcaagcttttgggggctgtcacgatcgcaaacggcggtgttatgcccaacatccatcagaatctgctgccgaagaaggttggcaaagggaaaggcgaaattggatccgcctcacaagaattttagggttgtattgttgtaatctggaattttatgggttgtaaaattttgggaaatttcaggcttaatacaaaattattattagtcttgtttggtacctggaaaagtttgcaactttttgtgttcaagagtggga

SEQ ID NO: 5805 - DNA, 724 bp, Cedrus atlantica
aatctgcttgtggggtttgagcatttttagaggttcagtttctgtgattgaatatctgcaagcatgagttcttctggagcaaagggtggtcgtgggaaggccaagtctacgaagtctgtgtccaggtcacagaaggcaggtttgcagttcccggttgggagaattgccaggtttctaaaggccggaaagtatgcagagcgtgttggggccggtgctcctgtctatctcgccgccgttctcgaatatcttgcggcagaggtcttggaactcgctggtaatgctgctcgtgataataagaagaatcgtatagtgccaaggcacattcagcttgctgttcggaacgatgaggaactgagcaagttgttgggtgctgtaaccattgctaatggaggagtcctgccaaacattcaccaggttcttttgcctaagaaatctggaaaagacaagggagagattggatccgcttcacaggaattttgatctgaaccatctttattgttgagagaattagaacagtatttttgatctatttgtaaatgattaattgggtagtcctgctcggtaagcctttggtgctctcttttcctaaagcggatggatttatttgttggatgtgaactacattgatgtttcgtattgaccttatatatcagctttgtgctatcttggcaccttggtcgagtttcatctttgctcttctcagtggtaatttatgcttttctca

SEQ ID NO: 5806 - DNA, 1154 bp, Pinus pinaster
acaactaaaatcaatcggtcacaactaaaatcaatcggtggtcaagccacgtcagcgatccgcggcaagccgtccgagccaatcagacaagagcggtatctcaaaaggccattaagtccctttccttgccctctaaataggcgggccgcccctgcaattttcattcgtattttcaagagtcaggagggtttcaggcgcaatcgagggtttgaattctacctgttgcaacacacttgtgagagttgcaatacacttgtgagatctcagcattttgcgaggtgttgttcccgagtctaaatctttgcaaagatgagttcttctggtgcaaaaggaggccgtgggaaggccaagtctacaaagtccgtgtccaggtcgcagaaggccggcttgcagttcccggtaggaagaatcgccaggttccttaaggccggaaagtatgcagagcgtgtgggtgctggagctccggtgtaccttgccgctgttcttgaatatctggctgctgaggttttggaacttgctggtaatgctgcccgggataacaagaagaatcgtatagttccaagacatattcagcttgccgttcgcaatgatgaggagctgagcaagttgctgggtgctgtaaccattgccaatggaggagtcctgcctaacattcaccaggttcttttgcctaagaaatctggaaaagacaagggggagattggatctgcttctcaggagttctgatcacctggcgtgttgttgagcgatttagaatagtatttttgatctatttgtaaatgattggtcggtttgtccttccgagtaagcatttgatgctccctttttcctaaagcggatggatttatttgttgaatgtgaacaacattgacagtttctgttgaacttatatacaagcttcgtgccatctcggcaccctggtcaaaattttgttacgcttttctcgatgtcaattatgatatgtagtttcagtttttatttggatggaaggctgtgcatttgccctattgatgggatcttacattgtgaatgaaagtcatgtgaaagttaaacagtgcatgtgataggctagggtaataactactttgcattgtagtgtgtaaacaatggttgtatttaagaaactaacgccttacccagatccattaacagtg

SEQ ID NO: 5807 - DNA, 997 bp, Pinus taeda
attcgtattttcaagagtcaggagggtttcaggcgcaatcgagggtttgaattctatctgttgtaatacacttgtaagatctcagcattttgcgaggtttcgttcccgagtctaaatctttgcaaacatgagttcttctggtgcgaaaggaggccgtgggaaggccaagtctacaaagtccgtgtccaggtcgcagaaggccggcttgcagttcccggtagggagaatcgccaggttccttaaggccggaaagtatgcagagcgtgtgggggctggagctccggtgtaccttgccgctgttcttgaatatctggctgctgaggttttggaacttgctggtaatgctgcccgggataacaagaagaatcgtatagttccaagacatattcagcttgccgttcgcaatgatgaggagctgagcaagttgctgggtgctgtaaccattgctaatggaggagtcctgcccaacattcaccaggttcttttgcctaagaaatctggaaaagacaagggggagattggatctgcttctcaggagttctgatcccgtggcgtgttgttgagtgatttagaatagtatttttgatctctttgtaaatgattggtcggttggtccttccgagtaagcatttgatgctcccctttccctaaagcggatggatttatttgttgaatgcgaacaacattggcagtttctgttgaacttatatacaagcttcgtgccatcttggcaccgctggttaaaattttgttatacttttctcgatgtcaattatgatatgtagcttcggtttttatttcgatggaaggctgtgcatttgccgtattgatgggaacttacattgtgaatgaaagtcatgtgaaagttaacagtgcatgtgataggctagggcaatgactactttgcattgtattgtgtaaacaatggttgtatttaagaagtaaagcaatatctaaacgccttactcagaccattaacagtgttaataacttttaa

SEQ ID NO: 5808 - DNA, 787 bp, Pinus taeda
gtcaggagggtttcaggcgcaatcgagggtttgaattctacctgttgcaacacacttgtgagagttgcaatacacttgtgagatctcagcattttgcgaggtgttgttcccgagtctaaatctttgcaaagatgagttcttctggtgcaaaaggaggccgtgggaaggccaagtctacaaagtccgtgtccaggtcgcagaaggccggcttgcagttcccggtaggaagaatcgccaggttccttaaggccggaaagtatgcagagcgtgtgggtgctggagctccggtgtaccttgccgctgttcttgaatatctggctgctgaggttttggaacttgctggtaatgctgcccgggataacaagaagaatcgtatagttccaagacatattcagcttgccgttcgcaatgatgaggagctgagcaagttgctgggtgctgtaaccattgccaatggaggagtcctgcctaacattcaccaggttcttttgcctaagaaatctggaaaagacaagggggagattggatctgcttctcaggagttctgatcacctggcgtgttgttgagcgatttagaatagtatttttgatctatttgtaaatgattggtcggtttgtccttccgagtaagcatttgatgctccccttttcctaaagcggatggatttatttgttgaatgtgaacaacattgacagtttctgttgaacttatatacaagcttcgtgccatctcggcacccttgtcaaaattttgttacactttctcgatgtcaattatgatatgtag

SEQ ID NO: 5809 - DNA, 659 bp, Podocarpus macrophillus
gatgagttcttctggagcaaaaggcggtcgtggaaaggccaaggctacgaaatctgtatcgcggtctcagaaggcaggcctgcaatttcctgtaggaagaatcgcgcgttttcttaaggcaggaaaatatgcagaaagggttggagccggcgcccctgtatacctcgctgctgttttggagtatcttgcagctgaggtgttggagcttgcaggcaatgctgcacgggataacaagaagaaccgaattgttcccaggcacattcagcttgcagtgaggaatgatgaggagctaagcaagctacttggtactgttactattgctaatggaggggttttgcctaatattcatcaagtcctcttaccaaagaaggctggcaaagacaagggggatattggttctgcttcccaagagttttgatcttatatatacctagcaatatctgttcaaagagatttgtgaatgaagattttatatggtaaaatcatatttatgtatggtttgtgaattgagggagcttaaaaagtcaatgtagacttgttggcttgtctactggacatgcagagattttccctgtcttggatttgaaaatctatcgtatacaagagctggaggtttgaattttacaatcttgctgatgcagacttggccgtgttgttat

SEQ ID NO: 5810 - DNA, 807 bp, Prunus mume
cagacacctgtaacccaaagcatcacactcttcatctcatttcgattttctctcctagggtttcagattcaatccctattcaaatcccagtatgagttcgccgacttccaagggaggcagaggcaagcctaaagcttccaaatccgtgtccaggtctcacaaggctggcctccaatttccagttggccgtatcgctcgattccttaagtctggcaagtacgccgagcgagttggcgccggcgctccggtctatctctctgccgttctcgagtatctcgctgctgaggtacttgagcttgctggcaatgcggccagggacaacaagaagaatcgaattgttccaaggcatattcagctggctgtgcgtaatgacgaggagttgagcaagcttttggggactgttactattgctaatggcggtgttttgccgaacattcatcagactctgttgccgaagaagattggtaaagggaaaggagacattggatctgcctctcaagaattttagagctgcttgttaaaatttgggggcgatttgttgtaaacacaaactttgggaattttggtttagtaattatctttgcggattgaaattgactggcgttttttatgagatttgtggtacttatcggttaagaaatcaaattgaaaatataaagatatatggggtgattatcttattttagtccagaaaatgaaaatgttttaggtttctaaatcaaaattaagatcttcaaaaaaattatgatcttcaaaattatagatgtttgaagatctaattcaatgtgaccaaaatgattttatgga

SEQ ID NO: 5811 - DNA, 833 bp, Picea glauca
ggtttgaggcgcaccttgagggtttggaattcaatcttctgcattccatttttggggtctgagcatttcgtgaggtttagtttctgtgtttgaatacttgcaaacatgagttcttctggtgcaaagggcggtcgtgggaaggccaagtctacaaagtccgtgtccaggtcgcagaaggccggcttgcagtttccggtggggaggattgctaggtttcttaaggccggaaagtatgcagagcgtgtcggtgctggtgctccggtgtacctcgctgctgttcttgaatatcttgctgccgaggttttggaactcgctggtaatgctgctcgggacaacaagaagaatcgtatagttcctaggcatattcagcttgctgttcggaatgacgaggaactgagcaagttgcttggtgctgtgaccattgctaatggaggagttctccctaacattcaccaggttcttttgcccaagaaatctggaaaagataagggagagattggatctgcttctcaagagttctgatctaggcttatgcttgttgttgagcaaattaggatagtatttttgatctatttgtaaatgattgatcgggtaatccttcccactaagcatttgatgctttcttttcctagagcggatggagttatttgttgaatgtgaactaaattgatgtttcctattgaacttatatacaagctttgtgctatcttggcaccttggtcaaaaaaaaaaaaaaataactcgtacgtacgtagaactaccgtacgtcgtccttctaggatacgtacgaaccggaacggaccaaaccacgggagggtaagtaggcagccaga

SEQ ID NO: 5812 - DNA, 742 bp, Picea glauca
tatttttcagagtccggagggtttgaggcgcaccttgaggtttgaattcactcttctgcattccatttttggggtctgagcatttcgtgaggtttagtttctgtgtttgaatacttgcaaacatgagttcttctggtgcaaagggcggtcgtgggaaggccaagtctacaaagtccgtgtccaggtcgcagaaggccggcttgcagtttccggtggggaggattgctaggtttcttaaggccggaaagtatgcagagcgtgtcggtgctggtgctccggtgtacctcgctgctgttcttgaatatcttgctgccgaggttttggaactcgctggtaatgctgctcgggacaacaagaagaatcgtatagttcctaggcatattcagcttgctgttcggaatgacgaggaactgagcaagttgcttggtgctgtgaccattgctaatggaggagttctccctaacattcaccaggttcttttgcccaagaaatctggaaaagataagggagagattggatctgcttctcaagagttctgatctaggcttatgcttgttgttgagcaaattaggatagtatttttgatctatttgtaaatgattgatcgggtaatccttcccactaagcatttgatgctttcttttcctagagcggatggagttatttgttgaatgtgaactaaattgatgtttcctattgaacttatatacaagctttgtgctatcttggcaccttggtcaaa

SEQ ID NO: 5813 - DNA, 686 bp, Picea glauca
tcttctgcattccacttttggggtctgagcatttcgtgaggtttagtttctgtgtttgaatacttgcaaacatgagttcttctggtgcaaagggcggtcgtgggaaggccaagtctacaaagtccgtgtccaggtcgcagaaggccggcttgcagttcccggtggggaggattgctaggtttcttaaggccggaaagtatgcagagcgtgtcggtgctggtgctccggtgtacctcgctgctgttcttgaatatcttgctgccgaggttttggaactcgctggtaatgctgctcgggacaacaagaagaatcgtatagtccctagacatattcagcttgctgttcggaatgacgaggaactgagcaagttgcttggtgctgtgaccattgccaatggaggagttctccctaatattcaccaggttcttttgcccaagaaatctggaaaagacaagggagagattggatctgcttctcaagagttctgatctaggcttatgcttgttgttgagcgaattaggatagtatttttgatctatttgtaaatgattgatcgggtaatccttcccagtaagcatttgatgctttcttttcctagagcggatggagttatttgttgaatgtgaactacattgatgtttcctattgaacttatatacaagctttgtgccatcttggcaccttgg

SEQ ID NO: 5814 - DNA, 740 bp, Picea glauca
ttttcagagtccggagggtttgaggcgcactttgagggtttgaattcaatcttctgcattccatttttggggtctgagcatttcgtgaggtttagtttctgtgtttgaatacttgcaaatatgagttcttctggtgcaaagggcggtcgtgggaaggccaagtctacaaagtccgtgtccaggtcgcagaaggccggcttgcagtttccggtggggaggattgctaggtttcttaaggccggaaagtatgcagagcgtgtcggtgctggtgctccggtgtacctcgctgctgttcttgaatatcttgctgccgaggttttggaactcgctggtaatgctgctcgggacaacaagaagaatcgtatagtccctaggcatattcagcttgctgttcggaatgacgaggaactgagcaagttgcttggtgctgtgactattgctaatggaggagttctccctaacattcaccaggttcttttgcccaagaaatctggaaaagataagggagagattggatctgcttctcaagagttctgatctaggcttatgcttgttgttgagcaaattaggatagtatttttgatctatttgtaaatgattgatcgggtaatccttcccactaagcatttgatgctttcttttcctagagcggatggagttatttgttgaatgtgaactaaattgatgtttcctattgaacttatatacaagctttgtgctatcttggcaccttggtcaaa

SEQ ID NO: 5815 - DNA, 697 bp, Fagus grandifolia
ctggaccttggctgtcactcagttgaaaatagaaagaggttagggttgttgttggttcaattggaatttcatttctagagagagagagagagacttccagagagagagagatgagttctacgggtggagctggaggagggtctacgaagggaggaagaggaaagccgaaggcatcgaagtcggtgtcgaggtcacagaaagctgggcttcagtttccggtggggaggatcgctaggtttctaaaggcgggcaagtatgcagagcgtgttggtgccggtgctccggtttatctttccgccgtgcttgaatacctcgctgctgaggtattggagcttgctggtaatgcagcaagggacaacaagaagaatcgaattgtgccgaggcacatccaacttgcggtgaggaatgacgaggagctgagcaagcttcttgggtctgtgactattgccaatggaggagtcttgccaaatatccaccagacccttttgcctaagaaggttggcaaagggaagggtgacattggatctgcttctcaggagttctagtgattttatagtgtctctttttgttactacagtttgtaatatatttatgtttttctgttttgttcttgtttcaactgaattttcaggttatgtgttattaatgaaatgaatcttttggcttttgcataatgaatatatttctaatgagcctt

SEQ ID NO: 5816 - DNA, 691 bp, Quercus alba
caattcccgggaaaagaatacaaagaaagaaagcaaagcaacacacacactgtgaatcaagagagagagagagagagagctagggttttcatttctagagagagaaagatacagagagagagatatgagttcaacgggcggagctggaggaggttcgaccaagggaggaagaggaaagccgaaggcctcgaagtcggtttcgaggtcgcagaaggctgggcttcagttcccagttggtaggatcgctaggtttctcaaggccggaaagtacgccgagcgtgtcggtgccggtgccccggtttatctctccgccgtgctcgaatatctagctgctgaggtactggagcttgctggaaatgcagctagggacaacaagaagaatagaattgtgcctaggcatatccagcttgcagtgaggaacgacgaggagctgagcaagcttctgggctctgtaactattgccaatggaggagtgttgccgaatatccaccagacccttctgcctaagaaggttggcaaaggaaaaggcgacattggatcagcttcacaggagttctagaatcctagtgccttcatatagataggggttgttttagtagtttgtaacatatatgtgtttttctgtttttgtacttgtgccaactgaattttcatgctatgtttcttgttaatgaaatgaatcttattgctt

SEQ ID NO: 5817 - DNA, 664 bp, Quercus alba
aaagaaagaaagcaaaagcaacacacactgtgaatcgagagagagagagagagagagagagagctagggttttcatttctagagagagaaagatacggagagagagatatgagttcaacgggcggagctggaggaggttcgaccaagggaggaagaggaaagccgaaggcctcgaagtcggtttcgaggtcgcagaaggctgggcttcagttcccagttggtaggatcgctaggtttctcaaggccggaaagtacgccgagcgtgtcggtgccggtgccccggtttatctctccgccgtgctcgaatatctagctgctgaggtactggagcttgctgggaatgcagcaagggacaacaagaagaatagaattgtgccaaggcacatccagcttgcagtgaggaacgacgaggagctgagcaagcttctgggctctgtaactattgccaatggaggagtgttgccgaatatccaccagacccttctgcctaagaaggttggcaaaggaaaaggcgacattggatcagcttcacaggagttctagaatcctagtaccttcatatagataggggttgttttagtagtttgtaacatatatgtgtttttctgtttttgtacttgtgccaactgaattttcatgctatgtttcttgttaatgaaatgaa

SEQ ID NO: 5818 - DNA, 575 bp, Juglans hindsii x Juglans regia
ggggactgcgattcttgccatccaccaacaaagagaagaaaatcgcaaaggagctagggttagggttttcggtggtctatctcttttacctcttcgtccggttttcgattaatcatcgttgagatgagttcgacgggagctggtggtggtgcgtctaccaagggcggtaggggcaagccgaaggcctcgaagtctgtgtccaggtcgcataaggctggtcttcagttcccggtggggaggatcgctagatttctcaaggctggcaagtacgccgagcgtgttggtgccggagctcccgtctacctctcggctgtgctcgagtacctcgcggctgaggtgttggagcttgctgggaacgcagcgagagacaacaagaagaaccgaattgttccgaggcacatccagcttgctgtgaggaatgacgaggagctgagcaagctattggggtctgtgaccattgccaatggaggtgttttacccaacatccaccagactcttctgccgaagaaggttggcaaaggcaaaggcgatattggatcggcttctcaggagttctaagcactttcaagtctcct

SEQ ID NO: 5819 - DNA, 632 bp, Fagus grandifolia
gttgttggttcaattggaattttatttctagagagagagagagagagagagacttctagagagagagagatgagttctacgggtggagctggaggagggtctacgaagggaggaagaggaaagccgaaggcatcgaagtcggtgtcgaggtcacagaaagctgggcttcagtttccgggtggggaggatcgcttaggtttctaaaggcgggcaagtatgcagagcgtgttggtgccggtgctccggtttatctttccgccgtgcttgaatacctcgctgctgaggtattggagcttgctggtaatgcagcaagggacaacaagaagaatcgaattgtgcctaggcacatccaacttgcggtgaggaatgacgaggagctgagcaagcttcttgggtctgtgactattgccaatggaggagtcttgccaaatatccaccagacccttttgcctaagaaggttggcaaagggaagggtgacattggctctgcttctcaggagttctagtgattttatagtgtctctttttgttactacagtttgtaatatatttatgtttttctgttttgttcttgtttcaactgaattttccggttatgtgttattaatgaaatgaatcttttggctttgcat

SEQ ID NO: 5820 - DNA, 787 bp, Rosmarinus officinalis
ctaattcacactgccagtgccagcgtcgcaatctgcaccctacgcatccagccaatcagaatccaccattcgtccctatataattccccgtccccctcatcagaacgcattcatcacatcccaaaacgctctagaatttcactcgattcagttcactctagggtttccgagccatcaactgccgccgccggaaaatgagttccaacgccgcaggcaccactaagggaggaagaggcaagcccaaggcctccaaatcagtttcccgctcgtcgaaagctggtcttcagtttcccgtcggcagaatcgcgcgttttctcaaggccggtaaatacgcggagcgcgtcggcgccggcgccccggtctacctctcagccgttctcgagtacctcgccgctgaggttttggagcttgcggggaatgctgctcgagacaacaagaagaataggattgttcctcgtcacatacagctggcagtgaggaacgacgaagagttgagcaagctgttgggccatgtgacaatagcaaatggtggtgttctgccaaatattcaccagactttgttgccgaagaaggctggcggaagggacaaggagattggttctgcgtcgcaggaattttagttttttgttgtgaattaaatagttcttgatggttctggttgaaggtttggatcgttgaaatcttggtccatatacatgcgttttggtatggttgggaatcttgggatatatatatgcgttttatgaacgagatatccaatttattttaacatttatattgctctttt

SEQ ID NO: 5821 - DNA, 649 bp, Antirrhinum majus
gcggccgctcccaaattcccaaatcccttcaccaaatttagggtttcaacattttgaaaaatgagctccaaggctgaaggaaccaccaaaggcggcagaggcaagcctaaatcctccaaatcagtttcacgatcatcaaaggccggtcttcaatttccggtcggtagaatcgctcgattcctcaaggccggtaaatacgccgagcgtgtcggtgcaggtgctccggtttatctatctgctgtgctcgagtatctcgctgctgaggttttggagcttgctggaaatgctgcgagggataataagaagaacaggattgtgccgaggcatatccagttggctgtgaggaatgatgaggaattgagtaagcttttggggagtgtgactattgcgaatggaggtgttttgccgaacattcatcagactctgttgccgaagaaggctggtggaagggacaaggagattggatctgcatctcaggagttttagggttttttaatcaagtgttttgttagttggtataaattgttgaggggcttggatcagttagtatggttgtgatgagcttttttccttgtgtaaatccttgttattgagtatttgctgaaatacagatgctcatgttactggacggaaaaaaagcggccgcgaa

SEQ ID NO: 5822 - DNA, 781 bp, Solanum melongena
tatcacacatttcaccatctttcttctctctgtctgtgcagcttcgaatctagggttagggtttttttcgtaagagaatagcaaaatgagttcgggtgctggagcaggcaaaggcggcgccggaagaggcaagccgaagtcatcgaaatcagtttcccgatcttcaaaagccggtcttcagttccctgttggtaggatcgctcgtttccttaaggctggaaagtacgctgaacgtgtcggtgctggtgctcctgtgtatctctctgctgtccttgagtatctcgctgctgaggtgttggagttagctgggaatgctgctagggacaacaagaagaatcgaattgtgcctaggcatattcagttggctgtgaggaatgacgaggagttgagcaagctgttgggtcaagttaccattgctaatggaggtgttctgcccaacattcaccagaatctgttacctaagaaggctggaagtggaaagggtgatattggctctgcatctcaggagttctagatgtaaaaatggggattgtgttttgggaaggattagtagaaaggagtagaactggttatgtaatataaagacacccttttgtgttctgttatttaatggtatgaaatgaaaaaagggcaagggccacctgcagtttgggtcacagacgggttagttcttcttgttcattgcaattctatgcttgtctgatttgattaattgagcttttgctgtatgcccttcagagtgtagcttttgctgattatgcagaaggcaaagtgtatttgc

SEQ ID NO: 5823 - DNA, 741 bp, Humulus lupulus
ctggttcccctgtaatctttactgtctatctcactaattcctccgtttttcgagaaagttagggttaggttttgtgtattttttttcatacaattgttattgtcttcctttcttgatcgagaatatgagttctgctgcagctggttcaaccaagggcggtagaggcaagccaaaggcctctaagtctgtatcgaggtcgcagaaggcggggctccagttccctgtgggtaggatcgctaggtttttgaaggttggaaagtatgccgaacgtgttggtgccggagctccggtctatctctctgctgttcttgaatacctcgccgctgaggttttggagcttgctggtaacgctgcgagagataacaagaaaaatcgcattgtgccgaggcatatacaactagctgtgagaaatgacgaggaattgagcaaacttttgggttctgttaccatcgccaatggtggtgttttgcccaatattcaccaaacccttttgcctaagaaggttggcaaaggcaagggtgatattggctctgcttcccaagagttttagggtttattagtattcttttttagtactctaggttattactacagctgtaatatatgtggattttcttttgctaaatttgtgttcaatcaaacgaaatatcgaattgttgttatattggcatatgggtttgaacttataaattaaagtcattccgtaacattcttatataaagattggttaaaattattccg

SEQ ID NO: 5824 - DNA, 793 bp, Medicago truncatula
gccttaccctctcaaccaataagcgcaaagcttggattcctatataacaacacttcatcgtcttcacaattcacagtcttctctctctctctctctctctgattttcagtcccaaaattaagatttagggttttcaatttctccaaattcaatccgaaaatgagttccaaaggtgccacaacaaccaccaaaggaggaagaggcaaaccaaaagcctcgaaatccgtttcaagatcttcaaaagccggtcttcaattccccgttggaagaatcgcaagattcctcaaggccggaaaatacgctgaacgtgtcggcgccggtgctccggtctacctctctgccgtacttgagtatctcgctgctgaggttttggaattggctggtaacgctgccagggacaacaagaagaatcgaattgttccaaggcatattcagcttgctgtgaggaatgacgaagaactcagcaagcttttgggagctgtaaccattgctaatggtggtgttttgcccaatattcatcagacattgcttcctaagaaagttggaaaagggaaaggggaaattggatctgcttctcaagagttttagggtttctgtgtgctgttttgagtagatcttagttttattgtgatgatgcagttgtaacatttacatgtttgattaatttttaatcacttcaaaggggaaatgtttaccaatgtttgatttttaatttacagttaataattgctgtttattgttaggttttgtcttgaggttgaaaattgttaagcaaggatacaattgtgacaga

SEQ ID NO: 5825 - DNA, 624 bp, Capsicum annuum
tttctctgcaatcttcaaatctagggttagggttagtttttttggaaagagaaaaaaagatgagttcaggtgctggagcaggcaagggcggcgctggaagaggaaagccgaagtcgtcgaaatcggtttcccgatcttcgaaagctgggcttcagtttccggtggggaggattgcgaggtttctgaaggctgggaagtatgcggaaagagttggtgctggtgctcctgtgtatctctctgctgtgcttgagtatctcgctgctgaggtgttggagttagctgggaatgctgctagggacaacaagaagaatcgcattgtgcctaggcacattcagcttgccgttaggaatgatgaggagcttagcaagctgttgggccatgtgaccattgctaatggtggtgttctgccgaacattcaccagaatctgttgcctaagaaggctggctctggaaagggtgacattggctctgcatctcaggagttttagatgtatatctggcttgtgttttgggtaaggattaggagaatggagttaaacatggtttatgtaatatagacaaataccccttttgtattttgttattcaatggtatgaaatggaaaagggcagtagccacctgcag

SEQ ID NO: 5826 - DNA, 759 bp, Populus trichocarpa
aatcaaacacctctctcattttccttctttaactccctctaaagccaaaatcagggttagggttttatagctctttgtgtaaaatgagttcaaaagaaggaggcgcttctaccaagggagggagagggaaaccaaaggcatcgaagtcggtgtcaagatcgcataaagcagggttgcaattcccagtcgggagaattgcaaggttcctgaaggctggtaaatatgctgaacgtgtcggtgccggagctcccgtctacctttctgctgtccttgagtatctcgctgccgaggtgcttgagctagcagggaacgcagcaagagataacaagaagaatcgtatagtgccaaggcacatccagcttgctgtgagaaacgatgaggagctaagcaagctactggggtcagttacaattgcaaatggaggtgtcttgcctaacattcaccagacacttcttcctaagaaggttggcaaagggaaaggcgacattggatctgcttctcaagagttctagttctaggcttagagctttgtctttttgaaaattctagggcttctacagtgtgtaatatagtctttttgatttcttggtttttcggaactggctacatggagtttcactgtatgtttttgataaaagctgaggctttttggaatctttatctaatgggagtttttatcaatcactgttcccttgttttgttctgtttttcttcttaaacgctttggttctccgttgattgattcgttaaaggttgctg

SEQ ID NO: 5827 - DNA, 986 bp, Prunus mume
tcagtttcacattaagaaaaacccatccctctttctctctgcctcgcacgcctctctcactcgcccaagacttgttctctgttctagggttagggttttgtgatttcagttttgatttgggaaaatgagttctaaagaagctggttcgacgaagggaggcaggggcaaaccgaaggcctccaagtctgtatcgaggtctcataaagcagggctccagtttccggtgggtaggatcgcccgatttcttaaggccggcaagtacgcagagcgggttggtgctggcgcacctgtatatctctccgccgtgctcgaataccttgctgcagaggtattggagcttgctggaaatgctgcaagggataacaagaagaaccgtattgtgccaaggcacatccaactggccgtgaggaacgacgaagagctaagcaagctattggggtctgtgaccattgctaatggaggagtgttgccaaacatccaccaaactcttttgccgaagaaggtgggcaaaggcaagggcgatattggatctgcctctcaggagttctagagggttctctcccttctgtggagttaaagagtagttactgcagttgtactatatgaagttgttttttaattttttgggatagagcttgatcatttggtacttggaattggtatgctataaatgaaagtttgtgttaggattttctcaactaaatccccttttcaagttactttgttctccaaaaccatctgcggatgttttagatattacttgtgcctctgggtatttgatgcattagggcttgatttcacttcatgaggtgaaagagttttggatcaactatctcaaatcaagttaaaaaaaagaggcatatctcttactaataaatcaatcctcagtttttcgcattctaatcttgcgccggtcttctccaattgtaaacacgaccagctatatttttcagaccatagtaaaccagttaccgaaggaaattcca

SEQ ID NO: 5828 - DNA, 682 bp, Prunus persica
ctctttctctctgcctcgcacgcatctctcactcgcccaagacttgttctctgttctagggttagggttttgtgatttcagtgttgatttgggaaaatgagttctaaagaagctggttcgacgaagggaggcaggggcaaaccgaaggcctccaagtctgtatcgaggtctcataaagcggggctccagtttccggtgggtaggatcgcccgatttcttaaggctggcaagtacgccgagcgggttggtgctggcgcacctgtatatctctccgccgtgctcgaataccttgctgcagaggtattggagcttgctggaaatgctgcaagggataacaagaagaaccgtattgtgccaaggcacatccaactggccgtgaggaacgacgaagagctaagcaagctattggggtctgtgaccattgctaatggaggagtgttgccaaacatccaccaaactcttttgccgaagaaggtgggcaaaggcaagggcgatattggatctgcgtctcaggagttctagagggttgtctctcttctgtggagtttatgagtagttactgcagttgtactatatgaagttgttttttaattttttgggatagagcttgatctattggtacttggaattggtatgctataaatgaaagtttgtgttaggattttctcaactaaatcccctt

SEQ ID NO: 5829 - DNA, 483 bp, Salvia sclarea
ctactagaccttggctgtcactcagcccctctgaaaatgagttccaacgctgctgccaccaccaagggcggaagaggcaagcccaaggcctctaaatccgtctcccgctcgtcaaaggccggcctccagtttcccgtaggcagaatcgctcgttttctcaaggccggtaaatacgccgagcgcgtcggcgcgggcgcccccgtatacctttccgctgttctcgagtacctcgccgctgaggtgttggagcttgcgggaaatgctgctagggacaacaagaagaataggattgttcctcgtcacatacagctggcagtgaggaacgacgaagagctgagtaagcttctgggccatgtcacaatagctaacggaggtgttctgccaaatattcaccagactttgttgccaaagaaggctggcggtagggacaaggagatcggttctgcgtcacaggaattttagggttattgttgtgaattaaaa

SEQ ID NO: 5830 - DNA, 690 bp, Solanum lycopersicum
cgtatcacatttcaccttcttccttctctctgtctctgcaactccgaatctagggtttgggttagggtttttttggtcagagaaaaaaaatgtcttcaggtgctggagcaggtaaaggcggcgccggaagaggcaagccgaaagcatcgaaatcggtttcccgatcttcaaaagctggtcttcagtttcccgtcggtaggatcgctcgtttccttaaggcaggaaagtacgctgaacgtgtcggtgctggtgctcctgtgtatctctccgccgtccttgagtatctcgctgctgaggtgttggagttggctggaaatgctgctagagacaacaagaagaatcgaattgtgcctaggcacattcaattggctgtgaggaatgatgaggagttgagcaagcttttgggtcaagttaccattgctaatggaggtgttttgcccaacattcaccagaatttgttgcctaagaaggctggctctgggaagggtgatattggctctgcatctcaggagttttagatgtaaatggggtgttatgttttgggaagtattaggagaaaggagtagaactgttatgtaatataaaaaaaaatacccttttgttattctgttatttaatggtatgaaatgaagaaaaaagggcaatagccacctgcagttttggttatagacgtcttactctttgctcatc

SEQ ID NO: 5831 - DNA, 638 bp, Triphysaria pusilla
tcaatcaaacaccagaaaaatgagttccaaagaagcagcctccactaaaggcggccgaggcaaggccaaatctaccaaatccgtctcccgttcttccaaggccggcctccaattccccgtaggcagaatcgcacgtttccttaaagccggtaaatatgccgagcgcgttggcgctggtgcgccggtctatctatccgccgttctcgaatacctcgccgccgaggttttggaacttgctggtaatgctgctagggacaataagaagaataggattgtgcccaggcatattcaattggctgtgaggaatgatgaagagttgagtaagctgttgggatgtgtaactattgctaatggtggagttttgcctaatattcatcaaactttgttgccgaagaaagcaggaggaaaggataaggagattggatctgcttctcaagagttttagatttgctttgctctttgtttaagttatttgattagtcggtgtgccatgtaaagggttggctcttttgtttatttaatgatgctgttgatctatgtaaaccctaattttggaacttgaattacaaataatgggtttggtgaattataattttttgaaatagttttttctaaatatcaagctatcatttttatct

SEQ ID NO: 5832 - DNA, 574 bp, Juglans hindsii x Juglans regia
ggggatttggagttcgattattcagcgtagagatgagttcgacgggcggaggtggctcgaccaagggtgggaggggcaagccgaaggcctcgaagtcggtgtctaggtcgcagaaggctggacttcagttcccggttgggagaatcgctagatttctcaaggctggcaagtatgctgagcgtgttggtgccggagctcccgtatacctctcggccgtgctcgaatacctcgctgctgaggtgttggagcttgctggtaacgcggcgagagacaacaagaagaacagaattgtgccgaggcacatccaacttgcagtgagaaacgatgaggagctgagcaagcttttgggctctgttaccattgccaatggaggtgtactgcctaatatccaccagactcttctgcccaagaaggttgggaaagggaagggtgagattggatctgcttctcaggagttctaggtctagcttagttgtttcacatttgtaatgtatatcagcattgcaatttcctccttttgtcatatgaattttgatggtacctttttgtcaatgaaaagaatttatcgactttg

SEQ ID NO: 5833 - DNA, 598 bp, Euphorbia peplus
tgtctcctccctgtcgcagagatttcaactagggttaacttttccaatcggaaaatgagttcaaccggcggatctactaaaggaggaagaggaaagcctaagtcggcgaaatcagtctcccgttctaccaaggctggtttgcagttccccgtcggaaggatcgccaggtttcttaaggccggaaagtatgccgagcgtgtcggcgccggagctcccgtctatctctctgctgtcctcgagtatctcgctgctgaggtattggagcttgcagggaatgcagcgagagataataagaagaatagaatagtgccaaggcatatccagcttgctgtgagaaatgatgaggagttgagcaagcttctgggctctgttactattgcaaatggtggtgttttgcctaacattcatcagactcttcttccaaagaaagcaggtgcaagcaaaggagatattggttctgcttctcaagaattctaggccctgtttttgttttttaggactccacagttgtaatatatgcccatcctttttctttgttttcatgatggttttagaatattatggtgcttttcagcaaagcagcctttgaatgaaatca

SEQ ID NO: 5834 - DNA, 828 bp, Linum usitatissimum
aatccagttctaatttccctcaaccatctctgcaacatcagaaaatcaatccggagctagggtttcgcgagatctcatcaattcatacctttaaatcgcatacaatgagttccgccgcaggatcaacgaaaggaggccgaggcaaggccaaggctgcgaaatccgtatccagatcatccaaggccggactgcagttccccgtcggaagaatcgctaggttcctcaaagcagggaaatacgccgagcgtgttggcgccggtgctccagtctacctctccgccgtcctcgagtacctcgctgccgaggtattggaacttgctggaaacgctgcgagggataacaagaagaaccggatcgtgccgaggcacatccaattggcggtgaggaacgatgaggaactgagcaagcttttgggatcggtgacgatcgccaacggaggcgttcttccaaacatccacaatactctcctcccgaagaaggccggagggaagggcgatatcggatctgcttctcaagagttttgaatttggttcgtttgaaaatctgggttatcttacagtttccgctggtcttttgatcctggagctttgttctgtgatgtataaagccacccaaattatgcgtccattccttcactgggatgttaaaatcttagcatttggataatcgaaacattccttgttctttgagcttgtctatctggttatgcctttgtcattctgtttgttcttcggctatggatttgcgtcctttaagagtatctgttctgcaattacgatattttcttctgggaatgagtagaagatttgcagacaaaggattactgac

SEQ ID NO: 5835 - DNA, 586 bp, Fraxinus spp
ccaatctcgaaacctcaaaaagtgaaaaaaaaatgagtcccaatgcttcaaccaagggcggtaggggcaaacccaagtcgtccaaatccgtctctcgctccagcaaggccggtctccagttccctgttggcagaatcgcccggttcctcaaagccggaaagtacgccgagcgtgttggggctggtgccccggtctacctcgccgccgtccttgaataccttgcagctgaggttttggagctcgcgggaaatgcggcgagggacaacaagaagaacaggattgtacctaggcacatacaattggcagtcaggaatgatgaggagttgagcaagctgttgggaagtgttacaattgcgaatggtggtgtcttgcccaacattcatcagaacctgttgcccaaaaaggctggaggaaaggacaaggaaatcggttctgcatcgcaagaattctagggttttgttgtttattaacgcggcttggttgatgaatatatatcactaaggttttggatcaattgttttgttatgtgatgtttggtccatgtaaaaaccctgatttcgctttggttaaaatatacaacatcttg

SEQ ID NO: 5836 - DNA, 1121 bp, Panax ginseng
caaatgaagcaatacatggaaacatcattttacagaaaccggaatcactgcaaggaaaagaaaagtgagcccctgaaagaagagaagctgagtgtgtctgatagtgcctctacaaaaagaggatgtaaaacttgtgcgtcattctgctcgagcctcagccaaagttagcaccagcgaacccataaatatcaaataagcagtggtatcaacgcagagtacatggggacgacaaacacatcctttctctctccttgggttttgttattcggtacagaacatttagattatcagatcgaagaaagctagagatgagttcaaaagaaggttcaaccaagggcggaagaggaaagccgaagtcctcgaagtctgtgacgcgatcttcaaaggccggtcttcagttccctgtcggtagaattgcccgttttctcaagaacggaaagtacgccgagcgtgtcggtgccggagctccggtatatctctctgccgtcctcgagtatctcgccgctgaggtgttggagttggctgggaatgcagcaagagacaacaagaagaatagaatagtgccaagacacatacagcttgcagtgaggaatgatgaggagttgagcaagctcttgggcgctgtaacaattgccaatggaggtgttttgcccaatattcaccagaatttgctacccaaaaaggttggcaaaggcaagggagacattggatccgcttctcaggagttttaggaagacattgtgctcttattagtagacttcttagtttttctcctcttgttttttttagtataaattctatatttgttttgcacttgatgctttcagttcaagattgttaattgggattgggtcatgcttttgtttacatttaaagttatttgatattggatggaatggtggtggttccttcaagaactttccacccttaattaatgtgcctttaggcactcgttgccttgcctaagcggtttgtatgtgttaccctagactgaccagcttttcactaaaacttgtaccttttataagttggaacgtgcttatacaaagtattcatagatcgaaagttgattacttagtagcaaaggtttattctttttctgtgctaggctataaggtttg

SEQ ID NO: 5837 - DNA, 727 bp, Panax ginseng
tatcaacgcagagtacatgggggtacgacaaacacatcctttctctctcctagggttttgctattctgtacagaacatttagatcgtcagatagaagaaatatagagatgagttcgaaagaaggttcaaccaagggtggaagaggaaagccgaagtcctcgaagtctgtgacgcgttcttcaaaggccggtcttcagttccctgtcggtagaattgcccgctttctcaagaacggaaagtacgccgagcgtgtcggtgccggagctccggtctatctgtccgccgtcctcgagtatctcgccgctgaggtgctggagttggctgggaatgcagcaagagacaacaagaagaatagaatagtgccaagacacatacagcttgcagtgaggaatgatgaggagttgagcaagcttttgggtgctgtaacaattgccaatggaggtgttttacccaatattcaccagaatttgctacccaaaaaggttggcaaaggcaaggaagacattggctctgcgtctcaggagttttaggaagacattgtgcttagtagacatgttggtttgtcttctcttcttagcttattaggaaagagaaatatgttatatataatataccatggtgtttgattatttggcgtgtgatgagaatttagtttttatttttttatcataaaaattatatatttgttttgagcttggtgctttcagttcaagattagtaattggca

SEQ ID NO: 5838 - DNA, 648 bp, Panax ginseng
tctcctagggttttgctattctgtacagaacatttagatcgtcagatagaagaaatatagagatgagttcgaaagaaggttcaaccaagggcggaagaggaaagccgaagtcctcgaagtcagtgacgcgttcttcaaaggccggtcttcagttccctgtcggtagaattgcccgctttctcaagaacggaaagtacgccgagcgtgtcggtgccggagctccggtctatctgtccgccgtcctcgagtatctcgccgctgaggtgctggagttggctgggaatgcagcaagagacaacaagaagaatagaatagtgccaagacacatacagcttgcagtgaggaatgatgaggagttgagcaagcttttgggtgctgtaacaattgccaatggaggtgttttacccaatattcaccagaatttgctacccaaaaaggttggcaaaggcaaggaagacattggctctgcgtctcaggagttttaggaagacatcgtgcttagtagacatgttggtttgtcttctcttcttagcttattaggaaagagaaatatgttatatgtaatataccatgatgtttgattatttggcgtgtgatgagaatttagtttttatttttttatcataaaaattatatatttgttttgag

SEQ ID NO: 5839 - DNA, 789 bp, Panax ginseng
tggtatcaacgcagagtacatggggtacgacaaacacatcctttctctctcctagggttttgctattctgtacagaacatttagatcgtcagatagaagaaatatagagatgagttcgaaagaaggttcaaccaagggcggaagaggaaaaccgaagtcttcgaagtctgtgacgcgttcttctaaggccggtcttcagttccctgtcggtagaattgcccgctttctcaagaacggaaagtacgccgaacgtgtcggtgccggagctccggtctatctgtccgccgtcctcgagtatctcgccgctgaggtgctggagttggctgggaatgcagcaagagacaacaagaagaatagaatagtgccaagacacatacagcttgcagtgaggaatgatgaggagttgagcaagcttttgggtgctgtaacaattgccaatggaggtgttttgcccaatattcaccagaatttgctacccaaaaaggttggcaaaggcaaggaagacattggctctgcttctcaggagttttaggaaagacattgtgactagtagacatgttagtttgtcttctcttcttagcttattaggaaagagaaatatgttatatgtaatataccatgatgtttgattatttggtgtgtaatgagaatttagtttttattttttagtataaaaattatatatttgtttaagattaaaaaaaaaaaacaaaaaaaaaaaaaacaaaaaaaaaaacaaaaaaaaaaacaaaaaaaaaaacaaaaaaaaacaaaaaaaaacaaaaaaac

SEQ ID NO: 5840 - DNA, 631 bp, Panax ginseng
ggtacgacaaacacatcctttctctctcctagggttttgctattctgtacagaacatttagatcgtcagatagaagaaatatagagatgagttcgaaagaaggttcaaccaagggcggaagaggaaaaccgaagtcttcgaagtctgtgacgcgttcttcaaaggccggtcttcagttccctgtcggtagaattgcccgctttctcaagaacggaaaatacgccgaacgtgtcggtgccggagctccggtctatctgtccgccgtcctcgagtatctcgccgctgaggtgctggagttggctgggaatgcagcaagagacaacaagaagaatagaatagtgccaagacacatacagcttgcagtgaggaatgatgaggagttgagcaagcttttgggtgctgtaacaattgccaatggaggtgttttgcccaatattcaccagaatttgctacccaaaaaggttggcaaaggcaaggaagacattggctctgcttctcaggagttttaggaaagacattgtgactagtaggacgtgttagtttgtcttctcttcttagcttattaggaaagagaaatatgttatatgtaatatactatgatgtttgattatttggtgtgtaatgagaattt

SEQ ID NO: 5841 - DNA, 871 bp, Lupinus angustifolius
actattctctctccactcgctttctcaatcgcaatttctagggttttgaaatttcttcaatcaatttgaaaaaataaaatgagttctaaagaaggatcaacgaaaggaggaagaggcaaaccaaagtcctcaaaatccgtttctcgatctcagaaagctggtcttcaattccccgttggaagaatcgcgagattcctcaaagctggaaaatacgctgaacgtgttggtgctggtgctccggtctacctctccgccgttctagaatacctcgccgccgaggttttggaattggctggaaacgctgcaagggataacaagaagaatcgtattgttcctcgtcatattcaactcgctgtgaggaacgatgaagaattgagcaagcttcttggttctgtgaccattgcgaacggtggcgttttgccgaatattcatcagacattgcttccgaagaaggttggaaagggaaaaggtgaaattggatctgcttcacaagagttctagaatgttctagtgtttgtgtttgtttagaagaattatagtttgttatattgctatagatgttaaatggatggaaaatgtagtgaacttttgatggttcataccgtgctctgtgactttgaatgaaagaaaattgttcactatcataattgttcataccctaaacccttaatctcagtccatttacaataaattcttagggtttgatatcctttggtggggatgagaactggaataccctttacccttataggatttgcttatcatttactattaatttgtattacttttgtttcattatcattgattattgataaatcaatgatgaatgatttgtggatagtataaaaataatataaatatacatggttaa

SEQ ID NO: 5842 - DNA, 703 bp, Lupinus angustifolius
atcaaaccactcttctctctctctttctctgtaaccaaatcacaatttctagggttttgaaatttctcaatcaatcaagaaaatgagttcaaaagaaggatcaacaaaaggaggaagaggaaaaccaaaggcatcaaaatcagtttctcgatctcaaaaagctggtcttcaatttcccgttggaagaatcgctagatttctcaaagctggaaaatacgctgaacgtgttggtgctggtgctcccgtttacctctccgcagttctcgaatatctcgccgccgaggttttagaattggctggtaatgctgctagggataataagaagaatagaatcgttcctcgtcatattcaacttgcggttagaaacgatgaagaactgagcaagcttttaggatcagtgactattgctaatggtggtgtgttaccgaatattcatcaaactttgcttccgaagaaaactggaaagggaaagggtgaaattggatctgcttctcaagagttctagaaggttctagaatggattttgattcggttgtaatatacaagttttggattgtattgtgatatctgtttttatgaaactttgaatgcaaggaattggtaatttataatctgaattatttgtgtcatgaatcatatatattggtaaatgttttttttatataagcaatagtagatgtataatttaattcattattaaaca

SEQ ID NO: 5843 - DNA, 642 bp, Orobanche aegyptiaca
gaaagcctttttttcacttacagataattaattcccctctctcacaacaattgtagggtttcttttaagtcgctaatcccatcgccggaaaaatgagctcaaccaccaaaggcggccgaggcaaggctaaatccactaaatccgtttcccgttcgtcgaaggccggcctccaattccccgtcggtagaatcgcacgatttctcaaagcgggtaaatacgccgagcgcgtcggtgcaggtgcacccgtttatctctccgccgtcctcgaatacctcgctgcagaggttctggagcttgccggaaatgcagcaagggataacaagaagaatcggattgtgcctagacacattcaattggcggtgaggaacgatgaggaattgagcaagcttttggggactgtaaccattgctaatggcggtgttttgcccaacattcaccagaccttgttgcctagtaagaaaggtggagggaaggacaaggagattggctctgcttcacaagagttttagggttcttctgttagctggctttggtttatgtggtggtatactttgtgaagggttttggatatctggtttcgtttatcactatctgtctgatcttgtaaaatccctggtttggaatctgaaatacatataatgg

SEQ ID NO: 5844 - DNA, 777 bp, Arachis hypogaea
gcagtggtatcaacgcagagtacggggggatgtgcttctccactctctaacatactctgcaatcgtcttcgcaccgattcacaaattctagggttagggttcccaaatttcgccgtcgatcacagaatgagttccaccgctggatcaaccaagggcggaaggggcaagccaaaggcctccaaatccgtttcaaggtctcaaaaggctggtcttcagttccccgtaggaaggattgccaggttccttaaggctggaaagtacgccgagcgtgtcggcgccggcgctccggtatacctctctgcggtgcttgagtacctagccgctgaggttttggaacttgctggcaatgccgcaagggacaacaagaagaaccgtattgttccgaggcacattcaacttgcagtgaggaacgatgaggagcttagcaagcttcttggatctgtgaccattgccaatggtggtgttttgccaaatatccatcagactcttcttccaaagaaggctggaaaagggaaggacgagattgggtctgcttctcaggagttctagggttttttgtaggctatgaattaggctataggtttttaatttttctgcggttgtaaaatacatgttttatttccttatatcggttggtaccaatggatataatgcttatcaatccactgaacatgatggaatattatgttactctttgaatggagatgaatgcaaaatccttttttgttactcaaaaaaaaaaaaaaaaacaaaagtactctgcgttgataccactgc

SEQ ID NO: 5845 - DNA, 830 bp, Arachis hypogaea
tgatagagcgaagcagtggtatcaacgcagagtacggggggtggtatcaacgcagagtacggggggaatgtgcttctccactctctaacatactctgcaatcgtcttcgcaccgaatcacaaattctagggttagggttcccaaatttcaccgtcgatcacagaatgagttccaccgctggatcaaccaagggcggaaggggcaagccaaaggcctccaaatccgtttcaaggtctcaaaaggctggtcttcagttccccgtaggaaggatcgccaggttccttaaggctggaaagtacgccgagcgtgtcggcgccggcgctccggtatacctctctgcggtgcttgagtacctagccgctgaggttttggaactagctggcaacgctgcaagggacaacaagaagaaccgtattgttccgaggcacattcaacttgcagtgaggaacgatgaggagcttagcaagcttcttggatctgtgaccattgccaatggtggtgttttgccaaatatccatcagactcttcttccaaagaaggctggaaaagggaaggacgagattgggtctgcttctcaggagttctagggttttttgtaggctatgaattaggctataggtttttactttttctgcggttgtaaaatacatgttttatttccttatatcggttgctaccaatggatataatgccttatcaatccactgagcttgatggaatattatgctactctttgaatggatatgaatgcaaaatcctttttttgttactcaaaaaaaaagaaaaaaaacaaaagtactctgcgttgataccactgcttcgctctatca

SEQ ID NO: 5846 - DNA, 601 bp, Euphorbia esula
tgtctcctccctgtcgcagagatttcaactagggttaacttttccaatcggaaaatgagttcaaccggcggatctactaaaggaggaagaggaaagcctaagtcggcgaaatcagtctcccgttctaccaaggctggtttgcagttccccgtcggaaggatcgccaggtttcttaaggccggaaagtatgccgagcgtgtcggcgccggagctcccgtctatctctctgctgtcctcgagtatctcgctgctgaggtattggagcttgcagggaatgcagcgagagataataagaagaatagaatagtgccaaggcatatccagcttgctgtgagaaatgatgaggagttgagcaagcttctgggctctgttactattgcaaatggtggtgttttgcctaacattcatcagactcttcttccaaagaaagcaggtgcaagcaaaggagatattggttctgcttctcaagaattctaggccctgtttttgttttttaggactccacagttgtaatatatgcccatcctttttctttgttttcatgatggttttcgaatattatggtgcttttcagccaagcagcctttgaatgaaatcatct

SEQ ID NO: 5847 - DNA, 761 bp, Trigonella foenum-graecum
aattgaatctcaaaatcaaggtttagggttttcaatttttccttcaatcagaaaatgagtaccaaagctacaacaactaaaggaggaagaggcaaaccaaaagcctccaaatccgtttcaagatcttccaaagccggtcttcaattccccgtcggaagaatcgcaagattcctcaaggccggaaaatacgccgaacgtgtcggcgccggtgctccggtatacctctctgcggtgcttgagtatctcgctgctgaggttttggaattggctggaaacgctgcaagggataacaagaagaatcgaattgttccaaggcacattcaacttgctgtgaggaatgatgaagaacttagcaagcttttgggagctgtaaccattgctaatggtggtgttttgcctaatattcatcagactttgcttcctaagaaggttggaaaagggaaaggtgaaattggatctgcttctcaagaattttagggtttctgttcgttgttttgagtaggatgattttagctttattatgacgcagttgtatcagacatgtttaattgctagtttattataattcaaaaggtataaggattatgcagttgagtatatttttacttttttatatcaatttgttgatttgaatctgtttttcactacaccagatttgcttgttattgttgggtttcaaggttgaaaaccattaaacaacagatcgtggctagggttggaaatgagttgagttgatttgaactcatctgaacttgactcaa

SEQ ID NO: 5848 - DNA, 687 bp, Acacia harpophylla
gaaacattctgacggaatcaaaacccaagagtaccttcattctctgattgctaaaccctagtcagacatttcgaaagccgtctacgccacaatgagttcggctggatcgaccaaaggtggaaggggtaagccgaaatcctctaaatctgtttctaggtctcaaaaggctggtcttcaatttcctgttggtcgtatcgctcgctttctcaaggccggaaagtatgccgaacgtgttggcgccggtgctcccgtctatctctctgccgtattggaatatcttgctgctgaggttcttgagcttgctggcaatgctgctagagataataagaggaatcgcattgttccaaggcatattcagcttgctgtacgtaatgacgaggagttaagtaagctcttaggatgtgtcactattgccaatggtggtgttttgccaaatattcatcaaaatctcctgccaaagccgatggggaagggaaaaggcgatattggatcagcgtcccaagaattctaagattccaccactctggagttagatctgaaagtcgagtttgttgatatggaatctatttgattatattttagtttccatatgtgataagaacatatattttacatattccttgccccttttttatgagaaaaacataaatcttacagtcgggaacagatgttagacaaatatgtgac

SEQ ID NO: 5849 - DNA, 1205 bp, Amorphophallus konjac
agtcggcccttcgttgccgccgttgccgtctttcccgatctgcctctagggttagggttcccatcgtttcgcccgtcgggaacaggaaccggcgtagcgatgagctcctcgggcacgaccaagggcgggcggggaaaggccaaggcctccaagtccgtctcccgctcccacaaggccggcctccagttccccgtcggcaggatcgcccgcttcctcaaggccggcaagtacgccgagcgcgtgggcgccggcgcccccgtctacctcgccgccgtcctcgagtatctcgccgccgaggtccttgagctggctggaaatgcggccagggacaacaagaagaacaggatcgtgccgaggcacatccagctggcggtgagaaacgacgaggagctgagcaagttgctggggacggtgaccatcgccaacggaggtgttctacccaatatccaccagacgctgttgccgaagaaacagggtgggaagggcgacattggatctgcctcccaggagttttagggttattgtggacttgtgagttgtcttgtatcgatgctctggctggaaaggggtgtttgggtggaagtgttttattgggaattcgattgcgacagaaatatgattttttttgtgttttttagggccatagtttctttgatccataaaatttctgtacacaatttgtgaacagacattatgtagacttgagctctcagcttctatggggttattggttgccaaccaaaatgaatttctaactctaaattgtactgtgattcttttttattggtgtaattcttctagggtgttaatcattgtcggactgcagatgctgatatgctggttgttgcagcatcttccatcagatgtggctattgtaaagtcatcaagctccttgggggagcatagtcccggcgtcaatcgtgcagtggactgagcatatattgtggttctcgcaaagaggtgaaaaaggggcgtattgttttgtgatgactgtaagtcgaatttcaaacaaaatataggggggaatgatcactgtatgttgccacactctagggtcaattgaacgtgtgatgaaaaaggtttgaaggatttagttaaagttcttcaactggtttgtgtgcaggtaaggactttgctaccttctcctagaatttggaaacttttagggcttgtttgttcatcctacaatagtgtaaatttgctaa

SEQ ID NO: 5850 - DNA, 613 bp, Persea americana
atagcgagaagggaaatcgtcagaacgaaagatcttcgtttctagggttagggtttcaaaagatgagttcttcagcttcgacgaaaggcggtcgaggaaagcccaaatcctccaaatccgtctcccgatctcacaaggccggcctccaattccccgtaggcaggatcgcgaggttcctcaaggccggaaaatacgcagagcgcgtaggagccggcgcccctgtctatctctccgctgttcttgaataccttgctgcagaggttcttgagctggctgggaatgcggcgagagataacaagaagaatcgtattgttccgaggcatatacagcttgcggtgaggaatgatgaggagcttagcaagcttttgggggctgttactattgcaaatggaggagttttgccgaacatacatcagacgttgctgccgaagaagacgggaaagggaaagggggagattggatctgtatctcaggagttctaggtttcttttgaggtttggggagaaatgttagggttgggtgatgttgagggtatgtttgtaaattttctttgatttttggaacctaatctgttgcttttataggatatataatgcaatggtaataattcatt

SEQ ID NO: 5851 - DNA, 748 bp, Musa acuminata
aaaactgaagccttcgccctcctcgtcgttcctcttcgttagggtttcttcgcgagcaagatataccagagatgagttccacaacgtcggcaaagggcggccgaggcaaggccaagtcgtcgaaatctgtctcccgttcgcataaggccggcctccagttccccgtcggccgcatcgctcggttcctcaaggccgggaagtatgccgagcgtgtcggcgcaggtgccccggtctacctcgccgccgtcctcgaataccttgctgccgaggtcctggaattggccggaaacgctgcgagggataataagaagaatagaatcgttccaaggcatatacagctcgctgtcaggaatgacgaggagttgagtaagcttttgggagctgttacgatcgccagtggtggtgttttgcccaatatccatcagaccttattgcctagtaaggcgggaaaggggaaaggggatattggatctgcgtcacaggagttctagattataaagatataatcttttggtatgatggaatatgatgaatggagtgagcctgataatgtaataaaacgttttggcaagttgttgaatatccttatcatagaataggatgagaggataattgaaaattgattatttttatgaggttataatccttttctggttctcaatctaattttccatttgcacctgaaatcaattactttttggctacattcagttgaattgtattgtttgattgaatcagtggcttgttt

SEQ ID NO: 5852 - DNA, 745 bp, Theobroma cacao
ctcattgatcgccacgaactctccattttctgccaaactaacaatttagggtttcaaaagaagatgagctcaacgggatcaacaaagggaggcagaggcaagcctaaatcctccaaatctgtttccagatctcagaaagctggcctccagttccccgttggccgcatcgcccgattccttaaagccgggaaatacgccgatcgcgtcggcgccggcgcccccgtctacctctccgctgtccttgaataccttgcggctgaggttcttgaacttgctggaaatgcagctagggacaacaagaagaatcgaatcgtaccaaggcacatacaactggcggtaaggaacgatgaagagttgagcaagcttttggggactgtaacgattgctaatggaggcgttttaccgaacattcatcagaatctgttgccgaagaagattggtaaagggaagggtgatattggatcggcttcacaagaattttagagactattttttggagtgtgagagagtctccttgttttggataaaatgttaaaggatcgaattgttttcgatgggctgttttttgaactttcaattgatctttgtaaatcctaaatttagggtggttttgctttgggtgaatataggttcggcgaattgaaatgctacttctctttcttagaatcaaatgaatataataatataagtacaagacatttcatcctacgaaatgtctgaggaagttgggtcttttttctggtca

SEQ ID NO: 5853 - DNA, 1295 bp, Trifolium pratense
tacatgggaaatcaaatttgttctcagttaacagtcttttgaatcgcataatcaacttttaggttttccaatttcttctccgatcagaagaatgagttcaaccggtacaaccaagggcggaaggggcaaaccaaaggccgctaaatcagtttccaggtcatctaaggccggtcttcaattccccgtcggaagaatcgctagattcctcaaagctggaaagtatgctgaacgtgtcggtgccggtgctccggtctacctctccgccgtccttgagtatctcgctgctgaggttttggaattggctggtaacgctgctagggataacaagaagaatcgtattgttccaagacacattcaacttgcagtaaggaacgatgaagaacttagcaagcttttgggttctgtaaccatcgctaatggtggtgttttgcctaatattaatcaggttttgctccctaagaagactggaaagggaaaagacgatattggatctgcttctcaagaattttagggtttatgtgttctgttctgaatagatcttaattttgttatattgcagtggtaacggaacatacatgtttaattgattattaactgcttcaattttataaggacaaaggtttattaatcgattcacttgtttctatcaagttaagaaaaattattagtgttatgcctctgtcttttcgcatctgaaactatccttgaagtgttcatcacaaaaatcacgtgttagataaaacaaatgtttaaactaggactaagtcttcaaatttaagtggaatggattgtgtcatctggagacaacttattattctgtttaatgatagatcaatggataggaataaaattcctgaaaataaatgttgctttgagacttgtgcatttcaacccataaagaaaattcacaatctgtattgtcatgaaattgtggcagtagcaacccttgttagactgtgagactgcaagtgggagaatgcgatttgcgatggtcggtgggagaatgcaatttgcgacggggtgggataatttgtggttgaagcagcggcaacccctaccagggttgtggccggcacggaatattgggaggggtgcggaattcaggcaaaggagcagtgcagtgccgcaaatgcaatatctattctatgatgattattgctttgaaattataacactttgcttggaatatcaacactttgctgcaacaaccttactcttgttgtcggtatacaatctctacaaatatgccatcaaatattttagtttcaggcggagcaagtaattgcccaacatgg

SEQ ID NO: 5854 - DNA, 1283 bp, Trifolium pratense
atactcactcactccttcttctcaatcttttcataatcttcgctctttgaaattcaatttcttcttctccgatcggaaaatgagttccaccggtactaccaagggcggaagaggcaagccaaaggctgccaaatcagtttctagatcatctaaagccggtcttcaatttcccgtcggaagaatcgcaagattcctcaaggctggtaaatacgccgaacgtgtcggtgccggtgctccggtctatctctccgccgtccttgagtatctcgctgctgaggttttggaattggctggtaacgctgctagggataacaagaagaatcgtattgttccaagacacattcaacttgcagtaaggaacgatgaagaacttagcaagcttttgggttctgtaaccatcgctaatggtggtgttttgcctaatattaatcaggttttgctccctaagaagactggaaagggaaaagacgatattggatctgcttctcaagaattttagggtttatgtgttctgttctgaatagatcttaattttgttatattgcagtggtaacggaacatacatgtttaattgattattaactgcttcaattttataaggacaaaggtttattaatcgattcacttgtttctatcaagttaagaaaaattattagtgttatgcctctgtcttttcgcatctgaaactatccttgaagtgttcatcacaaaaatcacgtgttagataaaacaaatgtttaaactaggactaagtcttcaaatttaagtggaatggattgtgtcatctggagacaacttattattctgtttaatgatagatcaatggataggaataaaattcctgaaaataaatgttgctttgagacttgtgcatttcaacccataaagaaaattcacaatctgtattgtcatgaaattgtggcagtagcaacccttgttagactgtgagactgcaagtgggagaatgcgatttgcgatggtcggtgggagaatgcaatttgcgacggggtgggataatttgtggttgaagcagcggcaacccctaccagggttgtggccggcacggaatattgggaggggtgcggaattcaggcaaaggagcagtgcagtgccgcaaatgcaatatctattctatgatgattattgctttgaaattataacactttgcttggaatatcaacactttgctgcaacaaccttactcttgttgtcggtatacaatctctacaaatatgccatcaaatattttagtttcaggcggagcaagtaattgcccaacatgg

SEQ ID NO: 5855 - DNA, 1654 bp, Cocos nucifera
ggaaaaaggaaatagcgaggtcgctcgttctgatcccccgcttccgccttctgtgagggttagggtttccttttttacctcgatccaagaggaagatgagctccacggcatctaccaagggaggcaggggcaagcccaagtcctccaagtccgtctcccggtcccagaaggccggcctccagttccccgtcggccggatcgctcggttcctcaaggccggaaagtacgccgagcgcgtcggtgccggcgctcccgtctacctctctgccgttctcgagtaccttgccgcagaggttctggagttggctgggaatgcggcaagggacaacaagaagactaggattgttccgaggcacatacagcttgcggtgaggaatgatgaggaactgagcaagcttcttgggacggtgactattgctaatggtggtgttttgcctaatattcaccaaactctgctgcctaagaaggcggggaaggacaagggggagcttgggtctgcatcacaggagttctagatgtctaacaatctcaagataatttagtaaaggatgggtatatttttctttgggggttttatgccagtggtagtgataatttgatgtatgaattaggttaagtggttgcagtacctttttgtatgttgaatcaaactataccctttgctttataggatgaaaataagtcaagaagttgatatttttgtgttttttgggtatttggtgggtgcaaactgataattcaattttcgttgcttatttcttttaggtctttctggttcaaaatttgcttaatatcgtttcttttagttttgaatcatattgtttgatggataacatctgagctggtggtctaatttaatgccatgttgttgatgtttggtggcgtgggctttatcttgcctttttacccgttgaagccttaaagctaatgtttcttgtcttgaatccactgtggcgttgacttcggttgtttgccactggctttgtcttctggagtagtatgctacatgtatatttttctgtactcaatcaacatttgattgcgaatgcaccccctcgccctcgtcaatgtgtgtggttctgatgggagaaatcagtgatgttgctgatgttatcttcaggctgatatccagttaagccatttgcttatttggtgttggctctgtggttgaaatttactcttcttcttggaaaagaggagagataagaatgttcatttgtttcaaacacatttctttggttgtcttccaagatgtcatcttggtgagaatgtggggttggtgatttgttacagttgtgtgtcattgtgtgttaggctgagggtgctgtcagagctgtgaatttgtctgagtcatctatagtctttctcaagtctggttgtttgcagttgcaagttctacaacaagttgataaggacctgaggaagggaaatgagatgggagatctgtcccttgtcaaggatttcttgggggatgcttggggtcttcagtgctttgaagaagcaaagcatgctgctcatttggatctcccccgtctatgtgctttttcctagagactgtgccaggatttcttttgatgtgcatgcttgtcacattttaattttatgtgctggtctcttatcatttcaacctggacaattttggtctaattttatg

SEQ ID NO: 5856 - DNA, 758 bp, Cryptomeria japonica
gagaggcatctcctgtctgtaaactgcaccgaaaaagaaaatgagttctacaggaggcggaggacgagggaagagcaaagcaaccaaagcagtttcgcgctcacaaaaagcagggttgcaattccctgttggtcgaattgctcgctatctcaaggcggggaaatatgcagagcgcgtaggcgcaggggctcctgtctatatggctgccgttttagagtatctagccgccgaggttcttgagttggctggaaatgctgcacgggacaacaagaagaacaggatcgttcctagacacatccagttggctgttagaaatgatgaagagttgagtaagttactgggttctgtcacaattgccaatggaggcgtactgcccaatattcatggcgttctattgccgaaaaagcctgggaaggataagggagcagaaattggtagtgcctctcaggagttctaggctaagatagcttcaattttctattttttttggtttaggtagtcattagtgattacctctcttccagtgccataatttagcaaccttaatcaaattattcatgtgttttgaacctttatgactaaaacgcaagtttgttgtttggcagtttgagtaacaattttattaatgcattcaactattgaaccacatgtcatagatatttgggaagcccttttgtcttgaagtgaaaacaagagtaaacgaggtctaactttttttctttctgtgattgtttcttattacagtctagacttgacac

SEQ ID NO: 5857 - DNA, 688 bp, Eschscholzia californica
ctttccttcgctctctcaaaattatcgcttatcatcaaattagggttttcaaatatcttcttcaaccaaaccctagaaaatgagttcaggaggatcaaccaaaggtggaagaggaaagccaaaatcatcaaaatctgtatcaagatctcaaaaagctggtcttcaattccccgttggtagaatcgctaggtttctcaaagctggtaaatacgcagaacgtgttggtgctggtgctcctgtttatctttccgctgttcttgaatatcttgcagcagaggttcttgagcttgctggaaacgcagcgagagataacaagaagaatcggattgttccaagacatatacaactagcagtaagaaatgatgaagagttgagcaagcttttaggaacagtgacgatcgctaatggaggagttttaccaaatattcatcaaactctattgccaaagaaaatggggaaaggaaaaggcgaacttggatcggcttcacaagaattttagggtttttatatagtaaatgctttggaatgatgtgatatagttttgatcttctgaagttggattttgtattacatctggttccttgattttccctttctttcttctcggatgttccgactcaagaaaacaatagtttctggtgttctgcagtatattgatcttgatataatgaaaagtttcagttgccct

SEQ ID NO: 5858 - DNA, 936 bp, Humulus lupulus
cacacccactctcacaactataggcttctctggactttttctacttcgatcagattccctagggtttatatttgcattttcatccggacactaaaaccctaaagatgagtacagccgcttcaaccaaaggaggcagaggcaagcctaagtcctccaaatctgtgtccaggtcttcgaaggccggtctccaatttcccgtcggccgaatcgcccgattccttaagaacggaaagtatgccgagagagtaggtgccggtgctccggtctacctatctgccgttcttgagtatctagccgctgaggttttggagctagctgggaacgctgcgagagacaacaagaagaaccgtatagtgccaaggcatatacagcttgctgtgagaaatgacgaggagttgagcaagcttttgggaactgttactattgctaatggcggtgttttgccaaacattcaccaaactctcttgcctaagaaagttgggaaaggaaagggtgattttggttctgcatcacaagagttctagtgtgggggatcttttatatggtttcatgtaggacatgggcggaagttgttgttttgaggataaagccttgttaaagattggctcttttccaccttcttggtgtcttgtaaacccaaattctgggcaatttattttgatggtttgaatatagaacaaagaaattcttctctttactatattgattcagtgctactataagttcacatacctatcttggtctcttgtttacctaaactctttctgcagcctctatctggctcggaaacttttctgttagccttttgttttcggactgagattaccggtcacattaactttttagtctttattcaaaaaatgacatttgagtcttttaaagtttaacaaaaaatgtataggcgccccattgtctgtggatggcatcggtatttcg

SEQ ID NO: 5859 - DNA, 799 bp, Elaeis guineensis
gatatagccctcctcccgtcgtcggcgctttttagggctagggtttcgtcggcacgatgagttcctcggcttcgacgaagggcggaagggggaagcctaagtcctccaaatccgtctcacggtctcagaaggccggccttcagtttcctgtcggccggatcgcccgcttcctcaaggccggcaagtacgcggagcgcgtcggcgccggcgcccccgtctatctctctgccgtccttgagtacctggccgctgaggttctggagctggctgggaacgctgcaagggacaacaagaagaacaggatcgtgccgaggcatatacagctcgcggtgaggaatgacgaggagctgagcaagcttttggggactgtcacgattgcaaatggtggcgttctgcccaatatccatcagactctgttgcctaagaagcagggcaaaggaaagggagagattggctccgcgtcgcaggagttttagatccttcttttctttttatcaaggtatcttgttataaatgtttgaagtagggtgactgttagtatatcttagggtgcttgtttgggaagtggtggtgctccttgatgtaatgagggcggatcgtgtcaataaatatggattttgaatacaatcatgatattcgtctttaaaaaaaaatattcttggggcttgaggcaagcctttttttcttgcttttgattgtaaatttctggcagaaagtcaacttaaaatatacaaaaaaaaaaaactaacagactacgtccaacggaacgacaccaagggaggtaaggtagccccccccc

SEQ ID NO: 5860 - DNA, 652 bp, Platanus occidentalis
aagagcttgagacctttctaaatcgtattgcagaaagcatttggttttgatctacacagaaaaacgcagaggcaaatgagttcttcagcgtcgaccaagggtgggagagggaagcccaaggcctccaaatcggtctccagatctcacaaggccggtctccaattccccgtcggaaggatcgccagattcctcaaagccggaaagtatgccgagcgtgtcggtgccggtgcgccggtctatctctctgccgtgctcgaataccttgcggccgaggtgcttgagcttgctggaaatgcggcaagagataacaaaaagaatcgtattgttccgaggcatatacagcttgcggtgaggaacgatgaggagttgagcaagcttctgggcaccgttacgatcgctaatggaggggttttgcccaacattcatcagactttgttgccgaagaagctcgggaaggggaaaggtgatggatctgcatcgcaagaattttaggtttaggcttttttttttttctcccaatcttagggaaagatgtgttttgatacggttctggatgggatctcttctgtactggtgttgaatttgtaatacacctttgatccgtaaatttttttatatcattttctcgttgtttcttatacacgaacgataa

SEQ ID NO: 5861 - DNA, 570 bp, Platanus occidentalis
ctttctaaatcgtattgcagagcatctggttttgatctacatagaaaacgcagaggccaatgagttcttcagcatcgacgaagggcgggagggggaagcccaaggcctccaaatcggtctccagatctcacaaggccggtctacaattccccgtcggaaggatcgccagattcctcaaagccggaaagtatgccgagcgcgtcggtgccggtgcgccggtttatctctctgctgttcttgaataccttgcggctgaggtgcttgagcttgctgggaatgcggcaagagataacaagaagaatcgtattgttccgaggcatatacagcttgcggtgaggaacgatgaggagttgagcaagcttctgggcactgttacgatcgctaatggaggggttttgccgaacattcatcagactttgttgccgaagaaggtcgggaaggggaaaggcgatggatctgcatcgcaagagttttaggtttaggtatttttttttttccgatcttagcgaaagatgtgtcttgatggcatctcttctgtactggtgttgaatttgtaatacctttgaatac

SEQ ID NO: 5862 - DNA, 807 bp, Primula obconica
tatatatatatatacagaaaccctaggaggcaagatgtcttcggaaggaacaacaaagggcggacgtggcaagccgaagtcggcgaaatcggtgtcgcgctcgtccaaagccggtctgcagtttcctgtcggtaggatcgctcggttccttaaagccggaaagtacgccgagcgtgtcggcgccggtgctcccgtctacctctctgccgttctcgagtatctcgctgccgaggtgttggagctagctgggaatgcagcaagggataacaaaaaaaacagaatagttccacgtcacattcagctggcagttcggaacgacgaggagctgagcaagctgttgggttctgtgaccattgctaacggtggtgttttgcccaacatccattcgactcttctccccagtaaagttggtaaaggcaaggccgatatcaactctgcttctcaggagttttagatgatacactactttggtggtcgagggccgtttgatgatatgataacataagagtttagtttctcatgatgtgtctcaatctatggataaagtacctaatgatgcagattttatgatggaatttaagttttatgttgaatggagcagctgagtttttatgacccttgccatgcttctctaaaaagttatttgttgagtaacttcattttgctacaaaattgtattagtccacttgatttttcaaaaggttgttgaatcatcagttctttgtactcttgtgattcaagataatcttatgtttaatttggactgccaaactccatataaccaactagataaatctctctggtgcc

SEQ ID NO: 5863 - DNA, 672 bp, Primula obconica
caagatgtcttcggaaggaacaacaaagggcggacgtggcaagccgaagtcggcgaaatcggtgtcgcgctcgtccaaagccggtctgcagtttcctgtcggtaggatcgctcggttccttaaagccggaaagtacgccgagcgtgtcggcgccggtgctcccgtctacctctctgccgttctcgagtatctcgctgccgaggtgttggagctagctgggaatgcagcaagggataacaaaaaaaacagaatagttccacgtcacattcagctggcagttcggaacgacgaggagctgagcaagctgttgggttctgtgaccattgctaacggtggtgttttgcccaacatccattcgactcttctccccagtaaagttggtaaaggcaaggccgatatcaactctgcttctcaggagttttagatgatacactactttggtggtcgagggccgtttgatgatatgataacataagagtttagtttctcatgatgtgtctcaatctatggataaagtacctaatgatgcagattttatgatggaatttaagttttatgttgaatggagcagctgagtttttatgacccttgccatgcttctctaaaaagttatttgttgagtaacttcattttgctacaaaattgtattagtccacttgatttttcaaaagg

SEQ ID NO: 5864 - DNA, 617 bp, Zostera marina
tttttttttccctccacgatttaacctagggtttccaaaactctcgatattctccgtccctcttagtatgagttcaccaggaataaccaagggcggccgtggaaagacgaagtctacaaagtctgtttcccgatcttcaaaggccggtctccagtttccggttggcaggatcgctaggtttcttaaagccgggaaatatgcagagcgcgtcggcgctggcgctcctgtttatttatctgctgttttagaatatctcgctgctgaggttttggaattagccggtaacgctgctagagataacaaaaagaatcgcattgttcctagacatatacagttggctgtaaggaatgatgaggaactgagtaaattacttggaactgtgaccatcgccaatggtggagttctcccaaatattcatcagaatcttttacctaagaaggctggaaagggaaagggcgaaatcggatctgcttcgcaggagttttagaattttcttgttagaagaaatgacgatcctttgctttctttcttcttatgtttgtacgcttatgatctgggtttccatcggttgccttttttgtttgatcgtttgttcaaacagaatgagaaatttcggt

SEQ ID NO: 5865 - DNA, 667 bp, Vaccinium corymbosum
gtgttcctccactatctctgtctagggtttccaatcaccaacacaaaatgagttctgcagcttcgaccaaaggaggcagaggcaagcccaagtcctccaaatctgtctctagatcttccaaggctggcctccagttccccgtcggtagaatcgcccgtttcctcaaggctggaaaatatgccgagcgtgtcggcgccggtgccccgttacctctccgccgtccttgaatacctcgctgccgaggtacttgaactagcggggaacgccgcgagggataacaagaagaatcggattgttccaaggcatatacagctggcggtgagaaacgacgaggagttgagtaagcttttggggaccgttacaattgcgaatggtggtgttttgccgaatattcatcagaatctgttgccgaagaaggttgggaaagggaagggtgagattggatctgcgtcacaggagttttagggttttgttgtctgtgagagatatatgaagttgagttgtcacatgtttgaaggatggagtagtttgtgtctgccttcttattatgatatgatgatcaatgtaaacccccattttgcggattgttattgaatataaaagcagttcaataaccccgttttgatcttgattgatacatcattatacatgagatgatattgtttgg

SEQ ID NO: 5866 - DNA, 614 bp, Trigonella foenum-graecum
atccgttctcgctttctcactcttctgatatccattttctcccaaattcaaggtttaggtttttcgatttcttctccgatccgaaaatgagttccacaggtacaaccaagggcggaaggggtaaaccaaagtccgccaaatcggtttccagatcttcaaaggccggtcttcaattcccagttggaagaatcgcaagattcctcaaggccggaaagtacgccgaacgtgttggtgccggtgctccggtctacctctctgcggtcctcgagtatctcgctgccgaggttttggaattggctgggaacgctgctcgggacaacaagaagaaccgaattgttccaaggcacattcagcttgcggtgaggaacgatgaggaactgagcaagcttttgggaactgtaaccattgctaatggtggtgttttgcccaatattcatcagacattgctcccaaagaaggttggaagggaaaggcgaaattggatctgcttctcaagaattttagggtttttgtattctgttctgaatagttatagtttatctttctgcagatgtagcataaatgttactccaatcatgaaaaggataatatttgaacaatgaattcgttggttt

SEQ ID NO: 5867 - DNA, 562 bp, Chelidonium majus
tccaatttctctctctaccgatagggtttcagacgaaacaagtttaacaaaatgagttctgcagcttcaaccaaaggtggccgtggaaaagccaaaatcatcaaaatctgtttcacgatctcagaaagccggtctccaattcccagtcggaaggatcgccagatttctcaaagccggtaaatatgctgaacgtgttggtgctggtgctcctgtttatctatccgccgttcttgagtatctcgcagcagaggttcttgagcttgccggaaatgctgcaagagataacaagaagaatcggattgttccgagacatatacagctagcggtgagaaacgatgaagagttgagcaaacttttaggaactgtgacgatcgctaatggaggagttttaccgaatattcatcagactttgttgccaaagaagatggggaaagggaaaggcgaacttggatctgcttcacaagagttttaggtttttgtaggaaagattttggtttaaatactcttattagggatgatgatgatgatgggatttcattttgatctatcgatgtagtagtat

SEQ ID NO: 5868 - DNA, 816 bp, Cryptomeria japonica
gctagctctcagagatttacacgcctcaatcgaaactttgctttttctcttttactgttgcattgatctctattgcaggacaaaaaggaaagaagagcatagctgttcgaactcgagacctgtcggtgccatttctaagcttttttttgaaaatctagggctgtaaaaatgagttcttcaggtgcaaagggcggccgtggaaaagccaagtcgacgaaatccgtttcgaggtctcagaaggcagggcttcagtttcctgttggaagaatcgcaaggtttcttaaggcagggaaatacgcagaacgtgtgggggcgggcgcacctgtttatcttgctgctgttcttgagtatctcgcagccgaggtcctggagcttgctggaaatgctgcccgagacaataaaaagaatcgtattgtacccaggcatattcagctagcagtgaggaatgatgaggagttaagtaaactgcttggtactgtaacaattgcaaatggaggagttttgccgaacatccaccaagttctcttgcctaagaaggctggaaaggataagggagatgttggatctgcttctcaagagttttgatctggtgacttgcatgatgttgaaagatattttaagaatcacttagtttgatcatgccaaactatgcattctcataaatgatttgtttttgggatgtagtggccatattttgtcaatttgaatttgttgactgtctcatggtcatgaagactattatgtcttgaaatgtattgaggataaagagcttgtcctatcttgaactttatcaatataatttaatttactctttgc

SEQ ID NO: 5869 - DNA, 841 bp, Cucurbita pepo
ttcttgaactcattgcgatatagattcaagtctctcgaaaaccccaaattagggttcttgattttcatctctcttctctccaaatccatcaattttttactccgattcaactatgagttccaccaagggcggtagaggaaagccgcaagccaccaaatccgttacacgatcgcataaagccggcctccagttccccgtcggtagaatcgcaaggtttctcaaggccggaaagtacgccgagcgtgtcggcgctggcgctccagtatatttgtcggccgttctcgagtatcttgccgccgaggttttggagcttgctggaaatgctgctagagacaacaagaagaatcgtattgtgccgaggcacatccaacttgctgtgaggaacgatgaggagttgagtaagcttttaggatctgtaaccattgctaatggaggtgttttgcccaatattcaccaaactcttttgcctaaaaaggtcggcaaagataagggtgatatcggttctgcatcacaggaattttagggcttataggattttcagtgcttgcttgtattgcatttgttgtgttctctgcgttgtatcatcttgattttgtttagatgcatacgtttttacatctatgcaaggctgtttgttgttggaacatctttgcaacaaaattaacaaaattttgtctacatttacacaaatttgcaacttaaaaaaaaacaaaaaagaaactccgtctcggtggtagtactacctagcgttctcgtagacggtacgtccgaacggacggactacacgggtagggtagagcatctgcgtgacgactcgttctccgttctctatggcgtgtcc

SEQ ID NO: 5870 - DNA, 885 bp, Pseudotsuga menziesii
ttttgtgagagtccgaagggtttcaggcacactcgagggtttgttttcaatctctgctgtaatccgcttgcggagtctgagcatttcgtgagatttagttcctgcgtttgaatcgctgcaaacatgagttcctctgctgcaaagggcggtcgtgggaaggcaaagtccacaaagtccgtgtccaggtcgcagaaggccggtctgcagttcccggtgggaagaatcgccaggtttcttaaggctggaaagtatgcagaacgtgttggggctggtgctcctgtgtatctcgctgctgttcttgaatatctcgcggccgaggttttggaactcgctggtaatgctgccagggataacaagaagaatcgtatagttccaaggcacattcagcttgctgttcggaatgatgaggagctgagcaagttgctgggtgctgtaaccattgccaatggaggagtcctaccgaatattcaccaggttctgttgcctaagaaatctggaaaagacaagggcgagattggatctgcttcccaagagttctaatctggtccgtgtttatggttgagcgagctagcagtatttttgatctatttgtaaatgattaatgggggtaatcctatttggcaagcatttgatgctatcttttctttgaactggtggatttatttgttcaatgcgaacttcattggtgtttcttgatgaacctatatacaagattagtgctttcttggcgccttgtcaaatttcacccctgcacttctcaatgataattatggtggttgtgggctgttctaaaatagtgctttaatcacatgtttggattcactgttctcggtttattaatggttttttcttaatctaatgagagttgcgaagtttagtagcaaa

SEQ ID NO: 5871 - DNA, 728 bp, Amaranthus tuberculatus
aaccctcgcctctctcccttctcacaccaaccttcttttttcccacacactctctctcttagggttcaggtaaaaaacaacaatgagtggcaaagatggttctggatctaccaaaggaggacgcggaaaacctaaatcttcgaaatcggtttctagatcttccaaggctggtctacagtttcctgttggtagaatcgcaaggtttctgaaggctggaaagtatgctgagcgtgttggtgctggtgctcctgtttatctctctgctgttctcgagtatctcgctgctgaggtgttggagctggctggaaatgcagcgagagacaacaagaagaacagaatagtaccgcgtcacattcaattagcagtaaggaacgatgaagagttgagcaagttattggggcaagtaacaattgccaatggcggtgtgttgccgaatattcatcagactcttttgcccaagaagcaaggtggtggtggtaaaggagatattggttctgcttctcaggaattctaaaatcttctcagatgtacgtaaaatgatgattaagatgtagtttaatggggctctagcgtgatctctttcttccaatcttgtttcatatatagcttcaacctgcaagggaatatagaatagaatgaactccatttgtgatggaactgtggaattttgatctcggtattttgttttttaattggaattctgtgaattagtcgtgggaggcaaggca

SEQ ID NO: 5872 - DNA, 1409 bp, Triphysaria pusilla
ctaaaactcttgagaagcagatccaatctccttatcctttcctcctgctttcttcggcaacaaagtttgatgaatattaggcaaaactccaccattcgcaatagttacacatcccaacagcttactcaactcttcatcattcctcacagccaattgaatatgcctgggcacaatcctattcttcttattatccctagcagcattaccagcaagttccaaaacctcggcggcgaggtattcgagaacagcagaaaggtaaaccggggcaccggcgccgacgcgttcagcatatttaccggctttaaggaaacgcgcgattctaccgacggggaactgtaggccggcctttgacgaacgagaaacggatttcgtggctttgggcttgcctcggccgcctttcgtggaggttgcgtctttggaactcattttccggtgatgtgatcggtgatttagaaaccctagatgtgttagatttgggattttacaggaatttgaactgactgtgggttttagttttatttgaagagctgctacttgcctgccgccgttctagagaaatcagttagagatggcagtgcatgacggtcgacgaggaggcgatgacggcgaggcagccctattcgaggaagaaggcgttgacatcacggatgaggaagacagcgactccgaaatccctctccaccttcgccccctcgtctccgccgcggagtccggcgacctaaatgccctacgcgtagcacttgacaatttcgatggcaacataaacgagccaatggaagatggtgacactcttcttcatctcacatgtctctatggccacttgaactgtgtccagtttttgttagaaaggggagctaacttggaggcaaaggatgaagatggaggaattgcactgcacgatgcctgtgctggaggttatacagaaatagcccaacttcttctaagctcggctaatgatccagagtgcgtcaagagaatgctcgaaactgttgatatggaaggggactcgcctcttcatcatgctgctagaggtgaatttgctgatgtcataaggttgttacttgcttatggggcctctttaaatttggcaaatctctacgggaagactccaactgaactggcttatcctggaactgaagcgagaaggatattggaagaggctacaggtgctgtgcttaaccattagtgtggccttgaaaatattgactttgatttcgggatattatcaatttatattctatcgttatttcgtagggtgattgaaagattctatgaaaggacctttaaagattagggtgtgtgacttagtaaattaaaatttactaaagtctttaagcaccttcaagtagatctattgtttcgtattcttttccgttgcgttagttctgaaattaaaaaaaaaaaaaaaa

SEQ ID NO: 5873 - DNA, 622 bp, Arabidopsis thaliana
aaatcactccactcacaaaatcctcagccatctctaatcacattttacaatcgcctcttcaaatttcccgataaacaaaaaatgagttccggcgccggcagtggaacaactaaaggtggcagaggaaagccaaaagctacaaagtccgtctctcgatcttctaaagctggtcttcaatttcccgttggaagaatcgctagattccttaaagccggtaaatacgccgaacgtgttggtgccggtgctcccgtttatctctccgccgttctcgaatacctcgccgctgaggtattggagctagctggaaatgcagcaagagataacaagaagacacgtatcgtaccacggcacattcagcttgcagtgaggaacgatgaagagcttagtaaacttcttggaagtgtaacaattgctaatggaggagttttgcccaacattcatcagactcttctcccatcaaaggttggaaagaacaaaggcgatatcggatctgcttctcaagagttttaattttattttttagcttgtaacatagacatggctctctgttccacaatagttttggtattttcatgttactcaaaaactgtgtttgcaaatccagtaatgaattcggtttgaa

SEQ ID NO: 5874 - DNA, 967 bp, Mimulus guttatus
acccaaacacaatcaaaattcgtctctctctctctctcgctaaatctagggtttcttcaatttcgaatcgcgcagccggaaaatgagctcccctgcagcggcgtcgacgaaaggcggcagaggcaagcctaaatcctcgaaatccgtgtctcgttcgtcgaaagccggccttcaatttcccgtcggcagaatcgcacgttttctcaaggccggtaaatacgccgagcgtgtcggcgccggcgctccggtgtatctctccgccgttctggagtacctcgccgctgaggttttggagcttgctgggaatgcagcacgtgacaacaagaagaacagaattgtgccgaggcacatacagttagctgtgaggaacgatgaggaattgagcaagctgttggggcacgtgacaattgcaaatggcggcgtgttgccgaatattcaccagaatttgttgcccaagaaagctggtggaagggacaaagagattggatctgcatctcaggaattttagggtttttaatcgaaatttagtcatcgttacgggcggcttatgttggttggcaagggtttggagtttagaaccctaattttggtttttgttgggattatgtacagtagtgttaacgacaatcgagggtatccttcttcgtttatggtaatgcctaatttcgtttcggtttttgatgcttcagtttgatgttgtcgaatgtcaatgcatttgtgactgaaaaaagctatgaaaagctcttctggtttgtgcttagtgagcaatattcgtatctttaaacatatttgtcgattttaattcgattgaggctgctcttggtaaatgatgtaactgaggtattctgcaggttgactgcctaatggtgatgactgatgaggttttgctttacataatttcaaacaaaatatttaaagtttgttgattgatattcgaaaaatatagaataaaataaaaaaaatgaga

SEQ ID NO: 5875 - DNA, 852 bp, Mimulus guttatus
atccgtgaaataagtcatcagtccttttcatctagatacagccccttcagaaatttagggtttttcgatcgccggaataacatttcagaatgagttccaccgccgcagccaccaaaaaaggcggtagaggcaagcctaaatcctccaaatccgtttcccgttcctccaaggccggcctccaatttcccgtcggcagaatcgctcgttttctgaaagccggtaaatatgccgagcgtgtcggtgccggcgcccctgtttacctcgccgccgttctcgagtatctcgccgctgaagttttggagcttgctgggaatgcggcgagggacaacaagaagaacaggattgtgccacgtcacattcagttggctgtgaggaacgatgaggaattaagcaagctgctgggtgctgtgactattgcaaacggcggcgttttaccaaacattcaccaaactttgctgcccaagaaaaccgggggaagagataaagaaattggctcggcttcacaagaattttagtaattttctcattatttaggttgtttggttaattgatggtatacttgatcaagtgttgatcagcggtttcacccccatgatttttgaattcctttcgtattcagataatagttttgatgaatcagaatttattctgttctatctgtatggtgaaatttcgtttttataatagtctttgattttttgggtgcttgcattactggaatttttcggcgattgtatgaatcaactcgttgtctttgcgattctgtttgaagatgatggaaacttaaacacaacagcattgtttgcttgtacagtccatatttatgtgtttgatctcttctattacagtatg

SEQ ID NO: 5876 - DNA, 732 bp, Nicotiana benthamiana
tcagtatcacatttccccaccatttcccccttctcgctgcactttcaaatctagggttacgctcagggttttcgtacctttgcaaagagaacaatgagttcaggtggaggagcaggtaagggcggcgccggaagaggtaaaccaaaggcgtcgaaatcggtttctcgatcttcaaaagccggtcttcagttccccgttggtaggatcgcccgttttcttaaggctggaaagtatgctgaacgtgtcggtgctggtgctccagtgtacctttctgctgtccttgaatatctcgctgctgaggtgttggagttggcaggtaatgcagcaagggacaacaagaagaatcgtatagtgccaaggcacattcagttggctgtgaggaatgatgaggagctgagcaagcttttgggtcaagttactattgccaatggaggtgttttgcccaacattcaccagaatcttttgcctaagaaagctggctctgggaagggtgatattggctctgcatcccaggagttttagatgtaaaaatgaagcttttgttttcctaaaggattaggggaaatgagtagacttcctttatgtaatatataaaaataccctttctagtttgttattgaatggttataaatgaaaaagggctataactacccgcagttttgtttacagatctttttagttctggaaattgcaattctatgcatttctttgtgaatgacaacttgtctgatt

SEQ ID NO: 5877 - DNA, 643 bp, Nicotiana benthamiana
acatttcccactgtttcccccttctcgctgcactttcaaatctagggttacgcttagggttttcgtacctttgtaaaaagaacaatgagttcaggtggaggagcaggtaagggcggcgccggaagaggaaaaccaaaggcgtctaaatcggtttctcgatcatcaaaagccggtcttcagttccccgttggtaggatcgcccgtttccttaaggctggaaagtatgctgaacgtgtcggtgctggtgctccagtgtacctttctgctgtccttgaatatctcgctgctgaggtgttggagttggcagggaatgcagcaagggacaacaagaagaatcgtatagtgccaaggcacattcagttggctgtgaggaatgatgaggagctgagcaagcttttgggtcatgttactattgccaatggaggtgttctgcccaacattcaccagaatcttttgcctaagaaagctggctctggaaagggtgatattggctctgcatcccaggagttttagatgtaaaaatggagcgtttgttttcctgaaggattaggagaaatgagtgccctttgtagtttgttattgaatggttataaatgaatggttataaatgaaaaagggctataactacccgcagttttgatta

SEQ ID NO: 5878 - DNA, 621 bp, Orobanche aegyptiaca
aaatcattctcaaaaaagacttaggttttccgattcagtatccccaagcaaagccggaaaaaatgagttctaaagcagcggcgactaccaaaggcggcagaggcaagcctaagacatccaaatccgtctcccgttcgtcgaaggctggattgcagtttcccgtcggtagaatcgcgaggtttttgaaggccgggaaatacgccgaacgtgtcggcgccggagctccggtttacttagccgccgtccttgaatacttggccgctgaggttttggagcttgctggaaacgcagcaagggataacaagaagaacaggatagtgccacgtcacatacaattggctgttcggaatgatgaggaattaagcaagttgttggggactgttacaatagcaaacggcggcgttttgccaaacattcatcagactctgttaccgaagaaaactggtggcaaggataaggagattggctctgcttcacaggagttttagttctttttattattcataattagttagatttagatgtgttggttgaattttgtatggagtttggatcaactgtgttatcttaatgtttggaagaaccctaattttgggttggtatgaatatataaatgttgtt

SEQ ID NO: 5879 - DNA, 1049 bp, Populus trichocarpa
ctctcatttcttctccactctctaggaccaaaactagggttagggttttacagcgttgtattttggtaaaatcatttgatttgaagatgagttcgaaggaaggaggcgcgtctactaagggaggaagaggtaaaccaaaggcatctaagtccgtgtcgagatcacagaaagcagggttgcaatttccagtagggaggattgctaggttcttgaaggctggtaaatatgctgaacgtgttggtgctggtgctcctgtctatctcgccgctgtcctcgagtatctcgctgccgaggtgcttgagttagctgggaatgcagcgagagataataagaagaatcgtatagtgccaaggcacattcagcttgcagtaaggaacgacgaggaattaagcaagctattggggtcagttacaattgctaatggaggtgttttgcctaatattcaccagacacttcttcccaagaagatgggcaaaggaaagggtgacattggatctgcttctcaggagttttaggctttgatatggcctgtatttttttgggtgttattagggtttccacagtctgtattatattctttttgatgtcctggctacgtggggttttactctgctgtatgtttttggtaaagctgaggctttttggaatctacatctaatggaactgctcttttctcgttttaaatgctcctcttctgctgcgatgattgtttggaaagccctatgacttgtgggcaagcaattcatagttttacaacatagtttcttcagtccttcatcattacagaagccagcttcccgtgtcatagcctatacaaatcgggatctagcttcgagatgacgattcaagataaagacagtgtttagtgtgaaagtttgcttccctctctgagaggtccaaccatttctctgctcatcaagctgttgcataattgcaaaatagtaataaagaatccagcctgaccttcgcaacttcagaatgaaggccttctgagcttccaaaagccaggtgctctgccacaaatcctcgtaatattatgcaagaaaaca

SEQ ID NO: 5880 - DNA, 674 bp, Sesamum indicum
gtaggatctctccgctccaaatctgtgcagattacggtttcctgtaatttctagggtttttgaatcgctactaactgtattgggagatgagttccgccgccgccgcagcaaccaaaggtggcagaggcaagcctaagtcctccaaatctgtttcgcgttcctccaaggctggcctccagtttcccgtcggcagaatcgctcgttttcttaaagccggtaaatatgctgagcgtgttggtgccggtgcaccagtgtatctctctgctgttctggaatacctcgctgctgaggttttggagcttgctggaaatgcggcgagggacaataagaagaacaggattgtgcccagacacatacaattggcggtgaggaatgatgaggaattaagcaagctgttgggcaatgtgacaattgctaatggtggtgttctgccgaacattcaccagaatttgttgcctaaaaaggctggaggaagggacaaagagattggctctgcgtctcaagagttttaggacttttgccgttaattagacggctggattgatgggtatactttgtaaagggttggatcattttttcgtttgtgatgaagtttggtccttgtcaaacccggattctgctttggtggaatgaatgataatctcttccttcgttctttctaaatatctgcagcc

SEQ ID NO: 5881 - DNA, 626 bp, Helianthus annuus
cattctcttccactagggtttatcattcatcatcaagatccatcacattcaacaaaatgagttccaaaggcgataccgattctaagaaaggcggcagaggcaagtccaaggccacgaaatcagtctcccgatcttccaaagccggtctccagttccccgtcggcaggattgctagattcctcaaagccggaaagtatgcggagcgtgtcggtgccggagcccctgtttatctgtcggcggtcctcgaataccttgccgctgaggttttggagttagcgggaaatgctgcaagggataacaagaaaagcagaatagttccaaggcacatacaattagcggtaaggaatgatgaagaactgagcaagttgttgggttcggtgacgattgcaaacggtggtgttttacccaacattcatcagactttgctaccacataaggttggcaaggataaaggagatattggttctgcttctcaggagttttagagacagatttttctgtttcgtaatcaactttattttgtctgcattttgcttacagtattttgtaaaaatgatgttcactttggcatttgaagttgttatgatggttatgcctaatcgggtttcggcaatataaacaatttt

SEQ ID NO: 5882 - DNA, 664 bp, Eutrema halophilum
aaatcactccactcaccgttctctagccattttcattcgcctcttcaatttctctcgaaaaaaagtatctttcgaagaagaagatgagttctggcgccggaagtggaacaaccaaaggaggcagaggaaagccgaaagctacaaagtccgtctctagatcgagcaaagctggtcttcagtttcccgttggaagaatcgcccgattccttaaagccggaaagtacgccgagcgtgtcggtgccggagctccggtttatctctccgccgttcttgagtacctcgccgcggaggtattggagcttgctggaaatgcagcaagagataacaagaagacacgtatcgtgccaagacacattcaacttgcagtgcggaacgatgaagagctgagtaagcttcttggaagtgtgacaatcgctaatggaggagttttgccaaacattcatcagacacttctcccatcaaaggttgggaagaacaaaggcgatatcggatctgcttctcaggagttttgattcttcatgtattactatcttgttcaattttagcctgtaaaatagactgggttttgttccaagaagatttttgggatctcatgtggtttgaagtctatgtttgcaaatctagtaacgaatttggtttgggatcaagtcaagtgctgttaaat

SEQ ID NO: 5883 - DNA, 622 bp, Eutrema parvulum
aaagcactttactcaccatttctcattcgcctcttcgattccccaaagagaatctttcgacgacgaagatgagttctggcgccggaagtggaacaaccaaaggaggcagaggaaagccgaaagctacaaagtccgtctctagatcgagcaaagccggtcttcagtttcccgtcggaagaatcgctagattccttaaagccggaaaatacgccgaacgtgtcggtgccggagctccggtttatctctccgccgttcttgagtacctcgccgctgaggtattggagcttgctggaaatgcagcaagagataacaagaaaacacgtatcgtaccaagacacattcaacttgcagtaaggaacgatgaagaacttagcaagcttcttggatgtgttacaatcgctaatggaggagtattgcctaacattcatcaaacacttctcccatcaaagagtggaaagaacaaaggagatattggatcagcttctcaagagttttgattctttatatttcacattgatgacccttcttgttgaactttagcttgtaaaatagactggtctctgtttcagaagagtttttgggtcttatatggtttgcaaatctggtaatgaatttggttcgg

SEQ ID NO: 5884 - DNA, 719 bp, Triphysaria pusilla
tcagttcgaattcctgtaaaatcccaaatctcaaacttctagggtttccaaatcaccaatcaaatcgccgataatgagttccaaagacgcagcctccaccaaaggcggccgaggcaagccaaaagccacaaaatccgtttcccgttcgtcaaaagcaggcctgcagttccccgttggtagaatcgcacgtttccttaaagccggtaaatacgctgagcgcgtcggcgccggtgctccggtttacctttctgccgttctcgagtatctcgccgcagaggttttggaacttgctggtaatgctgcgagggataataagaagactaggattgtgcccaggcatattcaattggctgtgaggaatgatgaggagttaagtaagctgctgggatgtgtaactattgctaatggtggagttttgcctaacattcaccaaactttgttgccgaagaaagtgggagggaaggataaggagattggatctgcttctcaagagttttagatttgctttgctctttgtttaagttatttgattagtcggtgtgccatgtaaagggttggctcttttgtttatttaatgatgctgttgatctatgtaaaccctaattttggaacttgaattacaaataatgggtttggtagaaaaaaaaaaaaaaaaaaaaaaaaacaaaaaaaaaaaaaaaaaaaacaaaaaaaaaaaaaaaaactaaaaaaaacgagaa

SEQ ID NO: 5885 - DNA, 587 bp, Acacia harpophylla
gattgcgctttgaattcaagacattcccctctgcaaatactagggttaggttcgaccgaagtgaaacatgagttctgccggtggtacgactaaaggtggcaggggcaagcctaaggccactaagtcagtatcaaagtcgcagaaggccggccttcagttccccgtcggaaggatcgctcgcttcctcaaggctggcaagtacgccgagcgtgtcggtgctggggctcccgtctatctctctgctgtcctcgagtaccttgctgctgaggtacttgagctcgctgggaacgctgccagagacaataagaagaaccgtattgttccgaggcacattcagcttgcagtgaggaatgacgaagagcttagcaagcttttggggtctgtgaccatcgccaatggaggtgtcttgcctaatattcaccaaactttgcttcctaagaaggctggtcaagggaagggcgaaattggttctgcctctcaagaattttagattttgttgtaattataaagcatatgtttgggttgctttttccttgttataatacttaacctcgagtaaattcaagcaaaaaaaaaaaaaaaaaggc

SEQ ID NO: 5886 - DNA, 810 bp, Amborella trichopoda
ataacccaacgatcagcgcctcatctcctttctctgttaccaagcaaacacaaacactaatctccttagcgtctctggtttcctccgtagagtagagaaagaaagaatgagttcctcagctggtggtggaaagggcgggagggggaagcccaaggcctcgaaatcggtatctaggtctcagaaggccggcctccagttccctgtgggaaggatcgctaggtttttaaaggctggcaaatatgcggagagggttggtgctggtgctcctgtctatcttgctgctgtactggaatacttggctgctgaggtgttggagcttgctgggaatgcagcgagggacaacaagaagaataggatagttccgcggcacattcagttggcggtgaggaatgatgaggagctcagcaagttgctcggcactgtcaccattgcaaatggaggagtgttgcctaacatccatcagatgctgttgccaaagaaggctgggaaggagaagggtggccctggctctgcttctcaggagttctgaagttctgtttttttttttttggcaaaatgtgagggggttttggacatcatcgttccccctatcatggatcacttaaagctctgtatttttttccccttctcttttggactttttatgcggcttttgccctttgttttatgtacatccagagcataagaatgaattgaatggaatacatttctgccccattcaggtgttgcggattcttttttcttgtttctaatcgatctcacatttagaggtgttattcctggattaatactcatgtgaataaacctttt

SEQ ID NO: 5887 - DNA, 1001 bp, Malus domestica
gttcaaagaaaaacaaggcctaataaagttataaggaccaaatcgacagtatgtaaaacttaggtggggcagggggggaatatggcaaaatacaccgacgaaagaaaaagcccgcgaaacgagaaggccttagcggtggacagtgaagaacaaatatttcattcccgccgaatttccacaccgggtgcctcgctggcgatccgtgcgcttaccctctcgaccaatcagatcacaccgtcgcctcctataattccctaaccccactcgcgtttcgtcttcacaagcactcctctgtctcgcgcatacttctctgtcgccaaagattcgatctttttctagggttagggtttctccgttcccaatttctgtgattccgtcgccgattctcggaaaatgagtgccaaagaaggagcgtcgaccaagggaggcagaggcaagccgaaggcctcgaagtctgtgtcgaggtcgcataaggccggtcttcaatttccggtgggtaggatcgcccgattcctcaagtctggaaagtacgccgagcgtgtcggtgccggcgcgcctgtgtatctctccgccgtcctcgaatacctcgccgctgaggtgttggagcttgctggaaatgctgcgagggacaacaagaagaaccgcattgtaccaaggcacatccagcttgcggttcggaacgacgaggagctaagcaagctgttgggggcagtgaccattgccaatggaggagtgttgccaaatatccaccaaaccctcttgcctaagaaggtcggaaaaggcaagggcgatatcggatccgcctctcaggagttctagctctctctcctttgtggtatagcgatgctgattagtcaccgcagttgtataatatgatggttttcgtttttgctgtttttagtagaccttgtgatgtttagtgcttgtaatttctatgatataatgaaatgtttgtgatagacctttgataaaaaaaaataaatgaaaatggtttgaaaatt

SEQ ID NO: 5888 - DNA, 970 bp, Cannabis sativa
aaattgctgtcgttttcgattcttgatcgaggatatgagttctgctgctgccggttcaactaagggcggtagaggcaagccaaaggcctcaaagtccgtgtcgaggtcgcagaaggcggggctccagttcccggtcggtaggatcgctagatttttgaaggttggaaagtatgccgaacgtgtcggcgctggagctccggtttatctttctgctgttctcgaatacctcgcagctgaggttttggagcttgccggtaacgctgcgagagataacaagaaaaatcgcattgtgccgaggcatattcaattagcagtgagaaacgacgaggagttgagcaaacttttgggttctgttactattgccaatggtggtgttttacccaatattcaccaaacccttttgcctaagaaggttggcaaaggaaagggggagattggctctgcttcccaagagttttagagtcttatgttcatcggagcaggttagcttgtcaaggcgaaaaacattagagaaattggatgaagagctgaccaagggggatgacaaggcagcactttcattggtcaaagctttgcaaggcaagcctggtggactgcgttgttttggtgctgctagataccccaaaggctttacactttggatgagctcaagctaaatggaatagaagctgcatctcttctttctccagtggatactactcttggtgccatagaaagaaatcttcagcttgctgctgttctgggaggtgtttctgcctggaatgtctttagttttaccccccagcaacttttctatatttctctaggattgttgttcctgtggacttttgactcggtaacttcctcatgcttgtttagaaatatgtcttcaagatctttaatctcatgtcaaatcagacccttcaaccatattacgatttacagttttataaaaagggcataaattgactaatcagattgttatcatttg

SEQ ID NO: 5889 - DNA, 631 bp, Ricinus communis
tcgaatcaaaggaaaaaagaaataaattagggttagggctttgtaagaaaaagaaagatgagttcaacaggaggatcaaccaagggaggaagaggaaagccaaaggcttcaaagtccgtgtccaggtcacagaaggctggattgcagtttcctgttggtagaattgctagatttctcaaggctggaaaatacgccgagcgtgtcggtgccggagctcccgtctatctctctgctgtcctcgagtatctcgctgctgaggtattggaattggctgggaatgcagcgagagataataagaagaatagaatagtgccaaggcatatacagttagcagtgaggaatgatgaagaattgagtaagctgttgggatctgttactattgccaatggtggtgttttgcctaacattcaccagacgttgcttcctaagaagatcgggaaaggcaaaggagatatgaattctctttctcaggagttttagtgtttttgttttgttttgttttctatgctaggggttttattagttgtaacatatgcttctcatttttggggttctttttccttgtcctggatcttcaagcaatattatgattacttatgatttgagtgaagtagctttttaatcaatagac

SEQ ID NO: 5890 - DNA, 636 bp, Cyclamen graecum
atctctctctcttagggttccgatgagttcaacaaccaaaggcggcggcggcggcaggggcaaaccgaagtccgccaaatcggtctccagatctagcaaggccggcctccagttccccgtcggcaggatcgcgaggttcctcaaggccgggaagtatgcggagcgtgtcggagctggggcacctgtatacctctcagcagtcctcgagtacctcgcagctgaggtacttgaactggctggaaatgctgctagggataacaagaagaaccgtatagtcccgaggcacatacagcttgctgttaggaatgatgaggagttgagcaagcttttgggggctgtgacaattgctaatggcggtgttttgcctaatattcatcagaatctgttgccaccgaagactgggaaggggaagggtaacatgggctctgaatcgcaagagttttaacgtatcggcatattatgatgatataatcaatggggtttaaatggaaggagaggggacccttgttactttcgtgttgtcctttggcattttgagagattttgatctgtgtaatctttgtttccagtatttggcagttgatataaatgcttgttgggggtatgtaagctttcaaatttcaatgataaaatgct

SEQ ID NO: 5891 - DNA, 726 bp, Fagopyrum esculentum
taccctaccctctgttttggctggcgctactctctcgtcaatttcaatcgattcatctctttagggtttttgcgttaaaatcgtgaaaatgagcaacaaagaagccggatctgccaagggcggccgtggcaagccaaagtcatccaaatcagtttccagatcctcaaaggccggtctccagtttccggttggtcgaattgctaggtttctcaaagccggaaagtatgctgagcgtgtcggcgccggagctccggtgtatctctctgctgtcctcgaataccttgctgccgaggttttggagttggctgggaacgctgctagagacaacaagaagaatagaattgttcctcgtcacgtacagcttgcagtgaggaatgacgaagaactgagtaaattgcttggatgtgtaactattgcaaatggaggtgttcttcccaatattcatcagactcttttgcccaagaagaccggccatggaaagggagatataggctctgcttctcaagagttttagattgcttttacatttatcgttttcattgtacatgcagaaggtggtaacagttttgttgggcgttgccgggggtttgattttgtaatcttgttttacagtgaatggatatttaaagtcttcatgcttcactagattgtcctttttaaatttggctgctcagttatcatctgtacaaactcgcttttgttcatttcgatttttgtagctctgtt

SEQ ID NO: 5892 - DNA, 621 bp, Fagopyrum esculentum
gtaccggggaccctacttccgccttcaccctctgttttcgctactctctcgcctaatttcaattgattcatctctctagggttttttttgcgagtgaaaatgagcaacaaagaagtcggatctaacaagggcggccgtggcaagccaaagtcatccaaatcagtttccagatcctcaaaggccggtctccagtttccggttggtcgaatcgctaggtttctcaaggccggaaagtatgctgagcgtgtcggcgccggagctccagtctacctctctgctgttcttgaataccttgctgccgaggttttggagttggctggtaacgctgctagagacaacaagaagaataggattgttcctcgtcacatacagcttgcagtgaggaacgacgaagaactgagcaaattgcttggatgtgtaactattgcaaatggaggtgttcttcccaacattcatcagactcttttgccgaagaaatcgggccatgggaagggagatatcggctctgcttctcaagagttttagattgcttttacgtttatcgtttcaatgtacacgggaagggcaattattatataactctttgaataaattaagtttttatatacatacaaattatga

SEQ ID NO: 5893 - DNA, 672 bp, Linum usitatissimum
gtctccgaaaccaattcccaattgcatttcttccccaaattctctgcaaccaatcctaaggttagggttccttgaatttgcagatccgaattaacaacaacaaaaaatgagttcagccgccgctggatcaaccaagggaggccgaggcaagggcaaaaccaccaaatccgtctccagatcctctaaggccggattgcagttccccgtcggtagaatcgccaggttcctcaaggccggcaagtacgctgagcgcgtcggcgccggtgctcccgtctacctctccgccgtcctcgagtacctcgccgctgaggttctggagctggccggaaacgctgcgagagacaacaagaagaacaggatcgtcccacggcacatccagttggcggtgaggaacgacgaggagctgagcaagctgcttggatcagtgacgatcgccaacggaggtgttctccccaacatccacaacactcttctgcccaagaaggctggaacgaaaggcgacatcggatctgcttcacaagagttttaagtttggttaatttggtaacgatttagtagaaaaagcttagaaccgtctttcttcttttgtgattctcctctatggttttgctgcttcggatctctccagatattgtaatataatgaaagctttcagtgaaatataagtggatt

SEQ ID NO: 5894 - DNA, 675 bp, Linum usitatissimum
gtctccgaaaccaatttccaattgcatttcttccccaaattctctgcaaccaatcctagggttagggttccgtgaattttacagatccgaatcagcaacaacaaagatgagttcagccgccgccggatcaaccaagggaggccgaggcaagggcaagaccactaaatccgtctccagatcctccaaggccggattgcagttccccgtcggaagaatcgccaggttcctcaaggccggcaagtacgccgagcgcgttggcgccggtgctcccgtctacctctccgccgtcctcgagtacctcgccgccgaggttctggagctggccggaaacgctgcgagagacaacaagaagaacaggatcgtccctcgccacatccaattggcggtgaggaacgacgaggagctgagcaagctgcttggatctgtgacgatcgccaacggaggtgttctccccaacatccacaacactcttctgcccaagaaggctggagcgaaaggcgacatcggatctgcttcacaagagttttaagtttggttaatttggtaacgatctagtagaaaaagcttagaacaactgtcttccttcttttgtgattctcctctatggttttgctgtttcggatctctccagatattgtaatataatcaaagctttcagtgaaatagaagtggatt

SEQ ID NO: 5895 - DNA, 783 bp, Linum usitatissimum
ggattccaatcgagttccaatttccctcgaccatctctgcaacaacagaaaaccaatccagagcctagggtttcgcgagatctatcgattcataccttcaaatcgcacaaatgagttccgccgcaggatcaacgaaaggaggcagaggcaaggccaaggcggcgaaatctgtatccagatcgtccaaggccggactgcagttccccgttggaaggatcgctaggttcctcaaagccgggaaatacgccgagcgtgttggcgccggtgcacccgtctacctctccgccgtcctcgagtacctcgccgcagaggtattggaacttgctggaaacgcggcgagggacaacaagaagaaccggatcgtgccgaggcacatccaattggcggtgaggaacgacgaggagctgagcaagcttttgggatcggtgacgatcgccaacggaggcgttcttcccaacatccacaacactctcctcccgaagaaggctggcgggaagggcgatatcggatttgcttcacaggagttttgaatttgtttcgttcaaatttccggttatcttacagtttcttcgctggtcttttgatcctagagcttttttcagtgatgtataaagccacccaaattttgcctccattccttcactgggaagttaaaatctttagcttatggataatcgaaacattccttgttctttgagcttgtctatctgtttatgactttgccattctgtttgttcttccgccatggattgcgttctttgaagagaatctgttctgcaatta

SEQ ID NO: 5896 - DNA, 713 bp, Actinidia deliciosa
ttactaaaaacgaggctttaaagctagggttagggtttgcagttctgcttcttcgatttgcagttgttcgatcgtgatctctgaagaaggaagaagatgagttcaggtggtgcttcgaccaagggcgggcgaggcaagcccaaggcctcgaaatccgtgtctcggtcccaaaaggccggtctccagttccctgtcggtaggatcgctcgcttcctaaaggccggaaaatatgccgagcgcgtcggcgccggagctccggtctacctctccgctgtcctcgaatacctcgccgctgaggtgttggagcttgctgggaatgcagcgagagacaacaagaagaacagaatagtgccaaggcacatacagctagccgtgaggaacgacgaggagctgagcaagctgttgggatcagtgaccattgccaatggaggggtgttgcctaacatccaccagactctgctccccaacaagcccggtaaaggcaagggcgagatcggttctgcttctcaggaattttagggtctctctctctctctctcgacttgaaatgactgtaatttccaatgtcttcatctcctttttgttgcgttttctcttctgtttttgtactagaattttagctcctttgggcaattgcccctacatgttttagtttttagggcctatggctctgatgagtgaagtcttttgtgggtgtggctggcatgctggtt

SEQ ID NO: 5897 - DNA, 717 bp, Lotus japonicus
attcttcactcgctcgctgtcttctcacctctctcacagcttctccgcgctctgatactggatcgcaatttctagggttagggtttcccaatttcttcctcgatcgtagagaatgagttccaccggcggcaacaacaccaagggcggcagaggcaagcccaaggccgccaaatcggtttccaggtctcagaaggctggtctccaattccccgttggaagaatcgcgaggttcctcaaggctggaaagtatgctgagcgtgttggtgctggtgctcctgtgtatctctctgctgtgcttgagtatctcgccgctgaggttttggaattggctgggaacgctgctagggacaacaagaagaatcgtattgttccaaggcacattcaacttgctgtgaggaacgatgaggagttgagcaagctgttgggatctgtcaccattgctaatggaggtgtgctgccgaatattcaccagactctgcttcctaagaaggctggaaaggggaaaggcgaaattggatctgcttctcaggaattttaggggttttgatgtctcctctgttgattagaccatagttttattttgctgcagttgtaatatacatcgatgtttgatttctatattgctgcccagagagatttgttgtttatcagtgggcagaattggatggcgtagaaccctctttataatgttggatgaatgataaatgcttttgcctg

SEQ ID NO: 5898 - DNA, 762 bp, Carica papaya
attcgttttcttgtataatttctttcacttgttccctccgcggtatagcacctagggttagggtttgaaacagagttgaagttccttttaatttggtgcgatctgaagatgagttcaacaggtggtggttcaaccaagggaggaaggggtaagcctaaggcctctaaagccgtatctaggtcgcagaaggccgggctacagttccctgtcggaaggattgcgaggtttcttaaggcaggaaaatacgccgagcgggttggtgctggagctcccgtctacctttctgctgtgctagagtatcttgcggctgaggttctggagcttgctgggaatgcagccagggataacaagaagaaccgtatcgtgccaaggcatatacagcttgcggtgaggaatgacgaagaactaagcaagcttcttgggtctgtaactattgccaatggaggtgttttgcctaatattcaccagactcttctcccgaagaagatgggcaaaggcaaaggagaaattggttctgtttctcaggaattctagggttttctagtattttgctttagaggccttttttgtttggtgtatggggttttctctgctgtaatataaatggcctcattaagtttttcctttttgggttttattttagtgctttgaacacatgtctcaggtaaattatgtagctttataagcataatgaaaggcttgtgcttgatcaaggacttctcttgtttttcttctggtaaatatctaaagtttttgttgtgt

SEQ ID NO: 5899 - DNA, 596 bp, Ananas comosus
tctctcttagggttccgatgagttcaacaaccaaaggcggcggcggcggcaggggcaaaccgaagtccgccaaatcggtctccagatctagcaaggccggcctccagttccccgtcggcaggatcgcgaggttcctcaaggccgggaagtatgcggagcgtgtcggagctggggcacctgtatacctctcagcagtcctcgagtacctcgcagctgaggtacttgaactggctggaaatgctgctagggataacaagaagaaccgtatagtcccgaggcacatacagcttgctgttaggaatgatgaggagttgagcaagcttttgggggctgtgacaattgctaatggcggtgttttgcctaatattcatcagaatctgttgccaccgaagactgggaaggggaagggtaacatgggctctgaatcgcaagagttttaacgtatcggcatattatgatgatataatcaatggggtttaaatggaaggagaggggacccttgttactttcgtgttgtcctttggcattttgagagattttgatctgtgtaatctttgtttccagtatttggcagttgatataaatgcttgtcgggg

SEQ ID NO: 5900 - DNA, 590 bp, Rhizophora mangle
ggaccagagagttcttttcaacttctctctttttcttcgttaaatcagaatctagggtttggtgttttcgattagttttccttttctcatttctgttttcttgaaagaaattagtgaagatgagttcaaaagaagaaacgaccaagggtggaaggggtaagccgaaggcctccaaggcggtgtcgcggtcgcagaaggccgggcttcagtttccggtgggaaggatcgcgaggtttctcaaggccggaaagtatgccgagcgtgtcggcgctggagctcctgtttatctctctgctgtcctcgagtatctcgccgctgaggtgttggagcttgctggaaatgcggcaagagacaacaaaaagaatcgtattgtgccgaggcatatccagcttgctgtgaggaatgatgaggagctaagcaagcttcttggttctgttaccattgctaatggaggtgttttgcccaacattcaccagactcttcttcctaagaagtcgggaaagggcaaaggagacattggttccgcttctcaggagttttagtttgctttgttttcaaaagttgcttgttatttttggaaactaaagttg

SEQ ID NO: 5901 - DNA, 595 bp, Rosa hybrid cultivar
ttagggtttcgtcgttaaatttgtgtgtgattttcgccgccggattcagaaaatgagtggaaaggaaggtgggtcgactaagggaggcagaggcaagccgaaggccaccaagtctgtgtccaggtctagcaaagccgggcttcaatttccggtgggtaggatcgcccggtttctcaagtccggcaagtatgccgagcgtgtcggcgccggagctccggtttatctctctgccgtgcttgaatacctggcagctgaggttttggagcttgctggcaacgcagctagagacaacaagaagaatcgtatagtaccgaggcacattcagcttgcggtgaggaatgacgaggagctaagcaagcttttggggtctgtgactattgccaatggaggagttttgcccaacattcaccaaactcttttgcctaagaaggttgggaaaggcaagggcgatatcggatccgcttctcaggagttctagggttcttgctctttgtgtttatctccttgtatggagatatgtttagttacctcagttgtaaaataccatgggatttgttagagttttctttgaaccttgttgttctggtgcttggga

SEQ ID NO: 5902 - DNA, 555 bp, Valeriana officinalis
cactcacgcattttcaaaatcagtatgagctcagccgatcaatcaacaaaaggtggaagaggcaagccaaaggcttcgaaatcagtctccagatcttcaaaagccggtctacagttccctgttggaaggattgctaggtttcttaaagccggaaagtatgccgagcgcgttggagccggtgctccggtctatctctccgccgtccttgagtatctcgctgccgaggtattggagctagcaggaaatgcagcaagggacaacaagaaaaacaggatagtgccaagacatattcagctagcagtgagaaatgatgaagaacttagcaaattgttaggatctgtcactattgcaaacggtggtgttttgccaaacattcagtcatctcttttgcctaaaaaagttggtaagggtaaaggagatatcggctctgcttcacaagagttctagatgcttctagaaactttctttttttattagtcttgcctttttggcataagaaatgttatggcttatgtaatatacatctactattggttttggattttatgttttgaa

SEQ ID NO: 5903 - DNA, 681 bp, Camellia sinensis
cgatctcggctctttcccatactctctttcaaatcaacaagtctagcgttagggttaggcttagggttagggctcgggtttttgagaatctcgaagtttttgaagaaagaaaatgagttcgggtggaggatcgacgaagggagggcgaggaaagcccaaggcttcgaaatcggtgtctcggtctcacaaggctggtcttcagttccctgtgggtaggatcgctcgattcttaaaggctggaaagtatgccgaacaagtcggcgccggagctcccgtctacctctctgctgttctcgagtacctcgccgccgaggttttagaacttgctgggaatgcagcgagggacaacaagaagaacagaatagtgcctcgacacatacagctggcggtgaggaatgatgaggagctgagcaagctgttgggttcagtgaccattgctaatggaggtgttttgccaacattcaccagacactgctgccgaagaaggtgggcaaaggcaagggcgagattggttctgcttctcaggagttttagggaacttggtttttgatcatgtaaaatacaaatgcttctgaattttttgttttgggtcttgtattagaacttcatgatagccctctcctttgggaagatgattacagtttaagccttctatgagtgaaaactctctgggtctgtttg

SEQ ID NO: 5904 - DNA, 895 bp, Cycas rumphii
ctctaatataaattagaggaaggggcagttcgtcttcctctatgcgtgctggggggtgcattggcaactgtatatattccgatcggcgcagggttggacgttcccgtgaggaagatccgggtcatcttcataacgatctgtgaggacctggcaattggattgcagtgagaatttgcgaggacaaacaacaccatgagttctgcaggtggtggcggccgagggaaggccaagtcatcgaaatctgtgtcaaggtctcagaaggccggcctccagttccccgttggaaggatcgcccgatttttgaaggctgggaagtatgccgagcgcgtaggtgcaggggctcctgtatatcttgctgctgtattggagtatctagccgcagaggtgctcgagttggctggaaatgcagcgcgggataataagaagaacaggatagtacctcgacatatccaattggcagtaaggaatgatgaagagttgagtaagttgttgggttctgttacaattgccaatggtggggtgctaccaaacattcacggtgttctccttcccaagaaatctggaaagggcaaggggcccgaggttggcagtgcttctcaggaattttagtcagtattggactaattgtcctatcttttgtacattttgggttattatgaagctgtcaattgactgcccctacttcgagtgccagattttggcgggaacaatcctaattgttaaggccccttaggaatggaacattttaggtattacagttttaggcctgcgtggttttggatatgcttgtatcttttgggataattaattgttttttgaaaaatttttaaaatatattttactcggtcatttttggaactcatgttttgtctacattactagctgttattaataa

SEQ ID NO: 5905 - DNA, 852 bp, Amorphophallus konjac
cggccggggggtctgagaaacgctagtttgcaaagctctccttcctctttgcgcccgccattgccaccctttccctccgacctctcgtatagttagggttagggttccgcccgtagcggaaggatgagctccgcggcttccaccaagggcgggcggggcaagcccaaggcctccaaatccatttcgcgctcccagaaggccggcctccagttccccgtcggcaggatcgctcgcttcctcaaggctggcaagtacgccgagcgtgtcggcgctggcgcccccgtctaccttgccgccgtcctcgagtacctcgcggccgaggtgcttgagctggctgggaacgcggcgagggacaacaagaagaacaggatcgtgccgaggcacatccagctggcggtgaggaacgacgaggagctgagcaagctgctgggatcggtgaccattgcgaacgggggcgtgctgcctaacatccaccagacgctgctgccgaagaagcagggttcggccaagggggacatcgggtccgcatcccaggagttttaggaagcttggcgagaaaagggtgggtcttgtgggtaccgtccgcggttttagtcgggaagatcgttgtttttgagaagcatgcagtacccagtgacgggatcctgcctttccgcagcataagtagggatttgtaatattttccgggtctctgatatactgcccctttgatctaatataaatgaagaaatggatagtttcatcctaaaaaaaacttcttgtttcttgtgtgcaaactgtggatgttgtcctttttattttattgtcgggaaaattatttgccgaagagatgaatgaggtagctagaattcg

SEQ ID NO: 5906 - DNA, 1194 bp, Cannabis sativa
tacactcgttccctccctacaacaattttccctctttttctaaataaaaactaaatatgttgacaggttggcgatctacgtccttggctatccaccaataatatcatttgtgccctactgcactttccccaaaccccttcgtataaatacgcacacactgtcttcttccagaacactcactttcacttcaatacgtctctttttctctctcttgccgttcttcttgctcgatcacatttcctagggtttacttgtattttgatccagacagcaaaaccctaaagatgagtacggccgctacaaccaaaggaggcagaggcaagccaaagtcctccaaatctgtctccaggtcttccaaggccggtctccaatttcctgttggccgaatcgccagattccttaaaaacggaaagtatgccgagagagtcggtgcaggtgctccggtctacctttccgccgttcttgagtatcttgctgctgaggttttggagctagctggaaacgctgcaagagacaacaagaagaatcgtatcgtgccaagacatatacaactcgcagtgagaaatgacgaggagttgagcaagcttttggggactgttacaattgctaatggcggtgttttgccaaacattcaccaaactctcttgcctaagaaagttgggaaaggaaagggtgaatttggttctgcatcacaagagttttagggtttgaggtcttttatatggtcttacttaggacatgggcacaaattgttgtttttgaggataaagtcctgttaaagatggctcgttttgaccttcttggaatcatgtaaacccaaattctgggcaaattttttttaatggtttgaatatagaacaaatatatcattttcgtctcatttttttttttgatggttttgtcatttggctttgaatcttttatgtgttggtcacatttttatacgttctccctaaaagaaaaaggtaaattcagacttaaacttgaacaaattattaaggtgccatggtctatcgatggtggccgtactctttcaaatcaggtttagatttagtagtggctactttgttgagcatgatcaggatcataattgtaggaaaatattttgtgcacgcccaagagtataggtattgtaataatagctgtatatgtttgttgagacatatatcaaatgagctatctcttaaatttttc

SEQ ID NO: 5907 - DNA, 738 bp, Cocos nucifera
attgagaagaatttttctacggactctatatacaaagcccgaccccttccccctttctcgataaagctctcctgtcgtcgttggcgctttctagggctagggtttcgttggcgcgatgagttcctcggcttcgacgaagggcggaagggggaagcctaaggcctccaaatccgtctcccggtctcagaaggccggcctccagtttcctgtcggccggatcgcccgcttcctcaaggccggcaagtacgccgagcgcgtcggcgcgggtgcccccgtctatctctctgctgtcctcgagtacctagccgctgaggttctggagctggctgggaacgcggcaagggacaacaagaagaacaggatcgtgccgaggcatatacagctcgcggtgaggaatgacgaggagctgagcaagctgttggggactgtcacgattgcaaatggtggcgttctgcccaatatccatcagactctgttgcctaagaagcagggcaaaggaaagggagaggttggctccgcctcgcaggagttttagatccttcgtttctttttatcaaggtatcttgttatatatgtttgaagtagggtgactgttagtatatcttagggttcttgtttggaaagtggtggtgctcctttgatgtaatgagggcggatcgtgtcaataaatctgggttttgagtacaatcatgatattcttgtttggaaagtggtggtgctcctttgatgtaatgaggg

SEQ ID NO: 5908 - DNA, 749 bp, Gossypium hirsutum
aaaaaaacttcgttcccacgcctttttctctcattaatcaccaaaattgcgccaaaaaagaacttaatactctacaatctccattaacaaaatctagggttttcaaaagaagatgagctcaacagtatcaacaaagggaggcagaggcaagcctaagtcctccaaatccgtctcccgatctcaaaaagccggcctacagttccccgttggccgtatcgcccgtttccttaaagctgggaaatacgccgatcgtgtcggcgctggtgcccccgtatatctctccgccgtccttgaataccttgctgctgaggttcttgaacttgctggaaatgctgctagggataacaagaagaatcggatcgtgccgaggcatattcaattggctgtaaggaacgatgaagagttaagtaaacttttggggactgttaccattgctaatggaggtgttttgcctaatattcatcaaaatctgttgccgaagaagattggtaaagggaagggtgatattggatcggcttcacaagaattttagacgattctggagcgtgaagaagtctcttttgtttcggaaatttattcttataattggaaactgttaaaacgattgggtaatcttatagtttgttttccgatgggttgttttgtgagctttcaactggtcctgtaaatcatattttgggctcgttttgattttggttgagtaggttgtgcaaaattgatatccttatatatatttactttgcatttgc

SEQ ID NO: 5909 - DNA, 427 bp, Cucumis sativus
atcgtacaatgagttcatcggcttcgacaaagggtggtagagggaaacccaaagccacaaagtctgtgtcgcggtctcagaaggctggtctacagttccctgttggtcgtattgctcggtttctcaaggccggtaagtacgcggagcgtgttggtgcgggtgctcccgtctatctctccgccgtcctcgaatatctggccgccgaggtgcttgagcttgcaggcaatgccgccagagacaacaagaagaatcgcattgttccaagacacatacagcttgcggtccgcaatgatgaagagttaagcaagcttttgggtgatgtgacaattgcaaatggtggtgtgttgcctaatatccatcaaactcttttgcctaagaaggccggatcaggaaaaggtgacatcggatctgcatcacaagagttcta

SEQ ID NO: 5910 - DNA, 765 bp, Gossypium raimondii
cattaatcaccaaaattgcgccaaaaaagaacttaatactctacaatctccattaacaaaatctagggttttcaaaagaagatgagctcaacagtatcaacaaagggaggcagaggcaagcctaagtcctccaaatccgtctcccgatctcaaaaagccggcctacagttccccgttggccgtatcgcccgtttccttaaagccgggaaatacgccgatcgtgtcggcgctggtgcccccgtatatctctccgccgtccttgaataccttgctgctgaggttcttgaacttgctggaaatgctgctagggataacaagaagaatcggatcgtgccgaggcatattcaattggctgtaaggaacgatgaagagttaagtaaacttttggggactgttaccattgctaatggaggtgttttgcctaatattcatcaaaatctgttgccgaagaagattggtaaagggaagggtgatattggatcggcttcacaagaattttagacgattctggagcgtgaagaagtctcttttgtttcggaaatttattcttataattggaaactgttaaaacgattgggtaatcttatattttgttttccgatgggttgttttgtgagctttcaactggtcctgtaaatcatattttgggctcgttttgattttggttgagtagggtgtgcaaaattgatatccttatatataattactttgcatttgcagtaatttttttgcaattcaacacaccaaacaaaacttatatataca

SEQ ID NO: 5911 - DNA, 778 bp, Elaeis guineensis
aactgctcttcccctcaagggtacgcctgccttctcttctacggaaaaaccggctgttcctttgttccgatcctctctgcctcctccgagggttagggtttttttttcccatcgatctaagaaaaagaaaaagaagatgagttccacggcttcgaccaagggcggcaggggcaagcccaagtcctccaagtctgtctcccggtcccagaaggcgggcctccagttccccgttggccggatcgctcgcttccttaaggctggaaagtacgccgagcgcgtcggtgccggcgctcccgtctatctctctgccgtcctcgagtacctcgctgctgaggttctggagttggctgggaatgcggcaagggacaacaagaagagtaggattgttccgaggcacatccagcttgcggtgaggaatgatgaggagcttagcaagcttcttgggacggtgactattgctaatggtggtgttttgcctaatattcaccaaactctgctgcctaagaaggtggggaaggagaagggggagcttgggtctgcatcacaggagttctagatgtctaacaatctccagataatttagtaaaggatggcgatatttctctttggggtttttatgccagtggtagtgataatttgatgtatgaatcaagttaactggttgctgtaccttttttatgttgaatcaaaccatacccttttctttatacaaggaaaataagtacaagaattgaatagaaaaaaaaaacaaatagacaccgaacgacgacacagagag

SEQ ID NO: 5912 - DNA, 666 bp, Olea europaea
tgagttccaatgcttcaaccaagggcggtaggggcaaacccaagtcgtcgaaatccgtctctcgctccagtaaggccggtctccagttccctgttggtagaatcgctcggttcctcaaagccggaaagtacgccgagcgtgttggggctggtgccccggtctacctcgccgctgtcctcgaataccttgcggctgaggttttggagcttgcgggaaatgctgcaagggacaacaagaagaacaggattgtacctaggcacatacaattggcagtcaggaatgatgaggagttgagcaagctgttgggaagtgttacaattgcgaatggtggtgttttgcccaacattcatcagaacctgttgccaaaaaaggctggaggaagggacaaggaaatcgggtcagcttcacaagaattctagggttttgtcatgtattagtgcggcttggttgatgaatatttattactaaggccttggatcaattgttttgtttatgcgatgtttggtccatgtaaaacccggatttcggtttggttaaatgtagaccatcttgttagtttcttttgcatttatgataatgtgttaaatatttcaaaattttcaatttcagtttctttctttaatcatgcagtttcaatagcttcacatgccctcttcatcgtatcag

SEQ ID NO: 5913 - DNA, 705 bp, Carica papaya
aacaatcttccgccatcttccaaacaccatcaacaagcttttcgcacctctcgtctgttaggttttagttccaatatcaaaaatcatgagttcaggaggatcgactaagggtggacgtggcaagccgaagtccgtcaagtctgtgagcagatcccagaaggccggcctgcagttccccgttggccgtatcgctcgtttcctaaaggcgggaaagtacgccgatcgtgtcggcgccggtgctccggtctacctctctgccgtcctcgaatacctcgctgctgaggttcttgaactcgcgggaaacgctgcgagggacaacaagaagaatcgtatagttccaagacacatacaattggctgttaggaacgatgaagaactgagcaagcttttggggactgtaacaattgcaaacggcggcgttttgcctaacattcatcaaaatctcttgcctaaaaagacgggaaaagggaaggatattgggtctgcctcccaagagttttaggagtatctggttttattattctttcatgggagtttttgcgaagattgtgatacaatttatctgggtccttataatctttgatttgggttaaattttttctgggttgaatatatatattgccaattacttttctgtgcatcattttgattttctgtgtggctatggatttcaagaatttactaataaacttgaatttacgggtc

SEQ ID NO: 5914 - DNA, 667 bp, Phalaenopsis aphrodite
gtgctctcctcgtcgttgtcgttgatttggagctagggtttgccgtcagattcaagccgaaatgagctctactgcatctactaagggaggtcgcggcaagtcgaagcccgcaaagtcggtatccagatctaataaggctggcttgcagtttcccgtcggtaggattgctcgcttcctcaaggctggaaaatactctgaacgcgtcggagccggcgctcccgtatatcttgcagctgttcttgagtaccttgccgctgaggttcttgagttggctgggaatgctgcgagagacaataagaagaataggattatgcccaggcacattcagcttgcggtgaggaatgatgaggagctcagcaagctgttgggagccgtgacgattgctaatgggggtgttttgcccaacatacaccagaatttactgcccaagaagcaaggcaaggggaagggcgacattggttctgcctctcaagaattttaaaattttctgtgcggtagtgtaactggaatttggttttagggtttagttcttgttgatatggttcctccgcaatgcatatctttttctataggcttattttagcctaatctttggttgattttccaaattttcgttcttgttttttttttttaatttttaagtgtatctgagtagtacttcgtaacg

SEQ ID NO: 5915 - DNA, 897 bp, Ananas comosus
cacctgtcctctttctctttagggttagggtttcgatccattccgttctccttctccactatagggttagggtttcgatccaaactgcgacaccgacgacgatgagctcctcgggatcgaccaagggagggcgcggcaaggcgaaggcgacgaaatcggtctcccggtcgcagaaggccggtctccagttccccgtcggccgaatcgcccgcttcctcaaggccgggaagtacgccgaccgcgtcggcgccggcgctcccgtatacctctctgcagtcctcgagtacctcgccgccgaggttcttgagttagctggcaatgctgcaagggataacaagaagaataggattgtgccacggcatatacagcttgctgtgaggaatgatgaggaactgagtaagcttttggggatggtgacaattgcgaatggtggggttttgcccaacattcatcagactttgttgcccaagaaggcggggaaggataagggggaacttggatcggcatcacaggagttttagatttgttttagctataaataatttgaggacggatggaaaggttttgttgttggtgtggtttcctttttctgggttatggtttgtaatgtaaggagtgggttaggaatatagtgctttttgatcttaattaactacagtttttaatgtcttgaaagctaaaactactggagtgaaaggatgtgcatcttagatgtgtatttttcatttttattgcattgttggtgtatattttccttatctgcttgcctttctcattaagtgatttgactgagtttttggaatcagttgggacatgggaagtttggaccttgaattcaatttcttcttttatgatttactttgttgtgttttaagttttaacctttagttagcagaa

SEQ ID NO: 5916 - DNA, 2019 bp, Ananas comosus
cgtgttagggtttccaatccattccccgctcctccacctctcctcttcctctctagggttggggtatcgatccattcccttatcctcctccactctagggttagggtttcgatccaaactacgaccccgacgacgatgagctcctcgggatcgaccaagggtgggcgcggcaaggccaaggcgacgaaatcggtctcacggtcgcagaaggccggtctccagttccccgtcggccgaatcgcccgcttcctcaaggccgggaagtacgccgaccgcgtcggcgccggcgctcccgtatacctctctgcagtcctcgagtacctcgccgccgaggttcttgagttggctggcaatgctgcgagggataacaagaagaataggattgtgccacggcatatacagcttgctgtgaggaatgatgaggaactgagtaagcttttggggatggtgacaattgcgaatggtggggttttgcccaacattcatcagactttgttgcccaagaaggcggggaaggataagggggaacttggatcagcgtcacaggagttttagatttgtgttagctataaataatttgagtaaggatggaaaggttttgttgttggtgtggtttcttttttctgggttatgatttgtaatgtatggagtaggttaggaatatagtgctttttgatcttaattaactgcagtttttaatgtcataaaagctaaaactactggggtgaaatgatgtgcatctttgatgtgtattgtcttttttattgcactgtttgtgtatattttccttatctgcttgtgtttctcattaagtgacttgactgagtttttggaatcagttgggacatgggaagtttggaccttgaattcaatttcttcttttatgatttactttgttgtgttttaagttttaacctttagttagcagaaatgtacttttaatattaaccctttacttttcttctcccatatcctctttacatgtgtgattcaaatggagggcaaagtgagaaatgtcactttcagggcaactatgacctctagtttatttggtggatatgtggctggaccacattgatttttaactttttgaggggcaactgataagaaagggcttcctttttgaacaagctgctgtctttgctctgtttttggggaaaggaggatgaatttggtgttatgttgtggtggctatttgcctaatataaagatgagattgcctatttgtagagctctgaagccctctgattcagctttgagttctcttcttgagtcaggtggatcaaggttgcaggtgctggagcaagttgatgaggagctgaggaggggagatgatagggctgctctttctctggtgaagggcctgcaagggaagcctgagggtcttaggtgctttggagcagcaaggcaggttgttgtttctcaccatgttcatgaacaactgttctcttgaatattcattctctggtttaatataagagtaaaaagggtaactccttggtttccttttatgtggcctttaaggtactgttgatgtgttggcattatcttgggcattattcttggatgcgtgcttaaaccaataagtgtttgttatgtgtgattgccaacacattagccgtatacatgtagcaggctagcagcactgtcatatataaagttcaagagtaatggttgttctgcttcacaattgttagatggacatattcgttgggttgcttgtgttcatgctgtataaatgctgattttaaaactgatgagaggactgtaccttcttttctttctaattaaaaagctttcttttgtgtatgccttccaaagttcatttttgaaactttagcatgcagagcttgctgtaatatgttatgtggcatgtcttgcttcagccaactataggcatgctgttgtgccatgggaaggcaagccttggctgcacctatgaaacatgatgtaatgatttggtttgtaatttgtattttatttattttattgacatcttttataactttgcttattggt

SEQ ID NO: 5917 - DNA, 576 bp, Platanus occidentalis
cgcgaacagagagccatctgctcgttttcttgaacgctttttcaattacgtacgaaacgcagacgacgatgagttctacagcttctacgaagggcggaagagggaagcccaaggcttcgaaatcggtctccagatctcacaaggccggtctccaattcccagtaggaaggatcgctaggtttctgaaagccggaaagtatgcccagcgtgtcggagctggtgcgccggtctatctctctgccgttcttgaatatcttgcagctgaggttcttgagcttgctggtaacgcggcaagggataacaagaagaatcgtattgttccgaggcatatacagcttgcagtgaggaacgatgaggagttgagcaagcttctggggactgttactatcgctaatgggggcgttttgccgaacattcatcagactttgttgccgaagaagatggggaagggaaaaggcgagactggatctgcatcacaagagttttagcttcgtttcttcctccccccccccctcccctttttctacgaaaggacgtgttttgatgcgtttagggatgattgtttttttttttcct

SEQ ID NO: 5918 - DNA, 979 bp, Pinus taeda
atagcatcgggttagttttggagctgctgcctgttcgtattacatagtggttcgttcctgtgaatcaacattaaagaggggagttggcatcatgagttctgcaggaggtggcggtggccgagggaaagcgaagtcttcaaagtctgtttcgaggtctcataaggctggcctgcaatttccggttggaaggattgctcgtttcctaaagtcgggcaagtatgcagagcgcgtcggtgcaggggctccggttatatggctgcggttttagagtatctagcagcagaggtgcttgagttggccggaaatgcagcaagggataacaagaagaacaggattgtacctcgacacattcagctagctgtcagaaacgacgaggagctcagcaaattgctaggtgctgtaacaattgccaatggtggtgtattgccgaatattcacggtgttttactacccaaaaggttggaaagggaaagggagatgagattggcagcgcctctcaagagttttaggctatgctcgactgttaattgatgcccacattttttgggggctcaatgctattgccaatcactgcctgcctgagtgccagaatctggcaaaatgccaattcttaaatcgtttaaaccgttaaccttccattaagattatacagttttaggtggacgaagttatgttattttccattagaatgcactgtgaactgttaatcttccattaggattatagggtttttggtggacgacttttcaatagaccaatggaatacattgtttttagctttcagaagtaactgatagatatgttcttggcagaaggtcattattgatggatattcttggcagaagattattatggattattcttggcagaagattattatggataattctttacagaagattattattgttattattctcacgagggagatgttcaattttaggtcgttaatgaaatgtgtatgactaaccgtcgtttt

SEQ ID NO: 5919 - DNA, 635 bp, Camellia sinensis
ggggatattctctctctctctctctctctctggcgggttttcgatcgacagatcatcaataaacgattatgagttctacaggcacaacaaaaggaggcagaggcaagcccaagtcctccaaatcggtctccagatctcagaaagccggcctccaattccccgtaggccgaatcgcccgtttcctcaaggccggaaaatacgccgagcgtgtcggcgccggtgcgcctgtctacctctccgccgttctcgaatacctcgccgccgaggttcttgaacttgcagggaatgctgcgagggacaacaagaagaaccggatagttccaaggcacatacaacttgctgtgagaaatgatgaggagttaagcaagctttgtgggaacagtcactattgcaaacgggtggtgttctgccaaacattcatcagaatttgttgccaaagaaggttgggaaagggaaaggcgagattggatctgcatcacaggagtttaagggtttatggtagtggttggattatttatataattaaggttttcatgtggttaattgatgggatcaattttggtgctttgtattattgatccctgtgttgtgggaatttacatttgaatatagaagaacaataaatttgtcggaaa

SEQ ID NO: 5920 - DNA, 701 bp, Vaccinium corymbosum
gcacgaacaacaaaaaatctagggttagggtttgctgttacacatccctgctccgaacttgctaaaggaagaagatgagttcaacgacgaagggtggtcgtggtaagcccaaggcggccaagtccgtctctaggtcccacaaggcgggcctacagttccccgtgggtcggatcgcccgatttctcaaggccgggaagtacgccgaccgcgtcggtgctggtgctccggtttatctctctgctgtcctcgaatacctagctgccgaggtgttggagctagctgggaatgcagcaagagataacaagaaaaacaggattgtgccaaggcacattcagctagctgtgaggaatgatgaggagctaagcaagctgttggggtctgtcacgattgcaaatggaggggttctgccaaacattcaccaaactctgctgccaaagaaggccggtaaaggcaagggcgagattggttctgcttctcaggagttttaggtggaaggctttttctagtggagaaaagcggggataggatgtttatatagtaggaactatgttttccatttgttttctatcttagcgattttgtattagtaagtgtctcagcttttaagccttttgatgggtaaactcttgtgaatatggcatttttgggttaagctgagccttaacttgctgagttaagttgcaatttggcattgtacatta

SEQ ID NO: 5921 - DNA, 663 bp, Brachypodium distachyon
caccacctctccagtccccacatctcgaaagggtttagaagcttccagaccccaccggcgaatcggcgatgagttccaccggaagcggcggccgtgggaaggcgaagtcgacgaaggtggtgtcgcgctcggccaaggccggcctccagttccccgtcggccgtatcgcgcggtacctcaaggccggcaagtacgcggagcgcgtcggcgccggcgcccccgtgtacctctccgccgttctcgagtacctcgccgccgaggtgctggagctggcggggaacgcggcgcgcgacaacaagaagaaccggatcgtgccgcgccacatccagctggcggtgcgcaatgacgaggagctgagcaagctgctgggaaccgtcacgatcgccaacggcggcgtgctgcccaagatccaccaggttctgctgcccaaaaaggctggcgctaagggggacatcggctcggcctcgcaggagttctgagcatcggaagaaatcgaagagggggccgtcctgagatgatgtttcttttggaatcgtggtgtgcgtttgttgtttgggatgtaaaagtttttcgcggtttggtctgttcttgacgaatgaatggaccgattgaattggctgaaggtgtcttttgaggttgattacttgatcgatttggttcgtc

SEQ ID NO: 5922 - DNA, 941 bp, Cephalotaxus harringtonia
tcaagcgcctctgctctttttattccatcggaacagatctttgctctacagattcttcaggaaaataaaaatctaatttaggtctcaaacttgagacctgtgggtgaccttttttccgtgtaaaaaatgagttcttcaggggcaaagggcggtcgaggaaaggccaagtcaacaaaatctgtatcgaggtctcagaaggctgggctgcagtttcccgtgggaagaatcgcaaggtttctaaaggcaggaaaatatgcagagcgtgtgggtgcaggcgcccctgtctatcttgctgcagttctcgagtatcttgctgcagaggtattggagcttgctggaaatgctgcccgagacaacaagaagaatcgtattgtaccccgacatattcaattagcagttaggaatgatgaggaattaagtaagctgcttggtactgtgaccattgctaatggaggagttttacctaacatccaccaagttctcttgcctaagaaggctggtaaagataagggagaggtggggtctgcttcccaagagttttgatttagtgactagataatatgttgaatcaaattatgtgtatcatttgatcagatcaaagcaaaattatgctttcataaatggttctgtttctgtatttggaggcctcgttttgtcaatttgaacttgttgactgtctaatggtcatggagattctcctggcttgaaatatacgactgggtacacaggacctgttttgtcttgaacttttctcagtggaatatgttctgtttatttgcatcatctgtgtattggattcatgtctcgattagattcattgtgatgctgcctctaatatcagcagtaactgttaatgacagtgtttcatatgtgctttgtgcttagcatctgtaagtcataaaatagtatcttgtggaaaccattagacagtcaacaagttc

SEQ ID NO: 5923 - DNA, 659 bp, Allium cepa
gcctagttacgggggatcagcattcgtcatctcttcgaattcaattttctagaatctctagcataaatactaaaatcagagaatgagttcaaaatcatctaagggaggaagaggtaagccaaagagcacaaagtcggtttctagatctagtaaagcaggactgcagtttcccgttggaagaatcgctcggtttttgaagaccgggaagtatgccgagagagttggtgccggagctccggtttatttgtcagcggtgcttgaatatctggctgccgaggttctggagcttgctggaaatgctgcaagagataataagaagagcagaatcgttccaaggcatattcagcttgctgttagaaacgacgaagagttgagtaaacttcttgggaccgtgactattgcaaatggaggagtgttgcctaatattcactctacacttttgcccaagaaggatggaaaaggaaagggagatataggctcggcatcccaagaattctaatcgattgcatcccttttaatcagtttagcttctgtgtagcttgtttgttttgggaaatgaaatctagtttgttttggatttatgttggcgctattgaatttctgtatcatatttggaaagtttatcagaagttaatgaaatttttgggaccgtaaaattt

SEQ ID NO: 5924 - DNA, 557 bp, Allium cepa
tcatctcttcgaattcaattttctagaatctctagcataaatactaaaatcagagaatgagttcaaaatcatctaagggaggaagaggtaagccaaagagcacaaagtcggtttctagatctagtaaagcaggactgcagtttcccgttggaagaatcgctcggtttttgaagaccgggaagtatgccgagagagttggtgccggagctccggtttatttgtcagcggtgcttgaatatctggctgccgaggttctggagcttgctggaaatgctgcaagagataataagaagagcagaatcgttccaaggcatattcagcttgctgttagaaacgacgaagagttgagtaaacttcttgggaccgtgactattgcaaatggaggagtgttgcctaatattcactctacacttttgcccaagaaggatggaaaaggaaagggagatataggctcggcatcccaagaattctaatcgattgcatcccttttaatcagtttagcttctgtgtagcttgtttgttttgggaaatgaaatctagtttgttttggatttatg

SEQ ID NO: 5925 - DNA, 605 bp, Papaver somniferum
atgacttctccagcaaagggtggtagaggaaaaccaaaatcatcaaaatcagtatcaagatctcaaaaagctggtcttcaatttcctgttggtagaatcgctagatttcttaaagctggtaaatatgctgagcgtgttggtgctggtgctcccgtttatctatctgccgttcttgaatacctagccgccgaggttttggaattagctggaaatgcagcgagagataacaagaagaataggattgtaccaagacacatacagcttgctgttagaaacgatgaagagttgagcaggctattgggtactgttactattgctaatggaggtgttttacctaatattcagcagactttgttgccaaagaaggctgggaaaggaaaggaaggactgggttctgcttcacaagagttttagggtttctattgggtacttcaagtctaaagtatagttttagggttcggggcatctgggtttttgatctgaaagcggtgggttacttttgtagtttcgtttggttcatgcaaaaacttaaaaagacagttaaattttttggttctgttttggtgtacaatgatgggtcttttgatgtaatggaattttaattt

SEQ ID NO: 5926 - DNA, 827 bp, Sequoia sempervirens
ttttcaacccatagcaatcagagatttacatacatccatcaaaactcttagtttttctctttcactgttgtattgatctctgttgcaggataaaaaggaaagaacagcaatagtccttagctgttcgggcttgataaccgtcggcgccatttctaagctatttgaaaatctagggctgtaagaatgagttcttcaggtgcaaagggcggccgtggaaaagccaagtcgacaaaatctgtgtcgaggtctcagaaggctgggcttcagtttcccgttgggagaatcgcaaggtttctcaaggcagggaaatacgcacaacgtgtgggggcgggcgcacctgtctatcttgctgctgttcttgagtatcttgcagccgaggtcctggagctcgctggaaatgctgcccgagacaacaaaaagaatcgtatagtacccaggcatattcagttagcagttaggaacgatgaggagttaagtaagctgcttggtactgtaacaattgctaatggaggagttttgccgaacatccaccaagttctcttgcctaagaaggctggaaaggataagggagatgttggatctgcttcccaagagttttgatcttgtgacttgcatcatgttgaaacaaattataggaatctcttagtttgatcatgccaaactatgcattcatatatggttctgtttttgggatgttgtggccatattttgtcaattttaacttgttgactccttgatggtcatagagactattgtcttgaaatgtattgagtataaagagcttgttccatcttgaactttatcaatagaatttattttacacctcg

SEQ ID NO: 5927 - DNA, 554 bp, Fragaria vesca
acacacactctgctagggtttcgactccaatctccgataatgacttctccgacttccaagggcggccgcggcaaggccaaggccaccaagtccgtctcccgttcctccaaggccggcctccagttccccgtcggccgtatcgctcgcttcctcaaatccggcaagtacgccgagcgtgtcggcgccggtgcccccgtttacctctccgccgtcctcgagtatctcgccgccgaggttcttgagctcgctggaaatgccgccagggataacaagaagaatcggattgttccgaggcatatccagctggctgtgcgaaacgatgaggagttgagcaagcttttggggactgtgactattgctaatggaggtgttttgcctaacattcatcagaatctgctgccgaagaagaccgggaaaggcaagggggacattggatcggcgtcgcaagagttttagggttcttgttttggtttcaaaatttgggactatttggttgtaaacagaaaattcggaaattattagtggaatataatatcgtctttgtcataatttca

SEQ ID NO: 5928 - DNA, 835 bp, Taxus baccata
actgctaatcctgacgtgtatacatagaagcccgtatcggtttttccacgcatcaaaactgtttttcctcattttccttcactgtgggattgcttatacctagcttcagtcgtgatttttcttttttccttggcacttgaagtttgaaccctagacgtgtgggttgctttttgtctgtgtaaaatatgagttcttcaggtgcaaagggcggtagaggaaaggccaagtcaacaaaatctgtatcaaggtctcaaaaggctgggctgcagttccctgtgggaagaattgcaagatttcttaaggcaggaaaatatgcagagcgtgtgggtgcaggcgcccctgtttatcttgcagcggttcttgagtatcttgctgccgaggtattggaacttgctggaaatgctgccagagacaataagaaaaatcgtattgtgcccaggcatattcaattagcagtcaggaatgatgaggagttaagtaagctgcttggtactgtgaccattgctaatggaggagttttgcctaacattcaccaggttctcttgcctaagaaggctggaaaagacaagggagaggttggatctgcttcccaagagttttgatttggtgacccacactgtgtttaattaaatttatgtatcatttgagctgagcaaagcaaaattatgctttcatatttggttctctttctggaattttgcggccttattttgtcaatttgaacttgttgactgtctaatggtgtcatatagagattctcctgtcttgaaatatacaactggatatgcagaacctgctgcattgaagtgttaaatgaaatttgttctgtttattt

SEQ ID NO: 5929 - DNA, 516 bp, Vicia sativa
ggaagaggcaagccaaaggcttccaaatctgtttcaagatcttccaaggctggtcttcaatttccagtcggtagaatcgccagattcttgaaggctgggaaatacgccgaacgtgtcggtgcaggtgctcccgtctacctctccgccgttctcgaatatctcgccgccgaggttttggaattggctgggaatgctgctagggataacaagaagaaccgaattgttccaaggcatattcagcttgctgtaaggaacgatgaagaactgagcaagcttttgggagctgtgaccattgctaatggtggagttttgcctaatattcaccagactttgttacctaagaaggttggaaagggaaaaggagaaattggatccgcttctcaagaattctagggtttatgttcgttgttgagtagttgtagttttaactttgttctagttgtaaaatacaaattttggttttatgtttcttgattgcaatgaatttcatattctctatggagtggatagtttaat

SEQ ID NO: 5930 - DNA, 647 bp, Vaccinium corymbosum
gcacgaacaacaaaaaatctagggttagggttcgctgatacacatccctgctccgaacttgctaaaggaagaagatgagttcaacgacgaaaggtggtcgtggtaagcccaaggcggccaagtccgtctctaggtcccacaaggcgggcctacagttccccgtgggtcggatcgcccgatttctcaaggccgggaagtacgccgaccgcgtcggtgctggtgctccggtttatctctctgctgtcctcgaatacctagctgccgaggtgttggagcttgctgggaatgcagcaagagataacaagaaaaacaggattgtgccaaggcacattcagctagccgtgaggaatgatgaggagctaagcaagctgttggggtctgtcaccattgcaaatggagggggttctgccaaacattcaccaaactctgctgccaaagaaggtcggtaaaggcaagggcgagatcggttctgcttctcaggagttttaggtggaaggcttttcctagtggagaaaaagtggggataggatgtttatatagtaggaactatgttttccatttgttttctatcttagcaattttgtattagttaacttttacgggtggctcctccttggccacatataaatcgaagtgcctcagctttt

SEQ ID NO: 5931 - DNA, 720 bp, Sciadopitys verticillata
tcttttttccttctactcttggaaactctacgattctaatccgagatctctgagtagtatttttcagtctgtgaaaatgagttcttcaggtgcgaagggcggaaggggaaaggccaagtctaccaaatctgtgtcgcgttctcagaaagcgggtctgcagtttccggtgggaagaatcgccaggtttttgaaggcagggaaatatgcagagcgagtgggtgcaggagccccagtgtatcttgctgcagttcttgaataccttgctgccgaggtgttagagctagcagggaacgctgccagagacaacaaaaaaatagaattgtacccaggcatattcagttagcggttagaaacgacgaggagttgagtaagctgcttggtactgtgaccattgccaatggaggggtattacctaacatccaccaagttctcttgcctaagaagtctgggaaagacaagggcgacgttggttctgcttcacaggagttttgatctgccgagtggggaaagaatattgaatggatttatctattgtttgtcaagggagacattggttctgcttcatatacagttgtgtgaaatgagctgccttattttgtcaatgtgaacttattatgtaccgctcttagagactcttctgtattgaaaacgcgtataccaactgggtaaataaatgccctgtattgccttgaaatgtgtcaatgaaaacctgtgctgagc

SEQ ID NO: 5932 - DNA, 569 bp, Castanea mollissima
gagttcgacgggcggagctggaggaggttcgaccaagggaggaagaggaaagccgaaggcgtcgaagtcggtttcgaggtcgcagaaggccgggcttcagttcccagtgggtaggatcgctaggtttctcaaggctggaaagtacgccgagcgtgtcggtgccggtgctccggtttatctctccgccgtgctcgaatatctcgctgctgaggtactggagcttgctggaaatgcagcaagggacaacaagaagaatagaattgtgccgaggcacatccagcttgcggtgaggaatgacgaggagctgagcaagcttctgggctctgtaactattgccaatggaggagtgttgccgaatatccaccagacccttctgcctaagaaggttggcaaaggaaaaggcgacattggatcagcttcacaggagttctagaatcctagtgccttcatatagataggggttgttttagtagtttgtaacatatatgtgtttttctgttttttgtacttgtgccaactgaatcttcatgctatgtttcttgttaatgaaatgaatcttattgcttctg

SEQ ID NO: 5933 - DNA, 827 bp, Ipomoea nil
atcgctacagaaaagccgcattcttcttcaatcattcacgagttttgattagggtttttgctgagtaaaaaatgagttctagcggcgcaggagcgggaaagggtggcgccggaaggggcaagcctaaggcgtcgaagtcggtgtcccgatcgtcgaaggcggggctccagttccccgtcggtaggatcgcgcgtttcctcaaggctgggaagtatgccgagcgtgtcggtgccggagctccggtgtatctctctgctgtactcgagtatctcgccgcagaggttttggaattagcagggaatgcagccagggacaacaagaagaatcggattgtgccgaggcatattcagctggctgtgaggaatgatgaggagctgagcaagcttttgggcaatgtgactattgctaatggtggtgtgttgcctaacattcatcagaatctgttgcccaagaaggctggctcagccaagggtgacattggctctgcttctcaggagttttaggggtttagcggatagaaagtgatagttggacttctgtaaaatagctgtttttgtactcgggtttattcaatgactttatatatgatataagcaattcaattgctgttttggttcaatatgctgctgtttgaggttttgatttcaaattcattgggttaattcaaatcatggttcaagcacatttgttttggggtttattggcattgcttgagatttgatgtgtttacccaagtctgagaatgctgtgatgcatatgcaagatactgtcaaattgcagtgctgtgggcatgatgaatgagtgactgttctttgtaaatgaactct

SEQ ID NO: 5934 - DNA, 520 bp, Scabiosa columbaria
tctctcgcttccttcgcgtatattcatctcaaaatctagggttagggtttgctaaacttctaagtttgagattagatttgaaatactaaaacaatgagttcaccaaccaagggaggaagaggaaagccaaagtcttccaagtctgtatctcgatcatccaaagccggactccagtttcccgtcggtaggatcgctaggtttctcaaagccggaaagtacgctgaacgtgtcggcgccggcgctccagtctacctctctgccgttctcgagtatttggctgctgaggtattggaattagcagggaatgcagcaagggataataagaagaacaggattgtgcccaggcatatacagcttgctgtaaggaatgatgaagaactgagtaaattgctgggtgctgtgactattgccaatggaggagttttgccaaacattcaccaaactctattgccaaagaaggttggaaaaggcaagggtgaaattggatccgcttctcaggagtttagatcatcagttgttt

SEQ ID NO: 5935 - DNA, 668 bp, Rosmarinus officinalis
cggccgggggattcatcactacccaaaaacgctcttcacaaatcactcgattcattctcatcctctagggttaccgagccactaatcgccgccgccggaaaatgagttccaaccccgcagccaccaccaagggcggaagaggcaagcccaaggcctccaaatcagtctcccgctcatcgaaagccggtccccagtttcccgtcggcagaatcgcacgttttcccaaggccggtaaatacgccgagcgcgtcggcgccggcgccccggtctacctttctgccgtccttgaatacctcgccgccgaggtcctggagcttgcgggaaatgctgctagagacaacaagaagaacaggattgttcctcgtcatatacagctggcagtgaggaacgacgaagaattgagcaagctgttgggccatgtaacgatagctaatggtggtgttctaccaaatattcaccaaactttgttgccgaagaaggccggcggaagggacaaggagatcggttctgcatcgcaggaattttagggtttttgttgtgaattaaattgcacttgggggttatggttaagggtttggatcgttgaaatgttggtccatatacaaccctaatttttggtttggttggaatatatacaggcgtttgatgaacaagatatccaatttact

SEQ ID NO: 5936 - DNA, 504 bp, Ambrosia trifida
aaaccctctttctcttccgttctaatttcttataaaactagggtttatcaagatccatcacattcaaacaacatgagttccaaaggagatacagattcaaagaaaggaggcagaggcaaatcaaaggccaccaaatctgtttccagatcttctaaagccggtcttcagttccctgttggtaggattgctcggttccttaaggctggaaagtatgctgaacgtgttggtgctggagcccctgtttatctttctgctgttcttgaatatcttgctgctgaggttttggagttggctggaaatgctgcaagggacaacaagaaaagccgaattgtgccaaggcatattcaattagcggtgaggaacgacgaagagctaagcaagttgttgggctcggtgacgattgcaaacggtggtgttttaccaaacattcatcagaccttgctaccacataaggttggcaaggagaaaggagatattggttctgcttctcaagagttctagaca

SEQ ID NO: 5937 - DNA, 810 bp, Arabidopsis lyrata
aaatcactccagtcacaaaactcagtcttctctactcatttttcaatcgcctcttcaaattttccgataaataaaagatgagttccggcgccggcagtggaacaaccaaaggaggcagaggaaagccgaaagctacaaagtccgtttctcgatcgtctaaagctggtcttcagtttcccgttggaagaatcgctagattccttaaagccggaaaatacgctgaacgtgttggtgccggtgctccggtttatctctccgccgttcttgagtacctcgccgctgagctattggagcttgctggaaatgcggcaagagataacaagaagacacgtatcgtaccacgacacattcagcttgcagtgagaaacgatgaagagcttagtaaacttcttggaagtgtaacaatcgctaatggaggagttttgcctaatattcatcagacacttctcccatcaaaggttgggaagaacaaaggcgatatcggatccgcttctcaagaattttgattcttatttcttggttgaatttttagcttgtaacatagacatggctctctattccacaatagttttgggattttcatatggtttaaaatctgtgtttgcaaatgaagttatgaatttggtttgaagatcagaaatagttaaatttgatgtctagaaattgcagattcaattgcttcaatacaagcaccaataggtttggctttagcaattgcttctgcaagtgaaactcttgcttcgctgtgagaatgtaataaggagacagtgttggaaacagcccatcttatatgagcctctttctctgttt

SEQ ID NO: 5938 - DNA, 591 bp, Cleome gynandra
cgtatttcctcgcttccattttcctcctaatagtctcgaatctcttgtgaggttctccttcttcgggcaagatatgagttcaggtggcggaagtagctcgacaaagggtggaagggggaagccaaaggctgcgaagtcagtatcgcggtcgcacaaagctgggcttcagttccctgtcggaagaatagccagatttctgaaggctgggaagtacgctgagcgcgttggtgctggggctccggtgtatctctcggccgttctcgagtaccttgctgctgaggttctggagcttgctggtaatgctgcgagagacaacaaaaagaaccgtatagtcccaagacacattcagcttgcggtgaggaacgatgaagagctaagcaagcttctgggtagtgtgactattgcaagtggaggagtgttgccaaacattcatcagactcttctcccgtctaaaagtggcaagggaaaaggcgatattgggtctgcttctcaggagttctagtctcctttggattcagcttttccttttactggttcaaatgtgtagtggtaaatgtgcaattttggcttctaatatatagactgggtttt

SEQ ID NO: 5939 - DNA, 612 bp, Flaveria ramosissima
ttttcgttaaaactagggttaggggtttatactccagatcgatccgacaatgagctccaaagccgatgccgattcgaagaaaggaggcagggggaaatcaaaggctacgaaatccgtctcccgatcttcaaaagccggtctccagttccccgtcggccggatcgctagattccttaaggccggaaagtatgcggagcgtgtcggtgccggagccccggtctacctctctgctgttcttgaatatctcgccgctgaggttttggagttggctgggaatgctgcaagggataacaagaagactagaatcgttccgaggcacatacaattggcagtgaggaatgatgaagaacttagcaagttgttgggttcagtgacaattgcaaatggtggtgttttaccaaacattcatcagactttgctgccaaagaaggttggcagtgataaaagagatattggttctgcttctcaagagttctagataaaagttgcataagcaatgcttctatggcataatcaacttcagcttcactacatttggttttaatctttgtaaaatgtttctttgatgtcaacttactatgatggttccattgaatcaaattttggcaatat

SEQ ID NO: 5940 - DNA, 649 bp, Petunia hybrida
attctcgtttcttttcgcccgataattaaagtctagggttagggtttctttttcatcacaacaaaaaatgagttcaggagcaggagcaggaaagggcggcgccggaagaggaaaaccaaaggcatcaaaatcagtttcccgatcatcgaaagcaggtcttcaattccccgttgggagaatcgctaggtttttgaaagcaggtaaatacgctgaacgtgttggtgctggtgctcccgtggacctctccgccgtcctcgaatatctcgccgctgaggtgttggagttggctggaaatgcagcaagggacgacaagaagaatcgtattgtgccaagacatattcaactgggtgtgaggaatgatgaggaactgagcaagctgttgggacatgttactattgctaatggaggtgttctgcccaacattcatcagactctgttgcctaagaaggctggtggtggcaagggtgatattggctctgcttctcaagagttctagatgtgaatgtggcttgtggtttttggaagaattaggagaaaaagtagtaaagcaaggttatgtaatatagaatttaatccttttgtattttgaatattgaatgaatggttttaaatgaaaaagcactataactgcttgcagttttggctacgt

SEQ ID NO: 5941 - DNA, 625 bp, Nicotiana tabacum
tactctagggttagattttaggattttcgtacccttttaaagagaaaaatgagtacaggtggaggagcaggtaaaggcggcgccggaagaggaaaaccaaaggcgtcgaaatcggtttctcgatcttcaaaagccggtcttcagttccccgttggcaggatcgcccgttttcttaaggctggaaagtatgctgaacgtgtcggtgctggtgctccagtgtacctttctgctgtccttgaatatctcgctgctgaggtgttggagttggcagggaatgccgcaagggacaacaagaagaatcgtatagtgccaaggcacattcagttggctgtgaggaatgatgaggagctgagcaagcttttgggtcatgttactattgccaatggaggtgttttgcccaacattcaccagaatctgttgcctaagaaagctggctctggaaagggtgatattggctctgcatcccaggagttttagatgtaaaaatggagcttttgttttcctgaaggattagaagaaatgagtgagacttgctttatgtaatataaaatacactttgtagtttgttattgaatggttataaatgaaaaagggctatgactacccgcagttttgattactcgtc

SEQ ID NO: 5942 - DNA, 654 bp, Triphysaria pusilla
acgcacaatatcaatttctcgaaaatttagggtttctgaatttgcatcttatttagtccaaaaatgagttctaaagcagcggcatcgacaaaaggcggcagaggcaagcctaaatcatccaaatctgtctcccgttcgtccaaagctggattgcaatttccggtcggtagaattgcacgttttctgaagaccgggaaatacgccgagcgtgttggcgccggcgctccggtttatctatctgccgtcctcgagtacttggccgcggaggttttggagcttgctggaaacgcagcaagggacaacaagaagaacaggattgtgcctcgtcacatacagttggcagtgaggaatgatgaggaattgagcaagcttttagggtgtgttacaatcgcgaatggtggtgtattgccaaatattcaccagacattgttgccgaaaaagaccggtgggaaggacaaggatattggttcggcatcacaagaattttaagctcatttgctgtggtttaaactttcttatgtttctggaatggtgttgagtctcgagtttggaccaaactctgtttttttgttgttttggaagaacctggttttgggggtgatattattttatatactggcgttttgatattaaaatatttaaaattcgttttcc

SEQ ID NO: 5943 - DNA, 703 bp, Triphysaria pusilla
acgcacaatatcaatttctcgagaatttagggtttctgaattagcacccgattaatcggaaaatgagttctaaagcagcggcatcgacaaaaggcggcagaggcaagcctaaatcatccaaatctgtctcccgttcgtccaaagccggattgcaatttccggtcggtagaattgcacgttttttgaagaccgggaaatacgccgagcgtgttggcgccggcgctccggtttatctatctgccgtcctcgagtacttggccgcagaggttttggagcttgctggaaatgcagcgagggacaacaagaagaacaggattgtgcctcgtcacatacagttggctgtgaggaatgatgaggaattgagcaagcttttagggtgtgttacaatcgcgaatggtggtgtattgccaaatattcaccagacattgttaccgaagaagaccggtgggaaggacaaagatattggctcagcatcacaagaattttaaactcatttactgtgttttaaactttcttatgtttctggaatggtgttgagtctcgagtttggaccaaactctgttttttttgttgttttggaagaacctggttttgggggtgatattattttatatactggcgttttgatattaaaatatttaaaattcgttttccatgtttccttatttgcacattttatatttagcaattttggttgatttct

SEQ ID NO: 5944 - DNA, 1138 bp, Ceratodon purpureus
gaagccttacccggactgccagcagccctaaacccctgaactcggtccaacacatgcatcaacagctcgcgtcgcggcgtgtccctcaaaggagttcccacccgggaacgacccacccgcgccgacggccccacccgcgccgacgacgccttcttcaacttcccccaacgtcactctgcctgccatttcttgtcttgtgtcgctccatctcttctcctggtgccgttgttgctgcttcccctcccaccctgccgtctcctaagggtaacgttgaggctgtgaaagggtgtgataccatccaagaccatgagttcccctgctgcgactggaggcggaggccgcggcaagtcgaaggcctcgaagtccatctctcggtcgcagaaggccgggctgcagttcccggtgggaaggattgctcgtttcctcaaggctgggaagtacgcggagcgtgtgggagcgggtgctccggtgtacttggctgcggtgctggagtacctggctgctgaggtgctggagttggcaggaaatgccgcaagagacaacaagaagaaccgtatcgtgcctcgccacatccagttggcagtgcgaaacgatgaggagctgagcaagctgctgggcacggtgaccatcgccgcaggaggagtgctgccgaacatccacacggtgctgcttccgaagaagactggcaagggcgggaaggacatcggagggagcatctcccaggagttctagatgggcagtgtgcagggcgagttttgtacatagctccagtgcgttgctctctctagtgtgtgtgagaattggaagaatatacaacacgacgtaacggtgtcctgataggggaacaccctgacagacgagattcattgtgtgtgtgatggccacatgaaacacagtctaggcccaggtattttgaagcgcggtatcagacaaccgtataatgcaagtctgtgtttttttactgtacgttgccagaaagggttgtgcatgaactatggcaggcaatcgttacaggtttcggagtgagtgaggatgtgtctgccatcaccttggacggacatcaccacggtggtgtaacatggcatcagttttgtaatgtgacttggcgattctagattaccggacttgatggtatgac

SEQ ID NO: 5945 - DNA, 739 bp, Tropaeolum majus
atctaaagaaacaaaagcattagacttcttctgctatatttcttgattcgatttcttcatatcggctttcagtttttgttcgaattccagggctaagggtttgtatcatttgtgttttgcgattagaagatgagttctactggagctggatcaaccaagggcggaagaggaaaacctaagacctccaaatcagtaacgaggtccactaaagccggtcttcagtttccggttggaagaatcgctagatttctcaaggctggtaaatacgctgaacgtgtaggtgccggtgcccctgtttatctttctgccgttttggagtatttggctgcagaggttttggaacttgctggcaatgctgctagagataacaagaagaacagaattatacctagacacattcagcttgcaataaggaacgacgaagagttgagtaaactccttggagcagtaaccattgccaatggcggcgttctacccaatattaaccagactctactaccgaagaagattggtaaaggaaagggagatattgggtcagcttctcaggaattctagtcgttccatattaattcctggatccgttcttcatgttttgcttccctagtgaatgtaaattagatggttttgtttaggagttccgttttatctcaatcattcaaattttccttcggtttaacatataatacataatatttttcccaatataaacgtttatttaacgtaagattgagcctttaat

SEQ ID NO: 5946 - DNA, 924 bp, Fragaria vesca
gtttcccgcgaattccaaaagcttaaggtgccacgctggcgatcccccgtgaccttcctctcgaccaatcagcgcacaccatcgcgtcctatatataagaacccccactaccttcctcaattcatctcacagcaaaatccaaagccttttctctctctcacaaattagactaggtcatttttagggttagggttttctttgattttcgccgccggtttctgaaaatgagcggaaaggaaagtgggtcgactaagggaggtaggggaaagccaaaggctaccaagtcggtgtccaggtctagcaaagccgggcttcaatttccggtgggtaggatcgcccggtttctcaagtccggcaagtacgccgagcgtgtcggcgccggtgctccggtgtatctttcggctgttcttgagtatctggctgctgaggtattggagctggctggtaatgcagctagggacaacaagaagaatcgaattgtgccaaggcacattcagcttgcggtgaggaatgatgaggaactaagcaagcttttggggtctgtgactattgccaatggaggagtgttgcccaacattcaccaaacccttttgcctaagaaggttgggaaaggcaagggtgatattgggtctgcttcgcaggagttctagggttcttgctctgtctggttatctccttctgtggagatttttagttaccccagttgtaatataccatgggttttgttagtgtttctctgaaccttgttggtctggtactttggatcttatgctataaatgaatggttctgtcagtagtttgatgaattgaatctgtgtcattttggtgtttattatggtgctttcagtggtgtttagagttcatttcaacttttcgagttcaaaatgcttggtgtgttgagaatgaattcctgaatttaacatg

SEQ ID NO: 5947 - DNA, 720 bp, Abies balsamea
gcgtggataggtagttagttattcagggcgaggtggtggtttgttcctgtgaaaaagtattcaattgcaatacccaacagggaaatcggcagcatgagttctacaggaggtggcggtggcggccgagggaaggcgaagtctacaaagtccgtttcgaggtctcagaaggcgggcctgcaattcccggttggaaggattgcacgctttctaaaggcgggcaagtatgcagaacgcgttggtgcaggggctcccgtttatttggctgcggttttagagtatctagcagcagaggtgctggagttggctggaaatgcagcacgggacaacaagaaaaacaggattgtgcctcgacatatccaactagctgtcagaaatgacgaagagcttagcaaactattaggttctgtgactattgccaatggtggtgtgttgccgaatattcatggtgttttactacctaagaaggctggaaagggaaagggagccgaggttggcagcgcctctcaggaattttagataatacaggatggaatggttatgttaaatgctgctgccaacattctaagggattacaatgccgtaacaatcactaccccgccccaagtgccagaatctggcagcgggaattcttaaggcgttcttactcttaagattatacagtcttaggcggatgaaattttgatatttagaccaatagaatacattttgttttggtttcag

SEQ ID NO: 5948 - DNA, 974 bp, Ricinus communis
gagctcttgattcatagcgattggaagaaaatggttctactcaatgatagtggaaaaataaaggccggtctcataattgaattttgttatgggctaacatcaatggaagcccatcaaatcagccacgtcggcgatccgtgcagttaagcaactctcttcttctacctctataaatataacccttttgctcatatacatgtatacctttttttctctctgttgatttttataaattcacaagtttgcgtttcaatcttgaactgaacagaagagatgagttcgggaggggcaacaaagggtggcagaggcaaacccaagtcttcaaaatcggtgtccagatctcagaaggctggtcttcagttccctgttggccgtatcgcccgttttctcaaagccggaaagtacgctgatcgtgttggtgccggcgctcctgtctatctttcggccgtcctcgagtatcttgctgctgaggtccttgaacttgctggcaatgctgcaagggacaacaagaagaaccgcattgttcctaggcacattcagcttgctgtgaggaatgatgaggagctcagcaagctcttgggaactgttactattgcaaatggtggtgttttgcctaacattcatcagaatctattgcctaagaaggcgaaaggcaagggcgacgttattggttctgcatcccaggaattctagagcgttttatccagtatgttacgcacttcataattttgtcaagaaatgggatcagatcatcccagagtttctttataatcattttgctccttgtaaacattacttcatttcggagggaagtttcgattgaatataggaaatgataggagatcatcaggaaatatgtcaattttcttacaggtcaatctatatggtgatgttatattgtggaactcttgattgtatttcaatgaaatgatgtgctttgagatagtcaagtggattttgtttagtaataagcg

SEQ ID NO: 5949 - DNA, 726 bp, Cichorium intybus
accaaatttaaatctctctcgtttcgtgataactagggttagggtttatcattcagatcaatcgcttgacaagaaaatgtcttccaaatccgatgccaaaggtggaagaggaaaagctaaggccacaaaatctgtgtctcgatcctccaaagccggtcttcagtttcccgtcggtaggattgccagatttctcaaggctggaaagtatgccgagcgtgtcggcgccggagctcccgtttatctctccgccgtccttgaatacttagccgccgaggttttggagttggctgggaatgccgcaagagataacaagaagtccagaatagttccaagacatattcaactggcagtaaggaacgatgaagagcttagcaaattgttggggtctgtgacgattgcaaacggtggcgttttacccaatatacattcaacattgctaccaagcaaggtcgggaaggacaaaggtgaaattggttctgcttctcaagaattctagagaaaaccaccccccccccccccccccccccccccccccccccccccccccccccccccccccccttatcaaaattttggtagtatatttaatatttaatgttttccggtgatttgataccgctataatgtctctttacatgatttcgtgatcttttgtgcgtgctttagatttatctatttaatttgttgatacgtttgaagatgtgtgaagaactacgatctttgaac

SEQ ID NO: 5950 - DNA, 657 bp, Cichorium intybus
accagtaccaaatttaaatctctctcgtttcgtgataactagggttagggtttatcattcagatcaatcgcttgacaagaaaatgtcttccaaatccgatgccaaaggtggaagaggaaaagctaaggccacaaaatctgtgtctcgatcctccaaagccggtcttcagtttcccgtcggtaggattgccagatttctcaaggctggaaagtatgccgagcgtgtcggcgccggagctcccgtttatctctccgccgtccttgaatacttagccgccgaggttttggagttggctgggaatgccgcaagagataacaagaagtccagaatagttccaagacatattcaactggcagtaaggaacgatgaagagcttagcaaattgttgggatctgtgacgattgcaaacggtggcgttttgcccaatatacattcaactttgctaccaagcaaggttggaaaggataaaggtgaaattggttctgcttctcaagaattctagagaaaaccaacttggaatatggatcaaaatgctctttttggggttaatctttgcaatcagttttatcaaaattttgatagtatatttatttaatatttaatgttttccggtgattcgattactgctataatgtctccttccatgatttcatgatc

SEQ ID NO: 5951 - DNA, 802 bp, Gossypium hirsutum
agaatcctccattggtaaaattttaaaccgacactttcgccattccccaattttcatcatttacaacaagaagttttagggttagggattatttttgaaagatgagtcccaccgaaggatcaacgaaaggcgggagagggaagcccaagtcaaccaaggcggtgtcgagatcgcataaggctgggcttcagtttccagtggggaggatcgctaggttcttgaaagccggaaaatatgctgagcgtgttggtgctggagctcccgtctatctctccgccgtattagagtatcttgctgctgaggttttagagcttgctggaaacgcagcgagagacaataaaaagaatcgaatagttccaaggcacatccaactagctgtaaggaacgatgaagagctaagtaagcttttgggttcagtcaccattgcaaatggaggtgttttgcctaatattcaccagactcttcttcccagtaaagggggaaaaagtaagggggatatcggatcagcttctcaggagttttaaactctctctcgcttttttgcttccatgagtttcttttaaacggttgtatgatatgcaacgtttagtactaaatttttttatttatggctttagccttgaacccctcatgttatctttttgatggaagcagtaatatatcaaagctttttaatattaaatctccaatgtccctttttcatttcctttcctgcacgattgattgttgatttttatttcggatgaatatatattttgttcctaggttcaagcaagaatgaatcaatgttgggttttggtgc

SEQ ID NO: 5952 - DNA, 916 bp, Gossypium hirsutum
agggaatcctccattggtaaaattttaaaccgacactttcgccattccccaattttcatcatttacaacaagaagttttagggttagggattatttttgaaggatgagtcccaccgaaggatcaacgaaaggcgggagagggaagcccaagtcaaccaaggcggtatcgagatcgcataaggctgggcttcagtttccggtggggaggatcgctaggttcttgaaagccggaaaatatgctgagcgtgttggtgccggagctcccgtctatctctccgccgtattagagtatcttgctgctgaggttttagagcttgctggaaacgcagcgagagacaataaaaagaatcgaatagttccaaggcatatccaactagctgtaaggaacgatgaagagctaagtaagcttttgggttcagtcaccattgcaaatggaggtgttttgccgaatattcaccagactcttcttcccagtaaagggggaaaaaataagggtgatatcggatcagcttctcaggagttttaaactctctctcgctcttttgcttccatgagtttcttttaaacggttgtatgatatgcaacgtttagtactaaatttttttatttatggctttagccttgaactcttcatgttatctttttgatggaagcagtaatatataaaagctttttaatattaaatctccaatgtccctttttcttttcctttcctgcacgattgattgttgattttaattttggatgaatatatatttgttcctaggttcaagcaagaatgaatcaatgttggattttggtgcaatttcgtgtttcgctccggattctgcatttctgctcagatgtttgctcatgagctttcttaatctaatgccaaatttgctaatttcaattcccagaacaccaataaaagttt

SEQ ID NO: 5953 - DNA, 666 bp, Panax ginseng
atcctttctctctccttgggttttgttattcggtacagaacatttagattatcagatcgaagaaagatagagatgagttcaaaagaaggttcaaccaagggcggaagaggaaagccgaagtcctcgaagtctgtgacgcgatcttcaaaggccggtcttcagttccctgtcggtagacttgcccgctttctcaagaacggaaagtacgccgagcgtgtcggtgccggagctcctgtctatttgtctgtcgtcctcgagtatctcgccgctgaggtgttggagttggctgggaatgcagcaagagacaacaagaagaatagaatagtgccaagacacatacagcttgcagtgaggaatgatgaggagttgagcaagcttttgggtgctgtaacaattgccaatggaggtgttttacccaatattcaccagaatttgctacccaaaaaggttggcaaaggcaaggaagacattggctctgcgtctcaggagttttaggaagacattgtgcttagtagacatgttggtttgtcttctcttcttagcttattaggaaagagaaatatgttatatataatataccatggtgtttgattatttggcgtgtgatgagaatttaagtttttaatttttttatcataaaaattatatatttgttttgagcttggt

SEQ ID NO: 5954 - DNA, 793 bp, Gossypium raimondii
gaatcctccattggtaaaattttaaaccgacactttcgccattccccaattttcatcatttacaacaagaagttttagggttagggattatttttgaaggatgagtcccaccgaaggatcaacgaaaggcgggagagggaagcccaagtcaaccaaggcggtatcgagatcgcataaggctgggcttcagtttccggtggggaggatcgctaggttcttgaaagccggaaaatatgctgagcgtgttggtgccggagctcccgtctatctctccgccgtattagagtatcttgctgctgaggttttagagcttgctggaaacgcagcgagagacaataaaaagaatcgaatagttccaaggcacatccaactagctgtaaggaacgatgaagagctaagtaagcttttgggttcagtcaccattgcaaatggaggtgttttgccgaatattcaccagactcttcttcccagtaaagggggaaaaaataagggtgatatcggatcagcttctcaggagttttaaactctctctcgctcttttgcttccatgagtttcttttaaacggttgtatgatatgcaacgtttagtactaaatttttttatttatggctttagccttgaactcttcatgttatctttttgatggaagcagtaatatatcaaagctttttaatattaaatctccaatgtccctttttcatttcctttcctgcacgattgattgttgattttaattttggatgaatatatatattgttcctaggttcaagcaagaatgaatcaatgttggat

SEQ ID NO: 5955 - DNA, 577 bp, Actinidia deliciosa
ctcgccaggccccattattctttcaatccctctctctctagggttttcaatccccaaattaggatggcttctgcggcttcgagcaaaggaggcagaggcaagcccaaggcctccaaatcggtatccagatctcataaggctggtctccaattcccggtcggaagaatcgcccgattcctcaaggccggcaagtatgcagagcgcgtcggtgctggtgcccctgtctacctctccgccgtccttgaataccttgccgccgaggttcttgaacttgcacggaatgctgctagggacaacaagaagaatcggattgttccaaggcacatacagcttgcggtgagaaacgatgaggaattaagcaagcttttgggggcagttacgattgcaaacggtggggttttaccgaacattcatcagaatctgttgccgaagaaggttgggaaagggaaaggcgagattggatctgcttcacaagagttttaagactttctttaaggagatttaagaattcaagattttcatatgatggatgggatctcgtttggtactcttcagcatatgatatcttccatccctg

SEQ ID NO: 5956 - DNA, 707 bp, Tropaeolum majus
ttctctgaattaattttacacaggcacataatcaagtgtttaagggttgtatagttaatcctaagatcggaaaagatgagttccactggcggttctaccaaaggaggaagagggaagccaaagacatctaaatccataaccaggtctactaaagcaggacttcaattccctgttggaagaattgcaaggtttttgaaggccggtaaatatgccgagcgtgttggcgctggtgcacctgtctatctttctgcagtccttgagtatcttgctgctgaggttttggaacttgctggtaacgcagctagggacaacaaaaagaataggatatctcctagacacatccagcttgctgtgaggaatgatgaagagctaagcaagcttctaggggctgtaaccatcgccaatggtggtgttttaccaaacattcaccagaatcttctccctaaaaaagctggcaaaggagacatcggttccgcttctcaagaattttagtcaatttcccatctactatcctctctttaactttggccatagttgtaatatagatgtgctatttgtttgaatatcgtttttaagtataaatgttttcgtggtgtaaactgaagatttccaatcaatctaatgatagtttatgcgttcatataaattctcttttctctccataaatcttaattgattgtttttgattagtatgataattatattaa

SEQ ID NO: 5957 - DNA, 936 bp, Allium cepa
ctttacaaaccaaacccgaattttttcttctagatagagatgagttctgccggaagaggaaaggcgaaaagcagctcaaaatcagtttctagatcttctaaagcagggcttcagtttcctgtcggaaggatcgccagatttctgaaggcaggaaaatacgccgagagagtcggtgccggcgctccggtctatatggctgctgttctcgagtatttagctgccgaggtgctggagctggctggaaatgcagcaagggacaacaagaagaatagaatagtgccaaggcacattcagctcgctgtgaggaacgatgaagaattaagcaagcttcttggaactgtcaccattgccaatggaggtgttttgcccaatattcattccactttgcttcctactaagcctggaaagggaaagggagatattggttctgcttctcaggaattttagtttgttttacttaatttatatataagttgtcactaaatgattcacctttataaatcctatgaatatggaaagtctttttgatatggttgataaattttcctgtgattttgatgctggaacgaatgcattatgtattcttaaatgcatccacttttggcttaattggagtgcagattggttatgcattttaattagttttcattgtattcaaaacttgtttattgataaaattgtgttgtgttatgagggcagaagtgttgcaaaaaagtgaatattatcatcgcaaatttatctttgcacttgcttcttcaggtagaggaactgaagagtatacatgttacatgggttgtgataaacgtgaagaaaattttaaaagaaaaacaaattatcgagtttttggatgttattttaacaaatgttgaagttgcacaaatgagctactagccaaaattttatattaaaaaagtgatataattgaaaaacacacac

SEQ ID NO: 5958 - DNA, 896 bp, Pseudotsuga menziesii
atttggagctgctgcctgctcgtaatatatttatattcagttattcttcagggcgaggccgtggttcgcttcagtgaagaagaagaagatttaactgcaacacccaacacagggatatcggcagcatgagttcttcgggaggtggcggcggtggccgagggaaggcgaagtctactaagtccgtttcgaggtctcagaaggctggtctgcaattcccggttggaaggattgcccgcttcctaaaggcgggaaaatatgcggaacgcgttggtgcaggggctccggtttatctggctgcggttttggaatatctggcagcagaggtgctcgagttggctgggaatgcagcacgggataataagaaaaacaggattgtgcctcgacatatccaactagctgttagaaacgacgaagagctcagcaaattactaggttctgtcactattgccaatggtggcgtgttgccgaatattcatggtgttttgctacccaagaaggttggaaaggggaagggggccgagataggcagcgcttctcaggagttttagatgatgataagatggactgttaagtgctgtttacattttcggggattataatggcgtcaccaatcactgcccgcactgattgccaaattctggcagagcaagtcttgaggcgattttagctgttaaccttccattagatatactattttaggtggacgattttttgatatttagaccagtggaatacgctctgttttagctttcagaacatcttatagatatatatatatattctcggcagaaggttactattgtcattatcattctcagaggaggaatgttcaaagttaaagtcgtctctgaaatgtgtataccaatgcaattttggtgtttgaatacattgcccct

SEQ ID NO: 5959 - DNA, 1031 bp, Picea glauca
aataacacccggtcagttttggagcaactgcctgctcgtatcatatattcattcattctacgggtagaggtggtggtttgttcctgtgaatcaactgaaatactcagtagggaaaacggcagcatgagttcttcaggaggtggcggtggtggccgagggaaggcgaaatctacaaagtccgtttcgaggtcccataaggctggcctgcaattcccggttggaaggattgcccgcttcctaaagtcgggaaagtatgctgaacgcgttggtgcaggggctccagtttatttggctgctgttttggagtatctagcagcagaggtacttgagttggctgggaatgcagcacgggataacaagaaaaacaggattgtgcctcgacacatccagctagctgtcaggaacgacgaggagctcagcaaattattaggttctgtgaccattgccaatggtggtgtgttgccaaatattcatggtgttttgctacccaagaaagctggaaagggaaagggagccgatattggcagcgcctctcaagagttttagatgatgatgataagatggaactgttaccaatcactgcccgccttgagtgccagattctggaaaagtcaattcttaaggcgttttaactgttaaccttccattaaagattatatagttttaggtggaggaaatttttgatacttagaccaatagaatatagtgttttttggcttttcagaaaccacctatagatatatgttcttggcagaagattattattgtcattatcattctcagaagggggaatgttcaatattctagtcgtcactgaaatgtgtgtacccagcggggcaaattttttttgtgttttgaatgcattaaacttgcatgtccacttttaggtggcttttctgtgttttaatttaatactagttgaggataggtgtatttttgagtatgaaggattttgtgtctgagaaatacatgtcgctgaagggtatcatttaatcaaatactaaaattaaataattaccccttacggtaac

SEQ ID NO: 5960 - DNA, 503 bp, Citrullus lanatus
gccctcgatatttattttttctctgtcaagttacacattctctagggtttcgaccatccgccggaaaagatcgtagaatgagttcatcggcttctaccaagggcggcagagggaaaccgaaagccacgaagtctgtttctcggtctcagaaggctggtcttcagttccccgtcggtcgtattgcacgatttcttaaagccggtaagtatgcggagcgtgtcggtgctggtgctcccgtctacctctccgccgtcctcgaatatctggccgccgaggtgcttgagcttgcaggcaatgctgccagagacaacaagaagaatcgcattgttccaagacacatacagcttgctgtccgcaatgacgaagagctaagcaagcttttgggtgatgtgaccattgcaaatggtggtgtgttaccaaatatccatcaaaatctcttgcctaagaaggcaggatcaggcaaaggcgacattggatctgcatcacaagagttctaatcgtgt

SEQ ID NO: 5961 - DNA, 785 bp, Secale cereale
gactatccccagcccagtccccacccacctctcgaaagggtttagaagcttccggaggcgaatcggcgatgagttcctcgggagcaggcgtcgccggccgcggcaaggcgaaggcgtccaagtcggtgtcgcggtcgtccaaggccgggctccagttccccgtcggccgcatcgcgcgctacctcaaggccggcaagtacgccgagcgcgtcggcgccggcgcccccgtctacctctccgccgtcctcgagtacctcgccgccgaggtgctggagctggcgggcaacgcggcgcgggacaacaagaagacgaggatcgtgccgcggcacatccagctggcggtgcgcaacgacgaggagctgagcaagctgctgggctcggtgacgatcgccaacggcggcgtcatgcccaacatcaaccaggtgctgctgcccaagaaggccgggcccaagggggagtatcggctcggcctcccaggagttctgagcgcgcgcggcttcaaggcgaagaaggagagaggccgtcctgtcctgtcatgtcttgtctgcctgacgacgatgttcatctgaagttgtgtggattgggatgtttttggagtctgaaactcggggtggaaaaaaccgtggtgtcttctgggctctggctcgctgttgaatgaatgagttgatcgatcagtagaagagaggaaacatatacatgtggtttcttatatgcgaacatgatattgctaagttgtcttttaagattgatgatttggttcagtcgtttgaatgattgaaataaag

SEQ ID NO: 5962 - DNA, 846 bp, Cycas rumphii
cttatttctaagacagctcgggttgccgtcgttcaacatctgatctttcgatcgagatttccgttgctgcatatgcgatttgctttggcgttgggttgatccgcagatttattctggaagctgtgtatttgcacgagattgatagctgagaaaacatgagttcctcgggtgcaaagggtggccgtggaaaggccaaggcgacgaaatctgtgtcccggtctcaaaaggccggtttgcagtttccagtgggtaggatcgccagatttttgaaggccggaaagtatgccgagcgtgtgggggctggcgctcccgtgtacctcgctgcagttttggaatatctggcagccgaggtgttggagcttgctggtaacgcagcccgagataacaagaagaatcgtatagtgcctagacacattcagttggcggtcagaaatgatgaggagttgagtaagctgcttggcactgtgaccatcgctaacggaggggttttgcctaatattcatcaagtccttttgcccaagaaggctggcaagggtaagggcgaggttggatctgcgtcccaggagttttgatttggtcaattgtaattgttgctggatgtaattaaacggctttgtatgttgaagctattcctgtgtccgtccgattggaaggctagtcctgtgtccgattgtaagggctttggttctttttgagcgtgaaacggcatttgccagtttgagtctgtggtgcctttaattttaatggatattttgagtttaattcacagcaggtttcaagcctttgctagtaaagatggccatttttcgctgaatgatgtgtggttgtttgtttggaattgtaaca

SEQ ID NO: 5963 - DNA, 750 bp, Cycas rumphii
cgttgctgtatatgcgatttgctttggcgttgggttgatccgcagatttattctggaaactgtgtatttgcacgagattgatagctgagaaaacatgagttcctcgggtgcaaagggtggccgtggaaaggccaaggcgacgaaatctgtgtcccggtctcaaaaggccggtttgcagtttccagtgggtaggatcgccagatttttgaaggccggaaagtatgccgagcgtgtgggggctggcgctcccgtgtacctcgctgcagttttggaatatctggcagccgaggtattggagcttgctggtaacgcagcccgagataacaagaagaatcgtatagtgcctagacacattcagttggcggtcagaaatgatgaggagttgagtaagctgcttggcacggtgaccatcgctaacggaggggttttgcctaatattcatcaagtgcttttgccaaagaaggctggcaagggtaagggcgaggttggatctgcgtcccaggagttttgatttggtcaattgtaattgttgctggatgtgattaaacggctttatatgttgaagctattcctgtgttcgattggaaggctattcctgtgtccgattggaagggctttggttctttttgagcgtgaaacggcatttggcagtttgagctctattgagtctgtgatgcctttaattttaatggctattttgagtttaattcagcaggtttcaagcctttgctagtaaagatggccattttt

SEQ ID NO: 5964 - DNA, 717 bp, Cycas rumphii
ggatttgctttggcgttgggttgatccgcagatttattctggaaactgtgtatttgcacgagattgatagctgagaaaacatgagttcctcgggtgcaaagggtggccgtggaaaggccaaggcgacgaaatctgtgtcccggtctcaaaaggccggtttgcagtttccagtgggtaggatcgccagatttttgaaggccggaaagtatgccgagcgtgtgggggctggcgctcccgtgtacctcgctgcagttttggaatatctggcagccgaggtattggagcttgctggtaacgcagcccgagataacaagaagaatcgtatagtgcctagacacattcagttggcggtcagaaatgatgaggagttgagtaagctgcttggcacggtgaccatcgctaacggaggggttttgcctaatattcatcaagtgcttttgccaaagaaggctggcaagggtaagggcgaggttggatctgcgtcccaggagttttgatttggtcaattgcaattgttgctggatgtgattaaacggctttatatgttgaagctattcctgtgtccgattggaaggctattcctgtgtccgattggaagggctttggttctttttgagcgtgaaacggcatttgccagtttgagctctattgagtctgtggtgcctttgtttttaatggctattttgagtttaattcagcaggtttcaagcctttgct

SEQ ID NO: 5965 - DNA, 564 bp, Nuphar advena
agggttttgcatctctctctctctctcaaggaagaagaagaagaagatgagttctacgggaacgaagggcggtcgagggaagccaaagtcgtcgaagtcggtgtcccgttcgcagaaggccgggcttcaatttccggtcgggaggatcgctcgttttctcaaggcagggaagtatgcagagcgagtcggcgcgggcgctcccgtctacctttccgccgttctcgaatacctagcagccgaggtgttggagttggccgggaacgctgcgagggacaacaagaagaatcggatcgtgccgaggcatatccagttggcagtgaggaacgatgaggagctgggcaaacttctgggtacggtgacgattgctaacggcggggtactgcccaatatccaccaggttctcctgccgaagaagacggggaaggtaaagagcgagcctggttctgcgtctcaggaggtttagggcttgcttttttctcctctcctttttgggcctctttcgggcgggagtttgatgcgccggttgtgtttttgatggttagggttggatcttgtatatttctt

SEQ ID NO: 5966 - DNA, 664 bp, Primula obconica
tcggaaggaacaacaaagggcggacgtggcaagccgaagtcggcgaaatcggtgtcgcgctcgtccaaagccggtctgcagtttcctgtcggtaggatcgctcggttccttaaagccggaaagtacgccgagcgtgtcggcgccggtgctcccgtctacctctctgccgttctcgagtatctcgctgccgaggtgttggagctagctgggaatgcagcaagggataacaaaaaaaacagaatagttccacgtcacattcagctggcagttcggaacgacgaggagctgagcaagctgttgggttctgtgaccattgctaacggtggtgttttgcccaacatccattcgactcttctccccagtaaagttggtaaaggcaaggccgatatcaactctgcttctcaggagttttagatgatacactactttggtggtcgagggccgtttgatgatatgataacataagagtttagtttctcatgatgtgtctcaatctatggataaagtacctaatgatgcagattttatgatggaatttaagttttatgttgaatggagcagctgtagtttttatgacccttgccatgcttctactaaaaagttatttgttgagtaacttcattttgctacaaaattgtattagtccacttgatttttcaaaagg

SEQ ID NO: 5967 - DNA, 704 bp, Arabidopsis lyrata
actcatattctcaattcccagcacaccaacacttcatttctcttcgaattctgctaaagtctcttcaagtcgttctagtttcgaagagaacgatgagtactggagcaggaagcggaacaaccaaaggtggcagaggaaagccaaaggccaccaaatccgtctctcgttcgtccaaagccggtcttcaattccctgtcggaagaatcgccagattcctcaaagccggtaaatacgccgagcgtgtcggtgccggagctcccgtctatctctccgctgttctcgaatacctcgcagctgaggtgttggagcttgcgggaaacgcagcaagggataacaagaagacacgtatagtaccaagacacattcagcttgcagtgaggaacgacgaagagctgagtaaacttctgggaagtgtgacgattgcgaatggaggtgttttgccaaatattcatcagaatcttttgccttccaaggttggcaagaacaaaggagatattggatctgcttctcaggagttctgagtttcttctttgttctgtttctgttgtttggattccgaacttgtaaaatagaccctgttggtgtttttttaggggatcagatttgcttaaaagcttggctattgcctaagtatgtttaattactgaatgatataatttttcggaactgatcaagtatcaatggtactggtattaaacaatata

SEQ ID NO: 5968 - DNA, 726 bp, Arabidopsis thaliana
actcatcttctcaattcccagatcatctacaatagtcatttctcttcgatttcttcaaactctcatcaaatcgtttatctgttctaaatttcgaagaagacgatgagtacaggcgcaggaagcggaacaaccaaaggtggcagaggaaagccaaaggccaccaaatccgtctctcgatcatctaaagccggtcttcaattccccgtcggaagaatcgctagattcctcaaatccggtaaatacgccgagcgtgtcggtgccggagctccggtctatctctccgctgttctcgagtacctcgccgccgaggtgttggagctggcgggaaacgcagcaagggataacaagaagacacgtatagtaccaagacacattcagcttgcagtgaggaacgatgaagagttaagcaaacttctgggaagtgtgacgattgcgaatggaggagttttgccaaatattcatcagactcttttgccatccaaggttggcaagaacaaaggagatattggatctgcttctcaggagttctgaggttcttagacttcttagttcagttctcttgtttggattcggaacttgtaaaatagaccctgatggtgttttttggggatcaaattaggttttaaagctaagtatatttggcttttgcctaagtatgtttaattagtgaatgatatgatatttcggaacgaatcatgtatcaatggaactgaattaatcgatata

SEQ ID NO: 5969 - DNA, 574 bp, Brassica juncea
acacaacaacatcttccctctctactcaagacttcaccaacttttcatctacaatcgacgatgagcaccggcgcaggaagcggcacgaccaaaggtggtagaggaaagccaaaggccaccaagtccgtctctcgttcttcaaaggccggtcttcagttccccgtcggaagaatcgctagattcctcaaggcaggcaaatacgccgagcgtgtcggcgccggagctccggtctatctctccgccgttctcgagtacctcgccgctgaggtgttggagcttgctggaaacgcagcgagggataacaagaagacgcgtattgtgccgagacacattcagcttgcggtgaggaacgatgaggagctgagtaagcttctgggagctgtgacgattgctaacggaggtgttttgcccaatattcattcgaatcttttgccttctaaggttgggaagaacaaaggagacattggatctgcttctcaggagttttgagtttcatctttcttttgtctctttgttgtctcgtttgctctttgtaaaatatcaactttgttttgaagctaagcttatggctttt

SEQ ID NO: 5970 - DNA, 599 bp, Brassica juncea
agactaggatcaccaactttcccactcgattttcttccaacagttttcgcttcaaagcaaacgatgagcaccggcgcaggaagcggaacaaccaaaggtgggaggggaaaaccaaaggccaccaaatcagtctctcgttcctccaaggccggcctccagttccctgtcggaagaatcgccagattcctcaaggccggtaaatacgccgagcgtgtcggtgccggagctccggtctatctctccgccgttctcgaatacctcgccgctgaggtgttggaactcgctggtaacgcggcgagggataacaagaagactcgtatcgtgccgaggcacatccagctagcggtgaggaacgatgaggagcttagtaaacttctcggagctgtgacgattgctaatggaggggttttgcccaacattcattccaaccttttgcctgccaaggttgggaagaataaaggagacatcggatctgcttctcaagagttctgagtttcattttgtctctttgttgttgtcggattccctcttttgtaaaatatcagacttgttttgaagctaaagcgtatggcttttgcaacaaatgtttcaatggcaga

SEQ ID NO: 5971 - DNA, 592 bp, Brassica nigra
ctttccctcgattttcttcacagttttcgcttttaaagcaaacgatgagcaccggcgcaggaagtggaacaaccaaaggtgggaggggaaaaccaaaggctaccaaatcagtctctcgttcctccaaggccggcctccagttccctgtcggaagaatcgccagattcctcaaggccggtaaatacgccgagcgtgtcggtgccggagctccggtctatctctccgccgttctcgaatacctcgccgctgaggtgttggagctcgctggaaacgcggcgagggataacaagaagactcgtatcgtgccgaggcacatccagctagcggtgaggaacgatgaggagcttagtaaacttctcggagctgtgacgattgctaacggaggggttttgcccaacattcattccaaccttttgcctgccaaggttgggaagaataaaggagacatcggatctgcttctcaagagttttgagtttcaccctttccttttgtctctttctttgttgttgtcgtattctctctattgtaatatatcagacttgttttgaagctaaaccgtatggcttttgcaccaaccaaatgtttcaatgg

SEQ ID NO: 5972 - DNA, 644 bp, Brassica oleracea
cacaacatcttctttcctctgtactcaagacttcaccaaccttttagattcgatatctgcgaaattttcttcttcaatcgacgatgagcaccggcgcaggaagcggcacgaccaaaggcggtagaggaaagccaaaggccaccaagtccgtctctcgatcctcgaaggccggtcttcagttccccgtcgggagaatcgccagattcctcaaggcagggaaatacgccgagcgtgtcggcgccggagctccggtctatctctccgccgttctcgagtacctcgccgctgaggtgttggagcttgctggaaacgcggcgagggataacaagaagacgcgtatcgtgccgaggcacattcagctcgcggtgaggaacgatgaggagctgagtaagcttctgggagctgtgacgattgctaacggtggtgttttgcccaacattcattcgaaccttttgccttccaaggttgggaagaacaagggagacattggatctgcttctcaagagttctgagtttcatctttccttttggtctctttgttgtcggattcccttgtaaaatatcaactttgttttgaagctaatggggcttttgtaacaaatgtttcgatgatataatattacctaatggatcttaggtttgat

SEQ ID NO: 5973 - DNA, 724 bp, Brassica rapa
gcacacaacatcttcctctgtactcaagaagacttcaccaacttttcttcttcaatcgacgatgagcaccggcgcaggaagcggcacgaccaaaggcggtagaggaaagccaaaggccaccaagtccgtctctcgttcttcaaaggccggtcttcagttccccgtcggaagaatcgctagattcctcaaggcaggcaaatacgccgagcgtgtcggcgccggagctccggtctatctctccgccgttctcgagtacctcgccgctgaggtgttggagcttgctggaaacgcggcgagggataacaagaagacgcgtattgtgccgaggcacattcagctcgcggtgaggaacgatgaggagctgagtaagcttctgggagctgtgacgattgctaacggtggtgttttgcccaacattcattccaaccttttgccttccaaggttgggaagaacaagggagacattggatctgcttctcaagagttctgagtttcatcttggtctctcttttgttgtcggattcccttgtaaaatatcaactttgttttgaagctaatggggcttttgtaacaaatgtttcgatgatataatattacctaatggatcttaggtttgattcattttttttccaattgcatgttcgatgttgcagttaaatacaattcagaccatatttgcggaacataaacccagtttcaatttcagtgtatctccttcagttgt

SEQ ID NO: 5974 - DNA, 816 bp, Brassica napus
cacacatcttctttcctctgtactcaagacttcaccaaccttttagattcgatatctgcgaaattttcttcttcaatcgacgatgagcaccggcgcaggaagcggcacgaccaaaggcggtagaggaaagccaaaggccaccaagtccgtctctcgatcctcgaaggccggtcttcagttccccgtcgggagaatcgccagattcctcaaggcagggaaatacgccgagcgtgtcggcgccggagctccggtctatctctccgccgttctcgagtacctcgccgctgaggtgttggagcttgctggaaacgcggcgagggataacaagaagacgcgtatcgtgccgaggcacattcagctcgcggtgaggaacgatgaggagctgagtaagcttctgggagctgtgacgattgcgaacggtggcgttttgcccaacattcattcgaaccttttgccttccaaggttgggaagaacaagggagacattggatctgcttctcaagagttctgagtttcacctttccttttggtctctttgttgtcgggttcccttgtaaaatatcaactttgttttgaagctaatggggcttttgtaacaaatgtttcgatgatataatatttcgtaatggatcttaggtttgattcattttttttccaattgcatgttcaatgttgcagttaaaatacaattcagaccattttgcagaacataaactcagttgcagtttcattcattaattgtatggttgaatatatgcaaatgcaatgtatagacctctcgcttgactaagcgagtagagaaatgaatagttgtac

SEQ ID NO: 5975 - DNA, 601 bp, Brassica napus
caatcgacgatgagcaccggcgcaggaagcggcacgaccaaaggcggtagaggaaaaccaaaggccaccaagtccgtctctcgttcttcaaaggccggtcttcagttccccgtcggaagaatcgctagattcctcaaggcaggcaaatacgccgagcgtgtcggcgccggagctccggtctatctctccgccgttctcgagtacctcgccgctgaggtgttggagcttgctggaaacgcggcgagggacaacaagaagacgcgtattgtgccgaggcacattcagctcgcggtgaggaacgatgaggagctgagtaagcttctgggagctgtgacgattgctaacggtggtgttttgcccaacattcattccaaccttttgccttccaaggttgggaagaacaagggagacattggatctgcttctcaagagttctgagtttcatcttggtctctcttttgttgtcggattcccttgtaaaatatcaactttgttttgaagctaatggggcttttgtaacaaatgtttcgattatataatattacctaatggatcttaggtttgattcattttttttccaattgcatgttcgatgttgcag

SEQ ID NO: 5976 - DNA, 766 bp, Solanum melongena
actgacacaaaaacagcagcatacaaatcgagagctagatttttagggtttctgtttcatcggaaaaaaaatgagttccggcggtggatcaggcaagggcggcgccggcagagggaaatcaaagtcttcaaaatcggtgtctaggtcatcgaaggcgggtctccaattccccgtcggtaggatcgcccgttttcttaagaatggaaaatatgctgaacgtgttggagctggtgcaccggtttatctctctgctgtccttgaatacctcgctgctgaggtgttggagttggctggaaatgcagcaagggataataagaagaatcgtatagtgccgaggcacattcagttggctgtgaggaatgatgaggagctgagcaagcttttgggtcaggttactattgctaatggaggtgtcttgcccaacattcatcagaatctgttgcctagaaaggctggctcaggcaagggtgatattgcctctgcatctcaagagttttagaaaataaagtactcctagttttgaatattgatatgaagtgaacaatacatatatgtaatatagaattgggttttgtttttgatagttttgaattcaatggtggtgtcaacttgctgttttggtatacaacttggaaaagttcttgtgatgtcaatggagttggatcaactttttttggctatacatttacagtctgctgttttctgaatttgtcattctcttgttaccttatgttattcagtcacaaaaatataaaatacttgagac

SEQ ID NO: 5977 - DNA, 639 bp, Solanum tuberosum
gcttccttctctctgtctctgcaactccgaatctagggttagggttttttcgtaagagaaaaaaaaaatgacttcaggtgctggagcaggtaaaggcggcgccggaagaggcaagccaaaggcaacgaaatcggtttctcgatcttcaaaagccggtcttcaatttcccgtcggtaggatcgctcgtttccttaaggcaggaaagtacgctgaacgtgtcggtgctggtgctcctgtgtatctctccgccgtccttgagtatctcgccgctgaggtgttggagttggctgggaatgctgctagagacaacaagaagaatcgaattgtgcctaggcacattcagttggctgtgaggaatgatgaggagttgagcaagctgttgggtcatgttaccattgctaatggaggtgttttgcccaacattcaccagaatttgttgcctaagaaagctggatctggaaagggtgatattggctctgcatctcaggagttttagatgtaaatggggtgttatgtttggggaagtattaggagaaaggagtagaacttgttatgtaatataaaaatacccttttgttattctgttattcaatggtatgaaatgaaaaaaagggcaatggccacctgcagttttggtta

SEQ ID NO: 5978 - DNA, 646 bp, Solanum tuberosum
caaaaacagcagcatacaaaatcgagagctagatttagggtttttgtttcatcggcaaaaaaatgagttccggcggtggatcaggcaagggcggcgccggtagagggaagccaaaggcatcgaaatctgtgtctaggtcttcaaaggcaggtctccaattccccgtcggtagaatcgctcgtttccttaagaatggaaaatatgctgaacgtgttggagctggtgcaccggtgtatctgtctgctgtccttgaatacctcgctgctgaggtgttggagttggctggaaatgcagcaagggataacaagaagaatcgtatagtgccgaggcacattcagttggctgtgagaaatgatgaggagctgagcaagcttttgggtcaagttacaattgctaatggaggtgtcttgcctaacatccaccagaatctgttgcctagaaaggctggctcaggcaagggcgatattggctctgcatctcaagagttttagaataaatgaactcctagttttgaaatcgatctgaagtgaacaattcatagctttgtaatatagaattggctcttgttttgatagttttgaattcaatggtgctgtcgactttctgttttgataaacaacttggaaagtttttgtgatgcaaatgg

SEQ ID NO: 5979 - DNA, 617 bp, Raphanus sativus
gggcactcgacatctttccctctgttctcagactttcacctacttttcaattaagacatctgcgaaagtctcttctacaatttgacgatgagcaccggcgcaggaagcggaacgaccaaaggtggaagaggaaagccaaaggccaccaaatccgtctctcgttcgtccaaggccggtctccagttccctgtcggaagaatcgccagattcctcaaggcgggaaaatacgccgagcgtgtcggcgccggagctccggtctatctctccgccgttctcgagtacctcgccgctgaggtgttggagcttgctggaaacgcggcgagggacaacaagaagacgcgtatcgtgccgaggcacattcagctcgcggtgaggaacgatgaggagctgagtaagcttctgggagccgtgacgattgctaacggaggagtgttgccgaacattcactcgaaccttttgccttccaaggttgggaagaacaaaggagacattggatctgcttctcaagagttttgaagtttcaatcaaacctttgctttgtttgttcttttgtttttctgattccctttgtaaaatatccaactatgctttgaagctaatggaaatgtttcgatata

SEQ ID NO: 5980 - DNA, 661 bp, Solanum phureja
accactgacgccaaaaacagcagcatacaaaatcgagagctagatttagggtttttgtttcatcggaaaaaaatgagttccggcggtggatcaggcaagggcggcgccggtagagggaagccaaaggcatcgaaatctgtgtctaggtcttcaaaggcgggtctccaattccccgtcggtagaatcgctcgtttccttaagaatggaaaatatgctgaacgtgttggagctggtgcaccggtgtatctgtctgctgtccttgaatacctcgctgctgaggtgttggagttggctggaaatgcagcaagggataacaagaagaatcgtatagtgccgaggcacattcagttggctgtgagaaatgatgaggagctgagcaagcttttgggtcaagttacaattgctaatggaggtgtcttgcctaacattcaccagaatctgttgcctagaaaggctggctcaggcaagggtgatattggctctgcatctcaagagttttagaataaatgaactcctagttttgaaatcgatctgaagtgaacaattcatagctttgtaatatagaattggctcttgttttgatagttttgaattcaatggtgctgtcgactttctgttttgatatacaacttggaaagtttttgtgaatggaattggatta

SEQ ID NO: 5981 - DNA, 745 bp, Solanum phureja
cgtatcacatttcaccatcttccttctctctgtctctgcaactccaaatctagggttagggttttttcgtaagagaaaaaaaaaatgacttcaggtgctggagcaggtaaaggcggcgccggaagaggcaagccaaaggcaacgaaatcggtttctcgatcttcaaaagccggtcttcaatttcccgtcggtaggatcgctcgtttccttaaggcaggaaagtacgctgaacgtgtcggtgctggtgctcctgtctatctctccgccgtccttgagtatctcgccgctgaggtgttggaattggctgggaatgctgctagagacaacaagaagaatcgaattgtgcccaggcacattcagttggctgtgaggaatgatgaggagttgagcaagctgttgggtcatgttaccattgctaatggaggtgttttgcccaacattcaccagaacttgttgcctaagaaggctggatctggaaagggtgatattggctctgcatctcaggagttttagatgtaaatgggtgttgtgtttggggaagtattaggagaaaggagtagagaacttgttatgtaatataaaaatacccttttgttattctgctattcaatggtatgaaatgaaaaaaagggcaatggccacctgcagttttggttatagttgttttagttcttgctcattgcaattctatgcttttctttgtcgataccaacttttctgattttgaattaattgagcttcttct

SEQ ID NO: 5982 - DNA, 779 bp, Eutrema parvulum
agatgtacggaccataataatccacaatttaaaaggctagatgaagtgccaggttggcgatccgcgtgatttcatgtctaaccaatcagagttaacattttcaccctatatatatggagcggcaaataaccctaaaggcactcaacatctccccttcccagactctactactttctcttcgttttctacaatcgttcttacagttttcacttcaaaagagacgatgagcacaggcgcaggaagcggcacgacaaaaggtgggagaggaaagccaaaggcgaccaagtccgtctctcgttcgtctaaagccggtctccagttccccgtcggaagaatcgccagattcctcaaggccggaaagtacgccgagcgtgtcggcgccggagctccggtgtatctctctgccgttctcgagtacctcgccgctgaggtgttggagcttgctggaaatgcagcgagggataacaagaagacgcgtatagtaccgagacacattcagcttgcagtgaggaacgacgaggagctgagtaaacttctgggaagcgtgacgattgctaatggaggagttttaccaaacattcatcagaatcttttgccttccaaggctgggaagaacaaaggagatattggatctgcttctcaagagttctgatttccccttttagtcgtattttagctctctttctcgttgttgttggattctctctttgtggaatttaactttttagcctctttgtaaaatatatcaaattgtttaatagctaagcgatctggctttt

SEQ ID NO: 5983 - DNA, 710 bp, Solanum lycopersicum
gccactaacacaaacagcagcatacaaaaccgagagctagaattagggtttttctttcatcgggaaaaaatgagttccggcggtggatcaggcaagggcggcgccggtagagggaagcaaaaggcatcgaaatctgtgtctaggtcttcaaaggcgggtctccaattccccgtcggtaggatcgctcgtttcctgaagaatggaaaatatgctgaacgtgttggagctggtgcaccagtttatctgtctgccgtccttgaatacctcgctgctgaggtgttggagttggctggaaatgcagcaagggataacaagaagaatcgtatagtgccgaggcacattcagttggctgtcagaaatgatgaggaactgagcaagcttttgggtcaagttacaattgctaatggaggtgtcttgcctaacattcaccagaatctgttgcctagaaaggctggctcaggcaagggcgatattggttctgcatctcaagagttctagaacaaatgaactccctagttttgaaatcgatctgaagtgaacaattcatagctttgtaatatagaattggctcttgttttgatagttttgaattcaatggtgctgtcgactttctgtttgatttacaacttggaaagtttttgtgatgcgaatggaattacatctttttgcctgtcaatttgcaatttgatattcaatttgggaagtttttt

SEQ ID NO: 5984 - DNA, 763 bp, Brachypodium distachyon
ttgccatctcaaacatcccacgccttcctcctccaccaccgcagtctccggcgacctccagaccagttcgcgcgtccaccgttttttgccgagatcctaagatgagttctaccggcgggaaggtgaccggagggaagacgggctcagccggcggagggcggggcaaggtcaagggttccaaggccgtgtcgcggtcgtccaaggccggcctccagttccccgtcggccgcatcgccaggtacctcaagatcggcaagtacgcacagcgcgtcggcgccggcgcccccgtctacctctccgctgtcctcgagtacctcgccgcagaggtcttggagctcgccggcaacgcggcgcgcgacaacaagaagaaccggatcgtgccgcgccacatccagttggcggtccgcaacgacgaggagctcagcaggctactgggcgcggtcaccatcgccgccggcggcgtgctgcccaacatccacacgacgctgctccccaagaaggctggcaaggacaaggccgacgtcgtctcgcagtcccaggagttctagagccttccagatcgaggcaaggccgcctcgcagaagatttgatggctctgtagtttggagtagtatatcgtgctctatgtacttagattaggttcttgtggaatcgttttatgttgttttgagttgtggacgaatgctatggttggaatggaattcaatcaatcgggttcttggtatatttgctgttacttgtgaatgtgaagttctcactgtga

SEQ ID NO: 5985 - DNA, 722 bp, Tropaeolum majus
ttgaaagaaatttaaataatacttcaattgttcttgaatcgatttcatattctcgtctttcattctcgttcgaaatccagatttagggttttatcctttgtgttatttgattagaagatgagttctactggagctggatcaaccaaaggcggaagaggaaaacctaaaacctcgaaatccgtaacgaggtccactaaagccggccttcagttcccggttggaagaatcgctagatttctcaaggctggtaaatatgccgatcgtgttggtgcgggtgcacctgtttatctttccgccgtcttggagtatctggctgctgaggttttggaacttgctggcaatgcggctagagataacaagaagaacagaatcatacctagacacatccagcttgcaataaggaacgacgaagagttgagtaaacttcttggagccgtaaccattgctaatggaggtgtgttacccaacattaatcaaactttactacctaagaagatgggcaaaggaaagggagatattgggtctgcttctcaggaattctgagaaattctaggcgttcggtagtgttttagcttcaagttttgccttccacatagatgttatataaatgggttttgcttaagaatttagttctttctcatttgttcaaaatgaaaattttccattactataatcaaatttattgactggttattgattcgtctagttcaatttaaatctaa

SEQ ID NO: 5986 - DNA, 1443 bp, Petroselinum crispum
tatacttacaatacacacaaacaatcacattctctcctagggttttaccatcaaaacagataaacatgagtgggaaaggagctactactactaaaggaggcagaggggtgtctaaaacaaagtcagtttcaagatcttcaaaggctggccttcagttccctgttggtagaattgctaggtttcttaaggccggaaagtatgctgagcgtgtcggcgccggagctccggtgtatctttctgctgttcttgaatatcttgctgctgaggttcttgagcttgctggcaatgcggcaagagataacaagaagaataggattgttccaaggcatattcagttagctgtaaggaatgatgaggagttgagcaagcttttgggtactgttacaattgctaatggtggtgttttgccaaacattcacacaactttgttgcccaagaaagtggggaaagggaaggatgagattggatccgcttcacaagagttttagggttttaaggagtgttatgtgtaatgaaaggtgcttgagtttatgtaagtgagaatgatggggtttaatgatgcttgattttgtgtaatctgttgatgtaaaacccctaaattttgggtttggtttgatgaaatcgaatatacaaatattatgatatttttgttgagtcttgtggattgacttggtttgttaaatttgttggtctgcctatgtattattcttgttctctgttttgttctgatcttccttccctggttaatttattaaattttgttaatagttaaactcaattgaagcctttgaaggttgtcaatgtgctggtttctgcagatttattgtgtacattttgtgttgacacttttattttcccctctggaatgcataatagtaatgtgtttatgaaatgataaagtggtggcctgaggttttaccttaaataatgaaatggtaaccttaggttttacctacttatggggagacttattgcttctgcactcactgattttaaacaatagcatatgacttcattttgaagctatggtgatcaatagcatatgcattgtacattgaataacattaggcacttgtcttggatagtagtagcagccccaatcctcctcacaagttcagggtccctggtattttacatttttaaataagttcatctaataaggtaacctaaaaaatagatccaaaaagaccttatcggatgagcacacataatatgaatcaccaaatattgggtcactacaattgtattctcatcaggtgctccactgctactttaattatattcaatatactttttaaaatgcattagcataatcgtcaatactataaggtcgtatttatatagtttattataggttaattccattttggggtgtctgttcccttccccttactcttatggttagaagtacaggtgttgtactcttataaatgtcttcttata

SEQ ID NO: 5987 - DNA, 1757 bp, Petroselinum crispum
atcaacctatacttacaatacacacaaacaatcacattctctcctagggttttaccatcaaaacacacaaaaatgagtgggaaaggagctactactactaagggaggcagaggggtgtctaaaacaaagtcagtttcaagatcttcaaaggctggccttcagttccctgttggtagaattgctaggtttcttaaggccggaaagtatgctgagcgtgtcggcgccggagctccggtgtatctttctgctgttcttgaatatcttgctgctgaggttcttgagcttgctggcaatgcggcaagagataacaagaagaataggattgttccaaggcatattcagttagctgtaaggaatgatgaggagttgagcaagcttttgggtactgttacaattgctaatggtggtgttttgccaaacattcacacaactttgttgcccaagaaagtggggaaagggaaggatgagattggatccgcttcacaagagttttagggttttaaggagtgttatgtgtaatgaaaggtgcttgagtttatgtaagtgagaatgatggggtttaatgatgcttgattttgtgtaatctgttgatgtaaaacccctaaattttgggtttggtttgataaatcgaatatacaaatattatgatatcttttttgagtcttgtggattgattggtttgttaaatttgttgttctgcctatatattattctttgttctctgttttgttctgatcttccttctctaggttaatttattaaattttgttaatagttaaattcaacttaagccaatgtgccgtgtttctgcagtttattgtgtacattttgtgttgatacttatattttcccctctggaatgcataatagtaatgtgtttatgaaatgataaagtggtggcctgaggttttaccttaaataatgaaatggtaaccttaggttttacctacttatggggagacttattgcttctgcactcactgattttaaacaatagcatatgacttcattttgaagctatggtgatcaatagcatatgcattgtacattgaataacattaggcacttgtcttggatagtagtagcagccccaatcctcctcacaagttcagggtccctggtattttacatttttaaataagttcatctaataaggtaacctaaaaaatagatccaaaaagaccttatcggatgagcacacataatatgaatcaccaaatattgggtcactacaattgtattctcatcaggtgctccactgctactttaattatattcaatatactttttaaaatgcattagcataatcgtcaatactataaggtcgtatttatatagtttattataggttaattccattttggggtgtctgttcccttccccttactcttatggttagaagtacaggtgttgtactcttataaatgtcttctccccccccccccccccccccccccccccccccccccccccccccccccccccccccccccccccccccccccccccccccccccccccccccccccccccccccccccccccccccctgaaggataaatctgacgactgtcaagcaatgcgtataagaaccactaatctggtctgctgtagaaatataatgcttatttggttcataacaaatgactttttaaatcgtaacttaatctggtagatcaccagaccagaagacaaattattttaaccatgaaaatgatagcccacttgccttgtagctccgagaccaacattatgtg

SEQ ID NO: 5988 - DNA, 661 bp, Quercus alba
cccctttatattatcatcatcagacccaaacaaaaaaaaaacacattcatttttttctccgatcagaaaaaccaaagtgcaaaaccatgagttccacaggagcttcaaccaagggtggccgaggcaaaccaaagtcctcaaagtctgtttctcggtcacagaaggcttcaattccctgtgggtcgtatcgcccggttcttaaaagccggcaagtacgccgagcgtgtcggtgccggagctccggtttacctctccgccgtgctcgaataccttgctgctgaggttcttgagctagctggcaatgctgctagagacaacaagaagaatcgtattgttccaagacacatacaacttgctgtgcgaaatgatgaggagttgagcaagcttttgggaacggtcaccattgctaatggaggtgtcttgcccaacattcatcagaatttgttgcctaagaagattggtaaagggaaaggtgatattggatcagcatcgcaagagttttaggattttttttgggtgaggaatttgatgtttgagatttaagaaacggtcgaggatgggatttgttgggtgcccatttgggctttctgatctgtttggtccttgtaaacccttaatttgggtatttttggtggttgaatataaaggataataatttaat

SEQ ID NO: 5989 - DNA, 826 bp, Cedrus atlantica
gtctgtcgctcctgcctgcgttgattgatacatccattcattcttcagggcgaggtggtggtctgttcctgtgaagaagggtattcaactgcaatacccaacagggaaatcagcagcatgagttcttcaggaggtggcggcggcggccgagggaaggcgaagtctacgaagtccgtttcgaggtctcagaaggcgggcctgcagttcccggttggaaggattgcccgcttcctaaaggcgggtaagtatgcagaacgtgttggtgcaggagctcccgtttatatggctgcggttttggagtatctagcagcagaggtgcttgagttggctgggaatgcagcacgggataacaagaaaaacaggattgtgcctcggcatatccagctagctgtcaggaatgatgaggagctcagcaaattattaggtgctgtgactattgccaatggtggtgtgttgccgaatattcacggtgttttactacctaagaaggctggaaagggaaagggagctgaggttggcagcgcctctcaggagttttagatgatgataagatgaactgttaaatgctgcccacattttaagggattgcaatgccgtcacaatcactgccccgccctgagtgccagattctggtagtcaattcttaaggcgttcttactgttgaccttccattaagattatacagttttaggcagatgaaattttgatatttagagcaatagaatacactgtttttcttggtttccagaaacatcttatagatatatattcctggcagtttgtcattatcattctgtgaagagaaatgctcaatgttaaaagtcat

SEQ ID NO: 5990 - DNA, 882 bp, Physcomitrella patens
tcttgctgccttcgctgcaccctttcttcgtcaacaccgaagagaggcgccttcaaatatatttgtccgtgaaagtgtgtgggtgccatttgcaaccatgagttctccagctgcaaccgccggaggccgcgggaagtctaaggcctcgaaatctacttctcggtcacagaaggccggtcttcaatttccggtaggaagaattgctaggtttttgaaggctggtaaatacgccgaacgtgtgggagctggtgcacctgtctacctagccgcagtgctggaatatttagcggccgaggtacttgaattagcaggaaatgccgccagagataacaagaagaatcgcattgtaccccgccacatccagctggcagtgagaaacgacgaggagttaagcaagttgttgggcactgtcacaattgccgccggtggtgtcctgcccaacattcacacaattctattgccgaagaagactggtaagggcggcaaggacattggtggaagcatctcgcaggagttttagagctaccctagtttgtacatagctccgtcgctttttctccctcaatttggagaatgcacgaaaaaatggcaatggtcttttttctgggaacttcgacatcacacaattattgtgtttgggctcatcggcttctgaaggctccaatttacttaaccccgctgaagcgtaggaatctgtgtcgcgagtgtgcatggcatgctgcttctgcttgaactgtagtagacgtggcaacttttacaagtttttggattgaacttgtcttctttaccgctttgtgtggcaatctgccactcatactgccgtataaagaagtcatttttgtaatgtgactcgattttcaattgacgcacaccttagcgatg

SEQ ID NO: 5991 - DNA, 1192 bp, Physcomitrella patens
actctgccttcttgtcctaccccttgccttcgctgcaccctatgcccgccaccactgaagagtggagcctcgataaatctttgcaagtgaaagagcgtgaaagcctttaacaaccatgagttctcccggtgctactcctggaggccgcgggaagtccaaggcctctaaatccatatctcgctcagccaaggctggtctccagttccctgttggaaggattgctcgtttcttgaaagctggcaagtatgctgaacgtgtgggagcgggtgcacccgtctacttggccgcagtgcttgaatacctagctgccgaggtccttgagttggcaggaaatgccgccagagataacaaaaagaatcgcatagtaccccgccatattcagctggcagtacgaaacgacgaggagttgagcaaacttttgggcaccgtcacaattgctgccggtggtgtgcttcccaatattcacaccatacttctgccgaagaagacgggcaagggcggcaaggacatcggagggagtatctcgcaggagttttaggtttcaacggtggatgagttttgtatataactccattggatattctcttcgaaatttgagaatgcactgaacgattctgagaactttgacatattcattgtgtgtaggcacatctacttctgaaggcacaccttattcaaccttgctgtcagatcattctgagtctcgtctttctttcttttatttccctttttttttttttttttttttttttttttttttttgcaactttaggaacgtctttctgaagtctcaatgtcatgctacttctgcatgaaccgctgatgaccctgcctgaatgttggcaacgtttttgggttgaaacggtctatcatagcgctgtgtgggaagctgacactcgtgctgctgataaatggcatcaattttgtaattcgacgcggttctcaacttccagataactaaggtgtatctgactagctgaaggtttccattttttcttccccatgggtttctgcggtttgtgggttgaaatcgcaaaaacggatagttaccaatcgacaaatagaataaactgtatctggagcatcataattacactgcgcagaccttcatgctcacatgttctactgttattttgaatagtcagatcaactgctaaaatctataatgcgttgatacaaattgttgtatgag

SEQ ID NO: 5992 - DNA, 960 bp, Picea glauca
taacacccggtcagttttggagcaactgcctgctcgtatcatatattcattcattctacgggtagaggtggtggtttgttcctgtgaatcaactgaaatactcaatagggaaaacggcagcatgagttcttcaggaggtggcggtggtggccgagggaaggcgaaatctacaaagtccgtttcgaggtcccataaggctggcctgcaattcccggttggaaggattgcccgcttcctaaagtcgggaaagtatgctgaacgcgttggtgcaggggctccagtttatttggctgctgttttggagtatctagcagcagaggtgcttgagttggctgggaatgcagcacgggataacaagaaaaacaggattgtgcctcgacacatccagctagctgtcaggaacgacgaggagctcagcaaattattaggttctgtgaccattgccaatggtggtgtgttgccaaatattcatggtgttttgctacccaagaaagctggaaagggaaagggagccgagattggcagcgcctctcaagagttttagatgatgatgataagatggaaatgttaccaatcactgcccgccttgagtgcttctggcaaagtcaattcttaaggcgttttaactgttaaccttccattaaagattatatagttttaggtggaggaaattttgatacttagaccaatagaatatagtgtttttttggctttcagaaaccacctatagatatatgttcttggcagaagattcagaaaccacctatagatatatgttcttggcagaagattattattgtcattatcattctcagaaggggaatgttcaatattctagtcgtcactgaaatgtgtatacccaccggacagttttttgtgtttgaatgcattaaacttgcatgtccactttggtggctttctgtgttttaatttaatactagtgagatgtgattttgagat

SEQ ID NO: 5993 - DNA, 1186 bp, Picea glauca
ggctggatataagggagggagggtagctgtaatcttgcaataacaccgggtcagttttggagcaactgcctgctcgtatcatatattcattcattctacgggcagaggtggtggtttgttcctgtgaatcaactgtaatactcagtagggaaaacggcagcatgagttcttcaggaggtggcggtggtggccgagggaaggcgaagtctacaaagtccgtttcgaggtcccataaggctggcctgcaattcccggttggaaggattgcccgcttcctaaagtcgggaaagtatgcagaacgcgttggtgcaggggctcctgtttatttggctgcggttttggagtatctagcagcagaggtgcttgagttggctgggaatgcagcacgggataacaagaaaaacaggattgtgcctcgacacatccagctagctgtcaggaacgacgaggagctcagcaaattattaggttctgtgaccattgccaatggtggtgtgttgccaaatattcatggtgttttgctacccaagaaagctggaaagggaaagggagccgagattggcagcgcctctcaagagttttagatgatgatgataagatggaactgttaccaatcactgcccgccttgagtgccagattctggaaaagtcaattcttaaggcgttttaactgttaaccttccattaaagattatatagttttaggtggaggaaatttttgatacttagaccaatagaatatagtgttttttggctttcagaaaccacctatagatatatgttcttggcagaagattattattgtcattatcattctcagaaggggaatgttcaatattctagtcgtcactgaaatgtgtatacccagcgggcaattttttgtgtttgaatgcattaaacttgcatgtccactttggtggctttctgtgttttaatttaatactagtgagatgtgattttgagatgaggattttgtgtctgagaaatacctgccgctgaagggtatcttttaatcaaatctattaatattcccttcgcatcttctgattgtcaattttcatcggttgcaaaatgttgtttattatatacttgaaaatgttttgtatatattcttagcaaatgagcgctttgctcaatttgggcacacagttcattcaaaacaaacgaatagaaatacttgtaagat

SEQ ID NO: 5994 - DNA, 1155 bp, Picea glauca
aaaaattaataccgaatagatttgaacacagaatgctggatataagggagggagggtagctgtaatcttgcaataacacccggtcagttttggagcaactgcctgctcgtatcatatattcattcattcaacgggtagaggtggtggtttgttcctgtgaatcaactgaaatactcagtagggaaaacggcagcatgagttcttcaggaggtggcggtggtggccgagggaaggcgaaatccacaaagtccgtttcgaggtcccataaggctggcctgcaattcccggttggaaggattgcccgcttcctaaagtcgggaaagtatgctgaacgcgttggtgcaggggctccagtttatttggctgctgttttggagtatctagcagcagaggtgcttgagttggctgggaatgcagcacgggataacaagaaaaacaggattgtgcctcgacacatccagctagctgtcaggaacgacgaggagctcagcaaattattaggttctgtgaccattgccaatggtggtgtgttgccaaatattcatggtgttttgctacccaagaaagctggaaagggaaagggagccgagattggcagcgcctctcaagagttttagatgatgatgataatatggaactgttaccaatcactgcccgccttgagtgccagattctggaaaagtcaattcttaaggcgttttaactgttaaccttccattaaagattatatagttttaggtggaggaaattttgatacttagaccaatagaatatagtgttttttggctttcagaaaccacctatagatatatatgttcttggcagaagattattattgtcattatcattctcagaaggggaatgttcaatattctagtcgtcactgaaatgtgtatacccagcgggcaattttttgtgtttgaatgcattaaacttgcatgtccactttggtgtctttctgtgttttaatttaatactagtgagatgtgattttgagatgaggattttgtgtctgagaaatacctgccgctgaagggtatcttttaatcaaatctattaatattcccttcgcatcttttatgtacaaaaaaaataaaaatctcgtgtacactaccagtctcctttcgaggaacgtactcgaaccgaaggccaacc

SEQ ID NO: 5995 - DNA, 770 bp, Picea glauca
agggagggagggtagctgtaatcttgcaataacacccggttcagttttggagcaactgcctgctcgtatcatatattcattcattctacgggtagaggtggtggtttgttcctgtgaatcaactgaaatactcaatagggaaaacggcagcatgagttcttcaggaggtggcggtggtggccgagggaaggcgaaatctacaaagtccgtttcgaggtcccataaggctggcctgcaattcccggttggaaggattgcccgcttcctaaagtcgggaaagtatgctgaacgcgttggtgcaggggctccagtttatttggctgctgttttggagtatctagcagcagaggtgcttgagttggctgggaatgcagcacgggataacaagaaaaacaggattgtgcctcgacacatccagctagctgtcaggaacgacgaggagctcagcaaattattaggttctgtgaccattgccaatggtggtgtgttgccaaatattcatggtgttttgctacccaagaaagctggaaagggaaagggagccgagattggcagcgcctctcaagagttctgatctaggcttatgcttgttgttgagcaaattaggatagtatttttgatctatttgtaaatgattgatcgggtaatccttcccactaagcatttgatgctttcttttcctagagcggatggagttatttgttgaatgtgaactaaattgatgtttcctattgaacttatatacaagctttgtgctatcttggcacctt

SEQ ID NO: 5996 - DNA, 1024 bp, Hordeum vulgare
ccaaatctccagcccagtccagtccagtccagtccagtcccgtcccgtccccacctctcgaaagggtttagaagcttccagaagggcgatgagttccccgggagcaggcgccggcggccgcggcaaggccaaggcgaccaagtcggtgtcgcggtcgtccaaggccggcctccagttccccgtcggccgcatcgcgcgctacctcaaggccggcaagtacgccgagcgcgtcggcgccggcgcccccgtctacctctccgccgtcctcgagtacctcgccgccgaggtgctggagctggcggggaacgcggcgcgggacaacaagaagacccggatcgtgccgcggcacatccagctggcggtgcgcaacgacgaggagctgagcaagctgctgggctcggtgacgatcgccaacggcggcgtgatgcccaacatcaaccaggtgctgctgcccaagaaggccggggccaagggggagatcgggtccatctcccaggagttctgagcgcgcgctgctacaaggctaaaggaggggctgccctgtcactcatgtctggctgacgacgatgttcatctgaagtttttggttgggttggggtgtgttttgggagtctgaatctcgtcatggaaaaaaccttgggtgtcttctgagctctgctcgcggttgaatgaatgagtcggtcgatcagtagaagagaggaaacatatacatgtggtttcttatatgcgaaatgatgtttggttgtttggatgattgaattccctgtgaaattttagttacaagaacctgactgctcttcgtctgaaggaaatgatcatctcgctgtggaaataaaaccgctcctcttagccctgtggaaatatagcagcatcaagcgctgttcctctttcagaaatctgcaagataactcttcagttgcagaagcagaaccaacatgtacacatgacagtgttgcttttgttcttgtggtcgtcaggttttggtaattatctcttggtgtaattcgtttcacggcgaagaact

SEQ ID NO: 5997 - DNA, 918 bp, Hordeum vulgare
accaaatctccagcccagtccagtccagtccagtccagtcccgtcccgtccccacctctcgaaagggtttagaagcttccagaagggcgatgagttccccgggagcaggcgccggcggccgcggcaaggccaaggcgaccaagtcggtgtcgcggtcgtccaaggccggcctccagttccccgtcggccgcatcgcgcgctacctcaaggccggcaagtacgccgagcgcgtcggcgccggcgcccccgtctacctctccgccgtcctcgagtacctcgccgccgaggtgctggagctggcggggaacgcggcgcgggacaacaagaagacccggatcgtgccgcggcacatccagctggcggtgcgcaacgacgaggagctgagcaagctgctgggctcggtgacgatcgccaacggcggcgtgatgcccaacatcaaccaggtgctgctgcccaagaaggccggggccaagggggagatcgggtccatctcccaggagttctgagcgcgcgctgctacaaggctaaaggaggggctgccctgtcactcatgtctggctgacgacgatgttcatctgaagtttttggttgggttggggtgtgttttgggagtctgaatctcgtcatggaaaaaaccttgggtgtcttctgagctctgctcgcggttgaatgaatgagtcggtcgatcagtagaagagaggaaacatatacatgtggtttcttatatgcgaaatgatgtttggttgtttggatgattgaattccctgtgaaattttagttacaagaacctgactgctcttcgtctgaaggaaatgatcatctcgctgtggaaataaaaccgctcctcttagccctgtggaaatatagcagcatcaagcgctgttcctctttcagaaatctgcaagataactcttcagt

SEQ ID NO: 5998 - DNA, 732 bp, Citrus clementina
cataaataaacagggctctccttcccttcaattcaatttcagagcttcaccagaaagcgcaagcaagagagcatttgcattattttgtcaatcgatgagctccgcaggatcaacgaagggcggcagaggcaagcccaagtcgaccaaatcaatttccagatctcacaaggctggccttcagttccccgtcggccgtattgctcgcttcctcaaagccggaaagtacgccgatcgcgtgggtgccggcgcccccgtctacctatcggctgttcttgaataccttgctgctgaggttttggagcttgctggcaatgctgcaagggataacaaaaagaaccgtatcgttccaaggcacattcaactagctgtgaggaatgatgaagaattaagcaagcttttgggcacagttactattgcaaatggaggagttctgccaaacattcatcagaacctgttgccaaggaaaatgggcaaaggaagggaggatattggatctgcttcgcaagaattttagtgctgaaacttctctgcttgttgaatttgaatacttaaaaaaaaaaaaaatgcaggattgattgatttacgcaatttttttctttatttgtgatccttttatctccgtgtaaactgggatttgggttccggccgaatatagtgaaacaataattttttgatgtcccatctcattgtgtgggggtttaaagttagcaacaatgaagttggtttgcatta

SEQ ID NO: 5999 - DNA, 698 bp, Panax ginseng
aagcagtggtatcaacgcagagtacatggggatcatccaacaatcaaaaacattggcatatagtactaccttatattttctctctcctagggtttgaactagcttcatccaaacctgcaaaaaaataatgacttctacgggtacaaccaaaggaggcagaggcaagccaaagtccaccaaatccgtttccagatctcagaaggccggtctccaattccccgtcggtagaatcgcccgatttctcaaagccggtaagtacgctgaacgtgtcggcgccggtgctcccgtatacctttccgccgtcctcgaataccttgccgctgaggttcttgagcttgctggaaatgctgcaagggataacaagaagaaccggatagttccgaggcacatacagcttgcagtgaggaatgatgaggagttaagcaagcttttgggcacagttactattgccaatggtggtgttttaccaaacattcaccaaaatctgttgccaaagaaatctgggaaagggaatgatgggatagggtccgcttcacaagaattttaggattatagctttgggaggtttttgttgtctgttgatgtttaagtatatacaagggagggtgtggttacaagttgttggttatgacttcaactgatgtataaccccatttttgggatttgtgatgaaatggatacacaagaaatacagtaac

SEQ ID NO: 6000 - DNA, 584 bp, Allium cepa
tcagagttacgggggtcttcttaaaaaccgaattaacatttaaaaccccaaaaaagatttattttctctctctttcaaattaatagaaatgagttccgcaggaagaggaaaggcaaaatccagttcaaaatcggtttctagatcgtcaaaagcagggcttcagtttccagtcggaaggatcgccagatttctgaaggcaggaaaatacgccgagagagtcggtgccggagctccggtctatatggctgctgttctcgagtatttagctgctgaggtgctggaactggctggaaatgcagcaagggacaacaagaagaatagaatagtgccaaggcacattcagctcgctgtgaggaacgatgaagaattaagcaagcttcttggcactgtcaccattgccaatggaggggttttgcccaatattcattccactttgttgcctactaagcctggaaagggaaaaggagatggttctgcctctcaagaattttaatttgttttacttaatttatatatatgttgtctttaaatggttcatcttcaacaattctatgagcatggaaggtctttttgaatatgggtga

SEQ ID NO: 6001 - DNA, 649 bp, Allium cepa
tgttacggggactgctcccttcccacaaaaccaaattaacaacccaaacccgaaatttattttgctttgtttgaatagaaatgagttccgcaggaagaggaaaggcaaaatctagttcaaaatcggtttctagatcgtcaaaagcagggcttcagtttccagtcggaaggatcgccagatttctgaaggcaggaaaatacgccgagagagtcggtgccggagctccggtctatatggctgctgttctcgagtatttagctgctgaggtgctggagctggctggaaatgcagcaagggacaacaagaagaatagaatagtgccaaggcacattcagctcgctgtgagaaacgatgaagaattaagcaagcttcttggaactgtcaccattgctaatggaggtgtcttgccgaatattcattccactttgttgcctactaagcctggaaagggaaaaggagaaattggctctgcctctcaagaattttaatttgttttacttaatttatatatatgttgtctttaaatggttcatcttcaacaattctatgagcatggaaggtctttttgaatatgggtgataaatttatttctgatttcaatgatggaatgaatgcatagtttttgttagtagcataatatatttaagag

SEQ ID NO: 6002 - DNA, 730 bp, Citrus sinensis
cataaataaacagggctctccttcccttcaattcaatttcagagcttcaccagaaagcgcaagcaagagagcatttgcattattttgtcaatcgatgagctccgcaggatcaacgaagggcggcagaggcaagcccaagtcgaccaaatcaatttccagatctcacaaggctggccttcagttccccgtcggccgtattgctcgcttcctcaaagccggaaagtacgccgatcgcgtgggtgccggcgcccccgtctacctatcggctgttcttgaataccttgctgctgaggttttggagcttgctggcaatgctgcaagggataacaaaaagaaccgtatcgttccaaggcacattcaactagctgtgaggaatgatgaagaattaagcaagcttttgggcacagttactattgcaaatggaggagttctgccaaacattcatcagaacctgttgccaaggaaaatgggcaaaggaagggaggatattggatctgcttcgcaagaattttagtgctgaaacttctctgcttgttgaatttgaatacttaaaaaaaaaaaatgcaggattgattgatttacgcaatttttttctttatttgtgatccttttatctccgtgtaaactgggatttgggttccggccgaatatagtgaaacaataattttttgatgtcccatctcattgtgtgggggtttaaagttagcaacaatgaagttggtttgcatta

SEQ ID NO: 6003 - DNA, 573 bp, Phalaenopsis aphrodite
ttggagctagggtttgccttcagattcaagccgatatgagctctactgcatctactaagggaggtcgcggcaagtcgaagcccgcaaaggccgtatccagatctaataaggccggcttgcagtttcccgtcggcaggattgctcgcttcctcaaggctggcaagtactctgaacgcgtcggatccggcgctcccgtatatcttgcagccgttctcgagtaccttgcggctgaggttcttgagttggctgggaatgctgcgagagacaataagaagaataggattatgcccaggcacattcagcttgcggtgaggaatgatgaggagctcagcaagctgttgggggccgtgacaattgctaatgggggtgttctgcccaacatacaccagaatttactgccaaagaagcaaggcaaggggaagggcgacattggttctgcctctcaagaattttaaatttttttcagcggtagtgtaactggattttggttttagtgcttagttcttgttgatatggttcctccgcaatgcatatctttttctatgggcttattctagccaaatctttggttga

SEQ ID NO: 6004 - DNA, 604 bp, Vinca minor
gcataagaagaatgagttcaacaacaacaaccaagggaggtagaggtaaacctaaatcctccaaatccgtctcccgatcttccaaagccggccttcagtttcccgtcggcagaatcgctcgtttcctcaaggccggcaaatacgccgaacgtgttggcgccggtgctcccgtctatctctccgccgtccttgagtatctcgctgcggaggttctggaactcgctggaaatgctgctagagataacaaaaagactaggattgttccaaggcatatacaacttgctgtgaggaatgacgaggagttgagcaagcttttgggcgctgtaactattgcgaatggcggcgttttgcccaacatacactcaaatctgttgccgaagaaggctggtgcagggaaaggcgatatcaattctgtttctcaagaattctagaatcttcatttattatttatagatgttaggtttaaggttggtatgaactttttaatccgatatatatgtaaaacactatttttgggtagttttgattcgacaaatgggcgatatggatcttttataaatgctcgttattttctgaacgacaatttaattgatgattagagtgc

SEQ ID NO: 6005 - DNA, 824 bp, Triticum aestivum
aaccctaacgctataaaacccgaggcgccgccccgggttctcctcccaccccaccaaatccccagtccagtccccacctctcgagagggtttagaagcttccagacctcccccaaaggcgaatcggcgatgagttccaccggagcaggcgtcgccggccgcggcaaggcgaaggcgaccaagtcggtgtcgcggtcgtccaaggccgggctccagttccccgtcggccgcatcgcgcgctacctcaaggccggcaagtacgccgagcgcgtcggcgccggcgcccccgtctacctctccgccgtcctcgagtacctcgccgccgaggtgctggagctggccgggaacgcggcgcgggacaacaagaagaccaggatcgtgccgcggcacatccagctggcggtgcgcaacgacgaggagctgagcaagctgctgggctcggtgacgatcgccaacggcggcgtgatgcccaacatcaaccaggtgctgctgcccaagaaggccgggcccaagggggatctgggctcggcctcgcaggagttctgagcccgcgcggcttcaaggcgaggaaggggaggccgtcctgtcatgtgatgttcatctgaagttgtgggttggggtgtttcgggagtctgaaactcccgatggaaaaaaaccttggtgtcttctcaactctgtcgtggttgagtgaatgagtcgatcgatcggtagaagaggagaggaaatatatactcctatgtggtttcttatatgcgaacatatatatgttgctcagttgtcttttatgattgatatggttcggttgtttgaatgattgaatgaatt

SEQ ID NO: 6006 - DNA, 683 bp, Centaurea maculosa
tatacttcagatctccacaaaaatgagttccaaatcagatgccgatgccaagaaggaggaagaggaaagcctaagtctacaaaatccgtctctcgatcttcgaaggctggtcttcagtttcccgttggtaggatcgctagatttctcaaggccggaaagtatgccgagcgtgtaggtgccggagctccggtgtacctttctgctgtccttgaatatctcgctgctgaggtgttggagttggcaggcaatgctgcaagggataacaagaaaacaagaatcattccaaggcacattcaattggcagtgaggaatgatgaagaacttagcaggttgttgggctctgtcacaattgcaaatggtggtgttttgccaaatattaatcagactttgctaccaaagaagattggtaaagataaaggtgaaattggttctgcttcccaagagttctagaagcaatctacaaaagggataaatggtactactatcaagtattggtagactttatcagcccaaaaaacttaccttcaatcttgtgggcaagttaatatagggaactcaatgcaaacaagtttgtaaaagtactttcttgggtgatgttttttgcaatcctaattgtttttgtggctttttcttgtcacaattttgcagtataatcaatcaatgtttggcttatgaagtcggac

SEQ ID NO: 6007 - DNA, 534 bp, Cirsium arvense
agttccaaatctgattccgatgccagaaaggaggaagaggaaagcctaagtctacaaaatctgtctctcgatcttccaaggccggtcttcagtttcccgtcggtaggatcgctagattcctcaaggctggaaagtacgccgagcgtgtcggtgccggagctccggtttacctttccgccgttcttgaatacctcgccgctgaggttttggagttggctgggaatgctgcaagggataacaagaaaaccagaataattccaaggcatatacaattggcagtgaggaatgatgaagaacttagcaggttgttggggtctgtgacaattgcaaatggtggtgttttaccaaacattaatcagaccctgttaccaaagaaagttggtaaggataagggtgaaattggttctgcttcccaagagttctagacttgccgtctatctagtaagcaagttaatacagtaaactcaatgcaaacaagtttgtaaaaatgttttctattttgcaatcaaaattgttatggtggctctgtcttgc

SEQ ID NO: 6008 - DNA, 689 bp, Vitis vinifera
aaagtgagaacaccgccgcttcggtaccgcgcagtggttttagtaatttagggtttcgaatcatgagttcctcaaacaaagggggcagaggcaagcccaaggccaccaaatcggtttcccgatcggcaaaggcgggtcttcagttcccagtcggccgaatcgcccgtttcctcaaagccggaaagtacgccgaacgtgtcggcgctggcgctcccgtttatctctccgccgttctcgagtaccttgcggctgaggttctcgagcttgctggcaatgctgcgagggacaacaagaagagtagaatcgttccccggcacattcagcttgctgtgaggaatgatgaggagttgagcaaactactggggacggttaccattgcaaatggtggtgtattgccgaacattcatcagaaccttttgccaaagaagacgggggcagggaagggagaaattggatctgcttcgcaggagttttaggttttatattgtgtcgaagtttagtttttgaagttttaatatggttaaggatgggatcttatgtgttattttttttggttttttgtctgcttgatccctgtaaaccctagtattgaaattttttatgatacaaaaaagaataacatacatctttggtcatcttcttcatttgatggttctgatttttaatataaatgagatatcttgcttcag

SEQ ID NO: 6009 - DNA, 744 bp, Carpinus betulus
ccttttcctaccgcgagaagccaaacgcatcaaagctagggttagggttaaggtttctgtaccattttcgtttttaggagttgtgaatctgagagatgagttcgacgggtggaactggtggagggtcgactaagggcgggagggaaagcccaaggcttcgaagtcggtgtcgcggtcgcagaaggctgggctgcagtttccggtgggcaggatcgccaggtttctcaaggctggcaagtacgccgagcgtgtcggtgctggcgctcctgtctacctctccgccgtgctcgagtacctcgctgctgaggtattggagcttgctgggaatgctgcgagagacaacaagaagaaccgaattgtgcccaggcatatccagctggcagtaagaaacgatgaagagctgagcaagcttttgggctctgtgaccattgccaatggaggagtcttgcccaatatccaccagaccccttctacctaagaaggtcggcaaaggaaggcgacattggatctgcttctcaagagttctagggctttctagtctcttccattcgtgggtttgccatagtttgtaaaatagatgtgcttttcagttttctgcttgtgtcatctgaattttgaaagttatctttttgttttaaaaaaaaaaaacgaatactgttagctttctcgtatatgtccaattggcctattttgtttgttctcttcaatcaaataaagacgaaggtgacatattggttgaagggt

SEQ ID NO: 6010 - DNA, 724 bp, Nicotiana benthamiana
aaaccaaaggcaaataagcaagcagcagttgattatctcagctgactttccacacaaatcgagagttagggttagggttttgtgtttcatctgaaaatgagttctgatggaggatcgggtaagggcaagggtggcgcaggtagaggaaaacctaaggcatcaaaatcggtgtctcggtcttcaaaagcggggctacaattccccgttggtaggatcgctcgtttccttaaggctggaaagtatgctgaacgtgttggtgctggtgcgccagtttacctatctgctgtccttgaatacctagcagctgaggtgttagagttggcagggaatgcagcaagggataacaagaagaatcgtattgtgccgaggcacattcagttggctgtgaggaatgatgaggagctgagcaagcttttaggtcaagttactatagctaatggaggtgtcatgcccaacattcatcagaatctgttgcctaaaaaggctggctcggggaagggtgatattggttctgcatctcaagagttttagatttgctcaatttcttgttctggggaaacgattaaaagtaaacatagttatgtaaaatagaaatggctgttgttttgataatactttcgaacattgacttctgtggcattgtcactttgcagttttggtaatacactgtggaatgtttttgtgaatggaagtggattaattggcctgaagtagattttgagtt

SEQ ID NO: 6011 - DNA, 772 bp, Brassica juncea
actaactctctattccatttcttcaatcgttttataattttcacttcgaaagagacgatgagcaccaacgcagcaaccggcacgaccaaaggagggagaggaaagccaaaggccaccaagtcagtctctcgttcgtccaaggccggtctccagttcccagtgggaagaatcgcgagattcctcaaggcagggaaatacgcagagcgtgtcggtgccggagctccggtctatctctccgccgttctcgagtacctcgccgctgaggtgttggagctagctggaaacgcggctagggataacaagaagacgcgtatcgtgccgagacatattcagcttgcggtgaggaacgatgaggagctgagtaagcttctgggagctgtgacgatcgctaacggaggggtgttgccgaacattcattcgaaccttttgccttccaaggttgggaagaacaaaggagatattggatctgcttctcaagagttctagagtttttcgtttttagctcttttgttctcttgtttgttggattgtaacttaatatgaagtttgattaatcgttagaggtttgccagaacagaatctaattcaacaaagaatcaaattttaatcaaatcggattaggatctagatttcgaatctgttaggtgttaatgtgatacgatgaagacaatcgaatgtgaagggctccatgtatcgatcaagtttagcaacagatgaattcacattttattcatgaaatagtaacagttcggaatatactctgttcttgttt

SEQ ID NO: 6012 - DNA, 594 bp, Brassica oleracea
actcaacatctccgctctcacactttcaccaactatctcaattcaatttcgattcgaaagagacgatgagcaccggcgcagcaagcggcacgaccaagggagggagaggaaagccaaaggccaccaagtccgtctctcgttcctcgaaagccggtcttcagttccccgtcggaagaatcgcgagattcctcaaagccggtaaatacgcggagcgtgtcggtgccggagctccggtttacctctccgccgttctagagtacctcgccgctgaggtgttggagctcgctggaaacgcggcgagggataacaagaagacgcgtattgtcccgaggcatattcagcttgcggtgaggaacgatgaggagctgagtaagcttctgggagctgtgacgattgctaacggaggagtgttgccgaatattcattcgaatcttttgccttccaaggttgggaagaacaaaggagatattggatctgcttctcaagagttttgagtttcattttagctcttgtttttttggatgtaactttagctaatatatgcttcttgattaatatcgtaaggtttgccaaaaaaaaaaaacgaaactaaac

SEQ ID NO: 6013 - DNA, 1216 bp, Brassica rapa
tttatagatttttgatagtttaattatttttttatcagtttaataattttgagatctaatccggttaagtgattggttcatggtcgaaccacttttagatccaatctagctgtgtaatcggtttatggtcgaatccgattcaatcatcgggttggtccagttttaaaaacactacttataactttcttatagtttgcagtaaactccttaatgttttataatttctcagcgtggtccttatctttataaataattgttacaggatacccttgtctttctctctatttccccgctaaaaatatgaacggacgataacaaatctactcaattttaaaggctagattaattgccacggtggcaatccgcgtgattctaagactaaccaatcggagttaatatttgcagcctataaataaagaagagcaaagaagccctaaacacacacagcatctccgctctcacactttcaacaactattctcaattcgatttcttcaatttcgagacgatgagcaccggcgcagcaagcggcacgaccaaaggagggagaggaaagccaaaggccaccaagtccgtctctcgttcatcgaaagccggtctccagttccccgtcgggagaatcgcgagattcctcaaagccggtaaatacgcggagcgtgtcggtgccggagctccggtttacctctccgccgttctcgagtacctcgccgctgaggtgttggagctagctggaaacgcggcgagggataacaagaagacgcgtattgtgccgaggcatattcagcttgcggtgaggaacgatgaggagctgagtaagcttctgggagctgtgacgattgctaacggaggagtgttaccgaatattcattcgaatcttttgccttccaaggttgggaagaacaaaggagatattggatctgcttctcaagagttttgagtttctttttagctttttggatgtaactttagctaatatatgcttcttgattaatcaatcgtaaggtttgccaaaaaaaaaaatcaaaatcaaacttttatcatcgatgaagctgtatgtgtatgtttgtggtcggcttgttagtcttctacacgcctaaaactataactattaaccaagaatcgttttcagtatttatttcggttcggaccatctcaaaaggaggcgtatctctgtatgagaatgtataaaacgatttgatagacttctcccagtatga

SEQ ID NO: 6014 - DNA, 560 bp, Brassica rapa
acaacatcttcctctgtactcaagaagacttcaccaacttttcttcttcaatcgacgatgagcaccggcgcaggaagcggcacgaccaaaggcggtagaggaaagccaaaggccaccaagtccgtctctcgttcttcaaaggccggtcttcagttccccgtcggaagaatcgctagattcctcaaggcaggcaaatacgccgagcgtgtcggcgccggagctccggtctatctctccgccgttctcgagtacctcgccgaggtgttggagcttgctggaaacgcggcgagggataacaagaagacgaggattgtgccgaggcacattcagctcgcggtgaggaacgatgaggagctgagtaagcttctgggagctgtgacgattgctaacggtggtgttttgcccaacattcattccaaccttttgccttccaaggttgggaagaacaagggagacattggatctgcttctcaagagttctgagtttcatcttggtctctcttttgttgtcggattcccttgtaaaatatcaactttgttttgaagctaatggggctttt

SEQ ID NO: 6015 - DNA, 731 bp, Brassica napus
gcactcagactctctcactaactctcaattcgatttcttcaatttcgattcgaaagagacgatgagcaccggcgcagcaagcggcacgacgaaaggagggagaggaaagccaaaggccaccaagtccgtctctcgttcctccaaggccggtctccagttccccgtcgggagaatcgcgagattcctcaaggccggtaaatacgcagagcgtgtcggtgccggagctccggtttacctctccgccgttctagagtacctcgccgctgaggtgttggagctcgctggaaacgcggcgagggataacaagaagacgcgtattgtcccgaggcatattcagcttgcggtgaggaacgatgaggagctgagtaagcttctgggagctgtgacgattgctaacggaggagtgttgccgaatattcattcgaatcttttgccttccaaggttgggaagaacaaaggagatattggatctgcttctcaagagttttgagtttcattttatctcttgtttttttggatgtaactttagctaatatatgcttcttgattaatatcgtaaggtttgccaaaaaaaaaaaaaacgaaactaaacatctatcatcgattaagctgtatgtgtatgtgtatgtgtgtggtcggcttgtggtctcatctacacctaaaactataactattaaccaagaatcgttttcagtatttatttcggtttggataatctaaattggaggagt

SEQ ID NO: 6016 - DNA, 1234 bp, Brassica napus
tagttttatagattgttgatagtttaagtatttttttatcagtttaataatcttgagatctaatccggtttaaatgatcagttcatggtcgaaccaattttaaatccaatctaactatgtaaccggtttatggtcgaatccgattcaatcatcgggttggtccagttttaaaaacactacttataactttcttatagtttgcagtaaactccttaatgttttataatttctcagcgtggtccttatctttataaataattgttacaagatacccttgtctttctctctatttccccgctaaaaatatgaacggacgataacaaatctactcaattttaaaggctagattaattgccacggtggcaatccgcgtgattctaagactaaccaatcggagttaatatttgcagcctataaataaagaagagcaaagaagccctaaacacacacagcatctccgctctcacactttcaacaactattctcaattcgatttcttcaatttcgagacgatgagcaccggcgcagcaagcggcacgaccaagggagggagaggaaagccaaaggctaccaagtccgtctctcgttcctccaaggccggtctccagttccccgtcggaagaatcgcgagattcctcaaggccggtaaatacgcagagcgtgtcggcgccggagctccggtctacctctccgccgttctcgagtacctcgccgccgaggtgttggagctagctggaaacgcggcgagggataacaaaaagacgcgtattgtgccgaggcatattcagcttgcggtgaggaacgatgaggagctgagtaagcttctgggagctgtgacgattgctaacggaggagtgttgccgaatattcattcgaatcttttgccttccaaggttgggaagaacaaaggagatattggatctgcttctcaagagttttgagtttttttttagctcttgtttttttggatgtaactttagctaatatatgcttcttgattaatcaatcctaaggtttgccaaaaaaaaaaaatcgaaatcaaacttttatcatcgatgatgctgtatgtgtatgtgtgtggtcggcttgtagtctcatctacacgcctaaaactataactaatcgttttcagtatttatttcggttcggaccatctcaaaaggaggcgtatctctgttgttgctcgaaagaaatttgaatgtataaaacgatttgatagacttctcccagtatg

SEQ ID NO: 6017 - DNA, 745 bp, Brassica napus
ccggaattcggtcttatgtccgggggactcaacatcttccgctctcacactttcaccaactattctcaattcgatttcttcaatttcgagacgatgagcaccggcgcagcaagcggcacgaccaaaggaggcagaggaaagccaaaggccaccaagtccgtctctcgttcctccaaggccggtctccagttccccgtcggaagaatcgccagattcctcaaagccggtaaatacgcggagcgtgtcggcgccggagctccggtctacctctccgccgttctcgagtacctcgccgctgaggtgttggagctagctggaaacgcggcgagggataacaagaagacgcgtattgtgccgaggcatattcagcttgcggtgaggaacgatgaggagctgagtaagcttctgggagctgtgacgattgctaacggaggagtgttgccgaatattcattcgaatcttttgccttccaaggttgggaagaacaagggagatattggatctgcttctcaagagttttgagtttctttttagctcttgtttttttggatgtaactttagctaatatatgcttcttgattaatcaatcgtaaggtttgccaaaaaaaaaacgaaatcaaacttttatcatcgatgatgctgtatgtgtatgtttgtggtcggcttgttagtcttctacgcctaaaactataactattaaccaataatcgttttctgtatttatttcggtttgggtaatctaaaa

SEQ ID NO: 6018 - DNA, 642 bp, Daucus carota
aaaacttacaattccaattcccacctctcttaatctattctctcctagggtttcaccatcaaaaaacacatacaaaaatgagtggcaagggggctacagctactactaaaggaggcagaggggtttcaaagaccaagtcagtgtctagatcttccaaggctggccttcagttccctgtggggaggattgctaggtttcttaaggctggcaagtatgctgagcgtgttggggctggagcacctgtttatctctctgctgtgcttgagtatcttgctgctgaggttctagagcttgctggcaatgctgcaagagacaataagaagaacaggattgtgccaaggcacattcagttagcggtgagaaatgatgaggagttgagcaagcttttggggactgttactattgctaatggtggtgttttaccaaacattcactcaactttgttgccgaagaaggtgggcaaagggaaggatgaaattggatctgcttcacaagagttttagagtgtttatgttgaatgagagtgcagagtgctcgagtttatgtaagtgagaatgatgggtttaatgtttgcgggattttgtgtaatctcttgatgcaaaacccctaattttggatggtttgatgaatttgaatatacaa

SEQ ID NO: 6019 - DNA, 729 bp, Daucus carota
gcccacacagtactcacaatcccaattctcacctctcttagtttatactctcctagggtttcaccatcaaaaaacacatacaaaaatgagtggcaagggggctactacaactactaaaggaggcagaggggtttcaaagaccaagtcagtgtctagatcttctaaggctggccttcagttccctgtggggaggattgctaggtttctcaaggcggggaagtatgctgagcgtgttggggctggagcacctgtttatctctctgctgtgcttgagtatcttgctgctgaggttctagagcttgctggcaatgctgcaagagacaataagaagaacaggattgtgccaaggcacattcagttagcggtgagaaatgatgaggagttgagcaagcttttggggactgttactattgctaatggtggtgttttaccaaacattcactcaactttgttgccgaagaaggtgggcaaagggaaggatgaaattggatctgcttcacaagagttttagagtgtttatgttgaatgagagtgcagagtgctcgagtttatgtaagtgagaatgatggggtttaatgtttccgggattttgtgtaatctcttgatgcaaaacccctaattttggatggtttgatgaatttgaatatacaaagttactatatttcggttgaattttgtgatttggttggtttgttaaatttgttcatgttaatctattattgttcttgg

SEQ ID NO: 6020 - DNA, 811 bp, Centaurea maculosa
acccttccattatcaaaatcaaaagcctctctcttctctaccgctttccgaaaactagggttagggtttatcatctttcagatctaatatcaacaaaaatgagttccaaatcagatgccgatgccaaaaagggaggaagaggaaagcctaagtctacgaaatccgtctctcgatcttccaaagccggtcttcagtttcccgtcggtaggatcgctaggtttcttaaggccggaaagtatgccgagcgtgtaggtgccggagctccggtctacctctccgccgtccttgaatatctcgccgctgaggttttggagttggcaggcaatgctgcaagggataacaagaagacaagaattattccaaggcacattcaattggcagtgaggaatgatgaagagctaagcaggttgttgggctctgtcacaattgcaaatggtggtgttttgccaaacattaatcagactttgctcccaaagaagattggaaaagataaaggtgaaattggttctgcttcccaagagttctagatgcaatctacagaggacttaatggtgctactatcaagtcttggtagactttatcaacccaaaaaacttaccttcaatcttgtgggcaagttaatatagggaactcaatgcaaacaagtttgtaaaagtactttcttgggtggtgtttttttgcaatcctaattgtttttgtggctatttcttgtcacaattttgcagtataatcaaaatatttggcttatgaaattgggattttatcacatctttgtctatgtgttcaattattcttgtatttatgctcatct

SEQ ID NO: 6021 - DNA, 610 bp, Cirsium arvense
ctaccgctttccgaaaactagggttagggtttatcatccttcagatctatcaacaaaaaatgagttccaaatcagatgccgatgccaaaaagggaggaagaggaaaacctaagtctacgaaatcagtctctcgatcttcaaaggccggtcttcagtttcccgtcggtaggatcgctaggtttctcaaggccggaaagtacgccgagcgtgtaggtgccggagctccggtctacctctccgccgtccttgaatatctcgccgctgaggttttggagttggcaggcaatgctgcaagggataacaagaagacaagaattattccaaggcacattcaattggcagtgaggaatgatgaagaacttagcaggttgttgggctctgtcacaattgcaaatggtggtgttttgccaaacattaatcagactttgcttccaaagaagattggaaaagataaaggtgaaattggttctgcttctcaagagttctagatgcaatctgcagaggattgagtggtactactatcaagtcttgctagactttatcaacccaaaaaacttaccttcaatcttgtggacaagttaatatagggaactcatgcaaacaagtttgt

SEQ ID NO: 6022 - DNA, 730 bp, Cirsium arvense
acacccttccattatcaaaatcaaaagcctctctcttctctaccgctttccgaaaactagggttagggtttaccatccttcagatctaccaacaaaaaatgagttccaaatcagatgccgatgccaaaaagggaggaagaggaaagcctaagtctacgaaatcagtctctcgatcttccaaggccggtcttcagtttcccgtcggtaggatcgctaggtttctcaaggccggaaagtatgccgagcgtgtaggtgccggagctccggtgtatctctccgccgtccttgaataccttgctgctgaggttttggagttggcaggcaatgctgcaagggataacaagaagacaagaattattccaaggcacattcaattggcagtgaggaatgatgaagaacttagcaggttgttgggctctgtcacaattgcaaatggtggtgttttgccaaacattaatcagactttgctcccaaagaagattggtaaagataaaggtgaaattggttctgcttcccaagagttctagatgcaatctacagaggactaaatggtgctactatcaagtcttggtagactttatcaacccaaaaaacttaccttcaatcttgtgggcaagttaatatagggaactcaatgcaaacaagtttgtaaaagtacttcttgggtggtgttttttgcaatcctaattgttttgtggctatttcttgtcacaatttgcagtataatcaa

SEQ ID NO: 6023 - DNA, 815 bp, Cynara scolymus
cggggtcacgtacccttatgctttctgttcaggtcccagatcaaaagtcactaccgctttgtgaaaaactagggttagggtttatcattcagatctatctcgcttcaagaaaatgagttccaaatctgatgccgatgccaagaaaggaggaagaggaaagcctaagtctacaaaatctgtctctcgatcttccaaggcgggtcttcagtttcccgtcggtaggatcgctcgattccttaaggctggaaagtatgccgagcgtgtaggtgccggagcgccggtttacctgtccgccgttcttgaataccttgcagctgaggttttggagttggcagggaatgctgcaagggataacaagaagaccaggataattccaaggcacatacaattggcagtgaggaacgatgaagagcttagcaggttgttaggctcagtgacaattgcaaatggtggtgtcttacctaacattaatcagaccctgctaccaaagaaggttggtaaggataaaggcgagattggttctgcatcccaagagttctagaaccaatcttggtagacttgatctacccaacacttgccttctatctagtgcgcaagctaatatagggaactcaatgcaaacaagtttgtagaaatattattttgggtgtttttctttgcaatctgaattgttatggtggctctgctccatcttgccacattttgacggtataatcaatattgggtttgtcgattctaattgcgttgctttagttgttgttggatctatgatcatattttttcaagatatgtgaattttaggagctgtttatcag

SEQ ID NO: 6024 - DNA, 786 bp, Eutrema halophilum
atgacatcttcgaaacagtgcacaaaattaggcaaaaaattccacaaaactgatatatatcttcagatatgcctatatattgagaaggggaaaatccccaaaggaacccatcatagaattgacttagttttcgcttcgattttctgcaaaatttcttcaatcgttcttacatattccgcttcaaaggagacgaagatgagcacaggcgcaggaagcggcacgacaaaaggtgggagaggaaagccaaaggcgaccaagtccgtctctcgttcgtctaaagccggtctccagttccccgtcggaagaatcgccagattcctcaaggccggaaagtacgccgagcgtgtcggcgccggagctccggtgtatctctctgccgttctcgagtacctcgccgctgaggtgttggagcttgctggaaatgcagcgagggataacaagaagacacgtatagtaccgagacacattcagcttgcagtgaggaacgacgaggagctgagtaaacttctgggaagcgtgacgattgctaatggaggagttttgccaaatattcattccaaccttttaccttcaaaggtcgggaagaacaaaggagatattggatctgcttctcaagagttctgagtttccttttagtcatttagctcagtctctgttgttggattccctctcgtggaacttatgtaaaatagaccccgaaggttttttcggggatcaaatttagttaaaagcttaagcatatgatgggttacggagaatatgttcaatgatgcaaatttcggaatc

SEQ ID NO: 6025 - DNA, 627 bp, Coffea canephora
cggccgggggagtacctcccagaactgctacgcctcatttctctaccagggctttcaagggttttagtttttcatcaattttccatcctataatccaagaaaatgagctcaaaagaaggctcaaccaagggcggcaggggtaagccaaaagcatcaaaatccgtctccagatctcaaaaagccggtctccaattccccgtcggtcgtatccccgtttcctcaaggccgggaagtatgcggatcgtgtcggagccggagcacctgtctacctctcggccgttctcgagtatcttgccgctgaggtgttggagttggcggggaatgcggcgagggataataagaagaacaggatagtgcctaggcatattcagttggcggtgaggaatgatgaggagttgagcaagctgttggggtcggttactattgctaatggaggagttatgcctaatattcatcaaaacttgctgcctaagaaggttgggaaaggtgggaaaggggacattggctctgcttctcaggagttttagttgaagagaaaattgtaggcgttaatgtaatctattagttgtgttcttctttatggattgtgaatttgggcttgtttcttggaatgatttggtccccctg

SEQ ID NO: 6026 - DNA, 574 bp, Panax ginseng
aagcagtggtatcaacgcagagtacatgggggaccgtacgacaaacacatcctttctctctcctagggttttgctattctgtacagaacatttggatcgtcagatagaagaaatatagagatgagttcgaaagaaggttcaaccaagggcggaagaggaaaaccgaagtcttcgaagtctgtgacgcgttctctaaggccggtcttcagttccctgtcggtagaattgcccgcttctcaagacggaaatagccgaacgtgtcggtgccggagctccggtctatctgtccgccgtcctcgagtatctcgccgctgaggtgctggagttggctgggaatgcagcaagagacaacaagaagaatagaatagtgccaagacacatacagcttgcagtgaggaatgatgaggagttgagcaagcttttgggtgctgtaacaattgccaatggaggtgttttgcccaatattcaccagaatttgctacccaaaaaggttggcaaaggcaaggaagacattggctctgcttctcaggagttttaggaaaacattgtgcttagtagacttcttagtttttct

SEQ ID NO: 6027 - DNA, 698 bp, Daucus carota
ctttcacctccaacacttacctataaaacaaaacccacatctcccattctcccacaatccaaacctacaaatacaaacaatccatttcacacatacaaaatacacacacaaagatgagtgggaaaggtgcaatcacaaagggaggcagaggccaacaagcaaagaccaagtcagtgtcaagatcctcaaaggctggccttcagttccctgttggtagaattgctcgctttctcaaatcaggcaagtatgctgaacgtgtaggggctggagccccggtctatctctctgctgtccttgagtatcttgctgctgaggttcttgagcttgctggcaatgctgcaagagataacaagaagaatcggatcgttccgaggcacattcagcttgctgtgaggaatgatgaggaattgagcaagcttttggggacggttactattgccaatggtggtgtgttgccaaatatccaccaaactttgttgccaaagaaaatggggaaaggaaaggatgagattggatctgcctcacaagaattttagggctttggcaaggttttgttgtggtgtttgactattatatgatgaatggcggggtttgatattatctgatttggtgtggtcagttaatatacccctcatatcaggattgtttgatttattttaaatataaaaatgcaatacttattttgtgttgtgaattaa

SEQ ID NO: 6028 - DNA, 601 bp, Catharanthus roseus
aacacaatcatgagttcaacaggatcaaccaagggagggagaggcaggacgaaggcctccaaatccgtctcccgatctcagaaagccggacttcaattccccgtcggtaggatcgctcgttttctgaaggccggaaagtatgccgaacgcgttggcggtggtgctcccgtctatctctccgccgtacttgagtatctcgctgcggaggttctcgaactcgctggaaatgcggcaagagataataagaagaacagaattactccgaggcatatacaacttgctgtgaggaatgatgaggagttgagcaagcttttgggggctgttactattgcgaatggcggagttatgcctaatatacatcaaaatttactgccgaagaaggctgggactgggaaaggcgatatcaattctgcttctcaagaattctagtctgctaattacttttctgtctttgagattatagatctagggtttggcaggtattattaggtcccttgcatttgtttgtataaaacccgaatgctgaaattttgatatgcgaaaaattttcttgggaagaatttgattgatcgtctgtgctgaatatgaactaatttacatc

SEQ ID NO: 6029 - DNA, 1327 bp, Lactuca sativa
taaaaaccgttcatcggcctttcgaaaacctatatataagcattctctgtgtcccatctttgacactccaaatcaagcacaagtacaacgcttaactgatcggagctattttagggcttttctttcttcatcgctgatcgacaatgagtacggaaggttcgactaaaggcgggagaggtaaatctaaaataacaaaatcagtctccagatctcagaaagctggcatccaattccccgtcggtagaatcgctcgatttctcaaagccggtaaatacgcggaacgtgttggtgccggagctccagtctatctcgctgccgttcttgaatacctcgccgctgaggtccttgaattggcgggaaatgcagcgagggataataagaagaatcggattgttccgaggcatatacagttggctgtgagaaacgatgaggaattaagcaagcttttggggactgttactattgctaatggcggcgttttacctaatattcatcacaatctgttgcctaaaaagtttgggaaggggaaggatgagattggatctgcttcgcaagaattctaagggtttaattagtatctgcaaccggatctcaaagttttcaggattgttaaacatcttttgggttttttcctattgttttcctgatctaaaagtcaaatgtaaaaccctggcctatctacgtaatacacattgatcagttgatccctgatcctgaattttgaagattaaatgaaatttagttgtaaaaatttgacatgagggtttatatatgctgtgtgtgatgccaatgaacaagagtttgcaaacgattttatatgagttaattaatactaacacgcttgaccttgatgaaggtaaggccattccaatcatcttgacgttcatgagagtttattttacatgcagtggaacagcatttagtttcaatgatttaagtcctctacttatgttctgagaacttttttcaggcatccaagtcgcaaaaagacacagacaaagccatgaatactactgtcgctggaaaaaaaaaaagatacacggttcatacttttgcttgaagtagactttttatattttgacaacaatgaaatgttgcttctttgattctgttgcagcttttgggacaataggcaatacttaatacgaacattattttgaatggatatgaacacgttgagcaaaccccattgctatataatttaggttgtgcttgattgagtgtgaatgaaggaaaaataattgatctataagcgattcagtaataagcttcttcatgagttgacttttatctacagtattgttttttattttattttttgtaaatt

SEQ ID NO: 6030 - DNA, 607 bp, Allium cepa
gaaatgagttctgcaggaagaggaaaggcgaaaagcagctcaaaatcagtttctagatcttctaaagcagggcttcagtttcctgtcggaaggatcgccagatttctgaaggcaggaaaatacgctgagagaatcggcgccggagctccagtctatatggctgctgtgctcgagtatttagccgccgaggtgctggaactggcaggaaatgcagcaagagataacaagaagaatagaatagtgccaaggcacattcagctcgctgtgagaaacgatgaagaattaagcaagcttcttggaactgtcaccattgctaatggaggtgtcttgcccaatattcattccactttgttgcctactaagcctggaaagggaaagggagaaattggttctgcttctcaggaattttagtttgttttcctgatatatgtaagttgtcgcaaaatgatgcacctttgtatattctggtctttttgattatgactgaacttctgatcttaatgctaagggcatccgctttagggttgaagcgttacatttatatgtgaagttattttgcatcatattcggaagtgatctgcatttaataaattagttcgcattgttt

SEQ ID NO: 6031 - DNA, 1021 bp, Gossypium hirsutum
atcaatcaccaaaattgcgccaaaaaagaactcgagactctacaatctccattaacaaaatctagggttttcaaaagaagatgagctcaacagtatcaacaaagggaggcagagaggcaagcctaagtcctccaaatccgtctcccgatctcaaaaagccggcctacagtttcccgttggccgtatcgcccgtttccttaaagccgggaaatacgccgatcgtgtcggcgctggtgcccccgtttatctctccgccgtccttgaataccttgctgctgaggttcttgaacttgctggaaatgctgctagggataacaagaagaatcggatcgtgccgaggcatattcaattggctgttaggaacgatgaagagttaagtaaacttttggggactgctaccattgctaatggaggtgttttgcctaatattcatcaaaatctgttgccgaagaagattggtaaagggaagggtgatattggatcggcttcacaagaattttagacgattctggagcgtgaagaagtctcttttgtttcggaaatttattcttatattcttttaattggaaactgttaaaaggattgggtaatcttatattttgttttccgatgggttgttttgtgagctttcaactggtcctgtaaatcatattttgggctcgttttgattttggttgagtggggtgtgcaaaattgatatccttatatataattactttgcaattgcagtaattttttgcaattcaacacgccaaacaaaacttatatgtacatatatatattcaaaagtattctgtgtagttggcagtcttctgccttccggtctaagtatcgatgtatatgtgttctattctattttgcaagtataggtatctagttgttcctcagtctgctgagactcaagggcagaatgatgaaaacattggaaaatgggttacaaagaggaagatctttgatgattctgttgtcattgcgaccaagtgtatagcaaattgtgagatgacttagcctgccatccagg

SEQ ID NO: 6032 - DNA, 583 bp, Elaeis guineensis
aggcaggggcaagcccaagtcctcaaagtccgtctctcggtcccagaaggccggcctccagttcccccgtcggccggatcgcccgcttcctcaaggctgggaaatacgccgagcgcgttggcgccggtgcccccgtctacctctccgctgtccttgagtaccttgcggctgaggttctggagttggctgggaatgctgcgagggacaacaagaagagtagaatcgttccaaggcatatacagcttgcagtgaggaatgatgaggagctgagcaagcttctggggactgttacaattgccaatggcggtgttttgcctaatatccatcagactctgttgcctaagaaagcagggaaggagaagggagatcttggttctgcatcgcaggagttctagagttttaataatctcaaaatttttcatgaaaggatcggggtattttcccttgggggttttctgtcaggggtgttgataacttgatgtatgaactgggttgaccgatgtaattttttttttttgtagtctatacaactataccttctcttattaacaaaaaaaaacaaaaagtgagctcacgagacaca

SEQ ID NO: 6033 - DNA, 698 bp, Nicotiana tabacum
ggccattacggccggggaaaccgaaagcaaataagcaacagaagaagaaagcttactttacacacaaatcgagagctagggttagggtttctgttactctttcatctaacaatgagttctgatggaggatcgggcaagggcaagggcggcgctggtagagggaaacctaaggcatcaaaatcggtgtctcggtcttcaaaagcggggctccaattccccgttggtaggatcgctcgttttcttaaggctggaaaatatgctgagcgtgttggtgctggtgcgccagtttacctatctgctgtccttgaatacctcgcagctgaggtgttagagttggcagggaatgcagcaagggataacaagaagaatcgtattgtgccgaggcacatccagttggctgtgaggaatgacgaggagctgagcaagattttaggtcaggttacaattgctaatggaggtgttatgcccaacattcaccagaatctgttgcctaaaaaggctggctcgggcaagggtgatattggctctgcatctcaagagttttagatttacccattttcttgttctggggaaatgattaaaagtaaacatagttatgtaaaatagaaatggctgttgttttgataatactttggaacattaaatgcagtggcattgtcaacttgcagttttggtaatacattgtggaatgtttttgt

SEQ ID NO: 6034 - DNA, 627 bp, Ipomoea nil
gaaggcgagaatttctgtgggttggagtctagagttttcagagaattgagagttaattagggttacgtaactaagaatgagttcaagcggcgcgggtgcagggaagggcggcgccggcagaggcaagccgaaagccacgaagtcggtgtctcgatcttctaaggcggggctccagttcccggtcggcagaatcgcgcgattcctcaaggctggaaagtacgccgagcgtgttggtggtggagctccggtttatctcgctgctgttcttgaatatctcgctgctgaggtgttggaattggctgggaatgcagcaagggacaacaagaagaatcgcatagtgccaaggcacattcaattggctgtgaggaatgatgaagagcttagcaagcttctgggtgatgtgactattgccaatgggggtgttttgcccaatatccatcaaactttgctgccaaagaaggctggctctggaaagggtgaaattggctctgcttctcaggagttttagggttttttagtggaggtgaaaatggaactttatgtatattagctagctgctgctattgagtggtttgaaatcaagaaatgcaatgaaattgcaattttggctcgttcccaaaaaaaaaa

SEQ ID NO: 6035 - DNA, 601 bp, Raphanus sativus
ggactgaacaacatcttccgctctctcaccacctctcaattcaattttcttcaatcgtaattttccattttcgcttcgtaaaagacgatgagcagcaccggcgcaggaagcggcacgaccaaaggagggagaggaaagccaaaggccaccaagtccgtctctcgttcgtcgaaggccggtctccagttccccgtcggaagaatcgccaggttcctcaaggcagggaaatacgccgagcgtgtcggtgccggagctccggtctatctctccgccgttctcgagtacctcgccgctgaggtgttggagctagctggaaacgcggcgagggataacaagaagacgcgtatcgtgccgagacatattcagcttgcggtgaggaacgatgaggagctgagtaagcttttgggagctgtgacgattgctaacggaggagtgttgccgaatattcattcgaaccttttgccttcaaaagttgggaagaacaacggagatatcggatctgcttctcaggagttctgagttctctttttagctcttttgttctctcgatgtaacttcatatgagttttgattaatctttgggtttgcaagaaaaaaaaaa

SEQ ID NO: 6036 - DNA, 582 bp, Centaurea maculosa
atacttcagatctatcacaaaaatgagttccaaatcagatgccgatgccaagaaaggaggaagaggaaagcctaagtctacaaaatccgtctctcgatcttcgaaagccggtcttcagtttcccgttggtaggatcgctagtttcttaaggccggaaagtatgccgagcgtgtaggtgccggagctccggtgtacctctccgccgtccttgaatatctcgccgctgaggtgttggagttggcaggcaatgctgcaagggataacaagaagacaagaataattccaaggcacattcaattggcagtgaggaatgatgaagagctaagcaggttgttgggctcagtcacaattgcaaatggtggtgtgttgccaaacattaatcagactttgctaccaaagaagattggaaaagataaaggtgaaattggttctgcttcccaagagttctagatgcaatctacaaaagggataaatggtactactattaagtcttggtagactttatcaacccaaaaaacttaccttcaatcttgtgggcaagttaatatagggaactcaatgcaaacaagtttgtaaaagtac

SEQ ID NO: 6037 - DNA, 626 bp, Amorphophallus konjac
gctgcgtcgtccagttctcttcttcttcgtctttctgctcgcctcggtgtggttccagccttccagagaggagggagggagggagcgaagatgagcaccacgggcaccaccaagggtgggcggggcaagcccaaggcctccaaggcagtctctcgctcgcagaaggccggcctccagttccccgtcggccggatcgcccgcttcctcaaggtcggcaagtacgccgatcgcgttggcgccggcgcccccgtctacctcgccgccgtcctcgagtacctcactgccgaggtactggagctggcggggaatgcggcgagggacaacaagaagaacaggatcgtgccgcggcacatccagctggcggtgcggaacgatgaggagctgagcaggctgctcggggcggtgaccatcgccagcggcggggtgctccctaacatccaccagacactgctccccaagaagcagggcgccggcaagggcgccaagggcgacatcggatccgcctcccaggagttctgagctccggtctcgtcttcccctccctcccttcttcgccaccccctgtcagtagtactgtaaatcctcgcctgatggaatgatatgatcaaatgccctctctcgtttcc

SEQ ID NO: 6038 - DNA, 567 bp, Catharanthus roseus
gacttgatttagggttcagagagaggaatttttctaaaccattcattctgtttctcctcaaagaaagaagatgagttcaaaagaaaccggcgcatcaaagggtggcagaggaaagccaaaagcgtcgaaatctgtttctcgatcttcaaaggccggtcttcagtttccggtgggtcgaattgctcggttccttaaggccggtaagtacgccgagcgtataggatccggagctccagtttatctgtctgcagtccttgaataccttgctgctgaggttttggagttggctggaaatgctgctagggataataagaagaacaggattgtgcccaggcacattcagttggctgtcaggaatgacgaggagttgagcaagcttttggggtcggttacaattgctaatggcggtgttttgcctaacattcaccagaatctgttgcccaagaaggttggcaaaggtggaaaaggagagattgggtctctttctcaggagttttaggttcgtggtgctctggggttagggttagggttagggttaggttttgaggcaactgataagaaaaagaa

SEQ ID NO: 6039 - DNA, 685 bp, Centaurea maculosa
tattccgatatatcaaaatcaaaagccactaccgctttctgaaaactagggttagggtttatacttcagatctatcacaaaaatgagttccaaatcagatgccgataccaagaaaggaggaagaggaaagccaaagtctacaaaatccgtctctcgatcttcaaaagccggtcttcagtttcccgtcggtaggatcgctagatttcttaaggccggaaagtatgccgagcgtgtaggtgccggagctccggtgtacctctccgccgtccttgaatatcttgccgctgaggttttggagttggcagccaatgctgcaagggataacaagaagacaagaataattccaaggcacattcaattggcagtgaggaatgatgaagaacttagcaggttgttgggctctgtcacaattgcaaatggtggtgttttgccaaacattaatcagactttgctaccaaagaagattggaaaagataaaggtgaaattggttctgcttcccaagagttctaaatgcaatctacagaggactaaaatggtactactatcaagtcttgttagactttatcaacccaaaaaacttaccttcaatcttgtgggcaagttaatatagggaactcaatgcaaacaagtttgtaaagtactttcttgggtgatgttttttgcaatcctaattgtttttgtggt

SEQ ID NO: 6040 - DNA, 623 bp, Cleome spinosa
tcaagcgtctcatcgtcttcttcttcgtcgattttgtccccaaatcttggtgtagggattttccgtcgatattatattgtcgaggattatcgaagatgagttctactggtggtgctggatctactaaaggagggagagggaagcccaaatcgacgaagtcggtatccagatcgcacaaagcggggcttcaatttcctgtcggaaggatcgcgaggtttctgaaggcaggaaagtacgccgaacatgtcggagccggcgctccggtttatctctccgccgtgcttgagtacctcgctgcggaggttttggagcttgctggtaatactgctagagacaacaagaagaataggattgttccgcggcatattcagcttgcggtgaggaacgacgaggagctaagcaaacttcttggcagcgtcaccattgctaacggaggtgttttgcccaatattcaccagcatctcttacccacaaaggctggcaaaggaaaaggcgatattggctcggcttctcaagaattttaatttgttcccctttcgttcgttcttgatgtagcatatatatagttttgtccttgtgggtcatgagaatgcggaatttgtaacttcgaattcgagtcaatt

SEQ ID NO: 6041 - DNA, 731 bp, Carthamus tinctorius
atgaagcctctccccgatttctgagaatagggttagagtctttccatcagatctatcgtcgcttcaacataaatgagttccaactcagatgccgatgtacagaaaggaggaagaggaaagccaaagtctacgaaatccgtctcccaatcttccaaggccggtcttcagtttcccgtcggcaggatcgctagatttctcaaggccggaaagtatgccgagcgtgtaggtgccggagctccggtgtacctctctgccgtccttgaatacctcgccgctgaggttttggagttggcaggcaatgctgcaagggataacaagaagacaagaataattccaaggcacattcaattggcagtgaggaatgatgaagaacttagcaggttgttggggtctgtcacaattgcaaatggtggtgttttaccaaacattaatcagactttgctaccaaagaagattggaaaagataaaggtgaaattggttctgcttcccaagagttctaaacacaagctacaaaagggcaaatggtactactactatcaagtctttggtagactttatctacccaatacttaccttcaatcttgtgggccagttaatatagggaactcaatgcaaacgagtttgcaacagcactttcttgggtggttttttttagcaatcctaatagttcttgtggctatttcttgtcacaatgttgcagcataagcaaatatctggtctatgaaattgg

SEQ ID NO: 6042 - DNA, 630 bp, Tabernaemontana elegans
atttagggttctgaaggaagtgaattatcaaattgattcatcatcttgatttaatcgtctaagaaaatgagttcaaaagaaggcggcgcttcgaagggtggcagaggaaagccaaaagcatcgaaatctgtttctcgatctcaaaaggctggtcttcaatttccggtgggtcgaattgctaggtttctcaaagccgggaagtatgctgagcgtattgggtccggagctcctgtttatctctccgcggtccttgaataccttgctgctgaggtgttggagttggctggaaatgctgctagggataacaagaagaataggattatgcccaggcatattcagttggctgtcaggaatgacgaggagttgagcaaacttttggggtcggttaccattgctaatggcggtgttttgcccaatattcaccagaatctgttgcctaagaaggtgggcaaagatggaaaaggacagattgggtctctctctcaggagttctagggttgtggtaatttggggttagggttagggttctgaggaaataaacatacaaaaaacaatgcttatgtaatatacaatgctacccttcttcctgccttgtcaatggtttcatatggaatgacaattttggttttg

SEQ ID NO: 6043 - DNA, 929 bp, Amorphophallus konjac
gcgtaaccatctctgtgcacttgttgcagtccgagggtttccagggtttttgcgtcgccggtcgtcccaaagccgaaggatgaactctgcagcttccactaagggcggcaggggcaggcccaaggcctccaaggccgtctcccgctcccacaaggccggcctccagttccccgttggccggatcgcccgcttcctcaagaccggtcgctatgccgaacgcgtcggcgccggcgctcccgtctacctctccgccgtcctcgagtaccttgccgccgaggtgctggagctggcggggaacgcggcgagggacaacaagaagaacaggatcgtgccgcggcacatccaactagcggtcaggaatgacgaagagctgagcaggttgctcggcgcggtgaccatcgccagcgggggggttctccctaatatccatcagacgctgctgccgaagaagcaggggaaggggaagagcgacgccgggaacgcttcccagtctcaggagttttagcgttctttttggatcctcgacggcgttgtgtgtcgtctgatgatggtataatttgcaagatggttgggttggcaagaaatggtactaacggcggatcccatttctgtagcgaagaggctaggattgtagaaaggttttggttgcttgtatagacgtcttgaagtttcacaaagcctaatgaagaaatcatagtgttgctgtgatgacatttggttctgctttgtgtgagatgatgacgcgttctctggttgtatggtgtccttttttcctccttttggtctctgagttttgttcaacgttgtaggatctccccaggttttctatctttttacctgtttctagaatttctttgagagaggatctttttgatctctgagttttgttcaacgttgtaggatctccccaggtttttctgtctcgtcat

SEQ ID NO: 6044 - DNA, 504 bp, Cirsium arvense
agttccaaatccgattccgatgccaagaaggaggaagaggaaaacctaagtccacaaaatctgtctctcgatcttccaaggccggacttcagtttcccgtcggtagaatcgctagattcctcaaggctggaaagtatgccgagcgtgtcggtgccggagctccggtttacctttccgccgtccttgaatacctcgccgctgaggttttggagttggctgggaatgctgcaagagataacaagaaaaccagaataattccaagacatatacaattggcagtgaggaatgatgaagaacttagcaggttgttgggatctgtgacaattgcaaatggtggtgttttaccaaacattaatcaaaccctgctaccaaagaaagttggtaaggataagggtgaaattggttctgcttctcaagagttctaaactcaatcttgttagactttatctacccaacacttgcattctatattgtgagcaagttaatagagggatcttaatgcaa

SEQ ID NO: 6045 - DNA, 685 bp, Cichorium intybus
aggagttacattttagagggaaaccaaaacatcaaattatcgtgccaacctggcaatcctcccctggttgattcaaccaataagaacgaagaaacttgatgtataaataagcacccttatgtcctcacacacagtaccaaattcaaatctctcccgttttgtgataaactagggttagggtttatcgttcagatcaatcgctcgacaagaaaatggctcccacatctgatgccaaaggcggaagaggaaaagctaaggctacaaaatctgtgtcccgatcttcaaaagccggtcttcagtttcccgtcggtaggattgccagatttctcaaggctggaaagtatgccgagcgtgtcggcgccggagctcccgtttatctctccgccgtccttgaatacctagccgccgaggttttggaattggctgggaatgccgcaagagataacaagaagtccagaatagttccaagacatattcaactggcagtaaggaacgatgaagagcttagcaaattgttggggtctgtgacgattgcaaacggtggcgttttacccaatatacattcaacattgctaccaagcaaggtcgggaaggacaaaggtgaaattggttctgcttctcaagaattctagagaaaaccaacttggaatatggatctcattgcaaagaaattttatgtaaaaaa

SEQ ID NO: 6046 - DNA, 628 bp, Cichorium intybus
tagagggaaaccaaaacatcaaattatcgtgccaacctggcaatcctcccctggttgattcaaccaataagaacgaagaaacttgatgtataaataagcacccttatgtcctcacacacagtaccaaattcaaatctctcccgttttgtgataaactagggttagggtttatcgttcagatcaatcgctcgacaagaaaatggctcccacatctgatgccaaaggcggaagaggaaaagctaaggctacaaaatctgtgtcccgatcttcaaaagccggtcttcagtttcccgtcggtaggattgccagatttctcaaggctggaaagtatgccgagcgtgtcggcgccggagctcccgtttatctctccgccgtccttgaatacttagccgccgaggttttggagttggctgggaatgccgcaagagataacaagaagtccagaatagttccaagacatattcaactggcagtaaggaacgatgaagagcttagcaaattgttgggatctgtgacgattgcaaacggtggcgttttgcccaatatacattcaactttgctaccaagcaaggttggaaaggataaaggtgaaattggttctgcttctcaagaattctagagaaaacca

SEQ ID NO: 6047 - DNA, 842 bp, Cichorium intybus
tagagggaaaccaaaacatcaaattatcgtgccaacctggcaatcctcccctggttgattcaaccaataagaacgaagaaacttgatgtataaataagcacccttatgtcctcacacacagtaccaaattcaaatctctcccgttttgtgataaactagggttagggtttatcgttcagatcaatcgctcgacaagaaaatggctcccacatctgatgccaaaggcggaagaggaaaagctaaggctacaaaatctgtgtcccgatcttcaaaagccggtcttcagtttcccgtcggtaggattgccagatttctcaaggctggaaagtatgccgagcgtgtcggcgccggagctcccgtttatctctccgccgtccttgaatacctagccgccgaggttttggaattggctgggaatgccgcaagagataacaagaagtccagaatagttccaagacatattcaactggcagtaaggaacgatgaagagcttagcaaattgttggggtctgtgacgattgcaaacggtggcgttttacccaatatacattcaacattgctaccaagcaaggtcgggaaggacaaaggtgaaattggttctgcttctcaagaattctagagaaaaccaacttggaatccccccaaatgctctttttggggttatctttgcaatcagttttatcaaaattttggtagtatatttaatatttaatgttttccggtgatttgataccgctataatgtctctttacatgatttcgtgatcttttgtgcgtgctttagattatctgtttaatttgttgatacgtttgaagatgtgtgaagaactacgatctttgaac

SEQ ID NO: 6048 - DNA, 799 bp, Lactuca sativa
gatcactaccagctttaaacatatctcgttccgtaaaaactagggttagggtttatcacttcaataaaatggctcccaagtcagatgccaaaggtggaagaggaaaacccaagaccacaaaatccgtgtctcgatcttccaaggccggtctccagttccccgtcggtaggatcgcccgattcctcaaggccggaaagtacgccgaacgtgttggcgccggagcccctgtttacctctccgccgtcctcgaatacctcgccgccgaggttttggagttggcagggaatgctgcaagggataacaaaaagagcagaattgttccaagacatatacagttagcagtgaggaatgatgaagaacttagcaagttgttggggtcagtgacgattgctaatggtggtgtcttaccaaatattcattcaactttgctaccaagtaaggttggaaaggataaaggtgaaattggttctgcttctcaagagttctagatcttattgcatatgaagtttttgtataaacgaaaaaggcctgttttggggttttacttgcaatcgaattatcaaaattttggtactataatcattgattggacttgaaatgagaatcatgtctccatcaatgatatgataatctttaatgtttactttagtttataatattggcatgtttatcatgtttgaaaatttcaagaagcagtttttatcatgacttgtttgatacaagaactacaatacctagtagtggttgataattaaaattttcaaactttggttaatgctaatgaactacaaaaatggct

SEQ ID NO: 6049 - DNA, 1222 bp, Marchantia polymorpha
ctccacacctcacgttcgctcttcatcgtttccttcgctgcgcccgacggcccccagtcggtctcgccctccgtaacgccgcttccgcagtgctagaacaatctgcccatcgatccccgtctgatcgacagttccgaaattgcgagtggagaggtcgaggtcgattgtaggtattaaggtctttttttctgctgttggaagggagctcgatctttcccacaccttcctcgactgttcataccctagggttggcaagactttgacgcctacatttcacgctcatcttcgagcaagaattgtctacacactacagtttgtgtagtacgccctactaccaacatgagctccgcaggaggcagcagcggtggtcgtggaaagaccaagggctcgaaggccgtctctcggtcccaaaaggccggtctgcagttccccgttggacgaattgcgaggttcctcaaagccggcaagtatgcagagcgtgttggagccggcgcccctgtttacttggccgccgtcatggagtacttggccgctgaggtgcttgagttggctggaaatgctgccagagataacaagaagaccagaatcattccacgtcacatccagcttgccgtgcggaacgacgaggagctcagcaagctgcttgggtctgtggttattgctagtggaggagttctgccgaacattcagtcctctctgttgccgaaaaagtctggcaagagcaagggtgacattggaagcatgtcccaggaattctagatccctgtacagtcattgcaattttttaaagcacttcgaaatttcaatcttgaagttgagaagtgccactgagtagagtaggactccacacgggactacaggtgcgtgcgtttgctggagttaattactacgtagaaacatgtagttgccattgggtggctacgtgttgtactcaaggtagttagttcctcctatacaggaggcggggtccttctgaaatggctcaatgtcaccgatgtatccttctgaattatggggttctcttatcagtagttggagatatcaggaccttcgttaggtaggaagtcccttacagtacagaatgggaactttaagtacttgactggtctcaagcaatgtgcagaggccaacttctctttcccttgtaaagcgctttgaatttcagccaaactctttttttgtaaactttcttaaggaaacaaacaaattgcgaaaaaaaaaa

SEQ ID NO: 6050 - DNA, 1106 bp, Physcomitrella patens
tgcctctggcgttgttgcttcgcctgtactcttgcttcgatcaatgtctgcacttgccactgcatagaaggacagtactcaaacctctgcgtgattgaaggagcgcggaggagctctcagaacgatgagttctacaggcgctactggaggccgtggcaagtctaaggcctccaaatctatttcccggtcgcagaaggctggccttcagtttcctgtgggaagaattgctcggttcttgaagtctgggaagttcgccgagcgcgttggagctggggcccctgtctaccttgctgcagtgcttgaatatctagctgctgaggttcttgagctggctggaaatgctgcgagagacaacaagaagaatcgtatcgtccctcgccacatccagctagcggtgcgaaacgatgaggagctaagtaagttgctgggcacagtcacaattgccgctggtggtgtcctgcccaacatccacacggtactcttgccgaagaaaactgacaagggtggcagggacatcggagggagcatttcgcaggagttttagacacttctccaccctggctaagtccaaaacaaatttgtctagacctccattacttccatctctcttgattcagagtaccctccgctccattgtcctggtttttgctggttcgacattcactgcccgtcgtgtacaaattgcactttagattctggaaggccagtgccagaacccttttatcccaagtcagctaaattcgctgtagtttgccaaaaatctgtcgctttggatcacttcgattcgtatgaggaaatatagcaattctcacggactttggtgtgatacttgcatttgtttaccaacgaagatggatatggtttactcactctgctgcaaactcacgacttgttatgtgacgttaaacagatatgaagctctcttgacacggcctgcaaaaacaaattaatgcaaacatcgacaaaccttcacatttaatcagtccagttgtaattatacttgtgcgttacattcatcatccatcttccatgattactcttttcatgaataactacatctaattttcagggcgtgagatttgtgagaattgtgtcactgattcatc

SEQ ID NO: 6051 - DNA, 473 bp, Pteridium aquilinum
gtcgcctctgccaagatgggctcgggaggcagagggaaagcgaaaacctccagcaagtctgtctcgcgatcgcacaaggctggcctgcagtttcctgttggccgcattgccaggtttctcaaagctggaaaatacgcagagcgtgttggtgcgggtgcgcctgtctaccttgctgctgtccttgagtatcttgctgcagaggttttggagctggctgggaatgcagcccgtgacaacaaaaagaataggattgtccctcggcatattcagttggctgtgcgcaatgatgaagagctgagcaagctgctaggtgctgtgactattgccaatggaggtgttttgcccaacattcacaatgtgctgctgcctaagaaaactgggaaggtgaagggggaagttggtagtgcctctcaagagttttaggttaatgtcaaaggtagccaaaggatattacctatgacaaagttgcttaa

SEQ ID NO: 6052 - DNA, 1060 bp, Triticum aestivum
ggcggggggggtgtaaataaaggcagactttgatttgttggcccgtcagattcgccgtgaaaccccattcacgctggtttagacggtcacaaaaaaacaccggggacgagtccgccctccggattttacctaagcgcggggggcggataaccaatttaccccaggaaaccagttatggccactaggcctattttaagtggccactttaaggacaaggttggaccaaaaaagcagggcgggaaccggttcggaatttcccgggatattcgttgacccacggggtccggggatgggcaccgaggacacttacctggaattaaaggagtagaaaaagcacacccagcgccctccacctgctcccagatcccggccatctctccgccgacaaccgcaccagcgcgtccaccctccaccgcgaaccagaagatggccattgccggcagtgggaggggcaaggcgaagcccgccgccagcgccaagtccgtgtcccggtcgtccaaggccggcctgcagttccccgtcggccgcgtcgcccggtacctcaaggtcggcaagtacgcgcagcgcgtcggcgccggcgcccccgtctacctcgccgccgtcctcgagtacctcgccgcagagaccctggagctcgccgggaacgcggcgcgggacaacaagaagaaccggatcgtgccgcgccacatccagctggcggtgcgcaacgacgaggagctgagccgtctgctgggctcggtcaccatcgccgccggcggggtgctgcccagcatccacaccacgctgctccccaagaaggccggcaagggcaagggcgacatcggctccgcttcccaggagttctagattagattagtatggtccttgtgaatgtttgggtttggtgcgtcatcgatgttgggtggtggatctggttgggatggattgccgctcgcaatctggttctcgttgttactgcctgtgatttgtcagtgctaatcttcatgaaaccgtagtttgatgcctaacggggactaaaacaggatgcgttcgttgatggtaaatcatgctgtgttgtttc

SEQ ID NO: 6053 - DNA, 629 bp, Amsonia hubrichtii
cgttcaacagaaggctccaacaaggggggtagaggcaagcccaagtcctctaaatctgtctcccggtcccataaagcaggccttcagtttcccgtcggtagaatcgctcgtttcctcaaggccggaaagtacgcggaacgcgtgggtgctggtgccccccgtctatctctccgccgtccttgagtatctcgctgcggaggttcttgaacttgctggaaacgcggcaagagataacaagaagagtaggattgttccaaggcatatacagcttgctgtgaggaatgacgaggagttgagcaagcttttaggggccgttactattgcgaacggaggcgttttgcccaatatacatcaacatctattaccgaagaaggctgggaaaagggaaggcgacatcgatcctacttctcaagaattctagggtttctgtatctctgttttaattcccttctttttaaggatcaaagctaagttttgagcaggtacttagtccgaaccgatacatttgtaaatccatcgttttgggaattttaattcgatgcataagtgacgtgaattcattatatacgtcaaatttctcgatgataatggaatttatgattagttctatcactagaggatgtgataat

SEQ ID NO: 6054 - DNA, 604 bp, Artemisia annua
acatcattcaccactcactcattgagaaaagcaaagcaaattagggtttttgagatctaaaaaaaagggttaagaaatgggtgggaaatcagtggaagacatgaagaagggaggaagagggaagacgaaatcatcagcgaagtcggtatcaagatcttcaaaagcagggcttcagttcccagttggaagaattgcaaggtttttaaaacaaggcaaatatgctcagcgtgttggtgctggtgctcctgtttatctctctgctgttcttgaatatcttgctgctgaggtattggaattagctggaaatgcagcaagggacaacaagaagacaagaatagtaccaaggcactccagctagcagtgaggaatgacgaggagctcagcaagttgttgggatcagtgacgattgcggtggtgttttgcccaacattcattcgactttgttgccaaagaaggctggtaaggacaagggtgatatcggctctgcttcacaagagttttagggtcaatgatttgttactagttgttgttttagggaaatggtcttgtttaatgctttttgaagatatgatgtttgttttatcaatcaatcaatgggaattaa

SEQ ID NO: 6055 - DNA, 3497 bp, Zea mays
ctcacaagggtatatagcttcagccgagcagccgaacatgctggaataagcatataatctctactactccttaagtctctactgtaggcgtccacatctgtgcgttctgccaccgcgcggcgtgtgccattcccagtcgtctcccccaggaaccgcgcctcccccactcgcgcattccatccatggcgctagacagtcgcgctcctccgcggccttccatccatggcagacgctccctccgcgtccttccatccgtcagtgatccatgcctctgatcttccagccaatcatagcgcatctctcactagaaccctaacagtataaaatcgcaggcgccgcccgctcctccctccaatatccctctgttctcctatcaatatcgcagcgctgcccgcatcaatcttgaagagttcgaaagtttccagacccccaaaaggcgaagcggcgatgagttccaccggaggcggcggccgcggtaaggcgaagccagcgaccaagtcggtgtcgcggtcctccaaggctgggcttcagttccccgtcggtcgcatcgtgcggtgcctcaaagccggcaaatatgcagagcgcgtcggcgctgggcccccgtgtacctctccgccgttctcgagtatctcgccgccgaggtgctggagctggccgggaacgctgctcgtgacaacaagaaccgtatcgtgatgcgccagatccagctggcggtgcggaacgacgaggagctgagcaagctgctgggcactgtgacgatcgcggccggcggcatgatgccaaacatccatcagaccctgctgcccaagaaagctggtcagaagggggacatcagctctgcctcccaggagttctaagcgctttggcggaatgagaatgagggaccgcccctgtttctgtctcgtccgcgtggttgtgtttcagctttgcggtttttggggagtgttgtcgatgagttgggattgatatgggttgtggggatgtaaacaaacgcagcccgttgtttcatgaatgaatgatggatagaaggaacatatctatcatgatttctaccctggttgcatttggatccgatttgctcctatcgtttggtacattgtatcagacctgatgatggaactttttctatcggttctatgaactctgcatcatatgatctgtcagatttcgattcatgttggaatatacagtccggaaactctgcatcttctggcctttggcttccagtagaagtcgggatcaatagctatctgtagtatggcactactaactatattaagaattttgcatttgttgactgttgatggcctcagtgaacctcaccgattgattgtacttgttcaatttttcctacgggttctctttgtgatgtaccaaaatctttgccaggttcgggagcgatatggtctcgagtctcgacctcctcggcgccgcgctgcgacgcggcatgcgcgtacagcgcgaggagcactgcctcgaacccggccagcggcttccgtgacatggcgtggcacaggtaattccagtggcatagcttcaatgctatgtatgactttcttaagaaaaaccgagagatcacaagatgggttgctctaggcattgttgtttttttagataagagacatgacttatctgacagcttttgatcttaactaaactcgaaggatcctcatttgatccttatgcttccaaagccattgtatttgcttcttcaacttgtactctgtaagtttctaatgttcatgcaaatgttttccaaatctaaattccgtctttggccccttttctaatttctcgtcaccccacactgcatgttttgtttaacctattagtatatgttttatactaatttttaactcccgtagcaacgcacaggcgcagaactagtatatatatatatatgcatatagagccataggcagggccggccctgagcctatgcaagggaggcgacggccgggggcccaaaattattaggggcccaatatttagtatctataacactatataacacacaagtttacacttcacaaaacctattcaaccaaataacccacacacctataatatttacgaaatccatcaaacaaattgcactcatatttaacataacatcaaaattaacggttcatatcattgaataacatcatctattttgctcactcaaatctaacgaacaatattatttgatcatcctttagccctcccctcctcgcgttcccaccgccatcaatccctcccctcgcgccaccaccgtcatcgtccacccctctccttctattcacaggaatgtagcgttagcacgggttatatgctagtagtaaaatagtataggtagccaacagggcgggagggcagggcacacggatgcacgatgcacacagacaacgtggcacgcgttgcccactgcctagtcgtcacgctcatgtcccagagcgtctatgagaccacaccctccacgtgatcgttgttcgccatctcgccgatccaaccctccaggattccagacacgcatggtcgagcaatcagaatttaagttattcggcgatcgtcgttcttatttttcaacatacgaagtgctaatttgtaccgatgtatattagctagcttcttagatttaaaaaactaatgtcaatacacatcaccatttatttacgaagtattaatatgctccactgtataatatagaatatttttaaagtctacagggcccaccacgatcagttcgcacgggggccctcaaaatcataggaccggggctggccataggcaacctagatccagagttccagacgaacgaagaggagagagacgatccaaagtgcatgaaaatgaaagcccgtcattggtttcgcagccctcttgatggacagatggatggatcacgttcgtgttctctctcgtattttcacgccggccgtcgtcgttgccttttccttgtctcatgcatgggccacctgcaggtggtctagtccatctgccactgacactgaggactgtgggaggtgacgcgcgcgtggacatgaacggggccggccggccggccgtgatgctgcgcaggcccgtcactaccccgtgcatgcatgcatgcatcgcatggttccgatgggattgggaggcagcaggggccatccggcctccggccatgcatcatgcaggcatgatggcggatggcctgggcgggcgcgcgcgcgaagactcggttagttctgatttgaagacgatggggaaaaaatatcaaattaaagcccgcaatgcaaggatgtgtgcatgctttgcaaatgatggattgatatggcattaaggctgcatagggcatgtttggttccataagactaaactttattctctcttttatagttcctaaattaccaaaaataggattatagatgggaggacatctgatttaatcccttttagtctttatatttagtaatctagaccagcctatttatacaaaccgtttagctaagagtaactctaacagcttatataaa

SEQ ID NO: 6056 - DNA, 390 bp, Castanea mollissima
ggcaaacccaagtcctcaaagtctgtttctcggtcacagaaagctgggcttcaattccctgtgggtcgtatcgcccggttcttaaaagccggcaagtacgccgagcgtgtcggtgccggagctccggtttacctctccgccgtgctcgaataccttgctgctgaggttcttgagctagctggtaatgctgctagagacaacaagaagaatcgtattgttccgagacacatacaacttgctgtgcgaaacgatgaggagttgagcaagcttttgggaacggtcaccattgctaatggaggtgtcttgcccaacattcatcagaatttgttgcctaagaagattggtaaagggaaaggtgatattggatcagcatcgcaagagttttagggt

SEQ ID NO: 6057 - DNA, 662 bp, Pteridium aquilinum
ctcacaattttgcttttgattgcgctcttcttcgtcttccctgcaacgagcccgccatagccctcgctttcctctgccttttcgtcttcaccgctcacctgcagacttcgacaccatgagttctggcggccgtggcaagaagccctcctcgaagtctgtttcccgttctcacaaggctggccttcagtttcctgttggtcgcattgcccgatttctgaaagcgggcaagtatgcggagcgtgttggtgctggtgcccctgtatatcttgctgctgtcttggagtatcttgctgcagaggttcttgaacttgctggtaatgctgcacgtgacaacaagaagaacaggattgtcccacgccacattcagcttgcagtgaggaatgatgaggagctgagcaagttgttgggaactgttacaattgcaaatggtggtgtccttccgaacatccattctgtcttgctgccaaagaagtctggtaaaggcaagggtgaagtgggcagtgtctcacaggagttctagacagagttctacatgcttttgggttttgccttttggatgtgcctctgtaaatttgagcagcactgaagcctcctgcatcaagtccttttgatgagttggagataagtctagtgttaatgaatggaatactttgtagcttagg

SEQ ID NO: 6058 - DNA, 626 bp, Zamia vazquezii
gcagcaattactaaaacgctgattgcatagagacgggcggaattgaattactgcccggcaaggttcgaatccatcagagatcatgagttcttctggcagggccggcggccgtgggaagggcaaggcggcgaaggctgtatcccggtcgcacagggcggggttgcagtttccggtgggcagaatcgccaggtttttgaaagccggcaaatacgcgcagcgcgttggtgcgggagcgcccgtataccttgcggcggttttggaatacctcgcagccgaggtgctggagctggccggcaatgctgcccgagacaataagaaaaaccgcatcgtgcctcggcacatacagcttgccgttagaaatgacgaggagctgagtaaactgcttggaatggtgacgatcgccaatggcggtgttctgcctaacattcaccaagtgcttttgccgaaaaagtccgggaagtccaaagtggaagctggatcggcttctcaggagttttgaagcggctgcgtgtaactttttgcgaaatgcatgtagcacttcggtgtgctctttaaaatgtcaatgtatttgctgtcttaatgtgacggtatactcgaaggccgagtaaagacataaaaaaacagca

SEQ ID NO: 6059 - DNA, 565 bp, Lippia dulcis
taatcgaacaccgtgagtatgagctccactgcggcggcggcgtccaccaagggcggcagagggaagcccaagtcttcgaaatctgtctctcgttcttcgaaagctggcctccagtttcccgtcggaagaatcgcgcgttttctgaagaatgggaagtatgctgagcgtgtcggcgctggggctcctgtttatctatcggccgtgctcgagtacctcgctgctgaggtcttagagcttgctgggaatgcagctagagacaacaaaaagaacagaattgtgccgaggcatatccaattggccgtgagaaacgatgaggaattgagcaaattgttggggaacgtgactattgccaatggtggtgtgctgccaaacatccaccagaatctgttgcctaagaaggctggtggaagggacaaagagattgggtctgcatcacaagagttttaaatctttgtttgggaattagcttggttggtgtttatagtttgtgaagggtttgcacaagtcgaaccctaaattttgggatggttggtagagtggttctaatgaatgaaaattaatggga

SEQ ID NO: 6060 - DNA, 588 bp, Chenopodium quinoa
ctccattaaccctgatttctctcattacaacaccaccacagcaattcgatcactttctctctcctagggttccgatctccggtaggtttccggcaacaatatgagcggcaaagaaggcggcgcatccaccaaaggcggccgaggcaagcctaaggcttctaaatcggtttcgaggtcgtcgaaagctgggcttcagtttcctgttggaaggatcgctaggtttttgaaggctggaaagtatgctgagcgtgtcggtgctggtgctccggtgtatctctccgccgttctcgagtatctcgctgctgaggtattggaattggccggaaacgccgcaagagacaacaagaaatctacgaatagtaccgcgtcacattcaactagcagttcgaaacgatgaagagttgagcaagctattagggcaagtaacaatcgcaaacggcggcgttttgccaaacattcatcagactcttttgcctaagaagattggcggtggtaaaggagataatactcaatctcaagagttctagaatattctcggatgtacttaaaaacaaggaaattaaaactagtataatttgtttttctttt

SEQ ID NO: 6061 - DNA, 639 bp, Parthenium argentatum
acaaaacaaacaaactagggtttatcagttaccatcaacatccaacccattcaaacacaatgacttcaaaagcagataacgattcaaagaaaggaggcagaggaaaaccaaaggcctcgaaatctgtttccagatcttctaaagccggtcttcagttccctgtcggtaggattgctcggttccttaaagccggaaagtatgctgagcgtgttggtgctggagcccctgtttatctttccgctgttcttgaatatcttgccgctgaggttttggagttggctggaaatgctgcaagggacaacaagaaaagcagaattgtgccgaggcacatacaattagcggtgaggaatgacgaagaactgagcaagttgttgggttcggtgacgattgcgaatggtggtgtgttacccaacattcatcagactttgctgccgcataaggctggcaaggagaaaggagatattggttctgcttctcaggagttctagatgtgttggttggttttgtgatggacttcaacttgtctgcattttggttacaatctttgtaaaaatggtctctttgatctttgattttgtgttctaaggtatttttatgatggttatatgtaatcgtatgttggcaatataaccaattttg

SEQ ID NO: 6062 - DNA, 497 bp, Amsonia hubrichtii
gtttagggttctgagcagaagaattcccaagttgattcatcaatctcggtttctcctcgaagaagatgagttcaaaagaaggcggcgctccaaagggcggcagaggaaagccaaaatcgtcaaaatctgtttctcgttctcaaaaggctggccttcaatttccggtgggtcgaattgctaggttcctcaaggctgggaagtatgctgagcgtatcggatccggagctcctgtttatctctccgccgtccttgaataccttgctgctgaggttttggagttggctggaaatgctgctagggataacaagaagaataggattgtgcccaggcacattcagttggctgtcaggaatgatgaggagttgagcaagcttttgggatcggttaccattgctaacggcggtgttttgccgaacattcatcagaatctgttgcctaagaagggcaaaggtggaaaagagattaactctctttctcaagagttttagggtcatggt

SEQ ID NO: 6063 - DNA, 929 bp, Musa acuminata
gagagagagagagagagagaggagagagagatgagctcaacggggggcacggctgcgaagggcgggagggggaagccgaaggcctccaagaccatctcccgctcgcagaaggccggtctccagttccccgtcgggcgcatcgcccgctacctcaaggacggcaagtacgccgaccgcgtgggcgccggcgcccccgtctacctgtccgccgtcctcgagtacctcgccgcggaggttctggagctggcggggaacgcggcgagggacaacaagaagaatcggatcgtgccgaggcacatacagcttgcgatcaggaacgatgaagagctgagcaaactcttggggaccgtcacgattgctaacggcggcgttttgcccaatattcatcagacgctgctgcccaagaagcaggggaaagggcagggagagcttggatctgcttcacaggagttctaggctcttggtggttttgcgagtctgctgatgcttggttcatttggactgtgtgcggaaggtgatggatgaaagggtaatggttttgaatcgtgttaatagttttggtttcgatcataaaaaagtcgccttttcttttgcttgatccttgaaaactagtaatgcttatgtttccggtatgtctctgatgataaaagttgtgattttgggggtaaatggctaatgtggacttcatgattataagaaaaatgaccaaagaaatttgctgcttgcagatgcttttaaagagacactggtttcaaaatgaaatatttgaaggactatttcattttccgctatctttcgtgtcagtcagggaaattaaaatttgattaggtgatgtttttgtgcgattggaagttgtatagttacctctccccttgatataattgaagatgaagaaaattatgctccattgagcgatatagtgctgatag

SEQ ID NO: 6064 - DNA, 665 bp, Fagopyrum esculentum
gtcaacgctacgccctcagccttcacattctcgttagcctccgtctcagtaaattcaatcgcctccgcgaggtttagggtttcaaaaacttcgccgttcgacatggcaggcaaggaaggaggatcaaccaaaggtggccgtggaaagcctaaatctacgaaatccgttactcgttcttccaaggctggtcttcagtttccagtcggtagaatcgctcggttcctcaaagccggcaaatacgccgagcgtgttggcgctggtgctcccgtctatctctccgctgttcttgagtatctcgctgcagaggttttggaattggctggaaatgctgcaagagacaacaagaagacaaggattgtaccgcgccacatcctactagctgtgaggaatgacgaggagttgagtaaattgcttgggtctgttacaattgctaacggaggtgttatgccaaatatccaccagactttgttgcccaagaaggtgggcaagggtggtgcggagatcggatctgcttctcaggagttctagggttttcatttcgtaaatcatatgcagtaggtttcggtttctatggattgtctctttttgtcgggttttttaggatttgttttgtacttccgcagtatctacattatacataaagaaaatgaagcttccctgttcta

SEQ ID NO: 6065 - DNA, 709 bp, Papaver somniferum
agaatctccaaatctcttttacagttctcataaattagggttagggtttcagtttaattttcaaagaagaagattccaagatgagttctccagcaacaaaatcaaccaaaggaggaagaggaaagccaaaagcaacaaaatcagtaacaagatcttcaaaagctggtctacaattccctgttggtagaatcgctaggtttctgaaagctggtaaatatgctgaacgtgttggtggtggtgctcctgtttacctcgccgccgtgcttgaatacctcgctgctgaggttttggaattagctggaaatgctgcaagagataacaagaagaacaggattgtaccaagacacatccaacttgcagtgaggaatgatgaagagttgagtaagctattgggtgctgttactattgctaatggaggtgttctacctaatattcatcagaatctgttgccaaagaaggctgggaaagggaagggtgaagtcggttctgcttctcaagaattttagagtgttgggtctatgtgtttttattttgtcattttatgatgttattgaatcagtttcagaagatgttagtagattttagtttagggtttatgaatcttgtcaagtttatgtaattacatccatccgtatcaatatatgcaagtttcagttcttccaatttgtgtattttcaatgtttgaaatgaaggcaaaacaattgtagaa

SEQ ID NO: 6066 - DNA, 438 bp, Cephalotaxus harringtonia
cggcggtcgagggaggagcaaggggagcaaggcaatatcgaggtcacataaagccgggttgcagttcccagtcggaaggattgctcgctttctcaaggcaggcaagtatgccgagcgagtaggtgcaggggctcctgtctatttggccgctgttttggagtatctcgccgcagaggtacttgagttggctgggaatgctgcacgggataacaagaagaacaggattgttcctagacatatccagttggctgttagaaatgatgaagagttgagcaaattattgggttctgtgactattgccaatggaggtgtactgcccaatattcatggcgttctcttgcctaagaagtctggaaaggataagggagcagaaattggcactgcttctcaggagttctagacaatgatgggctgacttttctaatatgggacatttca

SEQ ID NO: 6067 - DNA, 616 bp, Secale cereale
ggccatctctccggcgaccaccgcaccagcgcgtccactctccagtctccaccccgaaccagaagatggccatcgccggcagcgggaggggcaaggcgaagcccgccgccagcgccaagtccgtgtcccggtcgtccaaggccggcctgcagttccccgtcggccgcgtcgcccggtacctcaaggtcggcaagtacgcgcagcgcgtcggcgccggcgcccccgtctacctcgccgccgtcctcgagtacctcgccgccgagaccctggagctcgccgggaacgcggcgcgggacaacaagaagaaccggatcgtgccgcggcacatccagctggcggtgcgcaacgacgaggagctgagcaagctgctgggctccgtcaccatcgccgccggcggggtgctgcccagcatccacaccacgctgctccccaagaaggccggcaagggcaagggcgacatcggctctgcttcccaggagttctagattagattagtgttcttgtgaatgctttggttggcgtgtcatcgatgctagtgttggaatggaatgcatctcgcaatcttgtcctggttgttactgcctttgatttgtcaatgctaatctgcgtgaaaccg

SEQ ID NO: 6068 - DNA, 663 bp, Secale cereale
tctctccgccgacagccgcaccagcgggtccagccgtccaccctccaccgcgaaccagaagatggccatcgccggcagcgggaggggcaaggcgaagcccgccgccagcgccaagtccgtgtcccggtcgtccaaggccggtctgcagttccccgtcggccgcgtcgcccggtacctcaaggtcggcaagtacgcgcagcgcgtcggcgccggcgcccccgtctacctcgccgccgtcctcgagtacctcgccgccgagaccctggagctcgccggcaacgcggcgcgggacaacaagaagaaccggattgtgccgcggcacatccagctggcggtgcgcaacgacgaggagctgagcaagctgctgggctcagtcaccatcgccgccggcggggttctgcccagcatccacaccacgctcctccccaagaaggccggcaaggccaagggtgacatcggctctgcttcccaggagttctagattagattattatggtccttgtgaatgtttgggttggaaacttggaatgcatctagcaatcttgttcttgatgttactgcctgtgattcccttgtcaatactaatacgaatgaaacggatatgttgctactgttttagctgtctgaatcctgtacgaagtcagaattcgtcttgctgttgca

SEQ ID NO: 6069 - DNA, 536 bp, Podocarpus macrophillus
agagatatactcattgtatacccatcaggtatatatacatttcattcgttcggctcaagtttcgagggtttttggggatcaagatgagtcaacaggaggcagcggacgcgggaagagcaaggccacaaaatctgtatcgagatcgcacaaggcgggtctgcaattcccggttggaagaattgctcggtttttgaaggccggaaaatatgcagagcgtgtaggggccggtgctcctgtatatttggctgctgtcttggaatatcttgctgcagaggttcttgaattggctgggaatgcggcacgggacaacaagaaaaccagaattgttcctcggcacatccagctggctgtgagaaatgatgaggagttgagtaagctcttgggctctgtcactattgccaatggcggggtattacccaatattcatggtatgctattacctaagaagtctggaaaggagaagggaggagaaattggtagtgcttctcaggagttttaggttggtttcgaaattgggtagtgttacgatgattttg

SEQ ID NO: 6070 - DNA, 736 bp, Pteridium aquilinum
tgacatcctctctttgacatatacacatagcgctgcccttgccctgtgaaaccctaatcctgacagagctatcagtactaggtctctgtgcttctcggtgactctgcgaacatgagtctggaggggggtaaagcgaagactgccagcaagtctgtctcgcgatcacacaaggctggtctgcagtttcctgttggccgcattgccaggttcttaaagccggaaaatacgctgagcgtgtaggtgcaggtgcgcctgtctatcttgctgctgttctcgagtatcttgctgcagaggttttggagttggctggaaatgctgcacgtgacaacaaaaagaacagaattgtccctcggcacattcagttggctgtgcgtaatgatgaagagctaagcaagctactaggggctgtaactatcgccaatggaggtgttttgcccaacattcacaatgtgttgctgcccaagaaatctgggaaggtgaagggggaagctggtagtgcctctcaagagttttagattaatataaaggtagccataggacattattcacctgggataaaatcacttttatctgcctagaaaatgtaattcatctctgatgatgtaatactttctaagcctcgcagaaagttatgtcattgaggttgtttgatatgtgtttctacaatgctgtcaaattaatttgagttggataatttagcttggtttgagtcaaaaaagaaaaagtaccgactgcg

SEQ ID NO: 6071 - DNA, 598 bp, Allium cepa
tctaaattccgagcaacaaattaaaagtcggaggaaaatgagtcccaaaaaaggaggaaggggaaagccgaagagcacaaagtcggtatctagatcgagcaaagcaggcctccagttccccgtcggaagaattgctagatttttgaaggccggaaggtatgctcagagagtcggcgccggagctccggtttacttatcagcggttcttgagtatctggctgccgaggtattggagcttgctggaaatgcggcaaaggacaataagaagtcgagaataattcccaggcacattcaacttgcagttagaaatgatgaagaactaagcaaacttttgggaagggttaccattgctaatggaggagttttgccaaatatcaatgccgttcttctgccgaagaaggctggaaaagataaggcggaaattggatctgcttctcaagagttttaggtctttattttcaatttctttagattttgttgtattagatttagtgtcttgttggatctagtttgggagtattaatcagctggttattgttatgttgagtgtgatctgctccttgtttatttagcttgaacattgaaccaattaatgatg

SEQ ID NO: 6072 - DNA, 685 bp, Allium cepa
cccagattaatttccctctaaattccgagcaacaaattaaaagtcggaggaaaatgagtcccaaaaaaggaggaaggggaaagccgaagagcacaaagtcggtatctagatcgagcaaagcaggcctccagttccccgtcggaagaattgctagatttttgaaggccggaaggtatgctcagagagtcggcgccggagctccggtttacttatcagcggttcttgagtatctggctgccgaggtattggagcttgctggaaatgcggcaaaggacaataagaagtcgagaataattcccaggcacattcaacttgcagttagaaatgatgaagaactaagcaaacttttgggaagggttaccattgctaatggaggagttttgccaaatatcaatgccgttcttctgccgaagaaggctggaaaagataaggcggaaattggatctgcttctcaagagttttaggtctttattttcaatttctttagattttgttgtattagatttagtgtcttgttggatctagtttgggagtattaatcagctggttattgttatgttgagtgtgatctgctccttgtttatttagcttgaacattgaaccaattaatgatgcaatttttcttcaatcagctgcgtatacttccggtgatatgttttctaacactttcttatcctcttacaac

SEQ ID NO: 6073 - DNA, 672 bp, Allium cepa
gcctagttacgggggaccactcccagattaatttccctctaaattccgagcaacaaattaaaagtcggaggaaaatgagtcccaaaaaaggaggaaggggaaagccgaagagcacaaagtcggtatctagatcgagcaaagcaggcctccagttccccgtcggaagaattgctagatttttgaaggccggaaggtatgctcagagagtcggcgccggagctccggtttacttatcagcggttcttgagtatctggctgccgaggtattggagcttgctggaaatgcggcaaaggacaataagaagtcgagaataattcccaggcacattcaacttgcagttagaaatgatgaagaactaagcaaacttttgggaagggttaccattgctaatggaggagttttgccaaatatcaatgccgttcttctgccgaagaaggctggaaaagataaggcggaaattggatctgcttctcaagagttttaggtctttatttcaatttctttagattttgttgtattagatttagtgtcttgttggatctagtttgggagtattaatcagctggttattgttatgttgagtgtgatctgctccttgtttatttagcttgaacattgaaccaattaatgatgcattttttcttcaatcagctgcgtatacttccggtaag

SEQ ID NO: 6074 - DNA, 740 bp, Nicotiana tabacum
ggccattacggccggggaaaccaaaggcaaataagcaacaggtaaagaaatctctgctcactttccacacaaatcgagagctagggttagggtttctgtttcatctaaaaatgacttctgatggaggatcgggcaagggaaaaggcggcgcaggtagaggaaaacctaaggcgacgaaatcggtgtctcggtcttcaaaagcggggctccaattccccgttggtaggatcgctcgtttccttaaggctggaaagtatgctgaacgtgttggtgctggtgcgccggtttacctatctgctgtccttgaatacctcgcagctgaggtgttggagttggcagggaatgcagcaagggataacaagaagaatcgtattgtgccgaggcacattcagttggctgtgcggaatgatgaggagctgagcaagcttttaggtcaggttacaattgctaatggaggtgtcatgcccaacattcaccagaatctattgcctaaaaagactggctcgggcaagggtgatattggctctgcatctcaagagttttagatttgctctatttcttgttttggggaaatgattaaaagtaaacatagttatgtaaaatagaaatggctgttgtcttgataatactttcgaacattgaattctatggcattgtcaacttgcagttttggtaatacattgtggaatgtttttgtgaatggaattggattaattgttctgaagtagaatttgagtttt

SEQ ID NO: 6075 - DNA, 541 bp, Beta vulgaris
cccacttctctctctctcctacttcatttttccgatcactttctctctcctagggttccgatcaccattaattttccgtcgaaaaaaatgagcggcaaagaaagcggcgcaactactaaaggaggacgaggaaaacctaaagcaacgaaatcggtttctaagtcttcaaaagctggtcttcagtttcccgtcggtagaattacaaggtttttgaaggccggaaagtatgctgagcgtgtcggtgctggtgcgccggtttatctcgccgcagttctcgaatacctcgctgctgaggtgttggagttggctggaaatgcagcaagagacaacaaaaagaacagaatagtaccgcgtcacattcaattagcagtaaggaacgatgaagagttaagcaagctattagggcaagttacaatcgcaaacggcggcgttttgccaaacattcaccagactcttctgcctaaaaaagctggtggtagcaaaggagatattggttctgcttctcaagagttctaggttttttcatatgtacttaaaaaaa

SEQ ID NO: 6076 - DNA, 471 bp, Arnica chamissonis
tatcgtccagatccacccaatttgaacaaaatgagttctaaagcagatgccgattcaaataaaggaggcaggggaaaatccaaggctaccaaatccgtctctcgatcttccaaagccggtcttcagttccccgtcggtcggattgctagattccttaaggccggaaagtatgctgaacgtgtcggcgccggagcccctgtttacttatccgccgtccttgaatacctcgctgccgaggtttttggaattggcgggaaatgctgcgagggataacaagaaaaccagaattgttccgaggcatatacaattggcagttaggaatgatgaagagcttagcaagttgttaggttctgtgacaattgcaaatggtggtgttttacccaatattcatcaaactctgctgccaaagaaggttgggaagagtaaaggagatatcggttctgtcttctcaagtagttctagatgcatgaa

SEQ ID NO: 6077 - DNA, 596 bp, Chenopodium quinoa
caccattattaaccctgatttctttcactacaacacaaccaccgcaattttcaaccgatcaatttctctctcctagggttccgatctccggtaggtttccggcaacaatatgagcggcaaagaaggcggcgcatccaccaaaggcggccgaggcaagcctaaggcttctaaatcggtttcgaggtcgtcgaaagctgggcttcagtttcctgttggtaggatcgctaggtttttgaaggctggaaagtatgctgagcgtgtcggtgctggtgctccggtttatctctccgccgttctcgagtatctcgctgctgaggtattggagttggccggaacgccgcaagagacaacaagaaatctcgaatagtaccgcgtcacattcaactagcagttcgaaacgatgaagagttgagcaagctattagggcaagtaacaatcgcaaacggcggcgttttgccaaacattcatcagactcttttgcctaagaagattggcggtggtaaaggagataatactcaatctcaagagttctagaatattctcggatgtacttaaaaacaaggaaattaaagcttagtataatttcttttcctttt

SEQ ID NO: 6078 - DNA, 722 bp, Musa acuminata
gtcatccatctttcacctgttcagaggcaaggcaaaggagaccgtcgaagacatgagttcgtcgggtgcggcagcggcggcgactaccacgaagggaggtcggggcaagccaaaggcctcgaagagcgtctcccgctctcagaaggccggactccagttccccgtcggccggatcgcgcgcttcctcaaagccgggcgctatgctgagcgcgtcggtgccggcgccccggtctatctctccgctgtcctcgagtatcttgctgccgaggttctagagttggcggggaacgcggccagggacaacaagaagaaccggatcatcccgaggcacatacaactggcggtgcggaatgacgaggaactgagccggctcctgggcgccgtaaccatatccaacggtggagtggtgcccaacatccaccaggtcctgctcccgaagaagcagaccggcggcaaggggaagggcgatatcgggtccgcttcgcaggagttctagggtttatagtcctcgtatatcccgcttgttttgtccggctttgtagtataatgtttgctcggctctgtctccaagaacccatcaggcttttggttagctaatgcaaatgtttcgccggcggatgttatctgttgccatttattgtttggttttttctaagatttcaagatttgttcatacggtcgtttataacatcgagacttaacgggttaagatccgacaaggg

SEQ ID NO: 6079 - DNA, 571 bp, Elaeis guineensis
agaagcaatacaaggagcgcggaagggagcgatgagttcgacgggcgcgacgaagggtggtcgtgggaggccgaaggcctcaaaggcggtgtcacgatcccagaaggccggtcttcagttccccgtcggccggattgcccgcttcctcaaggccggccgttacgccgagcgcgtcggagccggcgcccccgtctacctctcggccgttttggaatacctcgccgccgaggtgctggagctggcggggaacgcggcgagggacaacaagaagaacaggataattccaaggcacattcagctggcgatcaggaacgatgaggagctgagccggcttcttggaggtgtgacgatctccaatgggggggtcctgccgaacattcaccaggttctgctgccgaagaagcaaggaggaaaggggaagggaggcgagatcgggtccatgtctcaggagttttaggctttcttttttgccttgtttggtgatgttgcgaggctcttttttgatctgcttgtaggcagagatgtaattaaaagattttagttactgaatctgaagaactttttttttttt

SEQ ID NO: 6080 - DNA, 539 bp, Fagopyrum esculentum
caggcaaggaaggaggatcaaccaaaggtagccgtggaaagcctaaatctacgaaatccgtcactcgttcttccaaggcaggtcttcagtttccggtcggtagaatcgctcggttcctcaaagcaggcaaatacgccgagcgtgttggcgctggtgctcccgtctacctctccgctgttcttgaatatctcgccgcagaggttttggaattggctgggaatgctgcaagagacaacaagaagacaaggattgtaccgcgccacatcctactagctgtgaggaatgacgaggagctgagtaaactgcttgggtcagttacaattgcaaacggaggtgttatgccaaatatccaccagactttgctgcccaaaaaggtgggcaagggtggtgcggaaattgggtctgcttcacaggaattctagggttttcatttggtaaatcatatgcagtaggtttgggtttctatggtttgtcttctttttgtcggggttttttgggattttgttttgtactcgtgcagtatctacattatacataaa

SEQ ID NO: 6081 - DNA, 681 bp, Panax ginseng
ggtatcaacgcagagtacatggggatccttcaaaaataaaaaatatttgcatatgccctccattttttctctcatagggtttgatctagctgcatccaaatctacaagaaaaaaaatgagttctataggtacaacaaaaggaggcataggcaagcaaaagtcaaccaaatcggttaccagatcttcaaaagccggtctacaattctccgtcggtcgaatcgctcgttttctcaaaaacgacaagtactccgaacgcgtcggcgccggtgctcccgtttatctctccaccgtcctcgagtacctcgctgctgaggttcttgaacttgcggggaacgctgcaagggataacaagaagaatcggatagttccaaggcacatacagcttgcagtgaggaatgatgaggagttaagcaagctcttgggcacagttactattgccaatggtggtgttttaccaaacattcaccaaactcttttgccaaagaaatctgagaaaggaaaagatgagattggatctgcttcccaagaattctagggtttctttgacttttgagggtggattttaatgtttcatgtttaatacttatatgaagggtggggtttcatgtttctgggttgtgacttctattgatgtaaaaccccaattttgggaatttttattgaatgaatacaaaagagtta

SEQ ID NO: 6082 - DNA, 691 bp, Tropaeolum majus
cggccgggggaacattaaagcatcactaacactaatcactatcatcactttcagactccgccatttttgcttgattagggttcttaatatctcgtactgaagaaatgacttcaccagcaacaactaagggaggcagaggtaaatctaagtcagcgaaatccgtcacaagatctaccaaagccggcctccagttccccgttggtcgcattgctcgtttcctcaaggccggtaaatatgccgaacgcgtcggtgctggtgctcctgtctatctctccgccgtccttgagtatctcgctgctgaggttcttgagcttgctggcaatgctgctagagacaacaagaagaccagaatcattccaaggcatattcagttagctgtgagaaacgacgaggagttgagcaagcttttgggaactgtcaccattgctaacggaggtgttcttcctaacattaaccagactctcttacccaaaaaatcaaacaaaggaggagacattgcatctgcttcacaagaattttaagggcattaaagagaggggttagggtagggatgtgtatgaatgaatagatagtgggttgaatgtgattcatttgaaccctttgagctcatgatttttgctgcttttatacattacatagtgcaattgttttgtccacattaccaattattgaatctattcattaagcacaa

SEQ ID NO: 6083 - DNA, 2470 bp, Zea mays
gcgtgtgccattcccagtcgcctcccccaggaaccgcgcctcccccactcgcgcattccatccatggcgctagacagtcgcgctccgcggccttccatccatggcagacgctccctccgcgttcttccatccgtcagtgatccatgcctctgatcttccagccaatcatagcgcatctctcactagaaccctaacagtataaaatcgcaggcgccgcccgctcctccctccaatatccctctgttctccttccaaaatcgcagcgccgcccgcaccaatcttgaagagttcgaaagtttccagacccccaaaaggcgaagcggcgatgagttccaccggaggcggcggccgcggtaaggcgaagccagcgaccaagtcggtgtcacggtcctccaaggctgggcttcagtttcccgtcggtcgcatcgtgcggtgcctcaaagccggcaaatatgcagagcgcgtcggcgctgggcccccgtgtacctctccgccgttctcgagtatcgcaccgccgaggtgctggagctggccgggaacgctgctcgtgacaacaagaaccgtatcgtgctgcgccacatccagctggcggtgcggaacgacgaggagctgagcaagctgatgggcactgtgacgatcgcggctagcggcgtgatgccagacatccatcagaccctgctgcccaagaaagctggtcagaagggggacatcggctctgcctcccaggagttctaagcgcatcggcggaatgagaatgagggaccacccctgtttctgtctcgtccgcgtggttgtgtttcagctttgcggtttttggggagtgttgtcgatgagttgggattgatatgtgttgtgggatgtaaacaaacgcagcggttgtttcatgaatgaatgatggatagaagaaacatagctatcatgatttctaccctgcttgcatttggatccgatttgctccagctatcgtttggtacattgtatcagacctgatgatggaacatttatgtcgattctatgaactctgcatcatatgatctgtcagatttcgattcatgttggaaaatacagtccggaaactctgcatcttctggcctttggcttccagtagaagtcgggatcaatagctatttgtagtatggcactactaactatattaagaattttgcatttgttgactgttgatggcctcagtgaacctcaccgattgattgtacttgttcaatttttcctacgggttctctttgtgatgtaccaaaatctttgccaggttcgggagcgatatggtctcgagtctcgacctccccggcgtcgcgctgcgacgcgacatgcgcgtacagcgcgaggagcactgcctcgaacccggccagcggcttccgtgacatggcgtggcacaggtgcgccctagctagcgacggcaccaacaccacgagctggagctcggggacgttggaccggaacgcgtcgtagagccagcggcagaggctgtcgttcccggcgcccgacccgggtccgcggaggcgtcccgtcacctcgctggcgacgtcggggtcgttgaggagcgcggccgtggggacggagcccaggtcgttgaggagcgcggccgagggcgtccatggcgtccttcgcgctgtggatgggcggcgacggcgcgtcgttcggcatcgtggcagtcaacggcgcagagaggagcgggtcggacttcggaggctagcgcgatcgcgtgtggcgtggcctcgagtctcgacgacgtacgggaaatcgggaatgaaaggcagagagattggagaggagcattgagcgggtgcggtacgtttcagctttttgacccgccttgctcgtcaggagacgagagcagagcgagctagcgaggtgtttggcgacggtgtgcatgtctgcttgaagcgtcgagacttgccaggaaaaggagcctagagggactcattgaagcatccagccaagatgtatcttctctatgttcacatcgaacacagtgattggtggcactgctcggacatagaagcaattggtttaccctttttttcctgtttgtttttgtagctattactgcatgcattttctttgaccatagctggaaagatgtgagtattatgttcggtgtttgtcttgggaattaaattactatagtgtaacttgtctcatcattttcttgagtacatgtacttatccattgacttcttttgcaggtaattccagtggcatagcttcaatgctatgtatgactttcttaagaaaaaccgggagatcacaagatgggttgctctaggcattgttgtttttttagataagagacatgacttatctcacagattttgatcttaactaaactcgaagggtcctcatttgatccttatgcttccaaagccattgtatttgcttcttcaacttgtactctgtaagtttctaatgttcatgcaaatgttttccaaatctaaattccgtctttggcccc

SEQ ID NO: 6084 - DNA, 531 bp, Allium cepa
aatgagttccgcgggaagaggaaaggcaaaatctagttcaaaatcggtttctagatcgtcaaaagcagggcttcagtttccagtcggaaggatcgccagatttctgaaggcaggaaatacgccgagagagtcggtgccggagctccggtctatatggctgctgtctcgagatttagctgctgaggtgctggaactggctggaaatgcagcaagggacaacaagaagaatagaatagtgccaaggcacattcagctcgctgtgaggaacgatgaagaattaagcaagcttcttggcactgtcaccattgccaatgaggggttttgcccaatattcattccactttgttgcctactaagcctggaaagggaaaaggagatggttctgcctctcaagaattttaatttgttttacttaatttatatatatgttgtctttaaatggttcatcttcaacaattctatgagcatggaaggtccttttgaatatgggtgataaatttatttctgatttcaatgatggaatgaatgcat

SEQ ID NO: 6085 - DNA, 588 bp, Allium cepa
ccgagcaacaaattaaaagtcggaggaaaatgagtcccaaaaaaggaggaagggaaagccgaagagcacaaagtcggtatctagatcgagcaaagcaggcctccagttccccgtcggaagaattgctagatttttgaaggccggaaggtatgctcagagagtcggcgccggagctccggtttacttatcagcggttcttgagtatctggctgcagaggtattggagcttgctggaaatgcggcaaaggacaataagaagtcgagaataattcccaggcacattcaacttgcagttagaaatgatgaagaactaagcaaacttttgggaagggttaccattgctaatggaggagttttgccaaatatcaatgccgttcttctgccgaagaaggctggaaaagataaggcggaaattggatctgcttctcaagagttttaggtctttatttcaatttctttagattttgttgtattagatttagtgtcttgttggatctagtttgggagtattaatcagctggttattgttatgttgagtgtgatctgctccttgtttatttagcttgaacattgaaccaattaatgatg

SEQ ID NO: 6086 - DNA, 581 bp, Taraxacum officinale
tttcaagtacagcatatcgaagttcagggttagggtttatcaaccggatctctcacaatcttacaagatgagttcgaagtcaaagtccgtcgccgattcgacgaaaggtggcaggggcaagcctaaggcaacaaagtccgtctcaagatcttcgaaggccggtcttcagttccccgtcgggagaatcgccaggttcctcaaggccggaaagtatgcccaacgtgttggtgccggtgctcctgtttacctttccgctgtactcgagtatctcgccgccgaggtattggagttggcgggtaatgcagcaagagacaacaagaaaaccaggatcgttccaagacacatccaactggcagttaggaacgatgaagaattgagtaaactgttgggatctgtcacaatcgctaatggcggtgttctgcccaacattcattcaactttgctaccaaagaaggtcggaaaagaaaagggcgatattggatctgcttcgcaagaattttaattagactgaaacaatggataatgatttttgtaagataaattgtttctttgttataaatgaagttttatctttgtagcac

SEQ ID NO: 6087 - DNA, 622 bp, Silene vulgaris
attggcaccgctgctgctattggcggtagaggtaaaccaaagtccgctaaatccgtctctcgttcttccaaggccggtcttcagttccccgtcggtcgtattgctaggtttttgaagtctggaaagtatgctgaccgtgttggtgccggtgctccggtttatctctccgctgtcctcgaatacctcgctgctgaggtgttggagttggcagggaacgcggcgagagacaacaagaagacgaggatagtccctcgacacattcaattggctgtacgaaatgatgaggagctgagcaagttgcttggacaggttacaattgcgaatggtggtgtgatgccgaatattcattcgactttgttgccaaagaaagcagctggtaaaggcgatattggctcggcttctcaggagttctagattccgtcttctggttgtgattaagtagtaaaagaaagataaacttcgaactttgagtgtattgactttgtttagttataagcttattaatcgatgtagctgagggtagagatgaagaagaacaatgtctgttttggatgttatgttttcctgcaatggaatttattgagtaattagtctctttcttagactcttattcggttgcgtt

SEQ ID NO: 6088 - DNA, 654 bp, Silene vulgaris
cagatttccgttttcaaatcaaaatcaaacatggccggaaaagacatcggcgcaattcccaagggcggaagaggcaaacccaagtcctcgaaatccgtgtcccgatcctctaaagccggtctccagtttcccgttggtcgtgtcgctaggtttctcaagtctggtaaatacgctgaccgtgtcggcgctggtgctcccgtttatctctccgccgttctcgaatatctcgctgctgaggtgttggaattggctggtaatgcggcgagggataacaagaagactaggatagtgccacggcacatacaactggctgttcgaaacgatgaggagctgagcaagctgttgggacaggtgactattgcgaatggaggtgtaatgccaaacattcaccagacgctgttgccgaagaagcaaggtggtaaaggggatattggttctgcttcacaagagttctagatgtttctcaccgtttgttctaaaaagaaaaggaagacggagtgtagtcggtggtgttagtaaatgtagccaagttttgtttagacgaaaaacgagtttcttagggagtcttggatgtgtgggtgaatgaagaactgaaaatgccatgtagtaatgtcttggtgccagtttttggtttcggatgttgtttttcaggca

SEQ ID NO: 6089 - DNA, 433 bp, Prunus mume
accatgagctccacagcagcagccaccaccaaatcaggcagaggcaaggtcagaggcaccaagtcggtctcaagatcccagaaggccggtctgcaattcccggttggtcgcgtcgcccggttcctcaaggccggtcggtacgctcaacgagtcggcagtggctccccggtctacctctctgctgttctcgaatacctagctgctgaggtacttgagcttgctggcaatgcggccagggacaacaagaagaatcgaattgttccaaggcatattcagctggctgtgcgtaatgacgaggagttgagcaagcttttggggactgttactattgctaatggcggtgttttgccgaacattcatcagactctgttgccgaagaagattggtaaagggaaaggagacattggatctgcctctcaagaattttagagct

SEQ ID NO: 6090 - DNA, 2504 bp, Conyza canadensis
tcgtgtccttgattttaactggctgatgtggagtatgagaccacatttaaagccaaacattgaagtaacaaagaagagagaggataaggaaaataaaatgtctgttggccttggcgttgggattgggcgggtagagatatcccggcagaaaataacagcagcaagtaaagtcaaaggggacggtcaacggcgtgcaggtgtattaaaaatggtggacagacagctagcaaagggcaacttcaaaatggctctttctttactcaaacaattgcatctctctgccttctcatcttgttcttctttcaaacaagttcccagaggagtctcatcagtagaggaattacatctaagcatgactgagacatctactctgcaaccattatttgactccattctcggttcaatcaagagtagccttgaatcttcaccattggatgagacactaaccggtgaagacggtaatttgtaccttgaagatgatgatataattgacaacaagtaagttgaaggcaagttgtgcagcacgaagcgggtcactttttagttggctacttgctaggtattttaccaaaagagtacagcttttccagcttggaagatgtgaagcaagacaaagttgctgttgcaagtgtaaaatttataggctttgaatttttggcagagttagaagataaagtgcaattgaagaaaaaatcacatgaagcaaagccaggtcatcgggctaataagaacaagctatcttccacggttttatgcaagttcgcctgtgtgattgtcggaggcttggtagcagagcatctggtctttggatactcaaaagggcatcatgcagatattgaaaaattggacagagttcttaaatggatgcatttcacggaagatgaagcaaacactctgatgagatgggctgtactgaacaccctcctaatattaaatcgtcatgatgaagctagatcaacattagtggaggccatggttgatggaagatcgattggaaagtgtattgatatgatagaaagtacaataaatgatcacaaaatctaaccttctcaaatattgggcatcatgctgttagtttgcttcgagaacactttgcagtcagtcattggaacttacatacttgtaagttccatattggacatcatctgatgctgcaaaaaccatacacagctacttggaaattgcacaatgtaatctccttatcatcaacattcatcccactgcagtgcagggatatatagattacagacttagttatgtttcaaagtgcagctcagcacatttaaagaatctttcagtttgttgtatctcttgattgcagttgtatgtacttgaactcattaggaaattgattcattttgtgctattaagttactacaaccttgctatgaaaacagatgaaacatacttgataatcctaagagaccaaatgctcctttaaaacatataccaaaacaattcaacatgaatcaacagaattcaaacaaaaattaagcaccatgatataaagttgatgaaacaaacagttgatcaaaaactgaaagtgtaatgcattgcagcagggacattatgcatacattaaatccatagaacattgtagcatcaactagaacttaaacatcaaatcaatccatctcttagtaaacaaaccaaatgtcttatctaatagagactccttgttttgatgagttaagtgaaatgaaagacaatttagatctttacatggtactagagtcatcacactaaatattgggcactaaagcttataatccatagtattaaaaccacttctaatcagtcacatcaaatcaactatcaaagtgaaaaaacaaataaattagactaaaacagcaaactaatcaaatttgaagagatctaattaaacaaaagataagataataaaccactacatagagaactgatttcaagtaagaaacatattctataatacaagaatctccataaaaactattgttaaaactcttgagaagcagacccaatctcacccttaccacttccacccttctttggcaacaaagtggaatgaatgttgggcaaaacacctccatttgcaattgtcactgaccccagtagcttacttagctcttcatcattccttactgccaactgtatatgccttggtactatccttgtctttttgttatcccttgctgcatttccagccaactccaatacctcagcggcaagatactcaagaacagcggcaaggtaaacaggagccccgccgccgacacgctgagcgtactttccggccttaagaaacctagcgattctacccaccggaaactgaagaccagcttttgaagatctggaaacagatttcgtgttctttgcttttcctctaccccctttcttcgcatcaccttctgctgttgctgttgctgctgcttttggtgccattatttgattcttttaataaaaaagatttaaaaacgaaacctaaccctaatctgaattggagatgagaaatgtgatgtgttttg

SEQ ID NO: 6091 - DNA, 623 bp, Chrysanthemum coronarium
accatcttctcagaaaaacaaacaaaacacaaattagggtttcagatctagaaaaaagaaagagaggaaaatgggtgggaaatcagtcgaagacatgaagaaaggaggaagaggaaagacaaaagcagcatcaacaacgaagtcagtatcaagatcttcaaaggcagggcttcagtttccagttggaaggattgctaggtttttaaaacaaggtaaatatgctcaacgtgttggtgctggtgctcctgtttacctctctgccgtccttgaatatctcgccgctgaggtattggaattagctggaaatgcagcaagagacaacaagaaaacaagaatagtaccaaggcacattcagctagcagtgaggaatgacgaggagctaagcaagctgttgggatcagtgaccattgctaacggtggtgttttgcccaacattcattctactttgttgccaaagaaggctggtaatagcaagggtgatattggttctgcttcacaagagttttagattactgctagttgtttgctgggattttcgttgttctaatgacagattcttgtatgatatcatgtttctttgttttatcaatcggaattaagtgcttttgttggatccatatttt

SEQ ID NO: 6092 - DNA, 782 bp, Panax ginseng
aagcagtggtatcaacgcagagtgcagttttttttttttttaagcagtggtatcaacgcagagtacatggggactgctgaatcctcagaaacaaccctctgttttctctctccaaaattcgaaaaatctcttcaaaaccaaaatcactgccatgagttctacagcaggcaagggtatagccggaagaggcaaatccaaagtcacaaagtcagtctccagatcctcaaaagccggccttcagttccctgtcggccgaattgctcgtttcctcaaggccggccggtatgctcagcgtgtcgggtctggttctccagtttacctttctgccgttctagaatacttggccgctgagcttttggagctggctgggaatgcggcgagggataacaagaagtctcgcataattccgagacatattcagttggctgtgaggaacgatgaggagttaagcaagttgttgggttctgtgactattgctaatggtggggttttgcccaacattcattcaactctgctgccgaagaaggctgggaaagggaagggcgaaattggctctgtttctcaagagttttaggggtttctatggtttttcgctcgtaactttttgctacgtagtagaaatgggcggtggagttggggattttgaattctgggtttctctttggttgggtaatgatggaataatagattgttaatagtggtagagtgtgtaatgaagtagattttctgacttcgattatgttctgttctaaggatgatcaattaaaatacgccttttttcc

SEQ ID NO: 6093 - DNA, 801 bp, Panax ginseng
caacgcagagtacatggggatccaccgctgaatccttagaaacaaccctctgttttctctctccaaaaaatctcttcaaaaccaaaatcactgccatgagttctacagtaggcaagggtatagccggaagaggcaaatccaaagtcacaaagtcagtctccagatcctcaaaagccggcctccagtttcctgtcggccgaattgctcgttttctcaaggccggccggtatgctcagcgtgtcggatctggttctccggtttacctttctgccgttctagaatacttggccgctgagcttttggagctggctgggaatgcggcgagggataacaagaagactcgcataattccgagacatattcagttggctgtgaggaacgatgaggagttaagcaagttgttgggatctgtgactattgctaatggcggggttttgcccaacattcattcaactctgctgccgaagaaggctgggaaagggaagggcgaaattggctctgtttctcaagagttttaggggtttctatgttatttcgtacgtaattttttgctacgcagacgaaatgggcggtggagttggggattttgaattttgggtttctctttggttgggtaatgatggaataatagattgttaatagtggtagagtgtgtaatgaagtagattttctgacttcgattatgttctgttctaaggatgatcaattaaaatacgccttttttccaacagtttggtttaatttgcagtgagtacattttataagctgttattagcatttgtgatgctttcttgctgaaaa

SEQ ID NO: 6094 - DNA, 608 bp, Vitis vinifera
aaatcgactacatatcgcgccaaagtctagggtggttttcaaatcttcgaaacgacgatgagctctgcagcaccggcaaagggcggtcgcggccactccaaggccaaatccgtttcaagatctcaaaaggccggcctccaattccccgtcggtcgaatagctcggttcctcaaaaagggccgatatgcacagcgcgttgggtctggctctccggtctacctctccgccgtcctcgaatacctcgcagccgaggttttggagcttgctggaaatgcggccagggacaacaagaagaatcggattatcccgaggcacatacaacttgcagtgaggaacgatgaggagttggggaaacttctgggaggcgtgactattgcgagcggaggagtcttgccaaacattcatcagaatctgttgccgaagaagaccgggaaagggaagggagagattgggtccgcatctcaagaattctagacctgattagccttctaggtttagattttgttgcctttgaataatcgtgacatgagatgttgatatttttgtgatgtagtagcttccctctccatatgtaaatggaaaattagtctttgattttctactcgtca

SEQ ID NO: 6095 - DNA, 523 bp, Allium cepa
gttccgctggaagaggaaaggcgaaatccagttcaaaatcggtttctagatcgtcaaaggcagggcttcagtttccagtcggaaggatcgccagatttctgaaggcaggaaaatacgctgagagagttggtgccggagctccggtctacatggctgctgtgctcgagtatttagctgctgaggtgctggaactggctggaaacgctgcaagggataacaagaagaatagaatagtgccaaggcacattcagctcgccgtgagaaacgatgaagaattaagcaagcttcttggaactgttaccattgccaacggaggagttttacccaatattcattccactttgcttcctactaagcctggaaagggaaaaggagaagctggttctgcttcacaagaattttaggtagcgtttggtttattttgtgttttgcatttttagttttcggcgttaattatgaaagttgtgaagatttgaagtgtagtggtggtgatggatcaaagggaaagggagtgacggagggg

SEQ ID NO: 6096 - DNA, 569 bp, Ambrosia trifida
gttaggttttaaaccttgaaataagtcaatggctcctaaagctgatgctgaagcaaagaagggaggcagaggaaaggccaagtcttcaaagtccgtctcaagatcatccaaagccggtcttcagttccccgttggtcgaattgctcggttccttaaggctggaaggtatgcgcagcgtgttggtgctggagcccctgtttacctctccgctgttctcgagtacttggctgctgaggtattggagttggctgggaatgcagcaagggataacaagaagtctagaatagtaccaaggcacatacagttggcggtcaggaatgatgaggagcttagtaaactgttgggatctgtgacaattgcaaatgggggtgtgctccctaatattaactctgttttgttgcccaagaaaggagccaaagaaaagggggatattggttctgcttctcaagtaatttttaaattttaattttaatttgtgttaatctaatctagttctttttgttgtacgtattggttttagtttggtcggttgggtttaggatggatgatgtatgactaaattactatct

SEQ ID NO: 6097 - DNA, 554 bp, Flaveria ramosissima
tcaaaccacaatctcccaaattagggttagggttcaccaatcaaacatctcaatcaaagacgatggcgacaaaatccgatgcagaaacgaagaaaggcggtaggggaaaacccaaagccacaaaggctgtatcacgatcttcaaaagccggtctccagttccccgtcggcagaatcgcgaggttcctcaaagccggaagatacgcccaacgcgtcggtgccggagctccggtgtacctctccgccgttctcgagtacctcgccgccgaggtgttggagttggctggaaatgcagcgagagataacaagaagagtcgaattggtcctaggcatatacagttagcagtgaggaatgatgaggagttgagtaagttgttggggtcgtgtgacgattgctaatggtggtgttttgcccaatattcattccactttgttgccgaagaaggtgggaaaggagaagggtgaaattgggtctgcttctcaagagttttgaggtgaagattgtgggtttgatggatttgtatggtacagtggtgctttcttgttattctgtct

SEQ ID NO: 6098 - DNA, 451 bp, Allium cepa
ttaatttccctctaaattccgagcaacaaattaaaagtcggaggaaaatgagtcccaaaaaaggaggaaggggaaagccgaagagcacaaagtcggtatctagatcgagcaaagcaggcctccagttccccgtcggaagaattgctagatttttgaaggccggaaggtatgctcagagagtcggcgccggagctccggtttacttatcagcggttcttgagtatctggctgccgaggtattggagcttgctggaaatgcggcaaaggacaataagaagtcgagaataattcccaggcacattcaacttgcagttagaaatgatgaagaactaagcaaacttttgggaagggttaccattgctaatggaggagttttgccaaatatcaatgccgttcttctgccgaagaaggctaggaaaagataaggcggaaattggatctgcttctcaag

SEQ ID NO: 6099 - DNA, 469 bp, Helianthus annuus
gaagaaaggcggtagaggaaaaccgaaggcttcaaagtctgtttcaagatcatctaaagccggtcttcagttccccgtaggcagaatcgctagattcctgaaggctggacggtatgcccaacgtgtcggcgccggagctccggtgtacctcgcggcagttctcgagtatctggctgctgaggtgttggagttggctggaaatgcagcgagggacaacaagaagagcagagtaggtccaaggcacattcaattagcggtgaggaacgatgaagaattaagtaaactgttgaaatctgtgactattgctaatggtggtgttcttcccaacattcattccactttgcttcccaagaaaggaggcaaggaaaagggggaaatcggctctgcttctcaagagttttaagtttaatattgtttcatgtatcatacagaactgcgcccgggttttggaatacattctcgcttttgg

SEQ ID NO: 6100 - DNA, 967 bp, Conyza canadensis
gtgaatccaatccagccaatcataagcgccaacctttcattataaataaatcccctttcattcgggcttttctcatcccaattttgaaaatccactctcattctagaaactactaaaataataataacgggtgcagttagggtttaatattaacaatcaaatatgagcggcggcgattcggaatcaaagaaaggaggaaggggaaaacaaaaaacgacgaaatccgtatctcgatcgtcaaaggctggtcttcagtttccagttggtcggatcgctagattccttaaggccggaaagtatgctgaacgtgttggtgctggtgcccccgtttacctctccgccgtcctcgaatatcttgccgccgaggtattggaattggcagggaatgcagcaagggataacaagaagagtagaatagtgccaaggcatattcagttggcagtgaggaatgacgaagagctgagcaaactattggggtctgtcacaatcgcaaatggtggtgttttaccaaatattaattctgttttacttcccaaaacgcatggcaaggataaagctgatctacacgcctctgcttctcaagagttctgatcacatcctctcaaagacgacttatatttcaatttcttttaatctacaaatttttatgatgaattttggtgttgctatgctatgtcatcaatcagttacttggtaattttattcgtttggttgttggctgatatttttgatggattttgtcttttgggctttggtgtggtgctatatgacactagacatcatttgttatatatctattatcaccccttccatttttagaaatagatactcaaatgtcatagaaaaatttaccaaattactcctaaataaaaacccactatgaaaagtattttataaattactaactttgcccttaattaattaatttacaccataaattcttattttaatacttaacactttaaac

SEQ ID NO: 6101 - DNA, 710 bp, Echinacea purpurea
cggccgggggacatcatcgttttcaaaacacaaatttggttaggttttaaagacaatggctcctaagactgatactgaagctaagaaaggaggtagagggaagcctaagacttcaaagtccgtgtcaagatcttctaaggctggtcttcagtttcccgtcggtagaatcgcccgctttctcaaggccggaaggtatgcccaacgtgtcggtgccggtgctcccgtctacctttctgccgttctcgagtatttggctgctgaggttttggagttggctggtaatgcggcaagggataacaagaagtcgagaatagttccaaggcacatacagttggcagtaaggaatgatgaagaactcagtaaactgctaggatctgtcacaattgcaaatggtggtgttttgcccaatattaactctgttttgcttccaaagaaagcaggcaaagacaagggtgatattggttctgcttctcaagagttttaagagcaaagaaatggttgtatatcatttggtttgggactagaattggtgttagttgtaagatgaatgcatgttatcatttcagttgttacaaattttgattatactcaatggatggtttgatatgtgcagatcgcttttgatcatgtcgttgtaatttccaattgatttttgcttatgattatttagatttactatgatgatttgtgtgcatttttacttgtgggtg

SEQ ID NO: 6102 - DNA, 730 bp, Mimulus guttatus
ccactacgctcaccaccaccaacaacatcttctcagcaaattcaaatttcaaatcccctccaaaataaaccatccaccaaaaaccatgggcgaaaagaccaccgctgctaagtcaatcgccggccgaggcaagtctaaatcgaagtccgtttccagatcttcaaaagcggggctccagttccccgttggccggatcgcccgtttcctgaagaagggccgttacgccgagcgcgtcggatctggttcgcctgtttacctctccgccgtccttgaatacctcgcggccgaggttttggagctagctggaaatgcggcgagggataataagaagaacagaatagtaccaaggcatattcaattagctgtgaggaacgacgaggagctgagcaagctgttgggatctgtgactattgcaaacggcggcgttttgcccaatatcaaccagattctgctgcccaagaagtctggcaaagggaaggcagaaatcggatctgcttctcaggaattttaggggatttattatgtttttttatttttgcttctcggtagatttagtcgtgctttgttttttaaaagaaatgttttgtcgatatgatgtagattagtttcgaattaatcaatggtgattttatatgttcatctgttatgtttaaatgaaatctggcaattttattctccatattttctgtcttctatttaaacaaaaaaaataagcctttttttttttttt

SEQ ID NO: 6103 - DNA, 590 bp, Chenopodium quinoa
cattattaaccctgatatctctcactacaacaccaccaccgcaattctcttccaccgatcactttctctctcctagggttccgatctcagttaggttcccggcgacaatatgagcggcaaagaagtcggcgcatccaccaaaggcggccgaggcaagcctaaggcttccaaatcggtttcgaggtcgtcgaaagctgggcttcagtttcctgttggtaggatcgctaggtttttgaaggctggaaagtacgctgagcgtgtcggtgctggtgctccggtgtatctctccgccgttcttgagtatctcgctgctgaggtattggagttggctggaaacgcagcaagagacaacaagaaatctcgaatagtaccgcgtcacattcaactagcagtgaggaacgatgaagagttgagcaagctactagggcaagtaacaatcgcaaacggcggcgttttgccaaacattcatcaaactcttttgcctaagaagattggaggtggtaaaggagataatactcaatctcaagagttctagaaatttttcggatgtacttaaaaacaaggaaattaaaactagtataatttgtttt

SEQ ID NO: 6104 - DNA, 694 bp, Silene vulgaris
aaaaaacaaaaccacacaacgccttcaaatacatacatacctctttctccttccactcgtatagatttccgctatcaaatcatggccggaaaagacatcggtgcaatcccaaaaggcggaagaggcaaacccaagtcctccaaatccgtatcccgatcctctaaagccggtctccagtttcccgttggtcgtgttgctaggtttctcaagtctggtaaatacgctgaccgcgtcggcgctggtgctcctgtttatctctccgccgttctcgaatatctcgctgctgaggtattggagttggctggtaatgcagcgagggacaacaagaagaccaggatagtgccgcgtcacatacaattggctgttcgaaacgatgaggagctgagcaagctgttgggacaggtgactattgcgaacgggggtgtaatgccaaacattcaccagacgctgttaccgaagaagctaggtggtagcaaaggggatatcggatctacttcacaagagttctagatgtttctccctctttgtctagtttattatatgaacagaaagaaatggaagacggagtatagtcggtgttattagtaaatgtagccaagttttgtttagtcgaaaagcgagttacttagagagtgtggggctgtgggctgtgtgggtgaatgaagaatgaaaataccatgtaatgtcttgctgc

SEQ ID NO: 6105 - DNA, 712 bp, Helianthus annuus
actcagattacgcggggataacaaccccaaactacatacattttctccaaattgaaattagggtttgcaaaaatggctggaaaatccgatgcagaagtgaagaaaggcggtagaggaaaaccgaaggcttcaaagtctgtttcaagatcgtctaaagccggccttcagttccccgtcggtagaatcgctagattcctcaaggctggacggtatgcccaacgtgtcggtgccggagctccggtgtacctggcggccgttctcgagtatctggcggctgaggtgttggagttggctggaaatgcagcgagggacaacaagaagagcagagtaggtccaaggcacatacaattagcggtgaggaacgatgaagaattgagtaaactgttgaaatctgtgactattgctaatggtggtgttctgcccaacattcattccactttgcttcccaagaaagcaggcaaggataagggggatatcggctctgcttctcaagagttttaagtttaatatcgtttcatgtatgatacagaacagtgtttggcttttggaatacagtctcgcttttgtttgcctcaacatctaactaaaggtgttacgtgtttaaaccaataactaaagatcgtttagatccatctcaagggacttaacatttagttaatatttgtttgtaactcattatgaacattaaatgttataaacttttcgggagttg

SEQ ID NO: 6106 - DNA, 563 bp, Castanea mollissima
acgcggggactcccatacctcacaagcaagacacatttccaaatcccaaaatctctctctcactcaaaaactctcaaatcccaaaacccacaatgagctccgctgcagaaaccaccacaaagggcggcagaggcaagccaaaagccacaaagtccgtctccagatcccacaaagccggtctccaattcccagttggccgtgtcgcccggttcctcaaaaccggccgatacgcccaacgtgtcggctccggctccccagtctacctctccgccgtcctcgaatacctcgctgctgaggttttggagttggctgggaatgcagcgagggacaacaagaagaacaggattatcccgaggcacatacagcttgctgtgaggaacgacgaggagttgagcaggcttatggggtctgtgaccattgctaatggcggtgttttgcctaacattcatcagaatttgttgcccaagaaagctgggaaaggaaagggtgatattgggtctgcttctcaggaattttaggtgtactgggtttgttgggtttcgttaggctttgtaatgaagtag

SEQ ID NO: 6107 - DNA, 623 bp, Euonymus alatus
acaaatcacgcggattcacgcctcagaatacttcactccctccatctttcgaaattcccagtttccgatacgatgagctctgccgctgctacaaccacaaagggcggccgaggaaagcccaaggccaccaaatcggtctccaggtcccagaaggcgggtctccaatttccggttggtcgaattgctcgcttccttaagaccggtaaatatgctgagcgagtcggatctggatcgcctgtctacctctccgctgttcttgagtacctcgctgcagaggttttggagttggcagggaatgctgcgagggataacaagaagagcaggattgtgcccaggcatatccagctcgcggtgaggaacgatgaggagttgagcaagttgttgggctctgtcacgatcgctaatggtggcgttttgccaaatattcaccagaatctgttgccgaggaagagcggggttgggaagggtgagatcggatcggcatctcaagagttttaggggaatttgaattgttcatctcggggttttggtttctgatatgtaaatttcatttaggttaatatctggacgaaataatttgctgggttatgtccctaatcgtgttataccgttttggtattcgg

SEQ ID NO: 6108 - DNA, 739 bp, Humulus lupulus
ttacggccggggccattcaaattctctattcgcttcttcttctcaaaaatctcaactaagaatatcagaattccgtagccctaattttcgtatcaatttcgatggattccaccgccgcagcaaccaagaagggaggcagaggaaagcctaaggctaccaaatcggtttccaggtcttcgaaggccggtctccaattccctgtcggccgaatcgctcgatttctcaagaaaggccgttacgctcagagagtcggctctggatcaccggtttatctctccgccgttctcgaataccttgccgctgagctattggagttggccggaaacgctgctagggacaacaagaagaacagaattgtcccgaggcacattcaattggctgtgaggaacgatgaagaattgagcaagcttctgggagcggtgacgatcgcgaatggaggtgttctccctaacattcaccagactttgttgccgaagaaagttggaaaagggaaaggcgaaattggatctgcatctcaagagttttagttttcgtgattattaattctacagtacagaacgaaaaaaatctgagttgtttggatctaacttttcttgatgtgttttgattagtgcatcgacagtgttgtaatgaactagtatgtttagatttgtaaaggctcctccttctgtggattgcttcttgcttctttctttgttccaccattactggtcttttcctcatactcattgaaaaatga

SEQ ID NO: 6109 - DNA, 725 bp, Quercus alba
ttcggggtattatctcaaaagcaaaacacatttccaaatctctctcactcaaaaactctcaaatcccaaaaccgacaatgagctccgctgcagaaaccaccacaaagggcggcagaggcaagccaaaagccacaaagtccgtctctagatcccacaaagccggtctccaattcccagttggccgtgtcgcccggttcctcaaaaccggccgatacgcccaacgtgtcggctccggctccccagtctacctctccgccgtccttgaatacctcgctgctgaggttttggagttggctgggaatgcagcgagggacaacaagaagaacaggattatcccaaggcacattcagcttgctgtgaggaacgacgaggagttgagcaggcttatggggtctgtgaccattgctaatggtggtgttttgcccaacattcatcagaatttgttgcccaagaaagctgggaaaggaaagggtgatattgggtctgcttctcaggaattttaggtgtactgggtttgttgggtttcgttaggttatggatatgatagccttgtaatgaagtagctttttattatgtaaagcttcacttgaatgataatgaaatattgggttttatctcagattttcaatttgtgttatgtgaatggtgtcttttgtttttacaatttggaaattataggaatctgaattttcaattaagcgcataacatggaaatgtgattatcg

SEQ ID NO: 6110 - DNA, 549 bp, Picea glauca
gctgtaatcttgcaataacaccgggtcagttttggagcaactgcctgctcgtatcatatattcattcattctacgggcagaggtggtggtttgttcctgtgaatcaactgtaatactcagtagggaaaacggcagcatgagttcttcaggaggtggcggtggtggccgagggaaggcgaagtctacaaagtccgtttcgaggtcccataaggctggcctgcaattcccggttggaaggattgcccgcttcctaaagtcgggaaagtatgcagaacgcgttggtgcaggggctcctgtttatttggctgcggttttggagtatctagcagcagaggtgcttgagttggctgggaatgcagcacgggataacaagaaaaacaggattgtgcctcgacacatccagctagctgtcaggaacgacgaggagctcagcaaattgttaggttctgtgaccattgccaatggtggtgtgttgccaaatattcatggtgttttgctacccaagaaaagctggaaaaggggaaagggagccgagattggcagcgcctc

SEQ ID NO: 6111 - DNA, 616 bp, Secale cereale
acccgcaccagcgcgtccactctccagtctccaccccgaaccagaagatggctatcgccggcagcgggaggggcaaggcgaagcccgccgccaccgccaagtccgtgtcccggtcgtccaaggccggcctgcagttccccgtcggccgcgtcgccaggtacctcaaggtcggcaagtacgcgcagcgcgtcggcgccggcgcccccgtctacctcgccgccgtcctcgagtacctcgccgcagagaccctggagctcgccgggaacgcggcgcgggacaacaagaagaaccggatcgtgccgcggcacatccagctggcggtgcgcaacgacgaggagctaagcaagctgctgggctccgtcaccatcgccgccgcggggtactgcccagcatccataccacgctgctccccaagaaggccggcaagggcaagggcgacatcggctccgcgtcccaggagttctagattagattagtgttcttgtgaatgctttggttggcgtgccatcgatgttggtgttggatctggttggaatggaatgcatctcgcaatcttgtcgttgctgttactgcctgtgatttgtcaatgctaatctgcgttgtaaaccgttaaaaa

SEQ ID NO: 6112 - DNA, 617 bp, Spinacia oleracea
aaaccctgatttccctgtcacaccaacaacgcactatcttcctcctacctatttctctcgatcactttctctctcctagggttctgatcatcgttaggtttccggcgtaaaaatgagcggtaaagaaggcggcggatccaccaagggaggcagaggaaagcctaaagcttcaaaatcggtttcgaggtcttccaaagccggtcttcagttccccgtcggtaggatcgctagatttttgaaggctggaaagtatgctgagcgtgttggtgctggtgctccagtctatctctccgccgtccttgagtatctcgctgctgaggtattggagttggctggaaacgcagcaagagacaacaagaagtcaagaatagtaccgcgtcacattcaattagcagtgaggaacgatgaggaattaagcaagcttttgggtcaagtaacaatcgcaaacggcggggtattgcccaacattaatccgactcttctgcccaggaagctagcgggcggtggtaaagacaataatactctatctcaagagttctagacatgtttcgggtgtactttaaaagagttataattagtgcttcttttcgatggagttatgggtttgattattcccc

SEQ ID NO: 6113 - DNA, 626 bp, Cichorium intybus
catcatttctcaaagtacaacttactgaagttcagggttagggtttatcaaccgcatatcttaaaaatccaacaagatgagttcgaaatcaaagcctgttaccgattcgaagaaaggtggaagaggaaagccgaagacaacaaagtccgtatccagatcttcaaaagccggtcttcagtttcccgtcggaagaatcgccaggtttctcaaggccggaaagtatgcccaacgtgttggtgccggcgctccggtctacctctccgccgttctcgagtatctcgccgctgaggtattggagttggctggaaatgcagcgagagacaacaagaaaaccagaattgttccaagacacatacaattagcagtaaggaacgatgaagaattgagtaaacttttgggatctgtgacgattgcaaatggcggtgttcttcccaacattcattcaactttactaccaaagaaagctggcaaggaaaagggcgatattggttctgcttctcaagaattttaagtagaaagaaacaaatggcaatggttattgtatgataaaatgtttgtttttgaattgaagttccatctttttagcacaactattttttgttttgatgttgaatttaggtttactc

SEQ ID NO: 6114 - DNA, 694 bp, Cichorium intybus
catcatttctcaaagtacaacttactgaagttccagggttagggtttatcaaccgcatctcttaaaaatccaacaagatgagttcgaaatcaaagcctgttaccgattcgaagaaaggtggaagaggaaagccgaagacaacaaagtccgtatctagatcttcaaaagccggtcttcagtttcccgtcggaagaatcgccaggtttctcaaggccggaaagtatgcccaacgtgttggtgccggcgctccggtctacctctccgccgttctcgagtatctcgccgctgaggtattggagttggctggaaatgcagcgagagacaacaagaaaaccagaattgttcctaggcacatacaattagcagtaaggaatgatgaagaattgagcaaacttttgggttctgtgacgattgcaaatggcggtgttttgcccaacattcattctactttactaccaaagaaagctggaaaggaaaagggtgatattggttctgcttctcaagaattttaagtagaaaaaaacaaatggcagtggttattgtatgataaaatgtttgtttttgaattgaagtttcatctttgtagcacaactaatttttgttttgatgttgaatttaggtttactgatttgtaggtgtaagtgaatgcataatatcatgatattttgggttttttacatcatgcctcgtcttt

SEQ ID NO: 6115 - DNA, 694 bp, Cichorium intybus
catcatttctcaaagtacaacttactgaagttccagggttagggtttatcaaccgcatatcttaaaaatccaacaagatgagttcgaaatcaaagcctgttaccgattcgaagaaaggtggaagaggaaagccgaagacaacaaagtccgtatccagatcttcaaaagccggtcttcagtttcccgtcggaagaatcgccaggtttctcaaggccggaaagtatgcccaacgtgttggtgccggcgctccggtctacctctccgccgttctcgagtatctcgccgctgaggtattggagttggctggaaatgcagcgagagacaacaagaaaacaagaattgttccaagacacatacaattagcagtaaggaacgatgaagaattgagtaaacttttgggatctgtgacgattgcaaatggcggtgttcttcccaacattcattcaactttactaccaaagaaagctggcaaggaaaagggcgatattggttctgcttctcaagaattttaagtagaacgaaacaaattgcaatggttattgtatgataaaatgtttgtttttgaatcgaagtttcaactttgtagcacaactattatttgttttgatgttgaatttaggtttactgattcgtaggtgtaagtgaatgcataatatcatgatattttgggttttttacatcatgcctcgtcttt

SEQ ID NO: 6116 - DNA, 823 bp, Lactuca sativa
ataactctctgaataaaatatcatctctcaaagcacttcttcttacacttcagggttagggtttattaaatcgcatctcaaacaatccatcaagatgagttcaaagacaaaagccgtctccgattcgaagaaaggtggcagagggacgccgaagacaacaaagtctgtttccagatcttcaaaggccggtcttcagttccccgtcggaagaatcgccagatttctcaaggccggaaagtatgcccaacgtgttggcgccggcgctccggtctacctttccgccgttctcgagtatctcgccgccgaggttttggagttggctggaaacgcagcaagagacaacaagaaaacaaggattgttccaagacacatacaactagcagtgaggaatgatgaagaattgagtaaacttctgggatccgtgacaattgcaaatggaggtgtgcttcctaacattcattctactttgctaccaaagaaggctggaaaagagaagggtgatattggatctgcttcacaagaattttaagttgtatcaaactttgaaatgatatttgtaagataaagtgttctttttttgaagtgaagttccgtatttgtaactcaacatggttttgttataaatttgaatttgggttacaagatttggtatctttaggtgtaagtgaagttttatcaaatctttggttataaacatgattaagtcgtttgaagtcccattaagtctctctatgtaattacttctaactagtaaagatgcttgtgttgtgtgtgttagattttttttgtggatgtttggtaggttgtatacacgaaaatccaa

SEQ ID NO: 6117 - DNA, 658 bp, Allium cepa
tcctctctctgctatttcttgaaacaaattaaaaagcataaaagaatgagtcccaaaaaaggtggaaggggaaagccgaagaatacaaaatcggtatctcgatctagcaaagcaggcctccagttcccagtcggaaggatcgccagatttttgaaggtcggaaggtacgctcagagagttggcgccggagctccggtctacttgtcggcggttcttgagtatctcgcggctgaggtattagaacttgctggaaatgcagccaaggacaataagaagtcgagaataattcctagacacattcagctggcagttaggaatgatgaagaattgagcaaacttctgggaagggttacgattgctaacggaggagttatgcccaatattcattctgctcttttgccaaagaaggctggaaaggttaagtcggaaattggatccgcttctcaagaattttaagtacctttgttttcatgtttttcatatttcaatttcgatttattaggtggtatttagttggattttgtttggcattattaactgctgtagatatcagactggtgttaatcaattggtcgtttgttttagcatgatttggatttttgtttacttttgttccagtttgaatttgctgctttattataaaaattacccttgttat

SEQ ID NO: 6118 - DNA, 481 bp, Allium cepa
ttacggggggtttagttttcctttcttcttcttagtctattttcttgaaacaaattaaaaagcataaaagaatgagtcccaaaaaaggtggaaggggaaagccgaagaatacaaaatcggtatctcgatctagcaaagcaggcctccagttcccagtcggaaggatcgccagatttttgaaggtcggaaggtacgctcagagagttggcgccggagctccggtctacttgtcggcggttcttgagtatctcgcggctgaggtattagaacttgctggaaatgcagccaaggacaataagaagtcgagaataattcctagacacattcagctggcagttaggaatgatgaagaattgagcaaacttctgggaagggttacgattgctaacggaggagttatgcccaatattcattctgctcttttgccaaagaaggctggaaaggttaagtcggaaattggatccgcttctcaagaatttta

SEQ ID NO: 6119 - DNA, 412 bp, Allium cepa
aatgagtcccaaaaaaggaggaaggggaaagccgaagaatacaaaatcggtatctcgatctagcaaagcaggcctccagttcccagtcggaaggatcgccagatttttgaaggtcggaaggtacgctcagagagtaggcgccggagctccggtctacttgtccgcggttcttgagtatctcgcggctgaggtattggaacttgctggaaatgcagccaaggacaataagaagtcgagaataattcctagacacattcagctggcagttaggaatgatgaagaattgagcaaacttctgggaagggttacgattgctaacggaggagttatgcccaatattcattctgctcttttgccaaagaaggctggaaaggttaagtcggaaattggatctgcttctcaagaattttaa

SEQ ID NO: 6120 - DNA, 685 bp, Populus trichocarpa
ccccatgccacacgaatacttctctcccagtgaagaaaaaaaacatttctctgatttttgcgtgaaaatgagttcaaaaggagcagcagtagcctctacaaggggagggagaggaaagccaaaggcctccaaggcggtgtcaaggtcccagaaggcagggctacagttcccagtgggaaggattgcaaggtttttgaaaaccggaaagtatgctgaacgtcttggtgctggatctcctgtctacctctccgctgtccttgaatacctcgctgccgaggttcttgagcttgctgggaatgctgcgagagataacaagaagaaccggatcataccgaggcacatccagcttgcagtgaggaatgatgaggagttggggaagctgttggggtcggttacaattgcaaatggaggtgttttgcctaacattaaccagactctgcttcctaagaaggctggcaaagggaagggcggtgacattggatctgcttctcaggagttttagggcttttgattaggatgtgctataggttgtcatatacattgcttagggtttttctatgtatttttttagttgtctaatgaaattaaacatttagttgcttaacatcctgcccttctctgctttgattttgaattaatataatttttttattaattaatcaatataattatattaattatttgg

SEQ ID NO: 6121 - DNA, 504 bp, Arnica chamissonis
taacaatcagacatctctcaattcaaaaatggcacctaaatctgatgctgaacctaagaagggtggcagagggaagcccaagactacaaagtccgtctcaagatcttccaaagctggtcttcagttccccgtcggaagaattgcgaggttcctcaaagccggacggtacgctcaacgtgtcggtgccggagcgcctgtttacctctctgcggttctcgaatacctcgccgccgaggtattggagttggctggtaatgcggcaagggataacaagaagtcgagaatagtcccgaggcacatacagctagcagtaaggaatgatgaagaactcagcaagctgttgggatctgtgacaattgcaaacggtggcgttttacccaatatcaacacggttttgctaccaaagaaagcaggaaaggagaagggtgatattggttctgcttctcaggtaattttaggcaaaacacagtgagaatcagtttagtgtttctattgtaatcagta

SEQ ID NO: 6122 - DNA, 509 bp, Flaveria ramosissima
aacatctcaatcgaagacgatggcgacaaaatccgatgcagaaacaaagaaaggcggtaggggaaaacccaaagccacaaaggccgtatcacgatcttcaaaagccggtctccagttccccgtcggcagaatcgcgaggttcctcaaagccggaagatacgcccaacgcgtcggtgccggagctccggtgtacctctccgccgtgctcgagtacctcgccgccgaggtgttggagttggctggaaatgcagcgagagataacaagaagagtcgaattggacctaggcatatacagttagcagtgaggaatgatgaggagttgagtaagttgttggggtctgtgacgattgctaatggtggtgttttgccaatattcattccactttgttgccgaagaaggtgggaaaggagaagggtgaaattgggtctgcttctcaagagttttgaggtgaagattgtgggttttgatggatttgtatggtacagtggtgctttcttgttattctgtc

SEQ ID NO: 6123 - DNA, 602 bp, Plantago ovata
actcttcaacctcaccacatctcaagcacactctacaatggccaccggcactccagtaaccaaatcagccgctggccgtggcaaggcgaagaccaaatccgtcagccgatcatcaaaagccggtctccagtttcccgttggccgcatcgcccgtttcctgaagaaaggccgatatgcggagcgtgttggatctggttcgcctgtttacctctctgctgtcctcgaataccttgctgctgaggttttggagcttgctggaaatgcggcgagggataacaagaagaatcggattgtgccaaggcacattgagttggctgtgaggaatgatgaggagttgagtaagttgcttggtggtgtgacgattgcaaatggtggagttttgcctcatattcaatccgttctgctaccgaagaaggctgggaaaggaaaggcggagattggatctgcttcacaggaattctagagtgtttgatttggttgattagggcttataggccgccttttgggttagaaatggtgtcggtttgttagggtttgtttatatgctattattatattattgtagctctatctttttgaattaatgaaatatttagattata

SEQ ID NO: 6124 - DNA, 825 bp, Pteridium aquilinum
gttctactctcagtttcttgtaacccattatggcggctggtggaggtgggagaggcaagccgaaaacagcaagtctgtttctcgctctcagaaggctggcttgcagtttccggttggaaggattgctaggttcttgaaaaaaggcaagtatgctgagcgtgtaggagcaggtgcccccgtctacctggctgctgtgatggagtaccttgctgcagaggttctggagcttgctggaaatgctgcccgtgataataaaaagaacaggattatcccacggcacattcagcttgcagtccgaaacgatgaggaactcagtaaactgcttggcaatgttgtgattgcaaatgggggtgttctgcctaacattcatgcaacactgctacccaagaaatctgcaaagggaaagggtgaagctggaggtgcatctcaggagtattaaccagagggagccaactgaaacaggaaattgcaagccaccacagcgtaaagggtcaatggactcttggctttactgaacttttttgcaagtcattcctttttgaaggtttcaaaaccgccttatgggaatgctttgggaatagtgctttgggaactattcattgcgaagtagaacattgctttttggaactcatctacgagtctctggtttccgaacttgtatgttgcagcactgctacatactttactcacacaataccaacttaccattttgctttgaattgcgggaatatgatgcgtatcctgtaagtacttatgtgccacttaggtgcccatgtaatctgaactgtcgtattgaatatgacctgcttaatcatttgttcatca

SEQ ID NO: 6125 - DNA, 611 bp, Guizotia abyssinica
atagcaccagaactcaaagaacagtttctcgaaattagggttagggttttgcaatcataaatctcaaacaaagaagatggcaccaaaggctgacgctactgaaacgaagaagggaggtagaggaaaggccaaggctacaaagtcagtttccagatcttcgaaggctggtctccagttccccgtcgggagaatcgctagattcctcaaggccggacggtatgctcaacgtgttggcgccggagctccggtctacctttctgccgttcttgagtaccttgctgctgaggtactggagttggctggtaatgctgcaagggacaacaagaagagcagaattggtcctaggcatatacagttggctgtgaggaatgatgaagaactgagtaaattgttgggatctgtgacaattgctaatggtggtgtccttcctaatattcattccactttgcttccaaagaaaggaggaaaggagaagggagatattggttctgcttctcaagaattttagggtagttgattttgtttgatatggtgttcttttttgagtaatagaattggtgctggttgtaagatgaatgcatgatgttatggaaagtttaaatttttctgca

SEQ ID NO: 6126 - DNA, 653 bp, Ipomoea nil
aaccagcgagcgaaaactcaattcatcaaattcattcaagttcacctccatcgccatgagttctgcagcagcggaagtgaaatccaccggcggcggccgcggcaagcctaaagcctcaaaatccgtcactaggtcttcaaaggccggccttcagttccccgtcggcagagtcgcccggtatctgaagaagggccgttatgctcaacgcgttggctccggttctccggtctatctctctgctgttctcgaatacctcgctgctgaggttttggagcttgctgggaatgccgcaagggacaataagaagaacaggatagtcccaaggcacatccaattggcggtgaggaacgatgaggagtttagcaagctgttaggatctgtgaccatcgccaatggcggtgttctgcccaacattaaccagtgtttgcttcccaagaagaatggtaaagggaagggcgagattggatctgcgtcccaggagttttagatcagcttacgagggctaagaaatgggggttgtgccaattttttgttgtcaaacatttagtgctaaatcaaagtgttaaatgtagatttagtagctgaattgcagttgttaatacaatgtttgatgcttgctttatgaaatgggtgctagtttaacaaaaaaaaaa

SEQ ID NO: 6127 - DNA, 538 bp, Flaveria ramosissima
ccaaattagggttagggttcaccaatcgaacatctcaatcgaagacgatggcgtcaaaatccgatgcagaaacaaagaaaggcggtagaggaaaacccaaagccactaaggccgtatcacgatcttcaaaagccggcctccagttccccgtcggcagaatcgcgaggttcctcaaagccggaagatacgcccaacgcgtcggtgccggagctccggtgtacctctccgccgttctcgagtacctcgccgcagaggtgttggagttggcaggaaatgcagcgagggataacaagaagagtcgaattggaccaaggcatatacagttagcagtgaggaatgatgaggagttgagtaagttgttggggtctgtgacgattgctaatggtggtgttttgcccaatattcattccactttgttgccgaagaaggtgggtaaggagaagggtgaaattgggtctgcttctcaagagttttgaggtgaagattgtgggtttgatggacttgtatggtacagtggtgctttcttgttattctgtct

SEQ ID NO: 6128 - DNA, 748 bp, Populus trichocarpa
atccatctccctgtctcataaaaaaccagcaattcgtgaaattctctttgtttcctgcgtgaaaatgagttcaaacgaaggaagagcatctacaaagggaggtagaggaagagccaaggcctccaaggcggtgtcaaggtcccagaaggcagggttacagtttccagtgggaagggtggcaaggttcttgaaaactggaaagtacgctgaacgtcttggtgctgggtctcctgtctacctctctgctgtcctcgaatacctcgctgccgaggttcttgagctagctgggaacgcagcaagagataacaagaagaaccggatcgtgccaaggcacatccagcttgcagtgaggaacgacgaggagttagggaagctgttggggtcggttacaattgcaaacggaggagttttgcctaacattcaccagactctgcttcctaagaaggttggcaaggggaagggtgatattggatctgtttcccaggacttctagggttttgatttgggatgtgccatgtaaaccatgcttgttagacctggtttaaagaatttcttcaaaaaagttcttggctattagattatcgggttaacttgtgaggttgagttgaatttaatgttcatatatgtttagattttttctagattgggtagaaaaagttgctgaatctttctaatccaatgaaaattgaaaatcttggtgctcattattgtgccttttatgcttccaaatttccaattcgttatttga

SEQ ID NO: 6129 - DNA, 450 bp, Utricularia gibba
ctccaggtttcctgatttctctcgcggatcacgatacctaaggatgagttctgcggccgcgtctaccacgaagggtggaagagggaggcagaaatcagccaaggcggtttcgcggtcatcgaaggccggtcttcagtttcctgtgggaagaatcgcgcgttttctcaaggctgggaagtacgccgagcgggtcggggccggagctcctgtatacctatccgccgtgcttgagtatttggcggccgaggtcttggagttggcagggaatgcggccagggataacaaaaagaatagaatcgttccaaggcacattcaattagcggtgaggaatgatgaagaattaagcaaactcttggggaatgtgacgatcgctaatggtggtgtcatgcccaatattcatcagaccttgttgccgaagaaggctggaggaagagacaaagagattggctc

SEQ ID NO: 6130 - DNA, 607 bp, Vinca minor
ctaagagcaagcaaaaaaaaaaaaaaatacccaaaatacaaaatacgtcgttttgttgatttctcctccaagaagaagaagaaaatgagtggaaaagaaagcggcgcttcaaagggcggcagaggaaagccaaaagcttcgaaatctgtttctcgatcttcaaaagctggtcttcaatttcccgtcggtcgaattgctcggtttttaaaggccggaaagtatgctcagcgtattggatccggtgccccggtttacctttctgctgtccttgaataccttgctgccgaggttttggagttggctgggaatgcggctagggataacaagaagaacaggattgttcccaggcatattcaattagctgtgaggaatgatgaggaactgagcaagcttttgggatcagtgaccatagcaaacggcggcgttttacctaatattcactcgaatctgttgcctaagaagatcggcaaaggtggaaaaggagagattggatccatgtctcaggagttttaggggcttaataacaagaatgaacaatatttatgtaaaatacttttctcccttttttcccctgccttgtttagtgttttctatggaatgaaaaatt

SEQ ID NO: 6131 - DNA, 455 bp, Flaveria ramosissima
aacatctcaatcgaagacgatggcgtcaaaatccgatgcagaaacaaagaaaggcggtagaggaaaacccaaagccacaaaggccgtatcacgatcttcaaaagccggtctccagttccccgtcggcagaatcgctaggttcctaaaggccggaagatacgcccagcgcgtcggtgccggagctccggtgtacctctccgccgttctcgagtacctcgccgcagaggtgttggagttggctggaaatgcagcgagggataacaagaagagtcgaattggtcctaggcatatacagttagcagtgaggaatgatgaagagttgagtaaactgttgggtctgtgacgattgctaatggtggagttttgcccaatattcattccactttgctgccgaagaaggtgggtaaggagaagggtgaaattgggtctgcttctcaggagttttgaagtgaaga

SEQ ID NO: 6132 - DNA, 693 bp, Chrysanthemum coronarium
cccctctccaccaatcagaaagcaccactcccccttataaataccaaacccaacccattcacaaaacacatcattcaccaccactcactcattgaaaagcaaattagggttgagatcttaaaaagaatagaagaaaatgggtgggaaatcagtagaagacatgaagaagggaggaagagggaagaccaaatcatcagccaagtcagtatcaagatcttcaaaagcaggtcttcagttcccagtcggaagaattgcaaggtttttaaaacaaggcaaatatgctcaacgtgttggtgctggtgctcctgtttatctctctgctgtccttgaatatctcgctgctgaggtgttggagttagctggaaatgcagcaagagacaacaagaagacaagaatagtaccaaggcacatccagctagcagtgaggaacgacgaggagctcagcaagttgttgggatcagtgacgattgcaaatggtggtgttttgcccaacattcattctactttgttgccaaagaaggctggtaaggacaagggtgatattggctctgcttcacaagagttttaggatcaaggattactagttgttgttttagggagatgctctggtttattgctttttttgtaagatatgatgtttgttttatcaatcggaattaagtggtcatgctttgatgttggttttgattgcaa

SEQ ID NO: 6133 - DNA, 560 bp, Gossypium hirsutum
ctttcaaaaggaaaagaaatccaaacaaatctgcaaatcatgagctccgcggcagcaacaaccaccaaaggaggccgaggcaagtcaaaggctaaagccgtttcccgatccagcaaagccggactccaattccccgttggtcgagttgcacgtttcctcaagaaaggacgatacgccgagcgcgtcggatctggatcccctgtctatctctctgccgttctcgagtatctagctgctgaggttttggaattggctggaaacgcagcaagggacaacaagaagaacagaattattccaaggcacattcagttggctgtgaggaacgacgaagaactgagcaagctgttgggaggtgtgacgattgcaaatggtggggttctgccaaacattcatcagaatctgttgccaaagaaggcttcgaaagggaagggcgagattggttctgtttctcaagagttttagaggatcttgcagtgcattggaatgattatttttgggatagcatgtaatgaaacagttcgttttttacatgtataaatctgttagtaaagaaagcgtag

SEQ ID NO: 6134 - DNA, 965 bp, Gossypium hirsutum
attacaaaatattctccttcacagaaatctatctttcaaaaaggaaaagaaatccaaacaaatctgcaaatcatgagctccgcggcagcaacaaccaccaaaggaggccggggcaagtcaaaggctaaagccgtttcccgatccagcaaagccggactccaattccccgtcggtcgagttgcacgttttctcaagaaaggacgatacgccgagcgcgtcggatctggatcccctgtctatctctctgccgttctcgagtatctagctgctgaggttttggaattggctggaaatgcagcaagggacaacaagaagaacagaatcattccaaggcacattcagttggctgtgaggaacgacgaagaactgagcaagctgttgggaggtgtgacgattgcaaatggtggagttttgccaaacattcatcagaatctgctgccaaagaaggcttcgaaagggaagggcgagattggatctgtttctcaagaattttagaggatcttgtagtgcattggggtgaattttttttttgggatagcatgtaatgaaacagttcgttttttacatgtataaacgtgttagtaaagaaagcgtagaattgaatcttttattctaactttttaggtttcaatttattttgttcgttcatgtttagaaccaaaatctccttcagtcaatatatgaaaaaaggtgcacatatataattagaatggtaaagcaagggtacaatgaaatataaaaactgtcgtggtaaaggtttgaagcgaaggagatagatgagatttgtaattcaagtacttggatgtcggagctgggttcccggtgcgactccaacagatcgttgttccgagacaaatgctttgatgaagttaacaatcgattttattcttggcaaaccaaagaacccatatcccagtagacatgttgcccgattctcgaatatttacaatttaaagtgatttaaa

SEQ ID NO: 6135 - DNA, 653 bp, Euonymus alatus
gaaatcacgcggattcacgcctcagaatacttcagtcttcactccctccatctctcgaaattcccagtttccgatacgatgagctctgccgctgctacaaccacaaagggcggccgaggaaagcccaaggccaccaaatcggtatccaggtcccagaaggcgggtctccaattcccggttggtcgaattgctcgcttcctcaagactggcaaatatgctgagcgggtcggatctggatcgcctgtctacctctccgctgttcttgagtacctcgctgcagaggttttggagttggcagggaatgctgcgagggataacaagaagagcaggattgtgcccaggcatatccagctcgcggtgaggaacgatgaggagttgagcaagttgttgggctctgtcacgatcgctaatggaggcgttttgccaaatattcaccagaatctgttgccgaggaagagcgcggttgggaagggcgagatcggatcggcatctcaagagttttaggggaatttgaattgttcatctcggcgttttggtttctgatatgtaaatttcattttaggttaatatctggacgaaatatttgctgggttatgtccctaatcgtgttataccgttttggattcggatgttttgggctctgcaattttcac

SEQ ID NO: 6136 - DNA, 730 bp, Gossypium raimondii
accaaaaccaattgcaaagattacaaaaaattccccttcaaaaaactctatctttcaaaaggaaaagaaatccaaacaaatctgcaaatcatgagctccgcggcagcaacaaccaccaaaggaggccgaggcaagtcaaaggctaaagccgtttcccgatccagcaaagccggactccaattccccgtcggtcgagttgcacgttttctcaagaaaggacgatacgccgagcgcgtcggatctggatcccctgtctatctctctgccgttctcgagtatctagctgctgaggttttggaattggctggaaacgcagcaagggacaacaagaagaacagaatcattccaaggcacattcagttggctgtgaggaacgacgaagaactgagcaagctgttgggaggtgtgacgattgcaaatggtggagttttgccaaacattcatcagaatctgctgccaaagaaggcttcgaaagggaagggcgagattggatctgtttctcaagaattttagaggatcttgtagtgcattggaatgattatttttgggatagcatgtaatgaaacagttcgttttttacatgtataaacgtgttagtaaagaaagcgtagaattgaatcttttattctaacttttttaggttttcaattttatttttgttcgttcatgtttagaaccaaaatctccttcagtcaatttatgaaaaaaggtgcacatatataattagaat

SEQ ID NO: 6137 - DNA, 693 bp, Panax ginseng
aagcagtggtatcaacgcagagtacatggggatcactcatcaagctgcattcagaaatctctccttttctctctaaaaccaaaactattatcatcatgagctcaacagcaggcaagggtatagccggaagaggcaaatccaagggcaccaagtcagtttccagatctcagaaagccggtctacaatttcccgtcggtcgaattgcccgattcctcaagaccggccgttacgctcagcgagtcggagccggttctccggtatacttctccgccgtactcgaatacctcgccgccgagcttttggagctagctgggaatgctgcgagggacaacaagaagagtcgaataattccaaggcatattcagttggcggtgaggaatgatgaggagttgagcaagttgttgggaactgtgaccattgcgaatggaggggttttgcctaatattcattcgacactgctgccgaacaaggttgggaaagggaagggtgagattggctctgtttctcaagagttttagggttctgaatctctgcttttagatttgtagaagaaatggaaggtggaaatggggttttggggaatcacaagtttgttaatacttaatagttggatatgtagaggtagaattctacagtaaatgagataatatttttgttgttaagatgatcaatgaaaatatctctgttttcttc

SEQ ID NO: 6138 - DNA, 873 bp, Secale cereale
caccatcctctgcccccccccccccctcactccggccatctctccggcgaccacagcagcagcatcccctccaccccaccccacccgaaagatggcgacagcggcagccggcggcgggaggggcaagccgaaggggagcaagtcggtgtcgcggtcggtgaaggcgggcctgcagttccccgtgggccgcgtggcccggcacctcaaggtcggccgctacgcgaagcgcgtgggcgcgggcgcccccgtctacctctgcgccgtgctcgagtacctcgccgccgaggccctggagctggccggcaacgcggcgcgcgacaacaagaagacccggatctcgccgcgccacatccagctcgccgtccgcaacgacgaggagctcagtcggctgctcggcggcgtcaccatcgccgccggcggcgtcctgcccaacatccactccgtgctcctccccaagaaggtcggcaaggccgccggcaccggcgggtccgcctcccagtcccaggagttctagagcctccgagatcttgatgcgtagcgtggcgtggtggtgtgatgctttaggttggtagattagttcttcttggccaatgttcttgttggtgcgtgtatcgagggtggatctggttggaatggaatgctagggatctggttcctgtctgctgcctgtgatttgtccatggtagtaatctgaatgaaactgtttttttgttgctctgacagtagttcgtcatgctttgttgaattcatgagctctcttgttgatctgggttggatggggtgaaatctagtttcttttgctatttgtcgctgcctatgacttgtcaatgttagtctgaatgaaacggaatgctgttattgtattattctagt

SEQ ID NO: 6139 - DNA, 680 bp, Triticum aestivum
gcccccacaacccccctcgctccctccatctctccggcgaccaccgtagtaccaccctaccccgtcctccccactccagcgatggcgacagcggcagccggcggcgggaggggcaagccgaaggggagcaagtcggtgtcgcggtcggtgaaggcgggcctgcagttcccggtgggccgcgtcgcccggcacctcaaggtcgggcgctacgcgaagcgcgtgggcgcgggcgcgcccgtctacctctgcgccgtcctcgagtacctcgccgccgaggccctggagctggccggcaacgcggcgcgcgacaacaagaagacccggatctcgccgcgccacatccagctcgccgtccgcaacgacgaggagctcagccggctgctcggcggcgtcaccatcgccgccggcggcgtcctgcccaacatccactccgtgctcctccccaagaaggccggcaagggcgccggcaccggcgggtccgcctcccagtcccaggagttctagagcgccagagatccgatgagtggcgtggcgtggcgtggtggtgtgatgcttttaggttggtagattagttcttcttggccagcgttcttgttggcgcgtgtatcgagggtggatctggttggaatggaatgcttgcaatctggttcttgtctgctgcctgtgatttgtccatggta

SEQ ID NO: 6140 - DNA, 416 bp, Rosmarinus officinalis
cggccgggggaccctagaacggacgaagaatgagttcaacaggctccaccaagggaggtagaggcaagcccaagtcctctaaatccgtctcccgatctcagaaagcgggccttcaatttcccgtcggcaggatcgctcgtttcctcaaggccggcaagtacgccgaacgcgttggcgctggtgccccggtctatctctccgccgtgctcgagtatctcgctgcggaggttcttgaactcgctggaaatgcggcaagagacaacaagaagaataggatcgctccaaggcatatacaacttgctgtgaggaatgacgaggaattgagcaagcttttggggtctgttacaattgccaacggtggcgttttgcccaatatacatcaaaatctattgccgaagaaggctgggtcagggaaa

SEQ ID NO: 6141 - DNA, 431 bp, Fagus grandifolia
catgagttccgcagcttcaaccaagggcggcagaggcaaacccaagtcgtcaaagtccgtttctcggtcacagaaagccgggcttcaattccccgtgggtcgtatcgcccggtttctcaaggccggcaagtacgccgagcgtgtcggtgccggcgctcccgtttatctctctgccgtgctcgaataccttgccgctgaggttcttgagctagctggaaatgctgctagagacaacaagaagaaccgtattgttccaaggcacatacaacttgctgtgcgtaatgacgaggagttgagcaagcttttgggaacggttactattgctaatggaggtgttttgccgaacattcatcagaatttgtaccgaagaagattgggaaagggaaaggcgatattggatcggcctcccaagagtttttagagtattttag

SEQ ID NO: 6142 - DNA, 1080 bp, Pinus pinaster
aatagcatcgggttagttttggagctgctgcctgttcgtattacagaattattcatttgacgggtcgaggtagtggttcgttcttgtgaatcaagagtaaagaggggagtcggcatcatgagttctgcaggaggtggcggcggccgagggaaagcgaagtcttcaaagtctgtttcgaggtctcataaggctggcctgcaatttccggttggaaggattgctcgtttcctaaagtcgggcaagtatgcagagcgcgttggggcaggggctccggtttatatggctgcggttttagagtatctagcagcagaggtgcttgagttggccggaaatgcagcaagggataacaagaagaacaggattgtacctcgacacattcagctagctgtcagaaacgacgaggagctcagcaaattgctaggtgctgtaacaattgccaatggtggtgtattgccgaatattcacggggttttactacccaaaaggttggaagggaaagggagatgagattggcagcgcctctcaagagttttagactatgctcgactgttaattgatggccacattttgggggctcaatgctattgccaatcactgcctgcctgagtgccagaatctggcaaaatgccaattcttaaagcgttttaaccgttaatcttccattaagattatacagttttaggtggacgaagttatgttattttccattagaatgcactgtgaactgttaatcttccattaggattatagggtttttggtggacgacatttcgatagaccaatggaatacgttgtttttagctttcagaagtaactgatagatatgttcttggcatgaggtcattattgatggatattcttggcagaagattattatggattattcttgacagaagattattatggataattctttatagaagattgttattgttatcattctcaccagggagatgttgaattttaggtcgtcaatgaaatgtgtatgactaaccgtcgtgtttgggtgtttaagtgcattaaacttgtatgtacactctagtagcgttctgctttgcaattgagtaccattgagatgtg

SEQ ID NO: 6143 - DNA, 398 bp, Vinca minor
ttcaaagggtggcggcagaggaaagccaaaagcttcgaaatctgtttctcgatcttcaaaagctggtcttcagtttccggtcggtcgaattgctcgcttccttaaggccgggaagtatgctcagcgtatcggatctggtgccccggtttatctatcagccgtcctcgaataccttgctgctgaggttttggaattggcgggaaatgctgctagggataataagaagaataggattgtgccgaggcatattcagttggctgtgaggaatgatgaggaattgagcaagcttttgggatctgttaccattgcaaatggcggcgttttgcctaacattcactccaatctcttgcctaaaaaggttggtaaaggtggaaaaggagaaattggatctatgtctc

SEQ ID NO: 6144 - DNA, 612 bp, Glycine max
gtgcaaagcctctattttttcttgtgaatttgaaggacgatgagttccacagaggtcgcagccacaacgaagaagggtggaagagggaaacccaagaccacaaagtccgtttcccgttcctccaaagccggccttcagttccccgtcggccgcgtcgctcgctacctcaaggccggtcgctatgcccagcgcgttggttccggttcccctgtttacctatctgcggttctcgaataccttgccgctgaggttttggagcttgccggcaacgctgcgagggacaacaagaagacgaggatcgttcctaggcacattcaacttgcggtgaggaacgatgaggagttgagcaagctgatggggtctgtgaccattgccaatggtggtgttctgcctaacattcaccagaatttgttgcccaagaaggccgctggcaagggaaagcccgagattggatctgccagtcaggagttttagattcttagggtttcatcttgttagtatttagagtgcaaaattgaaagaaaatggaactagttttggtatgtagttggccgcgtagtacagtgagactaggattgacattgaatgatgtatagtcattttatatgtgag

SEQ ID NO: 6145 - DNA, 977 bp, Cryptomeria japonica
gacagattcgtattgggcgaacaagcgacagcgtagactcagacaagaggaagagagaaaggatctcgttatttttcaagcaggcaaaaatggcaggcagagggaaatctgtagaggggaagaaggcagtttcaaggagttctaaggctggtcttcagtttcctgttgggcgtatcgccaggtttctcaaggcagggaaatatgctgagcgtgtaggtgcgggcgctcctgtttatcttgcagccgttctcgaatatcttgctgctgaggttcttgagctggctggtaacgctgcaagggacaacaagaagaccaggattgtgcctcgccatattcagttggctgtgaggaatgatgaggagcttagcaagctccttggagctgttaccattgctaatggcggcgttctccccaatattcacaatattctcttgcctaagaagaccggtagcggcaaggctggagccagtgaggccgaggcttgaggaattataatctgaccccccttctttggtgtttatgaacaccaccttaattaagaaatcttgtcaatgtttcggaagttttatttttgtacagatgttataagggtttctaaccggttagatgttagaagaaattgatgtaaattctttgctatggattttgttatttcaatataatatattaatgccctaggggtttcatttttcagtaattttcgactactctgattgaaaaagttgtttttgatttttctcctccctccaattctgatgacggggggtggggtcttagtcttgaaatttgtatgttacgttccatggcatgctttagaaggggatctcattggacttgtaattgtgctttgttactgtacctaatggctcttagggatctgacattcagtaagatgagcctaaaggaaacgaatttggggctttattcaattaaatttattagcgctggtatagcatctagcgtttgcagtttttaag

SEQ ID NO: 6146 - DNA, 756 bp, Glycine max
cacaccgcaaactctctctgtaaagtgcaaagcctctattttttcttgtgaatttgaaggacgatgagttccacagaggtcgcagccacaacgaagaagggtggaagagggaaacccaagaccacaaagtccgtttcccgttcctccaaagccggccttcagttccccgtcggccgcgtcgctcgctacctcaaggccggtcgctatgcccagcgcgttggttccggttcccctgtttacctatctgcggttctcgaataccttgccgctgaggttttggagcttgccggcaacgctgcgagggacaacaagaagacgaggatcgttcctaggcacattcaacttgcggtgaggaacgatgaggagttgagcaagctgatggggtctgtgaccattgccaatggtggtgttctgcctaacattcaccagaatttgttgcccaagaaggccgctggcaagggaaagcccgagattggatctgccagtcaggagttttagattcttagggtttcatcttgttagtatttagagtgcaaaattgaaagaaaatggaactagttttggtatgtagttggccgcgtagtacagtgagactaggattgacattgaatgatgtatagtcattttatatgtgagaataactagttgttttggtttatgatttggtttcctgcatagttttcgttctatttgaattttgcttgtatctagcacctttttctattattattttggtcaaattagtcttgattttag

SEQ ID NO: 6147 - DNA, 602 bp, Glycine max
tgaaaccaaagttcaaactctgtcttccctgggttctatttcgaaatcaacgacgatgagttccacagaggcagcagccacagagaagaaaggtggaagagggaaaccgaagacttcaaagtccgtttcccgttcctccaaagctggccttcagtttcccgtcggccgtgtcgctcgctacctcaaggccggtcgctacgcccagcgcgttggctccggttcccctgtttatctctccgcggttctcgaatacctcgctgccgaggttttggagcttgcggggaacgctgcgagggacaacaagaagacgaggatcgttccgaggcacattcaactggcggttaggaacgacgaggagttgagcaagctgatgggatctgtgaccattgccaacggtggtgttctgcctaacattcaccagaatttgttgcccaagaaggtcgctggcaaggggaagaccgagattggatctgctagtcaggagttttagatttaaggctcttgttttcgtatgtagttggttgccttatatagtaagattaggattgacattggatgatgtatagtcctttaacatttgaaaataattagttgttttctaa

SEQ ID NO: 6148 - DNA, 862 bp, Glycine max
acaacaattccacaacgcgatctctctctattctttgaaaccaaagttcaaactctgtcttccctgggttctatttcgaaatcaacgacgatgagttccacagaggcagcagccacagagaagaaaggtggaagagggaaaccgaagacttcaaagtccgtttcccgttcctccaaagctggccttcagtttcccgtcggccgtgtcgctcgctacctcaaggccggtcgctacgcccagcgcgttggctccggttcccctgtttatctctccgcggttctcgaatacctcgctgccgaggttttggagcttgcggggaacgctgcgagggacaacaagaagacgaggatcgttccgaggcacattcaactggcggttaggaacgacgaggagttgagcaagctgatgggatctgtgaccattgccaacggtggtgttctgcctaacattcaccagaatttgttgcccaagaaggtcgctggcaaggggaagaccgagattggatctgctagtcaggagttttagatttaagactcttgtgttcgtatgtagttggttggcttatatagtaagattaggattgacattggatgatgtatagtcctttaacatttgaaaataattagttgttttctaacatggttcctgcatagttttcatttatttgagtttctcgtgaatcgagatatctattctctttttatttgtgtgtttgggcataattttagtgtggtgtttatgttgaaggtgctgttgatggttgatgatatcatgtgttgatggttttcgttttaaatggctctgcaccaagtttattgacgataggtgttatcatctcaatgcaaacccccaatctttaata

SEQ ID NO: 6149 - DNA, 695 bp, Phaseolus vulgaris
ataattcaaaaacaatacctctgtttcttgcatagtgcaaaaacaaaattcaacgatttcaacttcaatcctgaaatcaaccacgatgagttctactgaggttgcaacaacaacgaagaagggtggaaggggcaagcccaagaccacaaagtctgtttcccgttcctctaaagctggtctacagtttcctgttggccgcatcgctcgttacctcaaagctggtcgctatgctcagcgtgttggctccggttccccggtttacctctctgctgttctggaataccttgccgctgaggttttggagcttgcggggaatgctgccagggacaacaagaagtcgagaattattccaaggcacattcaacttgcggttaggaatgacgaggagctcagcaagcttatggggtcggtgaccattgctagcggtggggttctgcccaaaattcatcaaaatttgctgcccaagaaaactggcaagggaaaaggagagattggatctgctagtcaggaattttagattttagtgtttaatcttaaattttaagatatgtgaccgtttcttatgtagttttgatatattgaaattaggatctagatttgatgatgtatagtccttcagtttgtgagaaataattacttgtttttctcaatatatgatttccgttcttttctttctaatgatgtctcttttaaaa

SEQ ID NO: 6150 - DNA, 535 bp, Liriodendron tulipifera
aaaagcctcgccgcctctgttgatctcttccagattaggttttcttcccctctttctagggttcgtgcagatcctccaatttaggtctttttcctctctctttgctagggttagggtttacaagagagaagatgagttcttcagcttcaacgaagggtggtcggggcaagcccaagtcctccaaatccgtttctcgatctcagaaggcaggcctccaattccccgttggaaggatcgccagatttctcaagtctgtttaagtatgcagagcgtgttggggctggtgctccggtctatctctctgctgttcttgaataccttgctgcagaggttcttgagcttgctggaaatgctgcgagggataacaagaagaatcggattgttccaaggcatatacaacttgcagtaagaaatgatgaggaactcagcaagctcttcgggactgttacaattgcgaatggtggggttttgcctaatatccatcagacgctgctggccacaaagcaaggaaaagggaagggagagcctggatctg

SEQ ID NO: 6151 - DNA, 1758 bp, Petroselinum crispum
gggaaaaacagttaattagggtttgattgtattagtgaaaaaatgggtaacaaagagggaaaatctaccggcggtagaggaaagacggcgccggcgagggggagcaagtcagtttcacgctcttccaaagctggacttcagtttccggtcggtagaattgctcgtttcctcaaagccggcaagtattctcagcgtgtcggtgctggtgctcctgtttatctcgctgctgttctcgagtatctcgctgctgaggtgttggaattggctggcaatgctgcgagggataacaagaagaacagggttgtgccgaggcatattcagttagcggtgcgaaatgatgaggaattgagcaagctattgggtgctgttacgattgctaatggaggtgtgatgccgaatattcatcagaatttgttgcctaagaaggttggcaaagggaaaggggacattggctctgcttctcaggagttttagggatgttaattttagaatttgagtttgttttcttagtcgtttactagtagaaatgtaattgtgcatattgttgtgtttgaaaatgctttggatgaatgttatgtaaatttatgatagccttgtggcaagattatgtttcttttgttcatgaatttgatttctggttcccttctcctagcttctgtatcgttttgtgatttaacgaaacaaaatggagattgtcaagttgttattgacaaagactcatactatagtatgtaaagcactagctttcttcctatatctagtgacttgatcaaaacaaagattatcatacatgtcactgatgattgatcaagacatcagtatgtactacagcacccatcacaattagattgatgactatataattggatcctttaaagcattttctattgtatcaatacaattccccactgaccttcctagtgccatggcctcggctaatcttgatctagcttcatattgatgatctagtattagtaatgtgttgagtgcagcccttttaatttgagattctgcttcatcctctttgaagtcccaccgcttaagtacattgtacatcttcttcacatcggaatgaagtcctgctgagcaaccaaagaccacatgctctgctactaagcctcctattataacacttagaattctacatgccgtctacaaaggagcaaaattaaagcttaagacaactgcatatattaatacacacacagagtacacagaaaaaagaaatgaggtcgagaaaaaacagttatatataaagtctaaaaatgcaaggcaaagtggtgaggcctctcaatgtcctatttcttaaatttctcacttcacaggaactagcttagcaagttcccccaagtaagatgaaatttgcacctcatcaaagctaagtactaagtattactatctaatgccaacttaaaggaactttagaataaaattacggctgttttacttatatcacatacctaaagtaccaccaatctggcacgttgtattctgttttcaaaggttataaatgtttctggcatcacacatacagtctactatcccatgcaactgataatcttatagtcatccagaacaataatagtgaaaactaagctgttgtaagtattattaagagcactacatgaattggtccagtaaagctatgtgtgcttccggtatccattacggcagatacaatgatactttaaaaggggaactgtacaccttacttgagctatgaaatgcctgatccattcttaataaacatacaaacaa

SEQ ID NO: 6152 - DNA, 627 bp, Linum usitatissimum
aactctcaactgcaaatactaatttcaaatttctgcagttcgaaatctcgtcactccaagcaataacccccatgagttcagtcgccgccgctggtttagccaagtccggcagaggcaagccgaaatccaaggctgtctctaggtctcagaaagccggtctacagttccccgtcggccgcatagctcgtttcctaaagagaggtagatacgctgagcgcgttggatctgggtcccctgtctacctctccgccgtcatggagtatctcgccgctgaggttttggagctggctggaaacgctgcgagggataacaagaagacaaggatcgttccgaggcacattcagctggctgtgaggaacgacgaggagttgagcaagctgctcggaggtgtcaccattgctaacggaggcgtgttgccgaagattcaccagagtttgctgccgaagaaagctgggaaagataagggagagatcggctctgcttcccaagagttttgagattccattattttttagtcaccgtttgggatgttgttaatacttagtctgtagtgagtctgagccaattatgtattaaagttctcgtttcggtactggaaatcaatggaactgaagttggtattttgac

SEQ ID NO: 6153 - DNA, 546 bp, Helianthus annuus
caaccccaaactacatacattttctccaaattgaaattagggtttgcaaaaatggctggaaaatccgatgcagaagtgaagaaaggcggtagaggaaaaccgaaggcttcaaagtctgtttcaagatcgtctaaagctggtcttcagttccccgtcggtagaatcgctagattcctcaaggctggacggtatgcccaacgtgtcggtgccggagctccggtgtacctggcagccgttctcgagtatctggccgctgaagtgttggagttggctggaaatgcagcgagggacaacaagaagagcagagtaggtccaaggcacattcaattagcggtgaggaacgatgaagaattgagtaaactgttgagatctgtgactattgctaatggtggtgttcttcccaacattcattccactttgcttcccaagaaagcaggcaaggaaaagggggaaatcggctctgcttctcaagagttttaagtttaatattgtttcatgtatgatacagaacagtgtttggcttttggaatacagtctcgcttttgg

SEQ ID NO: 6154 - DNA, 818 bp, Cannabis sativa
ctacattcacaatccaaattctctatttgctccatttcattttcaaccaagagtacctgaacaacgcatccctaatcttcgtatctattcaatggattccaccgccgcagcaacaaccaagaagggaggtagaggaaagcctaaggctaacaaatcggtttcaaggtcttcgaaggccggtctccaattccctgtcggtcgaatcgctcgattcctcaagaaaggccgatacgctcagcgagtcggctctggatcaccagtttacctctccgccgttctagaataccttgctgctgagttattggagttggcgggaaacgctgctagggacaacaagaagagcagaatcattccgaggcacattcagttggctgtgaggaacgatgaagagttgagcaagcttttgggtgcggtgaccatcgcgaacggaggtgttctgcctaacatccaccagactttgttgccgaagaaagtcggaaaagggaaagacgagattggatctgcgtctcaggagttttagattttatgatttattgttctatagtatagaaattgaaaaaagatgttagatttttggatcttcaaagttcaaacttttcttttgatgtgttttgattaggtcatcaatagtatcctaatgaagtagtatgtttagatttgtaaagcctcatctttctatggattgcttctctctatttcccatcattgtttcgcttttgatcaatttctttgaaaatagatatgtattgatccatctgtgtctatttattgttcgttttctttattctgaattaaaacaatatataccatttgtagta

SEQ ID NO: 6155 - DNA, 732 bp, Cucurbita pepo
tctttgctccaaattagtctctcctcaatttcgttacggtaaagtaaatatgagttccaccgatgttccggcgaagggtggcagaggcaagaaatctgccaccaagtccgtcactaggtctcacaaggccggtctccaatttcccgtcggccgtatcgccaggtacctcaagaagggccgttatgctcagcgtgtcggctccggctcaccggtttacctctccgctgttctcgaatacctcgctgccgaggttttggagttggctggcaatgctgcgagggacaacaagaaactagaatcgtcccgaggcatattcaactagcagtgagaaacgatgaggaattgagcaagcttttgggatcagttacgatcgccagcggaggagtgctgccgaagattcatcagtctcttttgccgaagaaggccggtagcacgaaggataaggccgagatcggatcggcgtctcaggaattttaggttgcattagaaatatccgtcgattaacagaaaacgaaacagttaggttgtgttagattgttgttagcttcaatgaatctttcttcatcaggttcgtaaatatactaaacgatctttggttagaaaggtatccgtcttcatcgccgataaatttctatattatgtgtaaatgctgatgaaattcgccactaatttaaatagaaaggaacgagttgaattttattgtctcggattctgtaagtttgttatcagcca

SEQ ID NO: 6156 - DNA, 642 bp, Daucus carota
tcataaagcacagcagttagggtttgatagtgaaaatacaaatgggcaacaaagagggaaaatccaccggcggcagaggaaagacggcgccggcgacgaagtcagtctcccgctcttcaaaagccggtcttcaattcccggtcggtcgaattgctcgttttctcaaagccggcaagtactctcagcgtgtcggtgctggtgctcccgtttatctcgctgctgttctcgaatacctcgctgctgaggtgctggaattggcgggaaatgctgcgagggataacaagaagactagggttatcccgaggcacattcagttagcggtgcggaatgatgaggagttgagcaagcttttggggtctgttacgattgccaatggaggtgtgatgccgaatattcatcagaatttgttgccgaagaaggtgggcaaagggaaaggggacattggctctgcttcgcaggagttctagggttgttgatttcagtttttgctttatggtactagtgggaatgtagggtgcttttgtgatatatcgtcgtgttttgaaatgctctggatgaatgtcatgtaaatttgttgatagcttaatggcgaaaaagctttggttatgaattcaaatttggttctcttttgtgtgctttttc

SEQ ID NO: 6157 - DNA, 630 bp, Petunia hybrida
ggaatcagtaattctactattggcttcaagttttcaaatctcccaaaattttcattcataaaaaaaaatgagttctacaattgagaaaaaaagtgtagggggtagaggaaaacccaaagcttcaaaatcagtatccagatctgcaaaagcggggctccaattcccagtgggtcgtattgcacgttacatgaagaaaggtcgttatgctgagcgtcttggctcgggctcacctatctatctatctgctgttcttgaatatcttgcagctgaggtgctagagttagctgggaacgcagcgagagataataagaagaataggattgtaccgagacatatacaattagcagtaaggaatgatgaggaactaagcaagttgttgggtactgttacaattgctaatggtggtgttttgcctaacattcaccagaatttgttgcctaaaaaaactggcaaagggaaacctgaagttggatctgagtctcaagagttttaggttttaggtggttaatatatggctagttgggtaggcaggttttaatggatttttgtgaaattggatgtaatatcgttggcgcaaatttagtcatttgatgttcctacaagtcttatttgtgaatgataagtttggtt

SEQ ID NO: 6158 - DNA, 799 bp, Prunus mume
atctccaaattccaaagacttgaattttttcaaacttgaattgaaattcccaaatcgagaaccatgagctccacagcagcagccaccaccaaatcaggcagaggcaaggtcagaggcaccaagtcggtctcaagatcccagaaggccggtctgcaattcccggttggtcgcgtcgcccggttcctcaaggccggtcggtacgctcaacgagtcggcagtggctccccggtctacctctctgctgttctcgaatacctagctgctgaggttctggagttggcagggaatgctgcgagggacaacaagaagaacagaatcactccgagacacattcagcttgcggtgagaaatgacgaggagtttacgaggcttttggggtctgtgacgatagctaatggaggtgttctgcccaatattcatcagaatctgcttccaaagaagggtggcaaagcaaagggcgagattggttctgcttcccaggagttctagggttgatagattttgttgttaggaaaaagaagaaaaagaaaaatttgagccccttgttcggttaaggctcttgctttttgatgggtagtttagattgttagaaggaagtagcaacctcatattgtaaagctttgcttccaggaagataaccatgttgtattctactggagtttatatcgttcagtgcagattctaatttccaaatttggttttgtccaattacatatgtttcttgtttttggttcattttatattttttgtgggtgcaaaaatttctgataataatcaatcttgctaagaatttgtctta

SEQ ID NO: 6159 - DNA, 624 bp, Antirrhinum majus
atttagcagaacacattcattattttcaaaaccctccaattctaaaacaaaaagagtatcaacaatggcatcaaacaccgctaccaaatccgtcgcgggcggccgtggaaagtcaaagtcaaaggccgtatctcgatcgtcaaaagccggcctccaattccccgttggccgtatcgcccgttttctcaagaagggccgttacgccgagcgggtcggatccgggtcacccgtttacctatccgccgtcctcgagtatctcgccgccgaggtattggaacttgctggaaatgcggcgagggacaacaagaagaacaggatagtgcctcggcacattcagcttgctgtgaggaatgacgaggagttgagcaagctcttggggtccgtcacgattgcaaacgccggcgttttgcccaacattaatcagactttgctgcccaagaaggctggtgctgctgctaaagccaagggagaaatgggctcggcctctcaggaattttaagcgagctttgtttagtgctatcgtagaattaggttagattcgtgatggatttttgtttatagagttattattaattattattatgttgctaattaagtagattagatttatgtttcgtcttaatg

SEQ ID NO: 6160 - DNA, 572 bp, Tropaeolum majus
attaaagcatcactaacactaatcactatcatcactttcagactccgccatttttgcttgattagggttcttaatatctcgtactgaagaaatgacttcaccagcatcaactaagggaggcagaggtaaatctaagtcagcgaaatccgtcacaagatctaccaaagccggcctccagttccccgttggtcgtattgctcgtttcctcaaggccggtaagtacgcggaacgcgtaggtgctggtgctcctgtctatctctccgccgtccttgagtatctcgctgctgaggttcttgagcttgctggcaatgctgctagagacaacaagaagaccagaatcatcccaaggcatattcagttagctgtgagaaacgacgaggagttgagcaagcttttgggagctgtcaccacttgctaacggaggtgttcttcctaacataaccgactctcttacccaaaaactacaaacaaaggaggagacattgcatctgcttcacaagaattttaagggtacgattaaagaagaggggttagggtagggagtgtgtatgaatagaatagatagtggttga

SEQ ID NO: 6161 - DNA, 675 bp, Rosmarinus officinalis
cacacccagatttcattcaccaatttcaaagtttaaaaatcccaccgaaaaagaattaaccaaaatcatgggcgaaaaggcagcgaagaccatcggcggccgtggcaagcctaaatcgaagtcggttgccagatctgcgaaggctggcctccagttccccgtcggccggattgctcgtttcctcaagaaggggcgctacgctcagcgcgtcggatccggatctcctgtctatctctctgccgtcctcgagtatcttgctgcggaggttttggagcttgctggaaatgcggcgagggacaacaagaagactaggatagttccgaggcatattcaattggctgtgcgtaacgatgaggagctggggaggctgctggggtctgtgacgattgccaatggcggtgttttgcccaacattcaccggactttgctgccgaagaaggctggggaaggcaagggtaagggtgaaattggatccgcgtctcaggaattctagggcaaccattgtgttactttatgatgtagttgtagatgctgtgttgatagcatttgtccattttctgttgatatagattagattatctcggtgctatgtattgtgatttaacagtgttaaatccttttgattatatgaaaagatattggattctgcatctattcgagtatgattgttgttaa

SEQ ID NO: 6162 - DNA, 758 bp, Gossypium hirsutum
gagattctggtgccacgttgacgatcctcgccagccttccatcaatcaatcaaattcgctaccaagcttttgctatataaccccactgctcccacttcattctcaagcagtcctttaaaatttgaaactcccgactttcacgttttcaattctgaaaagaaaaagttggttagggattttgaggatgagttccacaggaggatcagcgaaaggagggagagggaagcccaagtcatcgaaggcggtgtcgaggtcgcacaaggctgggcttcagtttcccgtggggaggatcgccaggttcttgaaagctggcaagtatgccgaacgtgtcggtgctggagctcccgtctacctctctgccgtgcttgagtacctcgctgctgaggtactagaacttgctggaaacgcagcgagagacaacaagaggaatcgaatagttccaaggcacatccagttagcagtgaggaatgatgaggagttgagcaagcttttgggttcagttactattgcaaatggaggtgttttgcctaacattcatcaaacccttcttcccaagaaaacgggaaggtaggtgacattggctctgcttctcaggagttttaggccttagttttgattttttgttttttaatgcttgtataatataagcaggttttcttgatctccttttcttatattttgagcaaatgtagttgcttattgatgttaatataaatgtactttttttaaagaagttctttctcattgatttgaggctt

SEQ ID NO: 6163 - DNA, 771 bp, Triticum aestivum
gagcatcctctgccccccacaatctcacctactccggccatctctccggcgaccaccgtagtaccaccctacctccccacccaaccctagcgatggcgacaacggcagccggcggcgggaggggcaagccgaagggcagcaagtcggtgtcgcggtcggtgaaggcgggcctgcagttccccgtcggccgcgtcgcccggcacctcaaggtcggccgctacgcgaagcgcgtgggcgcgggcgcccccgtctacctctgcgccgtcctcgagtacctcgccgccgaggccctggagctggccggcaacgcggcgcgcgacaacaagaagacccggatctcgccgcgccacatccagctcgccgtccgcaacgacgaggagctcagccggctgctcggcggcgtcaccatcgccgccggcggcgtcctgcccaacatccactccgtgctcctccccaagaaggccggcaagggcgccggcaccggcgggtccgcttcgcagtcccaggagttctagagtaccagagatctgagtatggcgtggtggtgcttttaggttggtagattagttcttcttggccaatgttcttgttggtgcatgtatcgagggtggatctggttggaatggaatgcatctggttctgctgtctgtgatttgtccatggtaatctgaatgaaacggattttgctttgctctgacaaaaaaaaaaaaaaaaaagggcggccgtccaaaagaccctcgaagggcccagcttcgcgtaccagctttctgg

SEQ ID NO: 6164 - DNA, 793 bp, Taxus baccata
ctcgcagatttgaatacaggcgaaaagaccaaagtagcgaattgaacaaggaacagtaaaattctacaaattgtttgaagcaggaagaatggcaggcagaggaaaatctgcagagggaaagaaggcggtttctaggagctccaaggcgggtcttcagtttcccgttggtcgtattgccaggttcctcaaggctggaaaatacgccgagcgtgtcggagcaggcgcacctgtttaccttgcagcggttcttgaataccttgccgctgaggttctcgagctggctgggaacgccgcaagagacaacaagaagaccaggattgttccccgtcacatccagctggcggtgaggaatgatgaagagttaagcaagcttcttggtgccgttaccattgccaatggcggcgttctgcctaacatccataacatccttttgcccaaaaagactggtggcaaggccgtggcaggcgaggcggaggcctgaacaaaccctaattgacattcttatggtgtttatgaacaccaccttctgcgagggatcttgttgatactgcacttcgtgctgtacagatctcattaggattttctaaccagttcggcgctatataaaatttatgtaaattgttattagggtttcagcaacaaatacaaatgcccggatatgttggggattctttttttttttcttaaacaaacgttagtaataatgtgaagtagtgatgcggcaattaatgtgccctagtagcaatcaacgtgtcattagcaaagatatgaaataggtcaacaagaaatctat

SEQ ID NO: 6165 - DNA, 2328 bp, Echinacea purpurea
aacagaagaattttcatctaaaactcttgagatgcagaaccaatatctcctttatccttgccagccttgtgtggtagcaaagtttgatgaatgtttggaagaacaccaccactcgcaatcgtcgcagatcccaacagtttactcaattcttcatcgttccttactgctagctgcatgtgcctcggacctattctgctcttcttgttatccctcgctgcattgcccgacaactccaacacctcagcggctaggtactcgagaacggccgataagtagaccggagctccggcgccgacacgtttagcataacgtccggccttcaaaaagcgagcgattctgccgacggggaactgcagaccggctttggaagatcttgaaaccgcctttgaagcctttggctttcctctaccgcctttcttcacttccgcatcagattttcccgccatcttcttcttcttcgatttcgattgctaaaccctagtttcagtttcaaatgtgtgctttttacggaaattactaaaacccatctagattttgttgtcagttgttggatttaaatggttgggagtggtagaatggaggtgattactacaaaggggtgttcaaagatgtatgctgatattggttgtacagtgggttctaattcttttagaggctttcaacctccacgttcatcaacctcaaattccccgttttctggtctggttatctgtgttactggcttatctaaagaagcaagaaaacaagtgatggatgcaacagagagattgggtggtcaatacagtcctcatttgcatcctcgttgtacccatttggtggtccagagctctggtgggcgaaaatttgagcatgcgttgaagcatggagccacaaacgggctctttattgttaaacttggatggtttgtggatagtgttagaagaaatgtgagattgaacgaagctctttatgttgtaagaagtcttggagaaaatcatacacctaaggatgatctcaacatgcttactagtgggaattcttgtcttcctgttgccatgcttgaaaacgctaaacagttgagtgtggttgaaaaaccaagattattctcatcagaagaacttaaaagaagaggttcactttttgcgggtcaatccatttatgttgacccggaagtttctgctgagcttcaaaataaggttgttgaggcggctttcggacaaggatgttcactagtggaccaatggttgccaggtcacaatcctagtcatgtggtatgcgaagagtcttcagttcaaaagtatcttggtcactccaattatcttgttacacccctatgggttctgaagaccgtcaaggagactaggccacagaggcttgtacatatgtctgctgacttggcacgccaaattggtatgatgcttgataatgttcaaggtcctgctcatcaaaaggataactgccgggccatttgtcctcaagaagatcaaagtgttggaattaattccaactatgaagaaaatcaaaatacagtaaaccttgccaaagacggagttagaaatcgtcggagtcgacgcatgcaggcaccaataaaaccactaaccccaagcacacttctaaattcaatctgctggtcaatctctgagccgtcatcaaatgctgctgtgtacaccgactctttcattgacaaaattgaagatgtgaaagaatctaatgcttcgtttgtcaacttctcgagagcgctttcagacgctgaaaagaatgagttggttttcaagaactattttctcacgatactgtttccggttgaccggttctcagagatgggccctagttcaaggacattttttagtgacacagggttcacatgcatgcaattgttagatcacatatacgcattttaccaggaaaacatgtcaaaaatggagattgagttggccattcataccgactcaaggcatgctgataggttaagatcagtttatgcaagcaaagaagctgctgaacgtggttatgcggaaatcaaacgtattgagtttctagggagtcgaaaaagctttgaaatgctaaaacgtgttcctggtgataacaatagtaatgtctatgagttggtgacccgagcgtagtgacatcagcgtgggttcactgtttgtgataagcgggtctagtgagccaacatgtgtaacgtttaaccatctgagactggtttgacctttgtttagtctgggctatgggagtctaaatgagtttagctttttgtaaagtgtaaaattaaagagatatatgaatgatatgtttttcaacagttttactaataacatcatgattatgttaaaagaaatctctttagac

SEQ ID NO: 6166 - DNA, 557 bp, Chrysanthemum coronarium
acactactcgtgaaaaacattgggatcaagtggagctgcaaagaaggctacatcaaggagtagcaaagctggtcttcagtttcctgttggtcgtattgctaggtttttgaaagctggtaaatatgctgagcgtgttggggctggagctccggtgtacctcgccgctgttcttgagtatctcgctgctgaggttttggaattagctggaaatgcagcaagagacaacaagaaaacaagaatagtaccaaggcacattcagctagcagttaggaacgacgaggagctaagcaagttgttgggatcagtgaccattgctaatggtggtgttctgcccaacattcattctactttgttgccaaagaaggctggtaacagcaagggtgatattggctctgcttcacaagagttttagattactgctagttgtttgctgggattttcgttgttctaatgacagattcttgtatgatatcatgtttctttgttttatcaatcggaattaagtgcttttgttggatccatattttgactgaatcatatcatctatttgcataaaa

SEQ ID NO: 6167 - DNA, 581 bp, Adiantum capillus-veneris
atggtgacacagaaattatggggctaaaaaaaacgtgcaaccatataattttggagcagtaatataatgcgaagcttcctctactataaagcgccatagcttcctgccgaagcttcaacaaaacagcagcaacacagttcttataatccacaatggcggctggtggaagaggtaagcccaaaaacagcaagtctgtttctcgctcccaaaaggcgggcttgcagtttccggttggaaggattgccaggtttctgaagaagggaaaatacgctgagcgcgtaggagctggtgctcctgtctacttggctgctgtcatggagtaccttgcagcggaggttctggagcttgcaggaaatgctgcccgtgacaacaagaaaaacaggatcattccgaggcacattcagcttgcagtccgaaacgacgaggagctcagtaaacttttgggcaatgtggtaattgcaaatggaggtgttctgcctaatattcatgccacactgctaccaaagaagtctgccaagggaaagggtgaagccggaggagcatcacaggagtactagcgaaagtcagacagggaaggaaag

SEQ ID NO: 6168 - DNA, 433 bp, Ambrosia trifida
aatggccggaaaatcgaatacagaggcaaagaaaggcggtagaggaaaaccaaaggctacaaaatctgtatcaagatcatctaaagccggtcttcagttccccgtcgggtaggaatcgctggttttaaagctggtcggtatgctcaacgtgttggtgctggagctcctgtctacttgtctgctgttcttgagtatcttgctgctgaggtgttggagttggctgggaatgcagcaagggacaacaagaagagtagagtaggtccgaggcacatacagctagcggtgaggaacgatgaggagttgagtaaattgcttggagctgtgacgattgcgaatggtggcgttcttcccaacattcattccactttgcttcccaagaaagcgggcaaggagaagggggatattggttcggcttctcaagagttttgaagtc

SEQ ID NO: 6169 - DNA, 586 bp, Allium cepa
tagttacgggggagtcggtccgttttctgctctctctcaaaacaaattaaaaagaacacaaaatgagtcccaaacaaggtggaaggggaaagccgaagaatacaaaatcggtatctcgatctagcaaagcaggcctccagttcccagtcggaaggatcgccagatttttgaaggtcggaaggtacgctcagagagtcggcgccggagctccggtctatttgtcggcggttcttgagtatctcgcggctgaggtattagaacttgctggaaatgcagccaaggacaataagaagtcgagaataattcctagacacattcagctggcagttaggaatgatgaagaattgagcaaacttctgggaagggttacgattgccaatggaggagttatgcccaatattcattctgctcttttgtcaaagaaggctgaaaaggttaagtcagaaattggatctgcttctcaagaattttaattacttttactttcatgcttcttacattttgcttactagtattatcattggatttagtttggcattatgaacttctgtagatatcagattgatgctaatcaattggttctttt

SEQ ID NO: 6170 - DNA, 549 bp, Allium cepa
agttacgggggagtcctctctgctatttctcgaaacaaattaaaaagcataaaagaatgagtccgaaaaaaggtggaaggggaaagccgaagaatacaaaatcggtgtcccgatcaatcaaagcaggcctccagttcccagtcggaaggatcgccagatttttgaaggtcggaaggtacgctcggagagtcggcgccggagctccggtctacttgtcggcggttcttgagtacctcgctgctgaggtattagaacttgctggaaatgcagccaaggacaataagaagtcgagaataattcctagacacattcagctggcagttaggaatgacgaagaattgagcaaacttctgggaagggttacgattgctagcggaggagttatgcccaacattcattctgctcttttgccaaagaaggctgcaaaggttaagtcagaaattggatctgcttctcaagaattttaattacttttactttcatgtttcttacattttgcttgctagtattatcattggatttagtttggcattatgaacttctgtagat

SEQ ID NO: 6171 - DNA, 703 bp, Tripterygium wilfordii
cgaggcaagcctaaggccaccaaatcggtctccaggtcacagaaggcgggtctccagttccctgtcgggagaattgctcgcttccttaggaccggcaaatacgctgagcggctcggatctggctctcccgtttacctctctgccgttttggagtaccttgctgcagaggttttggagctggcagggaatgctgcgagggataacaagaagaaccggatcgtgcccaggcatattcagctggcggtgaggaatgatgaggaattgagtaaattgttgggcggtgttactatcgctaatggaggcgtcttgcctaatattcaccaaaatttgttgccgaagaagatcgggaaagggaagggcgagattggatcggcatcacaagagttctagggcaaattaaattgttcatctagggttttggtacttccagtttctgatatgtaaatctcattttgtgtaacaactgaatgaagtatatggtcagttgatatattgactagaatcataatcaaattatgatttcttccacagtaatcaattgaaattaatcaccaatctcattggcttgtttgtctaataggatatgaggatgggcaaagaggttcctcatctcaaacctgcctggtttgtctaatagatatggggatgggtaaataggtctttatgaacgttatgtggcttgcgtgccacgctggcgatccgg

SEQ ID NO: 6172 - DNA, 490 bp, Ricinus communis
cacgactcacaaattatttcattctctcgctttcaattcaaaatcaaatcaaaatgagttctacggcaactaatacaccaaagggaggccgaggcaagtccaaggccaaagcagtgtcaagatcatcgaaggcgggtctccagttcccagttggtcgggtcgctcggtttctcaagaaaggaagatatgctcagagagtcgggtctggatcccctgtgtacctctctgctgttcttgagtaccttgctgctgaggtattggagcttgctgggaatgcagcaagagataacaagaagaatagaataataccaagacatattcagcttgcagttagaaatgatgaggaattgagtaagctgttaggtgccgtgactattgctagtggtggagttttgcctaatattcatcagaatttgttgcctaagaagtctgcgaaaggcggcaagggtgaaattgggtctgtttctcaggagttttaggctttccaaat

SEQ ID NO: 6173 - DNA, 722 bp, Cucurbita pepo
ccggaaagtaaaaatgagttctaccgatgttccgactaagggtggcagaggcaagaaatctgccgccaaggcagtctccaggtctcacaaggctggtcttcaattccccgtgggtcgtattgccaggtacctcaagaagggccgttatgcccagcgcgtaggttctggatcaccggtttacctctccgccgtcctcgaatacctcgccgctgaggttttggagttagcggggaatgctgcgagggacaacaagaagaacagaatcattccgaggcatattcagcttgcggtgaggaacgatgaggaattgagcaagcttttgggatcggttacgattgctagtggaggagtaatgccgaagattcatcagtctcttttgccgaagaaggctgggaatgcgaaagacaaggctgaaatcggatcggcctctcaagaattttaggttacggtagaaatcactaccattgatgatgaaatgaaaattaaatacttagattatgttagattgttattagcttcaatcgatcatacttctttcggtatgtaaatttgcgaaacgaatttcgcatagatcaggtttcgtcattgtcgtcgttcaacttttttattgtgtaaatgcggatgaagttcaccgctaatcagaatcgaaagaaactagtcgagttttcaatttcctggaatccgtaaattttcttgcatgccaatccgaaattacgagataa

SEQ ID NO: 6174 - DNA, 587 bp, Flaveria ramosissima
aacatctcaatcgaagacgatggcgacaaaatccgatgcagaaacgaagaaaggaggtagaggaaaacccaaagccacaaaggccgtatcacgatcttcaaaagccggcctccagttccccgtcggcagaatcgcgaggttcctcaaagccggaagatacgcccaacgcgtcggtgccggagctccggtgtacctctccgccgttctcgagtacctcgccgcagaggtgttggagttggcgggaaatgcagcgagggataacaaaaagagtcgaattggtcctaggcatatacagttagcagtgaggaatgatgaggagttgagtaagttgttggggtctgtgacgattgctaatggtggtgttttgcccaatattcattccactttgctgccgaagaaggtgggtaaggagaaaggtgaaattgggtctgcttctcaagagttttgaatgaaagattgtaagggtaggtgttcttgtgtggtacagtggtgctttcttgtgattctgtcttgtttttgttggtcatgggtttagtgtttttggggtttgatttgtaaggtgaatgcggaaagtgatgttagatgtt

SEQ ID NO: 6175 - DNA, 758 bp, Ipomoea batatas
aaatcgatcaacgcgaaaactcaaattatcaaattcaagttcatttcaatcgccatgagttctgcagcagcggaagcgaaatccaccggcggccgcggcaagcctaaagcctcaaaatccgtcactaggtcctcaaaggccggccttcagttccccgtcggcagagtcgctcggtatcttaagaagggccgttatgctcaacgcgtcggctccggttctcctgtctacctctctgctgttctcgaatacctagctgctgaggttttggagcttgctgggaatgccgcaagggacaataagaagaacaggatagtcccaaggcacatccaattggcggtgagaaacgatgaggagtttagcaagctgttaggatctgtgaccatcgccaatggcggtgttctgcccaacattaaccagtgtttgcttcccaagaagaatgctaaagggaagggcgagattggatctatgtcccaggagttttagatcagattaattagttgaagaattagagggcaaagaaatgggaattgtgccaactttttgtttttgaacatttagtgcttcatcaaagtgttaaatgtagatttggtggctgaattgcagttgttaatagaatgtttgatgcttgctttatgaaatgggtgctagtttaacaagtgatgactgacaagtgataactatcaaattgttaatcaatttttttgcctggtgcattgaagatatgatgaaatactattatatcatccctaattcaagcc

SEQ ID NO: 6176 - DNA, 782 bp, Cucumis melo
ttgctactctctccataacgaccaacggatcccttcccaatctcaaccggaaagcagagatgagttctactgaagtttccaccaagggcggcagaggcaggaaagcttccaccaagtctgtctccaggtctcacaaggctggtctccagttccctgtcggccgtatcgccaggtacctcaagaaaggccgttatgcacagcgtgtcggctcaggctccccggtctacctctccgccgtccttgaataccttgccgctgaggttttggagttggcggggaatgctgcgagggacaacaagaagaacagaatcattccaagacatatccagcttgcggtgaggaatgatgaggaattgagcaagcttttgggatcggttacgattgcaagcggaggagtgatgccgaagattcatcaatctcttttgccgaagaaggccgggaatgcgaaagacaaagctgaaatcggatcggcctctcaggaattctaggttatagtagaaatggccattgatgaatagaaaatcaaatagttatttaggttatgttagattttgtcattaacttcaatgaatgggttcattcttcttttggtttgtaaattttgcgaaacgagtttcacttagatttgtatctgttatcatcgccgtcgttcaaattttatgttattcaatgtaaatgctgatgaagttcaacattaatgaaatcgtatgtatttatttgaattatattttcttggaatctgtatgttttctcatggaccaaacaagaactatgagatttgt

SEQ ID NO: 6177 - DNA, 541 bp, Helianthus annuus
taaattaaggtttagcaaaatggcgggaaaatctgatgcagaagcaaagaaaggcggtagaggcaaaccaaaggcttcaaagtgcgtttcaagatcttcgaaagccggtcttcagttccccgtcggtagaatcgctaggtttctaaaggctggacgttatgcacaacgtgtcggcgccggagctccggtctacctctccgccgttctcgagtatctggccgctgaggtgttggagttggctgggaatgcagcgagggacaacaagaagagcagagtaggtccaaggcacatacagttagcggtgaggaacgatgaagagttgagtaaactgttgggatctgtgactattgcaaatggtggtgttcttcccaacattcattccactctgcttcctaagaaagcaggaaaggaaaagggagagatcggttcagcttcacaagagttttaagtaatatggatatattgtttcatgtatgatacagtgtttgggttttggaatagagtgttggtgtttggggttgtaggatgaatgcatttttat

SEQ ID NO: 6178 - DNA, 587 bp, Tabernaemontana elegans
ctttcaaaatttgaagctctgcaaagtcagtctcgaattcgatctccgttctcgttttgttctttgccaccatgagttcaacagcaacagcaaccaagtccaccacaggccgcgggaaacccaaagccaccaaatctgtctccagatcttcaaaagcaggtctccaatttcccgttggcagaattgctcgttacctcaagaaaggtcgttatgctcagcgagttggctccggttcccctgtctatttgtctgccgttctcgaataccttgctgctgaggttttggagcttgctggaaatgcagctagggataacaagaagaatcggatagttccgaggcacatacaattggctgtgagaaatgacgaggaactaagcaagttgttgggtgctgtgacgattgctaatggaggtgttctgcctaatattcatcagaatttgttgccgaagaagactggaaaagggaaggaaattgggtcgcaatctcaggaattttagggatctggaatatttgagggaatgcgaggaattaatctgatcttagtgcttttccgattttggttgatattagaggaatatcttgttaat

SEQ ID NO: 6179 - DNA, 712 bp, Cucurbita pepo
gattcttcgcgaaaatcttctttgctccaaattagtctctcctcaatttcgttacggtaaagtaaatatgagttccaccgatgttccggcgaagggtggcagaggcaagaaatctgccaccaagtccgtcactaggtctcacaaggccggtctccaattcccgtcggccgtatcgccaggtacctcaagaagggccgttatgctcagcgtgttggttccggctcaccggtttacctctccgccgttctcgaatacctcgctgccgaggttttggagttggctggcaatgctgcgagggacaacaagaaaactagaatcgtcccgaggcacattcaactagcagtgagaaacgatgaggaattgagcaagcttttgggatcagttacgatcgccagcggaggagtgctgccgaagattcatcagtctcttttgccgaagaaggccggtagcacgaaggataaggccgagatcggatcggcgtctcaggaattttaggttgcattagaaatatccgtcgattaacagaaaacgaaacagttaggttctgtaagattgttattagcttcaatgaatctttcttcatcaggttcgtaaatctacgaaacgatctttggttagaaaggtatccgtcttcgtcgccgataaattcctatattttgtgtaaatgctgatgaagttcaccactaatttgaatagaaaggaacgagttgaa

SEQ ID NO: 6180 - DNA, 636 bp, Daucus carota
ttcaattcctaaacctatacacacaaacactttgtagtttgtatctatacattttctgagtaatcgcaatcatgagttcaacaggagcaggcaaaggcatcgccggcagaggcaaatccaagggcaccaaatccgtgtcccggtctcagaaagccggtctgcagttcccggtcggtcggatcgcccggttcctcaaagccggccggtacgctcagcgggtcgggtccgggtccccggtctacctctccgccgttctcgaatatctcgctgctgaattgttggaattggcgggaaatgcggcgagagataacaagaagagcaggatcatcccgaggcacattcaattggcggtgaggaacgatgaggagctgagcaagttgttggggtctgtgacgattgcgagcggtggtgttctgcctaatatcaattccgttttgctgcccaagaaagttgcgaaagggaaagatcaaatcggctctgtttctcaagagttttaaggctcttaagttttgtagcccaaagttttaaatgttttgcagctttggggattagttggattgtgaatatggggtttattctgatgcgatgaatcggtttatgctataaatgatgattaatgaaatgattttgtgagag

SEQ ID NO: 6181 - DNA, 602 bp, Daucus carota
ctaaagcacagcggttagggtttgatagtgaaaatacaaatgggcaacaaagagggaaaatccaccggcggcagaggaaagaccgcgccggcgacgaagtcagtctcccgctcttcaaaagccggtcttcaattcccggtcggtcgaattgctcgttttctcaaagccggcaagtactctcagcgtgtcggtgctggtgctcccgtttatctcgctgctgttctcgaatacctcgctgctgaggtgctggaattggcgggaaatgctgcgagggataacaagaagactagggttatcccgaggcatattcagttagcggtgtgcaatgatgaggaattgagcaagcttttggggtctgttacgattgccaatggaggtgtgatgccgaatattcatcagaatttgttgccgaagaaggtgggcaaggggaaaggggacattggctctgcttcgcaggagttctagggttgttgatttcaggctgttttcagtttttgctatatggtactagtgggaatgtagggtgcttttgtgatatatggttgtgttttgaaatgctttggatgaatgtcatgtaaatttgttgatagcttaatggcgaa

SEQ ID NO: 6182 - DNA, 768 bp, Tropaeolum majus
gaagcaaacgaagttcaatacaaatcggtagcaaagccttactcgcatcgtataatccaaacgcaatccaaccaccatgagttcaaccgcagctacagtaaccaaaggaggaagaggtaaatccaaatctgccaaagcagtaaccagatcttcaaaggctggccttcaattccccgttggaagaatcgcaagatacctgaagaaaggccggtatgctcaacgagttggatctggatcacctgtttacctatctgcggttcttgagtatcttgcagcagaggttttggagttggccggtaacgcagcgagagataacaagaagtctcgaatcatccccaggcacatccagcttgctgtgaggaatgatgaagaactgagcaagctgttaggatctgtaaccattgctaatggaggagttttacctaaaatccactccagtctcctacctaagaaaggaggaaaggataagggtgaaatcggaactgtttctcaggagttctagacgtttctcctaggcgtatttgcgaggctagattcattctgttttgactaaattcgatatcacattgtaatgcaatgaagtagtttggttgtaaatcctttacgtcaatggtaacctcaatctttgtttcgatcattcctttattttcaattacagatgatgcttgtatttctactgaagttgaaaaccttttggtatctgtgattagaatgtggaatgaatttatttttatgtcatataggggatacatatttcaattatgaagg

SEQ ID NO: 6183 - DNA, 748 bp, Panax ginseng
aagcagtggtatcaacgcagagtacgcgggggatcactcatcaagcagcattcagaaatctctctctctaaaaccaaaactattatcatcatgaactcaacagcaggcaagggtatagccggaagaggcaaacccaagggcaccaagtcagtttccagatctcagaaagcaggtctacaatttcccgtcggtcgaatcgcccgattcctcaaggccggccgttacgctcagcgaatcggagccggttctccggtgtacttctccgccgtactcgaatacctcgccgccgagcttttggagctagctgggaatgctgcgagggacaacaagaagagtcgaataattccaaggcatattcagttggcggtgaggaatgatgaggagttgagcaagttgttgggaactgtgaccattgcgaatggaggggttttgcctaatattcattcgacactgctgccgaacaaggttgggaaagggaagggtgagattggctctgtttctcaagagttttagggttttgaatctctgcttttagatttgtagaagaaatggaaggtggaaattgggttttgcggaatcacaagtttgttaatagtgggatatgtagaggtagaattctacagtaaatgagataatatttttgttgttaaaatgatcaatgaaaatatctctgttttcttccattgtgcattctcgtgttgaatttaaattctaatatggaaattcgttgaaatgttttcacagtaaa

SEQ ID NO: 6184 - DNA, 591 bp, Secale cereale
cggcggcgggaggggcaagccgaaggggagcaagtcggtgtcgcggtcggtgaaggcgggcctgcagttcccggtgggccgcgtggcccggcacctcaaggtcggccggtacgcgaagcgcgtgggcgcgggcgcccccgtctacctctgcgccgtgctcgagtacctcgccgccgaggccctggagctggccggcaacgcggcgcgcgacaacaagaagacccggatctcgccgcgccacatccagctcgccgtccgcaacgacgaggagctcagccggctgctcggcggcgtcaccatcgccgccggcggcgtcctgcccaacatccactccgtgctcctccccaagaaggtcggcaaggccgccggcaccggcgggtccgcctcccagtcccaggagttctagagcgccagaggtctgtgtatggcgtggtgatggtgttttaggttggtagattagttcttcttggccaatgttcttgttggttcatgtatcgagagtggatctggttggaaatggaatgcatctggttctgctgtctgtgatgtgtccatggtagtaatctgaatgaaacggattttgttttgctc

SEQ ID NO: 6185 - DNA, 688 bp, Rosmarinus officinalis
acccagatttcattcaccaatttcaaattttaaaaatccctccgaaaaagaattaaccaaaatcatgggcgaaaaggcagcgaagaccatcggcggccgtggcaagcctaaatcgaagtcggttgccagatctgcgaaggctggcctccagttccccgtcggccggattgctcgtttcctcaagaaggggcgctacgctcagcgcgtcggatccggatctcccgtctatctctccgccgtcctagagtatcttgctgcggaggttttggagcttgctggaaatgcggcgagggacaacaagaagactaggatagttccgaggcatattcaattggctgtgcgtaacgatgaggagctggggaggctgctggggtctgtgacgattgccaatggcggtgttttgcccaacattcaccggactttgctgccgaagaaggctggtgatggcaaaggaaagggggaaatcggatccctgtctcaggaattctagggcaatcactttgttactttatgatgtagttgtagatgttttgtgtcgatagaatttttccaatagctgaagaaatgtcctttttgttgatatagataagattatcttggtcttatgtattgtgatttaacattgttaaatccttttgaattatatgaaaagatattagattttgtgtctattctattatgattgttg

SEQ ID NO: 6186 - DNA, 666 bp, Rosmarinus officinalis
acccagatttcattcaccaatttcaaagtttaaaaatcccaccgaaaaagaattaaccaaaatcatgggcgaaaaggcagcgaagaccatcggcggccgtggcaagcctaaatcgaagtcggttaccagatctgccaaggctggcctccagttccccgtcggccggattgctcgtttcctcaagaaggggcgctacgctcagcgcgtcggatccggatctcctgtctatctctctgccgtcctcgagtatctcgctgcggaggttttggagcttgctggaaatgcggcgagggacaacaagaagactaggatagttccgaggcatattcaattggctgtgcgtaacgatgaggagctggggaggctgctggggtctgtgacgattgccaatggcggtgttttgcccaacattcaccggactttgctgccgaagaaggctggtgatggcaaaggaaagggggaaatcggatccctgtctcaggaattctagggcaatcacgttgttactttatgatgtagttgtagatgttttgtgtcgatagaatttttccaatagctgaagaaatgtcctttttgttgatatagataagattatcttggtcttatgtattgtgatttaacattgttaaatccttttgaattatatgaaaagatattagattctgc

SEQ ID NO: 6187 - DNA, 685 bp, Panax ginseng
agtggtatcaacgcagagtacatggggatctctcatcaagctgcattcagaaatctctctctctctctaaaaccaaaactattatcatcatgaactcaacagcaggcaagggtatagccggaagaggcaaatccaagggcaccaagtcagtttccagatctcagaaagcaggtctacaatttcccgtcggtcgaatcgcccgattcctcaaggccggccgttacgctcagcgaatcggagccggttctccggtgtacttctccgccgtgctcgaatacctcgccgccgagcttttggagctagctgggaatgctgcgagggacaacaagaagagtcgaataattccaaggcatattcagttggcggtgaggaatgatgaggagttgagcaagttgttgggaactgtgaccattgcgaatggaggggttttgcctaatattcattcgacactgctgccgaacaaggttgggaaagggagggtgagattggctctgtttctcaagagtttttagggttctgaatctctgctttttagatttgtagaagaaatggaaggtggaaaatggggtttttggggaatcacaagtttgttaatacttaatagttggatatgtagaggtagaattctacagtaaatgagataatatttttgttgttaagatgatcaatgaaaatatctctgttt

SEQ ID NO: 6188 - DNA, 866 bp, Arachis hypogaea
cccctatcccctgtgtgccttggcagtctcaggcagtggtatcaacgcagagtacgggggacacaaaatttaaatcccgaattcgcatctgtcatcaaaatcccgcgccatgggttcttcagaagcagcagcaacaaccaacaagggcggaagaggcagacccaaatcctcaaagtccatttccagatcttccaaggccggcctccaattccccgtcggccgcgtcgctcgatacctcaaggttggccgttatgcccaacgggttgggtccgggtcacccgtttacctctccgccgtactcgaatatctcgccgccgaggttctggagcttgccggaaatgctgcgagagacaacaagaagactaggattattccgaggcacattcagcttgcggtgaggaacgatgaggaattgagcaagctcatgggatctgtgaccattgcgagtggtggagttctgccgaatattcaccagaatttgttgcctaagaaggttgctggtggaaagggcaaagccgagattggatctgctagtcaggagttctaggtgcataacatagaggattgcttagattattgggaattgggactgtttcaatgatgtaaaggttctttgtgatttggataaaggaaagttattcttggtttagaaggactataatggacttagcacaaaaatgttatttatttaaaagttatgaagaattagtttattaatattttgaagggctaccatactagtagacaaacgaagtcacgtagaattgtagaaattcttgattatattctccctcttgaaaattgttttgagttggcatgaaatgaaaaaacgtctcctttactccttaaaaaaaaaaaaaaaaaaa

SEQ ID NO: 6189 - DNA, 719 bp, Lippia dulcis
cacgcatccaaaatattctctgcgaattcaaattttcagtaatccctccaaaaccagtgaattcaccaataatcatggtcgagaaagccgccgcaaccaaaaccaccgccggccgtggcaagtctaagacgaaggccgtctcaagatcttcaaaagccggacttcagttccccgtaggcagaatcgcccgtttcctcaagaagggccgttatgccgaacgtgtcggttctgggtctccggtgtacctctccgccgtccttgaatacctcgccgctgaggttttggagctcgccggaaacgctgccagggataacaagaagaacagaatcataccgaggcatattcagttggcggtgaggaatgatgaggagttgagcaagctgttggggtcagtgaccatcgcaaacggtggcgtgttgcctaatatcaaccagactctgctgcccaagaaagccggttccggtaaaggaaagggggaaattggatccgtatctcaggaattttagggcaactacgcttgatttgttgttagacagaaggtttttttggttggtaggtcaatttaggatcgcttttgttgatagaatctaagatttctatggcttcatcaatggtcataatgcgatgttgatatgcttttattaagtgaaaacgattgcattatttgtttctccaattacatgtctcgattcaaattctggttttattctaaaaaagaa

SEQ ID NO: 6190 - DNA, 735 bp, Sesamum indicum
atccggagattcccgaataggacaactcaaccgaactcttgtaagcatattcaaatctcagaatcactccagaaaaataaaagaatttctccagagatcatgggtgaacaaattccggcaacgaagtccgtcggaggccggggcaaggctaaatccaaggcagtctctagatcatccaaagccggcctccagttccccgttggccgaatcgcccgtttcctcaagaaaggccgttatgctgaacgtgttgggtctggctcgccagtttacctttccgccgtcctcgagtacctcgccgccgaggttttggagctcgctggaaatgcggcgagggataacaagaagaatcggattattccgaggcatattcagctggctgtgaggaatgacgaggagttgagcaagctgctcggatctgttacaatcgcgaacggcggcgtgttgcctaatattcatcagaatcttctgccgaagaagacaggtgctggtaaaggaaagggtgaaggcggatctgtttctcaagaattttagttgtatctgcgcttaggttcttcttagatatctagtttagtagttgttttggtggttggaacttggaatcgtcatttcagaagaaaatgaatattttgttgatatgatcatgatgtaaagtttgtgggcatttggttgacatgatcacgaatatttaccaactcttctctatttctgattcattttgctagcagttgaaagtag

SEQ ID NO: 6191 - DNA, 1172 bp, Glycine max
aaacgagagcgagagagagaaagaaatggcgaccaacattgggatcatggatgcggcttacttcgtcggcagatctgagattctttcttggatcaactcaactctgcaactcaatctctccaaagtcgaagaggcttgttccggcgccgttcattgtcagcttctcgatgccgctcatccagggatcgtgcctatgcacaaggtcaatttcgacgccaagagcgagtacgagatgattcagaactacaaggtccttcaagatgtcttcaacaaactcaaaatcaccaagcacatcgaggtcagcaagctggtgaaaggaaggccactggataacctcgagttcatgcaatggatgaaacgatactgcgattctgtcgattccggccttcagtacaattataatcctctggagaggagagaggtttgcaaaggaggaagagaaacgagcaagaaatctgcaaactcccaagcctcaaccaagggttctactgcacagagacctcattcttctcataatgctcgaagaaatgaggtttctaatgcaaaccctacaaatcaggctgcaaaggttgcgagagcagcaccttctgctggaaaccctgctcctgtgtatgaagaaaagataacagagttgaagttgtccattgatagccttgagaaggaacgagatttctacttcgcaaagctgagagatattgagatactgtgccagactcctgagatagaacactcaccgattgttgcggcaatacagaagatattatatgctacagatgacaatggaatggctgtggtcgaagctcaagctatgatttctgttggtcgtaaggaaatagagggattaagccccattgctgaggtttcggaggagaagagcagttcagaaactcataagagaaagaatattgccaatattgattttgatgttgctggcctcgcaacgttgtctcccagacagaggctttctgatgtttcagatgttcattgtagcgagtcacctcttatgacttgttagggaggaggaaggatcaccttctgttgttaattcagttagcaacatgttaaaaccgttttggtcacagtaattcctgttacaagtgtgaattgacagggttattcataatggttaggggttttagggagactattctgttatcaagtatcaagtatcg

SEQ ID NO: 6192 - DNA, 1541 bp, Glycine max
atggtgaaagtgaaagaaatggagatggattgtagcaagaaatgggattttgaatttgaaatactaccgctcccgtctccatatatatcctttctttgtgaaagagccgttagaagaaacgagagcgagagagagaaagaaatggcgaccaacattgggatcatggatgcggcttacttcgtcggcagatctgagattctttcttggatcaactcaactctgcaactcaatctctccaaagtcgaagaggcttgttccggcgccgttcattgtcagcttctcgatgccgctcatccagggatcgtgcctatgcacaaggtcaatttcgacgccaagagcgagtacgagatgattcagaactacaaggtccttcaagatgtcttcaacaaactcaaaatcaccaagcacatcgaggtcagcaagctggtgaaaggaaggccactggataacctcgagttcatgcaatggatgaaacgatactgcgattctgtcgattccggccttcagtacaattataatcctctggagaggagagaggtttgcaaaggaggaagagaaacgagcaagaaatctgcaaactcccaagcctcaaccaagggttctactgcacagagacctcattcttctcataatgctcgaagaaatgaggtttctaatgcaaaccctacaaatcaggctgcaaaggttgcgagagcagcaccttctgctggaaaccctgctcctgtgtatgaagaaaagataacagagttgaagttgtccattgatagccttgagaaggaacgagatttctacttcgcaaagctgagagatattgagatactgtgccagactcctgagatagaacactcaccgattgttgcggcaatacagaagatattatatgctacagatgacaatggaatggctgtggtcgaagctcaagctatgatttctgttggtcgtaaggaaatagagggattaagccccattgctgaggtttcggaggagaagagcagttcagaaactcataagagaaagaatattgccaatattgattttgatgttgctggcctcgcaacgttgtctcccagacagaggctttctgatgtttcagatgttcattgtagcgagtcacctcttatgacttgttagggaggaggaaggatcaccttctgttgttaattcagttagcaacatgttaaaaccgttttggtcacagtaattcctgttacaagtgtgaattgacagggttattcataatggttaggggttttagggagactattctgttatcaagtatcaagtatcgggtatcgggtatcagcccagaaaaatgtagccagatatattttgcctttagaatttgcttgttgtctcaacaatgtttctgaatccagtcatgtaatttctggctagtgctttgagcaacactatttcattttcagcatttttttcatttattatgtgatgatcaaattgtttacaattcagggaaaattacatatcggaatttgtaattaatttctgaattcggtcttttttctgaatccagtcatgtagtt

SEQ ID NO: 6193 - DNA, 1462 bp, Cajanus cajan
aatcatccacaagggattttgaatttgaaatactcccgctcccgtctccatatatatgcgaacccttttttctttgcgagagagccgttataagagaacaaaacagaacagagaatccagaaagaaagaagaagaagaggaaactagaaatggccaccaacatcgggatcatggatgcggcctacttcgtcggcagatctgagattctttcatggatcaactcaactcttcaactcagtctctccaaagtcgaagaggcttgttccggtgcggttcactgccagcttcttgatgccgctcatccagggatcgtgcctatgcacaaagtcaatttcgacgcaaagaacgagtacgagatgattcagaactacaaggtccttcaagatgtcttcaacaaactcaaaatcaccaagcacatcgaggtcagcaagctcgtgaaaggaaggccactggataacctggagttcatgcaatggatgaaaagatactgcgattccgtcaattcaggacttcagcacagttataatcctatggagaggagagaggtttgcaagggaggaagagaaaccagcaagaaagctgtaaactctcaatcctcaaccaagggttctgctgcacagagacctcagtcttctcataatgctcgaagaaatgaggtttctaatgcaaaccctacaaatcacgctgcaaaggttaccaaaccttctgctggtggaggccctgtgtatgaagaaaagataacagagttgaagttatccattgatagccttgagaaggaacgggatttctactttgcgaaactgagagatattgagatactgtgccagactcctgagatagaacactcactgattgttggggcgatacagaagatattatatgctacagatgacgatggaacggctgtggctgaagctcaagctatgatttctgttggtcacaaggaaattgagggattgagccccattgctgaggtttcggaggagaaatgcagttcagaaactcataagaggaagaatattgcgaatattgattttgatgttgctggcatcgcaaatttgtctcccagacagaggctttctgatgtttcagatgttcactgtagcgagtcacctcttatgacttgttaaggagggatgtgtcaccttatgttgttaattaaattagcaacttgttaaattgttttggtcacagtaattcctgtttcatgtttgaattgacagggataatataatgattaggggttcttctagggagacaattctgttatcaacttatcgtttatgaatatgatatatcagcccagagaaatgtgttcatgatttagatatcttttgctttatagagtttgcagctgtctcaagtctcaatttttatttttttttctgaatccagttttcagtaatttctggcttgtgtgccttgattagcactatttcgttttttcaggattcttttattt

SEQ ID NO: 6194 - DNA, 1422 bp, Phaseolus vulgaris
cgaacgttgcgttgattccttattaagattgcgttgagaccgttaatcaccaaccaggggattttgaatttgaaaaactcccgctccagtgtccatatatatgccacctctgtttctttgtgaaagagccgttaacagtacacaaaagagtatccagaaggagaagaagaaacgagagagagagagaaatggcgaccaacattggaatcatggatgcggcttacttcgttggcagatctgagattctttcttggatcaactccactctgcaactcagtctctccaaagtcgaagaggcatgttccggcgctgttcactgccagcttctcgatgcggctcatcctgggatagtgccgatgcacaaagtcaatttcgatgccaagaacgagtacgagatgattcagaactacaaggtccttcaagatgtctttaacaaactcaaaatcaccaagtacatcgaggtcagcaagctcgtgaaaggaaggccactggataacctagaattcatgcaatggatgaaaagatactgcgattctgtgaattccggacagaacaattataatgctttggagaggagagaggtttgcagaggaggaagagaaacgagtaagaaatctgcaaactcccaagcctctactaagggttctacttcgcagagacctcagtcttcccacaattctcgaagaaccgaggttctaaatgcaaatccaacaaatcaggctgttaaggtcgcgagagcgccaattgctgcaggtggccctgcttatgaggaaaagataacggagttgaagctgtccatcgatagtcttgagaaagaacgggacttctacttcgcaaaactgagagatattgagatactgtgccagactcctgagatagaacactcaccgatcgttgaggcgattcagaagatattatatgccacagatgatgatggaacggctgtggctgaagctcaagccttactttctgctggtcataaggaaatagaggggttgagtccaatcgctgaggtttctgaggagaaaagcagttcagaaactaacaagagaaagaatatttccaatattgattttgatgctgctggcatcgcaacgttgtctcccagacagaggctttctgatgtttcggatgttcactgtagcgggtcacctcttatgacttgttaaggaatgagggaagcgtcgttaatttcaattagcaacttgttcaactgttttggttctgtttcttgtgtgaattgacagggatattataatgaatgattaggggttctagtatggttctgtgaagttatgaaaaatatagccagatatattttgccttgtagaatttgcagttgtcatcaacaaattgttgtcatcaagtaatttctggtcgttagccctattacattttcagctttttttcattagtttgcga

SEQ ID NO: 6195 - DNA, 1484 bp, Cicer arietinum
gcgacgtttccttaggccatgtttgtttccactaaaaccctcaatgagttaattttgaattcgtaaaatcccgctccaacttctataaatatttgaacttatttttttttttttattagagagagagccgttagagaaaaagaataagaagaaaaagaaaagcacagaacgttaagagaagaagaagaaaaaatggcgacaaacattggaattatggacgctgcatacttcgttggtagatctgagatactcgcttggatcaattcaactcttcaactcaatctctccaaagtcgaagaggcatgttcaggtgctgttcactgccagcttcttgatgccgctcatcctggaatcgtgccgatgcataaggttaatttcgatgctaagaatgagtatgaaatgattcagaactataaggtgcttcaagatgtattcaataaactgaaaatcacaaagcacattgaggtgaacaagctagtgaaaggaagaccactggataatctagagttcatgcaatggatgaaaagatactgtgattccgttaattccggacagcacaattataatcctttggagaggagagaggtatgcaaaggaggaagggaagtgagtaaaaaatctgcacactctcaaccctcaaacaagggtggttctactgcacagaggcctccatcttcccatgctcgaaggaatgatgtttcgtctactggaaaccctgcaaatcaagctgcaaaagtaacaaggccttcacctgctgctgctgctgcacctgcatatgatgaacagataacaggattgaagttatctattgatagccttgagaaggaaagagatttctactttgcaaaacttagagacattgaaatactctgtcagactcctgggatagagcattcaccggtttttgcagcaatacagaagatattgtatgctacagatgacaatggaaatgagttggctgaagcacaggctatgatttctggttgtttgcaggagccagagccattgagccctattgctgaggtttctgaggagaagagcagctctgaaactcacaagagaaagattattaccaatcctgagtttgatgctgctggcagcgctaatttgtctcctagacaaaggctttctgatgtttcggacgttcaccatagcgggtcacctctcatgacttgttaaagaaggaaaattagaggagtactgttttggttactgtaatttctgattatgtgttgagtgacaataattgtgacaattatatgtgggttctagtcttttatgtcatgaatatggtatatggtatatgttgatccagaaatatagctatgattatgcttggacttagcactattttatttttcattatttgtgttgatcactcaatttgcatataatcatgaattgtttgatcaagactgaagggttttatcaatggccgtgccatagcccatagatataataatgcttaccaatttcaacgcgac

SEQ ID NO: 6196 - DNA, 1404 bp, Lupinus angustifolius
atattccaaggagccgttagtagatagcgatagcagaatacagagatagaagaaaaccataacaacaatggcgaccaacattgggatcatggattcggcttacttcgttggaagatctgagattctcgcttggatcaattctacacttcaactcaatctctccaaagttgaagatgcttgttctggtgcggttcattgccagcttctagatgcggctcatccagggacggtgcctatgcacaaggtcaatttcgatgctaagaacgaatatgatatgattcagaattacaaggttcttcaggatgtctttaacaaactcaaaatcaccaagcacatcgaagtcagcaagttagtgaagggacgaccattggataacctggagttcatgcaatggatgaaaagatattgcgattctgtcaattctggacttcaccacaattacaatcctgtggaaaggagagaagtatgcaagggaggaagagaaactaccaagaaatctgcacagtcccaagcctcaaccaaggcttctacaacatccagacctcactcttctcataatgctcgaaggaatgatggatcttctgctgccaacgctagaaatcaggcacccaaggttactagcacaaggccttcttctgctggaggccctgcatatgatgaacagataactgggttgaagttatcagttgatagccttgagaaggaacgagatttctacttcgcaaaacttagagatattgagatactttgccagattcctgagatagaacagtcaccggttgtagcagcaattcagaagatactgtatgctactgatgatgatggaacagctgtggctgaagctcaagctatgatttctggtggacagaaggaggctgaacaattgagccccattgctgaggcttcagaggagaaaagctgttcagaaactcggaagagaaagatcattgccaatcttgactttgatgctgctggcaccacaaatttgtctcctagacaaaggctttctgatgtttcagatgttcattgcagcgagtcacctcttatgacttgctaaagagggagctagtaacttttgttgtcaatgcaattgtcaatttgaaaactatttttggtcacaatcattactgatttatggcacggattgctgtaatgatattgagttgttttagaaagactattatgtttcgaacatggtatatagtatatgtcaaccctgaaatatgtagtcataattaaggatctactttatagaacttatagttgtgtcattttagaatccagtattttggtgtgtacttcatctgcacctttttccagcatttttatagcttgcaaattgaaaccatttgcaatttgcaacaaattatatctgtatttgagtaaggaatttttcgttgttca

SEQ ID NO: 6197 - DNA, 1247 bp, Trifolium pratense
gaaagaaacaaagcgaagcagagaaaatggcgacgaatatcggaatcatggacgctgcttacttcgtcggtagatctgaaattatttcttggatcaattcaactcttcaactcaatctctccaaagtcgaagaggcgtgtaccggtgcggttcattgtcagcttcttgatgccgctcatcctggaattgttccgatgcataaggtgaattttgatgctaagaatgagtatgaaatgattcagaattataaggtgcttcaagatgtcttcaacaaactcaaaatcactaagcatattgaggttagcaagctagtgaaaggaagaccgctggataatctggagttcatgcaatggatgaagcgatactgcgattccgtcaattctggacagcacacttataatcctttggagaggagagaggtatgcaaggggggaggaagagaagtgagtaaaaaatctgcacactctcaaccctcaaacaagggtggttctacttcacacaggcctcaaccttcccatgctgctcgaagaaatgatgtgtctactgcaaaccctgcaaatcatgcggctgcaaaagccacaaggcctcctgctgcagctgtatcccctgcatatgatcaacagataacggaattgaagctatccatcgatagtcttgagaaggaaagagatttctactttgcaaaactgagggatattgagatactttgtcagactcctgaagttgaacattcaccggtttttgcagcaatacagaagatattgtatgctactgatgacaatggatctgagttagcagaagctcaagctatgcttactgctggtctacaggaacccgagccgttgagccccatcgctgaggtttctgaggagaaaagttctgaaactcacaagagaaagaattttgccaatccggaggttgatgctgctggcgtctccaatttgtctcctagacgaaggctttctgatatttcgaatgttcaccatagcgagtcacctcttatgacttgaaggaacattaaaggaggaagaaaactgttttgtttacaatactttcttaagtcatgtgttaagtgacaatggtttttataatgattaggggtttctagagagactattatgtcaagaatatggtatatggctatttgcctgcagaacttttggttgtctcaactattttgtattttaaaatccagaaatatagctatggttcgggctttatgcttcgattttggcactattttattt

SEQ ID NO: 6198 - DNA, 1244 bp, Trifolium pratense
gaaagaaacaaagcgaagcagagaaaatggcgacgaatatcggaatcatggacgctgcttacttcgtcggtagatctgaaattctttcatggatcaattcaactcttcaactcaatctctccaaagtcgaagaggcttgtactggtgcggttcattgtcagcttcttgatgccgctcatcctggaattgttccgatgcataaggtgaattttgatgctaagaatgagtatgaaatgattcagaattataaggtgcttcaagatgttttcaacaaactcaaaatcactaagcatattgaggttagtaagcttgtgaaaggaagaccgctggataatctggagttcatgcaatggatgaagcgatactgcgattccgtcaattctggacagcacacttataatcctttggagaggagagaggtatgcaagggaggaggaagagaagtgagtaaaaaatctgcacactctcaaccctcaaacaagggtggttctacttcacacaggcctcaaccttcccatgctgctcgaagaaatgatgtgtctactgcaaaccctgcaaatcatgcggctgcaaaagccacaaggcctcctgctgcagctgtatcccctgcatatgatcaacagataacggaattgaagctatccatcgatagtcttgagaaggaaagagatttctactttgcaaaactgagggatattgagatactttgtcagactcctgaagttgaacattcaccggtttttgcagcaatacagaagatattgtatgctactgatgacaatggatctgagttagcagaagctcaagctatgcttactgctggtctacaggaaccagagctgttgagccccattgctgaggtttctgaggagaaaagttctgaaactcacaagagaaagaattttgccaatccggaggttgatgctgctggcgtttctaatttgtctcctagaagaaggctctcagatgtttccaatattcaccatagcgggtcacctcttatgacctgaaggaaaattaaaggaggaagaaaactgttttgcttacaataatttcttagtcatgtgttaagtgacaatgttttttgtaatgattagggggtttctaaagagactattttgtcatgaatatgatatatggttaggggtttctaaagcgactgttgtgtcatgaatatgatatatggttaggttatgttgatccagaaatatagctattttctattttaaaatccagtgtgattt

SEQ ID NO: 6199 - DNA, 1368 bp, Trigonella foenum-graecum
attgaaatatcccgctccttcctctatatatactattcaaactcattttcatatcagagatagccgttagagaagaaagaagaaaacaaaagcaaaacgcaaaagcgaagcagagaaaaatggcgacgaacattggaataatggacgctgcatacttcgtcggtagatctgaaatcctctcttggatcaattcaactcttcaactcaatctctccaaagtcgaagaggcttgttctggtgcggttcattgtcagcttcttgatgccgctcatcctggaatcgttccgatgcataaggttaattttgatgctaagaatgagtatgagatgattcagaattataaggttcttcaagatgttttcaacaaactcaaaatcactaagcatatcgaggttagcaagctggtgaaaggaagaccgttggataacttggagttcatgcagtggatgaaacgatactgcgattccgtcaattccgggcagcacatttataatcctttggagaggagagaggtatgcaggggaggaggaagagaagtgagtaaaaaatctgcacactctcaaccctcaaacaagggcggttctacttcacacaggcctcctcaatcttcccacactgctcgaaggaatgatgtgtctactgcaaaccatgcaaatccagcagctgcaaaagtcgcaaggcctgctgccgccgccgctgctgctgctgcagcccctgcatatgatcaacagataacggaattgaagttatccattgatagtcttgagaaggaaagagatttctactttgcaaaactgagggatattgagatactttgccaaactcctgaagttgaacattcaccggtttttgctgcaatacagaagatattgtatgctactgatgacaatggatctgagttagctgaagctcaagctatgcttactgctggtttacaggaatcagagccattgagccctattgctgaggattctgaggagaagagcagttctgaaaatcacaagagaaagaattttgccaatcctgaggttgatgctgctggtgtcgaaaatttgtctcctagacgaaggctttctgatgtttcgaatgtccaccataacgggtcacctcttatgacctgaagtaaaaattaaaggaggatgaaaactattttggttataatgtgttaagtgacaatgttatttgtaatgagattaggggctctagagagactattatgtcatgaatatggtatatgttaatccagaaatatagctatcagtacatgtcaatccagaaatatagctatgactatggtcatagccttgcagattttataaattgtcccaacgattattgattttaaaatccagcgtaattccttggctt

SEQ ID NO: 6200 - DNA, 1246 bp, Trifolium pratense
aaaacgaaatacacgaaaactcagaacgaaagaaacaaaccgaagcagagaaaatggcgacgaatatcggaatcatggacgctgcttacttcgtcggtagatctgaaattctttcatggatcaattcaactcttcaactcaatctctccaaagtcgaagaggcttgtactggtgcggttcattgtcagcttcttgatgccgctcatcctggaattgttccgatgcataaggtgaattttgatgctaagaatgagtatgaaatgattcagaattataaggtgcttcaagatgttttcaacaaactcaaaatcactaagcatattgaggttagtaagcttgtgaaaggaagaccgctggataatctggagttcatgcaatggatgaagagatactgcgattccgtcaattctggacagaacagttataatcctttggagaggagagaggtatgcaaggggggaggaagagaagtgagtaaaaaatctgcacactctcaaccctcaaacaagggtggttctacttcacacaggcctcaaccctcccatgctgctcgaagaaatgatgtgtctactgcaaaccctgcaaatcaggtggctgcaaaacccacaaggccttctgctgctgctgctgtagcccctgcatatgatcaacagataacggaattgaagctatccattgatagtcttgagaaggaacgggatttctactttgcaaaactgagggatattgagatactttgtcagactccagaagttgaagattcaccggtttttgcagcaatccagaagatattgtatgctactgatgacaatggatcggagttagcagaagctcaagctatgcttactgctggtctacaggaagcagtgccgttgagccccatcgctgaggtttctgaggagaagagttctgaaactcacaagagaaagaattttgccaatccggaggttgatgctgctggcgtttctaatttgtctcctagaagaaggctctcagatgtttccaatattcaccatagcgggtcacctcttatgacctgaaggaaaattaaaggaggaagaaaactgttttgtttacaataatttcttagtatgtgttaagtgacaatggtttttgtaatgattagggggtttctaaagagactattttgtcatgaatatgatatatggttaggggtttctaaagcgactgttgtgtcatgaatatgatatatggttaggttatgttgatccagaaatatagctat

SEQ ID NO: 6201 - DNA, 3332 bp, Glycine max
gggaagagtgggagcaacgggtgagtgaaaagtgtgagaaaatgtctaaccctcaagaccagaaaccatggaaagcggaatacgcgaagtctgggagatcttcatgcaggacgtgcaagagccccattgccagcgaaacgctgcgtctcgggaagatggttcaatccaccaaattcgatggcctcgtgcccatgtggaaccatgctgcttgcgtattgaagaaagccaatcagataaaattagttgaagatgttgaaaacttagagtcacttcgttgggaagatcagcagaagatcagaaaatacatagagagtggcggcggtggcggcagcagcagtggcgggggcagcgcggcaaagtcagactccaagactgtcaaagatactaaatgtggtattgaagtttcacaaaattctcgtgccacatgcaaggattgcggtcaaaaaattatcaaaggagaggttcgtatatctactaagcaaggtggtcaaggtgctaaaggtttggcttggcaccatgccaagtgtctcatcgatctgtcaccatcaattgaagtggataagttatctggatggaacaatctctcatcttctgatcaatcagctgtcattgacttcgctaaaaagggtggtagtgatacaaaaattgagactgaggagggtaaagaatccacaccacaacaaacttccaaaggtggcataaaacgggggaaggatgttgatagtgagcggaaatcaaaagttgctaaggccaagggagatgtgtctgtgggcagcgcaatgtcagtgaaatcaggggaagcatgtgatctggagaagaaaatggagacccaaagcaaagaactctgggatttgaaggacgatctcaaaaagcacgttacaacaacagagttgcgtgaaatgttggaagccagtggtcaagattcaacaggatcagaacttgatttacgtgaccgctgtgctgatggaatgatgtttggagcacttgatctttgcccaatatgttctggctttctgcgttactctggaggaatgtaccggtgccatggatacatttccgagtggagtaaatgttcttactctacctgtgaaccaaaacgtattgaagggaagtggaaaatcccaaaagaaacaaataatcagtaccttaaaaagtggttcaaatctcaaaaagggaagaaaccagttaggatattgcctcttccatcaccaaggaaatctgctgaaagtcaaatgattgctagtcagcatcaatcatcaaatagtggaaatttacgagatttgaaagttgctatctgtggattacctaatgactctattgcggaatggaaatgcaaaattgatggcatatgtgggatgtttcatgcaaaagtaaataaagatactaactgcttggtggttggtggatcactcaattatgaagctgagatgcggaaggcaaggaggatgaaaataccaatagtcagagaggactatttgattgactgcttagcaagaaagaaaaggcttccatttgatatgtacaaggttgaaatgattggtgaggcttctagcatggtcaccattaaagtgaagggacatagcgctgttcacgaggcttctggcctacaggattccggccacatacttgaggaagggaaaagcatatataacacaactttgaatatgtctgatttgtctactggtattaacagctactacattctccagataatccaagaagataaggggtcagattgctatgtgtttcgtaaatggggccgagttggaaatgacaagattggaggaacaaagctggaggaaatgtcaaaatctgatgcagtatgtgaattcaaacgattattctatgagaagactggaaacccttgggacgcatgggaacaaaagactatccagaagcaacctggaagatttttcccattggatattgactatggagttaacaaacaggtctcaaaaaaggaaaaaaatgatgtcgacagcaaactacctcctccattaatagaattgatgaagatgctctttaatgtggaaacatacagagctgccatgatggaatttgagatcaatatgtctgaaatgccacttgggaaattgagcaaaagcaacatccaaaaggggtttgaagcattgacagagatacaaaatctgttaaaaattagcaatcccgatccatcagtcaaggaaagcttacttattaatgccagcaatcggttcttcaccatgatcccttctgttcatccacatattattagggatgaggatgactttaagtccaaggtgaaaatgttagaagcccttcaagacattgaaattgcctcaagattagttggatttgatgccaacaatgatgattccattgatgataattataagaagcttcactgtgatatatctccacttcctcatgatagtgaagagttttgtttaattgagaagtttctccataatactcatgcccccacacatacggactggagtcttgagctagaagaagttttttcacttgaaagggaaggtgaatttgataagtttgctccttacagggataaacttggaaacagaatgctcctatggcatggttctaggttgacaaactttgtgggcattcttagccaaggactcagaattgcacctcctgaagcccccgcgactggctatatgtttggcaaaggggtttactttgctgacctggtcagcaaaagtgctcagtattgcttcactgataagaaaaatcctgttggtctaatgcttttgagtgaagttgcacttggaaatgtctatgagctcaagaaagcgaagtatatggataaacctcctgaaggaaagcactctactaaaggactgggcaagaaaatgcctcaggaatcagaatatgtaaagtggaggggcaatgtcactgttccttgtggcaaaccagttccatcaaatgtcaagagttctgagctcatgtacaatgagtatattgtttataatactgctcaagttaagatgcaattcttgttgaaggtgaggtttcatcacaagagatgaggactggtgagaagtttgctgttctggggtatcatctatactaagctgttttttgaccatgacttgtacgtagtccatctgggacatctgggattttctagaattgtctttggtaaggtctcattttgagttgataggagatctttctacgtttttttttaggacatgtaagtccaggaatctatctagttgaaactcgccacttagaacagaaatatcccatgcaatttgtgatctggttatctgtatagaactattattttaatctcaaactttttattgagctcttccatttttagt

SEQ ID NO: 6202 - DNA, 4371 bp, Glycine max
aatccatttcaggaatgtacatgccactgataacgcaatttgtcagatcaaaaactattccaattggacgatgcaaggatcaaacaaatattgcctagcctagcagaaacaaattaaataacgatcatcgcgatttgacgaagcttcttaggagaataaatttcaaagtctgattcaagccagtgatctatactaaccgtctagtattcatggctcgcgagatcgtccaatctctgttctcaggaacacaattatagcaacggataattcaaatagatgaacacggaaagtacagaagccaataaagtgcagaaaaaaaaaaatcagatccgaaggaatatcggaaagttgtgagcgcacctgcggagggaatcggaactttgattttgctacgaaactaagcagaacgctgaagaaacgaggaattagggacaataatattatataatttaatattcttacggcgggatcggattcgctgagtgaggagaaactgcctctgagttatggttatggattcgtggaacgacgtcgctttagtgtcctcggagatggagaagttcctgtgcgagttgttgctggattcctcccagccaatttctgagcgcttcagagcattcttctctctccgcaacctcaaaggcgcctccactcgcaacgctcttattctcggttggtctctccctcccttcacaaccctaacctaactaagcagattcgtattcttcaactcatcattttagccacaagggattcgtcgaatttgttggcgcacgaagctgcatttgcgttgggtcatatgcaggaattggaagccatccctgctttggcctcagttctcaatgatctttctttgcatcacattgttcgccatgaggcagctgaggctctgggtgctattggttcagatggtaatgttcctctcctgaaaaatagtttggattcagatccggccgaggaggttcgagaaacatgtgaattggctcttgaacgaattcagaatttaaaagatgctggtaatactgatgtgttgctgcgaatgatgtatctacttttatgtctgttgatccagctgcaccagcgacccctgacaagtgcttattgatgaagaaacaagggatgtatgagcgctatgcagctctttttgcacttcgtaatgacggtggaaatgatgctgttgctgctattattgattccttgggctcaaaaagtgctctactgtgccatgagatgtggaaccatgctgcttgcgtattgaagaaagccaatcagataaaattagttgaagatgttgaaaacttagagtcacttcgttgggaagatcagcagaagatcagaaaatacatagagagtggcggcggtggcggcagcagcagtggcgggggcagcgcggcaaagtcagactccaagactgtcaaagatactaaatgtggtattgaagtttcacaaaattctcgtgccacatgcaaggattgcggtcaaaaaattatcaaaggagaggttcgtatatctactaagcaaggtggtcaaggtgctaaaggtttggcttggcaccatgccaagtgtctcatcgatctgtcaccatcaattgaagtggataagttatctggatggaacaatctctcatcttctgatcaatcagctgtcattgacttcgctaaaaagggtggtagtgatacaaaaattgagactgaggagggtaaagaatccacaccacaacaaacttccaaaggtggcataaaacgggggaaggatgttgatagtgagcggaaatcaaaagttgctaaggccaagggagatgtgtctgtgggcagcgcaatgtcagtgaaatcaggggaagcatgtgatctggagaagaaaatggagacccaaagcaaagaactctgggatttgaaggacgatctcaaaaagcacgttacaacaacagagttgcgtgaaatgttggaagccagtggtcaagattcaacaggatcagaacttgatttacgtgaccgctgtgctgatggaatgatgtttggagcacttgatctttgcccaatatgttctggctttctgcgttactctggaggaatgtaccggtgccatggatacatttccgagtggagtaaatgttcttactctacctgtgaaccaaaacgtattgaagggaagtggaaaatcccaaaagaaacaaataatcagtaccttaaaaagtggttcaaatctcaaaaagggaagaaaccagttaggatattgcctcttccatcaccaaggaaatctgctgaaagtcaaatgattgctagtcagcatcaatcatcaaatagtggaaatttacgagatttgaaagttgctatctgtggattacctaatgactctattgcggaatggaaatgcaaaattgatggcatatgtgggatgtttcatgcaaaagtaaataaagatactaactgcttggtggttggtggatcactcaattatgaagctgagatgcggaaggcaaggaggatgaaaataccaatagtcagagaggactatttgattgactgcttagcaagaaagaaaaggcttccatttgatatgtacaaggttgaaatgattggtgaggcttctagcatggtcaccattaaagtgaagggacatagtgctgttcacgaggcttctggcctacaggattccggccacatacttgaggaagggaaaagcatatataacacaactttgaatatgtctgatttgtctactggtattaacagctactacattctccagataatccaagaagataaggggtcagattgctatgtgtttcgtaaatggggccgagttggaaatgacaagattggaggaacaaagctggaggaaatgtcaaaatctgatgcagtatgtgaattcaaacgattattctatgagaagactggaaacccttgggacgcatgggaacaaaagactatccagaagcaacctggaagatttttcccattggatattgactatggagttaacaaacaggtctcaaaaaaggaaaaaaatgatgtcgacagcaaactacctcctccattaatagaattgatgaagatgctctttaatgtggaaacatacagagctgccatgatggaatttgagatcaatatgtctgaaatgccacttgggaaattgagcaaaagcaacatccaaaaggggtttgaagcattgacagagatacaaaatctgttaaaaattagcaatcccgatccatcagtcaaggaaagcttacttattaatgccagcaatcggttcttcaccatgatcccttctgttcatccacatattattagggatgaggatgactttaagtccaaggtgaaaatgttagaagcccttcaagacattgaaattgcctcaagattagttggatttgatgccaacaatgatgattccattgatgataattataagaagcttcactgtgatatatctccacttcctcatgatagtgaagagttttgtttaattgagaagtttctccataatactcatgcccccacacatacggactggagtcttgagctagaagaagttttttcacttgaaagggaaggtgaatttgataagtttgctccttacagggataaacttggaaacagaatgctcctatggcatggttctaggttgacaaactttgtgggcattcttagccaaggactcagaattgcacctcctgaagcccccgcgactggctatatgtttggcaaaggggtttactttgctgacctggtcagcaaaagtgctcagtattgcttcactgataagaaaaatcctgttggtctaatgcttttgagtgaagttgcacttggaaatgtctatgagctcaagaaagcgaagtatatggataaacctcctgaaggaaagcactctactaaaggactgggcaagaaaatgcctcaggaatcagaatatgtaaagtggaggggcaatgtcactgttccttgtggcaaaccagttccatcaaatgtcaagagttctgagctcatgtacaatgagtatattgtttataatactgctcaagttaagatgcaattcttgttgaaggtgaggtttcatcacaagagatgaggactggtgagaagtttgctgttctggggtatcatctatactaagctgttttttgaccatgacttgtacgtagtccatctgggacatctgggattttctagaattgtctttggtaaggtctcattttgagttgataggagatctttctacgtttttttttaggacatgtaagtccaggaatctatctagttgaaactcgccacttagaacagaaatatcccatgcaatttgtgatctggttatctgtatagaactattattttaatctcaaactttttattgagctcttccatttttagt

SEQ ID NO: 6203 - DNA, 3521 bp, Cajanus cajan
ggaaaagcgatagaagagaaagtagttattaaaaagaaaagaaaacaaaaaataagagagtaaaagtaaaaggagggaagagaagagtgggagtgagtgagagaaaatgtcgaaccctcaaaatcagaaaccatggaaggcggaatacgcgaagtcggggagatcatcatgcaggacgtgcaagtcccccattgccagcgaaacgctgcgtctcggcaagatggttcagtcgtccaaattcgatggcctcatgccgatgtggaatcatgctgcttgcatattgaagaaagccaatcagataaaattagttgaagatgttgaaaacatagaatcgcttcgttgggatgatcagcagaagatcagaaaatacatagagagtggcactgggactgggactgggactgggagcgggagcgcgtcaaagtcaaattcaaaggctgtcaaagatactgaatgtggtattgaagtttcacaaacttctcgtgctacttgcagggattgcggtcaaaaaatcatcaaaggagaggttcgaatatctaccaagcctgatggtcaaggtgctagaggattggcttggcaccatgccaagtgtcttgtggaactatcaccatcaattcaagtggataaattatctggatggaatagtctctcatcttctgatcaatcaactgtcagtgacttggctaagaagggtcattctctgactaaggggggtggtagtggtataaacatcaagactgaagagggtaaagaatccacacaacacacttccaaaggtggcataaaacggggcaaggatgctgatggtgaacggaaatcaaaggttgctaaggccaagggagatgtgtctgcaagcagcacagcatcagtaaagaatgaaccaggggaagcacgggacctggaaaatagactggaggcgcaaagcaaagaactctgggctctgaaggatgatatcaaagagcatgtgacaacagcagagttgcgtataatgctggatgccaatggtcaagattcaactggatcagaacttgatttgcgtgaccgctgtgctgatggaatgatgtttggaggacttggtctttgcccaatatgttctggctttctgcgttactctggaggaatgtaccggtgcaatggatacatttccgagtggagtagatgttcttactctacctgcgaaccaaaacggaatgaaggaaagtggaaaatcccagaggaaacaaataatcagtaccttaaaaagtggttcaaatctcaaaaagggaagaaaccagttaggatattgcctcttccatcaccaaggaaatctgctgaaagtcaaattactgctagtcagcatcaatcatcaaacactgaaaatttgcaagatttgaaagtttctatctgtggattacctaatgactctattgaggaatggaaatgcaaaattggaggtataggtggggtgtttcatgcaaaagtaaagaaagatactaactgcttggtggttggtggaacactcaatgatgaagctgagatgcggaaggcaaggaggatgaaaataccaatagtcagggaggactatttgattgactgcttagaaagaaagaagagacttccatttgatatgtataaggttgaaatgattggtgaggcttctagtatggttacaattaaagtgaagggtcacagtgctgttcacgaggcctctggcctacaggattctggccacatacttgaggaagggaaaagcatatataacacaactttgaatatgtctgacttgtctactggtattaacagctactacattctccagataatccaagaagataaggggtcagattgttatgtgtttcgtaaatggggtcgagtgggaaatgacaagattggaggaagtaaactggaggaaatgtcaaaacctgatgcagtctgtgaattcaaacgattattctatgagaaaactggaaacccctgggaggcgtgggaacaaaagactattcagaagcaacctggaagatttttcccattggatattgattatggagttaacaaacaggtctcaaaaaagaaaaaaaatgatgctgacagcaaactaccccctccattaatagaattgataaagatgctcttcaatgtggaaacatacagagctgccatgatggaatttgagattaatatgtctgaaatgccacttgggaaactgagcaaaagcaatattcaaagggggtttgaagcattgacagagatacagaatctgttaaaaaatggcaatcctgatccatctgtcaaggaaagcttgcttattaatgccagcaaccggttcttcaccatgatcccttctattcatccacatattataagggatgaagatgattttaagtccaaggtgaaaatgttagaagcccttcaagacattgagatagcctcaagattggttggatttgatgccaacagtgatgactccattgatgataattataagaagctccactgtgatatatctccactttctcatgatagtgaagatttttgtttaattgagaaatttctccataatactcatgcccccacacatacggactggagtcttgagctagaagaagttttttcacttgaaagggaaggtgaatttgataagtttgctccttacagggaaaaacttggtaacagaatgctcctatggcatggctctaggttgacaaactttgtgggcattcttagccaaggactcagaattgcacctcctgaagccccggcaactggctatatgtttggcaaaggagtttactttgctgacctggtcagcaaaagtgctcagtattgctacactgataagaaaaatcctgttggtctaatgcttttgagtgaagttgcacttggaaatgtctatgagctcaagaaagctaagtatatggataaacctcctgaaggaaagcactctactaaaggactgggcaagaaaatgccacttgaatcagaatatgcaaagtggaggggcgatgtcactgttccttgtggcaaaccagtgccatcaaatgtcaagagttctgagctcatgtacaatgagtatattgtttataatactgctcaagttaagatgcaattcttgttgaaggtgaggtttcatcacaagagatgaggattggagagaagtttgcggttctggggtatcatctatactaagcagttttttgaccaagacatgtacgaattgtcttggtaaggtctcattttgagttgactggagatctttcaagccttttttttggacatgtaagtgcagggatgtatctagttgaaacccatcacttctagcagtaatttctcatgcaatttgtgatctggttatctgtatataacctctattttagccttaaacttgtagcgagctcttccagtgtagtatgcgttgcatcagtagtggtgcttttattttttataaacacatcagtcaattttattttatttttaatcttactgcagtctagtattttttcagataggtatgcataaatagcagaagagctattttccttgct

SEQ ID NO: 6204 - DNA, 3377 bp, Phaseolus vulgaris
aagaagaaaaaggagggaagagtgggagtgtggagtgagtaagagaatgtcgaaccctcaagatcagaaaccatggaaggcggaatacgcgaagtcggggcgatcgtcatgcaggacgtgcaagaaccccattgccaccgaatcgctgcgtctcggcaagatggtcaaatccttcaagttcgatggcatcatgcccatgtggaatcatgctgcttgcgtcttggagaaagccaatcagataaaattagttgacgatgttgaaaacttagagtcgcttcgttgggaagatcagcagaacatcagaaaatacatagagagtggcggcagcagcagcactgccacaaaatcaggctcaaaagatgtcaaggaaactgaatgtgctattgaagtttcgcagacttctcgtgctacttgtagggattgcagtcaaaaaattatcaaaggagaggttcgtatatctactaagcctgatggttcaggcgcaagaggtttggcttggcaccatgccaagtgtctcatggaattatcgccatcaattcaagtggataagttatctggatggaatagtctttcatcttctgatcaatcagctgtcagtgacttcgctaacaagggtcatccgatgaacaaggggggtgttagtggtacaaacattgagactgaaaagggtgaagaatccacacaactacacacttccagaggtggtataaaacgagggaaagatgccgacagtgagcgaaaatcaaaagttgctaaggtcaagggagatgtgtccgccagcagtgcagtgtcagtgaaaaattataatgaaaccggggaagcatgtgatctggagaagaaaatggaaatccagagcaaagaaatctgggctctgaaggatgatctaaaaaagaatgtgacaacaccagagttgcgcgaaatgctggaagccaatgatcaagattcaacaggatcagaacttgatttacgtgaccgctgtgctgatggaatgatgtttggagcacttggtctttgcccaatatgttctggatttctgcgtcactctggaggaatgtaccgttgcaatggatacatttccgagtggagtaaatgttcttactctacctgcgaatcaaaacgtgttgaagggaagtggaaaatcccagaagaaacaaagaatcaataccttaaaaagtggttcaaatctcaaaaagggaagaaaccagttaggatattgcctcttccatcaccaagaaagtctgctgaaagtcaaattactgctagtcagcatcaatcatcacactctgaaaatttccgagatatcaaagttgctatctgtggattagctaatgacactattaaggaatggaaaagcaaaattagtgccatgggtggaatgtttcatgcaaaagtaaagaaagatactaactgcttggtggttggtggagtgctcaatgatgaagctgagatggggaaggcaaggaggatgaaaataccaatagtcagagaggactacttgattgactgcatacaaagaaagaagagacttccatttgatatgtacaaggttgaaatgattggtgaggcttctagcatggtcaccattaaagtgaagggacaaagtgctgttcatgaggcttctggcctacaagagtctggccacatacttgtggaagggaaaagcatatataacacaactttgaatatgtctgatttgtctactggtattaacagttactacattctccagataatccaagaagataaggggtcagattgctctgtgtttcgtaaatggggtcgagtaggaaatgacaagattggaggaagtaaactggtgaatgaaatgtcaaaatctgatgcaatctgtgaattcaaacgattattctttgtgaagactggaaacccttgggaggcatgggaacaaaagactattcagaagcaacctggaagatttttcccactggatattgattatggtgttaacaaacagatgtcaaaaaagaaaagaaatgacaatgacagcaaactacccgtgccattaatagaattgattaagatgctcttcaatgtagaaacttacagatctgccatgatggagtttgagattaatatgtctgaaatgccacttgggaaactaagcaaaagcaatatccaaaaggggtttgaagcattgacggagatacagaatctgttaaaaacgactagtccggatccatcagtcaaggaaagcttacttattaatgccagcaaccggttcttcaccatgatcccttctattcatccacatattattagggatgaggatgattttaagtccaaggtgaaaatgttagaagcccttcaagatattgaaatagcctctcgattagttggatttgatgccaacaacgaggactcaattgacgatagttataagaagcttcactgtgatatatctccacttcctcatgatagtgaagatttttgtttaattgaaaagtttctccataatacacatgcccctactcatacggactggagtcttgagctggaagaagttttttcacttgaaagggaaggtgaatttgataagtttgctccttacagggataaacttggaaacagaatgctcctatggcatggttctaggttgacaaactttgtgggcattcttagccaaggactcagaattgcacctcctgaagcccccgcgactggctatatgtttggcaaaggggtgtactttgctgacctggtcagcaaaagtgcccagtattgcttcactgataagaaaaatcctattggtctaatgcttttgagtgaagttgcactcggaaacatctatgagctcaagaaagctaagtatatggataaacctcccgaaggaaagcactctactaaaggactgggcaagaaaatgcctcaagaatcggaatgtgcaaagtggagaggcaatgtgactgttccttgtggcaaaccagtgccatcaaatgtcaaggcttctgagctcatgtacaatgagtacattgtttataatactgcccaagttaagatgcagttcttgttgaaggtgaggtttcatcacaagagatgagcactgtgagaagttttgctgttttggggtgtagtatatactatgcagttttttgacctgacttgtacgtagtctatctggctttccctagaattgtctaaggtctcattttgagttgactggagatctttcaaccttttttggggcatgtaagtgcagggattatctagttgaaactcatcacttctagctgaattatcccatgcaatttgtgatccggttatctgtatagattcgctattttaatcttaaacctgttttctcaaccttttttagtatgcattgcatcaggataggtgcttttatcttatttaaaacacaa

SEQ ID NO: 6205 - DNA, 3920 bp, Cicer arietinum
cctaaaactagtataagcaaaccctgaaagggatagtgagagtgagagtgtgagaaaatgtcgaaccctcaaagccagaagccatggaaagcagagtacgcgaaatcaggacgatcgtcatgcagaagctgcaagactcccattgccaccgagaaactccgtctcggcaagatggttcaatcctccaaattcgacggcctcatgcccatgtggaatcatgcggaatgcatattgaagaaacccaaacagataaaatcagttgatgatgttgaaaacttagagtcgcttcgttgggaagatcaacagaatatcagaaaatacatagagagcagcggcggcggcagcggcggcggcagcggcggcggcacaacaaagtcgaacacccctgcaaagtcgaatgctggcaaaaatgttgaatatggtattgaggtttcacaaacttcacgtgccacttgcaagccttgtggtcaaaaaattatcaaaggagaggttcgcatatctactaagcctgatggtcaaggtcctaggggtttggcttggcaccatgccaagtgtctcttggaactatctccatcaattgaagtcgatagtttgtctggatggaatagtctctcatcttctgatcaatcagctctcagtgatttggttatgaagggccgtcctactaataagggaggtggtagtggtacaaaagtagaggttgaagaggttaaagaatcaacaaaacaatcctcttccaaaggtggcacaaaacgggggaaagaggctgagggtgagcagaagtcaaaagctgctaaggtcaagggagatgtgtctgtgggcagggtagcggccatgaaaaatgctgatgactcgggggaggcatctgatcttgagaaaagactggaggcccagagcaaagaactctgggatctaaaggatgatcttaaaaagcacgtgacaacagcagagttgcgtgaaatgctggaaaccaacggtcaagattcaactggatcagagcttgatttgcgcgatcgctgtgctgatggaatgatgtttggaggactttctcattgctcattatgttctggttttttgcgttattctggaggaatgtaccggtgcactggattcatttctgagtggagtaaatgttcaaactctacctgtgaaccaaaacgtactgaagggaagtggagaatcccaaaggaaacagataatcagtaccttaaaaagtggttcaaatctcaaaaagggaagaaaccaattaggataatgcctccgccgtcgtcaaggacttctgctgaaagtcaaatttctgcaggccagcatcaatcatcgcacagtgaaagtttggcagatttgaaagttgccatctctggattacctaaagattcctttgaagactggaaacgcaagattgatggtgtgggtggagtgcttcatgcaaaagtgaagaaagatactaactgcttggtggtcagtggagcacttaaggatgaagctgagatgcggaaagcaaggaggatgaaaataccaatagtcagagaggactatttggttgactgtatggaaagaaagaaaaaacttccatttgatatgtacaaagttgaaatgattggtgaggcttctagtatggtcaccatcaaagtgaaggggcacagtgccgttcatgatgcttctggcctacaggattctggccacatactagaggaagggaaaagcatatataatacaactttgaatatgtctgatttgtctactggtgttaacagctactacatccttcaaataattgaagaagataaagggtcagattgttatgtgtttcgaaaatggggtcgagtgggaaatgagaagattggaggattcaaactggaggaaatgtcaaaatctgacgcaataagagaattcaaacgactattctttgagaaaactggaaacccttgggaggcatgggaacaaaagactattcagaagcaacctggaagattcttccccttggaaattgattatggagttaacaaacaagtctcaaaaaagaataaaaataatgcagatagcaaactaccccctccattaatagaattgatgaagattctctttaatgtggaaacatacagagctgccatgatggaatttgagatcaatatgtccgaaatgccacttgggaaactgagcaaaagtaatatacaaaaggggtttgaagcattaacagatattcaaaatctttttaaaattagcaatcctgatccatcagccagggaaagcttgcttattgatgccagtaatcggttcttcactatgatcccttccattcatccacatattattagggacgaggatgattttaagtcaaaggtgaaaatgttagaagcccttcaagacattgaaatagcctcaagattagttggatttgatgccaacaatgacgactccattgatgataattataagaagctccattgtggtatatctccacttcctcatgacagtgaagattttcgattagttgagaagtatctacatactactcatgccccaacacatgtggactggagtcttgagctagaagaagttttttcacttgaaagagaaggagaatttgataagtttgcaccttatagggacaaacttggtaacagaatgctcttatggcatggttctaggttgacaaactttgtgggcattcttaaccaaggactcagaattgcacctcctgaagctcctgcaactggctatatgtttggcaaagggatttactttgctgacctggtcagcaagagtgctcagtattgctacactgataagaaaaatcctgttggtctaatgcttttgagtgaagttgctcttggaaatgtctatgagctcaaaaaagctaagtatatggataaacctccagaaggaaagcattctacaaaaggattgggcaaaaaaatgccccttgaatcggaatatgtaaagtggagaggtgatgtcgttgttccttgtgggaaaccagtgtcatcaaatgtcaaggcatctgagctcatgtacaatgagtttattgtctataatactgctcaagttaaactgcaattcttgttaaaggtgaggttccatcacaagaaatgagggttggaactagaggtgtgctgttttggggtatcatctgtatgaagcagttttttttaccaggacttgtacatactccatgtggaattcttgtaaattctcttgataaggtctcattttgagttgactggagatctttcattgtttgttttgggggtttgttagtgcagggatctagttgaagctcgtctcttagagcagaaatctcatgccagatctagttgtgtatacatagaaccaccagtttaatatcaaacttgttatcaacttcttccctttccatattgcatttcaacttgcatcaatctagtaacttggcaggccaaatatctaagaacgaatatgtagctaatggagctattatggttgttgtggagacttattttattgcacaagatattatgtgatctgcatgtgtgtcacttgaaaggtgatgttaaccaatgcataaataaatgttggactacatgactcaatcagtttttggagctatatggtggcaagaacttttgaattcaggtggctcttagctatataggggactcttctttgatacaaacagacatttctttaagttataagtatgacaaacaaactttcatgtttcaatttttctgctttgtatgatgcatgagtcatatgtgtgtctctgctgcttaggggctcatcttacatcactttgtactagctaatgcaacctaccaaatacagctggtctttggtgtgatgaatagcccgttggaaacttatttattgtttgttttggtgttttctgatggtatttcatctgaatctaattgaagtattttgactttctaactcataat

SEQ ID NO: 6206 - DNA, 3430 bp, Medicago truncatula
gagaggagagagagagtggtagttccgagttggaggagtgtgttcgtgtgagaatcttttattcttcaatgtcgaaccctcaaaacgcgaagccatggaaagcagagtacgcaaaatcaggtcgttcgtcatgcagaagctgcaagagtcccattgcaaccgagaagcttcgtcttggcaagatggttcaatcctccaaattcgatggcctcatgcccatgtggaatcatgctgagtgcatattgaagaaagccaaccagataaaattagttgatgatgttgagaacttagagtcgcttcgttgggaagatcagcagaagattagaaagtacattgagagcggtggtggtggtggtagtggcacaccgaagtcgaatgctgcctctaagtcgactgctggaaaaaatattgaatatggtattgaagtttcgcaaacatcacgcgccacttgcaaacattgtggtcaaaaaattatcaaaggagagattcgcatatctactaagcctgatggtcaaggtgccaggggtttggcttggcaccatgctaagtgtctcttggaactatctccatcaattgaagtggataatttgcctggatggaatagtctctcatcatctgatcaatcggctgtcagtgagttggctacaaaagaccatcctacaaatagaggaggtggtagtggtacaaatgtcgaggctgaagatgttaaagaatccacacaacaatcctcttccaaaggtggcactaaacgggggaaagatgcagagggtgagcaaaagtcaaaggccgctaaagtcaagggagatgtgtctgcgagcagggtagcggcagtgaaaaatgctgatgactccggggcggcacgtgatcttgagaatagactggaggcccagagcaaagatctctgggctctgaaggatgatcttaaaaagcatgtgacaacagcagagatgcgtgaaatgctggatgccaatggtcaagattcaacaggatcagagcttgatttgcgtgaccgctgtgctgatggaatgatgtttggaggacttagtccttgctctctatgtgatggttttctgcgttattctggaggaatgtaccggtgcactggatacatttccgagtggagtaaatgttcctactctacctgcgaaccaaagcgtgcccaagggaagtggaaaatcccaaaggaaacagataatcagtaccttaaaaagtggttcaaatctcaaaaagggaagaaaccaactaggatattgcctccgccatcatcaaggacttctgctgaaagtcaaatttctgcaggccagcaccaaccatcaaacagtgaaactttggctgatttgagagttgccatctctgggttgcctgaagattccattgtggaatggaaacgtaaaattgatgccgtaggtggagtgcttcatgcaaaagtgaagaaagatactaactgcttggtggtcagtggagcgcttaaggatgaagttgagatgcggaaggcaaggaggatgaaaataccaatagtcagagaggactatttggtagactgtatggaaagaaagaagaagcttccatttgatatgtacaaagttgaaatgattggtgaggcttctagcatggtcaccatcaaagtcaaggggcaaagtgctgttcatgatgcttctggcctacaggattctggccacatactagaggaagggaaaagcatatataatacaactttgaatatgtctgatttgtctactggtattaacagctactacatcctgcaaataattgaagaagataatgggtcagattgctacgtgtttcgcaaatggggtcgagtgggaaatgacaagattggagggaacaaactggaggaaatgtcgaaatctgatgcaatcagggaattcaaacgactattctttgagaaaactggaaacccttgggaggcctgggaacaaaagactattcagaagcaacctggaagattcttccccttggaaattgattatggagttaacaaacaagttgtgaaaaagagtaaaaacaatgctgacagcaaattaccccctccattaatagaattgatcaagatgctctttaatgtggaaacatacagatccgccatgatggaatttgagatcaatatgtccgaaatgccactcgggaaactgagcaaaagtaatatccaaaaaggttttgaagcattaacagatatacaaaatctttttaaaagcagcaatgctgatccatcagtcagggatagcttgctcattgatgctagcaataggttcttcactgtgatcccttccattcatccacatattattagggatgaggatgattttaagtcaaaggtgaaaatgttggaagcccttcaagatattgaaatagcctcaagattagtgggatttgacgccaacaacgacgactccattgatgataattataagaagcttcactgtgatatatctccacttcctcatgacagtgaagattttagattagttgagaagtttctacatactactcatgcccccacacatacggactggagtcttgagctagaagaagttttttcacttgaaagagaaggtgaatttgataaatatgccccttacagagacaaagttggcaacagaatgctcctatggcatggttctaggttgacgaactttgtgggcattcttaaccaaggactgagaattgcacctcccgaagcccctgcaactggttatatgtttggcaaagggatttactttgctgaccttgtcagcaagagtgctcagtattgcttcactgataagaaaaatcctgttggtctaatgcttttgagtgaagttgcccttggaaatgtgtatgagctcaaaaaagctaagtatatggataaacctccgcaaggaaagcattctactaaaggactgggcaagaaaatgcccctggaatctgaatatgcaaagtggagagatgatgtcgttgttccttgtgggaaaccggtgtcatcaaatgtcaaggcatctgagctcatgtacaatgagtatattgtttataataccgctcaagttaaactgcaattcttgttgaaggtgaggttccatcacaagagatgaggatggaaactagaggtgtgctgttttggggtatcatctgtacgaagtagttttttgacaaggacttgtacatagtccatgtgggattctcgtaacttctcgtgataaggtctcattttgagttgactggagatctttcaccttttttattttttgggtgtgtttgttagtgcagggatctagttgaaactcgtcgtgtagagcagaaatctcatgcatgatctggttatgtgtatatagaactgctagtttaacatcaaacttcttgttatcaagttcttccctttgaatgtgttcacgttaagtgtgtttaccttctaaaaaacattaatgaagcttct

SEQ ID NO: 6207 - DNA, 3355 bp, Lupinus angustifolius
agagtacatgggggagtttgagttttgagaaatggcgaatcttcagaatcaaaagccatggaaagcagaatatgcaaaatctggaagatcatcatgtagaacttgcaagtcacccattgcttcagaggatcttcgtcttggaaaaatggttcaatccaccaaattcgatggcctcatgcccatgtggcatcatgctacttgcatattgaagaaagccaaccagataaaagaaactgatgatgttgaaaacttggagttgcttcgttgggaagatcagcagaagatcagaaaatacatagaggatggtggtggcagtagtgctccatcaaaatcaaaagccaccaaagatggtggtagtgctccaccaaaatcaaatgccaccaaagatgctgaatgtggtattgaagtttctcaaacttctcgtgctacttgcagggattgtggccaaaaaattatcaaaggagaggttcgcatatctattaagcctgatggtcaaggtgctagagggttagcttggcaccatgccaagtgtctcatggaattatcaccatcaattcaagtagataagttgtctggatgggatagtctctctccttctgatcaatcatctgtcagtgatttggctaagaagggaggtagtagtgctacaaacgttgaggccgaagaggttaaagaatccacttccaaaggtggcatgaaacgtgggaaggatgctgatggtggacagaaatcaaaagttgctaaggccgagggagatgtggcggcgagcaggacagcatcagtgaaaaatgctaatgattcggaggaggcacgtgatttggagagtagactggagacccagagcatagaactctgggctctgaaggacgaacttaaaaagcatgtgacaaatgcagagatgcgtgaaatgctggaagccaatgatcaagactcaagcggatcagaactggatttgcgtgaccgctgtgctgatggaatgatgtttggaggacttggtcattgcccaatatgtgctagttttctgcgttattccggaggaatgtaccggtgcactggattcagttctgagtggagtaagtgttcctactctaccactgaaccaaaacgtcttgaagggaagtggaaaatccctgtggaaacaaccaacgagtttcttaaaaagtggttcaaatctcaaaaagggaagaaaccagttcgggtattgcctcttcaatcaccaaagaagcccgtggatggtcaaactagtgcttcccagcatcaatcatcaaatagtgaaagtttgagggatttaaaaatttctatttgtggattacctaaagactctattgtggaatggaaacgcaaaattgatgacataggtgcggtgtttcatgcaaaagttaagaaagatactaactgcttggtggtcagtggaacactcaatgatgaagctgagatgcgaaaagcaaggaggatgaaaataccaatagttcgagaggactatttggttgactgtatagagaaaaagaagaagcttccatttgatatgtacaaagttgaaatgattggtgagtcttctagcatggtcaccatcaaagtgaagggacaaagtgctgttcatgatgcttctggactagcagattccggccacatactagaggaagggaaaagcatatataatacaacgttgaatatgtctgatttatctactggtgttaatagttactacgttctccaaattatcgaagaagataagggatcagattgctatgtgtttcgtaaatggggtcgagtgggaaatgacaagattggaggaagcaaactggacggaatgccgaaatcagatgcaatccatgaattcaaacggttattctttgagaagactgcaaacccttgggaggcttgggaacaaaagactattaagaagcaacctggaagattcttcccattagatattgattatggggttaacaagcaagtctcgaagaaaaagagtaacaatgaagacagcaagctagccccaccgttaattgagttgatgaaaatgctcttcaatgtagaaacatacagagctgccatgatggaatttgagatcaatatgtcagaaatgccacttgggaaacttagcaaaagtaacatccaaaaggggtttgaagcattaacagatatacagaatctgttaaaaactgacaatcctgatccgtcaatgttggaaagcttgcttattgatgccagcaatcggttcttcacaatgatcccttctattcatccacatattattagggatgaggatgatttcaagtcaaaggtgaaaatgttagaagcccttcaagacatcgaaatagcttcaagattagttggatttgatgccaataacgatgactcaattgacgataattataagaagctcaactgtgatatatctccacttcctcatgacagtgaagattatcgtttaatagagaagtttctccataatactcatgcccctacacatacagaatggagtcttgagttggaagaagtttttgcactcgaaagggaaggggaatttgacatgtttgttccttacagggagaaacttggtaacagaatgctcctatggcacggttctaggatgacaaattttgtgggcatccttagccaaggactcagaattgcacctcccgaagccccagctactggctacatgtttggtaaaggggtttactttgctgatctggtgagcaagagtgctcagtattgcttcactgataagaaaaatcctgttggcctaatgcttttgagtgaagtcgccctcggaaatgtctatgagctcaacaaagctaagtacatggataaacctccccgtggaaaacactcgactaaaggactgggcaaaaaagtgcctaatgaatcggaatatgcaaagtggaagggtgatgtcactgttccttgcggcaaaccagtgccatcaagtgtcaaggcttcggagctcatgtacaacgagtacattgtttataataccgcacaagttaagatgcaatttttgttgaaggtgaggttccatcacaagagatgaggattggaactagaattttgctattttggtgtgtcatctgtttgctcatcttcgattcccgaaaattgtcttagtaaggtctcgtcctcgattgcagttatgtcgcgtttatcataattacagaaaatattgtcgcaattatggtcgtgatgcagttacgaactgcaatttaaaatcatgcagtggagttttttcaacttttttgtgtgcagggatctagttgaaacttgtcacttgttggagttgtggtctggttatgtatagaaccactgttttaatctcatgctttatatcaactggctcttcaatttttta

SEQ ID NO: 6208 - DNA, 3515 bp, Trifolium pratense
gcaggagcgaggagggaggggatagtgggagtgagagagtgtgagaatgtcgaaccctcaaaaccagaagccatggaaagcagagtacgcgaaatcgggtcgttcatcatgcagaacctgcaagattcccattgcaagcgagagtctccgtcttggcaaaatggttcaatcttccaaattcgatggtctcatgcctatgtggaatcatgctcagtgcatattaaagaaagccaaccagattaaatcagttgatgatgttgaaaacatagagtcgcttcgttgggatgatcagcagaagattagaaaatacattgaaagtggtggtggtagtgggggtggtacgccgaagtcgaatgctgcctcaaagtcgaatgctagcaagaatattgaatatggtattgaagtttcgcaaacttcacgtgctacttgcaagcattgtggtcaaaaaattatcaaaggagaggttcgcatatctgctaagcctgatggtcaaggtgccaggggtttggcttggcaccatgccaagtgtctcttggaactatctccatcaattcaagtgaataatttgtctgggtgggatagtctctcatcttctgatcaatcagttgtcggcggtttggctaggaaaggacatcctacgggtaaggtggtagtagttcaaatgtcgaggtggaagaatccacattgcaaccctcttccaaaggtggcacaaaacgggggaaagatgcagagggtgagcaaaagtcaaaagctgccaaaatcaagggagatgtgtctgtgggcagggtagcaacaggaaaaaatgctgatgactcaggagagacacgcgattttgagaatagactggagacccagagcaaagatctatgggctttgaaggatgatcttaaaaagcatgtgacaacaacagagttgcgtgaaatgctggatgccaatcgtcaaggctcaacaggatcagagcttgatttgcgtgatcgctgtgctgatggaatgatgtttggaggacttagtcattgcccactttgttctggttttctgcgttattccggaggaatgtaccggtgcaccggatacatttctgagtggagtaaatgttcctactctacctgcgaaccaaagcgtactgaagggaagtggaaaatcccaaaggaaacagataatcagtaccttaaaaagtggttcaactctcaaaaagggaaaaaaccagttaggttattgcctccgccatcgtcaaggacttctgctgaaagtcaaatttctgcaggccagcatcaaccatcgaacagtgaaagtttgtcagatttgaaagttgccatttctggattacctaaagaatctattgaggaatggaaacacaaaattgatgccataggtggagtacttcatgcaaaagtgaaaaaagatactgactgcttggtggttagtggagcgcttaaggacgaagctgagatgcggaaggcaaggaggatgaaagtaccaatagttagagaggactatttggttgactgtatggaaagaaagaagaagcttccatttgatttgtacaaagttgaaatgattggtgaggcttctagcatggtcaccatcaaagtgaaggggcaaagttctgttcacgatgcttctggcctacaagattctggccacatactagaggatgggaaaagcatatataatacaactttgaatatgtctgatttgtctactggtattaacagttactatatccttcaaataattgaagaagataaagggtcagattgctatgtgtttcgtaaatggggtcgagttggaaatgacaagattggagggtccaaactggaggaaatgtcaaaatctgatgcaattagggaattcaaacgactattctcagagaaaactggaaatccttgggaggcctgggaacaaaggactattcaaaagcaacctggaagattcttccccttggaaattgattatggagttaatagacaagtctcaaaaaagaatagaaacaataccgacagcaaactaccccctccattaatagaattgatcaagatgctctttaatgtggaaacatacagatctgccatgatggaatttgagatcaatatgtccgaaatgccacttgggaaattgagcaaaagtaatatccaaaagggttttgaagcattaacagatatacaaaatctttttaaaagtagcaatcctgatccatcattgagggatagcttgcttattgatgctagcaatcggttcttcaccatgatcccttccattcatccacatattatcagggatgaggatgattttaaatcaaaggtgaaaatgttagaagcccttcaagacattgaaatagcctcaagattagttggatttgatgccaataatgatgactccattgatgataattataagaagctccactgtgatatatctccacttccccatgacagtgaagattttcgattagttgagaagtatctacatactactcatgcccccacacatacggactggagtcttgaactagaagaagttttttcacttgaaagagaaggtgaatttgataaatatgctccttacagggacaaagttggtaacagaatgctcctatggcatggttccaggctgacaaactttgtgggaattcttaaccaaggactcagaattgcacctcccgaagcccctgcaactggctatatgtttggcaaagggatttactttgctgaccttgtcagcaagagtgctcagtattgcttcactgataagaaaaatcctgttggtctaatgcttttgagtgaagttgcccttggaaatgtgtatgagctcaaaaaagctaagtatatcgataaacctccacaaggaaagcattctactaaaggactgggcaagaaaatgcccctggaatcagaatatgtaaagtggagagatgatgttgttgttccttgtgggaaaccagtttcatcaaatgtcaaggcatctgagctcatgtacaatgagtatattgtctataatactgctcaagttaaactgcaattcttgttgaaggtgaggttccatcacaagaaatgaggttggaaactagaagtgtgctgttttgttgtatcatcagtgcaaagcagttttttgaccaggacttgtacatactccatgtaggattctcttgataaggtctcattttgatttgactggagatctttcaccctttctttttggtgtgcttgttaggatctagttgaaactcgtcacttagagcagaaatctcatgccagatctggttatgtgtataatatgaaaccgccagtttaatgtcaaacgtattgttatcaactgcttcccttttaatatgtgttgcatcactctaggtacttttaccttctaaaatcaccaatgtggcttctttaactttgttttctcttggtgcatgtttggtatgacgacaaatttgtcattttgcaaaagctactacaaagtgtagctttcataaaattacagtgactcactgtaatttcagcattgtgatatcaaacatg

SEQ ID NO: 6209 - DNA, 3462 bp, Trifolium pratense
gggaggagatagtgggagtgagagagtgtgaaaatgtcgaaccctcaaaaccagaagccatggaaagcagagtacgcgaaatcgggtcgttcgtcatgcagaacctgcaagattcccattgcaagcgagaatctccgtcttggcaaaatggttcaatcttccaaattcgatggtctcatgcctatgtggaatcatgctgagtgcatattgaagaaaggcaatcagataaaatcagttgatgatgttgaaaacttagagtcgcttcggtgggatgatcagcagaagatcagaaaatacattgaaagtggcggtggtggtagtggtggtacgccgaagtcgaatgctgcctcaaagtcgactgctagcaagaatattgaatatggtattgaagtttcgcaaacttcacgggctacttgcaagcattgtggtcaaaaaattatcaaaggagaggttcgcatatctgctaagcctgaaggtcaaggtgccaggggtttggcttggcaccatgccaagtgtctcttggaactatctccatcaattcaagtgaataatttgtctgggtggaatagtctctcatcttctgatcaatcagctgtcagcggcttggataggaaaggacatcctacgaataaaggaggtggtagtagttcaaatgtcgaggtggaagaatccacagcgcaaccctcttccaaaggtggcacaaaacgggggaaagaggcagagggtgagcaaaagtcaaaagcagctaaggtcaagggagatgtgtctgtgagcagggtagcggcaggaaaaaatgctgatgactcaggagaggcacgggatcttgagaatagactggagacccagagcaaagatctatgggctctgaaggatgatcttaaaaagcatgtgacaacaacagagttgcgtgaaatgctggatgccaatggtcaaggttcaacaggatcagagcttgatttgcgtgatcactgtgctgatggaatgatgtttggaggacttggtcattgcccactttgttctggtagtctgcgttattctggaggaatgtaccggtgcaccggatacatttctgagtggagtaaatgttcctactcgacctgtgaaccaaagcgtactgaagggaagtggaaaatcccaaaggaaacagataatcagtaccttaaaaattggttcaaatctcaaaaagggaaaaaaccagttaggttattgcctccgccgtcgtcaaggacttctgctgaaagtcaaatttctgcaggccagcatcaaccatcgaacagtgaaagtttgtcagatttgaaagttgccatctctggattacctaaagaatctattgaggaatggaaacacaaaattgatgccataggtggagtacttcatgcaaaagtgaagaaagatactgactgcttggtggtcagtggagcgcttaaggacgaagctgagatgcggaaggcaaggaggatgaaagtaccaatagttagagaggactatttggttgactgtatggaaagaaagaagaagcttccatttgatttgtacaaagttgaaatgattggtgaggcttctagcatggtcaccatcaaagtgaaggggcaaagttctgttcatgatgcttctggcctacaagattctggccacatactagaggatgggaaaagtatatataacacaactttgaatatgtctgatttgtctactggtattaatagctactatatccttcaaataattgaagaagataaagggtcagattgctacgtgtttcgtaaatggggtcgagttggaaatgacaagattggagggtccaaactggaggaaatgtcgaaatctgatgcaattagggaattcaaacgactattcttggagaaaactggaaacccttgggaggcctgggaacaaaggactattcagaagcaacctggaagattctttcccttggaaattgattatggagttaatagacaagttccaaaaaagaatagaaacaatgcagtcagcaaactaccccctccattaatagaactgatcaagatgctctttaatgtggaaacatacagatctgccatgatggaatttgagatcaacatgtccgaaatgccacttgggaaactgagcaaaagtaatatccaaaagggttttgaagcattaacagatatacagaatctttttagaagtagcaatcatgatccatcgttgagggatagcttgcttattgatgctagcaatcggttcttcaccatgatcccttccattcatccacatattattagggatgaggatgattttaagtcaaaggtgaaaatgttagaagcccttcaagacattgaaatagcctcaagattagttggatttaatgccaatagtgatgactccattgatgataattataagaagctccactgtggtatatctccacttccccatgacagtgaagattttcgattagttgagaagtatctacaaaatactcatgcccccacacatatggactggagtcttgaacttgaagaagttttttcacttgaaagagaaggtgaatttgataaatatgctccttacagggacaaagttggtaacagaatgctcctatggcatggttctaggctgacgaattttgtgggaattcttaaccaaggactcagaattgcacctcctgaagctcctgcaactggctatatgtttggcaaagggatttactttgctgaccttgtcagcaagagtgctcagtattgcttcaccgataagaaaaatcctgttggtctaatgcttttgagtgaagttgcccttggaaatgtgtatgagctcaaaaaagctacgtatatggataaacctccacaaggaaagcattctactaaaggactgggcaagaaaatgcccctggaatcagaatatgtaaagtggagagatgatgtcgttgttccttgtggaaaaccagtgtcatcaaatgtcaaggcatccgagctcatgtacaatgagtatattgtctataatactgctcaagttaaactgcaattcttgttgaaggtgaggttccatcacaagaaatgatgttgaaactagaggtgggctgttttgttgtatcatcgatgccaaacagttttttgaccaggacatgtacatactccatgtgggattctcttgataaggtctcattttgatttgactggagatctttcaccttttcttttggtgtgcttgttagtgcaggtatctagttgaaactcgttacttagagcagaattttcatgccaaatctggttatgtgtataatatagaatcggcaatttaatgtcaaacatgctgttatcaacttcttcccttttaatatgtgctgcattgcatcactctaggtaggtacttttaccttctaaaaacaccaatgtggtttcttatatttaccccaacatattcactttaagtagcgtgcataaatagcagaatagttagttgcttcagttcctaagt

SEQ ID NO: 6210 - DNA, 3467 bp, Trifolium pratense
atctcgggaggagatagtgggagtgagagagtgtgaaaatgtcgaaccctcaaaaccagaagccatggaaagcagagtacgcgaaatcgggtcgttcatcatgcagaacctgcaagattcccattgcaagcgagaatctccgtcttggcaaaatggttcaatcttccaaattcgatggtctcatgcctatgtggaatcatgctgagtgcatattgaagaaaggcaatcagataaaatcagttgatgatgttgaaaacttagagtcgcttcggtgggatgatcagcagaagatcagaaaatacattgaaagtggcggtggtggtagtggtggtacgccgaagtcgaatgctgcctcaaagtcgactgctagcaagaatattgaatatggtattgaagtttcgcaaacttcacgggctacttgcaagcattgtggtcaaaaaattatcaaaggagaggttcgcatatctgctaagcctgaaggtcaaggtgccaggggtttggcttggcaccatgccaagtgtctcttggaactatctccatcaattcaagtgaataatttgtctgggtggaatagtctctcatcttctgatcaatcagctgtcagcggtttggataggaaaggacatcctacgaataaaggaggtggtagtagttcaaatgtcgaggtggaagaatccacagcgcaaccctcttccaaaggtggcacaaaacgggggaaagaggcagagggtgagcaaaagtcaaaagcagctaaggtcaagggagatgtgtctgtgagcagggtagcggcaggaaaaaatgctgatgactcaggagaggcacgggatcttgagaatagactggagacccagagcaaagatctatgggctctgaaggatgatcttaaaaagcatgtgacaacaacagagttgcgtgaaatgctggatgccaatggtcaaggttcaacaggatcagagcttgatttgcgtgatcactgtgctgatggaatgatgtttggaggacttggtcattgcccactttgttctggtagtctgcgttattctggaggaatgtaccggtgcaccggatacatttctgagtggagtaaatgttcctactcgacctgtgaaccaaagcgtactgaagggaagtggaaaatcccaaaggaaacagataatcagtaccttaaaaattggttcaaatctcaaaaagggaaaaaaccagttaggttattgcctccgccgtcgtcaaggacttctgctgaaagtcaaatttctgcaggccagcatcaaccatcgaacagtgaaagtttgtcagatttgaaagttgccatctctggattacctaaagaatctattgaggaatggaaacacaaaattgatgccataggtggagtacttcatgcaaaagtgaagaaagatactgactgcttggtggtcagtggagcgcttaaggacgaagctgagatgcggaaggcaaggaggatgaaagtaccaatagttagagaggactatttggttgactgtatggaaagaaagaagaagcttccatttgatttgtacaaagttgaaatgattggtgaggcttctagcatggtcaccatcaaagtgaaggggcaaagttctgttcatgatgcttctggcctacaagattctggccacatactagaggatgggaaaagtatatataacacaactttgaatatgtctgatttgtctactggtattaatagctactatatccttcaaataattgaagaagataaggggtcagattgctacgtgtttcgtaaatggggtcgagttggaaatgacaagattggagggtcaaaactggaggaaatgtcgaaatctgatgcaattagggaattcaaacgactattcttggagaaaactggaaacccttgggaggcctgggaacaaaggactattcagaagcaacctggaagattctttcccttggaaattgattatggagttaatagacaagttccaaaaaagaatagaaacaatgcagtcagcaaactaccccctccattaatagaactgatcaagatgctctttaatgtggaaacatacagatctgccatgatggaatttgagatcaacatgtccgaaatgccacttgggaaactgagcaaaagtaatatccaaaagggttttgaagcattaacagatatacagaatctttttagaagtagcaatcatgatccatcgttgagggatagcttgcttattgatgctagcaatcggttcttcaccatgatcccttccattcatccacatattattagggatgaggatgattttaagtcaaaggtgaaaatgttagaagcccttcaagacattgaaatagcctcaagattagttggatttaatgccaatagtgatgactccattgatgataattataagaagctccactgtggtatatctccacttccccatgacagtgaagattttcgattagttgagaagtatctacaaaatactcatgcccccacacatatggactggagtcttgaacttgaagaagttttttcacttgaaagagaaggtgaatttgataaatatgctccttacagggacaaagttggtaacagaatgctcctatggcatggttctaggctgacgaattttgtgggaattcttaaccaaggactcagaattgcacctcctgaagctcctgcaactggctatatgtttggcaaagggatttactttgctgaccttgtcagcaagagtgctcagtattgcttcaccgataagaaaaatcctgttggtctaatgcttttgagtgaagttgcccttggaaatgtgtatgagctcaaaaaagctacgtatatggataaacctccacaaggaaagcattctactaaaggactgggcaagaaaatgcccctggaatcagaatatgtaaagtggagagatgatgtcgttgttccttgtggaaaaccagtgtcatcaaatgtcaaggcatccgagctcatgtacaatgagtatattgtctataatactgctcaagttaaactgcaattcttgttgaaggtgaggttccatcacaagaaatgatgttgaaactagaggtgggctgttttgttgtatcatcgatgccaaacagttttttgaccaggacatgtacatactccatgtgggattctcttgataaggtctcattttgatttgactggagatctttcaccttttcttttggtgtgcttgttagtgcaggtatctagttgaaactcgttacttagagcagaatttttatgccaaatctggttatgtgtataatatagaatcggcaatttaatgtcaaacatgctgttatcaacttcttcccttttaatatgtgctgcattgcatcactctaggtaggtacttttaccttctaaaaacaccaatgtggtttcttatatttaccccaacatattcactttaagtagcgtgcataaatagcagaatagttagttgcttcagttcctaagt

SEQ ID NO: 6211 - DNA, 3494 bp, Trifolium pratense
agtgggagtgagagagtgtgagaatgtcgaaccctcaaaaccagaagccatggaaagcagagtacgcgaaatcgggtcgttcatcatgcagaacctgcaagattcccattgcaagcgagagtctccgtcttggcaaaatggttcaatcttccaaattcgatggtctcatgcctatgtggaatcatgctcagtgcatattaaagaaagccaaccagattaaatcagttgatgatgttgaaaacatagagtcgcttcgttgggatgatcagcagaagattagaaaatacattgaaagtggtggtggtagtgggggtggtacgccgaagtcgaatgctgcctcaaagtcgaatgctagcaagaatattgaatatggtattgaagtttcgcaaacttcacgtgctacttgcaagcattgtggtcaaaaaattatcaaaggagaggttcgcatatctgctaagcctgatggtcaaggtgccaggggtttggcttggcaccatgccaagtgtctcttggaactatctccatcaattcaagtgaataatttgtctgggtgggatagtctctcatcttctgatcaatcagttgtcggcgacttagctaggaaaggacatcctacgagtaaggaaggtggtagtagttcaaatgtcaaggtggaagaatccacattgcaaccctcttccaaaggtggcacaaaacgggggaaagatgcagagggtgagcaaaagtcaaaagctgccaaaatcaagggagatgtgtctgtgggcagggtagcagcaggaaaaaatgctgatgactcaggagagacacgcgattttgagaatagactggagacccagagcaaagatctatgggctttgaaggatgatcttaaaaagcatgtgacaacaactgagttgcgtgaaatgctggatgccaatcgtcaaggctcaacaggatcagagcttgatttgcgcgatcgctgtgctgatggaatgatgtttggaggacttagtcattgcccactttgttctggttttctgcgttattccggaggaatgtaccggtgcaccggatacatttctgagtggagtaaatgttcctactctacctgcgaaccaaagcgtactgaagggaagtggaaaatcccaaaggaaacagataatcagtaccttaaaaagtggttcaactctcaaaaagggaaaaaaccaattaggttattgcctcctgcatcatcgaggacttctgctgaaagtcaaatttctgcaggccagcatcaaccatcgaacagtgaaagtttgtcagatttgaaagttgccatttctggattacctaaagaatctattgaggaatggaaacacaaaattgatgccataggtggagtacttcatgcaaaagtgaagaaagatactgactgcttggtagtcagtggagcgcttaaggacgaagctgagatgcggaaggcaaggaggatgaaagtaccaatagttagagaggactatttggttgactgtatggaaagaaagaagaagcttccatttgatttgtacaaagttgaaatgattggtgaggcttctagcatggtcaccatcaaagtgaaggggcaaagttctgttcacgatgcttctggcctacaagattctggccacatactagaggatgggaaaagcatatataatacaactttgaatatgtctgatttgtctactggtattaacagttactatatccttcaaataattgaagaagataaagggtcagattgctatgtgtttcgtaaatggggtcgagttggaaatgacaagattggagggtccaaactggaggaaatgtcaaaatctgatgcaattagggaattcaaacgactattctcagagaaaactggaaatccttgggaggcctgggaacaaaggactattcaaaagcaacctggaagattcttccccttggaaattgattatggagttaatagacaagtctcaaaaaagaatagaaacaatgccgacagcaaactaccccctccattaatagaattgatcaagatgctctttaatgtggaaacatacagatctgccatgatggaatttgagatcaatatgtccgaaatgccacttgggaaattgagcaaaagtaatatccaaaagggttttgaagcattaacagatatacaaaatctttttaaaagtagcaatcctgatccatcattgagggatagcttgcttattgatgctagcaatcggttcttcaccatgatcccttccattcatccacatattatcagggatgaggatgattttaaatcaaaggtgaaaatgttagaagcccttcaagacattgaaatagcctcaagattagttggatttgatgccaataatgatgactccattgatgataattataagaagctccactgtgatatatctccacttccccatgacagtgaagattttcgattagttgagaagtatctacatactactcatgcccccacacatacggactggagtcttgaactagaagaagttttttcacttgaaagagaaggtgaatttgataaatatgctccttacagggacaaagttggtaacagaatgctcctatggcatggttccaggctgacaaactttgtgggaattcttaaccaaggactcagaattgcacctcccgaagcccctgcaactggctatatgtttggcaaagggatttactttgctgaccttgtcagcaagagtgctcagtattgcttcactgataagaaaaatcctgttggtctaatgcttttgagtgaagttgcccttggaaatgtgtatgagctcaaaaaagctacgtatatggatcaacctccacaaggaaagcattctactaaaggactgggcaagaaaatgcccctggaatcagaatatgtaaagtggagagatgatgttgttgttccttgtgggaaaccagtttcatcaaatgtcaaggcatctgagctcatgtacaatgagtatattgtctataatactgctcaagttaaactgcaattcttgttgaaggtgaggttccatcacaagaaatgaggttggaaactagaagtgtgctgttttgttgtatcatcagtgcaaagcagttttttgaccaggacttgtacatactccatgtaggattctcttgataaggtctcattttgatttgactggagatctttcaccctttctttttggtgtgcttgttaggatctagttgaaactcgtcacttagagcagaaatctcatgccagatctggttatgtgtataatatgaaaccgccagtttaatgtcaaacgtattgttatcaactgcttcccttttaatatgtgttgcatcactctaggtacttttaccttctaaaatcaccaatgtggcttctttaactttgttttctcttggtgcatgtttggtatgacgacaaatttgtcattttgcaaaagctactacaaagtgtagctttcataaaattacagtgactcactgtaatttcagcattgtgatatcaaaca

SEQ ID NO: 6212 - DNA, 3478 bp, Trifolium pratense
agtgggagtgagagagtgtgagaatgtcgaaccctcaaaaccagaagccatggaaagcagagtacgcgaaatcgggtcgttcatcatgcagaacctgcaagattcccattgcaagcgagagtctccgtcttggcaaaatggttcaatcttccaaattcgatggtctcatgcctatgtggaatcatgctcagtgcatattaaagaaagccagccagattaaatcagttgatgatgttgaaaacatagagtcgcttcgttgggatgatcagcagaagatcagaaaatacattgaaagtggtggtggtggtacgccgaagtcgaatgctgcctcaaagtcaaatgctagcaagaatattgaatatggtattgaagtttcgcaaacttcacgtgctacttgcaagcattgtggtcaaaaaattatcaaaggagaggttcgcatatctgctaagcctgatggtcaaggtgccaggggtttggcttggcaccatgccaagtgtctcttggaactatctccatcaattcaagtgaataatttgtctgggtgggatagtctctcatcttctgatcaatcagttgtcggcgacttagctaggaaaggacatcctacgggtggtagtagttcaaatgtcaaggtggaagaatccacattgcaaccctcttccaaaggtggcacaaaacgggggaaagatgcagagggtgagcaaaagtcaaaagctgccaaaatcaagggagatgtgtctgtgggcagggtagcagcaggaaaaaatgctgatgactcaggagaggcacgtgattttgagaatagactggagacccagagcaaagatctatgggctttgaaggatgatcttaaaaagcatgtgacaacaacagagttgcgtgaaatgctggatgccaatcgtcaaggctcaacaggatcagagcttgatttgcgcgaccgctgtgctgatggaatgatgtttggaggacttagtcattgcccactttgttctggttttctgcgttattctggaggaatgtaccggtgcaccggatacatttctgagtggagtaaatgttcctactctacctgcgaaccaaagcgtactgaagggaagtggaaaatcccaaaggaaacagataatcagtaccttaaaaagtggttcaactctcaaaaagggaaaaaaccaattaggttattgcctcctgcatcatcgaggacttctgctgaaagtcaaatttctgcaggccagcatcaaccatcgaacagtgaaagtttgtcagatttgaaagttgccatttctggattacctaaagaatctattgaggaatggaaacacaaaattgatgccataggtggagtacttcatgcaaaagtgaagaaagatactgactgcttggtagtcagtggagcgcttaaggacgaagctgagatgcggaaggcaaggaggatgaaagtaccaatagttagagaggactatttggttgactgtatggaaagaaagaagaagcttccatttgatttgtacaaagttgaaatgattggtgaggcttctagcatggtcaccatcaaagtgaaggggcaaagttctgttcacgatgcttctggcctacaagattctggccacatactagaggatgggaaaagcatatataatacaactttgaatatgtctgatttgtctactggtattaacagttactatatccttcaaataattgaagaagataaagggtcagattgctatgtgtttcgtaaatggggtcgagttggaaatgacaagattggagggtccaaactggaggaaatgtcaaaatctgatgcaattagggaattcaaaagactattctcagagaaaactggaaatccttgggaggcctgggaacaaaggactattcaaaagcaacctggaagattcttccccttggaaattgattatggagttaatagacaagtctcaaaaaagaatagaaacaataccgacagcaaactaccccctccattaatagaattgatcaagatgctctttaatgtggaaacatacagatctgccatgatggaatttgagatcaatatgtccgaaatgccacttgggaaattgagcaaaagtaatatccaaaagggttttgaagcattaacagatatacaaaatctttttaaaagtagcaatcctgatccatcattgagggatagcttgcttattgatgccagcaatcggttcttcaccatgatcccttccattcatccacatattatcagggatgaggatgattttaaatcaaaggtgaaaatgttagaagcccttcaagacattgaaatagcctcaagattagttggatttgatgccaataatgatgactccattgatgataattataagaagctccactgtgatatatctccacttccccatgacagtgaagattttcgattagttgagaagtatctacatactactcatgcccccacacatacggactggagtcttgaactagaagaagttttttcacttgaaagagaaggtgaatttgataaatatgctccttacagggacaaagttggtaacagaatgctcctatggcatggttccaggctgacaaactttgtgggaattcttaaccaaggactcagaattgcacctcccgaagcccctgcaactggctatatgtttggcaaagggatttactttgctgaccttgtcagcaagagtgctcagtattgcttcactgataagaaaaatcctgttggtctaatgcttttgagtgaagttgcccttggaaatgtgtatgagctcaaaaaagctaagtatatcgatcaacctccgcaaggaaagcattctactaaaggactgggcaagaaaatgcccctggaatcagaatatgtaaagtggagagatgatgttgttgttccttgtgggaaaccagtttcatcaaatgtcaaggcatctgagctcatgtacaatgagtatattgtctataatactgctcaagttaaactgcaattcttgttgaaggtgaggttccatcacaagaaatgaggttggaaactagaagtgtgctgttttgttgtatcatcagtgcaaagcagttttttgaccaggacttgtacatactccatgtaggattctcttgataaggtctcattttgatttgactggagatctttcaccctttctttttggtgtgcttgttaggatctagttgaaactcgtcacttagagcagaaatctcatgccagatctggttatgtgtataatatgaaaccgccagtttaatgtcaaacgtattgttatcaactgcttcccttttaatatgtgttgcatcactctaggtacttttaccttctaaaatcaccaatgtggcttctttaactttgttttctcttggtgcatgtttggtatgacgacaaatttgtcattttgcaaaagctactacaaagtgtagctttcataaaattacagtgactcactgtaatttcagcattgtgatatcaaacatg

SEQ ID NO: 6213 - DNA, 3430 bp, Trifolium pratense
aggagtgggagtgagagagtgtgagaatgtcgaaccctcaaaaccagaagccatggaaagcagagtacgcgaaatcgggtcgttcatcatgcagaacctgcaagattcccattgcaagcgagagtctccgtcttggcaaaatggttcaatcttccaaattcgatggccttatgcctatgtggaatcatgctcagtgcatattaaagaaagccaaccagattaaatcagttgatgatgttgaaaacatagagtcgcttcgttgggatgatcagcagaagattagaaaatacattgaaagtggtggtggtagtgggggtggtacgccgaagtcgaatgctgcctcaaagtcgaatgctagcaagaatattgaatatggtattgaagtttcgcaaacttcacgtgctacttgcaagcattgtggtcaaaaaattatcaaaggagaggttcgcatatctgctaagcctgatggtcaaggtgccaggggtttggcttggcaccatgccaagtgtctcttggaactatctccatcaattcaagtgaataatttgtctgggtgggatagtctctcatcttctgatcaatcagttgtcggcgacttggctaggaaaggacatcctacaagtaaggaaggcggtagtagttcaaatgttgaggtggaagaatccagaccgcaatcctcttctaaaggtggcacaaaacgggggaaagatgcagagggtgagcaaaagtcaaaagctgctaaaatcaagggagatgtgtctgtgggcagggtagcaacaggaaaaaatgctgatgactcaggagagacacgcgattttgagaatagactggagatccagagcaaagatctatgggctctgaaggatgatcttaaaaagcatgtgacaacagctgagttgcgtgaaatgctggatgccaatggtcaaggttcaacaggatcagagcttgatttgcgtgatcgctgtgctgatggaatgatgtttggaggacttagtcgttgcccactttgttctggttttctgcgttattccggaggaatgtaccggtgcaccggatacatttctgagtggagtaaatgttcctactctacctgcgaaccaaagcgtactgaagggaagtggaaaatcccaaaggaaacagataatcagtaccttaaaaagtggttcaactctcaaaaagggaaaaaaccaattaggttattgcctcctgcatcatcgaggacttctgctgaaagtcaaatttctgcaggccagcatcaaccatcgaacagtgaaagtttgtcagatttgaaagttgccatttctggattacctaaagaatctattgaggaatggaaacacaaaattgatgccataggtggagtacttcatgcaaaagtgaaaaaagatactgactgcttggtggttagtggagcgcttaaggacgaagctgagatgcggaaggcaaggaggatgaaagtaccaatagttagagaggactatttggttgactgtatggaaagaaagaagaagcttccatttgatttgtacaaagttgaaatgattggtgaggcttctagcatggtcaccatcaaagtgaaggggcaaagttctgttcacgatgcttctggcctacaagattctggccacatacttgaggatgggaaaagcatatataatacaactttgaatatgtctgatttgtctactggtattaacagttactatatccttcaaataattgaagaagataaagggtcagattgctatgtgtttcgtaaatggggtcgagttggaaatgacaagattggagggtccaaactggaggaaatgtcaaaatctgatgcaattagggaattcaaaagactattctcagagaaaactggaaatccttgggaggcctgggaacaaaggactattcaaaagcaacctggaagattcttccccttggaaattgattatggagttaatagacaagtctcaaaaaagaatagaaacaatgccgacagcaaactaccccctccattaatagaattgatcaagatgctctttaatgtggaaacatacagatctgccatgatggaatttgagatcaatatgtccgaaatgccacttgggaaattgagcaaaagtaatatccaaaagggttttgaagcattaacagatatacaaaatctttttaaaagtagcaatcctgatccatcattgagggatagcttgcttattgatgctagcaatcggttcttcaccatgatcccttccattcatccacatattatcagggatgaggatgattttaaatcaaaggtgaaaatgttagaagcccttcaagacattgaaatagcctcaagattagttggatttgatgccaataatgatgactccattgatgataattataagaagctccactgtgatatatctccacttccccatgacagtgaagattttcgattagttgagaagtatctacatactactcatgcccccacacatacggactggagtcttgaactagaagaagttttttcacttgaaagagaaggtgaatttgataaatatgctccttacagggacaaagttggtaacagaatgctcctatggcatggttccaggctgacaaactttgtgggaattcttaaccaaggactcagaattgcacctcccgaagcccctgcaactggctatatgtttggcaaagggatttactttgctgaccttgtcagcaagagtgctcagtattgcttcactgataagaaaaatcctgttggtctaatgcttttgagtgaagttgcccttggaaatgtgtatgagctcaaaaaagctaagtatatcgatcaacctccgcaaggaaagcattctactaaaggactgggcaagaaaatgcccctggaatcagaatatgtaaagtggagagatgatgttgttgttccttgtgggaaaccagtttcatcaaatgtcaaggcatctgagctcatgtacaatgagtatattgtctataatactgctcaagttaaactgcaattcttgttgaaggtgaggttccatcacaagaaatgaggttggaaactagaagtgtgctgttttgttgtatcatcagtgcaaagcagttttttgaccaggacttgtacatactccatgtaggattctcttgataaggtctcattttgatttgactggagatctttcaccctttctttttggtgtgcttgttaggatctagttgaaactcgtcacttagagcagaaatctcatgccagatctggttatgtgtataatatgaaaccgccagtttaatgtcaaacgtattgttatcaactgcttcccttttaatatgtgttgcatcactctaggtacttttaccttctaaaatcaccaatgtggcttctttaactttgttttctcttggtgcatgtttggtatgacgacaaatttgtcattttgcaaaagct

SEQ ID NO: 6214 - DNA, 3319 bp, Lotus japonicus
gaatgtcgtcgaaccctcaaaatcaaaagccatggaaagcagagtacgccaagtcaggccgatcgtcatgccggacctgcaagtcccccattgacaaggaggtcttccgtctcggcaagatggttcaatccacccaattcgatggcctcatgcctatgtggcatcatgctgattgcatattgaagaaatccaaccagataaaattagttgatgatgttgaaaacttagagtcgcttcgttgggaagaccagcaaaagatcagaaagtacatcgagagtggcggtggcggtagtggtggcacgccaacgccaaaaaaggctaacaaaaatactgagtgtggtattgaagtttcacaaacttctcgtgctacttgcaaggattgtggtcaaaaaatcatcaagggagaggttcgaatatccactaagcctgaaggtcaaggtgctaggggtttggcttggcaccatgccaagtgtctcatggaattatcaccatcgattcaagtggataagttgtctggatggaatagtctctcatcttctgatcaatcagccatcgaggctgaagagtttaatgaatccgcacaccaatccacttccaaaggtggcaccaaacgggggaagaatgccgatagtgagcggaagtcaaaagttactaaggccaaagaggatgtgtctgcaggcagggcagcatcaatgaaaaatgctgatggcttaggggaagcatgtgatctggagactaaactggaggcccagagcaaagaactctgggctctgaaggatgatcttaagaagaatgtgacaacagcagagttgcgtgaaatactggaagtcaatggtcaagattcaacaggatcagaacttgatttgcgtgatcgctgtgctgatggaatgatgtttggagcacttggtcattgcccaatatgttctggttatctgcgttattctggaggaatgttccggtgcaatggatacatttctgagtggagtaaatgttcctactctaccagcgaaccaaaacgtactgaagggaagtggaaaatcccggaggaaacaaataatcaatacctaaaaaagtggttcaaatctcaaaaggggaagaaaccagttaggatattgcctctgccatcatcaatgaactctgttgaaagtcaaattactaattcccagcagcatcaatcatcaagcagtgagagtttgatggatttgaaagtttctattgctggattacctaaagaatctattgaggattggaaacgcaaaattgatggcgttgatactagctgcttggtggtcagtggagcacttaatgatgaagctgagatgcggaaggcaaggaggatgaaaataccaatagtaagagaggactatttggttgactgtatggaaagaaataagaagcttccatttgatatgtacaaagttgaaaagattggtgaggcttctagcatggtcactgtcaaagtgaaggggcagagtgctgttcacgaagcttctggcctacaggattccggccacatactcgaggaagggaaaagcatatataatacaactttgaacatgtctgatttgtctactggtgttaacagaccacttgaattatcatgcatcactttctttttcaagattcttgttatgctgttatttcctctccttcattatcatcctctaacttcatttcccatgtaaagctactacattctccaaataatccaagaagataaggggtcaggttgctatgtgtttcgtaaatggggtcgtgtgggaaatgacaagattggaggaaagaaactggacgaaatgccaaaaggtgatgcaatccgtgaattcagacgattattctttgagaaaactggaaatccttgggacgcttgggaacaaaagactattcagaagcaacctggaagatttttcccattggatattgattatggagttagcaagcaggtgtccaaaaaaattaaaaatgaagatagtaaactaccctatccattaatagaattgatgaagatgctcttcaatgtggaaacatacagagctgccatgatggaatttgagattaatatgtccgaaatgccacttgggaaactgagcaaaagtaatatccaaaaggggtttgaagcattaacggatatacaaaatttgttacaaactagcaatcctgatccatcagtcagggaaagcttgcttattgatgccagcaatcggttcttcactatgatcccttctattcatccacatataattagggatgatgatgattttaagtcaaaggtgaaaatgttagaagcccttcaagacattgaaatagcctcaagattagttggatttgatgccaacagtgatgactccattgatgataattacaagaagctccactgtgatatgtctccacttcctcatgacagcgaagatttccgtttagttgagaagtttctccataacacccatgcccccactcatacggattggagtcttgagctagaagaagttttttcacttgaaagggaaggagagtttgataagtttgctccttacagggacaaacttggtaacagaatgctcctatggcatggttctaggttgacaaactttgttggaattctgagccaaggactgagaattgcccctcctgaagcccctgcgactggatatatgtttggcaaaggggtttactttgctgacctggtcagcaagagtgctcagtattgcttcacggataagaaaaaccctgttggtctaatgcttctgagtgaagttgcccttggagatgtctatgaactcaaaaaagctaagtatatggacaaacctccagtaggaaagcactctactaaaggactgggcaagaaaatgcctcaggaatcagaatatgtaaagtggagggatgatgtcgtcgttccttgtggcaaaccagtgtcatcaaatgtcaaggcatctgaactcatgtacaatgagtatattgtttataatactgctcaagtcaagatgcaattcttattgaaggtgaggttccatcacaaaaggtgaggtttggaaactagaggttttctgttttggggctttatgtgtacgtagcagtttttttgaccaggactagtacatattccatctggtattctctaaaattgtctaggaaaggtctcattttgagttgacgggagatctttcaaccttttttttggtgtgtttgtaagtgcagcctgtgcagggatctagttgaaactcgtcattttgtagcagaaatatctaatgcaatttgtgatctggttgtgtgtagaatagaccaccgttttaatgtcaaactgtgttatcgtgctgttccc

SEQ ID NO: 6215 - DNA, 2127 bp, Glycine max
cagacaaatggtccattttttcttttcttgttgtgagagtatataaatttatttatttgggaattattgtaagtgcttccctccacatctatatccgaaccaaattccctccttcttctgcctcttctctgctctctctcgttttctgctctctttctctcccgcttttttcattttctcactcgccaaacgctcagatctctctcattccctcttccgattccccctaattcccgccccgtaacccctccgccgccgatcgccgcccggggatgtcggcctcgcgcgctccccccgccgctaacccgccggaccagatcatgcactccatgaaacgccaactccccttctcctccatgaagcctcccttcgtcgccgccggagactatcaccgccatgacgccgccgaagccatcgtcgtcaagactcccctactgaagcggaagagtgaagtggctgattttgaagctgattctggtgataggatgactgctggattcactgaagcagctaatagtccttttcagacacctgtatcaggaaagacgggaaagggaggcaaatcctctaggctgacaaaaggcaacagagttggaactcagaccccaggctcaaacattggttctcctgcaggaagtaatctcactcctgctggtccatgtcgttatgacagctctttagggctgttgacaaagaagttcatcaatttgatcaaacaagctgaggatggtatccttgatctgaataaagctgctgacacattagaggtgcaaaagaggaggatatatgatataacaaatgttcttgaagggattggccttatagaaaagaaacttaaaaatcgaattcaatggaagggactagatgtttcaagaccgggtgaggctgatgatagttttgccagtttacaggcagaagttgaaaatttaacgatgaaggagcgccagttagacgaacaaataagggagatgcaagaaagactgcgggatcttagtgaagatgaaaataatgacaagttgctttttgttactgaggaagatataaagaatttgccctgcttccagaatgaaaccttgatagccattaaagctcctcatggaaccactttggaggtccctgatcccgacgaggccgttgattatctgcagaggagatacaggatagtcctcagaagcacaatgggcccaatagatctttaccttgttagtcaatttgaagaaaagtttgaagagattaatggtgctgatgttgcacccaaacttccatcaagtccagatgttaccaaacaacaatcaacagtggtcccagaggatagagggaagcacatagaagtgcagggacaagcagctcctggacctagttcagattttactccctcccaggatttcgtgagtgggatcatgaagattgttccttcagatgttgctagtgaagctgattactggcttttatcagatgctgatgttagcataactgacatgtggagaacagaacctggagttgaatggaatgaactggaaccacttcaagaagattattgtatgactgacgagaacactacaacgccaagtcatccttcaaatgtaggtgaagtgtcttctgcatctaaacctactggaggttgaagcttccaaaggatgcattgtgaatataatagtgaacgtggtgttcctcttccttctgagaacctatgacatctagccatctcccttttgtatcctctctacatagtcctggaggttggattgaaggttccatgaagatgctttctcatgtttctccaagaagttcgatctaggagctaactgagtggccaatcaactggctcattgtacagtaaatattacataacctaagcgaccttagttcaagaaaaaaatctcgctgctttgctgaaccatctttgtatattacataaccctagtcttggctttctagtgtacttagctcgatctcttatgtttaccaagcaataaaaaacacttcggaatgctcccaggcaatgttatcacctgtaactgttcgtccatttcaataagcttgcaattaagcacacagttggtgaaatgacatttcatctgtgactagttaattaccttctcgcgtctctgttcctgcctcgatatt

SEQ ID NO: 6216 - DNA, 1663 bp, Cajanus cajan
tcccgcttctttatttttccgacttgtcagatctccctttccattccccctaacccctccgatcctccatcgccggccggcggatgtccgcctcgcgcgctccccccgccgccgccgccaccaacccctccgaccagatcatgcactctatgaagcgccaactccccttctcctccatgaaaccgcctttcctcgccgccggcgactaccaccgcttcgcccccgaccaccgccgggccctcgaccaagaaccggaggccatcgtcgtcaagactccccaactgaagcgaaagagtgaagtggctgattttgaagctgattctggcgataggatgactcccggatctgctgaagcagctaatagtccttttcagacacctgtttcaggaaagatgggaaagggaggcaaatcctctaggctgacaaaatgtaacaggcctggagctcaaacctcaggctcaaatattggttctccagcgggcaataatctcactcctgctggtccatgtcgttatgacagctctttaggtctgttgacaaagaagttcatcaatttgatcaaacaagctgaggatggtatccttgatctgaataaagctgccgatacattagaggtgcaaaagaggagaatatatgatataaccaatgttcttgaagggattggcctgatagaaaagaaactcaagaaccgaattcaatggaagggactggatgtttcaagaccgggggaggctgatgatagttttgctagtttacaggcagaagttgaaaatttaacaatggaggagcaccggttagatgagcaaataagggagatgcaagaaagactgcgggatcttagtgaagatgaaaacaacgaaaagttgctttttgtgactgaggaagatataaagaatttgccctgcttccagaatgaaaccttgatagcaattaaagctccgcatggcaccactttggaggtccctgatcctgatgaggctgttgattatccgcagaggagatacaggatagtcctcagaagcacaatgggcccaatagatgtttaccttgttagtcaatttgaagaaaagtttgaagagattaatggtgttgatatttcacccaaacttccatccagtccagatgttaacaagcatcaatcaacgatggtcccagaggatagagggaaggacatagaagtgcagggacaagaagttcaagggcccagttcagattttgctgcctctcaggatttcgtgagtgggatcatgaagattgttccttcagatgttgctagtgaatctgattactggcttttatcagaagctgaggtttgcataactgacatgtggagaacagaacctgaagttgaatggaatgaactggatcctcttcaaggagattgttgtattactcgcgagaacactacgaccccaagtcaaccttcaaatgtagctgaagtgtcttccgcgcctaaacctactgttggaggttgaagcttccgaaggatacattgtgaatataaaagggaacgtggtactcctttcctgctgagaacctatgacatccagccatctcccttttgtatcctctctgcatagtcctggaggttggattgaaggttccatgaagatgctttctcatgtttctccaagtaaatattacataacctaagcgaccttag

SEQ ID NO: 6217 - DNA, 1842 bp, Glycine max
aacccctccgccgccgatcgccgcccggggatgtcggcctcgcgcgctccccccgccgctaacccgccggaccagatcatgcactccatgaaacgccaactccccttctcctccatgaagcctcccttcgtcgccgccggagactatcaccgccatgacgccgccgaagccatcgtcgtcaagactcccctactgaagcggaagagtgaagtggctgattttgaagctgattctggtgataggatgactgctggattcactgaagcagctaatagtccttttcagacacctgtatcaggaaagacgggaaagggaggcaaatcctctaggctgacaaaaggcaacagagttggaactcagaccccaggctcaaacattggttctcctgcaggaagtaatctcactcctgctggtccatgtcgttatgacagctctttagggctgttgacaaagaagttcatcaatttgatcaaacaagctgaggatggtatccttgatctgaataaagctgctgacacattagaggttaatataatttcatctgctcaaatgattccatgctgtaaagttttattattttcttttcggtatccgcaggtgcaaaagaggaggatatatgatataacaaatgttcttgaagggattggccttatagaaaagaaacttaaaaatcgaattcaatggaagggactagatgtttcaagaccgggtgaggctgatgatagttttgccagtttacaggcagaagttgaaaatttaacgatgaaggagcgccagttagacgaacaaataagggagatgcaagaaagactgcgggatcttagtgaagatgaaaataatgacaagttgctttttgttactgaggaagatataaagaatttgccctgcttccagaatgaaaccttgatagccattaaagctcctcatggaaccactttggaggtccctgatcccgacgaggccgttgattatctgcagaggagatacaggatagtcctcagaagcacaatgggcccaatagatctttaccttgttagtcaatttgaagaaaagtttgaagagattaatggtgctgatgttgcacccaaacttccatcaagtccagatgttaccaaacaacaatcaacagtggtcccagaggatagagggaagcacatagaagtgcagggacaagcagctcctggacctagttcagattttactccctcccaggatttcgtgagtgggatcatgaagattgttccttcagatgttgctagtgaagctgattactggcttttatcagatgctgatgttagcataactgacatgtggagaacagaacctggagttgaatggaatgaactggaaccacttcaagaagattattgtatgactgacgagaacactacaacgccaagtcatccttcaaatgtaggtgaagtgtcttctgcatctaaacctactggaggttgaagcttccaaaggatgcattgtgaatataatagtgaacgtggtgttcctcttccttctgagaacctatgacatctagccatctcccttttgtatcctctctacatagtcctggaggttggattgaaggttccatgaagatgctttctcatgtttctccaagaagttcgatctaggagctaactgagtggccaatcaactggctcattgtacagtaaatattacataacctaagcgaccttagttcaagaaaaaaatctcgctgctttgctgaaccatctttgtatattacataaccctagtcttggctttctagtgtacttagctcgatctcttatgtttaccaagcaataaaaaacacttcggaatgctcccaggcaatgttatcac

SEQ ID NO: 6218 - DNA, 2039 bp, Phaseolus vulgaris
aggaatttattgtagcaagtgcttccctccacatctatatccgaaccaaattccctcccttctcttcttcttctttctcttctctctcttttttttttgttcttctctttccctcgttttcctctccctttctctctcccgcttttttattttccgaaaccaacaaacgctcagatctctgtttccctcccattccttcggattcccccaattcccactctcaaaccccgccgattccccttccgcgcggcggatgtcggccccgcgcgctccctccgccgcagccgccaccgcctcctccaatccgcccgatcagatcatgcactccatgaaacgccaactacccttctcctccatgaaaccgcccttcgcagccgcaggagactaccaccgtttcgctcctgaccaccgccccagcctcgacgccgaagccgtggtcgtcaagactccccaattgaagcgaaagagtgaagcggctgattttgaagctgattctggtgacaggatgactcctggaaccactgaaccagctaatagtccttttcgtacacctgtatcaggaaaaacagggaagggtggcaaatcctctaggatgacaaaatgcaacagacttggaactcaaactccaggctcaaatattggctctccttctggcaataatctcactcctgctggtccatgtcgttatgacagctctttaggtctgttgaccaagaagttcatcaatttgatcaaacaagctgaggatggtatccttgatctgaataaagctgcagacacgttagaggtgcaaaagaggaggatatatgatataactaacgttcttgaagggattggccttatagaaaagaaactcaagaaccgaattcaatggaagggactggatgtttcaagaccgggagaggctgatgataattttgctagtttacaggcagaagttgaaaatttaacaatggatgaacgccggttagatgaacaaataagggagatgcaagaaagactgcgggagctcagtgaagatgaaaataatgagaggatgctttttgttactgaggaagatataaaaaatttgccctgcttccagaatgagaccttgatagcaattaaagctcctcatggcaccactttggaggtccctgatcccgacgaggctgttgattatccacagcggagatacaggatagtcctcagaagcacaatgggccccatagatgtttaccttgttagtcaatttgaagagaagtttgaagatattaatggtgttgatgttgcacccaaatttccatctagtccagatgttaacaaaatcaagccaaaacaccaaaatcatgaacttggctatgcaccaaccatgtcaagatcagggaccagattttcacgggcctagttcagagtttactacctctcaggatttcgtgagtgggatcatgaagattgttccttcagatgttgctagtgaagctgattactggcttttatcagatgctgatgttagcataactgacatgtggagaacagaacctggagttgaatggaatgaactggatccgcttcaagaagattactgcatcactcgcgagaacacttcgaccccaagtcatccttcaaatgtaggtgaagtgttgtcttctgcatctaaacctactggaggttgaagcttccaaaggatgcattgtgaatataaaagtgaacgtggtgtcattttcctgctgagaacctatgacatccatccatcatccttttgtatcctctctacattgccctggtggttggattgaaggttccatgaagatgttttctcatgtttctccaagaagctagtccgaggaactgagtgacctatcaattggctcattgtatagtaaatattacataacccatgggaccttagttcaagaaaaaagatcttgatactttgctgaaaccatctttgtatattattttaaatcttggctttctagtacttagttcaatgccttatgttttgcaagcaataaaaaaacttaggaatgcaaattagaagagttaagcttctaggc

SEQ ID NO: 6219 - DNA, 2128 bp, Cicer arietinum
atccgaaccaaatttctcattctcattttttctttccctcgttttcttctctcatttctctctcccgcttttttgttttccgacttaccaaacacctagatctcacccgtttccctcccatttcctctttcaattctcatcggagctccatcgccggcacttggatgtcggccaaccgagctcctcccgccgcctcctcctccaacccgccggaccagatcatgcaatccatgaaacgacaactcccgttttcctccatgaaacctccttttgtagcttccggagattatcacaggtttggtcccaacaaccgccggaatctggaccaagaaaccgaagctattgttgttaagactcctcaattgaagcggaagagtgaaacggccgattttgaagctgattcaggtgataggatgactcctgaatccaccgaagcagccaatagtccttctcagacgcctgcatctggtaagacggggaaggcaggcaaatcctctaggctgacaaaatgcaacagatctggaactcaaaccccaggctcaaatattggttctcctccaggaaacaatctcaccccggctggtccatgtcgatatgacagctctttaggcctgttgacgaaaaagttcatccatttaataaaacaagcagaggatggcattcttgatcttaataaagctgctgacacattggaggtgcaaaagaggaggatatatgatataacaaatgttcttgaagggattggccttatagaaaaaaagctcaagaacagaattcagtggaaggggctggatgtttcaaaaccaggggaggctgatgatagttttgctagtttacaggcagaagttgaaaatttaacaatcgaggaacgccggttagatgaacagataagggagatgcaagaaagactacgggaacttagtgaagatgaaaataatgagaagttgctttttgtcactgaggaagatataaagaatttgccctgctttcagaatgaaaccttgatagcaattaaagctccacatggcaccactttggaagtccctgatcctgatgaggctgttgattatccacagagaaggtacaggatagtcctgagaagcacaatgggcccaatagatgtttaccttgttagccaatttgaagagaagtttgaggagatcaacggtgttgatgttgcacccaaatttccatccagtccagaagttgacaagcagcaatcaactttggtcccagaggataaagggaaggaagtagaagtgcagggacaagatggtgaagggcctagttcagattttaccaactctcacgactttgtgagtgggatcatgaagattgttccttcagatgttgcgagtgacgctgattactggcttttatcagatgccgatgttagcataactgacatgtggagaacagaacccacagttgaatggaatgaactcaataagcttcaagaagattattgtacagctcctgaacacactacaaccccaagtcatccatcgaacataggtgaagtctcttctgcatccaaccctcctgatggttgaagcttcagaaggatgtattgtaaatggtgttctttcttcaactgagaacctatgacatccagccacctctctgttgtatcatcttcaacatagtgctagaggttggattgaaggttcctagaagttctaggctagaagttactttctcaatgtctctctgcgaagcttgtcctaaggaactgagggccagtcaaatggctcattgtacagttaatttttacataatccaagcaactttgtacttcaaggggaaaacacctgtggctttggtgaacccatctttgtatattgttgtaagtctcagctttctatagccgttagatcaaagtgtatgttcgcatagcaataaaaaaaagatttcaggatgcagagtgcagagctcagctaactgttttggtcaaatgataagtttcatctgatgaaagattatatggtcattccatttctttgaaaccttgtaattaacttctcagtttctatctgtacctcttttttcacgctccaatatcaatgtctctaacagttcacatgcttgtgagctacatcaattctacagaatgtagtttttccacatc

SEQ ID NO: 6220 - DNA, 1801 bp, Trifolium pratense
ctctcggagctccatcgccgtcaggtgatgtcgggcaaccgagctcctccgtccaccgccgctccctccaactcatcggaccagatcatgcaatcaatgaaacgccaactccctttctcttccatgaaacctccttttgtagcttccggagattatcatcgctttgcccccgaccaccgccgaaatctcgaccacgaaactgaagctatcgtcgttaagactcctccattgaagcggaaaagtgaagcagctgattctgaagctgattcaggtgataggatgactcctggatccactcaagcagccaatagtccttttcagacgcctgtatctggaaagatggggaagggaggcaaatcctctaggctgacaaaattcaacagatctggaactcaaaccccaggctcaaatattggttctccttcaggaaataatctcacccctgcgggtccatgtcgatatgacagctctttaggtctgttgacaaaaaagttcataaatttaataaaacaagcagaggatggtattcttgatctaaataatgctgctgacacattagaggtgcaaaagaggaggatatatgatataacaaatgttcttgaagggattgggcttatagagaaaaagctcaagaacagaattcagtggaaggggctggatgtttcaaaacctggggaggctgatgatagttttgctagtttacaggcagaaattgaaaatttaacaatggaggaacgccggttagatgaacaaataagggagatgcaagaaaagctgcgggatcttagtgaagatgaaaataatgagaagttgctttttgtcactgaggaagatataaagaacttgccctgcttccagaatgaaaccttgatagcaattaaagctccacatggcaccactttggaagtccctgatcctgatgaggctgttgattatccacagaggagatacaggatagtcctgagaagcacaatgggcccaatagatgtttaccttgttagtcaatttgaagaaaagtttgaggagatcaatggtgttgatgttgcacccaaaattccatccagtctagaagttaacatgcatctatcaactactgtggtcccagaggataaagggaaggaaatagaagtgcaggcacaagatggtgaagggcctagttcagacccaaccaactctcacgactttgtgagtgggatcatgaagattgttccttcagatgttgctagtgatgctgattactggcttttatcagatgccgatgttagcataaccgatatgtggagaacagaacccggagttgaatggaatgaactcgacgcgcttcaagaagatttttgtatggctcgtgagcaccctacaaccccgaatcatgcttcaaacataggtgaagcgtcttctgcatccaaccctactgaagggtgaagcctcaaaaggatttgttgtgactctaaagataaagtggagttctttctccaactgagaacctatgacatccaccaagcccccctgtggttggattgaaggttcctagaagatactttctcaatgtttcatcaagaagctagtcctgcagaactaaatggccagtcaaatagctaattgtacagttagtattacataatccaagtgactttgtacttcgaggaataaacacgcggctttggtgaacccaactttgtatattataactcccaggctttatagcccagttagcacaatgtgtatgtttcaaagcaataaaacacatctcagattgcaaattgaggtagaattatgctctcagcaaagcacaggtcaaata

SEQ ID NO: 6221 - DNA, 1845 bp, Trifolium pratense
attttccgactttccaaacaccgtagatctcatctcatttcctccgatctctctcggagctccatcgccgtcaggtgatgtcgggcaaccgagctcctccacccgccgcctctccctcgccggaccagatcatgcaatccatgaaacgccaactccctttctcctccatgaaacctccatttctagcttcctctgattatcatcgctttgcccctgaccaccgccggaatctcgaccaggaaactgaagctatcgtcgttaagactcctccattgaagcggaaaagtgaagcagctgatcttgaagctgattcaggtgataggatgacccctggatccactcaagcagccaatagtccttttcagacgcctgtatctggaaagatggggaagggaggcaaatcctctaggctgacaaaagccaacagatctggaacgcaaaccgcaggctcaaatattggttctccttcaggaaataatctcacccctgctggtccatgtcgatatgacagctctttaggtctgttgacaaaaaagttcataaatttaataaaacaagcagaggatggtattcttgatcttaataatgctgctgacacattagaggtgcaaaagaggaggatatatgatataacaaatgttcttgaagggattggtcttatagagaaaaagctcaagaacagaattcagtggaaggggctggatgtttcaaaaccaggggaagctgatgatagttttgctagtttacaggcagagattgaaaatttaacaatggaggaacgtcggttagatgaagaaataagggagatgcaagaaaagctacgggatcttagtgaagatgaaaataatgagaagttgctttttgtaactgaggatgatataaagaacttgccctgcttccagaatgaaaccttgatagcaattaaagctccacatggaaccactttggaagtccctgatcctgatgaggctgttgattatccacagaggagatacaggatagtcctgagaagcacaatgggtccaatagatgtttaccttgttagtcaatttgaagaaaagtttgaagagatcaatggtgttgatgttgcacccaaagttccatccagtctagaagttaatatgcatcaatcaactgtggtcccagaggataaagggaaggaaatagaagtgcagccacaagatgaagggcctagttcagatcctaccaactctcacgacttcgtgagtgggatcatgaagattgttccttcagatgttgctactgatgctgattactggcttttatcagatgccggtgttagcataaccgatatgtggagaacagaacccggagttgaatggaatgaactcaactcatttcaagaagatttttgtatggcccgtgagcacactacaaccccaaataatgcttcaaacataggtgaagtgtcttccacatccaaccctacagttggatgaagcctcaaaaggatttgttgtgactctaaagataaagtggagttctttctccactgagaacctatgacatccacccagccccgtgattggattgaaggttcctagaagatactttctcaacgtttcatcaagcttgtcctgcaaaactaaatggccagtcacatggctaattgtacagttagtattacataatccaagcgactttgtacttcgaggaaaaaacacgtagctttggtgaacccaactttgtatattataattcccagactttatagaccagttagcgcaatgtgtatgtttgcaaagcaataaaaaacacatttcagattgcaaattgaagtagaattatgctctcagcagagcacaggtcgaataataagtttca

SEQ ID NO: 6222 - DNA, 1905 bp, Medicago truncatula
ctccatcatcatcttcttctccctctccctcttccctttctctctcccgctttttcccactttccaaacacatagatctctcttccttttccctcccatttccttccatcgccggcaggtggatgtcgggcacccgaactcctcccgccaccgccgcgccggaccagatcatgcagcaacgtcaactccctttctcctccatgaaacctccctttctcgccgccgctgattatcaccgcttcgctcctgaccaccgccggaatcaagacctagaaactgaagctattgttgttaaaactcctcaattgaagcggaagagtgaagcagctgattttgaagctgattcaggtgataggatgactcctgggtccactgcagcagccaatagttctgttcagacgcctgtatctggaaaggcggggaaaggaggaaaatcctctaggatgacaaaatgcaacagatctggaactcaaacccctggctcaaatattggttctccttcaggaaataatctcacccctgctggtccatgtcgatatgacagctcattaggtctgttgacaaaaaagttcatcgctttaataaaacaagcagaggatggtattcttgatctaaataatgctgctgacacattagaggtgcaaaagaggaggatatatgatattacaaatgttcttgaaggaattggccttatagaaaaaaagctcaagaacagaattcagtggaaggggctggatgtttcaaaaccaggggaggccgatgatagttttgctagtttacaggcagaaattgaaaatttaacaattgaggaacgccggttggatgaacaaataagggagatgcaagaaagactacggaatctcagcgaagatgaaaataatgagaagtttctttttgtcactgaggaagatataaagaacttgccctgcttccagaatgaaaccttgatagcaattaaagctccacatggtaccactttggaagtacctgatcctgatgaggctgttgattatccccagagaagatacaggatagtcctcagaagcacaatgggcccaatagatgtttaccttgttagtcaatttgaagagaagtttgaggagatcaacggtgttgatgttgcatccaaatttccacccagtccagaagttaacaaagttaacaaggatcaatcaaccgtggtcccagaagataaagggaaggaaatagaagtgcagagacaagatggtgaagggcctagttcagatcttaataacaatcacgacttcgtgagtgggatcatgaagattgttccttcagatgttgctagtgatgctgattattggcttttatctgatgccgatgttagcataaccgacatgtggagaacagaacctggagttgaatggaatgaactcgaagcacttcaagaagaatattgtatggctcgtgagcaatctacaaccccaaatcatgcttcaaatattggtgaagtgccttctgcatccaaccctactgtaggatgaagcctcaaaaggatttattttgaacctgaagagaaagttgtgttctttctccaactgagaacctatgacatccacccagacctgcgaggttggattgaaggttgctagaagatactttctcaatgtttcatcaagaagcttgtcctggggaactgaatggccagtcaaatggctaattgtacagttagaattacataatccaagtgactttgtacttctagaggaaaaaacatgtggcttttgcgaacccaactttgtatattgtaatggtggggcattctagactacttagcgcgatgtgtatgtttgaaaggcaataaaaacacatttcagattgctaattgaagtagaattttgctctcaggcagagcactgatcaaataaaaagtttcatgacatt

SEQ ID NO: 6223 - DNA, 2429 bp, Glycine max
tccaattattttatctttgccgagacatcaactccccaaaaaaacaaaaccagtccggtttccagtttcagcttagctttaaggtatcaagcatatcttctatttctacttcacccctttcttctctctcctttcttcacccacatgagatgtgccttccttttccaacttgtgtactcttcttcttctccttcttcttgttgttgtccacctctctggaagagatgccccatcacttctactacttctcttacttcttgatgcctagtatcatcattgtctagtttttactgtgtttattttttttgggttgttgttgtctctctctttttttatggatcttggggtggtgggtttggagggggtggtgggttcagaaagtggttgtgtgtttggttcttctcttgcttcagatcctgagacaaagcacaagtggtacggatctggtttgctcaagcaagagagatctgccatagctactgaagatgatgagtggagaatttccaaagttgctaaaactgatcatgacatgtcttcagcctccaaagcaatgttctttcagcaaagaaacaactctttgttgagatctaataatgcaactcttttctctgatggtcatcaccaatcacaaatgttgaacttctcttctccaaagtcagagactttattggtagataaggctttctcaaatgccacattgcctttttcttatcatcaattgtctagttacagcagaaatacaggttacaattcgggaagcataagcatgcatggggctttggctagtgtgagagggccattcactccatcacagtggatggagcttgaacaccaagccttgatctacaagtacatcacagcaaatgttcctgtgccaactcatcttctcattcccatcagaaaagcacttgattccgttggcttctgcaacttctcatctggactcctcagatccaactcgttgggatggggaggcttccatttgggattctccaacagcacagaccctgagccagggaggtgtaggagaacagatgggaaaaaatggcgatgctcaagagatgctgtagtagatcagaagtattgcgaacggcacatgaaccgaggacgccatcgttcaagaaagcctgtggaaggccaatcaggccatgccctcaccaccactaacacacctaatgcttcctcaaactcaaccgtggtgcccggcaaccacaacaacaacacctttgcacacatcaatgtgcaccaccctcttcctcctcattcctctccagccaataccatcaataggatgtttatgagtaataataaagagaacaacaacacgagtgagaggatgaaggatggccttgcccttcccatgctacctcctactcttgagctgaaaccaaaggacaacaacaactctttcatggttcataaacaccaagaaccatatgatgaatcctcaaggaacaagaatgagtttggactcgtcacttctgattccttgcttaacccttcacagaaaagaagctttgattcttcttcttcttcttcacaaaaggatgattcttctgagtcccaacaacaacattccctcaggcacttcattgatgactctcccaaaccacagtctcatcataatcataaccatcgttcgtcgtcatctatttggcctgaactcgacaacatgcagtcagacaggactcagttatcaatctccataccaatatcttcctcagatcacttcatgtcatttgcaacttcctcgccctcgaatgaaaaactcacattgtcgccactaaggctttcgagggagttcgaccccattcaaatgggattaggagtgggaagtgcctccaatgaagcaaacactaggcaagccaattggattccaatcacttgggagagttcaatgggtggtcctcttggagaggttttgaaccttagtaacaataataataacagcaatgcaagtgatcaatgtggcaagaacaacaacaacacttcagctctcaacctcatgaaagatgatgacgatgatgatgggtgggacaatagtcctcctccaatagggtcatcaccaactggggtgcttcaaaaaacagcatttggatcactttccaacagcagtgctgggagcagtccaagaggggcaccagagaacaacaacaaagaatagagatttctgatgattccttgttttcacgtttgaactgttttttgttgttgttcttcttcttcttcctcaaaaaattgtttgggaatggattggcgtttgtagaatgtgtggaccacaacaactcaacaagagttgtagctggctagctactgtctctttcactccaaagttcttcaaaatctttggtttcacgggtttgtactattgtctggttttatatttggaattgtttaacttgaaaaaattacttctgttttcatcttaa

SEQ ID NO: 6224 - DNA, 2525 bp, Glycine max
gtttcttgctcccccgccagtttctctctatctctccaattattttatctttgccgagacatcaactccccaaaaaaacaaaaccagtccggtttccagtttcagcttagctttaaggtatcaagcatatcttctatttctacttcacccctttcttctctctcctttcttcacccacatgagatgtgccttccttttccaacttgtgtactcttcttcttctccttcttcttgttgttgtccacctctctggaagagatgccccatcacttctactacttctcttacttcttgatgcctagtatcatcattgtctagtttttactgtgtttattttttttgggttgttgttgtctctctctttttttatggatcttggggtggtgggtttggagggggtggtgggttcagaaagtggttgtgtgtttggttcttctcttgcttcagatcctgagacaaagcacaagtggtacggatctggtttgctcaagcaagagagatctgccatagctactgaagatgatgagtggagaatttccaaagttgctaaaactgatcatgacatgtcttcagcctccaaagcaatgttctttcagcaaagaaacaactctttgttgagatctaataatgcaactcttttctctgatggtcatcaccaatcacaaatgttgaacttctcttctccaaagtcagagactttattggtagataaggctttctcaaatgccacattgcctttttcttatcatcaattgtctagttacagcagaaatacaggttacaattcgggaagcataagcatgcatggggctttggctagtgtgagagggccattcactccatcacagtggatggagcttgaacaccaagccttgatctacaagtacatcacagcaaatgttcctgtgccaactcatcttctcattcccatcagaaaagcacttgattccgttggcttctgcaacttctcatctggactcctcagatccaactcgttgggatggggaggcttccatttgggattctccaacagcacagaccctgagccagggaggtgtaggagaacagatgggaaaaaatggcgatgctcaagagatgctgtagtagatcagaagtattgcgaacggcacatgaaccgaggacgccatcgttcaagaaagcctgtggaaggccaatcaggccatgccctcaccaccactaacacacctaatgcttcctcaaactcaaccgtggtgcccggcaaccacaacaacaacacctttgcacacatcaatgtgcaccaccctcttcctcctcattcctctccagccaataccatcaataggatgtttatgagtaataataaagagaacaacaacacgagtgagaggatgaaggatggccttgcccttcccatgctacctcctactcttgagctgaaaccaaaggacaacaacaactctttcatggttcataaacaccaagaaccatatgatgaatcctcaaggaacaagaatgagtttggactcgtcacttctgattccttgcttaacccttcacagaaaagaagctttgattcttcttcttcttcttcacaaaaggatgattcttctgagtcccaacaacaacattccctcaggcacttcattgatgactctcccaaaccacagtctcatcataatcataaccatcgttcgtcgtcatctatttggcctgaactcgacaacatgcagtcagacaggactcagttatcaatctccataccaatatcttcctcagatcacttcatgtcatttgcaacttcctcgccctcgaatgaaaaactcacattgtcgccactaaggctttcgagggagttcgaccccattcaaatgggattaggagtgggaagtgcctccaatgaagcaaacactaggcaagccaattggattccaatcacttgggagagttcaatgggtggtcctcttggagaggttttgaaccttagtaacaataataataacagcaatgcaagtgatcaatgtggcaagaacaacaacaacacttcagctctcaacctcatgaaagatgatgacgatgatgatgggtgggacaatagtcctcctccaatagggtcatcaccaactggggtgcttcaaaaaacagcatttggatcactttccaacagcagtgctgggagcagtccaagaggggcaccagagaacaacaacaaagaatagagatttctgatgattccttgttttcacgtttgaactgttttttgttgttgttcttcttcttcttcctcaaaaaattgtttgggaatggattggcgtttgtagaatgtgtggaccacaacaactcaacaagagttgtagctggctagctactgtctctttcactccaaagttcttcaaaatctttggtttcacgggtttgtactattgtctggttttatatttggaattgtttaacttgaaaaaattacttctgttttcatcttaacttttatattgttttcatgtgtgccgggtgttttgaaacatagttatgctcttaggttttgc

SEQ ID NO: 6225 - DNA, 2497 bp, Glycine max
gaaaaaacaaaaccaggccggtttccagtttcagcttagctttaaggtgtcaagcatatcttctatttctactctctctccttccttcacccacatgagatgtgccttccttttccaacttgtgtactcttcttcttcttgtccacctctcaggaagagatgccccatcacttcttcttcttcttgatgccaagtatcatcattgtctagttttcactgtgtttttttttgttgtctctctctctctctcttttttttttatggatcttggggtggtgggtttggagggggtggtgggttcagaaagttgttgtgtgtttggttcctctcttgcttcagatcctgagacaaagcacaaatggtacggatctggtgtgctcaagcaagagagatctgccatagcaagtgaagatgatgagtggagaacttctaaagtggccaaaactgatcatgacatgtcttctgcctccaaagcaatgctctttcagcaaagaaacaactctttgttgagatctaatgctacccttttctctgatggccatcatcaccaatcacaaatgttgagcttctcttctccaaagtcagagtctttgttggtagataaggcttcctcaaatgccacattgcctttttcttaccaccaattgtctagcaacaccagaaatgcaggttacagttcaggaagcataagcatgcatggggctttggctggtgtgagagggccattcactccgtcacagtggatggagcttgaacaccaagccttgatctacaaatacatcacttcaaacgtgcctgtgccaacccatctcatacccattagaaaagcacttgattctttgggcttctgcaacttttcaactggactcctaaggcccaacgcattgggatggggaggtttccatctgggattctcgaacaacacagaccctgagccaggcaggtgtaggagaacagatggaaaaaaatggcgatgctcgagagatgccgtagtggatcaaaagtattgcgagcggcacatgaatagaggacgccatcgttcaagaaagcctgtggaaggccaattaggccatgccctcaccaccaccaccaccaccaatacacctaatgcttcctccaactctaccgtggtgccccgcaacaccaccaccaccaccacctttgcacacaacaatgtgcaccaccctcttccacctcattcgtctcaggccaacaccatcaataggatgtttacaagcaacaaagagaataacagtaccagtgagaggctgcaggaccctgctcttcccatgctgcctcccactcttgagctgaaaccaaaggagaacaatcctttcatgattcataaacaccacatcccagctgatgaatactcaaggaacagcaatgagtttggactcgtcacttctgattccttgcttaaccctacacagaaaagaagctttacttcttcacaaaaggatgattctgagtcccaacaacaacattccctcaggcacttcattgatgactctcccaaaccacagtctcataatcatcaccaccatcatcattcgtcgtctatttggcccgaactggacagcatgcaatcagacaggactcagttatcaatctccataccgatatcttcctcagattttatgtcattcactacttcctcaccctccaacgagaaactcacgttgtcaccattggggcattcgagggagttagaccccattcaaatggagttgggaatgggaagtggtgcctccaatgaagcaaacaccaggcaagccaattggattccaatcacttgggagagttcaatgggtggtcctcttggagaggtattgaaccttagcaataacagcaatgcaagtgatcaatgtggcaagaacaacaacacttcagctctcaacctcatgaaagatgggtgggacaataatcctccactagggtcatccccaactggggtgcttcaaaaatcagcatttggatcactttccaatagcagtgctgggagcagtccaagggcagaaaacaacaaagaaggtgccaccttgtgcaatgccttgtaaagtacttcatacaagaagaagcccttgcccttgaactatggtgaagccatgatggaggaagaagaagaaaaggactttgttctttttacttcaattattagtgaagtttatatatataatatatatggtaatgctagagtttggaaatatgtgttcatgttcatgctaattacccttgcctaaataatttggatgtgtaggtaggttttttggtttggttgacttttactttgtttctttctattcatgcgtttttggcaaagtttgtattcaacagtaagtgaacgatgttggttggagtgtgtggacttggttgtttgttaaggagatgatgatggtcaggttttggggtccaagtgtggtgaccatgatttttcatgaccataataaatttatgtgactaattcgtgggactcaggcacgcacgtaggaaaaag

SEQ ID NO: 6226 - DNA, 2852 bp, Glycine max
aatttataaaccatgaagagtcagtttcttgcacccctaccagtttctctttatctctccaattattttatcttttgccaagacatcaactccccaaaagaaaaaacaaaaccaggccggtttccagtttcagcttagctttaaggtgtcaagcatatcttctatttctactctctctccttccttcacccacatgagatgtgccttccttttccaacttgtgtactcttcttcttcttgtccacctctcaggaagagatgccccatcacttcttcttcttcttgatgccaagtatcatcattgtctagttttcactgtgtttttttttgttgtctctctctctctctcttttttttttatggatcttggggtggtgggtttggagggggtggtgggttcagaaagttgttgtgtgtttggttcctctcttgcttcagatcctgagacaaagcacaaatggtacggatctggtgtgctcaagcaagagagatctgccatagcaagtgaagatgatgagtggagaacttctaaagtggccaaaactgatcatgacatgtcttctgcctccaaagcaatgctctttcagcaaagaaacaactctttgttgagatctaatgctacccttttctctgatggccatcatcaccaatcacaaatgttgagcttctcttctccaaagtcagagtctttgttggtagataaggcttcctcaaatgccacattgcctttttcttaccaccaattgtctagcaacaccagaaatgcaggttacagttcaggaagcataagcatgcatggggctttggctggtgtgagagggccattcactccgtcacagtggatggagcttgaacaccaagccttgatctacaaatacatcacttcaaacgtgcctgtgccaacccatctcatacccattagaaaagcacttgattctttgggcttctgcaacttttcaactggactcctaaggcccaacgcattgggatggggaggtttccatctgggattctcgaacaacacagaccctgagccaggcaggtgtaggagaacagatggaaaaaaatggcgatgctcgagagatgccgtagtggatcaaaagtattgcgagcggcacatgaatagaggacgccatcgttcaagaaagcctgtggaaggccaattaggccatgccctcaccaccaccaccaccaccaatacacctaatgcttcctccaactctaccgtggtgccccgcaacaccaccaccaccaccacctttgcacacaacaatgtgcaccaccctcttccacctcattcgtctcaggccaacaccatcaataggatgtttacaagcaacaaagagaataacagtaccagtgagaggctgcaggaccctgctcttcccatgctgcctcccactcttgagctgaaaccaaaggagaacaatcctttcatgattcataaacaccacatcccagctgatgaatactcaaggaacagcaatgagtttggactcgtcacttctgattccttgcttaaccctacacagaaaagaagctttacttcttcacaaaaggatgattctgagtcccaacaacaacattccctcaggcacttcattgatgactctcccaaaccacagtctcataatcatcaccaccatcatcattcgtcgtctatttggcccgaactggacagcatgcaatcagacaggactcagttatcaatctccataccgatatcttcctcagattttatgtcattcactacttcctcaccctccaacgagaaactcacgttgtcaccattggggcattcgagggagttagaccccattcaaatggagttgggaatgggaagtggtgcctccaatgaagcaaacaccaggcaagccaattggattccaatcacttgggagagttcaatgggtggtcctcttggagaggtattgaaccttagcaataacagcaatgcaagtgatcaatgtggcaagaacaacaacacttcagctctcaacctcatgaaagatgggtgggacaataatcctccactagggtcatccccaactggggtgcttcaaaaatcagcatttggatcactttccaatagcagtgctgggagcagtccaagggcagaaaacaacaaagaaggtgccaccttgtgcaatgccttgtaaagtacttcatacaagaagaagcccttgcccttgaactatggtgaagccatgatggaggaagaagaagaaaaggactttgttctttttacttcaattattagtgaagtttatatatataatatatatggtaatgctagagtttggaaatatgtgttcatgttcatgctaattacccttgcctaaataatttggatgtgtaggtaggttttttggtttggttgacttttactttgtttctttctattcatgcgtttttggcaaagtttgtattcaacagtaagtgaacgatgttggttggagtgtgtggacttggttgtttgttaaggagatgatgatggtcaggttttggggtccaagtgtggtgaccatgatttttcatgaccataataaatttatgtgactaattcgtgggactcaggcacgcacgtaggaaaaagttaatgcaagcaacacaagttttgtcgaagtcttatatggaatagagatttcgcatttcttgttttgaagtttgaacttgccctttgttcttcttcttcctcctcgttggaaatttgtttggaaatgaattggggtttgtggaatgtggaccacgcgagttgtagctgtctagctcgtgtttctttcacttcaaggtcttttaaatcttttggtttaacggagttataccaatctggttttaaatttggaattgtg

SEQ ID NO: 6227 - DNA, 2627 bp, Glycine max
ggtttccagtttcagcttagctttaaggtatcaagcatatcttctatttctacttcacccctttcttctctctcctttcttcacccacatgagatgtgccttccttttccaacttgtgtactcttcttcttctccttcttcttgttgttgtcctcctctctggaagagatgccccatcacttctaccacttctcttacttcttgatgcctagtatcatcattgtctagtttttactgtgttttttttttttttgggttgttgttgtctctctttttttatggatcttggggtggtgggtttggagggggtggtgggttcagaaagtggttgtgtgtttggttcttctcttgtttcagatcctgagacaaagcacaagtggtacggatctggtttgctcaagcaagagagatctgccatagctactgaagatgatgagtggagaatttccaaagttgctaaaactgatcatgacatgtcttcagcctccaaagcaatgctctttcagcaaagaaacaactctttgttgagatctaataatgcaactctcttctctgatggtcatcaccaatcacaaatgttgagcttctcttctccaaagtcagattctttgttgatagataaggcttcctcaaatgccacattgcctttttcttcccaccaattgtctagctacaccagaaatacaggttacaattcaggaagcataagcatgcatggggctttggctagtgtgagagggccattcactccatcacagtggatggagcttgaacaccaagccttgatctacaagtacatcacagcaaatgttcctgtgccaactcatcttctcattcccatcagaaaagcacttgattctgttggcttctgcaacttctcagccggactcctcagacccaactcattgggatggggaggtttccatctaggattctcgaacaatacagaccctgagccagggaggtgtaggagaacagatggaaagaaatggcgatgttcaagagatgccgtagtagatcagaagtattgcgagcggcacatgaaccgaggacgccatcgttcaagaaagcctgtggaaggccaatcaggccatgccctcaccaccaccaccagtaatacacctaatgcttcctccaactctgtggtgcctggcaacaacaacaacacctttgcacacaacaatgtgcaccaccctattcctcctcattcctctccggtcaacaccatcactaggatgtttacaagcaacaaagagaataataacagtaccagtgagaggatgcaggaccctgcacttcccatgcttcctcccactcttgagctgaaaccaaaggagaacaatcctttcatgattcataaacaccaaatcccatctgatgaatactcaagtaggaacaacaatgagtttgggcttgtcacttctgattctttgcttaacccctcagagaaaagaagctttacttcttcacaaaagaatgattcttctgagtcccaacaacaacattccctcaggcacttcattgatgactctcccaaaccacagtctaatcatcatcatcgttcgtcgtctatatggcctgaacttgacaacatgcagtcagacaggactcagttatcaatctccataccaatatcttcctcagatcacttcatgtcattcactacttccttgccctcgaacgagaaactcacgttgtcaccacttaggctttcaagggagttagaccccattcaaatggggttgggagtgggaagtgcccccaatgaagcaaacactaggcaagccaattggattccaatcacttgggagagttcaatgggtggtcctcttggagaggttttgaaccttagtaacaataacaacagcaatgctagtgatcaatgtggcaagaacaacaacaacacttcagctctcaacctcatgaaagatggatgggacaataatcctccatcagggtcatccccaactggggtgcttcaaaaatctgcatttggatcactttccaatagcagtgctgggagcagtccaaggggggcagagaacaacaaagaaggtgccaccttgtgcaatgccttgtaaagtacttcatacaagaagaagaagccccttgccctttgaaatatgatgaagccatgttggaggaggaagaagatgaaaaggactttgttcttttgacttcaattattagtgaagtttatatatatatggtaatgttagaatttggaaagatgtgttcgtgttcatgttcatgctaattacccttgccctcataatttggatgtgtaggtaaggttttttgtgtggtttgcttgacttgtaatttgtttctttctattaatgcgtttttagcaaagtttgtattctacaagtaagtgaatgattttggttggagtgtgtgtgaacttggttgtttttttaaggagatgatgatgatgatgatggtgatcaggttttggggcccaattgtggagaccatgatctttcatgacaatagtaaatatatgtgactaattcgtgggactcacggcacgcacgtagtagaaaaagttaatgcaaatgcaagcaacacaagttttgtcgaactcttaaatggaatagagatttctgattccttgttttgatgtt

SEQ ID NO: 6228 - DNA, 3018 bp, Glycine max
agatactaaaaatatttttttttgtcatttataataattttatataagttacataaaattatatctagtaaaatatactataaaaaaataccacaataaaccatgttgagtcagtttcttgcaaccccaccagtttctctctactctccaattattttatctttgccaagacatcaactccccaaaaaaacaaaaccagtccggtttccagtttcagcttagctttaaggtatcaagcatatcttctatttctacttcacccctttcttctctctcctttcttcacccacatgagatgtgccttccttttccaacttgtgtactcttcttcttctccttcttcttgttgttgtcctcctctctggaagagatgccccatcacttctaccacttctcttacttcttgatgcctagtatcatcattgtctagtttttactgtgttttttttttttttgggttgttgttgtctctctttttttatggatcttggggtggtgggtttggagggggtggtgggttcagaaagtggttgtgtgtttggttcttctcttgtttcagatcctgagacaaagcacaagtggtacggatctggtttgctcaagcaagagagatctgccatagctactgaagatgatgagtggagaatttccaaagttgctaaaactgatcatgacatgtcttcagcctccaaagcaatgctctttcagcaaagaaacaactctttgttgagatctaataatgcaactctcttctctgatggtcatcaccaatcacaaatgttgagcttctcttctccaaagtcagattctttgttgatagataaggcttcctcaaatgccacattgcctttttcttcccaccaattgtctagctacaccagaaatacaggttacaattcaggaagcataagcatgcatggggctttggctagtgtgagagggccattcactccatcacagtggatggagcttgaacaccaagccttgatctacaagtacatcacagcaaatgttcctgtgccaactcatcttctcattcccatcagaaaagcacttgattctgttggcttctgcaacttctcagccggactcctcagacccaactcattgggatggggaggtttccatctaggattctcgaacaatacagaccctgagccagggaggtgtaggagaacagatggaaagaaatggcgatgttcaagagatgccgtagtagatcagaagtattgcgagcggcacatgaaccgaggacgccatcgttcaagaaagcctgtggaaggccaatcaggccatgccctcaccaccaccaccagtaatacacctaatgcttcctccaactctgtggtgcctggcaacaacaacaacacctttgcacacaacaatgtgcaccaccctattcctcctcattcctctccggtcaacaccatcactaggatgtttacaagcaacaaagagaataataacagtaccagtgagaggatgcaggaccctgcacttcccatgcttcctcccactcttgagctgaaaccaaaggagaacaatcctttcatgattcataaacaccaaatcccatctgatgaatactcaagtaggaacaacaatgagtttgggcttgtcacttctgattctttgcttaacccctcagagaaaagaagctttacttcttcacaaaagaatgattcttctgagtcccaacaacaacattccctcaggcacttcattgatgactctcccaaaccacagtctaatcatcatcatcgttcgtcgtctatatggcctgaacttgacaacatgcagtcagacaggactcagttatcaatctccataccaatatcttcctcagatcacttcatgtcattcactacttccttgccctcgaacgagaaactcacgttgtcaccacttaggctttcaagggagttagaccccattcaaatggggttgggagtgggaagtgcccccaatgaagcaaacactaggcaagccaattggattccaatcacttgggagagttcaatgggtggtcctcttggagaggttttgaaccttagtaacaataacaacagcaatgctagtgatcaatgtggcaagaacaacaacaacacttcagctctcaacctcatgaaagatggatgggacaataatcctccatcagggtcatccccaactggggtgcttcaaaaatctgcatttggatcactttccaatagcagtgctgggagcagtccaaggggggcagagaacaacaaagaaggtgccaccttgtgcaatgccttgtaaagtacttcatacaagaagaagaagccccttgccctttgaaatatgatgaagccatgttggaggaggaagaagatgaaaaggactttgttcttttgacttcaattattagtgaagtttatatatatatggtaatgttagaatttggaaagatgtgttcgtgttcatgttcatgctaattacccttgccctcataatttggatgtgtaggtaaggttttttgtgtggtttgcttgacttgtaatttgtttctttctattaatgcgtttttagcaaagtttgtattctacaagtaagtgaatgattttggttggagtgtgtgtgaacttggttgtttttttaaggagatgatgatgatgatgatggtgatcaggttttggggcccaattgtggagaccatgatctttcatgacaatagtaaatatatgtgactaattcgtgggactcacggcacgcacgtagtagaaaaagttaatgcaaatgcaagcaacacaagttttgtcgaactcttaaatggaatagagatttctgattccttgttttgatgtttgaactggccctttgttctacttcttccttggaaatttgtttgggaatgaattggcgtttgtggaatgtgtggaccacgcgagttgtagctggttagctcgtgtctctttcactttaaggtcttttaaatcttttggtttcacggggttataccagtctggttttaaatttggaattgtgtaaagttga

SEQ ID NO: 6229 - DNA, 2774 bp, Phaseolus vulgaris
ccctcttccacagttacctctctctctctctctctttctcacacattttctctctccacccacatgagatgtgccttacttttccaaagggagcagcaacaacttgtgtactctacttcttgttgttgtccacaacctctcaggaagagatgccccatggccaacacttcccttgttccttgaagcctagtcttgttaatgctattatcagtgtctagttctagttatctgtgtgctcttttattgtatttgtttttggttccttctttgtcttgatggatcttggggtggtgggtttggaggggttggtgggttcagacagtagttgcgcctttggttcttctcttgcttcagatcctgagacaaaacacaagtggtacggatctggggtgctcaagcaagagagatctggcgcagcaagtgaagatgagtggaggacttcaaaagtgcctaaaactgatgacaacatgtctgctgcatccaaagcaatgctctttcaccagaggaactctctgctgagatctaatgtcacgcttttctctgagggccacaaccaaccacaaatgctgagcttctcttcaccaaaatcagagcctttgctggtggacaaggcctccttaaatgccacattgcctttttcttaccaccaattgtctagttacagcagaaatacaggttacagttcgggaagcataagcatgcatggggctttgtctggtatgagagggccattcacgccttcacagtggatggaacttgaacaccaagctttgatctacaagtacatcacagcaaacgtccctgtaccaactcatcttctcatacccatcagaaaagcactcgattctgctgccttctgcaacttttcaaccggactcctcagacccaacacattgggatggggaggtttccatctgggattctcgaacaacacagaccctgagccagggaggtgtaggagaacagatgggaagaaatggcggtgctcgagagatgccgtagttgatcagaaatattgcgagcggcacatgaacagaggacgccatcgttcaagaaagcctgtggaaggccaatcaggccatgccctcaccaccactaccaccacaacaaccaccactactcctcctaatgcttcctcaaactccattgtggtgcccggcaacaacaacaataacaacacctttgcacacaacaatgtgcaccaccctctcccatctcattcctcttcagccaacaccatcaacaggatgtttatgagtaacaaagagaacaataacaacgctagtgagaggatgcaggatggccctgcacttcccatggtgcctccaactcttgagctgaaaccaaaggaccctttcatgattcataaacaccaactcccatatgatgaatcatcctcaaggaacaacaatgagtttgggcttgtcacttctgattccttgctcaacccttcacagaagagaagctttggttcatcatcttcacaaaaggatgattctgagtcccaacaacaacatcatcccctcaggcacttcattgacgactctcccaaaccacagtctcatcatcaccatcatcgttcttctgtgtggcctgaacttgacaacatgcagtcagataggactcagttatcaatctccatacccatatcttcctcagatttcatgtcattcgctacctcctcaccctctaatgagaaactcacattgtcaccactaaggctttcaagggaattagaccccattcaaatggggttgggagtgggaagtggtgctcccaatgaatcaaacactaggcaagccaattggattccaatcacttgggagagttctatgggtggtcctcttggtgaggttttgaacctgagtagcagtaataacaacagcaatggaagtgatcactgtggcaagaacacttctgctctcaacctcatgaaagatgggtgggacaatagtcctcccctaggctcatcccctaacggggtgttgcaaaaaacagcatttggatcactttccaatagcagtgctggaagcagtccaagggcagacaacaacaataacaaagaaagtgccagtgccaccacactgtgcaatgccttgtgaagtccattccataccagaacaacaacaacttttatgacggcatgatggaaagaagaagaaggagaaggagaagaaaagaactttgttcttttgactttaatgattagtgaagtttatatatattataatatataaatacatatggtaatcttagaatttggaaatatgtgttcttgtttattaataccttgccctcatcataatttggatatgtaggtaggtttttggtttgcttgactttaatttgtttcttcttttcatgcattttggcaaagtttgtattctactgtaagtgatgttggttggagtgtgtggacttggttgttttttaaggagatgatgatgatgatgatggacatgttttggggtcaagttgagaccatgattttgcatgactatagtatatatatgtgtgtgtgagtgaatgatatgactaatttggtaggggtcaccacccatgcacttagaaaaagttaatgcaagttttgtcgtggtcttaaatggaatagagatttctgattcctggttttggagtttgaagtggcttttgttgttcttcttctttaagtttgtttgggaatggattggcgtttgtggaatgtggaccactcacttgtggttcccttgcttctgtccctttcactctaaggtctttcaaaaccttttggtttc

SEQ ID NO: 6230 - DNA, 2602 bp, Glycine max
agttagtgaatgctggtgtatctaagagtgcgttacgttaaattttgccaaaggattttacatgaggagtgactcagatatttcactcacgacagagccaggaggaggaggaggaggaggacaagttcactgtagcattgctcaactgttttgttgtgtgtacttgtgttcaaataacaacaagaaagactgaaccagagctccataacataagtttcttcttgtttttccttgtgtctatttccccgagacaaaggaggttgaacttgaaagttgaaactctcttctgttctgttctgtcttttaacacaaaaattatggttataattttttctggttctttctgaggggctgtttttagcggttgaggttgaagctgtaaatgccgctgagatagatttacatggggaagaagggaagtggtagttcatggttaactgctgtcaaaagggcattcagatctcccaccaaagacagtgacaaaaggagtggcagaagaagagaagactgtgatcaagaagaagacgaagaaaagaagagggaaaagagaagatggattttcaggaagactcacatgagtcatgaaggagggaacaacaacaacaacactcaacaaaagttgaagcatgatgtggcagcaagtggtggtggttcaaggacagaccaggatcagaagcatgcagttgcggtggcggtggccaccgcagaagccgccatggccaccgctcaggcggcggtggaggtggcaaggttgtccaaacctgctagccatgccagggagcattatgctgctgttgtgatccaaactgcttttagagggtatcttgctagaagagcacttcgtgcactaaagggtttggtgaagttgcaagctttggttaggggtcacaatgttaggaagcaggcaaagatgacccttaggtgcatgcaggctttggttagagttcaagcaagggttcttgaccaacgcataaggtcttcacttgaaggtagtagaaaatccactttcagtgacactgctagtgtttgggactcgcggtatcttcaggacatttcagataggaaatcaatatcaagagagggaagcagcattacagatgactgggatgaaaggcatcacacagttgaagaagtgaaggccatgttgatgcagaggaaggaagctgctgcaatgaagagggacaagaccttatcccaagccttttcccaacagatttggaggaatggtaggacatcatcaattggaaatgaagatgagttggaagagagaccaaaatggctagatcggtggatggccacaaagccatgggagaatagaggaagggcttcaactgatcaaagagaccacattaagactgtggaaattgacacatctcagccttattcatatctaggaaccaattacagaagatcacatccaaattatcaatacaacccaaaccatcaccaaccacaaaggcattccattgcttccccactccatagatctcaccaaaatggatcctcccttcaccagtcccctgccaccccttctcctgccaaatcgaggcccatccaagtccggtccgcgagtccacgttgcattagagacgacagaagctaccacacctcccaaacaccaagcttgaggtctaattaccactacgcaggaaatttgtaccaaaatgggagggttgttggaactggaactagtaatggtggtgctactgctacattgcctaattacatggcggcaaccgagtctgcaaaggctcgaattcggtcacaaagcgcgccaaggcagaggccatccacaccagagagggacagggttggatcagccaagaaaaggctttcttttccagctcctgacccttatggtgtgggagtgagttatggaaactatggacatagtttaaggagtccaagcttcaagagtgtgagtggatcacactttggggggttagaacaacaatcaaattactcttcttgctgcactgagagtattggtgggggtcaggtttctccttcttcaacaggtgaccttaggaggtggttgagatgatttgttgcacactttaatgagaagaaacatgaccggacccattaggccatggccataattcacttcatatttgatttttatttgggctttttgtgatgttagagttaattttagtttaaccctttctcaccctcccaaaagaaagttatttaattacccccgggcgacctgaatctgatgttaggaaccagagaagcaagcaagtactttttcttgctaggaaactcagaacaatttaatgtgttcgtttatcattcgtttttcatacttttcttaagatgccaagataaaaagtgagccctatgtggtggcctacctcacttgggatgttgtgttgatgttgaaagaattgccaagaccatctgaaatagcttttaatggactgtcctgtcacaataacatagacttgtaagagcatctctagcagtttataatggactccagctggacaaccttttcttcactgaaactcataatcagaggtatcttggaattatgagctgtttggggtcccatcctactgaacactagtgttattaggtgcgtgctagaaggaac

SEQ ID NO: 6231 - DNA, 3196 bp, Glycine max
ttaaatgaacagttagtgaatgctggtgtatctaagagtgcgttacgttaaattttgccaaaggattttacatgaggagtgactcagatatttcactcacgacagagccaggaggaggaggaggaggaggacaagttcactgtagcattgctcaactgttttgttgtgtgtacttgtgttcaaataacaacaagaaagactgaaccagagctccataacataagtttcttcttgtttttccttgtgtctatttccccgagacaaaggaggttgaacttgaaagttgaaactctcttctgttctgttctgtcttttaacacaaaaattatggttataattttttctggttctttctgaggggctgtttttagcggttgaggttgaagctgtaaatgccgctgagatagatttacatggggaagaagggaagtggtagttcatggttaactgctgtcaaaagggcattcagatctcccaccaaagacagtgacaaaaggagtggcagaagaagagaagactgtgatcaagaagaagacgaagaaaagaagagggaaaagagaagatggattttcaggaagactcacatgagtcatgaaggagggaacaacaacaacaacactcaacaaaagttgaagcatgatgtggcagcaagtggtggtggttcaaggacagaccaggatcagaagcatgcagttgcggtggcggtggccaccgcagaagccgccatggccaccgctcaggcggcggtggaggtggcaaggttgtccaaacctgctagccatgccagggagcattatgctgctgttgtgatccaaactgcttttagagggtatcttgctagaagagcacttcgtgcactaaagggtttggtgaagttgcaagctttggttaggggtcacaatgttaggaagcaggcaaagatgacccttaggtgcatgcaggctttggttagagttcaagcaagggttcttgaccaacgcataaggtcttcacttgaaggtagtagaaaatccactttcagtgacactgctagtgtttgggactcgcggtatcttcaggacatttcagataggaaatcaatatcaagagagggaagcagcattacagatgactgggatgaaaggcatcacacagttgaagaagtgaaggccatgttgatgcagaggaaggaagctgctgcaatgaagagggacaagaccttatcccaagccttttcccaacagatttggaggaatggtaggacatcatcaattggaaatgaagatgagttggaagagagaccaaaatggctagatcggtggatggccacaaagccatgggagaatagaggaagggcttcaactgatcaaagagaccacattaagactgtggaaattgacacatctcagccttattcatatctaggaaccaattacagaagatcacatccaaattatcaatacaacccaaaccatcaccaaccacaaaggcattccattgcttccccactccatagatctcaccaaaatggatcctcccttcaccagtcccctgccaccccttctcctgccaaatcgaggcccatccaagtccggtccgcgagtccacgttgcattagagacgacagaagctaccacacctcccaaacaccaagcttgaggtctaattaccactacgcaggaaatttgtaccaaaatgggagggttgttggaactggaactagtaatggtggtgctactgctacattgcctaattacatggcggcaaccgagtctgcaaaggctcgaattcggtcacaaagcgcgccaaggcagaggccatccacaccagagagggacagggttggatcagccaagaaaaggctttcttttccagctcctgacccttatggtgtgggagtgagttatggaaactatggacatagtttaaggagtccaagcttcaagagtgtgagtggatcacactttggggggttagaacaacaatcaaattactcttcttgctgcactgagagtattggtgggggtcaggtttctccttcttcaacaggtgaccttaggaggtggttgagatgatttgttgcacactttaatgagaagaaacatgaccggacccattaggccatggccataattcacttcatatttgatttttatttgggctttttgtgatgttagagttaattttagtttaaccctttctcaccctcccaaaagaaagttatttaattacccccgggcgacctgaatctgatgttaggaaccagagaagcaagcaagtactttttcttgctaggaaactcagaacaatttaatgtgttcgtttatcattcgtttttcatacttttcttaagatgccaagataaaaagtgagccctatgtggtggcctacctcacttgggatgttgtgttgatgttgaaagaattgccaagaccatctgaaatagcttttaatggactgtcctgtcacaataacatgtaatttttcgtattttagcgattgccttttgttagcaaaatgtacaactttttttttttcctttcattgatcaattttaatcaaatggataaattaaacattgctagcaagagcaaatcatatagtaatgggtatatatatatatagttcataattagcaaatacttaactcttggtcatgtcatattctttgacctttataaccccgcatgactataattgatgtttctgtatattacgttacgtacttgtgcaatgtgcagtggtacatgtcaattctgaaatgtgaaagcgaaacaattttattcgaactcctctttcccgtacattttcaacatttatctacattttgaaactatggttaaaatatgatttcattataattagtgaagataattaagtatatgtagacaatagaactttcctgcatgtggaggagatcaacgctaacaaattgctcaaggatatcaacaaagaataatttgctcagtttttttttacactattatttgctcttggccatgcaactttttcaggttgctacttggcctgcagcataaaaaggataaaagtagatacgcttgggcatttattgagaagagatcatgaactgtggcttatgttctgtagttttaaaccacggtatctttttttcccaaactcttcttctgtatgtagtgataaacgttttgttctgttttgcagagacttgtaagagcatctctagcagtttataatg

SEQ ID NO: 6232 - DNA, 2586 bp, Phaseolus vulgaris
cgaacaatcaagctgaaaaatgcacatatgagctgagcataatcttttttattttgttttatgatactttggtgaagaactcaatcaaaattgagcataagattgaaattaaatgaacagaaagggaatgatggtgcattacatatagttttgttcttgaggatttttaacgaggggtggctcagatatttcactcactcaagacagaggcatgaggaggacaaagttactgtagcattgctcaactgtgttgttatgtactcgttcaaattaataacaaagactgaacaagaactccattagtgttgtgttggccctctccttgttttccctcctgtccattttcctcagacaaggttaaaggaggttgagttgagtctcaacctctcttctgtctttaactcttcatcacaacttatttttctggctctttctttctaaaggctgtttttagcggttctagctgtaaatgccgctgagatagatttacatggggaagaagggaagtggtagttcctggttaactgctgtcaaaagggcattcagatctcccaccaaagacactgacaaaaggagtggcagaagaagagaagactgtgatcaagaagaagacgaggaaaagaaaagggaaaagagaagatggattttcaggaagactcacatgagtcatgaaggagtaagtagtggacacaacactcaacaaaagttgaagcatgatgtgacggcaactactgaaggttcaagaacagaccaggatcagaagcatgcacttgcggtggccgtggccaccgcagaagcagccatggccaccgctcaggtggcggtggaggtggcaaggttgaccaaacctgctagccatgcaagggagcattatgctgctgttgtgatccaaacagctttcagagggtatctggcaaaaagagcacttcgtgcactaaaggggttggtgaagttgcaagctttggttaggggtcacaatgttaggaagcaggcaaagatgacccttagatgcatgcaggctttggttagagttcaagcaagggtccttgaccagcgcataaggtcttcacttgacggtagcagaaaatccactttcagtgacaccgccagtgtttgggactcgcggtatcttcaggatatttctgataggaaatcaatatcaagagaggggagcagcattgcagatgactgggatgaacgtcctcacactgttgaagaagtgaaggctatgttgcagcagagaaaggaagctgcaatgaagagggacaagaccttatcccaagccttttcccaacagatttggaggaatggtaggacatcatcaattggaaatgaagatgagttggaagagagaccaaaatggctagatcggtggatggccacaaagccatgggagaatagaggaagggcttcaactgatcaaagagaccccattaagactgtggagattgacacctctcagccttattcgtatctaggaaccaattacagaagatcacatccaaattatcaatataacccaaaccaccatcaaccacaaaggcattccattgcttccccactccatagatctcaccaaaatggatcccttcaccaatcccctgcaaccccttctcctgccaagtcaaggcccatccaagtgcgatcagcaagccctcgttgcatcagagaagacagaaactaccccacctcccaaacaccaagcttgaggtccaattaccattatacaggaaacttgtaccaaaatggaagggctgttggaagtggaactagtagtggtggtggtggtggtggtggtgctacattgcctaattacatggcggcaacggagtctgcaaaggctcgaattcggtcacaaagcgctccaaggcagaggccttccacaccagagagggacagggtgggatcagcaaagaagaggctttcttttcctgctcctgacccttatagcgtgggagtgagttacggaaattatgggcatagtttaaggagtccaagcttcaagagtgtgagtggatcacactttgggttggagcagcagtcaaactactcctcttgctgcactgaaagtcttggtggtggtgaggtttctccttcttcaactggtgaccttaggaggtggttgagatgatttgttgcatacttcaatgagaagaaacatgagcggacccattaggctatcgccattcacttctttgatttttatttatttgggcttttgtgatgttagagttaattttagtttaaccctttctcaccccaaaagaaagttatttaccccgggtgacctgaactgaagctgatgtttaggagcagagaagcaagtactttttcttgctagcaaactcagaacaatttaatgtgtacgtttatcattcgtttttcatagttttcttgagatgccaagataaaaaagtaagccgtatgtggtggcctacctcacttgggatgttgtgttgatgttgaaagaattgcctagaccatctgaatagcttttaatggactgtcctgtcacaatagcatgttaatatttcgtattttagcattgccttcacttagcaaaatgtacaaccctctttcctttca

SEQ ID NO: 6233 - DNA, 3113 bp, Cicer arietinum
gctttatccaaactccaaagaagaagtaatagctttttctgattccattatagaaaaagccacttttggtttctctaggccaccctcaacttgctttacacccttctctagtttcaatctccttggcatcattctctatcacacacatcccttttctttataggtaatttatttatctcacacatctattgattcaactttcaattattattattcattattcataacattaaaaccttaaggtatagcttctgacactccactgctgtccaccctcatgccacaaaaatccataagctttgcacatttaaattaatctacatacataaaaatttaatattctatgctacccctctcactcaaccacatgctttctctgactaccaatatagtaaatcaatttgtgtacaaactttggaaccttgtagtactcaacataatcttaaagcaagattttaattaaatatactatatctcagtcaaaataatttaattcgttaagttattatcataacaatggaacaaacagtaaagtgaataatttaattaatagcatgttatattcaatattttggcagctaataatattagatattaatttcactgcaagaatgattcatttatttgcacaaataagggttttttttgatattcaagacagaaccataatgaagacaatttcacactctttaacattgttgaatgtgtactttttgtgtgtgtgataaaaaataacaaagaaagaaccaaagatccataagtgttagctttggttctccttgtttttctccttctcttttaaaacacacaagcgttgaacctttctgtctttaactctgcacaattttctgatatctttttctttagtagtaatttttttgaagctgtaaatgctgttaagttttacatggggaagaaaggaagtagttcatggttaaatgctgttaaaagagcattcagatctccaacaaaagatagtgacaaaaaaagtggtagaagaagagaagattgtgatcaagaagaagatgaagaaaagaagagagaaaaaagaaggtggatttttagaaaacctgtgagtcatgaaacagtgaacaacaacagtgcacaaagtacaacaacaccaacaaagttgaagaatgatgttgtggttactgctacaagtggagtttcaaggacagatcaagatcaaaaacatgctcttgctgttgctatggctactgctgaggcagcaagagccactgctcaagctgctgttgaagttgcaaggttgactaagccttcaaatcatgctagggagcattttgctgctgttgttattcaaacttctttcagaggttatttggctagaagagcacttcgtgcacttaagggtttggtaaagttgcaagctttagtgagaggacacaatgttagaaaacaagcaaagatgacacttaggtgcatgcaagctcttgttagagtacaagcaagagttcttgaccaacgtgtaagatcttcttcacatgaaggaagtagaaaatcaacctttagtgacactactagtgtttgggattcgcggtatcttcaagacatttcggataggaaatcaatgtcaagagaaggaagtagtgttgcagatgattgggatgaacgtccacatacagttgaagaagttaaggccatgttgcaacaaaggaaggaagctgctatgaagagggaaaagtcattgtctcaagctttttcacaacagatttggagaaatggaaggacatcatcaataggaaatgaagatgaacttgaggagagaccaaaatggttagatagatggatggctacaaagccatgggagaatagaggaagagcttcaactgatcaaagagaccccattaagactgttgaaattgacacatctcaaccttattcatatctaggaaccaattacagaagatcacatccaaattatcaatacaatccacaccaccaaccccaaagacattccattgcttcaccactccatagaacacaccaaaatggatccattcaccaatccgtcactactccatctccatcaaaatcgagacctatccaagtccgatcatcgagtccacgatgtgttagagaagatagaagctaccacacttctcaaacaccaagcttgaggtctaattaccattacaatggtaacttgtatcaaaatagtagggtaggaacaagtaacagtgctgctactactgctgctactactacattgcctaattacatgcaagcaactgagtctgcgaaggctcgaattagatcgcagagtgcgccaaggcaaaggccatcgactccggagagggatagagctggatctgtaaagaaaaggctctctttccccgctccggatccttataatgttggaggagttagttatggaaattatggacatagtttaaggagtccaagtttcaagagtgtgaatgtagtatcacattttggtttggagcaacaatccaattactcttcttgttgtaccgagagtctcggtggcgaggtttcgccttcttcaaccggagaccttagaaggtggttgagataactgtcacttagatccaacggctctgcaacgactactgagtattatgttgcaactatgacccattagtttataacaaccactcacttattttatttagacattttgtgatgttagtgttattcttagtattaacccttttcacccaaaaaagaaaggaagttacttaaggtgaacatgaatctaaggtactatgttgctaggaaggtgagaacaatttattgtgttttggttttttatcatttgtttttccatatacttttgttaggatgccaagataaaaagataggattatgtggtggcctacctcacttgggatgttttgtttgatgttgaaacaattgcctacaccacttgaatggctttaaatggaatgtcttgtcacaataacatgtaatattatgtaattttaactatggttgcttttagtttgaaatgtacacccccacccctttaactttttcttgtgttattttaatcaaattgatattacttatctcagttacctgtttctatcaagagaaagtaatatgattatggatatactttacaattagga

SEQ ID NO: 6234 - DNA, 2264 bp, Cajanus cajan
acgacagagccatgacgaggacaagattactgtagcattgctcaactgtgttgtgtacttgttaaaaataacaacaaagaccgaagcgtagctccataagtgttggcctcggttctccttctgtctatttcccccagacaaggttgaacttgaacctctctgtcttttaactctttatcacaatttttctggctccttctgcgggcatttttaagcggttgaagctgtaaatgcctctgagttttacatggggaagaaggggagtggtagttcatggttaactgctgtcaaaagggcattcagatctcccaccaaagacactgacaaaaggagtggcagaagaagagaggactgtgaccaagaagaagatgaagagaagaagagggagaagagaagatggattttcaggaagactcacatgagtcatgaaggtgtgaacaacaacactcaacaaaagttgaagcatgatgcggcggtggaggtggcaaggttgaccaaacctgctagccatgttggggagcatcgtgctgctgttaccattcaaactgctttcagagggtatctggcaagaagggcacttcgtgcacttaaggggttggtgaagttgcaagccttagttagagggcacaatgttaggaagcaggctaagatgacccttaggtgcatgcaggctttggttagagttcaggcaagggtccttgaccagcgtataaggtcttcacttgaaggtagtagaaaatcaactttcagtgatactgctagtgtttgggactcaaggtatcttcaggacatttcggatagaaaatcaatgtcaagagagggaagcagcattgcagatgactgggacgaacgtcctcacacggttgaagaagtgaaggccatgttgcagcagaggaaggaagctgcaatgaagagggacaagaacttatcccacgccttctcccaacagatatggaggaatggtaggacatcatcaattggaaatgaagatgagttagaagagagaccaaaatggctagaccggtggatggccacaaagccatgggagaatagaggaagggcttcaactgatcaaagagatcccattaagactgtggagattgacacctctcagccttattcatatctagcaaccaactacagaagatcacatcctaattatcaatacaatccacaccatcaccaaccacaaaggcattccattgcctccccaatccatagatctcaccaaaacggttcccttcaatccccagcaactccttctcctgccaagtcaaggcctatccaaatccggtcggcgagcccacgatgcattagagaagacagaagctaccacacctcacagacaccgagcttgaggtctaactaccactacacaggaagcttgtaccaaaatggaagggttggaacaagcagtggtagtggcaatggtggtggtgctacattgcctaattacatggcggcaaccgagtctgcgaaggctcgaatccggtcacaaagtgcgcctaggcagaggccatccacaccagagagggacagggttggatcagccaagaaaaggctttctttcccagctcctgatccttatagtgtgggagcgagttatggaaattatggtcatagtttgaggagtccaagcttcaagagtgtgagtggatcacactttgggttggagcatcagtccaactactcatcttgctgcactgagagtattggtggtggtgaggtttctccttcttcaaccggtgaccttagaaggtggttgagatgatttgttgcacactttaatgagaacatgattaggtcatggcatttgaatattttgtgtgatgttagagttaattttagtttaaccctttctcaccccaaaagaaagagttaccccgggtgacctgaatctgacgttaggagcagagaagcaagtacttttcttgctaggaaactcagaacaatttaatgtgttcgtttatcattcgtttttcatacttttgttaagatgccaagaaaaaagtgagccgtatgtggtggcctacctcacttgggatgttatgttgatgttgaaagaattgcctacaccatctgaatagcctttaatggactgtcctgtcacaataacatgtaatattttcgtattttagtgattgcctttaattagcatagcaaaatgtaccataataatggataaattgcacatcgctagctagagcaattcatataataatgggtgtacttcacaattagcatatacttaaactcttgcccat

SEQ ID NO: 6235 - DNA, 2467 bp, Medicago truncatula
ttcatattcattattcataacattaaaagcctaaggtataccttctgacactcccactgctgtccactttcatgccacaaaaatccataagctttgcacaattagattcatttacataataaaattttggattttaatattctatgctaccccctcctctcactcacaaacacagcctgtctctgactaccattatattgaatcataaatcaatttgtatacaaactttgaaaccttgtagtactcaacataatcttaaaccatgattttaattcaatattttatagtagtacattggtcaaaataatttattaattatcacaaagaaacaaacagtaagttttacatggggaagaaaggtagtagttcatggttaactgctgtgaaaagagcattcagatctccaacaaaagatagtgaaaaaagaagtggtagaagaagagaagattgtgatcaagaagaagatgaagaaaagaagagagaaaaaagaaggtggatttttaggaaaccagtgaatcatgaaacagtgaataatactcaacaaagtacaccaacaaaattgaagcatgatgtggttactgctacaagtgtggcttcaaggacagatcaggatgagaaacatgctcttgctgtggctatggctacagctgaggcagcaagagctactgctcaagctgctgtggaagttgcaaggttgactaagagttcaaatcatgctagggagcattatgcagctgttgtgattcaaacttcttttagaggttatttggcaagaagagcactccgtgcgcttaaggggttagtgaagttgcaagctttagtgagaggtcacaatgttaggaagcaagcaaagatgacacttaggtgcatgcaagctcttgttagagtacaagcaagagttcttgaccaaaggataaggtctacttcacatgaaggaagtagaaaatcaaccttcagtgatactgctagtgtttgggattcgcggtatcttcaagacatttcagataggaaatcactatcaagagaaggaagtagtattgcagatgattgggatgatcgtccgcacacagttgaagaagttaaggccatgttgcagcagaggaaagaagcagcaatgaagagggaaaagtccttgtcccaagcattttcacaacagatttggagaaatggcaggacatcatcaattggaaatgaagatgaacttgaagagagaccaaaatggctagatagatggatggctacaaaaccgtgggagaataggggaagggcttcaaccgatcaaagagactctattaagactgtggaagtcgacacatctcaaccttattcatatctaggagcaaattacagaagatcacatccaaattatcaatataatccacatcaccaaccacaaagacattccattgcttcaccgctccatagatcacaccaaaatggttccgttcacaaccaatccaccactactccatctccagcaaagtcaagacctattcaagtccgatcgtcaagccctcgctgtgttcgagaagatagaagctaccaccatacctctcaaacaccaagcttgaggtctaattaccattacaatgggaacttgtaccaaaatagcaggggtggaacaagtaatggtagtactaatagtattgcttctactactgcttcagctacattgcctaattacatgcaagcaaccgagtctgcgaaggctcgaattcggtcacagagtgcaccaaggcaaaggccatcgacaccagagagggatagatccggatcagtaaagaaaaggctttctttccctgctcctgatccttataatgtaggaggagttggttatggaaattatggacatagtttaaggagtccaagtttcaagagtgtgaatgtagcagcatcacattatggattggagcaaaattccaattactcttcttgttgtactgagagtcttggtggcgaggtttcgccttcttcaaccggtgaccttagacgatggttgagatgagacgattcaactacactcagtttcaaccgctctgcagcgactgcagaggattcggttacatctatgacactttaggttatttttcaccattcacttattttatttaggctttgtgtgatgtttattttagtattaacccttttcacccaaaaagaaaagaagttaacatagggtgaacctaaaaatctgatgttaggagttgagagaagcaagtactatgttgttaggaagctgagaaccatgtattgtgttttggttttatcatttgtttgttaggatgccaagataaatgttggccatatgttctggcctacctcacttggggtgttgaaacaattgcctacacaacaggtatgtccttaaatggactgtcttgtcacaataacatgtaatattttggaatctcaattatggtcgccttttgtttgcaatgtaatattttaacctttgcttttgttttaa

SEQ ID NO: 6236 - DNA, 2234 bp, Lupinus angustifolius
cttgttttccatctctctttactttttctctcctcttagtcagacactgttaaaagactttggttgggtgacattagtacccaacctggttggaactttcggtctttaactcttgcacacaatattctggctctatctgagcctttattttttggaaatttagctgtaaatgcatttgagattttactgttcattttgatggggaagaagggaagtagttcttggttaactgctgtcaaaagggcattcagatctccaacaaaagatagtgacaaaagtagtagaagaagagaggactatgatcatgaagaagatgaagaaaagaagagagaaaagagaagatggattttcagaaagaatcatgaaacagtgaacactcaacaaactccaacaaagttgaagcatgatgtggctactacaacaaatacaagtgtgacttcaaggacagaccaagatcagaaccatgcacttgcaatggctgtggccaccgctgaggctgctatggccactgctcaagctgctgtggaagttgcaaggttgaccaagcctattagtactactaatcatcatgctagggaccattttgctgctattgtgattcaaactgcttttagaggatatttggcgagaagagcgcttcgtgcgcttaaagggttggtgaagttgcaagctttggtaaggggccataatgttaggaagcaggcaaagatgacccttagatgcatgcaggctttggttagagtacaagcaagggtgcttgatcagcgcataaggtcttcgcttgatggtagtagaaaatctaccttcagtgacaccaccagcgtttgggaatcgcggtatcttcaggacatttcagataggaaatcagtatcaagagagggaagcagcattgcggatgattgggatgaaaggccacacacggttgaagaagttaaggctatgttgcagcagaggaaggaagcagctatgaagcgagaaaagtccttgtctcaagccttttcacagcagatttggaggaatgataggacatcatcaattggaaatgaaggtgagctggaagagagaccaaaatggctcgaccgatggatgtctacaaagccatgggagggtaggggaagagcttcaactgatcaaagagaccccattaagaccgtcgaaattgacaccgctcagccttactcatatctaggagctagttacagaagatcacatccaaattatcaatataacccacacctccaaccacaaagacattccattgcttcccctatccatggaacacaccaaaatggatctattcaccaatccaccgcaactccgtctccagcaaaatcaagacctatccaagtccggtctgcgagccctcgctgtgttagagaagatagaacaatccacacctcccaaacaccaagccttaggtctacttataattacactgggagcttgtaccagaatgggagggttggaacaagtaatgctgctgctgctgcattgcctaattacatggctgcaaccgagtctgcaaaggctcgaattcgatctcagagtgctccaaggcagaggccatcaacaccagagagggacagaggagctggatcagttaagaaaaggctttcattcccggctccagatccttataatgtaggagctggttatggaaattacgggcaaaacttaaggagtccaagcttcaagagtgtaggtgcatcacattttggtacggaacggcaatccaactactcttcttgctgcactgagagtaatggtggagagatttctccttcttcaaccggtgaccttagaagatggttgagatgatttgttgattaatttgatcacagtgtgagaactgagaactaatgaactatgactcattaggttattaccattcacttgttatttttaatttaggcttttgtgatattagagttattttagtgctagttaagcccagaaagagagaaagttattcagggtgtactgagtatgatgtaggagcagaggagaatgtattttcttgctacttgctaatatgctaagagccattgatgtgttgtatgatttgtttttattacttttgctaggattgaagataaaagtgagccctatgtggtggcctacctcacttgggatgttgtatttgatgttgaaagaatgaatggcctttattggactgtcctgtcatagtaacatgtaatatcttgcattctagctattgcctgtacactatactt

SEQ ID NO: 6237 - DNA, 2356 bp, Lupinus angustifolius
tttagatatttcactctaaagagagattcatttattttacagtattgaggggactcacggtagagccatgatgaggacaagttcactgtagcattgatgaacgtgtactgataaaaataacaaagattgaatcagtgctccactattatatactatggctcctcttgttgatttttcttctctcttttctttttcagtggcatcactacccaacttggttggagctttgtgtctttaactcttgcacacaattttatggctctttctgagtgtgtgtttttggcaatttagctgtaaatgcagttgagttattactgttcattttgatggggaaaaagggaagtagttcttggttaactgctgttaaaagggcatttagatctccaaccaaagacagtaacagaagaagagaggactatgatcatgaagaagatgaagagaagaagagagaaaaaagaagatggatttttagaaagaatcatgaaacagagaacattcaacaaagtccaacaaagtcaaagcatgttgtagctgcaacaacaaatgcaagtgtgggttcaaggacagaacaaaatcagaagcatgcacttgaaatggctatggcaaccgctgaggctgctatggccactgctcaagctgctgtggaggttgcaaggttgaccaagcctagtacaactactaatcatcactctagggaccattttgctgctattgtgattcaaactgcttttagaggatatttggctagaagagcactatgtgcgcttaaggggttggtgaagttgcaagctttggtaaggggtcacaatgttaggaagcaggcaaagatgacccttaaatgcatgcaggctttggttagagtacaagcaagggttcttgatcagcgcataaggtattcacttgatggtagtcgaaaatctaccttcagtgacaccgccagtgtttcggaattgcgatatcttcaggagatttcagataggaaatcagtatcaagagaaggaagcagcattgcagatgattgggatcacaggccacacacagttgaagaagttaaggctatgttgcagcagaggaaggaagcagctatgaagcgagaaaagtccttgtctcaagccttttcgcaacagatttggaggaacggtaggaaatcgtcaattggaaatgaagatgagctggaagagaggccaaaatggctcgaccggtggatggctacaaagccatgggagggcaggggaagagcttcaactgatcagagagaccccattaagactgtcgaaattgatactgctcagccttactcatatctaggaggatccaattacagaagatcacatccaaattatcaatataacccacaccaccaaccacaaagacattccatagcttcccctatccacagaacccaccaaaatggatcaattcgccaatccccttcaaccccgtcaccagctaaatcaagaccagtccaagtccggtcggcaagccctcgctgtgttagagaagatagaaacttacacatctcccaaacaccaagccttaggtctacttacagttacacagggaacttgtaccaaaatggaagggctggaacaagtaatagcggtgctgctgcattgcctaattacatggctgcaaccgagtctgcaaaagctcgaattcgatcgcagagcgcgccgaggcagagaccatcgaccccagagagggaaagaggagctggatcagttaagaaaaggctttctttcccggctccagatccttataatgtaggagctggttatgggaattatgggcagaacttaagaagtccaagcttcaagagtgtatgtgcatcacattttggtatggaacagcaatccaactactcttcttgctacactgagagtattggtggagaaatttctccttcttcaactagtgaccttagaaggtggcttaggtgatttgtccaaataattcgatgacaaagcgtgagaactaataatgaactatgactcactaagttattaccattcacttgctatttataattcaggcttttgtgatgttagagttattttagtaactagttaaccctttcaccccaaaatagagcaagtactttcatgctattaagctgagccattgatgcgtagtatcatttgtttctaatacttttgttaagattgaagaaaaatgtgagccctatgtggtggcctacctcacttgggatgttgtatttgatgttgaaagaattgcctataccattgaatggcctttattggaatgtcctatcatagtaacataacatgtaacatcttgtattttagctatacccttttaattcccttttaattattatatatatagacacacacat

SEQ ID NO: 6238 - DNA, 2580 bp, Glycine max
cataaataagcaaaaccagacaaaaaaaaaatcctagtagttaataattcagtctccatccaaaatccaaatgtgaggctcttacctgatccctattccactaccctacacctccccgcacagtattctgaattctctcatcacattcacagcgaaattacgaatcatcaagcaaacccgccaaagtttttcgcggcgcgtatccgaaaattttcaaaattttgattttgcgttttcagttttgagaaacttgaattcaaactctttctttctttacattaccctcagaaatttcaaagaacttgtctactctgagtgagatgacccatcgaaaaatcccttcttcacagaaaccattcaacaacgctgcttaaattgttgttactatgagagagcaaaacgttgagtcgttctacgctaagcttcgccaaaccgcgctatcttcttcctcttctccggttctcattttcccctcaacctccgatgtcgactctctctgcgctctgaaaatcatttttcacatcctcgaatccgattccatccaatacgcgtgctaccctgtgtcgtcttttcatgagatccacaaatacacaaattcctcctcaaacgacgagcctctctccgtcgttttggtcaattggggcaaccacagagacctcagcaataccctaaacctcccctccaacgcccgcgttttcgtcgtcgacagccaccgccccatccacctccgcaacctcagcgaccagaacgacgccgttgtggttctcttcactaaagaggacgagggacaatccgatcttgcttacgatttcgacctcaccacactcgccaacgccgccaccaccgtcgattctgattccgattccgaatctgagtccgaatcggattcggattccgactccggctctgaaaggactggatctagaaaaaggagaaagaagaaccctcaggatgatgatgatggtgatgatgaagatccaattaagctctaccggaagctgaagaaaggctattacaaattggggacgtttcacgggaagccctccgggtgtttgatgtatgaactcgctgacaagctcaggaagaacaccaacgaattgctctggatcgcgtgcatttccctcacggatcagtttgtgcacgagagattgagtgacgagaggtaccatgatggagtcatggagctcgagcagcacataaacagttctggtaacctggatgcggttacttcggttactctcaaggatggtaccaagattcgtgccccgaattctttgcggattacttatgaggaccagccgaggcttatgttgttgcaggagtggagcctctttgactccatgatgtgctcctcgtacattgccaccaagttgaagacgtggagtgagaacgggataaagaagctgaagcttctgttcgggacaatggggtttgctcttggtgattgccagcagaagtttcagcacatgaatttggaggttaagcgcaagatgaagaaggagtttgagaggtttttgcctgagtatgggctcactgatttttactacaggagtttcattaggactctcaagtatagttctaagatttctgctgcggatgtggtgtatggtgtgactgccttgcttgagtcttttgttagatctgatggttcttgtgcttctaagcagtttggtgtggcctatgatgcgctgtctttgaacaatattgacaacttgagaactgggatgcatcatgccattaaaattcagagagcaattttaaggcaagggagtgctgcaattactaagaatgggtgtataaggagtgggaggagtttccggtggctgaagctagaggattcaaatgatgctacgctgttggggtacccgcaggctttgactaagttctgttattttatcatggatgctttgcgagagaagggggccaaaatgaagcctttgatttgtgcttgtgtgtctcaggagccagggaaggtgctgattgtgggggtttgtgggaggccgcgtttgggtggggctcaaggcaatgcgtttgggattgcgtttaggactgcagcagaggagattggaactgagttctttcatgagttatttgaatcctcatggattgttctggatgcttcagctgtaaattcattcatggttaggttgaccaagaagctgtgacactgctgaatttctgattagaattggttctccaaggaagtgttttctctgaccacagtgccatgcctgagattgagattgctaataagttatgtgcagtggttgatgttgcaccaaaacatgactcttttcctagtcagttgtattatggttcatagcatattcatttgacttttcttgttttcccaaatatgttagcttgacactttcatgtaaactaatgttttaattccaatttggatgtaacgttgaattgaaacaatgagatcatggataaagtttgaatatcaagtgcctgagtttcaattatttgtgttagactatgaggttaatatgtcttttgaagtattgcattgccttctaccctaagttaatcttctttaacaaaggaacttagtaaggatatgtgcagagc

SEQ ID NO: 6239 - DNA, 2328 bp, Glycine max
aaattacgaatcatcaagcaaacccgccaaagtttttcgcggcgcgtatccgaaaattttcaaaattttgattttgcgttttcagttttgagaaacttgaattcaaactctttctttctttacattaccctcagaaatttcaaagaacttgtctactctgagtgagatgacccatcgaaaaatcccttcttcacagaaaccattcaacaacgctgcttaaattgttgttactatgagagagcaaaacgttgagtcgttctacgctaagcttcgccaaaccgcgctatcttcttcctcttctccggttctcattttcccctcaacctccgatgtcgactctctctgcgctctgaaaatcatttttcacatcctcgaatccgattccatccaatacgcgtgctaccctgtgtcgtcttttcatgagatccacaaatacacaaattcctcctcaaacgacgagcctctctccgtcgttttggtcaattggggcaaccacagagacctcagcaataccctaaacctcccctccaacgcccgcgttttcgtcgtcgacagccaccgccccatccacctccgcaacctcagcgaccagaacgacgccgttgtggttctcttcactaaagaggacgagggacaatccgatcttgcttacgatttcgacctcaccacactcgccaacgccgccaccaccgtcgattctgattccgattccgaatctgagtccgaatcggattcggattccgactccggctctgaaaggactggatctagaaaaaggagaaagaagaaccctcaggatgatgatgatggtgatgatgaagatccaattaagctctaccggaagctgaagaaaggctattacaaattggggacgtttcacgggaagccctccgggtgtttgatgtatgaactcgctgacaagctcaggaagaacaccaacgaattgctctggatcgcgtgcatttccctcacggatcagtttgtgcacgagagattgagtgacgagaggtaccatgatggagtcatggagctcgagcagcacataaacagttctggtaacctggatgcggttacttcggttactctcaaggatggtaccaagattcgtgccccgaattctttgcggattacttatgaggaccagccgaggcttatgttgttgcaggagtggagcctctttgactccatgatgtgctcctcgtacattgccaccaagttgaagacgtggagtgagaacgggataaagaagctgaagcttctgttcgggacaatggggtttgctcttggtgattgccagcagaagtttcagcacatgaatttggaggttaagcgcaagatgaagaaggagtttgagaggtttttgcctgagtatgggctcactgatttttactacaggagtttcattaggactctcaagtatagttctaagatttctgctgcggatgtggtgtatggtgtgactgccttgcttgagtcttttgttagatctgatggttcttgtgcttctaagcagtttggtgtggcctatgatgcgctgtctttgaacaatattgacaacttgagaactgggatgcatcatgccattaaaattcagagagcaattttaaggcaagggagtgctgcaattactaagaatgggtgtataaggagtgggaggagtttccggtggctgaagctagaggattcaaatgatgctacgctgttggggtacccgcaggctttgactaagttctgttattttatcatggatgctttgcgagagaagggggccaaaatgaagcctttgatttgtgcttgtgtgtctcaggagccagggaaggtgctgattgtgggggtttgtgggaggccgcgtttgggtggggctcaaggcaatgcgtttgggattgcgtttaggactgcagcagaggagattggaactgagttctttcatgagttatttgaatcctcatggattgttctggatgcttcagctgtaaattcattcatggttaggttgaccaagaagctgtgacactgctgaatttctgattagaattggttctccaaggaagtgttttctctgaccacagtgccatgcctgagattgagattgctaataagttatgtgcagtggttgatgttgcaccaaaacatgactcttttcctagtcagttgtattatggttcatagcatattcatttgacttttcttgttttcccaaatatgttagcttgacactttcatgtaaactaatgttttaattccaatttggatgtaacgttgaattgaaacaatgagatcatggataaagtttgaatatcaagtgcctgagtttcaattatttgtgtt

SEQ ID NO: 6240 - DNA, 2129 bp, Phaseolus vulgaris
ccattctttctcacacaacaaaccccaaatcccttcttcttcttcttcttcttcttcttcttcagtgttacaatgagagagacacgcgtggattccttctacaccaagcttcgtcaatctgctttatcttcttcttcttcgccagttctcattttcccctcaacctccgacgtcgattccctctgtgctctcaaaatcatcttccacattctcgaatcagattccatccaatacgcctgctaccctgtctcctccttccacgagatccacaaatacacttcctctgcctcaaaccaccaccctctctccgtcgttttggtcaattggggcaaccaccgggacctccgcaaagcgctcaatctcggccccaacgctcgcgttttcgtcgttgacagccaccgccccatccatctccgtaaccttagcgaccaaaacgacgccgttgttgtcctcttcaccaaatacgacgagcagcagtctgatctcgcctacgacttcgacctcaccacgctcgccaacgccgccgccgctgatggagatgaatccgaacctgaatctgaatccgattccgaatccgatgatgacggcaacggatctaggaagaggagaaagaagaacgacgatggcgaggaggatccgattaaactataccggaagctgaagaaggactattaccgactggggactttccatgggaagccgtccgggtgtttgatgtacgagctcgcggactctctcaggaagaatacgaatgagttgctctggttggcttgcgtttcgctcacggatcagttcgtgcacgaaaggttaagtgatgagaggtacctagatggggttatggagcttgagcagcatataaacagttctggtaatttggatgtggttacttcggttacactaaaggatggtacgaagattcgagcaccgaattcgtcgcggatcacttatgaggagcagccaaggcttatgttgttacaggagtggagcttgtttgactccatgatgtgctcttcttacattgccactaagttgaagacgtggagtgagaatggggtgaagaagttgaaccttctgtttgggaggatggggtttgctctaaccgattgccatcagaagtttcagcacatgaatgtggaggtgaagcgcaagatgaaggaggaatttgagcggtttttgcctgagtatggactcactgatttctactacagaagtttccagaggactctcaagtacagttctaaggtctctgccgcggatgtggtgtatggtgtgacggcgttacttgagtcttttgtgaaatcggatggttctagtgcttctaagcagtttggcgtggcatatgatgctctctctttgaataatattgacaacttgagaactgggatgcaacatgctattaagattcagagggccattacggccagggagtgctgcaattactaagaatgggtgtataaggagtgggaggagtttccggtggctgaagctggaggattcaagtgatgctaagttgttagggtacccacaggcattgactaagttttgttattttcttatggatgctttgagggagaagggggcgacaatgaagcctttgctttgtgcttgtgtatctcaagagcctgggaaggtgctgattgtaggggtttgtgggaggccacgtttggctggggctcgtgggaatgcatttggtattgcatttaggaccgctgcagaggagattggatctgagttcttccatgagttatttgaatcatcgtggattgttctggatgcttcagcggtgaattccttcatggttaggttgattgagaagctgtgatgcttctgaatttcttattagaatttgttctttgaggaagtgctttctctgactgctgtgcctgggactgagagtagtaataagtgaggtgcagtggttgatgttgcaccaagacatgactcttttcttagttaattgtattgtgatttatagcatattcatttgacttttcttacctgttcccccaaatactttcatgtaactagtgttctattccaaattagatgtaacattgcaatgttaaattgaaagtacgagatcaaatgaagttcgcatatctatctactgctacattttaaatttgtgt

SEQ ID NO: 6241 - DNA, 2116 bp, Cajanus cajan
ccaaccctcatgacattcccatcttcctcagtcacacagcccccaaacacgccctagcagcaacactatgagagagcaacgagtggagtcgttctacgccaagcttcgccagtccgccacgtcatcctcttcctcctctccggttctcatcttcccctcaacctccgacgtcgactccctctgcgccctcaaaatcatcctccacatcctccaatccgactccatccaatacgcatgctaccccgtctcgtctttccacgagatccacaaatacgtttcctccgcctccaacgaccaccctctctccgtcgttttggtcaactggggaaaccacagagacctccgcaaaacgctcaacctcagccccaacgcgcgcgtcttcgtcgtcgatagtcaccgcccaatccacctccgcaacctcagcgaccgaaacgacgccgtcacggtcctcttcactaaagacgacgagcaacaatcggatctcgcctacgacttcgacctcaccacgctcgccaacgccgggaacgaaaactccgaatccgaatccgaatccgaatcggaatccgaatctgagtctgactccgaggcggaatccgaacgagatggatctcgaaagaggagaaggaagaaccccgaagaggatccaattaaactgtaccgaaaactgaagaaggactattaccgattgggaacgttccacgggaaaccctcggggtgtttgatgtacgagctcgctcactttctgcggaggaacacgaacgagttgctctggctcgcgtgcgtttcgctcacggatcaattcgtgcacgagaggctcagcgaggagaggtaccacgacggcgtgatggagctcgagcagcatattaacagctccgggaacttggacgcgccgacttcggttacgctcaaggacggtaccaaaattcgcgctccgaattcgtcgcgaatcacgtacgaggatcaaccgaggttgatgctgttgcaggagtggaacctcttcgactccatgatgtgctcgtcgtacattgccactaagctgaagacgtggagcgagaacggggtgaagaagctgaagcttttgtttgggaggatggggtttgcgctcgcggattgccagcagcagtttcagtacatgaatgtggaggtgaagaggaagatgaagcaggagtttgagaggtttttgcctgagtatggactcactgatttttactacaggagtttcatgagggtttataggtattctagggtttctgctgcggatgtggtgtttggtgtcaccgctttgctcgagtcttttgtgaaatcggatggttcttgcgcttctcagaagtttggtgaggcgtatgatgcgttgttgtctttggataatattaataaggagctgcaaaaagggatgcaggatgctattaagattcagagggcaattttgaggcaagggagtgctgcgattactaagagtgggtgcataaggagtgggaggagttttcggtggttgaagttggaggattcgcgtgatgccaagttgttggggtaccctcaggcgttgaccaagttctgttattttctcatggatgctttgaaagagaagggggcgacgatgaagcctttgctttgtgcttgtttgtctcaggaggctgggaaggtgttgattgtgggggtttgtgggaggccgcgtttggctggggctcgggggaatgcgtttggaattgcgtttaggactgcagcggaggagattgggactcagttcttccatgagttgtttgaatcgtcgtggattgtgctggatgcttctgctgtgaattccttcatggttaggttgattgagaagctgtgataatgatgggtttctaattagagttggttcttcgaggaggtgtcttctctaactgcactgctgtgcctgagtctctggttactaataagttgtgcgcaggggttgatgttgcactcgtacgtgactctttcttagtcagttgtattgtgatttatagcatattcatttgacttttcttaccctttacttctctcaaatatgttgttagcttgacaatttcatgtaaacacatgctttattccaatttggatgtaacgttaaattgaaattatgagatcttca

SEQ ID NO: 6242 - DNA, 3055 bp, Glycine max
tcaacggtggagattccccaaatgaaaaagctagatggaacagcgtgctaacgtgactccaatatagaagaagagagccacacttccttttcccaccattgacattctctctctcactctttcctcagcatttggcaacatctgcaaactctcttctccttctctctatctctcactctgcagcaaaggggttattcacttatttgtcattcaatggctagttgctggttttgttgttgtgttgttaagtccagtgttgcagttttagcgttaagtgtggttgtgtttttgtgacgggaaaaaaaagttggaagctttggttggtggggtggtgtcaattgtgatgggtgcggatcgtctgatactgccaacagttggaccgccattaaaacggcgagcggggttgcggaggaagcaggctggaagagggtcatacagagggagctaggtgtgagtgagcgagtgagtgtgtggtgtttttggaggggttttgttctgttttttggaggattcagattctcgggggtgttaaagtttctgacttgttaaggggggcaacatgggtaccaacttgcaccaagtactcagaagcctctgtttgaatactcactggaactacgccatcttttggaagctcaaacatcgtgctcgaatgatcttgacatgggaggatgcatattatagcaatcctgatgattacgactcttcagaaaataagcactgccagaagaccttggaacagattggttgtgggaaattttcacacagtgcattagagttagcagtggctaagatgtcatatcatgcatattcattaggagaaggtatcattggacaggtagctgttactggaaagcataggtggatctgtgcagataatcaagttgcaggttctggcttgtcttttgagtttgcggatgggtggcagtctcagttttctgccggaatcaggactattgctgttgttgctgtagtcccacttggtgttgttcagcttggctctctaaataaagtgattgaagatatggagtttgtaactcatatcagaaatctttttttgtctactcaaaattactcaatcctacgtcctagtcaaatacagggtagtttgaagagctcatctgagctggatacattgaaggaaaatttgtcttcagatattatgcctacttgcttttacgatacacagaaatctatgaaaagtgaaacagcagatgttttaatgccccttcaatgttctgggactgggaggaactatacaccttctgctcatgagaaaatgtctgataatgtggccaagcaagagggacctgaattgtacaatgatgaaagttccattttgcttcagtcaatatccaatatgatgaatgtggactgtaaggaatttgaagagatgaaacctctatatgggatgaagtatgaaggtggaagtagtggcgactgcaaagatatgagattggaatcagaaaaaaatgtctcatcatatttaaatgattttgttacagataatgctagcttcaatgatttaatatgtccatcagaaaaagtcagagttgattctgcatgctttccttcagtttttcttgatacagttgtttgtgaaagtgataaattgcattatgcggatattaaccaaaaaggggcattgaattttgcccaaccttcagaagcaaactcccagcaacatattgaaaagtcaaagtttcatactgagccttgttacaaggatatctcagactttcaaactgaaccttgttataaggatgcctcacagatgttgaattttcctgctggctgtgagctacatgaagcacttggaccagctttttcgaaagtgggtaaatgttttgattggccaacacaggttaatcaagaaatgaaacctgttgaaatgtcagatgagattagcactagccaattgacttctgaatcttgtccagaacatcttttggaagcaatgctggtcaacattaaccatagtaataatgatgttaatagtgaattatcattttgtacatcaaagcaatctgcaatggcctctgcaaaaaatcatgaagcttctattcacaatgtgcatactattaattcagaaggctatttgatggatcagctctctcttgtcagagaggacaaacaccattctttgagttcatcatcagggatatgtggtgtgatgtcctcaaaaggtgtttcatctacatttcatagttcaaatagtggacagcttgaaaggtcgtctgaaccatccaagaacagcaaaaaaagggccaggccaggggaaagttgtaggcctcggccacgggatagacaactgatccaagatcgtatcaaggagttgagggagctggtgccaaatggagcaaagtgcagtattgattcactcctggagcgtgcaataaagcacttgctctttctccaaagcataactaaacatgctgacaagctaactgactttgctgatacaaagtcaaagttgcatcacaaggaagcagacattcttggatcctctagttatgatcagggctcaagctgggccatggaggtagggggtcatctgaaagttcattcaatattagtggagaatcttggtaagaatggacaaatgcttgttgagatgctctgtgaggaatgcagccattttcttgaaatagcagaagccataagaagtttgggccttaccattttaaagggtgcaacaaaagctcatggtgaaaagatatggatatgctttgtcgtcgagggtcaaaacaacaaaaatgtacacagattggatatcttgtggccgcttgttcaaatactgcaatccaagagcacggtgtattcacaataataacagtttggtttttggaaactatgtggccactcattggcaagtgtaactcattcttgatctttgaaatgaaatgatgtggttatgtgtgtgttttaaatgattgaaatgtgtgattgtcattgtttatgtttgacattgaaaatagcacaatacgttgaacatatattagtgtcacccttgccttccaaaaataaataaataatattagtgttactcttttca

SEQ ID NO: 6243 - DNA, 3329 bp, Glycine max
tggggcttttgccctttgtcaagttttagtcttcatttaccatatttttcatttttggttttattttctgaaaaaagatgtattatagtaaatatgaaactagatatcatctaataaaaacttaggccttaatttgtcatgttataaaattaaaaagaccaatctcttttgttatgtcaattacaccaaatttgctaaaatgcatgggatggttagtgatatgatcaatggtggattacgctacggttagcatgattgcatgaatcaacggtggagattccccaaatgaaaaagctagatggaacagcgtgctaacgtgactccaatatagaagaagagagccacacttccttttcccaccattgacattctctctctcactctttcctcagcatttggcaacatctgcaaactctcttctccttctctctatctctcactctgcagcaaaggggttattcacttatttgtcattcaatggctagttgctggttttgttgttgtgttgttaagtccagtgttgcagttttagcgttaagtgtggttgtgtttttgtgacgggaaaaaaaagttggaagctttggttggtggggtggtgtcaattgtgatgggtgcggatcgtctgatactgccaacagttggaccgccattaaaacggcgagcggggttgcggaggaagcaggctggaagagggtcatacagagggagctaggtgtgagtgagcgagtgagtgtgtggtgtttttggaggggttttgttctgttttttggaggattcagattctcgggggtgttaaagtttctgacttgttaaggggggcaacatgggtaccaacttgcaccaagtactcagaagcctctgtttgaatactcactggaactacgccatcttttggaagctcaaacatcgtgctcgaatgatcttgacatgggaggatgcatattatagcaatcctgatgattacgactcttcagaaaataagcactgccagaagaccttggaacagattggttgtgggaaattttcacccagtgcattagagttagcagtggctaagatgtcatatcatgcatattcattaggagaaggtatcattggacaggtagctgttactggaaagcataggtggatctgtgcagataatcaagttgcaggttctggcttgtcttttgagtttgcggatgggtggcagtctcagttttctgccggaatcaggactattgctgttgttgctgtagtcccacttggtgttgttcagcttggctctctaaataaagtgattgaagatatggagtttgtaactcatatcagaaatctttttttgtctactcaaaattactcaatcctacgtcctagtcaaatacagggtagtttgaagagctcatctgagctggatacattgaaggaaaatttgtcttcagatattatgcctacttgcttttacgatacacagaaatctatgaaaagtgaaacagcagatgttttaatgccccttcaatgttctgggactgggaggaactatacaccttctgctcatgagaaaatgtctgataatgtggccaagcaagagggacctgaattgtacaatgatgaaagttccattttgcttcagtcaatatccaatatgatgaatgtggactgtaaggaatttgaagagatgaaacctctatatgggatgaagtatgaaggtggaagtagtggcgactgcaaagatatgagattggaatcagaaaaaaatgtctcatcatatttaaatgattttgttacagataatgctagcttcaatgatttaatatgtccatcagaaaaagtcagagttgattctgcatgctttccttcagtttttcttgatacagttgtttgtgaaagtgataaattgcattatgcggatattaaccaaaaaggggcattgaattttgcccaaccttcagaagcaaactcccagcaacatattgaaaagtcaaagtttcatactgagccttgttacaaggatatctcagactttcaaactgaaccttgttataaggatgcctcacagatgttgaattttcctgctggctgtgagctacatgaagcacttggaccagctttttcgaaagtgggtaaatgttttgattggccaacacaggttaatcaagaaatgaaacctgttgaaatgtcagatgagattagcactagccaattgacttctgaatcttgtccagaacatcttttggaagcaatgctggtcaacattaaccatagtaataatgatgttaatagtgaattatcattttgtacatcaaagcaatctgcaatggcctctgcaaaaaatcatgaagcttctattcacaatgtgcatactattaattcagaaggctatttgatggatcagctctctcttgtcagagaggacaaacaccattctttgagttcatcatcagggatatgtggtgtgatgtcctcaaaaggtgtttcatctacatttcatagttcaaatagtggacagcttgaaaggtcgtctgaaccatccaagaacagcaaaaaaagggccaggccaggggaaagttgtaggcctcggccacgggatagacaactgatccaagatcgtatcaaggagttgagggagctggtgccaaatggagcaaagtgcagtattgattcactcctggagcgtgcaataaagcacttgctctttctccaaagcataactaaacatgctgacaagctaactgactttgctgatacaaagtcaaagttgcatcacaaggaagcagacattcttggatcctctagttatgatcagggctcaagctgggccatggaggtagggggtcatctgaaagttcattcaatattagtggagaatcttggtaagaatggacaaatgcttgttgagatgctctgtgaggaatgcagccattttcttgaaatagcagaagccataagaagtttgggccttaccattttaaagggtgcaacaaaagctcatggtgaaaagatatggatatgctttgtcgtcgagggtcaaaacaacaaaaatgtacacagattggatatcttgtggccgcttgttcaaatactgcaatccaagagcacggtgtattcacaataataacagtttggtttttggaaactatgtggccactcattggcaagtgtaactcattcttgatctttgaaatgaaatgatgtggttatgtgtgtgttttaaatgattgaaatgtgtgattgtcattgtttatgtttgacattgaaaatagcacaatacgttgaacatatattagtgtcacccttgccttccaaaaataaataaataatattagtgttactcttttcatgtctcagac

SEQ ID NO: 6244 - DNA, 2921 bp, Cajanus cajan
atgcatggtatggtttgtgatatgataggaagggatggtggattacgctatgctttggttggtggggtggtgggaattggtggggtgagtgatgggtgcggatcttctgatactgccaacagttggaccgccattaaaacggcgagcggggttgcggaggaagcaggctggaagagggtcctacagagggagctagtgtatgagaacatgggtactcacttgcaccaagtgctcagaagcctatgtttcaatactcactggaactacgccattttttggaagctcaaacatcgtgctcgaatgatcttgacatgggaggacgcatactataacaatcctgatgattatgactcttcagaaaataagcactgccagaagaccttggaacagattggttgtgggaaattttcacacagcgcactagggttagcggtggctaagatgtcatatcatgcatattctttaggagaaggtattgttggacaggtagctgttactggaaaacataggtggatctgtgcagataatcaaattacaggttctggcttgtcttttgagtttgctgatgggtggcagtctcagttttctgctggaatcaggaccgttgctgttgttgctgtagtcccacttggtgttgttcagctcggatctctaaataaagtgattgaagatatggagtttgtaaatcatatcagaaatctttttttgtctactcaaaattactcaataggtcaatgtcctaatcaaatacaggctagtttgaagagttcttcatcttcgctggataccttgaaggaaaacatgtcttcagatattgtgcctacttgcttttacaatacacagaaatccatgaagagtgaaacagcagatgttttaatgccccttcaatgttctgggaggaactatgcacctcattctggttgtgagaaaatgtctgataatgtggccaagcaagaggggcctggattttgcagtgatgaaagttccattttgcttcagtcgatatccaatatgatgaacgtggaacatcaggaatttgaagagatgaaacctctacatgggaggaagtgtgaaggaggaagtagtggctgtgaagatatgaagttggaatcagaaaaaaatatctcttctcttttaaacgaatttgttacagataatgctagcttcaatgatttaatatatccatctgaaaaagtcagagttgattctgcatgtcttccttcagtttttcatgatacagttgtttctgaaagtgataagttgcattgtgtggatattaaccaaaaagggaagttgaatttcgtccaaccttcagatgcaaacacccaacaacttactgaaaagtcaaaattccataccgagccttgttacaaggataactcatactttcaaactgaaccttgttacaaggatacgtcacacatgttgaagttccctgcaggctgtgagctacatgaagcacttggaccagcttttttgaaagggaataaaagttttgattggtcgacacatgttaatcaagatgtgaaaacagttgaaatgtcagatgagattgccactagccaattgacttctgaatctcttgcagagcatcttttggaagcaatggtggccaacatttgccatagtaataacaatgttaatagtgaattatcattttgtacatctacatcaatgcaatcagcaatggactctggaaaaaatcacgaagcttctatttacaatgtgcatgctattaattcagaaggctattcaatagatcagctctctcttgtcagagaagacaaacaccgttcgttgagttcatcatcagggatatgtggtgcgatgtcctcaaaaggcgtttcatctacatttcctagttcaaatagtggacagcttgaaaggtcttctgaaccatctaagaacagcaagaagagggccaggcctggagaaagttgtaggcctcggccaagggacaggcaactgatccaagatcgtattaaggagttgagagagctggtgccaaatggagcaaagtgcagtattgattcattactggagcgcgcaataaagcacatgctctttctccaaagcataactaaacatgctgacaagttaactgacttttctgatacaaagtcaaagttgcatcacatggaaccagaaattcttggatcctctagttatgagcagggctcaagctgggcaatggaggtagggggtcatctgaaagttcattcaatattagtggagaatcttagcaagaatggccagatgcttgttgagatgctctgtgaggagtgcagccattttcttgaaatagcagaagccatcagaagtttaggccttaccattttgaagggtgcaacaaaagctcatggtgagaagatatggatatgctttgtcgtcgagggtcaaaacaacagaaatgtacacagattggatatcttgtggccacttgttcaaatactgcagtccaagagcaccgtgtattctcaataattgcttgtttcttgcaaacttagtggccactcattggcaagtgtaactcattcttgatctctcaaatgaaatgaagccctcctttatagtgttttaagacttaggttgtggttgtggttgtggtttgtttttttttttttttttgatgattgaaatgtgtgattgtcattgtttatgtttgacattgaaaatagcacaacacgttgaacatacattagtgtcactcttttcagtcacatgaaacccgacgttagagggtggccttagtccttagccactatagccatggatgatggatccttcgccataatgtagttgtaatgaatatagtggaaaaggtggttttgtttaattaatggaataaagcaatttaacatattaattggttcatcaaataggcaatgacataaaattgacaggtggtttacattcaggta

SEQ ID NO: 6245 - DNA, 3362 bp, Phaseolus vulgaris
gtttgttcaagtcagtagttttattattgttccattttgaacattggcatgcacaagtaaatgacctttttctttacaaaaatgcatggtgtggttagtgatatgataggaggggatggtggattggattacgcaatggttaccatgattgcttgaatcaacggtgaagattccccgagtggaaaagctagaaggaaaagcgtgccaacgtgaccccgatatagaacaagagcctccctccctttccaccattgacattctctcactctaccttctccactctttactcggcgattgacaacttctcaaaaacctctatctctccctcactctgcaaagggtaaagactactttcacaattgcattcccagagaaactaaaccttcttcctccacaagcaaaagcctcacatgtcgtcggatataagctagataattagccaccctttttctttccttctttaactcaaccttcttcacaccccttttggaatctaacaaggttgttcgttattcaatggctagttgcgagatttgctgcgttgagtctggtgtttcagtttcagcgttaagtgtggtggtgggtttgggtttgttttgactgtagtgagggaaagttggaagctttggttggtggggtggtgggaattggcggggtgagtgatgggtgcggatcgtctgatactgccaacagttggaccgccattaaaacggcgagcgggattgcggaggaagcaggctggaagaggttcctacagagggagctaggggaaggagggtgagtgtgtggtgttggaggggttttcttcttttttggaggattggaattcacgacccttttctcgggggtgccttcggggtgttaaagtttctgacttgtttaaggaggggcagcatgggtactaacttgcaccaagtactcagaagcctctgtttgaatactcactggaactacgccatcttttggaagctcaaacatcgtgctcgaatgatcttgacatgggaggacgcgtactataacaatcctgatgattatgactcttcagaaaataagcactgccggaatatcgtggagcagattggttgtgggaaattttcgcacaacgcattaggcttagcagtggctaagatgtcgtatcatgcatattccttaggagaaggtattgttggacaggttgctgttacaggaaagcataggtggatctgtgcagataatcaggttgcaggttctggcttgtcttttgagtttgctgatgggtggcagtctcagttttctgctggaatcaggactgttgctgttgttgctgtagccccacttggtgttgttcagcttggttctcttaataaagtgattgaagatacggggtttgtaactcatattagaaatctctttttgtctactcaaaattactcaatagcccaatgtcccagtcaaatgcagggcagtttgaagagttctttatctcagctggatatattaaaggaaaatttgtcttcagatgttatgccaactggcttttacaattcacagaaatctatgaagagtgaaacatcagatgttttaatgccccttcaatgttctgggaggaacgatgcacctcattctgcttgtgtgaaaatgtctgatgacgtggccaagcaagaggggcctgaattgtacagtgatgaaagttccattttgcttcagtcaatatccaatatgatgaatgtggagcatcaagattttgaagagatgaaacctctctatgggaggaagggtgaagaaggaagtagtggctgcaaagatgtgaggttggaatcagaaaacaatgtcttgtcatttttaagtgactttgttacagataatgatttaatatgtccatcagaaaaagtcaaaattgattctgcatactttccttcagcttttcttgatactgttgtttgtgaaactgataagttgcattaccaaaaaggggtgttgaatttcacccaaccttcagatgcaaactcgcaacatgttgaaaagtcaaagttttgttctgagccttcttacaaggatatgtcacatgtgttaaatttccctgttggctgtgagctgcatgaagcacttggaccatcttttctgaaagggagtaaatgttttgattggccagcacaggttaatcaagatatgaaaactgttgaaatgtcagatgagattagccaattgacttctgaatctcgtccagagcatcttttggaagcaatggtggccaacatttgccatagtaataatgatgttaatagtgaattatcgttttgtccatcaatgcaatctgcaatggcatctggaaaaaaccatgaagcttctactcacaatgtgtatgctattaattcagaaggttgttcaatagatcagttctctcttgtcaaagaggacaaacaccattctttgagttcatcatcaggaatatgtggtgtgatgtcctccaaagctgtttcatctacgttccctagttcaagtagtggacaacttgaaaggtcatctgaaccatctaagaacagcaaaaaaagggccaggcctggggaaagttgtaggcctcggccaagggacaggcaattaatccaagatcgtattaaggagttgagagagctggtgccaaatggagcaaagtgcagtattgattccctactggagcgtgcaataaagcacatgctctttctccaaagcataactaaacatgctgacaagctagctgactttggtgatacaaagtctaagctgcatcacatggaagcagacattcttggatcctctagttatgagcagggctcaagctgggcaatggaagtagggggccatctgaaagttcattcggtattagtggagaatcttagcaagaatggacagatgcttgtggagatgctctgtgaggagtgcagccattttcttgaaatagcagaagccataagaagtttgggtcttaccattttgaagggtggtactaaagttcatggtgaaaagatatggatatgctttgttgtggagggtcaaaacaacagaaatgtacacagattggatatcttgtggccgcttgttcaaatactgcaatccaagagcaaggtgcattcacaataactgatcggttcttggaaactttgttgctcctcattgtgtaactcattcttaatctctgaatcaaatgattctgacatagtgtgttataagactggttgtggtggtgtggacatttttaatgattaaaatgtgtgattgtctttgtgtatgtttgaccctgaaaatagcgcaatacattgaacatatgtctcagacttttctcctttattcactacgtacattaacttgctaccagcaaggctcaagtttttatgttgttaataatc

SEQ ID NO: 6246 - DNA, 3308 bp, Cajanus cajan
atggcagagcaccaaagtggccgaatcagcgcctatttcagtgcttcaaagcctcttcttcctcgtaaaaggccttccgattcctctcctcaccgaatcaagagtgccggtgacgttgattccgtttccgttgcgaagagagttcctcttgcggaggtgtcgcagaacaggctcagtgcaattcacagcagcttcaatgcaaggactgtgtcactttctgcaatcggttccgcggatgagaatctgtgtcgatctcttttcgagaatccaaggagagaacctgaaggctctgagcctaaacagttggattactttacgattctcgacgatgatttcgatgagtctgttttggagcaaattgacattttggttgagcagaaatctgcagagttggcagcagagcagcagttagatactaaagaagaggaagtggatacaagctggcaaggtttacaaagttctgaaaatagcacgatgcctgaggaatattcgaaatacttgcagtccctaaatgacagacaaagagaagcagcttgcaccgatatttcaacccctttaatgattgtagctggtccaggaagtggaaagacatccaccatggttgggcgtgtattgatgttgctcaatgagggcattagtccatcaaacatccttgcaatgacatttacaacagcagctgcttctgaaatgagagaacgtataggaactatagctggaaaggcaacagctaaagaacttactatcagtacttttcattcattttccttgaaactttgtcgttcacatggagaaaagtttaggtcgtacatctgaattcttaatatatggacaggggcaacagcgtaatgcaattattgaggccattcgcttattagaaaataaaaagagtggtaacaaagatggtgcattattgattggtgaattgtccaatagtctaaagaatcctaaacaattcaaggataaggcaaagaaatggcaaaattttgtgactcaggctaaagcttcgggaagaacttcttcagaatatcgtgaaatgggcaacgaaataggagctgaaattcttgaaaattacaacaacatattaaaatcttgtaatgctctggattatcatgacttgatcagctgttctgtgaagctactcagtgattttcctgaagttttcaaagaatgtcaggattcatggaaagctattgttatagatgagttccaagatactagtgccatgcaatacaaatttctaaagattcttgcatctcatcataaaataacaattgttggtgatgacgatcaatcaatttacagtttcaatggagctgacatttctggatttatttcctttcgcaacgattttccaaactacaaagagattaggctcaacaaaaactatcgatccacacgttgcattgttgaggctgcatcttttcttattaaaaataattccaagcgatgtcagttgaagagtgttcttactgataactcttctggatccaagatagttatgaaggagtgtcacaatgaggatgcacaatgcgcatttattgttgacaaaatcttagaaatttcatcaaatcattcagcagctaacagttgttatggcaacattgcaattctctaccgtaggcagatatcggggaaagcctttcaaatggctttccgtgataggaaaataccatttaacattcacggtgtggctttttacagaaaaaaggtagtcagaactatcattgccatgcttcgaacagcactgcctggttgtgatgatggctcatatagtcgagtcttcaaggctttactgcctttggagaaagataaaaagaagaagataattgatcatatcaacaaaatatcaacaattagaaaatgcagtttcttgtcagctgccgctgacatctttagtgcaaagatttctggcacctttaaaaggagtgagcttacccacggaaggaaggttttaatgacactagagatgatatcaaaatttattcacagggaaaagtcactctctgctattataacttctgtggcaaacatgatacccgagaaataccttcttgagaaacgggcaatccttgatgttgatggagggacatttttgaatgaagactacgacattagatctgttcttcagtacctattagatgacgtctctgagtttctatccactaaattagttgaggtaaagagtgatagggaaacatcagaagataaaggctgcatttttgttctaaaagaattcattgattatttatttgagcgcgagaaagaaaatttccgtgctcggaggaaggacaacgaaaattctgtgacattgactaccattcatcaggcaaaaggtttagagtgggatgttgtcttcgtagttaaggcaaatgaatctgagatccctctattacacgatttcaagggcaatgtaaaggacactgcagccttggttgaggaagaaagacgtttattatatgttgcaatgactcgtgctcggcagaagctttttattctttatgtcatgatggactcaaactggcagatgcttcaaccttcaagatttttgaaagaaatccctcgtcatcttgtagaagttcagaaatgttcccagcaaggtgaaataaatttacaagaactacacataaagcaagaatctcttcaaaaggaaacagtccattgtaccatggacttgttgataagagagaaacaatctgaagcagatgtggtccctatgcctcgtgaaatacttgataatcattctagtgaggcttctaatgagcttgcagaatttgcagaggcaaacaatagcaataatttcttaagaagatttagtgttgaagacaggtctattgtttcccatttattccatcaatgggctaaaaagaaagcatttcaagatccaaagaggttgcttgacaaggttagttttgtgattgatgaacgcctcagacagaagaacaacaaaaacaaggatttgttgaaaacactaaaatcttgtttaagctgtgaagaagcatttcagtatgctcaatatgttttgagatgggagcagattcctgctgataaacgtgctcatcttatgagggaaaaacaggaacattttctgaaattaaagattgaaaatgcaatgggttcagcaataccaactgacaagcagatttcatatttgaaaaaactgggttgcaccttgacacctacttcccggctccatgcatctcatcttattgagcagtacaaatcattgtaagaatccagtaggggtattcttctgattctcctttccagtttctgtatattgaagaccaagctagtttggtcaagtaaat

SEQ ID NO: 6247 - DNA, 2242 bp, Solanum phureja
ccccaccggagatatcactccgccgtgtctcagcctctactgatgccgtcgattcacccttaatactatcgagggcaatagatgattcgaacatttaggttgctaggtttttgaacaatttgttttggttgtatttgctaagttgaagtggaagaagatggctgcgaaggttgctgctgcgggtatggtacatcaatcaaatgcacttaattttggtggtggtggtagttctaaggtcactactgccacattgaaacggaaaactccatcggagttgcggggagaacaattgaagaaaaagaatattgtggagcttgtggatgaatcaatagtctcaaatgggcccaagagatgtgatgtatcaaagaacccaaggtatgttgatactcgtgtggacgagctatttcctgccagaaaaagtagcatcaggcttaagttggtttcaagaaaagaaaatggcaaggaaaatgttcaagcagagaatagtggtaatactaaaaattgttctgttccttcagctttccctgctgagaatcaacagcgatcaaaatgcccaaaattctctcttgcttcaactgtaactggaaaagatcatgctactgaaacttgtagtacaagcgaaaggtgcagtgagaatactttccgcagtgtcactgagctgtcactgggtagtgtagatgtacatggcttgtttactgttgatatggataaagccttaagaggactggctactcatgagcatctaggtgctgctgctaaaattgctgaatcctctgaaactgatggtggtattaggtcaaaacatttctgctcagaattccatgtcccatgcaagatgaccccattggatttggcgatgaaaactaacatacgggttgtatcctcatcttccatcaattggtttcataggttgatcaattgtggcgccaacaatgtggtggcgaggtcctcagttaattgtttcacgaaactaaagatgacctgtttatctgaagtgacttctgtttcccaagcgactaatccaatgtcattgcattcctggatgtatcctcagtctcctctaccgccttcagttatatcagctttaaccttgtctgcttcagcgggagggcaactggactttttaagtgaaaggcagctagcatggcaggattcatttcgaagtttatattacatgcttcggaagaatgtttgcagcatcttctacgtttgcactgctcagtttgtgatcatgttcaccagttcttattcagaggagaacaaacatgtttgtaatgcatatatatctcagtcaacccggggtttgaggtcattactcaaagaacatgatgtttcttattctatgccgctttgccactcgaagttggaggagcttaatacagaagaactggttgagctttcagagattgagaaacaaaatctgggccagactaggcgtcggagtgctatgtccgatgtggataataggccagattccttgctggcattcactggaaataagaatgttcattctttatatgactttctgttgaactatcgatatttcttaacttctctaactggtgtggatgtccctgagttgtattcacctatcccatttgagaatgctgcactcactgctcctgagtcaaatgtgacttgtgtgcctaatcaacaaccatcttctgggatgtgctatagtgttgaaattaagggtcgataccttgccccatgggtaacctctgctatatgtgatgctttcagctctaacagcacaagttttgaggctagtttcatcagcgagccagcctcagttaacttgaatgctagtctcggcattactgggaaatattctgatcctgaagtttcagcaactgaagccttggacaaggataacctttgttttggtatccagaataccaaattttgttcccagataaattcaggtttcttaaaggggttgaagtacaatggtggttgttacaccgcttttctttcacctgtttgacaccccgtgtgcaacatattctgggtaaattataaactggcatctgtttttgctgcaatacatctttaccgttgtaaaattgttcagtaattgttcgtgtttcaacgaccttatgtcaaattcctgttgtaaaattgttcagtaatcgtacgagcattatagctaatactgtgcataatttgcaaaatgttgatgatcaatacttttgattctggtgaatggggttttgctctactgaaatacattgcacttgat

SEQ ID NO: 6248 - DNA, 2196 bp, Capsicum annuum
gttgctcagccacctccgccgccatcgatttccggcaattgatgattcgaaccgttccatttctaggtatttgctagttgaagtggaaggagatggtgaaggttgctgctgcgggtttggtacatcaatcaactggacttaagtttggtggtggtggtggttctaaagtcactaccaccacattgaaacgaaaaactccatcggagttgcgtggagaacaattgaagagaaagaatattgtggaactagtggatgaatcaacagcttcaaatggtggctcatggagtgctgttcttccagggcccaagagatgcgatgtatcgaagaacccaagatatgtcgatactcgtgtggacgagctatttcctgccagaaaaagcagcataaggctgaatttggcttcgagaaaagaaactggcaaggaaaatattcctgcagaggatagtggtagtactaaaaattgttatgttccttcagctttccctgctgagcatcaacagcgatcgaaatgcccagaattctctcttgcttcaactgtaactggaaaaaatcgtgaagccgaaacttgtggcacaagcgaaaggtgcagcgagaataccttccgcagtgtcactgagctgtcactgggtagtgaagatgtacatggcctgtctactgttgatatggataaagccttaagaggactggctactcatgagcatctaggtgttgctgctaaaatttctgaatcctctgaaactgatgatggtagaagggcaaaatttttttgctcagaattccatgtcccatgcaagatgaccccattggatttgacgatgaaaactaacatacgagttttgtcctcatcttccatcaattggtttcataggttgatcaattgtgataccagcagtgtggtcgcgaggtcctcagttaaatgttttaagagacaaaagatgaccagtttatctgaagtgaattctgtttcccaagcgattaatccagtgtcattgcattcctggatgtatcctcagtctcctataccgccttcagttatatcagctttaaccttgtctgcttcagtgggagggcaactggacttcttaagtgaaaggcagctaacatggcaggattcatttcgaagtttatattacatgcttcggaagaatgtttgcagcatcttctatgtttgcactgctcagtttgtgatcatgttcaccagttcttgttctgaggagaacaaatgtgtttgtaactcgtatatatctcagtcaacccggggtttgaggtcattactcaaagaacatgatgtttcttattctatgccgctttgccactcaaagttggaggagcttagtacagaagaactggttgagctttcagagattgagaaacaaaatctgggccagaccaggcggcggagtgcaatgtctgatgtggataataggccggattccctgttggcattcactggaaataagaatgttcattctttatatgacttcatattgaactatcgatatttcttaacttctctaactggtgtggatgtccctgtgctgtattcacctgtcccatttgagaatgctgcactcactgcacctgaggttagatgcaaggaggtcagaagagttgatcaggtagcttttcaaggaatggagtcgaatggtgcttgtgagcctaatcaacaaccatcttctggaatgtgctatagtgttgaaattaagggtcgataccttgccccatgggtaacctccgctatatgtgatgctttcagctctaacagcacaagttttgaggctagtttcatcacagagccaacttcagttaacttaaatactagtctcgacattactgggaaatgttccgatccagaagtttcagcaactgaagacatggacaagggtagcctctgtttcggtatcccaaataccaaattttattcccagatacattcttgttttctgaaggggttgaagtacaatgttggttcttacactgcttttctttcacctgtttgacatcccatatgcaacatattctgggtaagttataaactgtttttctctgcaatacatctttcgtgctgtaaaaattgttcggtaatcaactttcttttgtcaaattaacagacgctgttcgtctcttatctttaattttaactgatctcgcagtatagctgcatcgacagctaatacaatgtatgatttgcaaagc

SEQ ID NO: 6249 - DNA, 3392 bp, Solanum phureja
gtccaattagattgttttcttgcataataacttagattctctctttggtcttttattctccaagaaaatgttgtcatgttctgtagtatgttttcattcctcttaagaatcattcccttgacttggaatgtgggttggcagttttgttagtttgaactaagaaagatgtcatcttgttgacttgctgattggtgggtagtgggagttttttttggaaagatgggttctttggttttggttttggggttgatgtaaaggaaatcacagaggtttttatgggttctgttgaagaaaagaacaagccagggagtttggttagtggagcacatactctacttgaggaaatgaaattgttgaagggaatgcaggatcatactggaggaggaaggaagcatattagttctgagttgtggcatgcttgtgctggcccacttgtgactttgcctcaggttggaagccttgtgtattacttcccacaggggcacagtgaacaggtggcggtttccacaaatagaacagcaacttcacagatacctaattatccaaatcttgcttctcagttgttgtgccaagttcacaatgttaccctgcatgcagataaggagacagatgagatctatgcccaaatgagcctccaacctgtgaattctgagaaagatgtcttccccattccagactttgggctgaagcctaataagcatccaactgagttcttttgtaaaactttaactgccagtgatacaagcacacatggtggattctctgttcctagaagagcagcagaaaagctgttcccacccttggattattcaatgcaacctccaactcaagagcttgttgtacgagacttgcatgataatacttggacattccgtcacatataccgcgggcagccaaagcgacatcttctcacaaccggatggagcatgtttgttggagcaaaacgccttagagctggtgactctgttctatttatcagggatgagaagtcacagttattgctgggagtgaggcgtgctaaccgtcagcaaacttcattgccctcttcagttctgtctgctgatagtatgcatattggagtacttgctgctgctgcccatgctgctgctaatagaagcacattcacaatattctacaatcctagggcatgcccttcagagtttgtcattcctttggccaaatatagaaaatctgtttataacacacaactgtcagttggtatgaggtttggaatgatgtttgaaactgaggaatcgggtaaacgcagatatatgggcactattagcggcattagtgatttggatccactgagatggcctggttccaagtggcggtgtcttcaggttgagtgggatgagcctggatgtggagacaagcagaatagagttagtccatgggaagttgagacaccagaaagtctcttcatatttccttccctgactgcaggcctcaaacgaccttaccagtctacctttttgggagcaccgactgagtgggacagtttgatgcagcaccgccctttcatgcgtgttcctgaaaatgtatatggggatcttcaaagttcctctatctcaaacctatggtcagaacagctaatgaagatgctgataagacctcctcctggccttactggtcttcaatgcggtgttcccacagtacaagacattaaggttgcgctacctcaggaagctaggaatgttatacaaccagcaggaaaccaaaaacctgagctaattactgtagaagctacacctgcacaaagtgaaacaaattcagaagtcatccttaatcaacctgttggtgttgtgaactctatttcttcacagcaagcaactctgcaggcgaagtctcaacctctggaaaaagtagaaactgacgttattggaaaaagttacgagccaagaaaagaaacttgtaattcatcagttaagttagatcagtttcagtgtaatgaagacaaagtgactatcaagcctgcaagtccccatgatcttccaacagcgagtgcgacagcttcccaccataacagcttttctcaattacaagctactccatggctcattcctcataaccctcaaattgattctgctggttccaacaatatccttcaatgccccactaataatgagtggaatctgtcctctctccaatctgctgctggattgctcagatatcctgtgtcgacctccactttgacaaagcatgacaattcttttatgttgcctgatactattggtcatggattagctccaattggccaggatttgtgggatcatcagttgaatgatgttaagtgcttttcccagacaaaccttcaggttccactagacataactaacatgcaattcctacccgattcttatgattttaaagacctgtcagaggagagccataaccaaagtgatatatatagttgtcttaactttgatagcaacagcgggagcacagtgatcgataattctgtttcgagcacagtgttagatgagttctgcaatttgaagcatactgatttccagaatccttcagattttctattaggcaacatcagttctagtcaagatgttcaatctcaaattacatcagccagcctggcagattctcagaatttttctgtacaagaatttgctgacaactcaggtggtgcatcatcaagcaatgtaaattttgatgaatgtaatcttttgcagaatagctcatggcagcaagtcgctccacgtgtgcggacatttacgaagattcagaagactggatctgtaggaagatcaattgatgtctctggttttaaaaattatgaagaactgcggtctgaaattgaaagaatgtttggacttgaggggcttctgaatgacactcgaggctcaagctggaagttggtatatgtggattttgagcatgatgtcctccttgttggggatgatccttgggaggaatttgttggatgtgttcgatgcatcagaattttatcgcctactgaagtccagcaaatgggagaagaaggaatgcagctactgaactctgctggattgcaaggcataaatggctcaacatcagaatttccaaactgagctcaatacaagtgatctatgagagttcacagtgattgatcactagagttgcatggagcaacatgcaaatgtattgttgttgaacaacttatgaagaagaggattcactaggtttctgttatattagtgttgtaatttatgagtgttgatgactctgtaagaaaacagctttagcatattgaactttgccttccatatattagagttgttttcagctgcatcttgtttgtcttaaaaggctgtttttaatggagaaagttgttctgatttggaaatgaaagtacaatctgtttgcgagagctgctctcgctatatgcaggtttcact

SEQ ID NO: 6250 - DNA, 3077 bp, Nicotiana benthamiana
gctcatgcaaaagatgggttctttagttttgattttggggttgatgtaaaggaaattatagagaggtttatatgggttctgttgaagaaaagcacaagccaggaagtttggttagtggagctcatactctacttgaagaaatgaaattattgaaagaaatgcaggatcattctggaggaggagggaagctaataaattcagagctgtggcatgcttgtgctggcccacttgtaacattgcctcaagttggaagccttgtgtattacttcccacaggggcacagtgaacaggtggcagtttccacaaacagaacagcaacttcccagatacctaattatccaaatcttgcttctcaattgttgtgccaagttcacaatgttaccctacatgcagataaagaaacagatgagatatatgcccaaatgagcctccaacctgtgaattctgagagagatgtctttcccattccagattttggactgaagcctagtaagcatccaactgagttcttttgcaaaactttgactgctagtgatacgagcacacatggtggattctcagttcctagaagagcggcagaaaagctgtttccaccattggattactccatgcaacctccaacacaagagcttgttgtacgtgacttgcacgataatacttggacattccgtcacatataccgcgggcagccaaagcgacatcttctcacaaccggttggagcatgtttgttggagcaaaacgccttagagctggggattctgttctatttatcagagatgagaagtcacagttaatgttgggagtaaggcgtgctaaccgtcagcaaacctcattgccgtcatcagttctgtctgctgatagtatgcatattggagtacttgcagcagctgcccatgctgcggctaatagaagcacattcacgattttctacaatccgagggcatgcccttcggagtttgttattcctttggccaaatatagaaaatctgtttatgggacacaactatcagttggtatgaggtttggaatgatgtttgaaactgaggaatcgggtaaacgcagatatatgggcactattgttggcattagtgacttggatccactgagatggccgggttccaagtggcggtgtcttcaggcagagtgggacgaaccgggatgtggagacaagcagagtagagttagtccatgggaagttgagacaccagaaagtctcttcatatttccttctctgactgcaggcctcaaacgaccttaccagtcttcttttttgggaggacaaactgagtgggacagtttgatgcaccgccctttcatgcgtgttcctgaaaatgtatatggtgaacttcaaagttcctcaatctcaaacttatggtcagaacagttaatgaagatgctggcaagacctcctggtgtgacaggtcttcaatggggtgtccccacagtacaagatattaaggttgtgatacctcaagaatctaggaatctaatacatgcagcaggcaaccagaaacctgagctaagtaccgtagaagatacatctgtacaaagtgaaagaaatcctctagtcatcctcaatcaaccttgtgttgtgaactcaatttcttcatcgcaagcaactctgcagccaaagtctcaacctccagaaaaagtaggctccgacactgtaggaataagtactgagccggcaaaagaaactagtgtttcagtggataggttagatcagtgtccgtccctagggcagtgtagtgaagaaaaagtgactataaagcccgcaagtccacttattctcccgactgatgcaacagcttcccaccagaacagcttatctcaattgcaatccagtccatggcgtcaaattgagtctgctagcgccaataatatccttcaaggctccaataacaatgagtggaatctgccctctttccagtctactgctggattggtcagatctcctgtgtcgaactccactttgacgaagtatgagcattcttttatgttgcccgattcagttattggtcctggactagctccaataggccaggatttgtgggatcatcaattgaatgatgtgaagtgcttttcccaaacaaaccttcaggttccgctgttaacacaagacataactaacatgcagttcttacctgagtcatatggttttaaagacttgtcagaggagagtcataaccaaagcgacatatatagttgtcttaattttgatagtaacagtgggagcacggtgattgataattccgtttcaagcacagtgttagatgagttctgcactttaaaacataccgatttccagagtccttcagattttctattaggcaacttcagctccagtcaagatgttcagtctcagattacatcagctagcctggcagattctcagaatttctctgtacaagattttgctgacaactcaggtggcgcatcatcaagcaatgtaaattttgatgaaagtaatcttttgcagaatagctcatggcagcaagtagctccacgtgtgcgaacatatacaaagattcaaaaggctggatctgtaggaaggtcaattgatgtctccagttttaaaacttaccatgaactgcgatctgaaattgaaagaatgtttggacttgaggggctgctgaatgacacgaaaggctcggggtggaagctggtatatgttgattatgagaatgatgtactccttgtcggggatgatccttgggaggaatttgttggttgtgttcgatgtatcagaattttatcgcctacagaagtgcagcaaatgggcgaggagggaatgcagctcttgaattcggccggactgcagggcataaatggctcaacatcagaatttccaaactgagttttaaaacaagtgatctatgagctcaaagtgatcgatcacttgttgtatggaaacattcaaagtaatgttataacagccttaagagctgagatttagtaggtttctgttattagctgagttgtaatttatgagtgagactatgtaagaaacagctttagcatattaaactgtgcctctacaagttgggagtagtattctcttacataatttttgtgt

SEQ ID NO: 6251 - DNA, 1899 bp, Solanum phureja
aaccctagtcgtgttctcttccgctacacttgagcaaacatcgggagagattgagaagtgaaattccatggcactgtatctattgtatgagtcggcgtctgggtacggtttgtttttggctcacgggattgatgagatagggcagaacacggaggcggttcggaactcaatcactgacctcaatcgctttgggaaagtcgtaaagcttgaagcttttaacccttttgagtctgcccttgatgccctaaatcaatgcaatgctgtttctgaaggtcaaatgactgaggagctacagaacttcttggagcgtagtctcccaaaagtcaaggagggtaagaaagctaagttcagcttaggattggcagagcctaagcttgggtcacatatccatgaagtaactaagattccttgccaaagtaacgagtttgttcttgagattttgcgtggagtacgattgcattttgagaagttcattgaaaacctaaagcatggtgatttggagaaagcccaacttggtctgagtcacagttacagcagagcaaaggtcaagttcaatgtcaatcgtgttgacaatatggttactcaggcaattgtcctacttgatactcttgataaagatataaataccttttccatgagagtcagagagtggtactcttggcatttcccagagttggtcaagattgtcaatgacaattatctatatgccaaggttgcaaaattcgttgatgacaaatcccaattgtctgaagacaaaatttcagcattaactgaaatagtcggagatgaagataaagcaaaagaaatcgtagaagctgcaaaagcttccatgggccaggatttgtcaccagttgacttgattaatgtcaagctatttgcacagagggtaatggaccttgttgaatacaggaagaatctttatgattatcttgtcgccaaaatgcacgacatagcaccaaatttggctgctctgattggtgaagtcgtgggtgctcgtttaatttctcatgctggtagtctcacaaatttggcgaagtgcccttcttctacccttcagatcctgggtgctgagaaggcactcttcagggccttgaaaaccaaaggaaatacaccaaaatatggactcatattccattcttctttcattggccgtgcttctgctcgtaataaaggtcgaatggctcgttatcttgcaaacaagtgttctattgcttctcgtctcgactgtttcttagataagagtactactacttttggagagaaactccgtgaacaagttgaggagcgtctagacttctatgacaagggggttgcaccacgaaaaaacctagatgtgatgaaagctgctattgaaaccgtcgaagataaagacacagaaatggacgtagatgagctttccacaaagaaaagcaagaaaaagaaatccaaagttgatgtggtggaatatgctcaacccatgatcgaggataaaccacttgaaacaaatggtgatgcctctgaagaacccaagtctgaaaagaaaaagaagaagaaggagaagcggaaatcagaacaggaggcagagcatgaagaggatcagactgttgataatggtaatggtgtgcatgaggatggaacagcaaagaagaagaagaaaaagaagaacaaggaggacaatggagaggaactccaagctgctgttgaaattaaaaagaagaaaaagaagtccaaagtccaagatgatgaataaatgtacaatttttttctaatcttggtcttgttattttgacggttattggtcaccacctcttatagtgcctgtatgctgctagggtagatttttggctgtctttcaattttgcgtgtatcaaacactcatcttatttattattatcaggatggtcttatcatgattccctt

SEQ ID NO: 6252 - DNA, 2003 bp, Nicotiana benthamiana
actatcccaattcccacataatataaacatttgtagttatacaaaaacaggggctgagaccaagagagaagttctacctcaagcaacctgtacatggcgctgtatctactgtacgagtcggcgtctgggtacgcgttgttcttggctcatggaattgatgaaattgggcagaacacggaggcggttcgcaactccatcactgatctcaatcggttcgggaaggtcgtaaagattgaagcttttaacccttttgagtcagcccttgacgccctcaatcaatgcaatgctgtttctgaagggcaaatgactgaggagctaaggaacttcttggagcgtagtctcccaaaagtcaaggagggtaagaaggctaagttcagtttaggattggcagagcctaagcttggttctcatatccatgaagtaactaagattccctgccaaagtaacgagtttattcttgagcttctgcgtggagtacgcttgcattttgagaagttcattgaaaacctaaagcctggagatctggagaaagcccaacttggtctgagtcacagttacagcagagcaaaggtcaagttcaacgttaatcgtgttgacaatatggttactcaggcaattgtcctacttgatactcttgataaagatattaatacctttgccatgagagtcagagaatggtactcttggcatttcccagagttggtgaagattgtcaatgacaattatctatatgccaaagtagcaaaatttgttgatgacaaatcccaattgtgtgaaaacaaaattccagacttaatagaaatagttggagatgaagataaagcaaaagaaattgtagaagctgcaaaagcatccatgggccaggatttgtcgccagttgacttgattaatgtcaagatgtttgcacagagggtaatggaccttgtcgaatacaggaaggatctttatgattatcttgttgctaaaatgcatgacatagcaccaaatttggcttcgctgattggtgaagttgttggtgctcgtttaatttctcatgctggtagtctcacaaatttggcaaagtgcccttcttctacccttcagatccttggtgctgagaaggcactctttagggccttgaaaaccaaaggaaatacaccaaaatatggactcatattccattcttccttcatcggccgtgcatctgctcgtaacaaaggtcgaatggctcgttatcttgcaaacaaatgttcgattgcttctcgcttagactgtttcttagatactagtactactacttttggggagaaactccgtgaacaagttgaggagcgtctagacttttatgacaagggggttgcaccacggaaaaacatagatgtgatgaaatctgctattgaaacagtcgaaggcaaagatacagaaatggatgttgatgagacttcagcaaagaaaagcaagaaaaagaaatccaaagttgaggtggtggaatatgctcaacccattattgaggataagccacttgcaaatggtgatgcctctgaagaaccaaagtctgaaaagaagaagaagaagaaggagaagcggaaaacagaacaggagccagagcatgaagaggatcagaccaatggtgcgtctgaggatggaacagccaagaaaaagaaaaagaagagcaaggaggaaaatggagaggaactccaagctgcaagcgaagttaaaaagaagaaaaagaagtccaaagtccaagatgatgaataaatatataatacttcttattttgtctgtcttcctcactttgcctgtaagccccgccgtcaacctctttttgtaatcctaggtctcagtgccatctattagttttgttcctgaactaagttattgctagagagagccatgtatcaaacgctcatcttctctattaacagattggccttggtgataactttcctttgatgtgaggttggttcacttggatttatttattgtatcggttcttgatgagatcttttttaaaacaaaaaatc

SEQ ID NO: 6253 - DNA, 1662 bp, Nicotiana benthamiana
aacttatacatggcgctgtatctactgtacgagtcggcgtctgggtacgcgttgttcttggctcatggaattgatgaaattgggcagaacacagaggcggttcgcaattccatcactgatctcaaccggttcggcaaggtcgtaaagattgaagcttttaacccttttgagtcagcccttgacgccctcaatcaatgcaatgctgtttctgaagggcaaatgaccgaggagctaaggaacttcttggagcgaagtctcccaaaagtcaaggaggtcaaggagggtaagaaggctaagttcagtttaggattggcagagcctaagcttggttctcatatccatgaagtaactaagattccctgccaaagtaacgagtttattcttgagcttctgcgtggagtacgcttgcattttgagaagttcattgaaaacctaaagcctggagatctggagaaagcccaacttggtctgagtcacagttacagcagagcaaaggtcaagttcaacgttaatcgtgttgacaatatggttactcagggaattgtcttgcttgatactcttgataaagatattaatacctttgccatgagagtcagagaatggtactcttggcatttcccagagttggtgaagattgtcaatgacaattatctatttgccaaagtagcaaaatttgttgatgacaaatcccaattatctgaagacaaaattccagacttaacagaaatagttggagatgaagataaagcaaaagaaattgtagaagctgcaaaagcatccatgggccaggatttgtcgccagttgacttgattaatgttaagatgtttgcacagagggtaatggaccttgttgaatacaggaaggatctttatgattatcttgttgctaaaatgcatgacatagcaccgaatttggctgctctgattggtgaagttgttggtgctcgtttaatttctcatgctggtagtctcacaaatttggcaaagtgcccttcttccacccttcagattcttggtgctgagaaggcactctttagggccttgaaaaccaaaggaaatacaccaaaatatggactcatattccattcatccttcatcggccgtgcatctgctcgtaacaaaggtcgaatggctcgctttcttgcaaacaaatgttcgattgcttctcgcctagactgtttcttagataccagtactactacttttggggagaaactccgtgaacaagttgaggagcgtctagacttttatgacaagggggttgcaccacggaaaaacatagatgtgatgaaatctgctattgaaacagtcgaaggcaaagatgcagaaatggatgttgacgagccttcagcaatgaaaagcaagaaaaagaaatccaaagttgaggtggtggaatatgcgcaacccatgattgaggatcagccacttgtcacaaatgtggatgcctctgaagaaccaaagtctgaaaagaagaagaagaagaagaagcggaaaacagaacaggagcgagagcatgaagaggatcagacgaatggtgcgcctgaggatggaacagccaagaaaaagaaaaagagcaaggaggaaaatggagaggaacttcaagctgcaagcgaagttaaaaagaagaaaaagaagtccaaagtccaagatgatgaataaaga

SEQ ID NO: 6254 - DNA, 1812 bp, Nicotiana benthamiana
gcaacttatacaaaattttcagttctgaatctactgtacgagtcagcatctgggtacgcgttgttcttggctcatggaattgatgaaattgggcagaacacggaggcggttcgtaattccatcacttatcacaatcggttcggcaaggtcgtaaagattgaagcttttaacccttttgagtcagcccttgacgccctcaatcaatgcaatgctgtttctgaagggcaaatgaccgaggagctaaggaacttcttggagcgaagtctcccaaaagtcaaggagggtaagaaggctaagttcagtttaggattggcagagcctaagcttggttctcatatccatgaagtaactaagattccctgccaaagtaacgagtttattcttgagcttctgcgtggcgtacgcctgcattttgacaagttcattgaaaacctaaagcctggagatctggagaaagcccaacttggtctgagtcacagttacagcagagcaaaggtcaagttcaatgttaatcgtgttgacaatatggttactcagggaattgtcttgcttgatactcttgataaagatattaatacctttgccatgagagtcagagaatggtactcttggcatttcccagagttggcgaagattgtcaatgacaattatctatatgccaaagtagcaaaatttgttgatgacaaatcccaattatctgaagacaaaattccagacttaacagaaatagtggagatgaagataaagcaaaagaaattgtagaagctgcaaaagcatccatgggccaggatttgtcgccagttgacttgattaatgttaagatgtttgcacagagggtaatggaccttgttgaatacaggaaggatctttatgattatcttgttgctaaaatgcatgacatagcaccgaatttggctgctctgattggtgaagttgttggtgctcgtttaatttctcatgctggtagtctcacaaatttggcaaagtgcccttcttccacccttcagatccttggtgctgagaaggcactctttagggccttgaaaaccaaacgaaatacaccaaaatatggactcatattccattcatccttcatcggccgtgcatctgctcgtaacaaaggtcgaatggctcgctatcttgcaaacaaatgttcgattgcttctcgcctagactgtttcttagataccagtactactacttttggggagaaactccgtgaacaagttgaggagcgtctagacttttatgacaagggggttgcaccacggaaaaacatagatgtgatgaaatctgctattgaaacagtcgaaggcaaagatgcagaaatggatgttgatgagccttcagcaaagaaaagcaagaaaaagaaatccaaagttgaggtggtggaatatgctcaacccatgattgaggatcagccacttgtcacaaatggggatgcctctgaagaaccaaagtctgaaaagaagaagaagaaggagaagcggaaaacagaacaggagctagagcatgaagaggatcagaccaatggtgcgcctgaggatggaacagccaagaaaaagaaaaagagcaaggaggaaaatggagaggaacttcaagctgcaagcgaagttaaaaagaagaaaaagaagtccaaagtccaagatgatgaataaagatataatacttcttattttgtctgtcttcctcactttgcctgtatgccccgccgtcaacctctttttgtaatcctaggtatccgtgccatctattagttttgtacctgaactgagttattgctagagagagccatgtatcaaacgctcatct

SEQ ID NO: 6255 - DNA, 1960 bp, Nicotiana tabacum
ttgtacatgccgctgtacctcctgtacgagtccgcgtccgggtacgccctgttcttggcccatggccttgacgaaatcggccagaacaccgaggccgttcgcaactccctcaccgatctcaaccgcttcggcaacctcctaaacctcgccgcctttaccccctttgactccgcccttgacgccctcaaccaatgcaacgctgtctctgaagggcaaatgactgacgagctaaggaacttcttggagcccactctcccaaaagtcaaggagggtaagaagcccaagttcagtctaggattggcagagcctaaccttggctctcatatccatgaagtaactaagattccctgccaaagtaacgagtttattcttgagcttctgcgtggagtccgcttgcattttgagaagttcattgaaaacctaaagcctggagatctggagaaagcccaacttggtctgagtcaccgttacagcagagcaaaggtcaagttcaatgttaatcgtgttgacaatatggttactcaggcaattgtcctacttgatactcttgataaagatattaatacctttgccatgagagtcagagaatggtcctcttggcatttcccagagttggtgaagattgtcaatgacaattatctatatgccaaagtagcaaaatttgttgatgacaaatcccaattatccgaagacaaaattccagacttaacagaaatagttggagatgaagataaagcaaaagaaattgtagaagctgcaaaagcatccatgggccaggatttgtcgccagttgacttgattaatgtcaagatgtttgcacagagggtaatggaccttgtcgaatacaggaagaatctttatgattatcttgttgctaaaatgcatgacatagcaccgaatttggctgctctgattggtgaagttgttggtgctcgtttaatttctcatgctggtagtctcacaaatttggcaaagtgcccttcttctacccttcagatccttggtgctgagaaggcactctttagggccttgaaaaccaaaggaaatacaccaaaatatggactcatattccattcttccttcatcggccgtgcatctgctcgtaacaaaggtcgaatggctcgttatcttgcaaacaaatgttcgattgcttctcgcctagactgtttcttagatacgagtactactacttttggggagaaactccgtgaacaagttgaggagcgtctagacttttatgacaagggggttgcaccacggaaaaacatagatgtgatgaaatctgctattgaaacagtcaaaggcaaagatacagaaatggatgttgatgagccttcagcaaagaaaagcaagaaaaagaaatccaaagttgaggtggtggaatatgctcaacccatgattgaggataagccacttgtcacaaatgatgatgcctttgaagaaccgaagtctgaaaagaagaagaagaagaaggagaagcggaaaacagaacaggagccagagcacgaagaggatcagaccaatggtgcgcctgaggatggaacagcaaagaaaaagaaaaagaagagtaaggaggaaaatggagaggaactccaagctgcaagcgaaattaaaaagaagaaaaagaagtccaaagtccaagatgatgaataaagatacaattttagccacccttggtcttcttattttgtttgtcttcctcaccttgcctgtatgccccgccctcaaactctttttgtaatcctaggtatctgtgccatctattagttttgttcctgaactaagttattgctagagagggccatttatcaaacgctcatcttctctattaacagattggccttagtgataactttcctttgatgtgaggttggttcacttggatttatttattgtatcggttctttgtttagatctttttaaatacataaaatcatgattaaaaaatagcggccgcatg

SEQ ID NO: 6256 - DNA, 1941 bp, Amsonia hubrichtii
gaatttccctcttttctcctccgtcctcgccaatatagttgatacccccaatccgtatttcgccagaaattagccctcgagaacagaggtggaggcggagctctgctttgaagctcaattatggccctgtatttgctctacgagtcggcgtcaggatactctgtctttttggcgcatggtttggatgaaatcggccagaatacggtggatgttcgtaactcggttttcgatctcaatcggtttggaaaagttgtgaagcttgccgcttttagcccatttgagtccgcacttgatgctcttaagcaatgcaatgctgtctctgaagggcaaatgactgatgaactaagaaacttcttggagcttactctcccaaaggtcaaggaaggtaagaagcctaaattcagtcttggactagcagagcctaagcttggatctcacatccatgaagaaactaagatcccctgccaaagtaatgagtttgttcttgagcttcttcgtggtgtgcgtttgcattttgataggttcattgagaatctcaaggctggcgacttggagaaagcccaacttggcttggggcacagttatagcagagcaaaggtcaagtttaatgttaaccgtgttgataatatggttattcaggcaatcttccttcttgatactcttgacaaagacattaattccttctccatgagagtcagagaatggtactcttggcatttccctgaattagtgaagattgttaatgacaattacctatatgccaaagttgcaaaatttgtggacgacaaatcagagctatctgaagacaagataccaggcttaacagagatcgtcaatgatgaagataaagcaaaagaaattgtagaagctgctaaagcatcaatgggacaggatttatccccgattgacttgattaatgtcaagcaatttgcacagagggtgattgaccttgctgagtacaggaaaaatctgtatgattatctggtagctaaaatgaatgacatagcaccaaacttggcagcactcattggtgaagttgtgggagctcgtttgatttctcatgctggaagcctcacaaatttggcgaagtgcccgtcttctacacttcagatccttggtgcagaaaaggcactcttcagggcattaaaaacccgaggaaacactccaaagtatggtcttatctttcattcatctttcattggtcgtgcatctgctcggaacaagggtcgaatggctcgttatctggccaacaaatgctccattgcttcccggattgattgtttcttggagcaaaacaccaacgcctttggggagaaactccgtgaacaagttgaagagcgacttgacttctatgacaagggggtcgcacctcgtaaaaacattgatgttatgaagtctgttcttgagaatgctctaacaaaagaaatggatgtggatgaagatgagccttcagtaaagaaaagcaagaaaaagaaatccaaaacccaagtggcagaggataaacctgcagctgttagaaatggggatgctactgaagaacctaaaaccgaaaagaagaagaaaaaggagaagcgaaaatcagaggagcctgaccctgatgaggctgcaggaactgcaaatggtgagaatggctccaatgcagaggatggaactgcaaagaagaagaaaaagaaaaagagtcaggatgatggagagaatattgcagctgctagtgaaggtaaaaagaaaaggaagaagaagtcaaagactgaagatgacgaatagtttgtaagcttctagtgggttaaaggcctgtccttgttttgcatctgaaattagttttatgttgtatttactagaagaagattagtgattccatgctaagtttcgttttctgcttctatgcttgtattcttagctacatggaaggcccaattttctagttatttcctgcaggatcag

SEQ ID NO: 6257 - DNA, 2017 bp, Tabernaemontana elegans
acgctcgctgccaagcccccactcccataaaaccctaaaccctaaacctaaatacaatttctcaaactttctctctttcttttccacctcctcctccacctcacccttgcttgggcaagggaaggcaagtaaagaaagaagttgggaggattggattgaagtttaactatggcgctctatctactgtacgagtcggcatcagggtacgcggtgtttttggctcacggcttggatgaaattgggcagaacacggaggccgttcgaaactcggttttagatctcaaccggttcggaaaggttgtgaaccttgctgcttttagcccctttgagtctgcacttgatgctcttaagcaatgcaattccgtttctgaagggcaaatgactgatgaacttaggaacttcttggagcttactctcccaaaggtcaaggaaggtaagaagcttaagttcagtctaggcgtagcagagcctaagcttggatcacacattcatgaagaaactaagataccctgccaaagcaacgagttcgttcttgagcttcttcgtggtgtgcgtttgcactttgataggttcattgagaacctgaaggctggcgatttggagaaagcccaacttgggttggggcacagttacagcagagcaaaggttaagtttaatgttaaccgtgtggataatatggttattcaggcaatcttccttcttgatactcttgacaaagatattaattccttctccatgagagtcagagagtggtactcttggcatttccctgaattagttaagattgttaatgataactatatatatgccaaagttgcgaaatttgtggatgacaaatcacagctatccgaagacaagattccaggcttaacagagattgttggtgatgaagacaaagcaaaagaaattgtggaagctgctaaagcatcaatgggacaggatttatccccgattgacttgattaatgtcaagcaatttgctcagagggtgattgaccttgctgagtacaggaaaactctctatgactatctcgtagctaaaatgaatgacatagcaccaaacttagcagcactcattggtgaagttgtgggagctcgtttaatttctcatgctggtagcctcacaaacttggcaaagtgcccctcttctacacttcaaatccttggtgcagaaaaggcactcttcagggcattaaaaacccgaggaaacactccaaagtatggtcttatctttcactcgtctttcattggtcgtgcatctgctcggaacaagggtcgaatggctcgttatctggcaaacaaatgttccattgcttcccggattgattgtttcttggagaaaaataccaatgcctttggtgagaaactccgtgaacaagttgaagagcggcttgacttctatgacaagggggtcgcacctcgtaaaaacattgatgttatgaagtctgctcttgagaatgctcaaacgaaagaaatggacgtggatgaagacgacgagccttcggtaaagaaaagcaagaaaaagaaatccaaagcatccaaagctcaagtgacagaagatggtgaacccaaggcagaggataaatctgcagctctcacaaatggtgatgctgtcgaagtgcctaaaactgaaaagaagaagaagaaaaagaagcgaaaatcagaagaggagcctcatcctgatgacgctgcagaaaatgcaaatggtttcaatgcagaagatggaacagcaaagaagaagaaaaagaaggagagtcgggataatgatggggagaatactgcagcagctagtgaagttaaaaagaaaaagagaaagaagtcaaagactgaagatgacgaatagttgagattcgagtgggttaaaagcctgtgcttatgctgcctctaatgtttgttttatgttgtatttatatttcgtagaagaagattagtgcttccattctaagttttatctatgcttgagttgttagctacatggaaagtccatttttctagttgtttcttgcaggatcagaata

SEQ ID NO: 6258 - DNA, 1738 bp, Vinca minor
gtgaccattacacatttcttctttcagaaattaaggtgaagagctttgtaagcttaactatgtcgctgtatctactctacgagtcagcgtcaggctacgccgtcttccaggctcatggtttggatgaaatcggtcagaacactgaggctgttcgtaactccgtcaccgatctcaaccgtttcggaaaagttgtgcagcttgccgcttttagtccttttgaatccgctcttgatgctcttaatcaatgcaattccgtttctgaagggcaaatgactgatgaactaaggaacttcttggagctcactctcccgaaggtcaaggaaggcaagaagcctaaattcagtttaggcatatcagagcctaagcttggatcacacatccttgaagaaactaagataccttgccaaagtaacgagtttgttcttgagcttcttcgtggtgtgcgcttgcacttcgataggttcattgaaaaccttaaggctggtgacttggaaaaggcccaacttggcttgagtcacagttacagcagagcaaaggtcaagtttaatgttaaccgtgttgataacatggttattcaggcaatcttccttcttgatactcttgacaaagatatcaattccttctccatgagagtcagagaatggtactcatggcattttcctgagttggtaaagattgttaatgacaactatctatatgccaaagttgcacagtttgtggacgacaaatcacagctgtctgaagatatgttaccaggattaacggagattgttggtgatgaagataaagctaaagaagtcgtagaagctgctaaagcatcaatgggacaggatttatccccaattgacttgattaatgtcaagcaatttgcacagagggtgattaaccttgctgaatacaggaaaacactgtatgactaccttgtagctaaaatgaatgacatagcaccaaacttggcagctctcattggtgaagttgttggagctcgtttgatttctcatgctggtagtctcacaaacttggcaaagtgcccatcttctacgcttcagattcttggtgcagaaaaggcacttttcagggcattaaaaacccgaggaaacactccaaagtatggtcttatctttcattcatcttttattggtcgtgcatctgctcggaacaagggtcgtatggctcgttatcttgcgaacaaatgctccattgcttcccggattgattgtttcttggataaaaataccaaagcctttggagagaaactccgcgaacaagttgaagagcgacttgatttctatgacaagggtgttgcacctcgtaaaaatatcgacatgatgaagtctgttcttgagaatgctgaaacaaaagaaatggacgtggatgtggatgaggatgagccttcagtgaagaaaaacaagaaaaagaaatccaaatctcaagtggcagaagatggtgaaccaatggcagaggataaacctgcagctgtcacaaatggggatgatactgaggaacccagaactgaaaagaaaaagaagaaaaaggagaagcgaaagtcagaaaaggatgctgagcctgaaaaagcaagtggcgctaatggcttcaatgcagcagaggatggaactgccaaaaagaagaagaagaagagtcaggatgatggagagagtattggagccgccgtcagtgaaggtaaaaggaaaaagaagaagtcgaagactgaagacgatgaatagtttgagatatataa

SEQ ID NO: 6259 - DNA, 1918 bp, Vitis vinifera
ccctacttcgccgatacatatatgaaggttttagggggacaaaagctttgagtctctccgtgccagctatcaatggcgctttatcttctctacgaatcggcttctgggtacgctctatttctcgctcatgggctcgacgaaatcggtcagaacaccgaggcggttcggagctccgtttcggatctgaaccgattcggcaaggtggtaaagctggctgcttttcacccgtttgaatccgctctcgatgctctgaatcaatgcaactcagtgtctgaagggcttatgactgatgagttgaggagtttcttggagcttaatcttcctaaagtcaaggaaggtaagaagcccaagttcagtttaggaactgcagaacctaagattggatcgcatatctttgaagatactaaaattccttgccaaagcaatgagtttgttcttgagcttctccgtggtgtgcggttgcattttgataggtttattaaggatctcaagcctggagacctagaaaaggcccaacttggtctgggacacagttacagcagagcaaaggtgaagttcaatgtgaacagagtcgataatatggtcattcaggccatcttccttctcgatactcttgataaagatatcaattccttctccatgagagtcagggaatggtactcttggcatttccccgagttggtgaagatagtgaatgacaactatctctatgccaaagttgcaaaatttgttgagaacaagttggagttgtctgaagacaaaattccaggcttaactgagatccttggagatgaagataaagcaaaggagattgtggaagctgccaaagcatccatgggacaggatttgtccccaattgacttgattaatgtccagcaatttgcgcagagggtaatggacctctctgagtacaggaagaagctgtatgaatatctggttactaaaatgaacgacattgcacccaatttggcttctctaattggtgaagttgttggggcacggttgatttctcatgcaggtagtctcactaatcttgcaaaatgcccttcctccactcttcagatccttggtgctgaaaaggctctattcagggcattgaaaacaagagggaacacgccaaaatatggtctaatcttccattcttcttttattggtcgtgcatctgcccggaacaagggacgtatggctcgttatcttgcaaacaagtgttccattgcttctcgtattgactgttttgctgagagtaacaccacggtttttggggagaaactccgtgaacaagttgaggagcgactcgaattttatgacaagggaattgcacctcggaaaaacattgatgttatgaaagctgccattgaaattactcaaaacaatgacacggaggacaaagcaaccactgagccttcagcaaagaaaagcaagaaaaagaagtctaaagtcgaggctgcagaggatggtgagcccatggttgaggataaaccaactgctgctacaaatggagatgcttctgaggaacccaaaactgagaagaagaaaaagaaggagaagcgaaagttggtagaagaagaagagcaggttcaggctgtggagaattcaattggtgtgaacggggttaacacagaggatggaacagcaaagaagaagaaaaagaagaagagcaaggatgaggatggagagggtcttgcagctgccagtgaaggtaagaagaaaaagaagaaatcaagaagcgaagacgatgattaaattttgatcgagtagtctaaaattctggtagatatctatctgggctgcagttgttgcataagtttgaaattatgatgaaattacgatgaaatttaggcacctagagctttcctaaattatgaacttcaatatcaactcttaatgtgtttttctccatatctttaatctcatgggt

SEQ ID NO: 6260 - DNA, 3402 bp, Capsicum annuum
aaagaaaaccctcccaaaaccctagctacaccgtagctccgacggtgaatgtaaagtccggttattcgccgggggcgactgtatagatcatcggaaacctaattcgattggttggaagttttgaagaaaaatttaaaatttgacggaggagttgacgattgaaagatcacgaacatgtcagatatcaggaaatggttcatgaagcagcatgacaaaggcaccggtaatgggagtatgtccaagaatagtgcagcagaaaagccttccccagctactccaaaggcagaaagcctggtacaagaaggacaagagactgccggcagaaggaaaactagtaaatattttgctacagacaaggtgaagccaaaagaagaaaaagttgaggaagtgtcagcaaaaagaaaagctcaaaatgatggtggaagttcatcagctaatgagaagccaccagctgcaaaaagaattcacaaagctgaggatgatgacgactttgtactgtcttcatctgcaacgggatccagagatgtcactcccagcaaaaggttggtaagtggctctggaaggggatctgcgcggaaaaatgtgatcagtgatgatagtgacgatgatcttaagagcaaaaagtctgatgtcaaacctgctggaagagggcgtggtggacgggcagctcagaccggtggaaagcgcgcccctcttgatgaaagtgatgatgatgcctcagctgtcaaggacaccaaatctggtggacgagggcgtggtggtaaagcaccatctgcagcaccaagtggtggacgaggcagaggtggtggaggacgaggaggtttcatgaatttcggtgaaagaaaagaccctcctcacaagggggaaaaggaagttcctgaaggtgccccagattgtttagctggtttgacttttgtaattagtggaactcttgacagtttagaaagagaagaagctgaggatttgattaaacgccatggtggtcgcgtcacaggatctgttagcaggaaaacgaattatcttttatgtgatgaagacatcgagggaaggaaatcctctaaagccaaggagctcggaactgcatttctcactgaggatggtttgtttgaaatgatccggtcatccaataaatcaaaatcagctacccaaccagagtcaaagaaatctctggacactgttgtttcttctccaaagagaaagttacaaaatacaagtgatggaactggaagcactgccgcgaagattctagctgccaaacaattggcatctagtgcatctcttgctaaaagtagtgcatctcctgcgaagggtagtgcatctcctgccaagaggaaaagccaagttaaagagtctttactaccatggacagaaaaatacaggcccaaagctattgtagacataataggaaataagtcactggtggaacagattcaacgttggctagagagctgggatgagcatttcctaaaagcagctagtaaggggaagggaaaaaaacagaatgactctggtgctaaaaaggcagttctgttgagtggtatgccgggtatagggaagactacatcagcaaaggtggttagtcagttgcttggtttccaaaccattgaggtaaatgctagtgatagtcgtggaaaggctgattcaaaaattgagaaaggaattggtggaagtactgctaattccataaaagaacttgttagcaatgaatctctaagtgctaatattggcagatcacaccatcagaagactgttctgattatggacgaggttgatggcatgtctgctggagatagaggaggcgttgccgatcttattgctagcatcaagatctcaaaaattcctattatctgcatttgcaatgatcgctacagtcagaaattgaagagccttgtcaattattgccttccaattgtcttcagaaaaccaaccaagcagcagatggcaaagaggttaaagcaagtggcaaatgctgaaggcattcaagtcaatgagattgctcttgaggaattggcagaccgtgttggtggagatatgcgtatggctctaaatcaattgcaatacatgagtctctctaaatctgtgatccaatacgatgatataagacagcgccttctaagcagttcaaaggatgaggatatctcaccgttcaaagctatagaaaagctgtttgattttaatgccaagaacttaaagatagatcaaagaattgacctaagtatgagtgacccagatcttgtcccgcttcttgtccaggagaactatctcaattacaaaccaagttctgctggcaaagatgatagtgacttaaagcggatgagcctaattgcatgtgctgcagactctattgcgaatagtgacttaataaatgtacaaattcgaagataccagcagtggcaactttctccagctggttgcatttcatcttgcataattcctgcttctttgttgcacggacagaggcagactcttgagcagggagaacgcaactttaacaggtttggtggctggctaggtaagaactctacaatgggaaagaattatcgaattctggaggacttgcatgttcacctactcgcatctcgtgaatcttatttgggaagggcaaacctgagactggactactttactcttcttggaaagaagttgactgatccattaagagtgctgcctaaggatgaagctgtagagaatgttgtggatttcatggattcatactctataagccaggatgactttgataatattgtggagatctcaaaattcaagggatgtccgactcttctggatggtgttcagcctgctgtgaaagctgcactgacaaaggcatacaacaaaggaagtaaatcacgtgttattcgcacagcagatttaattacccttcctggaattaaaaaagctcccaagaagcgcgttgcagcgatgcttgagccactagacgaaggcgtagctgctgaagaaaatgacgaaacacttgctgaagatgaagagaactcatcagagacagaagacacggcagatgttgagaaaaaattgcagtcagatcttcagagtctcagttcgaaaggaatccaagtaaacatggacttgaagggtggcaagaagccttctgcaggaagaggacgaggaagaggaagttctaatagcagtgataaaggaagcgctgaatcctcaggtaagagaggtggccgaggttctggagctgctgccaagcgaaaaagatgaaacccgaaagcattagacatctccctgacctcattttgtctgttacaatcatcggaagctgcagttttttccgggtgtaagtcctcgcgatgacgaatgtaggaaactttgtttagctattcgtgtagagagaaaaggtcctaagttgacctatgtaatattctacttgaatttgatgag

SEQ ID NO: 6261 - DNA, 3350 bp, Nicotiana benthamiana
aaatcatagtctcattctcaaaaccctataccggagctacgttgacggtaatggccggttactccccgcaggcgaattcatagcttggtggaattttgaaattaatcgaaagttgaagaaggcattgcctattgaagacagtgcgttttacaagtcacaaaaatgtcagatatcagaaaatggttcatgaagcagcatgacaaaggtacgggtaatgggagtatgtccaagtatagtgctccagaaaagccttcagcagaaaagccttctccaggaaacctggtacaagaaggacaagagactgccggcagaaggaaaactagtaaatattttgctacagacaaggtgaagacaaaagaagaaaaagtagaggaagtatcagcaaaaagaaaagctcaaaatgctggtggaagttcatcagttaatgagaagccaccagctgcgaaaagaattcacaaacctgaggatgatgacgactttgtactgcccacatctgcaatgggatccagaggtgccactcccaccaaaaaatcggcaagtggctctggcaggggatctgcacggaagtctgtgatcagtgatgaaagtgacgatgatctcaaggatacaaaatctgatctcaaacctactggaagagggcgtggtggacgagcagctcagactggtggaaaaggcatccctcttgatgaaagtgatgatgatgcctcagctgataaggacaccaaatctggtggacgagggcgtggtggtaaaggaccatctgcagcaccaagtggtggacgaggcagaggtggtggaggacggggcggtttcatgaattttggtgaaagaaaagaccctcctcacaagggggaaaaggaagttcctgaaggtgccccaaactgtttagctggtttgacttttgtaattagtggaactctggacagtttagaaagagaagaagctgaggatttgattaaacgccatggtggtcgtgtcacaggatctgttagcaagaaaacgaattatcttttatgcgatgaagacatcgagggacggaaatcctctaaagcgaaggaacttggaactgcatttctcactgaggatggtttgtttgatatgatccggtcttcaaagaaatcaaaatcagctacacaacctgagtcaaagaaatcggtgcacactgttgtttctcctgcaaagagaaattcacaaaatacaagtgatggaactggaagcactgccacaaagattttagctgacaaagaattgacacctagtgcatctcctaccaagaggaaaggccaagctaaagagtcttcactaccatggacagaaaaacacaggcccaaagctattgtagacataatagggaataagtcactggtagaacagattcagcgttggctggacagttgggatgagcattttctaaatgtagctggtaaggggaaggggaaaaaacagaatgactctggtgctaaaaaggcagttctgttgagtggtatgccgggtatagggaagactacatcagcaaaggtggttagtcagctactgggtttccaaaccattgaggtaaatgctagtgatagccgtggaaaggctgattcaaaaattgcgaaaggaattggtggtagtactgctaattccataaaggaacttgttagcaatgaatcactaggtgctaatattggcagatcgcaccatcagaagactgttctgattatggacgaggttgatggcatgtctgctggagatagaggtggtgttgccgatcttattgctagcatcaagttatccaaaattcctattatctgcatttgtaatgatcgctacagtcagaaattgaagagccttgtcaattattgcctaccaattgttttccgaaaaccgaccaagcagcagatggcgaagaggttaaagcaagtggcaaatgctgaaggccttcaagtcaatgagattgctcttgaggaattggcagaacgtgttggtggcgatatgcgtatggctctaaatcaattgcaatacatgagtctctccaagtctgtgatccaatacgatgatataagacagcgccttctaagcagttcaaaggatgaagacatctcacctttcaaagctgtcgaactgctgtttgattttaatgccaagaacttgaaaatagatcgaagaattgatctaagtatgagtgactcagatcttgtcccgcttcttatacaggagaactatctcaattacaagccaagttctgttggcaaagatgatgatggtttaaagcggatgagcctaattgcgcgtgctgctgactctattgcaaatggtgatttaataaatgtacagattcgtagataccagcagtggcagctatctccagctggttgcctttcgtcttgcataattcctgcttcgttgttgcatggacagaggcagactcttgagcagggagaacgcaactttaataggtttggtggctggctaggaaagaactctacaatgggaaagaattaccggattttggaggacttgcatgttcacctactcgcatctcgtgaatcatatttgggaagggcaaacctgaggcttgactactttactcttcttacaaagaagttgacagatccattaaaactgctacctaaggatgaagctgtcgagaacgttgtggatttcatggattcgtactctataagccaggatgacttcgataatattgtggagatatcaaaattcaagggacatccaaatccactggatggtgttcagcctgttgtgaaagctgcactgacaagggcatacaacaaaggaagcaaatcacgtgttattcgcacagcagatttaatatcccttcctggaattaaaaaagctcccaagaagcgggttgcagctatgctggagccactagatgaaggcttagctgaagaaaatggtgaagcaattgctgaagatgaagagaactcatcagagccagaggatatagatgttgagaaaaagttggagtcagatcttcagagtctcaattcgaagggaatccaagtaaatgtagttctgaagggtgctggtggaaagaagccgtctgctggaagaggaagaggtagttctaatagcagggagaaaggaggcgctgaatcttcaggcaagagaggtggccggggttctggagctaccaagagaaagaggtgaaacccgaaaacatcttcctgaccctaatgtctgttacaaccatcagaatctgctttccgggtcaagcatttaggaaactttgtttagctatttgtgtaaaagaaaaaagggggtctcaagttgatctgtgtacattctacttgaagctgatgagtaactattttctgtctatagttttggtttgtattcaa

SEQ ID NO: 6262 - DNA, 3025 bp, Nicotiana benthamiana
aaaaagaaaagctcaaaatgctggtggaagttcatcagttaatgagaagccaccagctgcgaaaagaattcacaaacctgaggatgacgatgactttgtactgcctgcatctgcaatgggatccagaggtgccactcctgccaagaagtcggcaagtggctctggcaggggatctgcacggaagtctgtgatcagtgatgaaagtgacgatgatcttaaggatacaaaatctgatcccaaacctactggaagagggcgtggcggacgagcagctcagactggtggaaaaggcatccctcttgatgaaagtgatgatgatgcctcagctgataaggacaccaaatctggtggacgagggcgtggtggtaaaggaccatctgcagcaccaagtggtggacgaggcagaggtggtggaggacggggcggtttcatgaattttggtgaaagaaaagaccctcctcacaagggggaaaaggaagttcctgaaggtgccccaaactgtttagctggtttgacttttgtaattagtggaactctggacagtttagaaagagaagaagctgaggatttgattaaacgccatggtggtcgtgttacaggatctgttagcaagaaaacgaattatcttttatgcgatgaagacatcgagggacggaaatcctctaaagccaaggaactcggaactgcatttctcactgaggatggtttgttcgatatgatccggtcatcaaagaaatcaaaatcagctacacagcccgagtcaaagaaatcagtggacactgttgtttctcctgcaaagagaaattcacaaaatacaagtgatggaattggaagcactgccacaaagattttagctgccaaagaattgacacctagtgcatctcctgcaaagaggaaaggccaagctaaagagtcttcactaccatggacagaaaaatacaggcccaaagctattgtagacataatagggaacaagtcactggtagaacagattcagcgttggctggagagctgggatgagcattttctaaatgcagctagcaaggggaaggggaaaaaacagaatgactctggtgctaaaaaggcagttctgttgagtggtatgccgggtatagggaagactacatcagcaaaggtggttagtcagctactgggtttccaaaccattgaggtaaatgctagtgatagtcgtggaaaggctgattcaaaaattgagaaaggaattggtggtagtactgctaattccataaaagaacttgttagcaatgaatccctaggtgctaatattggcagatcgcaccatcagaagactgttctgattatggatgaggttgatggcatgtctgctggagatagaggtggtgttgccgatcttattgctagcatcaagttatccaaaattcctattatctgcatttgtaatgatcgctacagtcagaaattgaagagccttgtcaattattgcctaccaattgttttccgaaaaccgaccaagcagcagatggcaaagaggttaaagcaagtggcaaatgctgaaggccttcaagtcaatgagattgctcttgaggaattggcagaacgtgttggtggcgatatgcgtatggctctaaatcaattgcaatacatgagtctctccaagtctgtgatccaatacgatgatataagacagcgccttctaagcagttcaaaggatgaagacatctcacccttcaaagctgtcgaactgttgtttgattttaatgccaagaacttgaaaatagatcgaagaattgatctaagtatgagtgacccagatcttgtcccgcttcttatacaggagaactatctcaattacaaaccaagttctgttggcaaagatgatgacggtttaaagcggatgtgcctaattgcaagcgctgctgactctattgcaaatggtgatttaataaatgtacagattcgtagataccagcagtggcaactatctccagctggttgcctttcgtcttgcattattcctgcttcgttgttgcatggacagaggcagactcttgagcagggagaacgtaactttaataggtttggtggctggctaggaaagaactctacaatgggaaagaattaccggattttggaggacttgcatgttcacctactcgcttctcgtgaatcatatttgggaagggcaaacctgaggcttgactactttactcttcttacaaagaagttgacagatccattaaaagtgctacctaaggatgaagctgtcgagaacgttgtggatttcatggattcgtactctataagccaggatgacttcgataatattgtggagatatcaaaattcaagggacatccgaatccactggatggtattcagcctgttgtgaaagctgcactgacaagggcatacaacaaaggaagcaaatcacgtgttattcgcacagcagatttaatatcccttcctggaattaaaaaagctcccaagaagcgggttgcagctatgctggagccactagatgaaggcttagctgaagaaaatggtgaagcaattgctgaagatgaagagaactcatcagagccagaggatatagatgttgagaaaaaattggagtcagatcttcagagtctcaattcgaagggaatccaagtaaatctagatctgaagggtgctggtggaaagaagccgtctgctggaagaggaagaggaagttctagtagcagggagaaaggaggtgctgaatcctcgggcaagagaggtggccggggttctggagctaccaagagaaagaggtgaaacccgaaaacatcttcctgacctaatgtctattgcaaccatcggaagctgcagctttccgggtctagcatttaggaaactttgtttagctatttgtgtaaaagaagaaagggggtcttaagttgatctgtgtacattctacttgaagctgatgagtaactatttctgtctatagttttggtttgtattcaaattttggattctcatgtcagtgccgcgttaattctattccactatcttatgacactt

SEQ ID NO: 6263 - DNA, 3272 bp, Solanum phureja
atgtcgaataaggagaaaggtgtaaatgttcaggttttgcttcgttgcaggccgtttagtaatgatgagttgcggagtaatgctccgcaagtggtgacttgcaatgagtttcagagagaggttgctgtttcacagaacattgctggaaaacacatagataggatttttactttcgataaggtttttggcccctctgcacaacaaagggacctctatgatcaagcaattatccccattgtcaatgaagttttagagggatttaactgtacaatttttgcttatgggcaaactggtaccggcaaaacttacactatggaaggtgaatgcaagaggtccaagagtgggcctaacggagagcttccactaggagcaggtgttatacctagagctgtcaagcaaatttttgatacattagagagtcaaaatgcagaatacagtgtgaaagttacattcttagagttgtataatgaagaaatcactgacttgttagcccctgaggatttgtctaaagttgctttagaagacagacagaagaaacaattgccactcatggaagatgggaaaggtggagttctagttagagggcttgaagaagaaattgtgacaagtgccagtgagatattcaccttaattgaaaggggttcatcaaaacgccggactgcagaaaccttgctcaataagcaatcaagtcggtcacattctcttttttccatcacaatacacatcaaggaagcaacccctgaaggcgaagaactaataaaatgtggcaagttgaatttagttgatttggctggttcagagaatatttctcgctctggggctagggagggtcgtgcaagggaagctggagaaataaacaaaagtttactcacacttggacgagtgattaatgcccttgttgagcatcttgggcatattccttacagggatagcaaacttacacgtttgctgcgtgattcattgggaggaagaaccaaaacatgtatcattgccacagtgtcacctgctgtgcactgtcttgaggagactctgagcacactagactatgcccacagagcaaaaaacataaggaataagcctgaggtgaatcaaaaaatgatgaaatcaaccctcatcaaggatttgtatggagaaattgagcggcttaaaggagaggtatatgctgctcgtgagaagaatggtgtttatataccaaaagaacgatattatcaggaggagagcgagagaaaagcaatggcagatcaaattgaacaaatgggagtaagcatagaaaaccaacagaagcaactcgaggagttacaaagtagacatgattgtcaggttcaacagtgctcagatttgacttgtaaacttgatgcaacacagaaacaattgaaccaaacaagcaaattgctagcctacactgaggaacagttgagacaaaatctatacactctcaaggagcgggattttatcatctctgaacaaaaaaaagctgaaaatgccctggctcaccaagcatgtgttttacgggctgacttagagaaatcaattcaagagaatgcttccttgtttcaaaaaattgctagagaggataaactgagcactgataatcggtcagtggtagacaactttcaaactgagcttgcaaagcaacttggtagtctttccaccactgtggcaacatcagtgtctcgacaaaatgaacacctccaccatgtcgagaaaatctgtcataattttcttgaatcacatgagaaggctgccttagacttgacgaataaaattcattcttcaaaggccttgtacatatctcactttgaggctatgcaaaatgtagtgaagctgcataaagccactgctaatgctgctctggaggaaatttcatctttggcttcttctaattcaatttccactaaagaatttttagatgcagagtctgttgaagcaaatttaatttttgatgaacttcagagcactctgtcaacccaccaaggagaaatggcacattttgctagagagcttcgtcagagatttaatgacagtacagagcatttgacaaatatctctgagatcatacaaggattttttgacaaacttttagaagaatcaaaaagacttgaaagacattcaacaacagctgatgagattcaaacgaagtctattgctgaatttgagaaggcatatgaggagcaatcaagatcagatgcagaaaagcttattgctgaggtgacttccttggtctccaatcacatgcgtcgccaaaaagaactggttggtgcaaggcttggtgatcttagagaaactgtttctggaaataagacattcttggatgggcatgtatcctctatggaaggtattacaacagatacaaaaagaaaatggcaggacttttatacgcaagcagaaggtgagaccaaagaaaatgctgatttctcagctgctaaacattgccgaatggagttactcatgcagaagtgtgtaagcacaactgaaaccactgtgaaacggttgcaaagtactcatgaattggcaaaagacatgggcaatcaacatgtttcaacaatgcattcagttgtcaggaacatatgcgatagcaatgagcaacatgtaattgaatttgattccacaagggaagctgctgaagaagctgtgaaaaggaatagtgaagatatcattaaatctattgacggcttatcaggggaagagagaggatctatatctggcattttggatactgccagtgcacactcggagacccttgatgaacttaagaaagatcattgcacacagtctacctccattgaacagaaggcccttgaaacatttcagcagaagtttatggattatgagccaactggaacaacaccaattaggtctgagccagatgtaccaagcaagggaacaattgagtcgttgcgagccatgccaatggagactctactagaggagtttcgagaaaacaattcattcgagtccttccaagtaaaggatttaaagccatcacttataccacgatctcctctctcactgattaacaattagcagattggtttcatcattccctcctgcatatgatcacttaatctgtatcagtattttccttgtatactgagtgaaactgcaaactgcagtatatattgtaggttgtttgattcagtcttaaaatataaatcccaccttgggatttagaaaaatggctgtaaatgagtaactcttggtgttattccttgaagagttgataattcaaccgccaaaccaaccaaatcaaaccacaaattttttattttttt

SEQ ID NO: 6264 - DNA, 3405 bp, Capsicum annuum
caccaaaaaaacaaacacttacaccgaaaacacacagtaactctcacaaattatacactttctctttcggtttttgcttcagcatttttctctcacacaaacaccaaaaacacacagtaacaccaaaaacatacagtggctcaatcaagtacaccgaaaagaagcataggttcaccgtgtgttcagcgattgaagatgtcgaataaggaaaaaggcgtaaatgttcaggttttgcttcgttgcagaccgtttagtaacgatgagttacggagtaatgctccacaagtggtgacgtgtaatgagttacagagagaagttgctgtttcacagaacattgctggaaaacatatcgataggattttcactttcgataaggtttttggcccctcagcacaacaaagggacctctatgatcaagcaattatccccattgtcaatgaggttttagaaggatttaactgtacaatttttgcttatggtcaaactggtacggggaagacttacactatggaaggtgaatgcaagaggtccaagagtgggcctaatggagagctgccacaagatgcaggtgtcatacccagagcagtgaagcaaatttttgatacattggagggtcaaaatgctgaatacagtgtgaaagttacgttcttagagttgtataacgaagaaatcactgatttgttagcccctgaggatttgtctaaagttgctttagaagacagacagaagaaacaattgccactcatggaggatgggaaaggtggagttctagttagagggcttgaagaagaaattgtgacaagtgctaatgagatattcaccttacttgaaaggggatcatcaaaacgccggactgctgaaaccttgctcaataagcaatcaagtcggtcacactctcttttttccataacaatacacatcaaggaagccacccctgaaggcgaagaactaataaaatgtggcaagttgaatttagttgatttggctggttcagagaatatttctcgctctggggctagggagggtcgtgcaagggaagctggagaaataaacaaaagtttactcacacttggacgggtgattaatgcccttgttgagcatcttgggcatatcccttatagggacagcaaacttacacgtttgctgcgtgattcattgggaggaagaaccaaaacatgtatcattgccacagtgtcacctgctgtgcactgtcttgaggagactttgagcacactagactatgcccacagagccaaacacataaggaataagcctgaggtgaatcaaaaaatgatgaaatcaaccctcatcaaggatttgtatggcgaaattgagcggcttaaaggagaggtgtatgctgctcgtgagaagaatggtgtttatataccaaaagaacgatattatcaggaagagagtgagagaaaggcaatggctgatcaaattgaacaaatgggagttagcatagaaaacctgcagaagcaactcgaggagttacaaagtagacatgatagtcaggttcagcagtgctcagatttgactagtaaacttgatgcaacacagaaacaattgaaccaaacaagcaaagtactatcctactctgaagaacagttgagacaatgtcaatatactctcaaggagcgggattttatcatctctgaacaaaagaaagctgaaaatgccttggctcaccaagcatgcgttttacgggctgacttggagaaatcaattcaagagaatgcttccttatttcaaaaaattgctagagaggataaactgaatactgataatcggtcagtggtcgacacctttcaatccgagcttgcaaagcaacttggttctctttccagcacagtggcaatgtcagtgtctcggcaaaatgaacacctccagcgcgtcgagaaaatctgtcgtgattttcttgaatcacatgacaaggctgccttagacttgacaaggaaaatcaattcttcgaaggccttgtacaaatctcactttgaggctatgcaaaatgtagtgaggctgcataaagctacttctaatgctgctctggaggaaatctcgactttggcttcttctaactctatttctactaaagaatttttagatgcagagtctgctgaagcaaatttgatatttgatgaacttcagagcactttgtcaacgcaccaaggagaaatggcaaaatttgctagagagcttcgccagagatttaatgacagtacagaacatttgacaaatatctccgagatcattcaaggattttttgataagctcttagacgaatcaaaaagtcttgaaaggcattcaacaacagctgatgagattcaaacgaagtctattgctgaatttgagaaggcatatgaggaccaatcaagatcagatgcagagaagcttattgctgagatgacttccttgatctccaatcacatgcgccgccaaaaagaactggttggtgcaaggcttgttgatcttagagaaactgtttctgcaaataagacattcttggatgggcatgtatcctctatggaaggcattacaacagatgcaaaaagaaaatggcaggacttctatacacaagcagaaggtgggaccaaagaaaatgctgatttctctgctgctaaacattgccgaatggagttactcatgcagaagtgtgtaaacacaactgaaacagctctgaaacggtggcaaagtacacatgaatcagttaaagacatgggcaatcaacatgtttcgacaatgcattcagttgtcaggaacatatgcgatagcaacgatcaacatgtaaatgaatttgattccacaaaggaagctgctgaagaagatgtgaaaaggaatagtgaagatatcattaaatctattgacggtttatcaggcgaagaaagagcatctatatctggcattttgggtaccgccagtgcacactcggagacccttgaagaacttaagaaaaatcactgcacacagtctacctccattgaacagaaggcccttgaaacatttcaacagaagttcatggattatgaggcaactgggacaacaccaattaggtgtgagcaagatgtacccagcaagggaacaattgattcattgagagccatgccaatggagactctacttgaagaatttagagagaacaattcatttgagtcattccaattaaaggaactaaagccatcacttataccaaggtcccctctatcactcatcaacaattagaaaaataaatcccaccttgggatttagaaaaaaaaaatggctgtaaatgagcaccccttggtgcatttctttagtgaaagatgatacttttatgtattgtaaaagtgctgttccttgaagagttgatggttcatcttgcaacacttacatagcaacaatcaatggtgaataatagataaaatttta

SEQ ID NO: 6265 - DNA, 3557 bp, Nicotiana benthamiana
ccccacactctctctctctcacacacacaaacacacagaaaaacgcacaaacccccaaaacacacagtgcctcaatcaaaactcccaaagtgaaggcacaaactcccaggaaacacgcacaaacaccgagcacacacagtggctcaatcaactacaccaaatagaagcataggttcgccctgtgttcaacgttctaagatgtcaaataaggagaaaggtgtaaatgttcaggttctgcttcgttgcaggccgtttagtaacgatgagttgcggaataatgctccgcaagtggtgacttgcaatgattatcagagagaggtcgccgtttctcagaacattgctggaaaacacatcgataggatttttactttcgataaggtttttggtccctcagcacaacaaagggacctttatgatcaagcaattgtcccgattgtcaatgaagttttagagggatttaactgtacaatttttgcttatgggcaaactggtactgggaagacatacactatggaaggtgaatgcaagaggtccaagagcggacctaatggggagctgccacaagaagcaggtgtcatacctagagcagtgaagcaaatatttgatacattggagagtcaaaatgctgaatacagtgtgaaagttacattcttagagttgtataatgaagaaatcactgacttgttagcccctgaggatttaaaagttgctttagaagacaggcagaaaaaacagttgccacttatggaagatgggaaaggcggagttctagttagagggcttgaagaggaaattgtgacaagtgccaatgagatattcaccttacttgaaaggggatcagcaaaacgtcgaactgcagaaaccttgctcaataagcaatcaagtcggtcacattctcttttctccataaccatacacatcaaggaagcaacccctgaaggcgaagaacttataaaatgtggaaagttaaatttagttgatttggctggttcggagaacatttctcgctctggggctagggagggccgtgcaagggaagctggagaaataaacaaaagtctactcacacttggacgagtgattaatgcccttgttgagcatcttgggcacatcccgtacagagatagcaaacttacgcgtttgctgcgggattcattaggcggaagaacaaaaacctgtataattgccacagtgtcacctgctgtgcactgtcttgaggagactctgagtacactagactatgcacacagagcaaaaaacataaagaataagcctgaggtcaatcaaaaaatgatgaaatcaaccctcatcaaggatttatatggtgaaattgagcggcttaaaacagaggtgtatgctgctcgtgaaaagaatggtgtttatataccaaaagagcgatattatcaggaggagaatgagagaaaggcaatggctgatcaaattgaacaaatgggagttagcatagaaaaccatcagaagcaattcgaggagttacaaagtagacatgacagtcaggttcagcagtgctcagatttgacttgtaagcttgatgcaacacagaaacaattgaaccaaacaagcaaattgctagcatacactgaagaacaattaagacaatcccaatataatttgaaggagcgggatttcatcatctctgaacaaaaaaaagctgaaaatgcgctggctcaccaagcatgtgtattacgggccgacttggagaaatcaattcaagagaatgcttccttatttcaaaaaattgctagagaggataaactcagtactgataataggtctctggtaaacaacttccaagcggagcttgcgaagcaacttggttctctttccagcacattagcaacttcagtgtgtcgacaaacggaacacctccattgcgttgagaaattctgtcataattttcttgaatcacatgacaaggctgtcctaaacttgaagaggaaaattaattcttcgaaggccttgtacatatctcactttgaggctatgcaaaatgtagtgaggctgtataaagctacctctaatgctactctggaggaaatttcaactttggcatcttctaattcaatttccaccaaagaatttttagacgcagagactgtggaagcaaattccatgtttgatgaacttcagagcactttgtcaacccaccaaggagagatggcacattttgctagagagctccgtcagagatttaatgacagtacggagcatttgacaaatatctctgtagtcattcaaggattttttgacaagcttttggacgaatcaaaaagacttgaaaaacatgcaacaacagttgatgagattcaaacgaaatctattgctgaatttgagaaggcatacgaggagcaatcaagatcagatgcagagaagcttattgctgatgtgacttccttggtctccaatcacatgcgtcgtcaaaaagaactggtgggtgcaaggctagttgatcttagagaaactgtttctggaaataggacattcttggatgggcatgtatcctctatggaaggtattacaacagatgcaaaaagaaaatggcaggacttctatatgcaagcagaaggcgagaccaaagaaaatgctgatttctcagctgctaaacactgccgaatggaatcactcatgcagaagtgtgtaagcactgctgaaacagctctgaaacggtggcaaagtacacatgaattggttaacgacatgggcaatcaacacgtctcgacaatgcattcggttgtcaggaacatatgcgataacaatgagcaacatgtaactgattttgactccacaagggaatctgctgaagaagatgtgaaaaggaatagcgaagatatcattatatctattgacagtttgtcaggcgaagagagaggaactatatctggcgttttggatactaccagtgcacactcagagacccttgatgtacttaagaaagatcactgcatgcagtctacctccattgaacagatagcccttgaaacttttcagcagaagtatatggattatgagccaactggaacaacaccaattaggtctgagccagatgtaccaagcaaggttaaaattgagtcgttgcgtgccatgccaatggaggctctattagaggaattccgagagaacaattcattcgagtcattccaagtaaaggaactaaagccatcacttatcccacgatctcctttctcacagattaacaattagcagattggtcttttttgttccctcgtgcatatgatcatttataatccgtgcctgtattttgttttgtatactggtcctgcccacaaatacaagtaaattactgcaaccgcagtatatgttgtaggttgattcagtctgaaaaataaaccccaccttgggattttggaagtggctgaaaatgaggaaaatttggtgcatggttcctgacattttaggttaaggaaagatactcctctatgtattgtaaaagtgagattacttgaaagagttgcagttacatgttcaatagctctataatgacattcaacggtgaatactagtagataatgtttctattt

SEQ ID NO: 6266 - DNA, 3684 bp, Nicotiana tabacum
ctcccccccacccccacctccgcacacacactctctctcacacacacaaacacacagaaaaaacgcacaaacacccaaaacacacagtgtctcaatcaaaactcccaaagtgaaggcacaagctcccagaaaaacacgcacaaacaccgagcacacacagtggctcaatcaagtacaccaaatagaagcataggttcaccctgtgttcaacgttttaagatgtcaaataaggagaaaggtgtaaatgttcaggttctgcttcgttgcaggccgtttagtaacgatgagttgcggaataatgctccgcaagtggtgacttgcaatgattatcagagagaggtcgccgtttctcagaacattgctggaaaacacatcgataggatttttactttcgataaggtttttggtccctcagcacagcaaagggacctttatgatcaagcaattgtcccaattgtcaatgaagttttagagggatttaactgtacaatttttgcttatgggcaaactggtacagggaagacatacactatggaaggtgaatgcaagaggtccaagagcggacctaatggagagctgccacaagaagcaggtgtcatacctagagcagtgaagcaagtatttgatacattggagagtcaaaatgcagaatacagtgtgaaagttacattcttagagttgtataatgaagaaatcactgacttgttagcccctgaggatttgaaagttgctttagaagacaggcagaagaaacaattgccacttatggaagatgggaaaggtggagttctagttagagggcttgaagaggaaattgtgacaagtgccaatgagatattcaccttacttgaaaggggatcagcaaaacgtcgaactgcagaaaccttgctcaataagcaatcaagtcggtcacattctcttttctccataaccatacacatcaaggaagcaacccctgaaggcgaagaacttataaaatgtggcaagttaaatttagttgatttggctggttcggagaacatttctcgctctggagctagggagggtcgtgcaagggaagctggagaaataaacaaaagtctactcacacttggacgagtgattaatgcccttgttgagcatcttgggcacatcccgtacagagatagcaaacttacgcgtttgctgcgggattcattaggcggaagaacaaaaacctgtataattgccacagtgtcacctgctgtgcactgtcttgaggagactctgagtacactagactatgcacacagagcaaaaaacataaagaataagcctgaggtcaatcaaaaaatgatgaaatcaaccctcatcaaggatttgtatggtgaaattgagcggcttaaagcagaggtgtatgctgctcgtgagaaaaatggtgtttatataccaaaagagcgatattatcaggaggagaatgagagaaaggctatggcggatcaaattgaacaaatgggagttagcatagaaaaccatcagaagcaattcgaggagttacaaagtagacatgacagtcaggttcagcagtgctcagatttgacttgtaagcttgatgtaacacagaaacaattgaaccaaacaagcaaattgctagcatacactgaagaacaattaagacaatcccaatatactctgaaggagcgggatttcatcatctctgaacaaaaaaaagctgaaaatgcgctggctcaccaagcatgtgttttacgggccgacttggagaaatcaattcaagagaatgcttccttatttcaaaaaattgctagagaggataaactcagtactgataataggtctctggtaaacaacttccaagctgagcttgcgaagcaacttggttctctttccagcacattggcaacttcagtgtgtcgacaaactgaacacctccaatgcgttgagaaattctgtcataattttcttgattcacatgacaaggctgtcctagacttgaagaggaaaattaattcttcaatggccttgtacatatctcactttgaggctatgcaaaatgtagtgaggctgcataaagctacctctaatgctactctggaggaagtttcaactttggcatcttctaattcaatttccaccaaagaatttttagacgcagaggctgtggaagcaaattccatgtttgatgaacttcagagcactttgtcaacccaccaaggagagatggcacattttgctagagagctccgtcagagatttaatgacagtacagagcatttgacaaatatctctgcaatcattcaaagattttttgacaagcttttggacgaatcaaaaagacttgaaaagcatgcaacaacagttgatgagattcaaacgaattctattgctgaatttgagaaggcatacgaggagcaatcaaaatcagatgcagagaagcttattgctgatgtgacttccttggtctccaatcacatgcgtcgtcaaaaagaactggtgggtgcaaggcttgttgatcttagagaaactgtttctggaaataggacattcttggatgggcatgtatcctctatggaaggtattacaacagatgcaaaaagaaaatggcaggacttctatatgcaagcagaaggcgagaccaaagaaaatgctgatttctcagctgctaaacactgccgaatggaatcactcatgcagaagtgtgtaagcactgctgaaacagctctgaaacggtggcaaagtacacatgaattggttaacgacatgggcaatcaacacgtcttgacaatgcattcggttgtcaggaacatatgcgataacaatgagcaacatgtaactgattttgactccacaagggaatctgctgaagaagatgtgaaaaggaatagcgaagatatcattaaatctattgacagcttgtcaggcgaagagagaggatctatatctggcgttttggatactaccagtgcacactcagagacccttgatgtacttaagaaagatcactgcatgcagtctacctccattgaacagatagcccttgaaacttttcagcagaagtatatggattatgagccaactggagcaacaccaattaggtctgagccagatgtaccaagcaaggttacaattgagtcgttgcgtgccatgccaatggaggttctactagaggaattccgagagaacaattcattcgagtcatttcaagtaaaggaagtaaagccatcacttatcccacgatcacctttctcacagattaacaattagcagattggtcttttttgttccctcgtgcatatgatcatttataatgtgtacctgtattttcttttctatactggtcctgcctacaaatacgagtaaattactgcaactgcagtatatgttataggttaattcagtctgaaaaataaatcccatcttgggatttagaaagtggctgtaaatgaggaaagcttggtgcgtggttcctgagagtttaggtcaaggaaagatactcttctatgtattgtaaaagtgctatttcttgaagagttgcagtttcatcgtgcaatagatctataatgacattcgacggtcaatgctagatagtaatatttatattttggtaacttgcatataggtgccaattgatttgtttgaatttttttacagatgtactagtctctgtattaaggttgggcatcaatctaaacatatgtgctatgccca

SEQ ID NO: 6267 - DNA, 3022 bp, Nicotiana benthamiana
atgtcaaataaggagaaaggcgtaaatgttcaggttctgcttcgttgcaggccgtttagtaacgatgagttgcggaataatgctccgcaagtggtgacttgcaatgattatcagagagaggttgctgtttctcagaacattgccggaaaacacatcgataggatttttactttcgataaggtttttggcccctcagcacagcaaagggacctttatgatcaagcaattgtcccaattgtcaatgaagttttagagggatttaactgtactatttttgcttatgggcaaactggtacagggaagacatacactatggaaggtgaatgcaagaggtccaagagcggacctaatggagagctgcccccagaagcaggtgtcatacctagagcagtgaagcaaatatttgatacattggagagtcaaaatgcagaatacagtgtgaaagttacattcttagagttgtataatgaagaaatcactgacttgttagcccctgaggatttgaaagttgctttagaagataggcagaagaaacagttgccacttatggaagatgggaaaggcggagttctagttagagggcttgaagaggaaattgtgacaagtgccaatgagatattcaccttacttgaaaggggatcagcaaaacgtcgaactgcagaaaccttgctcaataagcaatcaagtcggtcccattctcttttctccataacgatacacatcaaggaagcaacccctgaaggcgaagaacttataaaatgtggcaagttaaatttagttgatttggctggttcagagaacatttctcgctctggggccagggagggtcgtgcaagggaagctggagaaataaacaaaagtctactcacacttggacgagtgattaatgcccttgttgagcatcttgggcatatcccatacagagatagcaaacttacgcgtttgctgcgggattcattaggcggaagaacaaaaacctgtataattgccacagtgtcacctgctgtgcactgtcttgaggagactctgagtacactagactatgcacacagagcaaaaaacataaagaataagcctgaggtcaatcaaaaaatgatgaaatcaaccctcatcaaggatttgtatggtgaaattgagcggcttaaagcagaggtgtatgctgctcgtgagaagaatggtgtttatatgccaaaagagcgatattatcaggaggagaatgaaagaaaggcaatggcggatcaaattgaacaactgggagttagcatagaaaaccatcagaagcaacttgaggagttacaaagtagacatgacagtcaggttcagcagtgctcagatttgacttgtaagcttgatgcgacacagaaacaattgaaccaaacaagcaaattgctagcatacactgaagaacaattaagacaatcccaatatactttgaaggagcgggatttcatcatctccgaacaaaaaaaagctgaaaatgcgctggctcaccaagcatgtgttttaagggccgacttggagaaatctattcaagagaatgcttccttatttcaaaaaattgctagagaggataaactcagcactgataataggtctctggtaaacaacttccaatctgagcttgcgaagcaacttggttctctttccagcacattggcaacttctgtgtgtcgacaaactgaacacctccaatgcgttgagaagttctgtcatacttttcttgaatcacatgacacggctgtcctagacttgaagaggaaaattaattcttcaaaggccttgtgcatatctcactttgaggctatgcaaaatgtagtgaggctgcataaagctacctctaatgctactctggaggaaatttcaactttggcatctactaattcaattttcaccaaagaatttttagacgcagaggctgtggaagcaaattccatgtttgatgaacttcagagaactttgtcaacccaccaaggagagatggcacattttgctagagagctccgtcagagatttaatgacagtacagtgcatttgacaaatatctctgaaatcattcaaggattttttgacaagcttttggatgaatcaaaaagacttgaaaaacatgcaacaacagttgatgagattcaaacgaaatctattgctgaattccagaaggcatatgaggagcaatcaagatcagattcagagaagcttattgctgatatgacttccttggtctccaatcacatgcatcgtcaaaaagaactggtgggtgcaaggctagttgatcttagagaaactgtttctggaaataggacattcttggatgggcatgtatcctctatggaaggtattacggcagatgcaaaaagaaaatggcaggacttctatatgcaagcagaaggcgagaccaaagacaatgctgatttctcagctgctaaacactgtcgaatggaatcactcatgcagaatgtaagcactgctgaaacagctctgaactggtggcaaagtacacatgaatcggttagcaacatggacaatgaacatgtttcaataatgaattcggttgtcaggaacatatgcgataacaatgatcaacatgtaactgattttgacgccacaagggaatctgctgaagaagatgtgaaaaggaatagcgaagatatcattaaatctattgacagcttgtcagccgaagagaaaggatctatatctggtgttttggataccaccagtgcacactcggagacccttgatgtacttgagaatgatcactgcatgcagtctagctccattgaacataagtcccttgaaacttttcagcagaagtatatggattatgagccaactggaacaacaccaattaggtctgagccagatgtaccaagcaaggttacgattgagtcgttgcgtgccatgccaatggaggctctattagaggaattccgagagaacaattcattcgagtcattccaagtaaaggaactaaagccatcacttatcccacgatctcctttctcacagattaacaattagcaga

SEQ ID NO: 6268 - DNA, 3385 bp, Solanum lycopersicum
tttctctctctctaactttctctctctaaaaatcgacttcttcgaaaatgtcgaatcgccatgagaaggagaaaagtgtaaacgttcaagttctgcttcgttgcaggccttttagtgaggatgaagtccggaataatgctccgcaagtggtgacttgcaatgagtaccaaaaagaggtagctgtttcacagaacattgctgggaagcacatagatagggtttttacatttgataaggtttttggcccatctgctcagcaaagggatctttatgatcaggcaattatccccattgtgaatgaagttttagagggatttaactgtactatttttgcttatggtcaaactggtacaggtaaaacatacaccatggaaggtgaatgtaagaggtctaagagtgggcataacagtgagcttcctccaggagcaggagttatacctcgagcagtcaagcaaatttttgatatgctggagagtcaaaatgcagaatatagtgtgaaagttactttcttagagttgtacaatgaagagatcactgacttgttagcccctgatgatttatcaaaagtttctgtagaagataggcaaaagaaacaattgccacttatggaagatggaaaaggtggagtattagtgagaggacttgaagaagaaattgttacaagtgctagtgagatattcgctttgcttgaaaggggatcagcaaaacgtcggactgcagaaaccttgctgaataagcaatcaagtcgttcacattcccttttctccataacaatacacatcaaggaagcaaacactgaaggcgaagaactcataaaatgtggcaagctaaatttagtcgatttggctggttcagaaaatatttcacgttctggggctagggaggggcgtgcaagggaagctggagaaataaacaaaagtctacttacactagggagagtaattagtgctcttgttgagcatcttgggcatgtcccttacagggatagcaagctcacacgtttgctccgtgattcattgggaggaagaacaaaaacatgtattattgccacagtgtcacctgctgttcactgtctggaggagaccttgagtacgctggattatgcccacagggcaaagaatattaagaataagcctgaggtgaatcaaaaaatgatgaaatccaccctcatcaaggatctgtatggtgaaattgacaggcttaaagcagaggtgtatgctacacgtgaaaagaatggtgtgtacataccaaaagatcgatattatcaggaggagaatgagagaaaggctatgacagatcaaattgaacaaatgggagtgaccttagaaaaccagctgaagcaacttgaggagttgcaaagtagatatgatcaccaggttcatctgtgctcagatttgacatgtaaacttgatgctacacagaaacacctgaaccaaactacaaccttgttgtctaatgctgaggaagaattaagacaaagcaagtacaccctcaaggagcgggattttatcatctgtgaacagaaaaaagctgaaaatgcccttgctcagcaagcatgtagtttacgggctcagttggagaaatcacttatagacaacgcttcactatttctgaaaattgacagagaagacaagctgagtgctgataataggtcggtggtcaacaactttcaaacagaccttgcaaagcaacttggtttcctttccaactcagtggcaacatcagtgtgtcgacaaaatgaacacctccagtgtgttgagaaattctgtcacggctttcttgaatctcatgataaggctgttgtagatttgaagaggaaaactagagcttcaagggctttgtatgtatctcatttagaggccatgcaaaatgtggtaaaactgcataaagctagttcttctgctgctctggaggagatttctgctttggcttcttctaattcaatttccattaaagaatttttagatgcagaagatgtggaagcaaattcactatttgaagaactccagagcactctctcaactcaccaaggagaaatggcactttttgctggcgaacttcgtcagaaatttcacgatagtacagagcatttggcaaatatctccgagatcattcaaggatattttgataagcttgtggaagaatcaaaaaaacttgaaagacatgccctgacagttgatgagatccagacgaagtgtattgctgaatttgaggctgcgtatgaggaacaagcaagagcagaagcacagaagcttattgctgatatgactaccatggtctccaatcacctgcatcgacaaaaagagctggtgggtacacgcttagttgatcttagaggaactgttactggaaataagactttcttggatggacatgtatcctctatggagggtattacaacagttgcaaaaaggaaatggcaggattattctacgcaagcaggcagtagcatggaagaaaatgctgatttctcagctgctaaacattgtcggatggaattacttatgcagaagtgtgtaagcactactgaaacagctcataagctgtggcgaagtacaaatgaatcagttaatgacatgggtagtcaacatgtcttgacaatgcattcagttgtcaggaatatgtgtgacagtaatgagcaacatgtaactgaatttgactctacaaaggatgctgctgaagaagttgtaacaaggaatagtgaagatgccgttcaatcttttgacagcttgtcggagaaagaaagagcatctatatctggcattttggaaactgccaacactcattcagaaaccattggagtacttgagcacaatcacgctagtcagtgtacttccatagaacagaaggcccttgaaacttttcagcagagatatatggattatgaaccaactggatcaacaccagtcaggtctgagccagatgttccaagcaaggggactattgaatctttgcgcacgatgccaatggaatcccttctagaggaatttcgggagaataactccttcgaatcatttcaagtaaaggaagtaaagcaatcactagtcccacgacctcctctatcgcaaattaaccattagcagattgattactttcttgtgtgtcatcctctgctctgtatcactaatttttgtgtgtatgagaaatgtctaatactgtaacattaacatgttgctagctaattctgtcaaaaagataaatcccgccttgggatttagaaatggttgtaaatgaggaaaaacttgatcattggtttccagaatttgatttagtgactgagaggaataactttatttattgtgacaatggctctttgctactcagtaagagtgacaattccattttgtaacacttatgtaatactaagtcaatagatatgttgtaa

SEQ ID NO: 6269 - DNA, 3073 bp, Solanum phureja
actcgattgctaattagtttaagtccaaaaaaatggattaattttgttgatttgatgtattataggccgtttagtgaggatgaagtgcggaataatgctccgcaagtggtgacttgcaatgagtaccaaaaagaggtagctgtgtcacagaatattgctgggaagcacatagatagggtttttacatttgataaggtttttggcccatctgctcagcaaagggatctttatgatcaggcaattatcccaattgtgaatgaagttttagagggatttaactgtactatttttgcttatggtcaaactggtacaggtaaaacatacaccatggaaggtgaatgtaagaggtctaagagtgggcataacagtgaacttcctccaggagcaggagttatacctcgagcagtcaagcaaatttttgatatgctggagagtcaaaatgcagaatatagtgtgaaagtaactttcttggagttgtacaatgaagagatcactgacttgttagcccctgatgatttatcaaaagtttctgtagaagataggcaaaagaaacaattgccacttatggaagatggaaaaggtggagtattagtgagaggacttgaagaagaaattgttacaagtgctagtgagatattcgccttgcttgaaaggggatcagcaaaacgtcggactgcagaaaccttgctgaataagcaatcaagtcgttcacattctcttttctccataacaatacacatcaaggaagcaaacactgaaggcgaagaactcataaaatgtggcaagcttaatttagtagatttggctggttcagaaaatatttcacgttctggggctagggaggggcgtgcaagggaagctggagaaataaacaaaagtctacttacactagggagagtaattagtgctcttgttgagcatcttgggcatgtcccttacagggatagcaaactcacacgtttgctccgtgattcattgggaggaagaacaaaaacatgtattattgccacagtgtcacctgctgttcactgtctggaggagaccttgagtacgctggattatgcccacagggcaaagaatattaagaataagcctgaggtgaatcaaaaaatgatgaaatccaccctcatcaaggatctgtatggtgaaattgacaggcttaaagcaggcgagtacttttttgttctagccaattgtgaggtgtatgctacacgtgaaaagaatggtgtgtacataccaaaagatcgatattatcaggaggagaatgagagaaaggctatgacagatcaaattgaacaaatgggagtgaccttagaaaaccagctgaagcaacttgaggagttgcaaagtagatatgatcaccaggttcatcagtgctcagatttgacatgtaaacttgatgctacacagaaacacttgaaccaaactaccttcttcttgtctaatgctgaggaagaattaagacaaagcaagtacaccctcaaggagcgggattttatcatctgcgaacagaaaaaagctgaaaatgcccttgctcagcaagcatgtagtttacgggctcagttggagaaatcacttaaagacaacacttcactatttctgaaaattgacagagaagacaagctgagtgccgataataggtcggtggtgaacaactttcaaactgaccttgcaaaacaacttggtttcctttccaactcggtggcaacatcagtgtgtcgacaaaatgaacacctccagtgtgttgagaaattctgtcacgactttcttgaatctcatgataaggctgttgtagatttgaagaggaaaactagagcttcaagggccctgtatgtatctcatttagaggccatgcaaaatgtggtaaaactgcataaagctagttctactgctgctctggaggagatttctgctttggcttcttctaattcaatttccattaaagaattttttgatgcggaagatgtggaagcaaattccctatttgaagaactccagagcactctctcaactcaccaaggagaaatggcactttttgctggcgaacttcgtcagaaatttcacgatagtacagagcatttggcaaatatctccgagatcattcaaggattttttgataagcttgtggaagaatcaaaaaaacttgaaagacatgcgtcgacagttgatgagatccagacgaagtgtattgctgaatttgaggcggcatatgaggaacaatcaagagcagaagcagagaagcttattgctgatatgactaccatggtctccaatcacctgcatcgacaaaaagagctggtgggtacacgcttagttgatcttagagaaactgttactggaaataagacattcttggatggacatgtatcctctatggagggtattacaacagttgcaaaaagaaaatggcaggattattctacgcaagcaggcagtagcacgaaagaaaatgctgatttctcagctgctaaacattgtcggatggaattacttatgcagaagtgtgtaagcactactgaaacagctcataagcagtggcaaagtacaaatgaatcagttaatgacatgggtagtcaacatgtcttgacaatgcattcagttgtcaggaatatgtgtgacagtaatgagcaacatgtaactgaatttgactctacaaaggatgctgctgacgaagtcgtaacaaggaatagtgaagatgccgttcaatcttttgacagcttgtcggagaaagagagagcatctatatctggcattttggatactgccaacactcattcagaaaccattggagtacttgagcacgatcacgctagtcagtgtacttctatagaacagaaggcccttgaaacttttcagcagagatatatggattatgagccaactggatcaacaccagtcaggtctgagccagatgttccaagcaaggggactattgaatctttgcgcaccatgccagtggaatcccttctagaggagtttcgggagaataacactttcgagtcatttcaagtaaaggaagtaaagccatcactagtcccacgatctcctctatcgcaaattaaccattagcaga

SEQ ID NO: 6270 - DNA, 994 bp, Solanum phureja
gaagcaaatcgccattgaaacgccagaatgggaagacttggagtgaaaactgactatgaagaactccgaaacgctcaaattttggaaaacaaggcgcgattggccagtcttggacttcaaaaaactgtggcagagcttcgatctatcagatctaaaccacaatctgagaagagaaaatacaacaaagttgactacttctcaacccctttgcgccgatctagtcgattgaaaggcaactcttccgaattgaattcatgcggcactgcgccgctagcgaaaagtctgtatttatggaaattggggctttttgatgaagaagatgatgaggatgatattgagaagagaccagctaatgcacctctgttgagagtgaaatatggcttaatgcttcgtcttactccggaagctttgactcggcgttgcacaagcaaggataggggaacgttatatgacccttatttgggtatttgctgtcacttttgcaggcaaaagaaattatgtggtgaagaagactgtaagcgatgtggtgattcagacatggatcaaccttgcttaggcaagacagattgttcaatttgtcattctagccaaggtgttctttgccgaggttgtcttaaggttcgatatggtgaagaaatggaggatgtgagagcaaataaagaatggatatgtcctcattgtactgaagaaaaaggtatcaatccatattggatatgtaatagctcattgtgcctaaagaaacgaaagatggctccaactgggatcgccatattcaaagctagagagatgggatacaaatcagtggcacatctgttaatggatcaacttcagggagcagtgaagggttaattataaactaattttagtgcattgttaacttcttgttggtgcagtagaattagcttcagaatgtaaaaatgaatgttatgaagaccaatcactggttgtgtaatgcaaggatcctcattatgaaagttataacaccctttcattt

SEQ ID NO: 6271 - DNA, 1075 bp, Phaseolus vulgaris
aattttcaaacagaagtaccgcaccactctctgcttgcgttttcatccctcttttcagtctttgaagcggtatgggggagcattgagaaaccgtggaaactcaaaacgacctaagaagacaccaacacaatcctgcactccataggcagttaagaggagttattatagggttcagggaaacatgttgaaacaagcaattggcagaatttgcagaaccagtgcttatgcttttgaaggaaacagagtttttccttgtattcatgtgccttcgtgctttttccacaatggacagacgcacatggcacctagaagcttttttggggttgaggatttccttgatgatgacaatagcagaccttacacataccaaaaagggaagaagtcaaagaatccacacaagcacatatctttcaaacaaagaacgattgcctacatggaaccgtttacccttgatgtgtttatctcaaaacgctttgtatcagcttcactcactcacagaatgacaagcaaacaggttgcagttgctggtaccaactccaaggacataaaagctgttctcaggtctcgttcagacataccagcatgcatatccgtaggtaagattttatctgaaagagcaagagaagctgatgtttacactgcttcctatactccaagggaaagggacaagtttgaagggaaaatcagagctgtagttcaatcacttattgataatgggattgatgtcaaggtttatctggactgagttgaatcactcaagattttgtggctatcagtttgatatcaattggtgattactggtttggtcttgtggctagttaagatttatcagttaccatatactccttcaatggataggaagatagacaaatatgttttcatgttgctatatttttgggctagtaatttgggaaaattataactaagaaatatctttcaaatccatgcatgcaattggataactcctggttccactgtcactgccttggaggctaaagggtttgtatgctgcacaacatttgtcatattttatttctctctttgcacttgttcagctgtgaactaaattgggtcc

SEQ ID NO: 6272 - DNA, 1729 bp, Cajanus cajan
agagagagagagagagagggagagagaaagagatgatgaacatctgaagaaatgaaaaatagatgaaaaaaacaaagaaaaagaaagaaatggaaggaagaagaaaaaacaaatagaaaataaaaaagaactcttgcaggtcgttggatttgttggccggaaaactttctggagctcaggctgctatggttcacgtctccgagaggctgttggcctaagaaggctcaccgtagttgtttgttcacaatttaggagcttcacaagagaaaagatgagaaaagaaaaagaggatgaggagtatttccaccatgagcaccatgaagccatggccatggcagacgccgctatataacgggaaataacggatagcgaatgttggaggggttagaaaacgccatgttatacctttatggtggcgccataatagttatttgataacattgacagtgttctaccgtcatttctggcaaactcactgctcctcacatcattgcagtcaaaattgcgattttcctcaactcatataattacgcaattcccaagtttttatcttagcaatcctgacctccccaaaacactcattgtagtgtgcttgcatgatcttttgtgttgaattagtggtattggatgattcctatggggctcttcaaccatgagatgtaatgtatatttgacatatttgtcagtgcttatttagatttctagttggtgattgtcaaattctgaattagtgagtatatatttggcagctatgaattagctgaatttgaacttattgatgtgccattagaagatgaatgatgatatattatgcatattatggttatggttattatttggctcctaattttaaattaatcttcttacagataaagggagcaatttgtttccatttcccagtcaatcctatactccttaggctgcagtaagcttctgctaataaggaggagttattattgggttttgagaaacatgttgaaacaagcaattagcagaatttgcagaaccagtttttatgcttgggaaggaaacacagttttgccatgcatttatgtgccttcatgttttttacacaatggacaagcgcatatggcacctagaagcttttttggggtagaggatttccttgatgatgacaatagccgaccttacacatatcaaaaagggaagaagtcaaagaatccaaataagcatgtatcattcaaacaaagaacaattgcttacatggagccttttacacttgatgtttttatctcaaaacgttttgtatcagcttcactcactcatagggtgacaagcaaacaggttgcagttgctggaaccaactcaaaggacataaaagctgttcttaggtctcgttcagacataccagcatgcatagccattggtaggattttatctgaaagagcaagagaagctgatgtttacactgcttcttatactccaagggatagggacaagtttgaagggaaaatcagagctgttgttcaatcacttattgataatgggattgatgtcaaggtttatcttgattgatcatgtttatttagctttggttgataattgaaacatcgttatttgaattacatatttggtaattgaattagatgaatctgtgttatattgtggtaattgtagttaactagtttctcaccccgtgcactctacggatcactaacattgggaataaatttgttgtttaacttttatacatggaagttactaaaaa

SEQ ID NO: 6273 - DNA, 1239 bp, Glycine max
aaagattccaattattattaaagatgctcttaatatccaaaacaaatcaatgatccattcaagtctaatactattaaatggcactcatcaatcatcacttgcacaagaatattacactttgagtgccattattgggtcctgggttcgagacaagacacccacattccctaaacccttccaaatccaattcaacaacaaaaatacgcaacagtcaccggttctcttcacctaatctgaatcacactctcttcgttgcttcagttcatctcctcatatctacaactctccctcattctctggttcttttctcactccaaactgaactgcaaaattttggttttgttcactcaatacagggtgcgatttgcttccattttccagtcattcccatactccttaggctattgtatgcttctactaataaggaggagttgttattgggttctgagaaacatgttgaaacaagtaattggcagaatctgtagaaccgatgtttatgcttgtgaaggaaacagagttttgccttggatttatgtgccttcatgctttttccaccatggacaagcgcacatggcacctagaagcttttttggggtagaggatttccttgacgatgacaatagccgaccttacacataccaaaaagggaagaagtcaaagaatcccaataagcacatatcattcaaacaaagaacaattgcctacatggagccttttacacttgatgtgtttatctcgaaacgttttgtatcagcttcactcactcatagggtaacaagcaaacaggttgcagttgccgggaccaactccaaggacataaaagctgttcttaggtctcgttccgacataccggcatgcatagccattggtaggattttagctgaaagagcaaaagaagctgatgtttacactggttcttatactccaagggatagggacaagtttgaagggaaaatcagagctgtagttcaatcacttattgataatgggattgatatcaaggtttatcttgattgagttgagtcactcaagtttttgggactatcagtttagctgttgatatttcggttcgccttgtgtgtttgaacatgtccatttagtttggtttttatgataatgggaaaatatcattattagaattacagatttcgtaatttacttttatgaatgagttatgttgtcgtaattgtagttagttattcgttttaattaatgttaaataataatcgtgttacaaat

SEQ ID NO: 6274 - DNA, 1154 bp, Glycine max
atccttcatcacattaatcagtccagacagagaactgagagaagaccctcacttcctgtttggctcgacgaagacctcacttcgcccaacctccgtctccggcggcgtctcttatcctaacggctccttccctcaccgtcactgaaacggcgtccctgaactcgcaacactgccctccctctgactctgatttcgttcgaacttcgaactcattcccacttcgcagtcctcgccatgcttcgttgtcggcgactcctcgcagtggcaaacctcaaacgacatagctagagatacagggtgcgatttgtttccattttccagtcaatcctatactccttaggctattgtaatcttctgctaataaggaggaattattattgggttctgaaaacatgttgaaacaagcaattggcagaatcttcagaaccggtgtttatgcttgtgaaggaaatagagttttgccttggatttatgtgccttcgagctttttccaccatggacaagcgcacatggcacctagaagcttttttggggtagaggatttccttgatgatgacaatagccgaccttacacataccaaaaagggaagaagtcaaagaatccaaataagcacatatcattcaaacaaagaacaattgcctacatggaaccttttacacttgatgtgtttatctcaaagcgctttgtatcggcttcactcactcatagggtaacaagcaaacaggttgcagttgccgggaccaactccaaggacataaaagctgttcttaggtctcgttcagacataccagcatgcatagcaattggtaggattttagctgaaagagcaaaagaagctgatgtttacactggttcttatactccaagggacagggacaagtttgaagggaaaatcagagctgtagttcaatcacttattgataatgggattgatatcaaggtttatcttgattgagtttagtcactcaagtttgtgggactatcagttaaggtgttgatattttggttgaagcagtaggccccttgtgtgtttgaacatgtccatttagtttggttttgatgataatgggaatatcattattcgaattacagatttggtaatttagttttatgaatgagttatgttgtcgtaattgtagttggttattcgttt

SEQ ID NO: 6275 - DNA, 916 bp, Medicago truncatula
aatatacttcccatcatcccaagctcgattggaaaaactgaactcgccgggaaacactgccggcgttactcgtcagccgcctcaaacagaatcacgtcgccgggctgaaggaattgatttcttcttttaatttctatctgagaaacatgttgaagcaagcaattggcagaatttgcagaaccaatgcgtatgcttgtgaaggaaacaaagttttgccatggagttatgtgtcttcatgttgtttccacaatggacaagcacatatggcacctagaagctttttcggagtagaggattttgttgatgatgacaacagccgaccttatacataccaaaaagggaagaaatccaagaatccaaacaagcatatatcattcaaacaaagaacagttgcctacatggagccttttacacttgacgtatttatctcaaaacggttcgtatcagcttctctaactcatagagtgacaagcaaacaggttgccgttgcaggtaccaactccaaggacattaaagctgttcttagatctcggtcagacataccagcatgcatagccattggtaggattttagcggaacgagcgatggaagctgatgtttacactgcttcttatactccaagggatcgggataagtttgaagggaaaatcagagctgtagttcaatcacttattgataatggaattgatctcaaggtttatcttgattgagtcacacaatcttttaaataaaacactaccagcccatttgtgtgttttattatgtccatgtagcttgataattagtaattggtatcaatattagtattgtgaactataaactatggcataatgaatgttattttatttttatatatagcccatgataaccatcttctagcgttccgatttctgattcatattgtagaactaccaag

SEQ ID NO: 6276 - DNA, 1256 bp, Glycine max
aaaggcattgttttggcctttggttaaagaatccttcatcacattaatcagtccagacagagaactgagagaagaccctcacttcctgtttggctcgacgaagacctcacttcgcccaacctccgtctccggcggcgtctcttatcctaacggctccttccctcaccgtcactgaaacggcgtccctgaactcgcaacactgccctccctctgactctgatttcgttcgaacttcgaactcattcccacttcgcagtcctcgccatgcttcgttgtcggcgactcctcgcagtggcaaacctcaaacgacatagctagagatacagggtgcgatttgtttccattttccagtcaatcctatactccttaggctattgtaatcttctgctaataaggaggaattattattgggttctgaaaacatgttgaaacaagcaattggcagaatcttcagaaccggtgtttatgcttgtgaaggaaatagagttttgccttggatttatgtgccttcgagctttttccaccatggacaagcgcacatggcacctagaagcttttttggggtagaggatttccttgatgatgacaatagccgaccttacacataccaaaaagggaagaagtcaaagaatccaaataagcacatatcattcaaacaaagaacaattgcctacatggaaccttttacacttgatgtgtttatctcaaagcgctttgtatcggcttcactcactcatagggtaacaagcaaacaggttgcagttgccgggaccaactccaaggacataaaagctgttcttaggtctcgttcagacataccagcatgcatagcaattggtaggattttagctgaaagagcaaaagaagctgatgtttacactggttcttatactccaagggacagggacaagtttgaagggaaaatcagagctgtagttcaatcacttattgataatgggattgatatcaaggtttatcttgattgagtttagtcactcaagtttgtgggactatcagttaaggtgttgatattttggttgaagcagtaggccccttgtgtgtttgaacatgtccatttagtttggttttgatgataatgggaatatcattattcgaattacagatttggtaatttagttttatgaatgagttatgttgtcgtaattgtagttggttattcgttttaattaatgttaaataacctgtcacaaataatacaatcatatgatattgtatatattttatactaatgagca

SEQ ID NO: 6277 - DNA, 833 bp, Vicia sativa
tggactgaattagggttttgttaatcaggaggatttgttattgagtgtctgtctatctgtgaaacatgttgaagcaagcaattggtagaatttgcagcagaaccaatgtttattcttgtgaaggaaacagagttttgccttggatttatgtgccttcctgttttttccacaatggacaggcaaatatggcacctagaagcttttttggggtagaggattttgtcgatgatgacaacagtcgaccttatacataccaaaaagggaagaagtcaaaaaatccaaacaagcatatatcattcaaacaaagaacagttgcatacatggagccttttacacttgacgtgttcatctcaaaacgttttgtatcagcttcactcactcatagagtaacaagcaaacaggttgcagttgcaggtaccaactccaaggacattaaagctgttcttagatctcgatcagacataccagcgtgcatagccattggtcggattttagctgaacgggcagtggaagctgatgtttacactgcttcgtatactccaagggaacgggataagtttgaagggaaaatcagagctgttgttcaatcactcattgataatgggattgatctcaaggtttatcttgattgagtctcgcacaatcttttaaagcaaacactaccagccagttaagttatttagattctggttgtgtttcaatcttgtccatgtagcttgataattataaattgatatcaatactagtatgtgaactaaagattatggcataatgcatggaattttgtatttacaaaacacaccataaccatcttgggttccaatttctgaatc

SEQ ID NO: 6278 - DNA, 842 bp, Lotus japonicus
gactctgtgattcacttcactcggtcttgcacttttggttaggctgcgattgacggcccctcgccggcgtcactcttttccggtggtcggaaaattactctgtttccctatctattttcttcacaagggagcagtttgtttccgattaatcccattttccacaagctgaagtgtgtttctgctaaatagaagttattattgggtatctgagaaacgtgttgaagcaagcatttggtagaatatgcagaaccagtgcttacacttgtgaaggaaatagagtcttgccatggatttatgtgccctcgtgctttttccacaatggacaagttcatatggcaccaagaagcttttttggggtagaggatttccttgatgatgacaacagccgaccttacacataccaaaaagggaagaagtcaaagaatccaaataagcatgtatcattcaaacaaagaacagttgccttcatggagcctttcacacttgatgtgtttatctcaaaacgctttgtatcagcttcagtcactcatagggtgacaagcaaacaggttgcagttgctggtaccaactccaaggacattaaagctgttcttcgatctcgttctgacataccggcgtgcatagccattggtcggattttagctgaaagagcaagagaggctgatgtttacactgcttcttatactccaagggatagggacaagttcgaagggaaaatcagagctgtagttcaatcacttattgataatgggattgatatcaaggtttatcttgattgagtcacaactttttgtgaaaacactagaagttattatattgagattctgattgaaatagtctta

SEQ ID NO: 6279 - DNA, 1352 bp, Cicer arietinum
ctttggaagaggcccatccatcattcatggccgctttgcccttgtagtagtatcagaaacaactttagattgaagtcgcgctcaattcaactcgccggtaaacgcggccggaaaacgacgtccgccgccgtaacagaacttcatcgcaacatatttaaccgcaccccgtaccgcgctaaagcaaacggcacgatttacaacacaggaacttatttgttttcagttaatcctgtactccattggccaaattaggtttctgtctgagaaacatgttgaagcaagcaattggtagaatttgccgagcaaatgtttattcttgtgaaggaaacagagttttgccttggttttatgtgccctcgtgctttttccacaatggacaagtacataatgcaccaagaagcttttttggtgtagaggatttcatcgatgatgataacagccgaccttatacataccaaaaagggaagaagtcaaagaatccaaacaagcatatatcattcaaacaaagaacagttgcatacatggaaccttttacacttgacgtgtttatctcaaaacggtttgtatcagctgcactcactcatagagtgacaagcaaacaagttgcagttgcaggtaccaactccaaggacattaaagctgttctcagatctcgatccgacataccggcatgcatagctattggccggattttagctgaacgagctagggaagctgatgtttacactgcttcttatactccaagagatcgggataaatttgaagggaaaatcagagctgtagttcaatcacttattgataatgggattgatctcaaggtttatcttgattgagtcacaaacaatcttttaaagctaacactaccagccagttaagttattgagattctggttgaagcattgtgtttcattatgcccatgtagctttataattagtaattgatatcaatactagttttgtgaactagaaattatggcttaatgaatgtaatttatttttatatttttatgcacattattcaaatttcatctaatttgcttattcagtattcacaattaacctcaaacacaccataaccatcaatcatgttgtccaactaccaaatcataccaggagtaaaaagcacttgtaaaatcaatttgatgtaggatgtgagaattggattgataaatatttatctatagccgtctgaacccagagttttcgaggttggtgaagaatctgccatcctagcttttctcatgccaagacccgctgaatgtaaaggttgagccactttgttccatttcacccagtgacaatttttacctccccaaataaattgtttgatgcatgagtcaatggagtcacaa

SEQ ID NO: 6280 - DNA, 939 bp, Lupinus angustifolius
tccaccccattctcttccaaacacattttcatggcatggagcgtaaaacacagtgcattcaaggagacacacacgaataagaggaaggaggtagtgtttgtcaacagtcctatacttcattggcgtaagtaagtttctgctagttaggtgttactattgggtgttctgagaaacatgtcgaagcaagcaattggtagatttttcagatcaaatgtttatgcttgtgaaggaaacagagttttaccctggatttatatgccctcatgctatttccacaatggacaggctcatatggcacctcgaagttttttcggggtagaggatttcctggatgatgataacagcaaaccttacacgtatcagaaagggaagaaatcaaagaatccaaataagcacatatcattcaaacaaagaacaattgcgtatatggaaccttttacacttgatgtgtttatctcgaaacgatttgtgtcatcttcactcactcatagggtgacaagcaaacaagtttcagttgctggtaccaactccaaggacataaaagctgttctccggtctcgctcagacatacccgcgtgcatcgccattggtcggattttagccgaaagagctagagaagctgatgtttacactgcttcttacactccaagggacagggacaagtttgaagggaaaatcagagctgtagttcaatcacttattgataatgggattgatgtcaaggtctatcttgattaagttattcaatttttatagcaaacactaccattgaagttattgaaattctggcttaagcattacaccccctggcccttgatgtatttaatcattgatgttaacagaaagtggagacctattttatagggccgagctcctctccaatattggactcagattatgacatatgatatcgaaaaaaattaatgattcagattttct

SEQ ID NO: 6281 - DNA, 948 bp, Trigonella foenum-graecum
ccactttgccgttgttgtagtatcagaaacaacaagctccattggtattgcattgaaaaactcaacttgccggaaaacgctgccggaaatcctcgtcggccgccgggaacagaatcaagtcgccgggaagaaggaactgatttgtttgtattgagctgaattagggttctgttaatcaggaggatttgttattgagtgtctgtctgagaaatatgttgaagcaagcaattggtagaatttgcagcagaaccaatgtttatgcttgtgaaggaaacagagttttgccttggatttatgttccctcatgctgtttccacaatggacaagcgaatatggcacctagaagcttttttggtgtagaggatttcgtcgatgatgacaacagccgaccttatacataccaaaaagggaagaagtcaaagaatccaaacaagcatatatcattcaaacaaagaacagttgcctacatggagccttttacacttgacgtgcttatctcaaaacggttcgtatcagcttctctaactcatagagtgacaagcaaacaggttgcagttgcaggtaccaactccaaggacataaaagctgttcttagatctcgatcagacattccagcatgcatagccattggtaggattttagcggaacgagcaatggaagctgatgtttacactgcttcttatactccaagggatcgggataagtttgaagggaaaatcagagctgtagttcaatcacttatagataatggggttgatctcaaggtttatcttgattgagtcacattcaatcttttaaataaaacactgcagccagtgaagttattgagattctggttgaagcaatctagcccctatgtgtgtttcattatgtccatgtagcttgataattagtaattgatatcaatacaagtattgtgaactataaattatggcataatgcatgtag

SEQ ID NO: 6282 - DNA, 1292 bp, Trifolium pratense
agagcagaagattacccaagcccaatgaaagcccgtgtgctatttgcttgactgattatcttccaaaggataccatacggtgcgttcctgattgtcaacattgttttcatgccgactgtgttgatgagtggcttcggatgagtgccacgtgtcctctgtgtcggaattctcctgctgtttcgccggtaactacgccggtggttactccgttgtcagagcttgctcctctggcttttcatgccaggcccatccatcatcatacactgtccgctttgtattctctcatctctctccctcttcaccgtcgcccaccctctccaccacatagcaaccatcatcgccggcgccgccgaacctgccaccgtcgtcgctcaccgtcactgcaccaccggctacagtccattgggctgaattagggttatgttgaagcaagcaattggaagaatttgcagcagcagagtcaatgtttatgcttatgaaggaaacagaattttgcctttcatttatgtgccctcatgttgtttccacaatggacaagcaaatatggctcctagaagttttttcggtgtagaggattttgtcgatgatgataacagccgaccttatacataccagaaagggaagaagtcaaagaatccaaacaagcatatatcgttcaaacaaagaacagttgcctacatggagccttttacacttgacgtgttcatctcaaaaagatttgtatcagcttcactcactcatagagtcactagcaaacaggttgcagttgcaggtaccaattcgaaggacattaaagctgttcttagatcacgatcagacataccagcatgcatagccattggtcggattttagctgaacgagcaatggaagctgatgtttacactgcttcatatactccaagggatcgggataagttcgaagggaaaatcagagctgttgttcagtcacttatcgataatgggattgacctcaaggtttatcttgattgagtcacacagtcttttaaagcaaacacgaccagccagttatgttattcatattctggatttctggttgaagcaatctagcccctttgcgtgtttcgttatgtccatgtagcttggttaataagtattttgatatcaatactggtattgtgcacctctagggttccattttccaaatcatgttgtagaaccacccaatcacaggagacccttttgctgcactgtcaactgtcatccccttcgctgtaatatattgaaaagctcagacaactgatacttcctaatttagtaatggcttttttctt

SEQ ID NO: 6283 - DNA, 838 bp, Trifolium pratense
atgttgaagcaagcaattggaagaatttgcagcagagccaatgtttatgtttatgaaggaaacagaattttgccttcgatttatgtgccctcgtgttgtttccacaatggacaagcaaatatggctcctagaagttttttcggtgtagaggatttcgtcgatgatgacaacagccgaccttatacataccagaaagggaagaagtcaaagaatccaaacaagcatatatcgttcaaacaaagaacggttgcctacatggagccttttacacttgacgtgtttatctcaaaacgatttgtatcagcttcactcactcatagagtgactagtaaacaggttgcagttgcaggtaccaactccaaggacattaaagctgttcttagatctcgatcagacataccagcatgcatagccattggtcggattttagctgaacgagcaatggaagctgatgtttacactgcttcgtatactccaagggatcgggataagtttgaagggaaaatcagagctgtagttcagtcacttatcgataatggggttgatctcaaggtttatcttgattgagtcacacagactcttttaaagcaaacactaccagccagttatgttattcagattttggatttctggttgaagcaatctagcccctttgtgtgtttcgttatgtccatgtagcttggttaataagtattttgatatcaatactggtattgtgcacctctagggttccattttctgaatcatgttgttgaaccaccaaatcataggagacccttgcgttgcactgtcaactgtcgtccccttcgctgtaatatattgaaaagttcagacaact

SEQ ID NO: 6284 - DNA, 1053 bp, Glycine max
aatcatcacttgcacaagaatattacactttgagtgccattattgggtcctgggttcgagacaagacacccacattccctaaacccttccaaatccaattcaacaacaaaaatacgcaacagtcaccggttctcttcacctaatctgaatcacactctcttcgttgcttcagttcatctcctcatatctacaactctccctcattctctggttcttttctcactccaaactgaactgcaaaattttggttttgttcactcaatacagggtgcgatttgcttccattttccagtcattcccatactccttaggctattgtatgcttctactaataaggaggagttgttattgggttctgagaaacatgttgaaacaagtaattggcagaatctgtagaaccgatgtttatgcttgtgaaggaaacagagttttgccttggatttatgtgccttcatgctttttccaccatggacaagcgcacatggcacctagaagcttttttggggtagaggatttccttgacgatgacaatagccgaccttacacataccaaaaagggaagaagtcaaagaatcccaataagcacatatcattcaaacaaagaacaattgcctacatggagccttttacacttgatgtgtttatctcgaaacgttttgtatcagcttcactcactcatagggtaacaagcaaacaggttgcagttgccgggaccaactccaaggacataaaagctgttcttaggtctcgttccgacataccggcatgcatagccattggtaggattttagctgaaagagcaaaagaagctgatgtttacactggttcttatactccaagggatagggacaagtttgaagggaaaatcagagctgtagttcaatcacttattgataatgggattgatatcaaggtttatcttgattgagttgagtcactcaagtttttgggactatcagtttagctgttgatatttcggttcgccttgtgtgtttgaacatgtccatttagtttggtttttatgataatgggaaaatatcattattagaatta

SEQ ID NO: 6285 - DNA, 1137 bp, Arachis hypogaea
accacacccccagctcgctctcacactctcgtctctaacggcacacctcacagacaggcagagctgggagctcgcctcggttcaccgacactgcatgctcgccgacgtcgctgcgcctcttgccggatcctccgcgtcgtatgctcctctctcctccgtctgagctcggctgctcgcgcgtctctcgcctccgcgtctgctcgagctgtgcttcctgctcgtatcgccgccgcgccaacctcgcctctctccctcctcacgtctctgctcgactttgcttcctgctcgagtctcaccgcgcctccctccgcctctcctccgtctctgtgggcggttgttgctgctcgtccctcgtcgtccgtgcatccgtggttgttgctgcctgcacgctgccgtgtgtcgtccaccttctggaattgattttgcctctgcaacaagagttacaggaaagcaaacaagcatcaagaagaaggatatagtgacacatgtagctcaatcctggattttaaggagataaaaaaaaagagtcaagtttgatgaatatgttgaagcaagcagtcggaagaatttggaaaagcagcagtggttatgctttagaaggaggaacaaaaattttggcttggagttatgttccttcgatctatttccacaatacacaagctcatacagcacctagaagctttttcggtgttgaggatttccttgatgatgacaacagcaaaccttacacttaccagaaagggaagaaatcaaagaatccacataaacatgtatcgttcaaacaaagaactgttgcatacatggagccttttacccttgatgtgttcatctcaaagcgttttgtgtcggcttcgctcacccatagagtgacaagcaaacaggttgcagtttctggcaccaactccaaggacataaaagctgttcttaaatctcgttcagacataccagcttgcatagcaattggaaggattttggccgaaagagcaagagaagctgatgtttacactgcctcttatactccaagggatagggataaatttgaagggaaaatcagagctgtagttcaatcacttattgataatgggattgatgtcaaggtttatcttgattgagttattaacatctatttgagcaaaa

SEQ ID NO: 6286 - DNA, 1232 bp, Arachis hypogaea
aggcagagctgggagctcgcctcggttcacggacactgcatgctcgccgacgtcgctgcgcctctcgccggatcctccgcgtcgtgtgctcctctctcctccgtctgagctcggctgctcgcgcgtctctcgcctccgcgtctgctcgagctgtgcttcctgctcatatcgccgccgcgcctccctcgcctctctccctcctcacgtctctgctcgactttgcttcctgctcgcgtctcaccgcgcctcccccgcctctcctccgtctctgtgggtggttgttgctgctcgtccctcatcgtctgtgcctccgtggttgttgctgcctgcacgctgccgtgggtcgtccaccttctggaattgattctgcctctgcaacaacagctacaggaaagcaaacaaaagcatcaagaagaaggatatagtgacacgtgtagctccattctggattttaaggagataaaaaaaagagtcaagtctgatgaatatgttgaagcaagcagtcggaagaatttggaaaagcagcagtggttatgcttcagaaggaggaacaaaaattttggcttggagttatgttccttcattctatttccacaatacacaagctcatacagcacctagaagctttttcggtgttgaggatttccttgatgatgacaacagcaaaccttacacttaccagaaagggaagaaatcaaagaatccagataaacatgtatcattcaaacaaagaactgttgcatacatggagccttttactcttgatgtgttcatctcaaagcgttttgtgtcggcttcgctcacccatagagtgacaagcaaacaggttgcagtttctggtaccaactccaaggacataaaagctgttcttaaatctcgttcagacataccagcttgcatagcaattggaaggattttggccgaaagagcaagagaagctgatgtctacactgcctcttatactccaagggatagggataaatttgaagggaaaatcagagctgtagttcaatcacttattgataatgggattgatgtcaaggtttatcttgattgagttattaacatctatttgagcaaaacttgccaactaaattattgagattttagttagcggaggtataaatatttttttgtgtttgaaaaatagaaaagatcacgtgtttttgaaagcaaaaaaaagtaaaaaaaacaaaagtactctgcgttgataccactgctttacgtcgtat

SEQ ID NO: 6287 - DNA, 1470 bp, Ricinus communis
aaatcttttagtaattaggatttaacgttacctttatatttatttatcctgcatttcaaattctttttgggatataatggtgtcaatatgtttgtggatggagtgctcgtgtgatgtattttattggatttcatgtgggtgttctaatgtgacttaaaattatttcatttgggctgtgctctttctgtaggtttttctcaagtgattataagataagtataattaattgagttgaagttgggataacaaggtgctggctgtgcatcaaatatgttgaagcaagtgcttggcaagattattcacagagggccttttctaaatggaggagacaagcttagactgtctctttatgtgcccggcagttgcttccacaatggtcaggttcattattcaccaagaagcttttttggagtagaagatttccttgacgatgacaatagcaggccttacacttaccagaaagagaaaaagtcaaaaaaccccaacaacaagcatatgtcatttaagcaacggaccaaagcgtacatggagccatttacacttgatgtgtttatatcaaagcgctttgtttctgcatcacttacccacagggtaacaagtaagcaggttgcagttgctggtactaactctaaagacattaaagctgcactcaggtcccggtcagatatacctgcatgtttggccattggccgcattttatccgagagagcacgagaagctgatgtatatactgcatcttacactccaagggagagggacaagttcgaaggaaagattagagctgtggttcaatctctcattgataatgggatcgacattaaagtttatcttgactgaccaggtttttatacattcttgaaattaatcctttagaccataggaaaaatagttgttgcaatcttttagtctatgtatgcaatttgcatatttgcttttttttttttttgtttcccttaagtattaattgaatgaaagcggctgtattaaggttagaatttaagttaaatctattgtgtttgaaccaaatacaatataaatatcaaacaagagagagaaggtaaaaagcctcttaattctccgtttttgtctcattaaacttatagcctgtaagggtgcaaaagttacaaaatttgggcctgaaagccagaacctgtatttcaattggacatagtaaggcatttataagagacggccgaagaattgaagtgctaacccaacttttgaatcacaaaaagggcataattcagaaccattatcatgattatttataatttatttatttattattattttttaaattacgataacttctataatgttcttatcttattactaagttaagcatatgattatttttttcctaattttattattgtgagggatttgatcgctttttataaacaaatgttgtcaagaaagttaaaatactaaagatggttcaagtttattgagatacaatatgccttgctt

SEQ ID NO: 6288 - DNA, 750 bp, Centaurea maculosa
ggcaaataaaatcaccaataaaccttcgattcttttcactctcgatttctctcaagaaaccggcggacaccaccagttaccggcgaacaccggtcaccggcgctaccacagtcgattctcttatcagtaaccatcaaactcttgattccgggttgtgagccatgttgaaacgagtgtgctctatgtcatatacacatggaagtgagaggactaagctctgtttgaaggctattacaagacattttcacagtgggcagcctcattcagccgcaaggagcttttttggagtagaggactttctcgacgatgataacagccgtccgtatacataccagaaagaaaagaagtccaagaacccaaacaaacacatatcattcaaacagagaacgatagcatacatggagccatttacgctagacgttttcatctcaaagcggtttgtttcagcctcccttactcacagggtaacgagcaagcaagttgcggttgccggtaccaactcgaaggatatcaaggcagctcttaaatcccgttcagacattcctgcttgtttggcgattgggaaaatactttctgaacgggccagagaagccgatgttttcacggcttcgtatacccccagagaacgggataaattcgaaggtaaaattagagcggtcgttcaatcgctaattgataacggtatcgatgttaaaatttatctcgattgattatgtaatatgatcttaaaaggtataagtaggaattttc

SEQ ID NO: 6289 - DNA, 871 bp, Populus trichocarpa
ctcgctctctttgtggaggaattttctggccttcctgactatccaggtgaatatagagctagtgaatagttgagtaagttttgttgggtgtgagtggaacatgttgaagcaagtttttggaaaggttttgaacaagggtttttttgcaaatggaggagataagttaaggcctgggttgtatgtgcctaatactggattccacaatggacaggctcattgtgcacccagaagcttttttggggtggaagatttccttgatgatgataacagcaggccatacacgtaccagaaagggaaaaagtcgaagaacccaaacaagcatttatcatttaaacagcggactgtagcatacatggagccatttacacttgatgtttttatttcaaagcgtttcgtttcagcatcgctcactcatagagtgaccagtaagcaggtagcagttgctggtaccaactctaaagacattaaagctgtgctcaagtcccgctcagacattcctgcatgtttagccgttgggcaaatcttagctgatagagcgagagaagctgatgtatatactgcctcttatactccgagggaaagggacaagtttgaaggaaagatcagagcagtggttcagtctctcattgataatgggattgatgttaaaatttatcttgactgaacaagtcacatctgtttttgatatttctcgtattgaattgttggaaaatggtgtttgtaactttgtgaatataaaggatatgatcaccataagttttggcactgagaattgaaagaagtgaatgtgctgctcttgacaaagtgcttatctatgaaacttagaagcaggcagttgatcatacaacaaaaatgtcaatgattctgtcca

SEQ ID NO: 6290 - DNA, 752 bp, Juglans hindsii x Juglans regia
tcgcgactctgctacggttcaggttccggtcttagagaatacgctacaagagtcaggtgttgactgcaaaaaagatgttgaagtatgtgctgggcaaggcgtggaataaagggatcaatggatttggaggggacaaagttaggcctcctttttttgttctcacaagcagtttccacaatggacaggttcattttgcaccaagaagcttccttggggtagaggatttcctagatgatgacaatagccgaccatacacataccagaaggggaagaagtcaaaaaatccaactaagcatatatcgttcaaacaacgcaccgtagcctacatggagccatttacgcttgatgtgttcatttcaaaacgatttgtgtcggcctcactcacccacagggtgacaagcaagcaggttgcagttgctggtaccaactctaaagacattaaagctgtactcaagtcccggtcagatataccagcatgtttggccgttggtgctattctggccgacagggcaagagaagctgatgtgtatactgcttcctacacgccgagggagagagacaagtttgaagggaagatcagagcagtggttcaatcccttattgataatgggattgatgtcaaaatttatctggactgaatccagttgcctgcctttgttaattaactttcattcggacccatggggatggaaaatgctgtgtaaccctagttttttaacttatgaaggcatcatgccattatgctgagaacc

SEQ ID NO: 6291 - DNA, 4523 bp, Glycine max
cttagtccctgtttggatgcttaaatagcataatcccctgaattttgattttgaaataccccgcccgttggcaccgtctctctctctctctctctctctctctcatgttcatcctcaacatttgaaaatctgcgaagcaaaaccctagaaagatgaaccagtaccacatctacgaagccatcggtcgcggcagatactctaccgtttacaaaggcaggaagaagaagacaatcgagtatttcgccatcaaaagcgtcgataaatcacagaaaaccaaggtccttgaagaagtcaggattcttcacacattgggccatgtaaatgtgctgaaattttacgattggtatgaaacttctgctcacctatggttggttttggagtactgtgttggaggggatctgctttccatattacgacaggatagtcaacttcctgaagactcggtttatgattttgcttatgatatagtcaaagctttgcagtttttacattcaaatggaataatctattgtgacctgaaaccatccaatatcctactagatgaaaatggatgtgcaaagctatgtgattttggattggctaggaagttgaaagatatatcaaaagctccttcttcctcgttaccgcgagcaaaacgtggaacaccctcttacatggctccggagctttttgaggacagtggagtccattcttatgcttctgatttctgggcactaggctgtgtactatatgaatgctatgctgggaggccaccctttgtgggaagagaattcacccagcttgtaaaatccatcatttcggatccgactccacctctccctggtaatccaagtcggccttttgtcaatttaattaattccctgttggtaaaagatccagctgaaagaatacagtggcctgagctttgtggacatgccttttggagaaccaaatttactctggtgtctctgcctgctcaacctgcatttgatgatatgatagggctacatgctaaaccatgcttatcagaacgtaatggagataaatcttcccataacaggacccctaccaaatatcgtgaaaaagatgtcaaagggtttttgagaaaggatgagaactctgttttaggatctagaggcattgagacaccaacaagggcaacaccaattggccacagaactcagacaaagggttctggcagaatacatgaggtaaagcaaaaagataattccaatattagcaagggtgtgaatcttttgagactgtcaagaatagcaaaaacaaatctacagagagaaaatgagaaggaaaactatcgacgccccttgcctaataactctgagaatgattctgaagttaaaattgagaacactgacatggaacttgattttaatgagaatgctgaagatgatgcgcatgaagaaactgatggtgccgaacagacaactcctgtgcctgatgagaaaatggtcaatcattttctgaaccagggaaaagcagaggaggttgaaaataatacacaccagttggacaccccatctgttcaccctccagtctcagatgatccaaggtcatttgatcatgaatcaactcctgaccatcctgacatatctgctatttctcccagtgtgagccctcaggtgaagaaacatagaactaaagaagactcaggatctggccttgactctgattcttcgaggttgtctaacaacctttcccaggttctttggcatgcatctgatctctcagtcagacctgtaatgcctagcagaaaagttgataaagtctcagaagtcattccttcactcccttttgaggcattgcaagcatctgattttgtcaagatgcctaaagagcaattggaggcagtccacaaccgaatattatccattttgaatggaaataccagcattggagagaaacagaatgtgattaggtaccttgagatgttgagcagtaatgctgatgcagctaatatcttgaccaatgggccaataatgctcatgcttgtaaaattgcagcgtcaatccaaggcatcagctttgcgtgttcaacttgcttcactgatcggtttgttgattaggcactccacctttgttgatgacagtttggctagttctggaattttaggtgcactgactgatggccttagagacagacaggaaaaagtaaggaggttctccatggctgctttgggtgagttactattttatatatccactcaaaatgcagactgcagggataacaatcaacttgaatctccatcaaaggacaataggaatgcgcatggctggcaggttccaaattcattaatatcacttgtgtcatcaatattgcggaagggagaggatgatataactcaattatatgcattgagaacaattgagaatatttgcagtcaaggaggttcatgggtggggcgtttgtccagtcaagatgtaattagtaatctctgctatatctatagggcctcagggaaacaagagagtatgagactcactgcaggatcatgcttggtgcgcttagttcgttttaatcctcctagcattcagtcggtgatagagaaactctcattcaaggacctatcttctgctcttgtcaagggcagtccacgagagcaacaaatcagcttaaatcttcttaacatggcaatgcttggaagccacatgttcacaaatattggaagataccttgtttcacttgctgaggataaaaatctgatcccaagtcttttgggtcttgttgagcaaggtagtgaagttttaagaggaaaggcactagtccttgtggctctcctctgtaagcatggcaggaggtggcttccacacttcttttgtagccaaaagttactctctgtagtggataggctgggaaaagagaaggatgcttatgtgaggcagtgtttggatgcatttgtgcatattgtggcatccagtattccaggtttacttgatataataacaggggatatccagcaaatgatgggaggaaggcgccatggacacatctctgcccttaccagcagatctgccccaaaacccaacattcatttgtttcctgttgtccttcatcttcttggaacttcaacttttaagcacaaagtagttacaccacaagtcttacggcagttggcgaatctaattaaactcgtggagacatcgtttcagggaagagatgacttccaaataacccttcttcgaattttcgagtctctcacagaggaatctcctgtgattattggcaatcctgacattttcatacgtgaaatcctccctagtctgacagttctgtacaagggtaacaaggacggtgatgccagatttttgtgccttaaaattctttttgatgtgatgatcattcttttgagtgaaccaattgaagaagagcaaagattgacggatctgaaattcgtatccaatacccgttttcttcctctctacccaaccttgattgaagatgaagatcctattcctatctatgcgcagaagcttcttgtcatgctaatggagttcagttttattacaattccagacattctacatctgaagacaatttcacaatgcttcgagttcttgcttggcgatctctcaaatgcaaatgtgaacaatgttaagctgtgtcttgctctggcttctgctcctgagatggagtccaaattactctctcagttaaaggtggttaggaggattggcaactttcttgagtttgtatatgcaaagggtatggaagatttgctggaaccaactcttgggttgtgtaaggcttttctagcacgttcagttagctgcacaaaaggcttcagctacacaacagaactaattctcttaggtgactgtcctcccgagttgagtggtggcgctgtcgatccccaacaatgcataaaagatatagcggactttggaagcaatgtcggtgtcttgctagagttgagtgcctctgcagaaaccagtattgctgatatagcttctgaatgtgttgtcttactgctcaaggcagctcctagagaagccaccactggtatactaaccaatctccccaaggtgactgtgatcctagagagctggagtagaggcattcctcacttgatcatccagcgaatgcttcacgctttaggctatgcttgcaagcaatacttactgcatgcaatgatattatcaatatccaaacctgagatttcaagaactgaagtcatagtttctgaactcaaaaattcaggtgtaccagctttagccaaaacagctgggctggcagccttggaattgcagcggttgcctcgttgcatttgaataattgtaggtatcatgttctgttctgttcctctcattagaatgtgtaacttttctagttcaccgtttatccttatatttcaaggtattgttaaaactccagataaaggttgagcaatttggtgaattccactcaggcttcactgtatttctatgtaaagcatgtgtactctgtatcttcgtgaacattaaaatataaagtcaacgatttttttcctcctagatttttctataaattgattcttgtcaatgtaatag

SEQ ID NO: 6292 - DNA, 4555 bp, Glycine max
cttagtccctgtttggatgcttaaatagcataatcccctgaattttgattttgaaataccccgcccgttggcaccgtctctctctctctctctctctctctctcatgttcatcctcaacatttgaaaatctgcgaagcaaaaccctagaaagatgaaccagtaccacatctacgaagccatcggtcgcggcagatactctaccgtttacaaaggcaggaagaagaagacaatcgagtatttcgccatcaaaagcgtcgataaatcacagaaaaccaaggtccttgaagaagtcaggattcttcacacattgggccatgtaaatgtgctgaaattttacgattggtatgaaacttctgctcacctatggttggttttggagtactgtgttggaggggatctgctttccatattacgacaggatagtcaacttcctgaagactcggtttatgattttgcttatgatatagtcaaagctttgcagtttttacattcaaatggaataatctattgtgacctgaaaccatccaatatcctactagatgaaaatggatgtgcaaagctatgtgattttggattggctaggaagttgaaagatatatcaaaagctccttcttcctcgttaccgcgagcaaaacgtggaacaccctcttacatggctccggagctttttgaggacagtggagtccattcttatgcttctgatttctgggcactaggctgtgtactatatgaatgctatgctgggaggccaccctttgtgggaagagaattcacccagcttgtaaaatccatcatttcggatccgactccacctctccctggtaatccaagtcggccttttgtcaatttaattaattccctgttggtaaaagatccagctgaaagaatacagtggcctgagctttgtggacatgccttttggagaaccaaatttactctggtgtctctgcctgctcaacctgcatttgatgatatgatagggctacatgctaaaccatgcttatcagaacgtaatggagataaatcttcccataacaggacccctaccaaatatcgtgaaaaagatgtcaaagggtttttgagaaaggatgagaactctgttttaggatctagaggcattgagacaccaacaagggcaacaccaattggccacagaactcagacaaagggttctggcagaatacatgaggtaaagcaaaaagataattccaatattagcaagggtgtgaatcttttgagactgtcaagaatagcaaaaacaaatctacagagagaaaatgagaaggaaaactatcgacgccccttgcctaataactctgagaatgattctgaagttaaaattgagaacactgacatggaacttgattttaatgagaatgctgaagatgatgcgcatgaagaaactgatggtgccgaacagacaactcctgtgcctgatgagaaaatggtcaatcattttctgaaccagggaaaagcagaggaggttgaaaataatacacaccagttggacaccccatctgttcaccctccagtctcagatgatccaaggtcatttgatcatgaatcaactcctgaccatcctgacatatctgctatttctcccagtgtgagccctcaggtgaagaaacatagaactaaagaagactcaggatctggccttgactctgattcttcgaggttgtctaacaacctttcccaggttctttggcatgcatctgatctctcagtcagacctgtaatgcctagcagaaaagttgataaagtctcagaagtcattccttcactcccttttgaggcattgcaagcatctgattttgtcaagatgcctaaagagcaattggaggcagtccacaaccgaatattatccattttgaatggaaataccagcattggagagaaacagaatgtgattaggtaccttgagatgttgagcagtaatgctgatgcagctaatatcttgaccaatgggccaataatgctcatgcttgtaaaattgcagcgtcaatccaaggcatcagctttgcgtgttcaacttgcttcactgatcggtttgttgattaggcactccacctttgttgatgacagtttggctagttctggaattttaggtgcactgactgatggccttagagacagacaggaaaaagtaaggaggttctccatggctgctttgggtgagttactattttatatatccactcaaaatgcagactgcagggataacaatcaacttgaatctccatcaaaggacaataggaatgcgcatggctggcaggttccaaattcattaatatcacttgtgtcatcaatattgcggaagggagaggatgatataactcaattatatgcattgagaacaattgagaatatttgcagtcaaggaggttcatgggtggggcgtttgtccagtcaagatgtaattagtaatctctgctatatctatagggcctcagggaaacaagagagtatgagactcactgcaggatcatgcttggtgcgcttagttcgttttaatcctcctagcattcagtcggtgatagagaaactctcattcaaggacctatcttctgctcttgtcaagggcagtccacgagagcaacaaatcagcttaaatcttcttaacatggcaatgcttggaagccacatgttcacaaatattggaagataccttgtttcacttgctgaggataaaaatctgatcccaagtcttttgggtcttgttgagcaaggtagtgaagttttaagaggaaaggcactagtccttgtggctctcctctgtaagcatggcaggaggtggcttccacacttcttttgtagccaaaagttactctctgtagtggataggctgggaaaagagaaggatgcttatgtgaggcagtgtttggatgcatttgtgcatattgtggcatccagtattccaggtttacttgatataataacaggggatatccagcaaatgatgggaggaaggcgccatggacacatctctgcccttaccagcagatctgccccaaaacccaacattcatttgtttcctgttgtccttcatcttcttggaacttcaacttttaagcacaaagtagttacaccacaagtcttacggcagttggcgaatctaattaaactcgtggagacatcgtttcagggaagagatgacttccaaataacccttcttcgaattttcgagtctctcacagaggaatctcctgtgattattggcaatcctgacattttcatacgtgaaatcctccctagtctgacagttctgtacaagggtaacaaggacggtgatgccagatttttgtgccttaaaattctttttgatgtgatgatcattcttttgagtgaaccaattgaagaagagcaaagattgacggatctgaaattcgtatccaatacccgttttcttcctctctacccaaccttgattgaagatgaagatcctattcctatctatgcgcagaagcttcttgtcatgctaatggagttcagttttattacaattccagacattctacatctgaagacaatttcacaatgcttcgagttcttgcttggcgatctctcaaatgcaaatgtgaacaatgttaagctgtgtcttgctctggcttctgctcctgagatggagtccaaattactctctcagttaaaggtggttaggaggattggcaactttcttgagtttgtatatgcaaagggtatggaagatttgctggaaccaactcttgggttgtgtaaggcttttctagcacgttcagttagctgcacaaaaggcttcagctacacaacagaactaattctcttaggtgactgtcctcccgagttgagtggtggcgctgtcgatccccaacaatgcataaaagatatagcggactttggaagcaatgtcggtgtcttgctagagttgagtgcctctgcagaaaccagtattgctgatatagcttctgaatgtgttgtcttactgctcaaggcagctcctagagaagccaccactggtatactaaccaatctccccaaggtgactgtgatcctagagagctggagtagaggcattcctcacttgatcatccagcgaatgcttcacgctttaggctatgcttgcaagcaatacttactgcatgcaatgatattatcaatatccaaacctgagatttcaagaactgaagtcatagtttctgaactcaaaaattcaggtgtaccagctttagccaaaacagctgggctggcagccttggaattgcagcggttgcctcgttgcatttgaataattgtaggtatcatgttctgttctgttcctctcattagaatgtgtaacttttctagttcaccgtttatccttatatttcaaggtattgttaaaactccagataaaggttgagcaatttggtgaattccactcaggcttcactgtatttctatgtaaagcatgtgtactctgtatcttcgtgaacattaaaatataaagtcaacgatttttttcctcctagatttttctataaattgattcttgtcaatgtaatagtctgtctcctttcattaatttaaacactaacg

SEQ ID NO: 6293 - DNA, 4868 bp, Glycine max
cacaactttactagacactacagtttacgttacttaagtcaaaagtatattctctttccaattccaaaattgcgctcgttgtatccttagtccctgtttggatgcttaaatagcataatcccccgaattttgattttgaaatgccccgcccgttggcacagtctctctttctctccctctctcagtcgtatcctaattcatttctatctctctcatgttaatgttcatcctcaacatttgaaatctgcgaagcaaaatcccagaaagatgaaccagtaccacatctacgaagccatcggtcgcggcagatactccaccgtttacaagggcaggaagaagaagactattgagtatttcgccatcaaaagcgtcgataaatcgcagaaaactaaggtccttgaagaagtcaggattcttcacacattggatcatgcaaatgtgctgaagttttacgactggtatgaaacttctgctcacctatggttggttttagagtactgtgttggaggggatctgctttccatattacgacaggatagtcaacttcctgaagattcggttcatggttttgcttataatctagtcaaagctttgcagtttttacattcaaatgaaataatatattgtgacctgaaaccttcaaacatcctactagatgaaaacggatgtgcaaagctatgtgattttggattggcgaggaagttgaaagatatatcaaaagctccttcttcctcgttaccgcgagcaaaacgtggaacaccctcttacatggctccggagctttttgaggatggtggagtccattcttatgcttctgatttctgggcactaggctgtgtactatatgaatgctatgctgggaggccaccctttgtgggaagagaattcacccagcttgtaaaatccatcatttcagatccgactccacctctccctggtaatccaagtcggccttttgtcaatttaattaattccctgttggtaaaagatccagctgaaagaatacagtggcctgagctttgtggacatgccttttggagaaccaaatttactctgttgcctctgcctgctcaacctgcctttgatgatatgatagagctacatgctaaaccatgcttatcagaacgtaatggagataaatcttcgcataacaggacccctaccaaatatcgtgaaaaagatgtcaaaggggcgttgagaaaggatgagaactctgttttaggatctagaggcattgagacaccagcaagggcaacaccaattggccacagaactcagacaaagggttctggcagaatacatgaggtaaagcaaaaagataattctaacattagcaagggtgtgaatcttttgagactgtcaagaatagcaaaaacaaatttacagagagaaaatgagaaggaaaactatcgacgccccttgcctaataactctgagaatgattctgaagttaaaattgagaacactgacatggaacttgattttaacgagaatactgaagatgatgcgcatgaagaaactgatggcaccgaacaaacaactcctgtgcctgatgagaaaacagacaatcattttctgaaccagggaaaagcagaggagattgaaaataatacacaccagttggacaccccatctgttgttcaccctccagtctcggatgacccaaggtcatttgatcatgaatcaactcctgaccttcctgacatatctgctatttctcccagtgtgagccctcaggtgaagaagcatagaactaaagaagacgcaggatcaggccttgacttcgattcttcaaggttgtctaacaacctttcccaggttctttggcatccatctgatctctcagtcagacctgtaatgcctagcagaaaaattgataaagcctcagaagtcattccttcactcccttttgaggcattgcaagcatctgattttgtcaagatgcccaaagagaaattggaggcaatccacaaccgaatattatccattttgaatggaaataccagcattggagagaaacagaatgtgattaggtaccttgagatgttgagcagtaatgctgatgcagctaatatcttgaccaatgggccaataatgctcatgcttgtaaaattgcagcgtcaatccaaggcatcagctttgcgtgttcaacttgcttcactgattggtctgttgattaggcactccacctttgttgatgacagtttggctagttctggaattttaggtgcactgactgatggccttagagacaggcaggaaaaagtaaggaggttctccatggctgctttgggtgagttactattttatatatccactcaaaatgcggactgcagggataacaatcaacttgaatctccatcaaaggacaataggactacacatggctggcaggttccaaattcattaatatcacttgtgtcatcaatgttgcggaagggagaggatgatataactcaattgtatgcattgagaacaattgagaatatttgcagtcaaggaggttcctgggtggggcgtttgtccagtcaatatgttattagtaatctctgctatatctatagggcctcagggaaacaagagagtatgaggctcactgcaggatcatgcttggtgcgcttagttcgttttaatcctcctagcattcagttggttattgagaagctctcattcaaggacctagcttctgctcttgtcaagggcagtccacgagagcagcaaatcagcttaaatcttcttaacatggcaatgcttggaagtcacatgttcacaaatattggaagatgccttgtatcacttgctgaggataaaaatctgatcccaagtcttttgggtcttgtcgagcaaggtagtgaagttttaagaggaaaggcactagtccttgtggccctcctctgtaagcatggcaggaggtggcttccacacttcttttgtagccaaaagttactctctgtggtggataggttgggaaaagagaaggatgcttatgtgaggcagtgtttggatgcatttgtgcatattgtggcatccagtattccaggtttattggatataataacaggggatgtccagcaaatgatgggaggaaggcgccaaggacacatctctgcccttaccagcagatctgccccaaaaaccagcattcatttgtttcctgttgtccttcatcttcttggaacttctacttttaagcacaaagtagtcacaccgcaagtcttacggcagttagcgaatttaattaaactcgtggagacaccgtttcagggaagagatgacttccaaataacccttcttcgaattttcgagtctctcacagaggaatctcctgtgattcttggtaatcctgacattttcatacgtgaaatcctccctagttcgacagttctctacaaggggaacaaggacggtgatgccagatttttgtgccttaaaattctttttgatgtgatgatcattcttttgagtgaaccaattgaagaagagcatagattgaaggatctgaaattcgtatcaaatacccattttcttcctctctacccaaccttgattgaagatgaagatcctattcctatctatgcacagaagcttcttgtcatgctaatggagttcagttttattacaattcctgacattctacatctgaagacaatttcacaatgctttgagttcttgctgggtgatctctcaaatgcaaatgtgaataatgttaagctgtgtcttgctctggcttctgctcctgagatggagtccaaattactctctcagttaaaggtggttaggaggattggcaactttcttgagtttgtatatgcaaagggtatggaagatttgctggatccaactcttgggctgtgtaaggcttttctagcacgttcagtcagctgcacaaaaggcttcagctacacaacagaaccaattctcttaggtgactgtcctcctgagttgagtggtggtgctgttgatccccagcaatgcataaaagatatagcagactttggaagcaatgtcggtgtcttactagagttgagtgcctctgcagaaaccagtattgctgatatagcttctgaatgtgttgtcttactgctcaaggcagctcctagagaagccacgactggtatactaaccaatctccccaaggtgactgtgatcctagagagctggaatagaggcattcctcacttgatggtccagcgaatgcttcacgctttaggttatgcttgcaagcaatacttactgcatgcaatgatattatcaatatccaaacctgagatttcaagaactgaagtcatagtttctgaactcaaaagttcaggtggatcagctttagccaaaacagctgggctggcagccttggaattgcagcggttgcctcgctgcatttgaataattgtaggtatcatgttcctctcattagagctgtaacttttctagttcaacgtttacccttatatttcggctcttattaaattcctgataaaggttgagcaatttggtgaattccactcaggcttcactgtatttctatgtaaagcatgtgtactctatatcttcgtggtgaacattaaaatataagtcaacgaattttttcctcctaaatttttctataaattgattcttgtccatgtaatataggctcctttcattaagttaaacactaacgtattttacaagtataaagttacccaggaaaaacccttaaatggagtgaaactgcatgcatatgaatatgattgagattcctatttgataggtaccatggtacacaattacacatacttccaagacagaaagattgtcagctatgtaagaaggattatttcaataattgctgctcaagcaacaaaaatgtccagcctagccacctttat

SEQ ID NO: 6294 - DNA, 4968 bp, Glycine max
actcgaacacacccttcacaactttactagacactacagtttacgttacttaagtcaaaagtatattctctttccaattccaaaattgcgctcgttgtatccttagtccctgtttggatgcttaaatagcataatcccccgaattttgattttgaaatgccccgcccgttggcacagtctctctttctctccctctctcagtcgtatcctaattcatttctatctctctcatgttaatgttcatcctcaacatttgaaatctgcgaagcaaaatcccagaaagatgaaccagtaccacatctacgaagccatcggtcgcggcagatactccaccgtttacaagggcaggaagaagaagactattgagtatttcgccatcaaaagcgtcgataaatcgcagaaaactaaggtccttgaagaagtcaggattcttcacacattggatcatgcaaatgtgctgaagttttacgactggtatgaaacttctgctcacctatggttggttttagagtactgtgttggaggggatctgctttccatattacgacaggatagtcaacttcctgaagattcggttcatggttttgcttataatctagtcaaagctttgcagtttttacattcaaatgaaataatatattgtgacctgaaaccttcaaacatcctactagatgaaaacggatgtgcaaagctatgtgattttggattggcgaggaagttgaaagatatatcaaaagctccttcttcctcgttaccgcgagcaaaacgtggaacaccctcttacatggctccggagctttttgaggatggtggagtccattcttatgcttctgatttctgggcactaggctgtgtactatatgaatgctatgctgggaggccaccctttgtgggaagagaattcacccagcttgtaaaatccatcatttcagatccgactccacctctccctggtaatccaagtcggccttttgtcaatttaattaattccctgttggtaaaagatccagctgaaagaatacagtggcctgagctttgtggacatgccttttggagaaccaaatttactctgttgcctctgcctgctcaacctgcctttgatgatatgatagagctacatgctaaaccatgcttatcagaacgtaatggagataaatcttcgcataacaggacccctaccaaatatcgtgaaaaagatgtcaaaggggcgttgagaaaggatgagaactctgttttaggatctagaggcattgagacaccagcaagggcaacaccaattggccacagaactcagacaaagggttctggcagaatacatgaggtaaagcaaaaagataattctaacattagcaagggtgtgaatcttttgagactgtcaagaatagcaaaaacaaatttacagagagaaaatgagaaggaaaactatcgacgccccttgcctaataactctgagaatgattctgaagttaaaattgagaacactgacatggaacttgattttaacgagaatactgaagatgatgcgcatgaagaaactgatggcaccgaacaaacaactcctgtgcctgatgagaaaacagacaatcattttctgaaccagggaaaagcagaggagattgaaaataatacacaccagttggacaccccatctgttgttcaccctccagtctcggatgacccaaggtcatttgatcatgaatcaactcctgaccttcctgacatatctgctatttctcccagtgtgagccctcaggtgaagaagcatagaactaaagaagacgcaggatcaggccttgacttcgatttttcaaggttgtctaacaacctttcccaggttctttggcatccatctgatctctcagtcagacctgtaatgcctagcagaaaaattgataaagcctcagaagtcattccttcactcccttttgaggcattgcaagcatctgattttgtcaagatgcccaaagagaaattggaggcaatccacaaccgaatattatccattttgaatggaaataccagcattggagagaaacagaatgtgattaggtaccttgagatgttgagcagtaatgctgatgcagctaatatcttgaccaatgggccaataatgctcatgcttgtaaaattgcagcgtcaatccaaggcatcagctttgcgtgttcaacttgcttcactgattggtctgttgattaggcactccacctttgttgatgacagtttggctagttctggaattttaggtgcactgactgatggccttagagacaggcaggaaaaagtaaggaggttctccatggctgctttgggtgagttactattttatatatccactcaaaatgcggactgcagggataacaatcaacttgaatctccatcaaaggacaataggactacacatggctggcaggttccaaattcattaatatcacttgtgtcatcaatgttgcggaagggagaggatgatataactcaattgtatgcattgagaacaattgagaatatttgcagtcaaggaggttcctgggtggggcgtttgtccagtcaatatgttattagtaatctctgctatatctatagggcctcagggaaacaagagagtatgaggctcactgcaggatcatgcttggtgcgcttagttcgttttaatcctcctagcattcagttggttattgagaagctctcattcaaggacctagcttctgctcttgtcaagggcagtccacgagagcagcaaatcagcttaaatcttcttaacatggcaatgcttggaagtcacatgttcacaaatattggaagatgccttgtatcacttgctgaggataaaaatctgatcccaagtcttttgggtcttgtcgagcaaggtagtgaagttttaagaggaaaggcactagtccttgtggccctcctctgtaagcatggcaggaggtggcttccacacttcttttgtagccaaaagttactctctgtggtggataggttgggaaaagagaaggatgcttatgtgaggcagtgtttggatgcatttgtgcatattgtggcatccagtattccaggtttattggatataataacaggggatgtccagcaaatgatgggaggaaggcgccaaggacacatctctgcccttaccagcagatctgccccaaaaaccagcattcatttgtttcctgttgtccttcatcttcttggaacttctacttttaagcacaaagtagtcacaccgcaagtcttacggcagttagcgaatttaattaaactcgtggagacaccgtttcagggaagagatgacttccaaataacccttcttcgaattttcgagtctctcacagaggaatctcctgtgattcttggtaatcctgacattttcatacgtgaaatcctccctagttcgacagttctctacaaggggaacaaggacggtgatgccagatttttgtgccttaaaattctttttgatgtgatgatcattcttttgagtgaaccaattgaagaagagcatagattgaaggatctgaaattcgtatcaaatacccattttcttcctctctacccaaccttgattgaagatgaagatcctattcctatctatgcacagaagcttcttgtcatgctaatggagttcagttttattacaattcctgacattctacatctgaagacaatttcacaatgctttgagttcttgctgggtgatctctcaaatgcaaatgtgaataatgttaagctgtgtcttgctctggcttctgctcctgagatggagtccaaattactctctcagttaaaggtggttaggaggattggcaactttcttgagtttgtatatgcaaagggtatggaagatttgctggatccaactcttgggctgtgtaaggcttttctagcacgttcagtcagctgcacaaaaggcttcagctacacaacagaaccaattctcttaggtgactgtcctcctgagttgagtggtggtgctgttgatccccagcaatgcataaaagatatagcagactttggaagcaatgtcggtgtcttactagagttgagtgcctctgcagaaaccagtattgctgatatagcttctgaatgtgttgtcttactgctcaaggcagctcctagagaagccacgactggtatactaaccaatctccccaaggtgactgtgatcctagagagctggaatagaggcattcctcacttgatggtccagcgaatgcttcacgctttaggttatgcttgcaagcaatacttactgcatgcaatgatattatcaatatccaaacctgagatttcaagaactgaagtcatagtttctgaactcaaaagttcaggtggatcagctttagccaaaacagctgggctggcagccttggaattgcagcggttgcctcgctgcatttgaataattgtaggtatcatgttcctctcattagagctgtaacttttctagttcaacgtttacccttatatttcggctcttattaaattcctgataaaggttgagcaatttggtgaattccactcaggcttcactgtatttctatgtaaagcatgtgtactctatatcttcgtggtgaacattaaaatataagtcaacgaattttttcctcctaaatttttctataaattgattcttgtccatgtaatataggctcctttcattaagttaaacactaacgtattttacaagtataaagttacccaggaaaaacccttaaatggagtgaaactgcatgcatatgaatatgattgagattcctatttgataggtaccatggtacacaattacacatacttccaagacagaaagattgtcagctatgtaagaaggattatttcaataattgctgctcaagcaacaaaaatgtccagcctagccacctttatgctcataggaatgttcgtcacgagacaacctcgcgttaaaaaatcaacatttaccatgcaaaatagtaacatgaagacagatga

SEQ ID NO: 6295 - DNA, 4307 bp, Lupinus angustifolius
catccctcactcaccatgaaccagtaccacatctacgaagccattggtcgcggaaaatactcgaccgtgtacaaaggtagaaagaagcagacaattgaatatttcgccatcaaaagcgtcgataaatctcagaaaaacaaggtgcttcaagaagttaggattcttcactctttggatcaccaaaatgtgctcaagttctattcctggtatgaaacttctgctcacctatggttggtgttggagtattgtgttggaggagatttgctttccatattacggcaggacactcaacttccagaagactcagttcatgatcttgcttttgacctagtcaaggctttgcagtttttacattcaaatggaataatatattgtgacctgaaaccatcaaatatcctactggatgaaaatggacgtactaagctatgtgatttcggtttggctagaaagttaagagatatatcaaaagctccatcttcgtcgttgcctcaagcaaaacgtggaacaccgtcttacatggctccggagctttttgaggatggtggagtccattcttatgcttctgatttctgggccctagggtgtgtactatatgaatgttatactgggaggcctccctttttgggaagagaattcactcagcttgtaaaatccattatttcagatccaactccacctctccctggcaatccgagtcgaccttttgtcaatttaattaactctctgctggtaaaagatccagctgaaagaatacagtggcctgagctttgtggacatgcattttggagtaccaaattgactatggtgcctctacctgctcaacttgcatttgatgatatgatagaactacatgctaaaccatgcataccagaaaggaatggtgataaatcttcccataacaagacccctcccaaatatcgtgaaaaagatgtgaagggggtgatgaagaaggatgaaaattccattttaggttctagaggcattgagacaccaacaagggcaacaccaaatggccacagaactcaggcaaaggtttctggcaaaatagctgaagcgaagcagaaaggtccttccaaaattagcaaggttgtgaatcttttgagactgtcaagaatagccaaatcaaatttgcaaaaagaaaatgagaaggaaaactatcgacgccccttgcctaacaactctgaaaatgactctgaagttaaaattgagaacactgacatggaacttgattttaatgagaacactgaagatgatgcacctgaagaaactgatggcttagaacatacaacttccatacctgatgagaaaatggacaatagtgatcagaaacagggtaaaatagaagagactgcaaataatatacaccagttggacactccatccattgttaacacacctgtttcacatgatccgaggtcagttgatcaagagtcaacacctgattattctgatatatctgctatttctcccagtgtgagcccacaggtaaagaaacatagagttaaagaagaagcaggatcaggccttgactctgaatcttcaaggtcgtctaacaatctctctcaagttctttggcatccatctgatctctcagtcagacctgtaatgcccagcagaaaagttgataaagtctcagaagtcattccttcacttccttttgaggctttgcaagcatctgattttgtcaagttgcctaaagagcaattggacgcaatcctaaacaggattattgccattttgaatgggaatgccagcattggagagaaacagaacttggttaggtaccttgagctgttaagcagtaatgctgatgcagctaacatattgaccaatggaccaataatgctcatacttgtaaaattgcttcgccaatctaaggcattagccttgcgtgttcaacttgcttcactgattggtttgttgattcggcactccacttttgttgatgacagtttggctaattctggaattttaggttcactgactgatggccttagagacaagcaggaaaaagtgaggaggttttccatggctgctttgggtgagttgctattttatatatcgactcaaaatgcggattgcagggataacaatccacttgaatctccatcaaaagacaataggacttcggttggctggcaggttccaaattcattaatatcttttgtgtcgtcaatgttgaggaagggagaggatgatttgactcaattatatgcattgagaacagttgagaatgtttgcagccaaggaggaacctgggtggggcgtttgagcagccaagatgttatcagtaatctctgctatatctatagggcgtcaggaaagcaagagagcatgaggcttactgcagggtcatgtttggtgcgcttggttcgttttaatcctcctagcattcaatcagtcatggagaaactgtcattcaaggacctagcttctgctcttgtcaagggtagtccacgagagcaacaaatcagcttaaatcttctaaacatggctatgcttggaagtcacatgttcacaaatatgggaagataccttctaccacttgcggaggataaaaatctgatcccaagtcttttggcttttgtggagcagggtagtgaagttttaaaaggaaaggcacttgtccttgtggctctcctctgtaagcatggtaggaggtggctttcactcttcttttgtagccaaaagttactttctgtggtggacaggttgggaaaggagaaggatgcctatgtacatcagtgtttagatgcatttgttcatgttgtggcatctactattccaggtttactagatacaataacaggtgatatccagcaaatgatgggaggaaggcgccaagggcatgtctctgcccttaccagcagatctgctccaaaaaccaacattcatgtgtttcctgttgtccttcatcttattgggagttcaattttgaaacacaaagttgttacccctcatgtcttgcaacagttagccagtctaatcaaactaacagagacaccgtttcagggaagagatgacttccaaataacccttcttcgagttttggagtgtctcacagaggaatctcttgtggttcttggaaaccctgacattttcgtacgtgaaatccttcctagcttgacagttctctataagggtaataaagatggtgatgccagatttttgtgccttaaaattcttttcgatgtgatgattattgttttgagtgaaccggttgaagaagagcagagattgaaagacctgaaattcatatcaaatgcccgttttcttcctctctacccaaccttgattgaagatgaggatcctattcctatctttgcacaaaagcttctggtcatgctactggagtttaattttattacaattcaggacattttacatataaagacaatttcacaatgctttgagttcttgcttggtgatctgtcaaatgcaaatgtgaataatgttaagatctgtctagctctggcttctgctcctggaatggaatccaagatactctctcaactaaaagtggttaggaggattggtaattttctcgagtttgtatatgcaaagggtatggaagatttgctggaaccaactcttgggctgtgtaaggcttttctagcgcgttccgttacatgtgcaaaaggcttcaattactcaacagaaccaactctcctatgtgacaatccttctgagatgagtggtgctgttgatccccagcaatgcataagagatatagcagatcttgcaagcaatgttggtgtcttgctagagttgagtgcctccattgaaaccaatattgtggatatagcttctgaatgtgtagttttactgctcaaagcagctcctagagaagccaccactggtctactaaccaatttacccaaggtcagtgtaatcctagagtcctggagtagaggcacccctcacttgttggtgcagcgaatgctacatgctttagggtatgcatgcaaacagtacttattgcatgctatgatattatcaatatccataccagagatttcaagaattgaagtgattgtttctgaactcaaaagttctggtgttcctggtttaaccaaagctgctacattagcagcattggaattgcagcggctacctcgctgcatttgaatgattgtaggtctttctgaattctggatgaaggcaatttggtgaattccactcggcttcactgtacttttatgtaaagtatgcttacactgtatcttccttaacattgaaatataaatcaaggaattttcccaacctaaaatttgcataattgatgagtttgatttatcacactagca

SEQ ID NO: 6296 - DNA, 4484 bp, Cicer arietinum
cgctctacgataatctctctctaacttcaatcttcgcacttcgatcactcttttatcttttttttttatttttttatttataatttttctggtgaattcgcagaccgtgtacaaaggcaggaagaagaagaccattgagtatttcgccatcaaaagcgtcgataagtctcagaaaaccaaggttcttcaagaagtcaggattcttcacactttagatcaccaaaatgtgctcaagttttattcatggtatgaaacttctgctcacctgtggttggttttggagtattgtgttggaggggatctactttccatattgcggcaggatagtcagcttcctgaagattctgttaccgaacttgcttgtgaccttgtcagagctttgcagtatttacattcaaatggaataatttattgtgacctgaaaccatcaaatattctactagatgaaaatggatgtggaaagctctgtgatttcggtttggccagaaagctaaaagagatatcaaaagttccttcttcctcgttgcctcaagcaaaacgtggaacaccctcttacatggctcctgagctttttgaggatggtggagtgcattcttatgcttctgatttctgggctttaggctgtgtactatatgaatgttatgctgggaagcctccttttgtaggaagagaattcactcagcttgtaaaatccatcatttcagatccgactccacctctccctggcaatccaagtcgtccttttgtcaatctaataaattctctgttggtcaaagatccagctgaaagaataaaatggcctgagctttgtggacatgccgtttggaaaactaaattcactctagtgcctcttcctcctcaacctgcatttgattatatgatagagctacatgctaaaccatgcttatcagaacgtaatggagataaatcttctcataataggacccctcccaaatatcgtgaaaaagatgtgaaagggatgctaaagaaggatgaaaattctggtttaggatctagaggcattgagacaccaacaagggcaacaccaaatggtcacagaacacagacaaagggttctggccgaacaattgaggtgaagcagaaagattcttccattattaacaagggtttgaatcttttgagactatcaagaatagcaaaatcaaatttgcaaaaagaaaacgagaaagaaaattatcgacgtcccttgcccaatggctctgagaaggataccgatgttaaaattgagaacaccgacatggaacttgattttaacgagaatagtgaagaggatgcacttgaagaacctgatggttctgaacatacaccttcggtgcccaatgagaaaatggagattaattttcagaatcagggaaaagtagaggagactgagaacaatatacaccggttggacaccccatctgttactactcctgcctcaaatgatccaaggtcatttgatcacgagtcaactcctgacagttctgacatatctgttatttctcctagtgtgagccctctagtgaagaaacagagacctaaagaagacttaggatctggctttgactctgattattcgagatcgtctaacgacatctcccaggttatttggcatccatctgatctctcagtgagacctgtaatgcccagcagaaaagttgacaaaggcttagaagtcattccttcacttccttttgaggcgttgcaagcacctgattttgtcaagatgcctaaagagcaactggaggcagtccttaaccgaattatagccatcctgaatgggaatactagcattggagagagacaaaatgtggttaggtacctcgagatgttgagcagtaatgctgatgcagccaatatcttgaccaatgggccaataatgctcattctcataaagttgctgcgtcaatccaaggcatcagctttacgtcttcaacttgcttcactgatcggtctgttgattagacactctacttttgttgacgacagtttggctaactctggaattctaggttcactgactgatggccttagagacagacatgaaaaagtgaggaggttttctatggctgctttgggtgagttgctattttatatatccacccaaaatgcggactctaaggatagcactccacttgaatctccatcaaaggacaataggactgcgaatggctggcaggttccaaattcattgatttcttttgtgtcatcaatattgaggaaaggagaggatgatattactcaattgtacgcattgagaacaattgagaatatttgcagtcaaggaggggtctgggtgggacgtttggccagtcaagatgttattagtaatctctgttatatctatagagcggcaggaaaacaggaaagtatgaggctaactgcaggatcatgtttagtgcgcttagttcgttttaatcctcctagcgttcagtctgttatagagaaactctcattcaaggacctagcttctgctcttgtcaaaggaagtccacgagagcagcaaatcatcttaaatcttcttaacatggcaatgcttggaagtcatatgttcacaaatgttggaagattcgttgtaccacttgcagaggagaagaatctgatcccaagtcttttggctcttgttgagcagggtagtgaagttttaaaaggaaaggcacttgtctttgtggctctcctctgtaagcacggtaggaggtggcttccacagtttttttgtagtcataagttactttcagtggtggacaggctgggaaaagagaaggatgcctttgtgcggcagtgtttagatgcatttctacatattgtggcatctacaattccaggtttacttgatataataacgggggatatccaacaaatgatgggaggaaggcgccacggacatatctcttcccttaccagcagatctgctccaaaagctaacattaatttgtttcctgttgtcctccatcttctcgaaagttcagcttttaagcacaaagtggcaacatttccagtgctacggcagttggcgaatctgattaaactcgtggaggctccgttccagggaagagacgagttccaaataaccctgcttcgaattttagagtctctcacggaggaaacttctgtgatccttggcaatcctgacattttcatacgtgaaatccttcctagtttgacagttctctacaagggtaataaggatggtgatgccaggtttttgtgccttaaaatatttttcgacgtgatgattattctcttgagcgaaccaattgaagaggagcaaagattaactgatctgaaattcgtatcaaatacacattttcttcctctctacccaaccttgatcgaggatgaagatcctattcctatctttgcacagaaacttcttgtcatgctactagagttcagttttatttcgattccagacattctacatctgaagacaatttcacaatgctttgagttcttgcttggtgatctgtcaaatgcaaacgtgaataatgttaagctgtgtcttgctctggcttctgctcctgaaatggaatccaagttgctctctcaattgaaagtagttaggagaattggcaactttcttgagtttgtatgtgcaaagggtatggaagatttgctggaaccaactcttgggctatgtagagcctttctagcacgttcagtcagctggacaaaaggcttcagctatacaacagaaccaactctcttacgtgattgtcctcctgaggtgtgtggcgccgttgatccccaacaatacataagggatataacagactttggaagcaatgttggtgtttttctagaactgagtgctttgagagagaccagtattgctgatatagcttctcagtgtgtggttttactcctcaaggctgctcctagagaagcaaccactggtctactaaccaatttgcccaaggtcactgtgatcctagaatcttggagtaaaggaatccctcacttaacggtgcagagaatgcttcatgctttaggttatgcttgcaagcagtacttattgcatgcaatgatattatcaatatctataccagagatttcaagaattgaagtggtagtttctgagctcaagagttcaagtgtgcctgctttagccaaaactgctggtttggcagccttggaattgcagcggctacctcgctgcatctgaatgttggtatcatgttgtgattgtcctgttctatttttttgataatatgattgtcctgttctagttgaattcctgatagaggttaagcattttggtgaaattccactcaggcttcattgtacttgtatgtaaaaagtatgtgtactatgtatcttcatgaacactagcatataaatcaatgagttcccctcctccccaccctagatttttctggttgaatttcctgatttttatctatccgtgtaatagaaaattaatgtgattataataaaaaattgcttagctcaaatttctttcagtaatttaaaaaagaagaaac

SEQ ID NO: 6297 - DNA, 4161 bp, Cajanus cajan
tctctctcatgttcctccgcaacatttgaaatctgcgaagaaaaaccctatcgagatgaaccaataccacatctacgaagccatcggtcgcggcaaacactccaccgtttacaaaggcaggaagaagaagactatcgagtatttcgccatcaaaagcgtcgataaattacagaagactaaggtccttgaagaggtcaggattcttcacacattggatcatgtaaatgtgctcaagtttcatgaatggtatgaaacttctgctcacctatggttggttttggagtactgtgttggaggggatctgctttccatattacaacaggatagtcaacttcccgaagactcggttcatgatcttgcttatgatctagtcaaagctttgcaatttttacattcaaatggaataatttattgtgacctgaaaccatcaaatatcctgttagatgaaaatggatgtgcaaagctatgtgattttggattggctaggaaattgaaagatatatcaaaagctccttctcccttgttgtcatcgcgagcaaaacgtggaacgccctattacatggctccggagctttttgaggatggtggagtccattcttatgcttctgatttctgggccctaggctgtgtactatatgaatgttatactgggaagcctccctttgtggcaagagaattaactcagcttgtaaaatcaatcatttctgatccgactccacctctccctggtaatccaagtcgaccttttgtgaatttaattaattccctgttggtaaaagatccagctgaaagaatacattggcctgagctttgtggacatgccttttggagaaccaaatttactctggtgcctctgcctgctcaacctgcatttgatgatatgatagggctacatgccaaaccatgcttatcagaacaaaacgagaaggaaaactatcgacgccccttgcctaataactctgagaatgattctgaagttaaaattgagaacactgacatggaacttgattttaacgagaatactgaagatgatgcgcatgaagactctgatggcgctgaacaaacaactcctgtgcccagtgagaaaatggacaatcatttccttaatcagggaaaagtggaggagattgaaaataatacacaccagttggacaccccatctgttgttaacactccagcctcagatgatcccaggtcatttgatcatgaatcagctcctgactgtcctgacatatccgctatttctcccagcgtgagtcctcaggtaaagaaacatagaggagttaaagaagactcaggatctggccttgaatctgattcttcaaggttgtctaacaacctttcccaggttctttggcatccatctgatctctcggtcagacctgtaatgcctagcagaaaagttgataaagtcttagaagtcattccttctctcccttttgaggcattgcaagcatctgattttgtcaagatgcctaaagagcaattggaggcagtcctcaaccgaatattagccattttgaatggaaataccagcattggagagaaacagaatgtgattaggtaccttgagatgttaagcagtaatgctgacgcagctaatatcttgaccaatgggccaataatgctcatgcttgtaaaattgctgcgtcaatccaaggcatctgctttgcgtgttcaacttgcttcactgatcggtctgttgattaggcactctacttttgttgatgatagtttggctaattctggaattttaggtgcgctgactgatggtcttagagataggcaggaaaaggtgaggagattctccatggctgctttgggtgagttactattttatatatccactcaaaatgcggatggcaaggataacagtcaacttgaatctccatcaaaggacaataggactacgtatggctggcaggttccaaattcattaatatcatttgtgtcatcaatattgagaaagggtgaggatgatataactcaattgtatgcattgagaacaattgagaatatttgcagtcaaggagggttctgggtagggcgtttgaccagtcaagatgttattagtaatctctgctatatctatagagcggcagggaaacaagagagtatgaggctcactgcaggatcatgtttggtgcgcttagtccgttttaatcctcctagcattcagtcggttatagagaaactctcattcaaggatctagcttctgctcttgtcaagggcagtccacgagagcaacaaatcagcttaaatcttcttaacatggcaatccttggaaacacgttcacaaatattggaagatatcttctaccactcgctgaggataaaaatctgatcccaagtcttttggctcttgtcgagcaaggtactgaagttttaagaggaaaggcactagtccttgtggctctcctgtgtaaacatggcaggaggtggcttccacactttttttgtagccaaaagttactttctgtggtagacaggctgggaaaagagaaggatgcctatgtgaggcaatgtttggatgcatttgtgcctattgtggcatccagtattcctggcttactggatataataacaggggatgtccagcaaatgatgggagcaaggcgccacggacacatctctgcccttgccagcagatctgcttcaaaaaccaacatccatttgtttcccgttgtccttcatcttcttggaagttcaacatttaagcacaaagtcgtgacaccacaagtcttacggcagttagcgaatctaatcaaactcgtggagacaccgtttcagggaagagatgacttccaaataacccttcttcgaattttcgagtctctcacagaggaatctcctgtgattcttggcaatcctgacattttcatacgtgaaatcctcccgagtttgacagttctctacaagggtaacaaggatggtgatgccagatttttgtgccttaaaattctttttgatgtgatgattgtacttttgagtgaaccaattgaagaagagcaaagattgaaggatctgaaattcatatcaaatacccgttttcttcctctctacccgaccttgattgaagatgaagatcctattcctatctatgcacagaagcttcttgtcatgctactggagttcagtttcatcacaattccggacattcttcatctgaagacaatttcacaatgctttgagttcttgcttggtgatctctcaaatgcaaatgtgaataatgttaagctgtgtcttgctctggcttcagctcctgagatggagtccaaaatactctctcatttgaaagtggttaggaggattggcaactttcttgagtttgtatatgcaaagggtatggacgatttgctggaaccaactcttgggctgtgtagggcttttctagcacgttcagtcagctgtaccaaaggcttcagctacacaacagaaccaactctcttaggtaagtgtcctcccgagttgagtggtggtgctattgatccccaacaatgcataaaagatatagcagactttggaagcaatgttagtattttgcttgagttgagtgcctccacagaaaccaccattgctgatatggcttctgaatgtgtcgtattactgctcaaggcagcacctagagaagccaccactggtatactaaccaatctccccaaggtcactgtgatcctagagacctggaatagaggcattcctcacttgatggtgcagcgaatgcttcatgctttaggttatgcttgcaaacaatacttgctgcatgcaatgatattatcaatatccataccagagatttcaagaattgaagtcatagtttctgaactcaaaagttcaggtgtaccagctttagccaaaacagctgggctggcagccatggaattgcagcggcttcctcgctgcatttgaataattgtaggtttcattttgtgccctgttcctctcattagaatctgtaacttctgtagttcaccgtttacccttatttcaggtcttattaaattccagataaaggttgatcaatttggtgaattccacccaggcttcactgtatttctatgtaaagtatgtgtactttatatcttcgtgaacattaaaatataagtcaactaattttttcatctccaaggtttttccttaaattgattaagctagaattt

SEQ ID NO: 6298 - DNA, 4529 bp, Medicago truncatula
aattaaaccgcccgttagaacacacagacactctctctctctctctctctctctcttcatctattctacacacacaaccccagcatttgaaatcgacgacgaagccatcatgaaccagtaccacatctacgaagccattggtcgcggaagatactcgactgtttacaaaggtagaaagaagaagacgatcgagtatttcgcaatcaaaagtgtcgataaatctcagaagaacaaggttcttcaagaagttaggattcttcacactttagatcaccaaaatgttctcaagttttattcatggtatgaaacttctgctcacttatggttggtcttggagtattgtgttggtggggatctactttctatattacggcaggatagtcaacttcctgaagattctgttaatgaacttgcttgtgaccttgtcagagctttgcagtatttacattcaaatggaataatttattgtgacctgaaaccatcaaatatcctactagatgaaaatgggcgtacaaagctctgtgatttcggattggccagaaggttgaaagagatatcaaaagttccttcttcctcgttgcctcaagcaaaacgtggaacgccctcttacatggctccggagctttttgaagatggcggagtccattcttatgcttctgatttctgggctctaggatgtgtactgtatgaatgttacactgggagacctccttttgtgggaagagaattcactcagctcgtaaaatccataatttcagacccgactccacctctccctggcaatccaagtccaccttttgtcaatttaataaattcactgttagtcaaagatccagctgaaagaatacagtggcatgagctttgtggacatggcttttggaaaaccaaattcactctagtgtctcttcctcctcaacctgcgtttgatgatatgactgagctacatgctaaacaatgcttatcagaacgtaatggagataagtcttctcataacaggacccctcccaaatctcgtgaaaaagacgggaaaggggcaagagccattgagacaccaacaagagcaacaccaaatggacacagaactcagacaaagggttctggcagaacagttgaggcgaagcagaaggatccttccattattaaaaaaggtttgaatcttttgagaatgtcaagaatagcaaaatcaaatttacaaaaagaaaatgagaaagaaaactatcgacgtcccttgccaaatggctccgagaaagatgtcgatgttaaaattgagaacactgacatggaacttgattttaatgagaataatgaagaggacgcacttgatgaaaatgatggttctgaacatacaccttctgtggccaatgagaaaatggagagtaattttcagaatcagggaaaagcagatgacactgaaaatgatatacaccggttggacaccccatctgtgactactcctgcctcagatgattcaaggacgtttgttcatgagtcaactcctgaccgttctgacatatctgctatttctccaagtgtcagccctctagtaaaaaaacagaggcttaaagatgacttaggatctggtcttgactctgattcttcaagatcctctaacgacatctcccaggttagttggcatccatctgatctctcagtcagacctgtaatgcccagcagaaaagttgacaaaggctcggaagtcattccttcacttccttttgaggcgttgcaagcacctgaatttgtgaagatgcctaaagagcaactggaggcactccataaccgaattatagccatattgaacgggagtactgccattggagagaaacaaaatgcggttaggtaccttgagatgttgagcactaatgctgatgcagccaatatcttgaccaatgggccaataatgctcattctcataaagttgctacgtcaatccaaggcatcggctttacgggttcaacttgcttcgctgattggtctgttgattagacactctacctttgttgatgacagtttagctaattctggaattctaggttcactgacggatggtcttagggataggcaagaaaaagtgaggaggttttccatggctgcattgggtgagttgctattttatatatccacccaaagtgcagattccagggataacactccgcttgaatctccatcaaaggacaataggaccgcgcatggttggcaggttccaaattcattaatttccttggtatcatcggtattgaggaaaggtgaagatgatataactcaattgtatgcattgagaacaatcgagaatatttgcagtcaaggaggggcctgggtgggacgtttgatcagtcaagatgttattagtaatctctgctatatctatagagcggtagggaaactggaaagcatgaggcttactgcaggatcatgtttggtgcgcttagttcgttttaatcctcctagtattcagtctgttatagagaagctctcattcaaggacctagcatctgctcttgtcaaaggcagtccacgcgagcagcaaatcagcttaaatcttcttaacacggcaatgcttggaagtcacatgttgacaaatgttggacgataccttatgcaacttgcagaggataagaatctgatcccaagtctattggcttttgttgagcagggtagtaaagttttaaaaggaaaggcacttgtctttgtggctctcctctgcaagcacggtaggagatggcttccacagttcttttgtagccataagttactttcagtggtggacaggctgggaaaagagaaggatgcctttgtgcggcagtgtttagatgcatttctacatattgtggcatctactattcctggattactggatataataactggggatatccagcaaatgatgggaggaaggcgccatgggcatatctcttcgcttaccagtagatctgctccaaaatccaacattcatttgtttcctgtagtccttcatcttcttgaaagttcagcttttaagcacaaagtggcgacacttcctgttctacggcagttggcaaatctgattaaactcgcggaggcaccgtttcagggaagagacgacttccaaataacccttcttcgaattttagagtctctcacggaggaatcttctgtgatccttgcaaatcccgacattttcttacgggaaatcctccctagtttgacagttctctacaagggtaacaaggatggtgatgcgagatttttgtgccttaaaatctttttcgatgttatgattattctcttgagtgaaccaattgaagaagagcaaagattgaacgacttgaaattcgtgtcaaatacacattttcttcctctctacccgaccttgatcgaagatgaagaccctattcctatatttgcacagaagcttcttgtcatgctactggagttcagttttatttcaattccagacattctacacctgaagacaatttcacaatgttttgagttcttgcttggtgatctgtcaaatgcaaatgtgaataatgttaagctgtgtcttgctttggcttctgcccctgaaatggagtccaaattactttcccagttgaaagttgttaggaggatcggcaacttccttgagtttgtatgtgcaaagggtatggaagatttgctggagccaactcttgggctgtgcagagcctttctagcacggtcagtcagctgtacaaaaggcttcagctacacaacagagccaactctcttaggtgacagtcctcccgaggtgagtggcgctgttgatccgcagcaatgcataagagatataacagactttggaaacaatgttggtgtctttctagagttgagtggatctagagagaccagtgttgctgatatagcttctcagtgtgtggttttactgcttaaggctgctcctagagaagcaaccactggtctactaaccaatctccccaaggtcaccgtgatcctagaatcctggagtaaaggcacccctcacttaacggtgcagagaatgcttcatgctttaggatatgcttgcaagcaatacttattgcatgcaatgatattatcaatatctataccagagatttcaagaattgaagtgatagttactgaactcaagagttcaagtgtgcctgctttagccaaaactgctggattggcagccttggagttgcagcggttacctcgctgcatttgaatttgaataattggtggtatcatgttatgattgtccagttcttttttgacaatatgattgttcttattctggtcagccttggagttgcagcggttacctcgctgcatttgaatttgaataattggtggtatcatgttatgattgtccagttcttttttgacaatatgattgttcttattctggttattggaatttgtaacttctctactgttcaggtaatagtaaattccttataaaggttaaacattttggtgaattccactcaggcttcactgtacttctatgtaaagtttgtgtactctgtatcttggtgaacattcatatatgaattaacgaattcccc

SEQ ID NO: 6299 - DNA, 4645 bp, Lupinus angustifolius
tctctcgttgttcattttcttccacatacatacatcattcaccatttgaaatcttcgaaaaaaccctacaagttcaaagatcctcactcgccatgaaccaataccatatctacgaagccattggtcgcggaaaatactctactgtgtacaaaggtaggaagaagcagacaattgagtatttcgccatcaaaagcgtcgataaatcacagaaatccaaggtccttcaagaagttaggattcttcactctttggatcaccaaaatgtactcaagttctattcctggtatgaaacttctgctcacctatggttggtattggagtattgtgttgggggagatctgctttccatattacggcaggacactcaacttcctgaagattcagttcatgatcttgcttttgacctagtcaaggctttgcagtttttacattcaaatggaataatatattgtgacctgaaaccatcaaatatcctactggatgaaaatggacatacgaagctatgtgattttgggttggctagaaagttaagagatatatcaaaagctccttcttcctcgttgcctcaagcaaaacgtggaacaccctcttacatggctccagagctttttggggatggtggagtccattcttatgcttctgatttctgggccctgggctgtgtactatatgaatgttatgctgggaagcctccctttgtgggaggagaattcactcagcttgttaaatccattatttcagatccaactccccctctccctggtaatcctagtcgaccttttgttaatttaattaattctctgctggtaaaagatccagctgaaagaatacagtggcctgagctttgtggtcatgcattttggagaaccaaattgagtggatgcctctgcctgctcaacctgcatttgatgatatgatagagctacaagctaaaccatgcttatcagtacggaatggtgataaaccatctcttgacaggacccctctcaaatatcgtgaaaaagatgtgaaagggcgcattgagacaccaacaagggcaataacaaatggccacagaactcagacgaaaggttctggcaaaacagttgaggtgaagcagaaaggtccatccaaaataagcaaggttgtgaatcttttgagactatcaagaatagcaaaatcaaatttgcaaaaagaaaatgagaaggaaaactatcgacgccccttgcctaataactctgagatagactctgaagttaaaattgagaacacagacatggaacttgattttaatgagagcatcgaagatgatgcacctgaaaaaactgatggctcagaacatgcaacttctgtacctgatgagaaaatggacaatcatgatcagaaacagggtaaaacagatgagtttgaaaatgatatacaccagctgggcacttcacctgttgttaacacacctgtttcaaatgatccaaggtcatttgatcatgagtcaactcctgattatcctgacatatctgctatttctcccagtgtgagccctcaggtgaagaaacatagagttaaagaagaagcaggatctggccttgactctgattcttcaaggtcgtctaacaacctttctcaagttatttggcatccatctgatctctcagtcagacctgtaatgcccagcagaaaagttgataaagtctcagatctcattccttcacttccttttcaggctttgcaagcagttgattttgtcaagttgcctaaagagcaattggaggcaatccaaaacagaattttagccattttgaatgggaataccagcattggagagaaacagaatttgattaggtaccttgagatgttaagcagtaatgctgatgcggctaacatattgaccaatggaccaataatgctcatacttgtaaaattgcttcgccaatccaaggcatcagctttgcgtgttcaacttgcttcactggttggtctgttgattcggcactccacttttgttgatgacagtttggctaattctggaattttaggttcactgactgatggccttcgagacaggcaggaaaaagtgaggaggttctcaatggctgctttgggtgagttgctattttatatatcgactcaaaatgcggattgcagagataacaacccacttgaatctccattaaaagacaataggacttcggttggctggcaggtttcaaattcattaatatcttttgtgtcatcaatgttgaggaagggagaggatgatttaactcagttgtatgcattgagaacagttgagaatttttgcagccagggagggacctgggtaggacgttttagcagccaagatgttatcagtaatctctgctatctctacagggcggcagggaaacaagagagcatgaggcttactgcaggatcatgtttggtacgcttggttcgttttaatcctgctagcattcaatcagtcatggagaaactctcattcaaggacctagcttctgctcttgtcaagggcagtccacgagagcagcaaatcagcttaaatattctaaacatggctatgcttggaagtcacatgttcacaaatattggaagacaccttctacccctcacagaggataaaaatctgacccaaagtcttttggcttttgttgagcagggtagtgaggttttaaaaggaaagtcacttgtccttgtggctctcctctgtaagcacggtaggaggtggctttcacacttcttttgtagcagaaagttactttctgtggtggacaggctgggaaaagagaaggattcctatatacggcagtgtttagatgcatttgtgcatgttgtgacatctaccatcccaggcttactggatacagtaacaggtgatatccatcaaataatgggaggaaggcgccaagggcatatctctgcccttgccaacagatctgctccaaaaaccaacattcatttgtttcccgttgtccttcatcttctcgggagttcaattttgaagcacagagtagttacacctcaagtcctgcggcagttagcaaatctaatcaaactcgtggagacaccatttcagggaagagatgacttccaaataacccttcttcgagttttggagtgtcttacagaggaatctcttgtggttcttggcaatcctgacattttcatacgtgaaatccttccgagcttgacagttctctataagggtaacaaggatgatgatgccagatttttgtgccttaaaacactttttgatgtgatgattattgttttgagtgaaccggttgaagaagaacagagattgggagacctgaaattcatatcaaatgcccgttttcttcctctctacccaaccttgattgaagatgaagatccaattcctatatatgcacagaagcttcttgtcatgctactagagtttagttttattacaattccagacattttacatctgaagacaatttcacaatgctttgagttcttgcttggtgatctgtcaaatgcaaatgtgaataatgttaagctgtgtctggctctggcttctgctcccgaaatggagtccaagttactctctcaattaaaagtggttaggaggattggcaattttcttgagtttgtatatgcaaagggtatggaagatttgctggaaccaactctagggctatgtagggcttttctggcacgttcattcacctgtgcaaaaggcttcagctatacaacagaaacaactctcctaggtgaccatcctactgagatgagtggtgctgttgatccccaacggtccataagagatatagcggactttgcaagcaatgctggtgtcttactggagttgagttcctccaatgaaaccaatgttgcagatatagcttctgaatgtgtagttttactgctcaaggcagctcctagagaagccaccactggtctactaaccaatctccccaaggtcagtgtaatcctagagtcatggagtagaggcattcctcacttatttgtgcagagaatgcttcatgcattagattatgcatgcaagcagtacttattgcatgcaatgatattatcaatatcaataccagagatatcaagaattaaaatgattgtttctgaactcaaaagttcaagtgtgcctggtttagccacagctgctgcgctaacagcctcggaattgcagcggctgcctcgctgcatttgaataattgtaggtatcatgttgctattgttttgttccagttattagaatctgtaacttctgtagtttttcatttacctgtttttaggatcttactggatattctaggtgaaggcaattttttgaattccactcggcttcacggtaccttttatgtaaagtatgtttacattttattttccttcacattgaaatatacatcaaggaatttttacacctagaatttccataaatggatgagtttaatttgtatacattgtcagtgtaaaggagtcttacactagcatataatcaaatttgacaaatcaatatttatcactatttctctcaatttattaaaataaacttacatgttaaatattagtggatgtcagtgtaaaacttgtgtacatctctttaattctacattgctttggcttgaattgcctccaagtaattgtcaagcttagactcaataatttaaacacatgtaaaagaagaaac

SEQ ID NO: 6300 - DNA, 3345 bp, Fragaria vesca
atggggcacagactcaaataattagctaaataattttctagtttcgaattttgagcctctcactaatcgccttcacactcactcaaaccttcttcttcttcccccaacaaactcgccacacttctcaaaaaccctttcctcaatccccacgcaaagctcccgtctttctctcgccggaaaaccccttactctttcccggcgacggcgatggcctccacgaccacctccttcgccgctcccggagtcgtcgctctccgtcttccccagtccaaatgttgcaccaaagcttctctctttcctcacccaaacccctccgtctccctccgcgcccggccccacttcctccgcggactcacttcctgccgattcgacccgaactccccttttcaaaccgggtcgggtcggatgacccggagcccgaaccagtttgttgtgcgcgccatggcttcttcagctggaaggggacagattacgcagcaggattttactgagatggcgtggcaggcggtggtttcgtcgccggaggtggccaaggagaacaagcatcagatagtggagactgagcatttgatgaaggcgttgttggagcagaagaatggacttgctaggaggattttcgctaaggctggggtggataatactcaacttcttgaggctactgataagtatattcagcgccaaccaaagattcttggtgaaactgcgggatcaatgttaggacgggatttggaagccttgcttgagcgagccagggattacaagaaagagtatggagactcatttgtgtctgtggagcatttggttcttggtttcattcaagatcaacgatttgggaagcaattatttaaggaatttcaaatctccaagcaatctttgaagtctgctatagaatccataaggggacgccaatcagttattgaccaagatcctgaggggaaatatgagtcccttgaaaagtacggaaaagatctgacagccatggcaagacaaggaaagcttgacccggttataggaagagatgatgaaatccgcaggtgcatccagattctgtcaagaagaacaaagaacaacccggtgctaattggtgaaccaggtgttgggaaaactgcaatttcagaagggcttgctcagcgtattgtgcaagaggatgtcccacaagctttgatgaatcgtaagctaatctctcttgacatgggttcactaattgctggggcaaaataccgtggagagtttgaggataggctgaaggctgtactcaaggaagtaacagaatctgaaggccagattatcctttttattgatgaaattcacacagttgtcggggcaggagctacaagtggtgcaatggatgctggaaatcttttaaaacccatgcttggtcggggagagttgcggtgtataggtgcaacaacactggatgagtatcgcaaatatattgagaaagatccagcgttggagcgtcgttttcagcaagtttatgttgatcaacctacagttgaggatacaatctcaatactccgaggactgcgtgaaagatatgagttgcatcacggggtccgcatttctgatggtgcacttgtggaagctgcaattctctcagaccgttacatcagtgggagatttttacccgacaaagctatcgacttagttgatgaagctgctgccaaattgaaaatggaaattacatcaaagcccacagcgctagatgagattaatcgttcagtgttgaaacttgaaatggaaagactgtcacttacaaatgacaccgacaaagcatccagagagagattgaaccgccttgaggcggagttgtccgtcttaaaagagaaacaatctcagctgtctgagcagtgggaacatgagaagtctgttatgactcgaattcagtcaatcaaggaagaggttgacagggtaaatctggagatccagcaggctgaacgagagtatgatcttaaccgtgctgctgagctgaagtatgggagtttgaattccttacagcgccaactccttagtgctgaaaaagagctcgatgagtatatcaggtctgggaaatcaatgctgagagaggaagttacgggaaatgacatttctgaaattgtcagcaagtggactggtattcctgtttccaagcttctacagtcagagagggaaaagctcttacatttggaggaagagctgcataaacgtgttgtaggacaggatcctgctgtgaaatcagtagctgaagctattcagcggtctcgagcaggtctctcagatcctcatcgcccgattgctagtttcatgttcatgggccccaccggtgtagggaagacagaactagccaagacccttgcctcctacatgttcaacactgaagaagctcttgttagaattgatatgagtgagtacatggaaaagcatgctgtgtcaagactgataggtgctccacctggctatgtgggttatgaggagggaggacagctgacagaggttgttcgccggaggccatattcagttatcctgtttgacgagattgaaaaggcgcattctgatgtgttcaatgttttccttcaaattttagatgatggaagagtaaccgactcacagggccgcactgtgagtttcaccaacactgtgatcattatgacctcaaatgttggttcacagtatatactaaacggagatgatgacgtctcgccgaaggaattgggttatgaaactataaagcagcgggtgatggaggctgcaaggtccgtatttcgccccgagttcatgaatcgggttgatgagtacatagttttccagcccttggaccgtgatcagataaacaatattgtcaggatacagttggaacgagtccagaggaggattgcagaccgcaagatgaaaatccaagtgagcgatgctgctgtgcagcttcttggaagtcttggatacgatccaaactacggtgctaggccagtaaagcgagtgattcagcaatatgtagaaaatgagcttgccaagggcatcttgagaggagagttccaagaagaaggcaccattttggtcgacacagaggtcacagcgtatggcaacggccagctcccccagcaaaagctagtcttcaagacgcttgagactggttcagaatctcctgcagctgagaacaagggagctttgtcaggcgctgtctgaggctttctattctgcacgccagtatagtttttcaactagtttaaaattatgttctttctcctgtatatgacatttcctttctcctgtacaagcttcaaactatgttataacggtataacctttagttgatataaattaaatataccactctcaccaacttcaagtcctatatgagagtatgagata

SEQ ID NO: 6301 - DNA, 3154 bp, Cocos nucifera
ttcccttctccacctctccgccacgttcacgaacgttcttttccacactctgtagagctggaacctcccggaagctagcaacccgctcccccaacttccgtttttatatattaccaatcccgccatcatccatacccttaacatttcccccaattccctgaacgcccccgtcggaagtagaacaagagagcgatagacctcagcggattccgcaaatggcggcctcgctttccgcccaccagcaccacctcctccgcctcgtccccctgccttcgaagagctccgggaggagcccctccgtggcggcgttgtttcccgtatcctctaatggcccgagatcgcagagcgccctaagggcactcaggtggtcgggaaccctaggtaggagcgaccgcttcgtctcgaagagggctgggaggtctgggagcggttcgaggtcggtcgtcatcagatgtgaagcgtccaaggatgggaggattactcaacaagaatttaccgaaatggcttggcaagcaattgtttcatcacctgaagttgcaaaagagagcaagcatcagattgtggagacagaacatttgatgaaggctttgttggagcagaggaatgggcttgctcgtcgcatcttttccaaggctggaattgataattcccggcttcttgatgctactgataagttcatccagaggcagccaaaggtcctgggtgagacggctggttccatgttaggacgagaccttgaagctttaattcagagagccagggagtacaagaaagagtatggggactcatttgtgtcagtcgaacatctagttcttggttatgctgatgatcggcgctttgggaaacaactatttaaggattttcaaatttcactacaaaccttacaatctgccataaaagctataagaggaaaccagactgttattgaccaagatccagagggcaagtacgaagccttggagaagtacgggaaggatttgactgctatggcacgtgaagggaaacttgatccagttatagggagagatgatgaaatccgtagatgtatacaaattctatcaaggagaacaaagaacaatcctgtattaatcggtgaacctggtgttggaaaaactgccatatcagaagggcttgcccagagaattgtgcaaggtgacgttcctcaggcattgatgaaccgaaggctaatttcccttgatatgggtgcacttattgctggggcaaaatatcggggagaatttgaagacagattgaaagctgtattgaaagaagtgactgaatcagatggtcagataatactattcattgatgagatccacactgttgttggagcaggtgccacaaatggtgcaatggatgcaggcaatctgctgaaaccaatgcttggtcggggggagttgcgctgtattggtgcaacaacccttgatgaatatcgtaaatatattgagaaagatccagctttggaacgtcggttccagcaagtttatgttgaccagcctagcgttgaagacacaatctctatactgcgtggattgcgtgaaagatatgagctgcaccatggagtccgtatatctgacagtgcacttgtggaggctgcaattctttcagatcgttatatcagtgggcgctttttgcctgataaagctattgatttagttgatgaggctgctgctaaattgaagatggagattacatccaagccaactgctctggatgagattaatcgttctgtactgaagctagagatggagcgtctatctttaactaatgatacagacaaagcttcaaaagatagattgagccgccttgaagccgaattggcactcttgaaagagaagcaggctgaacttactgagcagtgggagcatgagaagtcagtaatgacgcgtattcagtctataaaagaagagattgacagggtgaatgtagagatccagcaggcagaacgtgaatacgatcttaatcgagctgctgaattaaagtatgggagccttaataccttgcagcgtcaacttgaaattgcagaaaaggagctggatgaataccaaagttcagggaagtcaatgctcagagaagaggttaccggaaatgacatagcagaaattgtcagcaaatggacaggcattccggtttccaagctgcaacagtctgaaagggagaaactgctgcatttggaagaggaattgcacaagcgtgttgtgggtcaagacccagcagtgagagcagtggcagaagctatccagcggtcaagggctggcttgtcggacccacaccgtccaattgctagcttcatgttcatgggccccacaggagttggcaaaacagaactggcaaaagcccttgcatcttatatgtttaacactgaggaagctcttgtgagaatagacatgagcgagtacatggaaaagcatgctgtctcaagattgataggagccccacctggttatgttggatatgaggaaggtggccagctgaccgagacagtacgcaggaggccttatgctgttatattgtttgatgaaatcgaaaaggcccattccgatgtgttcaatgctttccttcaaatactggatgatggcagggtgactgattcacaaggtcgcactgtcagttttaccaatacggtcatcatcatgacatcaaatgtgggttctcagtacatattaaatatgaatgatgagacggagtcaaaggattctgcctatgaggctattaagcaaagggtaatggaagctgcaagatccattttccgccctgagttcatgaaccgtgttgatgaatatatcgttttccagcctctggaccgtgaacaaataaacagtatcgtcaggttacagttggagagagtacagaagcgagttgcagatcggaagatcaaaattgaggtgacggatgcggcggttgagtttctgggaagcctgggatatgaccccaactatggtgctagaccggtgaagcgtgtgattcaacagaacgtggagaatgaactagcaaagggtatattgaggggtgacttcaaggaggaggacaccatctcggtggacacagaagtctgcgcgttctccaatggccagcttccccagcagaagcttgtgttccgaagactggatccagattcgtcagataagcctgcttccgaagaacagaaggcttt

SEQ ID NO: 6302 - DNA, 3402 bp, Amaranthus tuberculatus
gaactctctgtacatcctttcccctcctagaaggtgctggaatttcatcaatccatttggggatttcccctattttgccaaaccattataaaggcaactcgcatacaattttctcttcgatcttcctttgttgaattcccacgcaaagcatactcaatagtcaattccctttaattattcttcaatctgatcgattgtctacacccaaatccctactcgtttatggctactgctacaacgtcgtttccgggagcctatcttcgtgttccacctaagaatggggttagaaatgcgttgttttctcagtctatagtctctattgcactcaattcaagaaaacccaagtcgctaaaatcattgaaatcgagtacaaattcatttaattttggtttacacaagagttgtaggaagggttctaaatctggctcttttgttgttcgatgtgatgcagcaggtggaaggattactcagcaagaattcacagaaatggcctggcaagcaattgtttcttctccagaagtggcaaaagagaataaacatcagatagtggagactgagcatttgatgaaagcccttctagagcaaaagaatggacttgctcgtcgcattttttctaaagctggaattgacaataccagtttactcgaagcaaccgacaagtttatacaacggcaaccaaaggttctgggtgaatctgctggttcaatgttgggacgagattttgaaggattgattcaaaaagccagggaatacaagaaagaatacggagattcatttgtgtccgtggagcatttggttcttgcttttgcacaagataaaagattcgggaaacagttgttcaatgattttcggctttctgagaaattattaaaatctaccatacaagctgtaaggggacgccaatcagtcatcgaccaagaccccgagggaaaatatgaagctctggagaagtatggaaaagatttgactgccatggcaagggaaggaaaattggatcctgtaataggacgagatgatgagatacgtagaagtatccaaattctatcacgaagaacaaaaaacaatcctgttcttatggtgaacctggtgttggtaaaactgcaattgccgaagggcttgctcaaagaatcgttgagggggatgtacctcaagctttggtgaaccgaaagttattttctcttgacatgggagcattgatagctggagctaaatatcgaggagaatttgaggaccgccttaaggctgtactgaaggaagtgactgaggccgagggtcagactatcctttttattgatgagattcacacagtagttggagcaggtgccacaaatggtgctatggatgctggtactcttttgaagcctatgctcggccgtggagagttgcgatgtattggtgctactacacttgatgaatatcgtaaatacattgaaaaggatccagcattggagcgacgttttcaacaggtgtatgttgaccagccaagcgttgaaaatacaatctcaatacttcgtggtctacgtgagagatatgagttgcatcacggagttaggatatctgatagtgcccttgtggaagctgctgtcctttcagatcgctacattagtggacgtttcttaccagacaaagctatcgacttggttgatgaagctgctgctaaactaaagatggaaataacatcaaaacctactgcgcttgatgagattaaccgttctgtattgaagcttgagatggaaagactctcgcttaccaatgacactgataaagcgtcaaaagagaggctcaatcggcttgatacagagctgtccatattaaaggaaaagcaagctgaattgactgagcagtgggagcatgagaaaagcgtaatgacccgcatacagtccatcaaagaagagattgacagggtaaacattgagatccaacaggcagagcgagaatatgatctaaatcgtgctgctgaactaaagtatggcagtctcaattctctacagcgccaattagaaagcgcggaaaaagagctggatgagtacatgaaatcagggaaatctatgttacgagaagaagtaactggtagtgatatcgctgaaatcgttagcaagtggacaggaattcctgtttcaaagctacagcagtcagagagggagaaactattgcatttggaagaagagctgcacaaacgtgtcgtgggccaagatcctgcagtaagggctgtagctgaggctattcaacgttctagggctgggctctctgatccacatcgcccgattgccagtttcatgttcatgggccccaccggtgtgggaaagactgagctagctaaggccttagcctcttacctgttcaacaccgaggaggcccttgttagaattgatatgagtgaatacatggagaaatttgccgtctcgagacttataggtgctccacctggttatgtgggatatgaggagggaggccaattaacagaaatagttaggaggaggccgtatgcagtgatcctattcgatgagatagaaaaggcgcatgctgacgttttcaacgtgttccttcaaattttagacgatggtagggtgaccgactcacaaggacgaactgtgagcttcaccaatactgtaatcattatgacttcaaatgttgggtcccaatacattttaaatgctgaagacgagacttcgtccaaggaggttacgtatgagattataaagcaaagagtaatggatgcggcccgatcaattttccgtcctgagtttatgaacagagtagatgaatacatcgtctttcagcctcttgatcgtgaacaaattagcagcattgtgcaattacagctgcaaagagttcaatcgagaattgcagatcgtaagatgaagattgaagtgactgatcccgcagttcagcttctcggcaagctcggatatgatcctaactatggtgccaggcctgtcaagcgtgtaatacagcagcatgtggagaatgagattgcaaaaggcatcttgagaggagattttaaagaagacgataccattgttgttgatacagaggtcacagctttttcaaatggccagcttccccaggaaaaactcgtattccggaaactggagcctgaatctggctcttctgctgaagaagagaaacaagctgtttctcctttttagatctaaagtattttacagtttatagtctttataccaaattgttatctagtttgaacttacggtgcataaaaattagtgcaaggttgtgggactggtacaatatggttttatagcagtcttagagtagttctcttacactagtataaaagacttgtacacaaataacttgattaaggtcacaaaattattctaataggttttttattattattctctccatttgattacctattatcaatggatatgttactag

SEQ ID NO: 6303 - DNA, 3477 bp, Eutrema parvulum
aacacgtgtcagaagaaggtctaagtacgtagttgcgcacctcatcccgagtgttcacgaatcctccggcgtcgtttagcatcttctcctttcttttattatttcctcctccaccttctcctgcttctcgctaaactacgcgacgacaggaaaaaaaaagcaaaaagcgtccatctttgctgaattcttaagtaaacatctcgccgttttggtgaattggtggtaaaccgcctgttgtgttccataatcctttttcaattgcctgctatttttagtctccgagcaaaatggcgacggctgctacggcggcgtttagtgatgtggtcggagtaggatcggagtcccgacagatttcttcattttctcatcttcaaccttctgtggcttttccggcgaagcctagttccttcaaagctctgaagttaaagcagagcgcgaggctcacgcggaggcttgagcatcggccgtttgttatccgatgcgaagcttcttctaatggacggcttacacagcaagaatttacggaaatggcgtggcaatcgatagtttcgtcaccagatgtggctaaggagaacaagcaacagattgtggagacggagcatctaatgaaagctcttttggagcagaagaatggtttagcgcgcaggattttctctaagatcggtgtggataacacaaaggttctagaagcaactgagaagttcattcaacgccaaccaaaggtgtatggagaagctgctggttcgatgttggggcgtgatttggaaggtctgtttcagcgggcaaggcagtataagaaagacttaggagactcttatgtctcagtggagcatttggttcttgcttttgctgaagataagcggtttggtaaacagttgtttagggattttcagatatcagagaagagcttgaaatctgcaattgaatccattagagggaaacaatcagtcattgaccaagatccggaaggcaagtatgaggcattggagaagtatggaaaagatttgacagcaatggcgagagaaggaaaactcgatcctgtaattgggagagatgatgagatccgtagatgcattcagattctctcaaggagaacgaagaacaaccctgtcttgataggtgaaccaggtgttggtaaaaccgcaatttcagaaggacttgctcagaggattgtgcaaggagatgtacctcaagcattgatgaacagaaagttgatatctctagatatgggcgcactcattgctggagcaaagtatcgaggagaattcgaagatagactaaaggctgtattaaaggaagtcacagattcagaaggccagaccattttattcattgatgagatccacactgttgttggagcaggtgcgactaatggggcgatggatgctggtaatctgctgaaaccgatgctgggtcgaggcgagttacgttgtatcggtgcaacaactcttgatgaatataggaagtacatagagaaagatccagccttggaacgtaggtttcagcaggtttatgtcgatcaacctacggttgaagacacgatttctattctccgtggattgcgggaaaggtatgaacttcatcacggagttcgcatctcggatagtgctctagtggaagccgctattctctccgaccgttacatcagtggccgatttctacctgataaagcaattgatctggttgatgaagcggcggccaaattgaaaatggaaatcacttcaaaaccgacagctcttgacgagcttgaccgtgcggtaataaagcttgaaatggagaggctttctctcactaatgatacagacaaagcttctagagagagattgaatcggattgaaaccgagttattgttactgaaggagaagcaagctgagttaactgaacagtgggagcacgagaggtctgtcatgtcccgtcttcaatcaattaaagaggagattgatcgagtaaaccttgagatccagcaagctgaacgtgaatacgatcttaaccgtgcagcagagctcaaatatggaagcttaaactcgttgcagcgacaactaaacgaagcagagaaagagcttaacgaatacttaagctccgggaaatcgatgtttagagaagaggttttaggtagcgatatagctgagattgtgagtaaatggactggaatcccggtatcaaagcttcaacaatccgaaagagataaacttctacatttggaagaagaattgcataagcgggtggtcggtcaaaacccagcagtgactgcggtagctgaagcgattcaacgatcaagagctggtctttcagatccaggccgtccgatagctagtttcatgtttatgggaccaaccggtgttggcaaaaccgagctagccaaagcacttgcttcgtatctgttcaacacagaagaagctttagtgagaatcgacatgagtgagtacatggagaaacatgctgtgtcaagactcattggagctccacctggatatgtcggttacgaagaaggaggacagttaacagaaacggttagaagaaggccttactcggttatcctctttgatgagattgagaaagctcatggagatgtcttcaatgtgtttctacaaatcttggacgatgggcgagtgacggattctcaaggacgtactgttagtttcaccaataccgttattattatgacctcgaatgttggttcccagtttatcctcaacaatacagatgatgatgcaaaggagcttgcttatgacacgattaaacagagagtgatggatgctgcaagatcaatctttcggcctgagtttatgaatagggtcgatgagtatatagttttccaacctcttgaccgcgagcagatcaacagcattgtccggttacagctggctcgtgtgcagaagcggattgtagacaggaaaatgaagatagagatcacagacgcagcagtggatcttctcggaagcctcgggtatgatcctaactatggagctagacccgtcaagcgtgtgatacagcaaaacattgagaacgagcttgcgaaaggtatcttgagaggagatttcaaggaagaagatggcattctgattgatacagaggtcacagcgttctccaatggtcagctacctcagcaaaagctcatattcaaaaatatcgagtcagaaacagcagatgctgaaaaagaaaaagaagctttctcaaaacagaggaattgaaaaacgacacctttgaagcccaagaagtttaagactttttgtagtacagaacatctagtgagtgacatgtgacagaacacaataaatgtgggttgtataaatctacgctgaagagtcattgtattgatgtctaaaaatcctgagattatggaaattgttgatcatatgaatgaatctctgaagatgcaatagactcagaatcacacaaattgacaaatttacagatgtttcacacatcaatgttacattgattcgagttggtcagtcgtttttgaggcggaggtcc

SEQ ID NO: 6304 - DNA, 3499 bp, Brassica rapa
gaagttccaggctcatcccgaggggtcaggaaggctctccggcgtcgtttagcatcttcctctcccttctttattatttccttcttctcacttctcttgcttctcgctaactaaaactacacgaaaacacaagcaaaaagcgttatcgtttgctcaattcttaagtaaacatctcgccgtttagcgaatttatactaaactccctgttgtaatacatctccctttctaaactgtttaccgttttttaatttctccgagcaaatggcgacggctaagacgactgcaacggcggcgtttagtggtatcgtcggcggcgtaggatcagactcccgaaaggtttcctctttctctcacctccaaccttccgtggctttcccggcgaagcccacttccttcaaagcactgaaactaaagcagagcgcgaggctcactcgaagacttcaacatcaaccgttcgtcgtccgatgcgaagcttcttctaacggaaggcttacacagcaagagttcacagagatggcgtggcaatcgatagtctcttcaccagacgtggctaaagagaacaagcagcagatcgtggagacggagcatcttatgaaagctcttttggagcagaagaacggtttagctcgaaggatcttctctaagatcggtgtggataacactaaggttttggaagcgacggataagttcattcaacggcagccaaaggtgtatggagaagctgctggttcgatgttggggcgtgatttggaaggtttgtttcagagggcgagacagtataagaaagacttgggggactcttatgtctctgtggagcatttggttcttgcttttgttgatgacaagcggtttgggaaacagctgtttagggattttcagatatctgagaagagtttgaaaactgctattgagtctattagagggaaacaatcagtcattgaccaagatccggaaggcaagtatgaggcgttggagaagtatggtaaagatttgacagcgatggcgagagaagggaagcttgatcctgtgattggaagagatgatgagatccgtagatgcattcagattctctcaaggaggactaaaaataaccctgtgttgatcggtgaacctggtgttggtaaaaccgcaatctcagaaggacttgctcagaggattgtgcaaggagatgtacctcaagcattgatgaacagaaagttgatatctcttgatatgggggcacttattgctggagcaaagtatcgaggagagttcgaagatagactaaaggctgtacttaaggaggtcacagactcagaaggccaaactattctgttcatcgatgagatacacacagttgttggtgcaggtgctactaatggggcaatggatgctggtaatctactaaaaccaatgttgggtcgaggcgagctaagatgcatcggcgcaacaacgcttgatgaatatagaaagtacatagagaaagatccagccttggaacgcaggtttcaacaggtttacgttgatcaacctaccgtggaagacacggtttcgatcctccgtggtttgagagaaaggtacgaacttcatcacggagttcgcatctcagacagtgctctagtggaagccgctattctctctgaccgttacatcagcggccggttcctacctgacaaagcgattgacttggttgatgaagcagcagccaaactaaaaatggaaatcacttcaaaaccaacagctctcgacgagcttgaccgcgcggtgatcaagctcgaaatggagagactctcactcaccaacgacacagacaaagcttcaagagagaggctaaaccggatcgaaacggagttagtcttgctaaaggagaagcaagccgagttaaccgagcagtgggagcacgagaggtccgtcatgtcccgtctccagtccatcaaagaggagatagatcgtgtcaacctcgagatccagcaagcggagcgcgagtacgatctaaaccgcgcagcagagctcaaatacggaagcctaaactctctccagcgtcagctaaacgaagctgagaaggagctcaacgagtacttaagctctggcaagtctatgtttagagaagaggtgttaggcagcgacatagcagagatcgtgagcaaatggactggcatccctgtctccaagctccaacagtccgagagagataagcttctgcacttggaagaggagctgcatagacgagttataggtcagaaccctgcagttacggccgtagccgaagcgatccaacggtctagagccggcctgtcggatccaggccgtccgatagcttccttcatgttcatgggaccgacaggagtcggcaaaaccgagctggccaaggcgctagcttcttacctcttcaacacggaggaagctctggtgaggatcgacatgagcgagtacatggagaaacacgcggtctcgaggctcatcggagctcctcccggatacgtgggatacgaggaaggagggcagttgactgaagtggttaggaggaggccttactcggtcatcctcttcgacgagatcgagaaggctcatggagatgtgttcaacgtgtttctccagatcttggacgatgggagggttactgactctcagggacgtacggtgagtttcaccaatacggttattatcatgacctcgaacgttggctcgcagtatatactgaacaacaacgcggatgatgaggggagtgagctcggttatgagacgattaagcagagagtgatggatgctgcgagatcgatctttcgtcctgagtttatgaatagggttgatgagtatattgttttccagcctcttgaccgtgagcagatcaacagcatcgtccggttacagctggctcgtgtgcagaagcggattgcggataggaaaatgaagatagagatcacagatgcggcggtggatcttctcgggagcctcgggtatgatcctaactacggagctagacctgttaagcgtgtgatacagcagaacattgagaacgagctggcgaaaggtatcttgagaggagatttcaaggaagaagatggcattctgatcgatacagaggtcacagcgttctccaatggtcagttacctcagcaaaagctcacattcaaaaagattgcgtcagaaacggcagatgctgagaaggaggaagaagaagctttctcaaaacagagcaattgaaaaacgacaccttttggagcccaagaagtttcggactttatagtacatagcttctagtgagttggttgtgacagaacagaatgataacatttatctcaatgtgagatataaaccataagctaataagttattgtgctgatgtctcaaaatccatattctctgaaaatgcaatgtattttagcaacgttatatagttttccggtgaccacttatatgttgggcctgattcgttaggcttgtgtggcacttccccgtagatctgccaaaaagacatgatgtatgtgttgcttctgcatcatttaacggttttaggtga

SEQ ID NO: 6305 - DNA, 3193 bp, Arabidopsis lyrata
acatctcgccgttttggcgaatttgtgctaaactacctgttgtattttatcttcctttttcaattacttgctgtttttaattctccgagctaatggcgacggctacgacgactgctacggcggcgtttagtggtgtagtcagcgtaggaacgaagactcgaaggatttctacgttttctcatcttcaaccttctgtggcttttccggcgaagcccaattcattcaaacttctgaaatttaagcagagcgcgaggctcacacggcggcttgagcatcggccattctttgtccgatgtgaagcttcttcttctaatggaaggcttacacagcaagaattcacagaaatggcgtggcaatcgatagtttcgtcaccagatgttgcgaaagagaataagcaacagattgtggagacagagcatctaatgaaagctcttttggagcagaagaatggtttagctcgcaggattttctctaagatcggtgtggataacactaaggttctagaagcaactgagaagttcattcaacgccagccaaaggtgtatggagatgctgctggttcgatgttagggcgtgatttggaaggtctgttccagagagcaagacagtttaagaaagatttaggagactcttatgtgtcagtggagcatttggttcttgcttttgctgatgataagcggtttgggaaacagttgttcaaggattttcagatatcagagaagagcttaaaatctgcaattgaatccattagagggaaacaatcagtcattgaccaagatccggaaggcaagtatgaggcattggagaagtatggaaaagatttgacagcaatggcaagagaaggaaaacttgatcctgtgattggtagagatgacgagatccgaagatgcattcagattctctcgaggagaacaaagaacaaccctgtgttgatcggtgaaccaggtgttggtaaaaccgcaatttcagaaggacttgctcagaggattgtgcaaggagatgtacctcaagcattgatgaacagaaagttgatatctcttgatatgggtgctctcattgctggagcaaagtatcggggagaattcgaagatagactaaaggctgtgcttaaggaagtcacagactcagaaggccaaatcattttgttcatcgatgagatccacacagttgttggtgcaggtgcgactaatggggccatggatgctggtaatctgctgaaaccaatgctgggtcgaggcgagttacgctgtatcggtgcaacaacgctcgatgaatataggaaatacatagagaaagatccagccttggaacgtaggtttcaacaggtttatgtcgatcaacctacggttgaagacacgatttcgattctccgtggtttgcgggaaaggtatgaacttcatcatggagttcgcatctcagatagtgctctagtggaagctgctatcctctcggaccgttacatcagtggccggtttctacccgataaagcaattgacttggtcgatgaagcggcagccaaattgaaaatggaaatcacttcgaaaccgacagctcttgatgagcttgaccgctcggtgataaagcttgaaatggagaggctttcactcaccaatgatacagacaaagcttctagagagagattgaatcgaattgaaacagagttagtgttattaaaggagaagcaagctgaattaaccgaacagtgggagcacgagaggtctgttatgtcccgtcttcagtcgattaaagaggagattgatcgagtaaacgtcgagatccagcaggcggaacgtgaatacgatcttaaccgtgcagctgagctcaaatacggaagcttaaactcattgcagcgacagcttaatgaagcagagaaagagctgaacgagtacttaagctccgggaaatctatgttcagagaagaggttttgggtagcgatattgccgagattgtgagtaaatggactggaatcccagtatcgaagcttcaacagtctgaaagagataaacttctacatttggaagaagaattgcataaaagggtagtcggtcaaaacccagcagtgactgcagtagctgaagcaatccaacgatcaagggctggtctttcggatccaggccgtccaatagctagtttcatgtttatgggaccaaccggtgtgggtaaaacagagctagccaaaacacttgcttcttatttgttcaacacagaagaagctttagtcagaattgacatgagtgagtacatggagaagcatgctgtctctaggctcattggagctccacctggatatgttggttacgaagaaggaggacagttaacagaaacggttagaaggcggccttattcggtcatcctctttgatgagattgagaaagctcatggagatgtcttcaatgtgtttctccaaatcttggatgatgggcgagtcacagattctcaaggacgtactgtgagtttcaccaataccgtcattatcatgacttcaaatgttggttcgcagtttattctgaacaacacagatgatgatgctaatgagctcgtttatgaaacgattaaagagagagtgatgaatgctgcaagatcaatctttcgtcctgaattcatgaatagggttgatgagtatatagttttccaacctcttgaccgcgagcagatcaaccgcattgttcggttacagctggcacgtgtgcagaagcgaattgcagacaggaaaatgaagataaatatcacagatgcagcagtcgatcttctcggaagcctagggtatgatccaaactatggagctagacctgttaagcgtgtaatacagcaaaacattgagaatgagctcgctaaaggtatcttgagaggagatttcaaggaggaagatggcattttgatcgataccgaggtcacagcgttctccaatggccagttacctcagcaaaagctcacattcaagaagattgagtcagaaacagcagatgctgaacaagaagaagaagaagctttctcaaaacagagcagatgaaaaatgaaaccttttggagcacaataagtttcagtctttttagtacagaacttctagtgagttacttgtcagaaaaggcactgctaatatttatctcgatgtgagtttatataaatcataagctgatgagtcattgtactgatgtatcaaaggtccagatattatggaaattgttgatcata

SEQ ID NO: 6306 - DNA, 2930 bp, Brassica napus
aatacatctccctttctaaactgtttaccgttttttaatttctccgagcaaatggcgacggctaagacgactgcaacggcggcgtttagtggtatcgtcggcggcgtaggatcagactcccgaaaggtttcctctttctctcacctccaaccttccgtggctttcccggcgaagcccacttccttcaaagcactgaaactaaagcagagcgcgaggctcactcgaagacttcaacatcaaccgttcgtcgtccgatgcgaagcttcttctaacggaaggcttacacagcaagagttcacagagatggcgtggcagtccatagtctcttcaccagacgtggctaaagagaacaagcagcagatcgtggagacggagcatcttatgaaagctcttttggagcagaagaacggtttagctcgcaggatcttctccaagatcggtgtggataacactaaggttttggaagcgacggataagttcattcaacgccagccaaaggtgtatggagaagctgctggttcgatgttggggcgtgatttggaaggtttgtttcagagggcgagacagtataagaaagacttgggggactcttatgtttctgtggagcatttggttcttgcctttgttgatgataagcggtttgggaaacagctgtttagggattttcagatatctgagaagagtttgaaaactgctattgagtccattagagggaaacaatcagtcattgaccaagatccggaaggaaagtatgaggcgttggagaagtatggtaaagatttgacagcgatggcgagagaagggaagcttgatcctgtgattggaagagatgatgagatccgtagatgcattcagattctctcaaggaggactaagaataaccctgtgttgatcggtgaacctggtgttggtaaaaccgcaatctcagaaggacttgctcagaggattgtgcaaggagatgtacctcaagcattgatgaacagaaagttgatatctcttgatatgggggcacttattgctggagcaaagtatcgaggagagttcgaagatagactaaaggctgtacttaaggaggtcacagactcagaaggccaaactattctgttcatcgatgagatacacacagttgttggtgcaggtgctactaatggggcaatggatgctggtaatctactaaaaccaatgttgggtcgaggcgagctaagatgcatcggcgcaacaacgcttgatgaatatagaaagtacatagagaaagatccagccttggaacgcaggtttcaacaggtttacgttgatcaacctaccgtggaagacacggtttcgatcctccgtggtttgagagaaaggtacgaacttcatcacggagttcgcatctcagacagtgctctagtggaagccgctattctctctgaccgttacatcagcggccggttcctacctgacaaagcgattgacttggttgatgaagcagcagccaaactaaaaatggaaatcacttcaaaaccaacagctctcgacgagcttgaccgcgcggtgatcaagctcgaaatggagagactctcactcaccaacgacacagacaaagcttcaagagagaggctaaaccggatcgaaacggagttagtcttgctaaaggagaagcaagccgagttaaccgagcagtgggagcacgagaggtccgtcatgtcccgtctccagtccatcaaagaggagatagatcgtgtcaacctcgagatccagcaagcggagcgcgagtacgatctaaaccgcgcagcagagctcaaatacggaagcctaaactctctccagcggcagctaaacgaagctgagaaggagctcaacgagtacttaagctctggcaagtctatgtttagagaagaggtgttaggcagcgacatagcagagatcgtgagcaaatggactggcatccctgtctccaagctccaacagtccgagagagataagcttctgcacttggaagaggagctgcatagacgagttataggtcagaaccctgcagttacggccgtagccgaagcgatccaacggtctagagccggcctgtcggatccaggccgtccgattgcttccttcatgttcatgggaccgacaggagtcggcaaaaccgagctggccaaggcgctagcttcttacctctttaacacggaggaagctcttgtgcggatcgacatgagcgagtacatggagaaacacgcggtctcgaggctcatcggagctcctcctggatacgtgggctacgaggaaggagggcagttgactgaagtggttaggaggaggccttactcggtcatcctcttcgatgagattgagaaggcgcacggagatgtgttcaacgtgtttctccagatcttggacgatgggagggttactgactctcagggacgtacggtgagtttcaccaatacggttattattatgacctccaacgttggctcgcagtatatcttgaacaacaacgcggatgatgaggggagtgagcttggttatgagacgattaagcagagagtgatggatgctgcgagatcgatctttcgtcctgagtttatgaatagggttgatgagtatatagttttccagcctcttgaccgtgagcagatcaacagcatcgtccggttacagctggctcgtgtgcagaagcggattgcggataggaaaatgaagatagagatcacagatgcggcggtggatcttctcgggagcctcgggtatgatcctaactacggagctagacctgttaagcgtgtgatacagcagaacattgagaacgagctggcgaaaggtatcttgagaggtgatttcaaggaagaagatggcattctgatcgatacagaggtcacagcgttctccaatggtcagttgcctcagcaaaagctcacattcaaaaagattgcgtcagaaacggcagatgc

SEQ ID NO: 6307 - DNA, 1542 bp, Sorghum bicolor
cgcaacggtcaatccaatcccctcaaattcgaattgcagccggtgcgacacccacacccacctcacatggcggcggcggcggcggcggcgactgcgaaggcggcggaagagatggtggaggtgctcgacgaggagacgctggcgctgatgggggtcagcagcgccgccaccgcggcgccggtggcggtgggcgccgagtgggagacgttcaaggagaacgtgcggccgctcaagcgcgggcgcgacgtgtccaaactcaaccacgcgctcaaggcacacgccgatcccgcgcagcgcgccgctctcctcgagacccgcaagaagatgattgaggcaatcgaccagtaccaaggcgaggatccgctccaaccgtggctggactgcatcaaatgggtccaggagtcattcccgactggcggcgagtgctcggggttggtggtgttgtacgagcagtgcgtgcggaccttttggcacgacgggcgctacaaggacgacctccgcttcctcaaagtgtggctggaatacgctgggaattgtgcagatgctgaggtgatttacaggttcctggaggccaaccagattgggcagggccatgccatctactacatggcttacgcatcgttgatggagtcaaagaacaagttgaggaaagctaaggagatctttgaccttggtatagctagaaaagcgaagcctatggagaagttggaagctgtatacaggacatttcttcgaagatcaaccaaaagaagggaacaggagccggataatacagcagatgatgatctgccaaatcgcagtttcgggactaacttgaaacgagatgaaaacagaaatcaccaagcagggaactccggcctggggagaccaagggcactgcagagaatcgatcccaacaggccactttcaatttacaaagatgagaggccattactaaatcagggccttgacggagtgaggaacagagaaaataacacaagctggcgcaccctcccaacacaagcagatcgaaacaaggagaatagcatgatgcctgctaaatggacatctcacaagattccacaaaagttaggagcaagaggagcagttcagtccacccgaaccagttccattgaggtcttcgtggaggaagacactgcacaggaacctgctcagccggtgccgaagaccccaaatccttctgttctgaagcttagacaagcaacaagcaaaagccttaagaaggaaactgaattgcttaaggagaaccccttgcgcaacttccccctgagcagccttagatagtcagcattttgctggttctgagaagcattctcgttactgatttggttgtatgattgttgtgaggttgtgcctttatgcccaataagctttagcctctaaagctttgacaagcaacatgtgcgcgcccacgggctttatgcaagtgttgtaatcttattattgatagacctgcagatctcgcaggcttatgtgaatctaatagctacacaaaataatctgcttctacaaattccggttggtcctttctgcttgttttta

SEQ ID NO: 6308 - DNA, 1742 bp, Panicum virgatum
atgttccagttgaaaagatctgattaatgttttccggtcagttctgcaggcaattcacgcttctcatgtcgagcaaatcctcggccaaaatttagctgtgctatcctgggcacaaaccagcccaaacaatctaccgatcggactactttaatagcccacggcccaaactgaagcccgaactttttcgcaaacccttaccgtttaaaacctgaccaacagctgcctccgctcctaaacgcaacggtcgaatcccctcgagttcgaattgcagccggagcggcacccacacccacctgacatggcggcggcggcgggggcggaagagatggtggcggtgctcgacgaggagacgctggcgctgatggggatcagcaacgccgccgccgtggcgccgccggtggctgtgggcgccgagtgggagacgttcaaggagaacgtgcggccgctcaagcgcgggcgcgacgtgtccaagctcaaccgcgcgctcaaggcgcaggtcgaccccgcccagcgcgccgccctcctcgaagcccgcaggaggatgattgaggcaatctacgagtaccagggcgaggatccgctccaaccgtggctggactgcatcaagtgggttcaggagtcgttccctaccggcggcgagtgctcggggctagtggtgttgtacgagcagtgtgtgcggaccttctggcacgacgagcgctacaaggaggacctccgcttcctcaaagtgtggctggaatacgctgggaattgcactgatgctgaggtgatatacagatttctggaggcgaaccagattgggcagagccatgccatttactacatgtcctacgcgtcgttgttagaatcaaagaacaagctaaggaaagctaatgagatctttcaccttggtatatctagaaaagcaaagcctctggagaaattggaagctgtatacaggacatttcttcgaagatctaccaaaaagagcgaacacgctgagcaagatgatacaacagatgatctgccaatccgtagctttgggactaacttgaaacgtgatgaaaacagaaatcagcaagcagataactcccaccttgggaggccaagggcactgcaaagaatcgacgttaacaaaccactttcagtatacaaagatgagaagtcgttaccaaatcagggcattgacagtacaaggaacaaagaaaatatgagctggcgcacccttggaacacaagcagataggaacaaagaaaataacatgatgcctgctaaatggacgtgtcacaaggttccacaaaagttaggagcgagaggagcagttcagccaacccgggccacttccattgaggttttcgtggacgaagaatgtgcacaggaaccagctcggaaggtaccaaagagcccaaatccttctgttctgaagctcaggcaagcaacaagcaaaagcattaagaaggaaactgaattgcttaaagagaatccactgcgcaacttccccctgagcagccttagataatcagcatttggctgattttatgaagcatttcaactatgttaaccggtttgatttggttgtttggttgttgtgaggttgtctggttatgcctgtatgacaaaataagctttagcctctaaagcttattagacaagcaatgagcctgttggcttattaagtgttttaatcttctacaataagttgatagaatctcgagggcttacatgaatctaatatcttcacaaagtaatttgcttttacgaac

SEQ ID NO: 6309 - DNA, 1510 bp, Setaria italica
tcgaattccagccggagcgacacccccacccacctcacatggcggcggcggcggcggcggcggcgacggcgaaggcggcggaagagatggtggcggtgctcgacgacgagacgctggcgctgatgggggtcagcaactccgccgccgcggcgccggtggttgtgggcgccgagtgggagacgttcaaggagaacgtgcggccgctcaaacgcgggcgcgatgtgtccaaactcaaccgcgcgctcaaggcgctcgtcgaccccgcccagcgcgccgccctcctcgaagctcgcaggaggatgatcgaggcaatctacgagtatcagggcgaggatccgctccaaccgtggctggactgcatcaagtgggttcaggagtcgttcccgaccggcggcgagtgctcggggctggtggtgttgtacgagcagtgcgtgcggaccttctggcacgacgagcgctacaaggacgacctccgcttcctcaaagtgtggctggaatacgctggaaattgcgctgatgctgaggtgatatacaaattcctggaggcaaaccagattgggcagggccatgccatttactacatgtcctatgcgtcattgttggaggcaaagaacaagctgagaaaagctaatgagatctttgacattggtatagctagaaaagcaaagcctctggagaagttggaagctgtatacaggacatttcttcgaaggtcgaccaaaaggagcgaacattctgagcaaaatgatacagcaaatgatgatctaccaatacgtagcttcgggactagcttgaaacgcgatgaaaacagaaatcagcaagcagagaactcccagctggggaggccaagggcgctgcaaagaatcgacgttaacaggccactttcagtattcaaagatgagaattcattgccaaatcagggcattgacaaaataaggagaaaagaaaatacgagctggcgcacccttggaacacaagcagataggaacaaagaaaataacatgatgcccactaaatggacatgtcacaaggttccacaaaagttaggagcaagaggagcagttccggcaacccgggccagttccattgaggttttcgtggacgaagaatgtgcacaggaaccagctcggcaggtaccaaagagcccaaatccttctgttctgaagctcaggcaagcaacaagcaaaaaccttaagaaggaaactgaattacttaaagagaatccactgcgcaacttccccctgagcagccttagataatcagcatttagctgattctgtgaaacatttcgagttaatggtttggttgtttgattgttgtgaggttgaggttgtgcctgttgtggaatgagctttagcctctaaagcttagacaagcaatgagccagttggcttattttagtgttgtaatcttcttcgataagatgatagacctgctattttggacagacctgcagatcctgagtgcctatacgaatctaatatcttcacaaagtaattttcttttacaa

SEQ ID NO: 6310 - DNA, 1809 bp, Panicum virgatum
cagctggtccgctcctaaacgcaacggtcaaatcccctcgagttcgaattgcagccgcagcggcacccacacccacctaacatggcggcggcggcggtggcggcggaagagatggtggcggtgctcgacgaggagacgctggcgctgatggggatgagcagcgccgccgccgcggcgccggtggctgtgggcgccgagtgggagaccttcaaggagaacgtgcggccgctcaagcgcgggcgcgacgtgtccaagctcaaccgcgcgctcaaggcgcaggtcgaccccgcccagcgcaccgccctcctcgaagcccgcaggaggatgattgaggcaatctacgagtaccagggcgaggatccgctccaaccgtggctggactgcatcaagtgggttcaggagtcgttccctaccggcggcgagtgctcggggctggtggtgttgtacgagcagtgtgtgcggaccttctggcacgacgagcgctacaaggacgacctccgcttcctcaaagtgtggttggaatacgccgggaattgcgctgatgctgaggtcatatacaggtttctggaggcgaaccagattggacagagccatgccatttactacatgtcctacgcgtcgctgttagaatcaaagaacaagctgaggaaagctaatgagatctttggccttggtatagctagaaaagcaaagcctctggagaagttggaagctgtatacaggacatttcttcgaagatctaccaaaaagagtgaacactctgagcaagatgatacgacaaatgatctgccaatccgtagctttgggacaagcttgaaacgtgatgaaaacagaaatcagcaagcagataactcccaccttgggaggccaagggcactgcaaagaatcgacgttaacaaaccactttcagtatacaaagatgagaacttgttacaaaatcaggtcattgacagaacaaggagaaaagaaaatgcgagctggcgcaccctgggaacacaagcagataggaacaaagaaaataacatgatgcccactaaatgggcgtgtcacaaggttccacaaaaggtaggagcgagaggagcagttcagccaacccgggccacttcaattgaggtttttgtggacgaagaatgtgcaaaggaaccaactcggatggtaccaaagagcccaaatccttctgttctgaagctcaggcaagcaacaagcaaaagccttaagaaggaaactgaattgcttaaagagaatccactgcacaacttccctctgagcagccttagataatcagcatttggctgattttatggaacatttcaattgtgtcaacttaacctgtttgatttggttgtttggttgttgtgaggtttttcagttatgcctgaatgaccaaataagctttagcctctaaagcttattagacaagcaatgagccggttggcttattaagtgttgtaatcttctacaataagttgatagacctgcagatgtcgagtgcttattatcttcacaaagtaatttgcttttacaaactttagttggctatgttacacggatactggtacgggtatcggatacgatacgcatcggatacgcgtatacgcacttccccaaaaaacacggggatacggctaggttaatttagtattaataattatatatataatatcacataatcagcattaagcaaacaggtcatctacatgattaattgtccaacaaagataaaaacgacttgttgggctggcagtctgggagtccttccacatgggttggcccatttggcccagtagggttcagcttagagccacgtct

SEQ ID NO: 6311 - DNA, 642 bp, Trifolium pratense
ggggagggagagggagtgaccgcgacgagatagtaaaggcatagttctaagatttagggtttagctcccgcgtctccactaacctccatcgtttttcaaacaccttagctgccatggcgagcaccaaagttcagagggttatgacccaacccatcaacttgatcttcaggtttcttcaaagcaaagctcgtattcagatttggctttttgagcaaaaggatttgaggattgaaggcagaatcattggttttgatgagtacatgaatttggttttggatgatgctgaagaagtaaacgtcaagaagaagagcaaaaagactttggggaggatccttcttaaaggagacaacataacactaatgatgaacacggggaaatgaggatgagcacattggtacggttgctccatccaacaagaaggctgattttatctttaccttttcagtttgattagtacttctgttgtcaacaaatacttggattgtttttcacttggtcctctagttatgtcatcttgttgcctgtattaaagcccaaattccagaatgaaatccaatctgtatggtgattcagaaactttaacaccaacattatatcgcagctaattaagttatttagaggattttttatatctcaaaaaaa

SEQ ID NO: 6312 - DNA, 665 bp, Trifolium pratense
acgcgagggagggagtgaccgtcgaagagatagtaaaggcatagatagttctaagatttagggtttagctcccgcgtctccactaacctcaatcgtttcttcaaacaccttagctgccatggcgagcaccaaagttcagagggttatgacccaacccatcaacttgatcttcaggtttcttcaaagcaaagcgcgtattcagatttggctttttgagcaaaaggatttgaggattgaaggcagaatcattggttttgatgagtacatgaatttggttttggatgatgctgaagaagtaaacgtcaagaagaagagcaaaaagactttggggaggatccttcttaaaggagacaacataacactaatgatgaacacggggaaatgatgatgagcacattggtacagttgctccatccaacaagaaggctgattttatctttaccttttcagtttaattagtacttatgttgtcaacatgttgaatatgctgtgttaaatattatgttgacaatatgaaatttttatgcaccatagaaatacttggaatgtttgtcacttggatctttagttatgccctcttgttgcctgtattaaagcccaaatttcagaatgaaaaccaatctgtatggtgattcagaaactttaacaccaacattataaccttc

SEQ ID NO: 6313 - DNA, 712 bp, Trifolium pratense
acgtgagggagggagtgaccgtcgaagagatagtaaaggcatagatagttctaagatttagggtttagctcccgcgtctccactaacctccatcgtttattcaaacaccttagctgccatggcgagcaccaaagttcagagggttatgacccaacccatcaacttgatcttcaggtttcttcaaagcaaagcgcgtattcagatttggctttttgagcaaaaggatttgagaattgaaggcagaatcattggttttgatgagtacatgaatttggttttggatgatgctgaagaagtaaacgtcaagaagaagagcaaaaagactttagggaggatccttctcaaaggtgacaacattacattaatgatgaacacggggaaatgatgatgagcacattggtgtggttgctccatccaacaggaaggctgattttatctttaccttttcagtttaattagtacttatgttgtcaacatgttgaatatgctgtgttaaatattatgttgacaatatgaaatttttatgcaccatagaaatacttggaatgtttgtcacttggatctttagttatgccctcttgttgcctgtattaaagcccaaattccagaatgaaagccaatctgtaatggtgtgattcagaaacattaacaccaacattataaccttcttccatttattgacttctcccttttataatgctatatcgcagca

SEQ ID NO: 6314 - DNA, 714 bp, Lupinus angustifolius
tcaaataatcgcattcttcagtgttcactgggatttagctctatctttcgcatctctgcaatcgttcattgattctggaaaccatggccagcaccaaagttcagagggttatgacccaacccattaacttgattttcaggttccttcaaagtaaagcacgcattcaaatttggctctttgagcaaaaagatttgaggattgaaggccgcatcattggttttgatgaatacatgaatttggttttggacgatgctgaagaagttaatgtcaagaaaaagagcaaaaagacattggggagaatccttcttaaaggagacaacataactctaatgatgaacacggggaaatgatgaaaaccctggcatatttgtaaatcatatgtcctatacaatgaaacagatgcagatttatcttttcttttcagtttaattacaatttatctagttatcatgttaagtatgttgtgtgagaaatcttgttatgtatgacagtatgaattttccagcactagatagattcttagttgagctgcttagcatttttgtttgttggttcaccttatcctgccttcagtttccatgtacttttctgagttcgggcactgggagatgactatattgacttaaagtatggctgtagtgctagtaggatttgtgtcatggatgaaaatgcacatttgatatattttcagtgctaacttttactatgcaactt

SEQ ID NO: 6315 - DNA, 692 bp, Trigonella foenum-graecum
actaaaaaccctgtgagcggattcaccatcattcacctgctttagggtttagctctcatcgtctctccaaaccttgagccggttcattgtccgcaatcctcacctgctgccatggcgagcaccaaagttcagagggttatgacccaacccattaacttgatattcaggtttcttcaaagcaaagcgcggattcagatttggctttttgagcagaaggatttgaggattgaaggaagaatcattggttttgatgaatacatgaatttggttttggacgatgctgaagaagtaaacgtcaagaagaagagcaaaaagacattagggaggatccttcttaaaggagacaacataactttgatgatgaacacgggtaaatgatgatgatcacattggtacggtggttccgttcaacaagaaggccgatttatctttaccctttcagtttaattactatatctcttgtcaacatgttgaatatgctgtgtgaaaaatgttatgttggcaatatgaaatttttatgcaccagacaaatacttggtttgttggtcctcgtagtcatgccttcttgttgcctgtattaaagcccaaactccagaatgaaagccaaactgtggtgattcagaaagtttaacaattttgtaaccttcatccatttattgacttcgtccctttctatcatatgctatattgca

SEQ ID NO: 6316 - DNA, 468 bp, Glycine max
tctcttgcaatctcatagattttagcagccatggcgagtaccaaagttcagagggttatgacccaacctattaacttgattttcaggtttcttcagagcaaagcgcgcatccagatttggctctttgagcaaaaggatttgaggattgaaggccgaatcattggttttgatgaatacatgaatttggttcttgatgatgctgaagaagtgaacgtcaagaagaaaagcagaaagacattagggaggatccttcttaaaggagacaacataaccttgatgatgaacacggggaaatgatgaacaacgctggcacagttgtaaacactgttcctatccaacaggagagaaaaaaatatctttccttttccagtttaattactgtttctcttgttgaaatcttgaatatgttgtgagagaaatattatcatgcatgaatctgtgaatttttaatacactagatgaattctt

SEQ ID NO: 6317 - DNA, 406 bp, Glycine max
agagtgagagagagggcaaaaccctagctttggagtcttccctcccatctcccacttcttgcaatctctgcagccatggcgagtaccaaagttcagagggttatgacccaacctattaacttgattttcaggtttcttcagagcaaagcgcgcattcagatttggctttttgagcagaaggatttgaggattgaaggccgaatcatcggttttgatgaatacatgaatttggttcttgatgatgctgaagaagtgaacgtcaagaagaaaagcagaaagacattagggaggatccttcttaaaggagacaacataaccttgatgatgaacacggggaaatgattaacactctggcacagttgtaaactccgttcctatccaacaagaaagaaaaattatctttccc

SEQ ID NO: 6318 - DNA, 799 bp, Cicer arietinum
ggtaaatgtataatttttaggggtaccaaactaaaaaatttccatattcattcattgtaagcaaaaccctttgaacaaaaataccaaaaccctaaaaaccaacatcaggctaccggaaacccagaatcggcgccgatcagaagcaattcagctgccatggctagcactaaagttcagagggtcatgacccaacccattaacttgatctttaggtttcttcaaagtaaagcgcgcattcagatttggctctttgagcaaaaggatttgaggattgaaggaagaatcattggttttgatgagtacatgaatttggttttggatgacgctgaagaagtaaatgtgaagaagaagagcagaaagacattagggaggatccttcttaaaggagacaacataactttaatgatgaacactgggaaatgatgatgagcacataggtacaattgttcccatccaacaagaaggctggtttatctttacctttgctgtttaattactatttctcttgtcaatatgttgaatatgctgtatgagaaatattatgttgacattatgaaaattttctgcaccagacaaatacttggcttattggttctcttagttatgccttcttgacattatgtcctgaattaatgcctggattccagcatgaaaggcaactaactgtattgtgattgagaaagtataataccgatattataaccttcttccatttattgacttcccctttttattatcatgcttaatagtaggggtgagcaatactcaacccaatctaaagcctatccccccccccccc

SEQ ID NO: 6319 - DNA, 731 bp, Cyamopsis tetragonoloba
cacgaggcttttcgatcgtctctctgcaattgagctcgtctctgcaaactccgaccatcttcacagccatggcgagcacaaaagtccagagggttatgacccagcccatcaacttgatttttaggtttcttcaaagcaaggcacgcattcagatctggctcttcgagcagaaggatttaaggattgaaggacgaattatcggttttgatgaatatatgaatttggtccttgatgatgcagaggaagtcaacgtcaagaagaaaagcagaaagacattagggaggatcctgcttaaaggagacaatatcactttgatgatgaacacggggaaatgatgataaacacctttaaaccttgtgtcctatccaacaaggaggcagacttatcttccccttttcagtgtaattactattttgaatatgctgtgtgagaatatcatgtattactgtatggttttttcatgctctagatggattcttctttcagttgcttagcatcttgggaccttgttatcacatcagcatggaagataacaatattatgaatgatgaattgtaaaatcagctttaatttttagccggttccccattcgttagttttttcctttttattgtgatgtcatattatataatcatatataggagtttgttagttggatttctttatatctctgtttgttatatttgctaagatttggcaaaaggtaaatgttgattatgcgggttatgaaa

SEQ ID NO: 6320 - DNA, 538 bp, Glycyrrhiza uralensis
agtgaggagcattgttcagttcagctctctcatctctgcaaagtgctgcaacggttccgttcatagattactactagctgctgccatggcgagcaccaaagttcagagggttatgacccaacccattaacttgatcttcaggtttcttcaaagcaaagcgcgcattcagatttggctctttgagcaaaaggatttgaggattgaaggccgaatcattggttttgatgaatacatgaatttggttctggatgatgctgaagaagtaaatgtcaagaaaaagagcagaaagacattagggaggatccttcttaaaggagacaacataactttaatgatgaacacggggaaatgatgatgaacacattgggacagttgtattatccaacaagaaggcagatttatctttcccttttccgtttaattactatctcttgttaagatgttgaatatgctgtgagatatattaacatgtatgactaaggaaatttttatgcactagataaaatacttagttgaggtgaacatctgggtttgttgg

SEQ ID NO: 6321 - DNA, 489 bp, Glycyrrhiza uralensis
gagggttaacaagtagcgttgtcgctctgctccacttccgaaagtaaaacttggtctctgtttctaagcattattctgttggttcatagtagctgctgccatggcgagcacaaaagttcagagggttatgacccaacccattaacttgatcttcaggtttcttcaaagcaaagcgcgcattcagatctggctctttgagcaaaaggatttgaggattgaaggccgaatcattggttttgatgaatacatgaatttggttctggatgatgctgaagaagtaaacgtcaagaaaaagagcagaaagacacttgggaggatccttcttaaaggagacaacataactctaatgatgaacactgggaaatgatgaagatttatctttccctattctgtttaacaattatttctcttgttaagatgttgtatatgctgtgagatattatgatgtatgactaatgaaatttttatacactgataaatacttagttt

SEQ ID NO: 6322 - DNA, 711 bp, Lotus japonicus
ggagtgtagagagagacaacaacattgttcagtcttgttcttcagggttttgctgtcgcggtcactgcaaagcaccatcttcttcgcgcatacaattcagcagccatggcgagcaccaaagttcagagggttatgacccagcccattaacttgattttcaggtttcttcaaagcaaagcgcgcattcagatttggctatttgagcagaaggatttgaggattgaaggccgaatcattggttttgatgagtacatgaatttggttctggatgatgctgaagaagtaaacgtcaagaagaagagcagaaagacattagggaggatccttcttaaaggagacaacataactttgatgatgaacacgggcaaatgatgatggacacattgggacagttctactatccaacaagaaggctgatttatctttcccttttccgtttaattattgttgctcttgttaacatgttgaatatgctgtgtgaggatatttatcgtgtgtgacagtaagaaattttggtacactagataaatactcagtatagctgcttatcatcttggtctgttgggtcactctttgtctacattaattaatatacagattgacatgggagctatgaccaagtttgggttagcttctagtttataggagcttctcaactaagtattaggcttctaacttatgaaaagtacttaaagttgtgtttatggagaa

SEQ ID NO: 6323 - DNA, 547 bp, Lupinus angustifolius
ggaatcgcatttttcagtcttcactagggtttagctctctctgcaatcgttcattgattctgggaaccatggccagcaccaaagttcaaagggttatgacccagcccattaacttgattttcaggttccttcaaagtaaagcacgtattcaaatttggctctttgagcaaaaagatttaaggattgaaggccgaatcattggttttgatgaatacatgaatttggttttggatgatgctgaagaagttaacgtcaagaaaaagagcagaaagacattggggaggatccttcttaaaggagacaacataactcttatgatgaacacggggaaatgaggaaaactccggtgtaattgtaaacattatgtcctatccaattgaacagatgaagatttatctgtcttttcagtttaattacaatttatctagttaccattttgaatatgttgtgtgagaaatcttgttatgtgactgatgaatatcctggcaatagatagattcttagttgagctgcttatcatttgggtatgttggtctaccttattatg

SEQ ID NO: 6324 - DNA, 655 bp, Lupinus angustifolius
gattttgcagtcttcacacttcttcagcattgactagggttttgttctctctatttggcatctctgcaaaatttcaatcgtccattaatttttggagccatggccagcaccaaagttcagagggttatgacccaacccattaacttgattttcagatttcttcaaagtaaagcgcgcattcaaatatggctcttcgagcaaaaggatttgaggatcgaaggccgcatcatcggttttgatgaatacatgaatttggttttggatgatgccgaagaagttaacgtcaagaagaagagcagaaagacattggggaggatccttcttaaaggagacaacataactctaatgatgaacacggggaaatgatgaaaactctgatgtaattgtaaaccatatgtcctatccaatgaaacagaccgatttatctttctgttttcagtttaattataatttatctagatatcatttggaatatgttgtgggagaaatcttgttatatatgacagtatgaattttctagcactagataggttcatagttgagctgcttatcatcttggtttgttagcctgcctggtttgttatgtatgacagtatgataagattataactatattatggtcagggcatcaacattatatactttctcccaatta

SEQ ID NO: 6325 - DNA, 708 bp, Cajanus cajan
gaggcgaaaacagtcacaagtgtctatatgtttgaaagtgagaagacgaaaccctagttttggtttttggttggctcatacattcgaaagttagtagtcttcctcttcccattccaaaactctagcagccatggcgagcaccaaagttcagagggttatgacccaacccattaacttgattttcaggtttcttcagagcaaagcgcgcattcagatttggctttttgagcaaaaggatttgaggatcgaaggccgaatcattggttttgatgaatacatgaatttggttcttgatgatgctgaagaagtgaacgtcaagaagaatagcaaaaagacattagggaggatccttcttaaaggggacaacataaccttaatgatgaacacggggaaatgatgaatactctgacagttgtaaactatattcttatccaacaagatggcaaaattatcttccctttcccgtttaattactgtttctcttggtaacattttgaatatgttgggtgagaaatattatcttgtattaatctgtgaattttttctacaataggtaaattcttggttgagcagcttaatagttaatatattggtttgttggtcctcttaattttgcattctgtttacctattttactctagtttctatcttgaagatgatgatatatctttgaggagttataggctttatagaactaatattacaacc

SEQ ID NO: 6326 - DNA, 1241 bp, Cajanus cajan
ggagcatgtgcatgagtatcggtttctttcgttcatctttaaaaccctttcagttttaataaaacctttttagggtttagtggtgtacctttcacttcttcgaatcgtcgttgattttagcagccatggcgagcaccaaagttcagagggttatgacccaacctattaacttgattttcaggtttcttcagagcaaagcacgcattcagatttggctttttgagcaaaaggatttgaggattgaaggcagaatcattggttttgatgaatatatgaatttggtccttgatgatgctgaagaagtgaacatcaagaagaaaagcaaaaagacattagggaggatccttcttaaaggagacaacataactttaatgatgaacacggggaaatgatgaagactctgtgggacagttgtaaactatctttcctgtccatcaaggaggtggaactatctttcccttttcagtttgattactatttctcttgttaacattttgaagattttgtgtgagaaatattgtcatgtatgaagttgtgaatttttcgtacactagataaattcttagttgagctgcttaacatattagtttgttggccctcttaattttgccattggtttgcctctattatcccgattgtatattttccccttcctcatttattggttttctgctttatgtttaatatcatatatctaattcaatccttataggaatttgctagattggttcctttgggatgtctttttgctgtatttgctaaggttttgctggaggcaaatgcccgttatgcaaggttatgaaatagagcattttgacggcaatcagttttagatctgttgatttggactgcttccaaatgctgtgcaaatttctagaagattacttgaagtatggaatgttctagacttctagtagcatttatggtgaggaagttgtacaagtaaattttggcaacagattttatggtggagggtagcaatttcttgtagtgattattcttgagttctcgtactcattgtcttattctcctaggctatctttcatttaatagaaatggaaatgtgttagtcgttattgtttgaatccttagaaattataaaggatataacaaactgggtaactcttccatctcattccatccaatgcacattttaacttctctaatttgggaggtatgggaggatgagccaactctttatttaaaataaccatcaaattgattttttttttccttaaccc

SEQ ID NO: 6327 - DNA, 571 bp, Glycine max
agttgtctgcaacagagtaagagggcaaaaccctagctttagtgtcttcccgcccatctcttgcaatctcatagattttagcagccatggcgagtaccaaagttcagagggttatgacccaacctattaacttgattttcaggtttcttcagagcaaagcgcgcatccagatttggctctttgagcaaaaggatttgaggattgaaggccgaatcattggttttgatgaatacatgaatttggttcttgatgatgctgaagaagtgaacgtcaagaagaaaagcagaaagacattagggaggatccttcttaaaggagacaacataaccttgatgatgaacacggggaaatgatgaacaacgctggcacagttgtaaacactgttcctatccaacaggagagaaaaaaatatctttccttttccagtttaattactgtttctcttgttgaaatcttgaatatgttgtgagagaaatattatcatgcatgaatctgtgaatttttaatacactagatgaattcttagttgagcagtttaacatattatattgccttcagtttgcctctatta

SEQ ID NO: 6328 - DNA, 663 bp, Glycine max
atttgtctgaaacagagagtgagagagagggcaaaaccctagctttggagtcttccctcccatctcccacttcttgcaatctctgcagccatggcgagtaccaaagttcagagggttatgacccaacctattaacttgattttcaggtttcttcagagcaaagcgcgcattcagatttggctttttgagcagaaggatttgaggattgaaggccgaatcatcggttttgatgaatacatgaatttggttcttgatgatgctgaagaagtgaacgtcaagaagaaaagcagaaagacattagggaggatccttcttaaaggagacaacataaccttgatgatgaacacggggaaatgattaacactctggcacagttgtaaactccgttcctatccaacaagaaagaaaaattatctttccctttccagtttaattactgtttctcttgttaacatcttgaatatgttgtgggagaaatattatcatgtatgaatctgtgaatttttaatactctagataaattcttagttgagcagtttaacatgttatattgccatcagtttgcctctattatatttgtgcctggaagcttgtgattttatgactgaggaagtatagcatcaatcttaacctcatttagtggatttctccttttattatgtt

SEQ ID NO: 6329 - DNA, 363 bp, Vicia sativa
acctagctgccatggcgagtaccaaagttcagagggttatgacccaacccattaacttgatcttcaggtttcttcaaagcaaagctcgtattcagatttggctctttgagcagaaggatttgaggattgaaggaagaatcattggtttcgatgagtacatgaatttggttttggatgacgcagaagaagtaaacgtcaagaagaaaagcagaaagacactagggaggatccttcttaaaggagacaacataaccttgatgatgaacacggggaaatgatgagcacatatttccatccaacaagaaggctgattttatctttacatttttcagtttaatgactatttctcctgtcaacatgttg

SEQ ID NO: 6330 - DNA, 642 bp, Cucurbita pepo
ttcgaagcatcggtctctggacgtgaagtggaagtgctctagggtttacatttcgtatcgaagattctcccactgccaaaacaaattcggtagccatggcgagcaccaaagttcagaggattatgactcaaccgattaacttgatattcagatttcttcaaagtaaagctcgtattcagatttggctatttgagcaaaaagaccttaggatcgaaggccgaattattggatttgacgagtacatgaatttagttcttgatgatgctgaggaagttaatgttaagaaaaagagtaaaaagcactcgggaggattcttctcaaaggagacaatataacgttaatgatgaatacgggaaaatgatgatcatccagcagaccacattattgagatagttttcacttccatcgtatggcgttatagcttttacaatcatcttccttttggagttgtatctttcaacgttttaatccatcgatgattaactagttattatttggaagtataatgttatttcgctgttggtagataatatccttttatttatcgtccttataaccggttgtttattcatctaatccttgaaattatggaactagggctccttgaatcgtaaactataaatagtggagcatcgtttgtac

SEQ ID NO: 6331 - DNA, 437 bp, Glycine max
aggcagtcttttggggtttaaccgtgtacctctcacttcttctacgaccatcatcttccttccttccttcaatcgttctaactcttagcagccatggcgagcaccaaagttcagagggttatgactcagcccattaacttgattttcaggtttcttcagagcaaagcacgcattcagatttggctatttgagcaaaaggatttgaggattgaaggccgaatcattggttttgatgaatacatgaatttggttcttgatgatgctgaagaagtgaacatcaagaagaagagcagaaaaacattagggaggatccttcttaaaggagataacataactttaatgatgaacacggggaaatgatgaacactccttgacagttgtaaactatgttcctatcaaacaagaaggcataattatctttcccttgggtttgtatt

SEQ ID NO: 6332 - DNA, 588 bp, Phaseolus vulgaris
actatagttcagattttagggtttaaaagggtctctctctcacttctcctgccatctttctactacaatccttcataaattttgtagccatggctagcaccaaagttcagagggttatgactcagcccattaacttgatttttaggtttcttcagagtaaagcacgcattcaaatttggctttttgagcaaaaggatttgaggattgaaggacgaatcattggttttgatgaatacatgaatttggttcttgacgatgctgaggaagtgaacgtcaagaagaagagcagaaagacattagggaggatccttcttaaaggagacaacataactttaatgatgagcacggggaaatgatgtacactctggggcattttgtaaactatattcctattgaacaaggcagaactatttttctctttggtttgtattcatctatcaaactcccaaactggaagctgatggttttatgattgtggaagtatagcactaatattacgacctttctctcatttgatgagtttctcattttgttatgtttttaatatatcttattaaatcctttatacaagtatgttagattgatttc

SEQ ID NO: 6333 - DNA, 771 bp, Fagus grandifolia
atttgaacccaaaaagataagaaccgtgaaccagaaatgaatatgaaacggcgtcgttttagtaacataaaactagcaaagtttgcaacgatgtcgtttagcgtgaaagaaaaaacccctaaacctttctctgacctagctcctctcagtcacgctctctctctggtctgggaattcgctttggttttgcctctctgtgagtttgacctgaagaagtagaaccattcactttcgcaatcgcagccatggcaagcaccaaagttcagaggatcatgacccaacccattaacttgattttcaggtttcttcagagtaaagctcgcattcagatatggctttttgagcagcgagacttgaggatcgagggtcgtatcattggctttgatgagtacatgaatttggttctggatgatgctgaagaagtcaacgtcaagaagaagagcaagaaaactttagggcggattcttcttaagggagacaacataactctgatgatgaacactggaaagtgatgatgattccagcaattttgtaagttggcattacgtggcctgttcaatcacatggaggcctagcatctttgtttactggccatgttgtatacatcttggacatcaagaatgattaaagtaaacatatgaaggattctctatccatctagtaaatacattgtcactgttgctcttttacatttatgcctcatatgcattttttagaatcttgattgttccatagatagaaaatctatacaattttcatcgggtttcttgt

SEQ ID NO: 6334 - DNA, 863 bp, Cicer arietinum
aaaataggttaaattatttaattttgtgctgctcccgttggtgtctaaaacctcctctcatctcagtgagtgagtactgagtagcaaaaaccctctcatctctgcaaattgcgaacgtcgataaacttcagcttcaatggctagcaccaaagttcagagggttatgacccaacccatcaacttgatcttcaggtttcttcaaagcaaagcgcgtattcagatttggctctttgagcaaaaggatttgaggattgaaggaagaatcattggttttgacgagtacatgaatttggttttggatgatgctgaagaagtaaacgtcaagaagaagagcagaaagacattagggaggatccttcttaaaggagacaacataactttaatgatgaacacggcaaaatgatgagcacattggtccggtcgttgcatccaacaagaaggcttatttatctttaccttttcagtttaattacaatatctcttgtcaacatgttgaatatgctgtgtgagaaaatattatgttgacaatgtgaattttttatgcaccaagacaaatacttgattgatggtcctcttagttatgccttcttgttggctgtattaatgctcagattccagcatgaaaggaaactaactgtattgtgattgagagtatagcaccatattatataaccttcctccatttattgtcaatttgatcccttctaaaaacccaaatttattctcaaatcattgtaatgtcagtcaatttagtctttgttatagcggtcatgaactattttgatagtatgttgttttttttcctaaacttttataacagtaagttgtaatttagaagaagtatttttataattcgaggatta

SEQ ID NO: 6335 - DNA, 695 bp, Vigna unguiculata
ggaattcagagtttagggtttaacagtgtgtttctcacttctcctgccatcttcctgctacaattgttactcccttctcgtaaccatggcgagcacaaaagttcagagggttatgactcagcccattaacttgattttcaggtttcttcagagcaaagcacgcattcagatttggctttttgagcaaaaggacttgaggattgaaggaagaatcattggttttgatgaatacatgaatttggttcttgatgatgctgaggaagtgaacatcaagaagaagagcaagaagacattagggaggatccttcttaaaggagacaacataactttaatgatgagcacggggaaatgatatacactctgggacatttgtaaactatattcgtatcaaacaaggcagaactatttttctctttggtttgtattcatctatcaaactcccaaactggaatctgatggtttttcgattatggaagtatagcctacaacctttccctcatttgattactttctcattttgatatgtttttaatatctcttattcaatcccttatacaagcatgttagattgatttctttgggatatctcttcaatgtatttgctaaggttttgcaataggtaaatgtctttatgctggatataatagttcatttttatagcttacacttaaatctattgatttggatggcttcca

SEQ ID NO: 6336 - DNA, 657 bp, Cucurbita pepo
ccctaacagaagtttcaatctataccacagctgtgagctgcaatttgtgagcgaaagcggagaagttaggccttcgatttcctttttccccttccttcagaaatcttttcgattcagtcgccatggcgagcaccaaagttcagaggattatgacccaacccatcaacttgattttcaggttccttcaaagtaaagctcggattcagatatggctttttgagcagaaagacctgaggatcgaaggccgaatcattggctttgatgaatatatgaatttggtgttggatgatgccgaggaggtcaatgtgaagaagaagagcaagaagagtttagggaggatattgctcaaaggagataacataactctgatgatgaacacggggaagtgatggacattttttggtgcacccataatagagatagcgaagtcagcccctttcatgttgaaacttgaaggccttgtgttaccatagaatgttcattttactgtcaaatggttggctgtttttgtactgttgtttaaagaaagtagaatacagtttatgtaagacaaccattgcactcaactcatccacctctattattgttgcttgggggtcattgtacttagtttgcatcggatcctcaactctatcattcatggttagatttgaatat

SEQ ID NO: 6337 - DNA, 709 bp, Lotus japonicus
ggattcccattcaattcaaaaccctttactctcactatagtttcaggttttagctcaattcgattctcgtcttcttcttcgattttagcagccatggcgagcaccaaggttcagagggttatgacccaacccattaacttgattttcaggtttcttcagagcaaagcgcgcattcagatttggctctttgagcagaaggatttgaggatcgaaggccgaatcattggttttgatgaatacatgaatttggttctggatgatgctgaagaagttaacgtcaagaaaaatagcagaaagacactagggaggatccttcttaaaggagacaacataactttgatgatgaacacggggaagtgatgatcaacacatttggacagtggggatatccaacaagaaggcttatttagcttccccttttcagtttaatcactatttctgctgttaacatgttgaatatgctgtgggagatatattatcatgtatgaacagtgttaaatttttatcccattagataagtacttagttgagctgcttaagatattggtttgttgatccacttagctatgccttcattctgcctttatgagtatccatccggcatggaggctaattgtattatgattggcaaagtataacaccaatgttacaagcttccccaatttatttacttttttctcctatcatgctatcatactatttatcattt

SEQ ID NO: 6338 - DNA, 723 bp, Momordica charantia
gatttgcgattgaaagctgaaagcagagagttcggccttcaatctccttgcaccaccaacctctttgttcggaaagcttttcgattcagtcgccatggcgagcaccaaagttcagaggattatgacccaacccattaacttgattttcaggtttcttcaaagtaaagctcgcattcagatatggctttttgagcagaaagacctgaggatcgaaggccgcatcattggcttcgatgaatatatgaatttggttctcgatgatgcagaggaagtcaacgtaaagaagaagagcaggaagactttagggaggatactccttaaaggagacaacataactctgatgatgaacacgggaaagtgatggtcatttttgcaccctttaagaggtattgaagtcggccctttcacggcgtaacatagaatgttcattttagtgtgaattgttgatgtgtttattgtagtgacgttaaaagatgtagtttatatgagagatactagacactgcactcaactcatccagctctctacttgttgctttgctttgctatgatacatgctaggtttgaatatcaaatttcagttggatttgcttggaattgctcaaaatttgggtgttacagaaagaatgtagccctgtttactagggaatgagaatcaattttttcattccctttatcaggttgtaggaatcgaaagaaatgatgagacttatctcaaactttg

SEQ ID NO: 6339 - DNA, 660 bp, Petunia hybrida
tactagggtttagggtatttgctaaggtttagctgctttcgttgagaccaaagaagaaaagttgatcgggagaagcaggaatttaagcaatggcgagcaccaaagttcaaaggattatgacccagcccattaacctgatcttcaggtttcttcagagtaaagctcgcattcagatatggcttttcgaacagaaggatctgaggattgaaggacgtattattggttttgatgagtatatgaatttggttctggatgatgctgaggaagttaatgtgaagaagaagagcaaaaagcagttggggcggatacttctgaaaggcgataatatcactctgatgatgaacacgggaaaataatttcctgacggagttcggaggttggcggcatcttttgtgttgccagatgcgaattgaaactatatgtacttgtgaatgacagaattgcatggccctgactatgatttagattttgtattttctaaggtatattcagcatgattttgttgaatcgaagatgctttaacttttgtatgaatgtctattaatgaaactggatcttgctcatctccatttctagggtactcaggcttgactattagcactcagcagtgtattttcccagtttctggtggtcgagtatatattgaccatacctttttat

SEQ ID NO: 6340 - DNA, 746 bp, Glycine max
agttaatgagaagatataaaactctggtgaggaaattacaatctctcatttcaggcagtcttttggggtttaaccgtgtacctctcacttcttctacgaccatcatcttccttccttccttcaatcgttctaactcttagcagccatggcgagcaccaaagttcagagggttatgactcagcccattaacttgattttcaggtttcttcagagcaaagcacgcattcagatttggctatttgagcaaaaggatttgaggattgaaggccgaatcattggttttgatgaatacatgaatttggttcttgatgatgctgaagaagtgaacatcaagaagaagagcagaaaaacattagggaggatccttcttaaaggagataacataactttaatgatgaacacggggaaatgatgaacactccttgacagttgtaaactatgttcctatcaaacaagaaggcataattatctttcccttgggtttgtattcatctaacaaactctcaaaccggaagctgatgattttatgattaaggaagtatagtaccaatattacaacatttccctcatttgttagctttctccttttattatgtttattttgtatcttattcaatcctttatagaagtttgtttgatcaatttctttgggatgtctttttattgtatttgccaaggttttgcaagaggcaaatgtctattatgctggatatttaatattgcattttgataacattcacttctat

SEQ ID NO: 6341 - DNA, 654 bp, Trigonella foenum-graecum
gctatagcactgttgtgttgcggaatttgaacaaaccacttttgcgatttgtagttgacaacattgtaatttgtgtaggaatatttgtgtgtttcgcctctctgcaatctattcattcaccctctcgtgtctcggtactgtaactgccatggcgagcaccaaagttcagagggttatgacccaacccattaacttgatcttcagatttcttcaaagcaaagcgcgcattcagatttggctctttgagcaaaaggatttgaggatcgaaggcagaatcattggttttgatgagtacatgaatttggttttggatgatgctgaagaagtaaacgtcaagaaaaacagcagaaagacattagggaggatccttcttaaaggagacaacataactttaatgatgaacacggggaaatgatgatgagcatattggtatggtatggtatggttgttccatcgaacaagaaggcttctcttgtcaacatgttgagtatgcggtttgagaaatattatgttgacaatgtgaaatttttatgcatcagacgaatacttggtttgttggttctcttagttatgccttcttgttgccagattccagcatgaaagccaactgtattgtgattcagaaagtttaacataaatattattgccttcctc

SEQ ID NO: 6342 - DNA, 500 bp, Glycine max
ggtttagctgtgtacctctgctctcacttctccgaccatccttccttccttccttcaattgttctaactcttagcagccatggcgagcaccaaagttcagagggttatgactcagcccattaacttgattttcaggtttcttcagagcaaagcacgcattcagatttggctatttgagcaaaaggatttgaggattgaaggcagaatcattggttttgatgaatacatgaatttggttcttgatgatgctgaagaagtgagcatcaagaagaagagcagaaagacattagggaggatccttcttaaaggagataacataactttaatgatgaacacggggaaatgatgaacactccaggacagttgtaaactatattcccatcaaacaagaaggcataattatctttccctttggtttgtattcatctaacaaactctcaaaccagaagctgatgattttatgattgaggaagtatagtaccaatattacaacatttccc

SEQ ID NO: 6343 - DNA, 751 bp, Amaranthus tuberculatus
acaacaagcaaacaacactccagtattcccgcacaaatcgtctctcgcaatttacaggtttataaagctagggtttaggagagaccagttcctaagcagctgcaaaaatggcgagcactaaagttcagaggattatgacccagcctattaacctgatcttcaggtttcttcaaagcaaagctcgtattcagatttggctgtttgagcagaaggatttgaggatcgaaggccgtataattggctttgacgagtacatgaatttggtgttggatgacgctgaagaggtgaatgttaagaagaagacaaaaaaaacactagggaggatccttttgaaaggagacaatattactctgatgatgaatacggcaaaatgaggcccagctgcccaggttattgtgcacatgttcagagtctttgaattgttggtctgcaagccgctgcaatgtgctctcttgctgtagaagtttttgtgttaaattgctgattaatttggtatctattactggtatttgccccgcccggtgtagatagatattatcatgatgagactgaagtagtggatcagatgttttttttttccaaatgtagtggctttcttattcatgttatagtagaggccagagatttcattatcttggcattgtcgtagaatattgtgaatcattaatcgtaagatgtatttcgttattgccgtgtattcggatttgcacaatccagtttttagggggttaaaatccatgcttgacagggg

SEQ ID NO: 6344 - DNA, 1090 bp, Ricinus communis
cttgttgaaccttctctccatatttggctagcctatctctccagacacttttgtagccgttagcatcaatcatatcgcagccatggcgagtactaaggtccagagaattatgacccaacccattaacttgattttcaggttccttcaaagtaaagctcgaattcaattttggctttttgagcagaaagatttgaggattgaaggccgaattattggttttgatgagtatatgaatttggttcttgatgatgctgaggaagtcaatgtcaagaaaaagagtagaaagactttaggaaggattcttcttaaaggagacaacattactctgatgatgaacacggggaaatgatgatcaacctggcaactgcatggacatctccatgagctatctagagtctaccgctatattgaatattgaaacatgctttcatttggactttaggtgataaatgtaggcgggatatggatcgaggaaaatgtttgagagattaggtttgtcgttaacttgaccttactgttgcaattaatatcatgatgcttgtcaggaatttatattatatgagctgtacatgttcatgaactatttgtatgcaacagatatctgtatggaagcttcatgattttagacaagctcgtagctgacgcatgctttagatctcatgtctcatgagagcataagctttattgagattgaaacaagtcaacaagggtacaggagaggaaataaataacatgaaagaaaatgtagaagtgtatgtggggttagaagtaataaaagggcttgtgccactgccattgcacccctgcccttgatggcaacctatatgcatataatgtgtctgcctgtgttggagcaattactgtatccatggcccatttgccttgtcctctttctttgcactactcgttgctgactattgactcggcttccacatatatcagatctttaccccaaacatgtatgctggcctgcctgcctttgcttgccttttttatgtggttggttgtgtattcctttgatattccatactccttcaagcatgtcaaaacaatgatgatttgattcccagcgctcaagcacaagaacaaa

SEQ ID NO: 6345 - DNA, 757 bp, Cucumis sativus
acctaaaccgtataagccttcgttgccctaattgaagttccattcccgtagttggcgactgtgagggcgtgagctgctgcgtcttgcgagtgaaattcagagacacttggctcttccaatttcctttcttcagaagtccatttcattgaatcgccatggcgagcaccaaagttcagaggattatgacccaacctataaacttgattttcaggttccttcaaagtaaagctcgaattcaaatatggctttttgagcaaaaagacctgaggattgaaggccgaatcattggctttgacgaatatatgaatttggttttggatgatgctgaggaagtcaatgtaaagaagaagagcaggaaaactttggggaggatactgcttaaaggggataacataactctgatgatgaactcgggcaagtgatgaccatttttgcaccaatataagagatagtgaagtgtagcccctttcaatggtgaaacttggaagtcttgcgttgatcataacgtagaatgttatttttactgtcaattggttggctgtttttgtacttgccttaaaagaaattaaaatgccagcttatatgagagatagtcatcgcactcaattcatccagctctaatgttgcttagatcattgtatttattttgcatatatcctcaactttatgatccatgctagatattgccgtttgctgagctatattgtggattaattggacatcaagtagaaattggttcttgtttatctttatgtta

SEQ ID NO: 6346 - DNA, 649 bp, Cucumis sativus
ctctacaatttaaataaatgtgggtttagggtttcgtttctcatagcccgaagattctcttacaatttcgaatttcggtagccatggcgagcaccaaagtgcagaggattatgacccagcccattaacttgatattcaggtttcttcaaagtaaagctcgtattcagatttggctatttgagcaaaaggacctgaggattgaaggccgaatcattggatttgatgagtacatgaatttagtgcttgatgatgctgaggaagttaatgtcaagaaaaagagtaaaaaggcacttgggaggattcttcttaagggagacaatattacactaatgatgaactcgggaaaatgatgcagcagaacacattattgagataaagttttcactttcgttgtaacattctggcggtaaagcccttacaattacgttctgttgagaggttgtttctttcaatgttttaacccattgctgatcagctagttctttggatgtataatgtaatgttatattgctgttggtaggttatccatgtatgtgaacacctcttagtttatcatcgttataattggttgtttacaccaaccaatccttgaaactattaatttaggttccttgaatcataaactataaacagtggagcacagtttgag

SEQ ID NO: 6347 - DNA, 748 bp, Linum usitatissimum
attttcatttagcgggagactcttgttcgttgaagaagaaacccccttcccctctctaaaccctaggaaagtcaccggagactcctgcagccatggcgagcaccaaggttcaaaggattatgacccaacccattaacctgattttcaggttccttcagagtaaagctcgtatccagatttggctgttcgagcagaaggatctgagaattgaaggccgaattatcggttttgatgagtacatgaacttggtcttggatgatgccgaagaggtcaatgtcaagaagaagagcagaaagtctctagggaggattcttctgaaaggagacaacatcaccctgatgatgaacacgggaaagtgagcttccattttgtactgtgttaagtaagaagactacatggtgcactaaagcaaggttgtaactttcgtcagaagttttgtgaatcgttgtagaagattaatgaaactgagttgaatgcttgaatgttgaagtctgttgttcctgttatgaaggatctgggaacctaattcagtttcattggtgttgccatgtaactctgtatcccctttactcaaggaaaacaaattgttatgcattttgtcagccttttgatattactactagtatgattgttgatactgagtgccttgaagcaaagaacagataatgtcgatgagttgcagctggtcttctaaggccaaccaacccgatgttataaaccatttttaactggccaagttgttgggatc

SEQ ID NO: 6348 - DNA, 877 bp, Humulus lupulus
ggccgggggtcacacgcacgcactgacctctctactctacctgctcttcgtctctctctaccagtgataattcgaacggcgccagaggaaagggaaagagctctctcagaagctagggttttacatttctgaagttcaacctcttcaattcgcagccatggcgagcactaaagttcagaggattatgacccaacctattaacttgatttttaggtttcttcaaagcaaagcacgcattcaaatttggctttttgagcagaaggacctaaggatcgagggccgaatcattggttttgatgaatacatgaatttggttcttgatgatgctgaagaagtcaacgtcaagaagaagagcagcaagacactggggaggatacttttgaaaggagacaacataactctgatgatgaattcgggaaaatgatgatcatgtcactgattggattgattggggcttacagtgttgttcccgtagcatagcatgtatgttgagttaatttacagttactacttcggccgcttggtttgagtacattttggatagcatgtaggagaactcattgaatgttgattttatatgcctataagtagataagttgttgcattcgcttctcttaattagtatctgctatgctctgattgtcatgtttgtgaaatctagtcatgtcatttctcctaggtagaactatgatgtctgagactgagtcatatcccctcataagttcataaccatgtgaaattttctgcgtcctctttcaaaaaaaagctgttttggaaaattattcttacggaacatttacatttacctcttggagtgttccaggcaccacaatgtaatatgtcacaatttttcaaaattttaatcacaggatgggga

SEQ ID NO: 6349 - DNA, 746 bp, Cucumis melo
aaagaagaagaaagaattcacatctaaaccaaaccgtataagccttcttcgttgccctaattgaagttccattcccgtagctggcgactgtgagggcgtgagctgctgcgacttccgagtgaactcagacagagttaggtcttccaatttcctttcttgagatatctatttgcttgaatcgccatggcgagcaccaaagttcagaggattatgacccaacctataaacttgattttcaggtttcttcaaagtaaagctcgaattcaaatatggctttttgagcaaaaagacctgaggattgaaggccgaattattggatttgacgaatatatgaatttggttttggatgatgctgaggaagtcaatgtaaagaagaagagcaggaaaactttggggaggatattgcttaaaggggataacataactctgatgatgaactcgggcaagtgatgaccatttttgaaccaatacaagagatagtgaagtgtagcccttttcagtggtggaacttggaagtcttgtgttgatcataacatagattgttatttttactgtcaattggttgactgtttttgtacttgccttaaaaagaaattagaatgtcagcttatatgagagatagtcatggcactcaactcatccagcactaatgttgcttagatcattgtatttattttgcatatatcctcaaccttatgatacatgctagatatttgctgagctatggtggattaattggacaacaa

SEQ ID NO: 6350 - DNA, 649 bp, Cucumis melo
gaagcgccaattttgaaatcaagtacatagagagagataaaaatgtgccgcgaggggtctttacaatttaaataaaactgggttagggtttcgtttctcatatccccgaagatcctctttacattttcgatagccatggcgagcaccaaagtgcagaggattatgacccagcccattaacttgattttcaggtttcttcaaagtaaagctcgtattcagatttggctatttgagcaaaaggaccttaggattgaaggccgaattatcggatttgatgagtacatgaacttagtgcttgatgatgctgaggaagttaatgttaagaaaaagagtaaaaaggcacttgggaggattcttctcaagggagacaatattacattaatgatgaacgcgggaaaatgatgatcatccagcagaacacattattgagataaagttttcactttcattgtatggtgctatagcttttacaactaccttctgtttggagttgtatctttcaacgttttaagccatcaatgattaactagttctttggatgtatgatgttatattgctgttgataggtaacattctggcggtgaagcctttacaattaccttctgttgtgaggttgtttctttcaacgttttaagtcatcgctgattag

SEQ ID NO: 6351 - DNA, 732 bp, Nicotiana benthamiana
gccatttcgattcgcgcatccaagtattagggtatttggtagggtttagctgctttccttgagaccgcagagcgagctttacttcgtcggagaaacaggagtcttagccatggctagcaccaaagttcaaaggattatgacccagcccattaacctgatcttcaggtttctacagagtaaagctcgcattcagatatggcttttcgagcagaaagatctgaggattgaaggacgtattatcggtttcgatgagtacatgaatttggttctggatgatgctgaggaagtcaatgtgaagaagaaaagcagaaaacagttggggcgtattcttctgaaaggcgataatatcacactgatgatgaacacggggaaataatatttcgtcagttggagtacgtagggtggtgatatctttatgtgttcgcgggatgcgaattgaaaccttgtgtcctcatgaatgacagaatatgtgccctgacttctatttagattttgtattctgctataggtatattcgacatggtttcattgaatcaaatgctttaattgttgtatgaatttctatctattaaacaggttctgggctcctctgcatttctggattgcttgatggcttgaactattagcagcgtatattttccaattttcagtgggttgggtataaatcaaccacacccttttatcatttgaggtctcgtgtttggaatatgtttgatttggagacattgatcg

SEQ ID NO: 6352 - DNA, 732 bp, Nicotiana benthamiana
ccgaatttatattcgtaagtgtacggtattaggcgccatttcgattcgcgcatccaagtattagggtatttgctagggtttagctgctttccttgagacgcagagcgagctttacttcgtcggagaaacaggaatcttagtcatggctagcaccaaagttcaaaggattatgacccagcccattaacctgatcttcaggtttctacagagtaaagctcgcattcagatatggcttttcgagcagaaagatttgaggattgaaggacgtattatcggtttcgatgagtacatgaatttggttctggatgatgctgaggaagtcaatgtgaagaagaaaagcagaaaacagttggggcgtattcttctgaaaggcgataatatcacactgatgatgaacacggggaaataatttttcgtcagttggagtatggaggttggtgacgtctttatgtgttcacgggatgcgaattgaaactgtgtgtcctcatgaatgagagaatatgcgccccgacttctatttagattgtgtattctgctataggtatattcgacatggtttcgttgaatcaaatgctttaattgttgtatgaatttctatctattaaacaggatctgggctcctctgcatttctggattgcttggcttgactattagcagagtgtatattttccaagtttcagtgggttgggtattataaatcaaccacccttttatcatttgagctctggttg

SEQ ID NO: 6353 - DNA, 799 bp, Orobanche aegyptiaca
aaaacctataataaaagactcggagaatctcgaacctattgctagggtttttgctgcgagagaagtagagagagcgccagtaacttttctgcatcggagtccagaatcatcagcagcaacagcagccatggctagcacgaaagtccagcggattatgacccaacccattaacctgatcttcaggtttcttcagagcaaagctcgcattcagatatggcttttcgagcagaaagatctgaggatcgaaggcagaataattggcttcgacgagtacatgaacttggttttggatgacgcggaggaggtcaatgtcaagaagaagagcaggaagcatctcgggagaatcttattgaaaggggataatataactttgatgatgaatactgggaagtgatgctggaaaacaggctatttgactgaatcttgaagaaggcttggtcctcgtggttcgatccgatgtctggcttgacttcattagaatctactttctgttagactgttgttcttttatctccttatctttatgtccccctatcttacttttatatgtatgttagtatcatgtaccaagatttactagtacttgaaattggatattcggtaaaataggatatttgtttggtgggggattttgcagatagttgaatctattgagagattttgcatccttgatttggttatatttattctatttagtcatgtgaggtttttaccggactggaattgggtttgatttgttttgttggtcatgtgatgtttattttgaatgaacttgaagtggatacgaaaaaaaaaaaaa

SEQ ID NO: 6354 - DNA, 746 bp, Arachis hypogaea
ctcaggcacttagtcgcaaaccctagcaggtatactctgatcctcgccgctcgctgccggctgcccgttgcccaccgtcctcgccggcaactctcttttctctcatccctcgatactcaacggtattcaaattgaattcgttgaatttgtttgtttggtttagtagggttttagttcgagctccctcgctgcaaaatacagttttgtttctgcaactgtttgatccagtttccaaaccatggcaagcactaaagttcagagggttatgacccaacccattaacttgattttcaggttccttcaaagtaaagctcgcattcagatttggctctttgagcaaaaggatttgaggattgaaggccgtatcattggttttgatgaatacatgaatttggttctggatgatgctgaagaagtgaatgtcaagaagaacaccagaaagacattagggaggatccttcttaaaggagacaacataactttaatgatgaacacgggaaaatgatgaagaagatgaacacccagggtgtattgtaaaccatacattccattcagcaaggagacagaattatctttcattttgttaatcgctgtcacttagaattttgaatatccggtgtgagaatggttgttatgtagattagattttgttgcactagatgaattcttagttcagcgactttctttgctgttccacctgttctgccttctttatgcatatatcaatatcttatattacgattgag

SEQ ID NO: 6355 - DNA, 693 bp, Arachis hypogaea
gcttttggggtttggggttttagctgcaaacaacaacgatcttcctgaatccttttcgccatggctagcaccaaagttcagagggttatgacccaacctattaacttgattttcaggtttcttcaaagtaaagctcgcattcagatttggctcttcgagcaaaaggatttgaggatcgaaggccgaatcatcggttttgatgaatacatgaatttggttcttgatgatgctgaagaagtgaacgtaaagaagaatatcagaaagacattagggaggatccttcttaaaggagacaacataacgttaatgatgaacacgggcaaatgataatgaacattgaacagagggaggcagaactgtgaaccatacattctatccagcaaaggagaggcagaatcatctttcatttcatttcatttcaattactatttcacttatattgagtaggggatgtgaggaattttgttatgtagattgatttttctggcactagatgaattcttagttcagctactcatcattcttggtttgtttttccccatgattctgcctattctgctaggatcaatatctagactaaagctgggaagctaactgtattatgattgaggcaaatatatcaccaatgtcatataacctttttcctgttaaaaaaaaagaaaaaaaacaaaagtactctgcgttgataccact

SEQ ID NO: 6356 - DNA, 621 bp, Arachis hypogaea
ttttagctgcaaacaacaacgatcttcctgaatccttttcgccatggctagcaccaaagttcagagggttatgacccaacctattaacttgattttcaggtttcttcaaagtaaagctcgcattcagatttggctcttcgagcaaaaggatttgaggatcgaaggccgaatcatcggttttgatgaatacatgaatttggttcttgatgatgctgaagaagtgaacgtaaagaagaatacgagaaagacattggggaggatccttcttaaaggagacaacataacgttaatgatgaacacgggcaaatgataatgaacattgaacagagggaggcagaactgtgaaccatacattctatccagcaaaggagaggcagaatcatctttcatttcatttcaattactatttcacttatattgaataggggatgtgaggaattttgttatgtagattgattttctggcattagatgaattcttagttcagctactcatcattcttggtttcttttttccccatgattctgcctattctgctaggatcaatatctagactaaagctgggaagctaactgtattatgattgaggcaaatatatcaccaatgtcatataaccttttt

SEQ ID NO: 6357 - DNA, 682 bp, Arachis hypogaea
gagcaaagcaaattggaatccctcgatttgattgagctttgagattttggggtttagggttttagctgcaaacaacaacgatcttcctgaatccttttcgccatggctagcaccaaagttcagagggttatgacccaacctattaacttgattttcaggtttcttcaaagtaaagctcgcattcagatttggctcttcgagcaaaaggatttgaggatcgaaggccgaatcatcggttttgatgaatacatgaatttggttcttgatgatgctgaagaagtgaacgtaaagaagaatacgagaaagacattggggaggatccttcttaaaggagacaacataacgttaatgatgaacacgggcaaatgataatgaacattgaacagagggaggcagaactgtgaaccatacattctatccagcaaaggagaggcagaatcatctttcatttcatttcaattactatttcacttatattgaataggggatgtgaggaattttgttatgtagattgatttttctggcattagatgaattcttagttcagctactcatcattcttggtttctttttccccatgattctgcctattctgctaggatcaatatctagactaaagctgggaagctaactgtattatgattgaggcaaatatatcaccaatgtcatataacctttttcc

SEQ ID NO: 6358 - DNA, 969 bp, Glycine max
ggaaattacacattcacttcagtcagtctttacgttttagctgtgtacctctgctctcacttccttccttccttccttcaattgttctaactcttagcagccatggcgagcaccaaagttcagagggttatgactcagcccattaacttgattttcaggtttcttcagagcaaagcacgcattcagatttggctatttgagcaaaaggatttgaggattgaaggcagaatcattggttttgatgaatacatgaatttggttcttgatgatgctgaagaagtgagcatcaagaagaagagcagaaagacattagggaggatccttcttaaaggagataacataactttaatgatgaacacggggaaatgatgaacactccaggacagttgtaaactatattcccatcaaacaagaaggcataattatctttccctttggtttgtattcatctaacaaactctcaaaccagaagctgatgattttatgattgaggaagtatagtaccaatattacaacatttccctcatttgttggctttcttcttttattgtttatttggtatcttattcaatcctttagagaagtttgttagatcgatttctttggatgtctttttgttgtatttgccaaggttttgcaaaaggcaaaatgtctattatgcaggatgtgaaatagtgcattttgataacattcacttctattgatttggactgcttccaaatactgagtctgtgacaattactagaagatgacctcaaatatggaatagttctaatagcatttatggtgaggaagttgcacaattaatatattgatatattctagtagctattcttgaattttccttctcatcatcttattctcttaggctatgctacagttggtagaaacagaaatgaaatgctaggggatgtaatggaatctcatcagttgtcattgtttgaattcttaaaagatggaacaggctgg

SEQ ID NO: 6359 - DNA, 684 bp, Nicotiana tabacum
ggccatttcgattggcgcatccaagtattagggtatttgctagggtttagctgctttccttgagaccgcagagcgagctttacttcgtcggagaaacaagagtcttagccatggctagcaccaaagttcaaaggattatgacccagcccattaacctgatcttcaggtttctacagagtaaagctcgcattcagatatggcttttcgagcagaaagatctgaggattgaaggacgtattatcggtttcgatgagtacatgaatttggttctggatgatgctgaggaagtcaatgtgaagaagaaaagcagaaaacagttggggcgtattcttctgaaaggcgataatatcacactgatgatgaacacggggaaataatttttcgtcagttggagtacggaggttggtgacatctttatgtgtttgcgggatgcgaattgaaaccgtgtgtcctcatgaatgacagaatatgtgccctgacttctatttagattgtgtattctgctataggtatattcgacatggtttcattgaaacaaatgctttaattgttgtatgaatttctatctattaaacaggatctgggctcctctgcatttctggactgcttgatggcttgactattagcagtgtatattttccaagtttcagtgggttgggtataaatcaaccacaacaccctttt

SEQ ID NO: 6360 - DNA, 718 bp, Citrullus lanatus
ttcacatttaaaccgtaaaagcctccgttgccctaattgaagttccattcccgtagctggcgaccgtgaggctgtgagctgcgatttgcgagtgaaatcaccgagagttaggcctccaatttcctttcaacccctttcttgagaaatctattcgatttagtcgccatggcgagcaccaaagttcagaggattatgacccaacccattaacttgattttcaggttccttcaaagtaaagctcgaattcaaatatggctttttgagcaaaaagacctgaggattgaaggccgaatcattggctttgacgaatatatgaatttggttttggatgatgccgaggaagtcaacgtaaagaagaagagcaggaaaactttagggaggatattgcttaaaggagacaacataactctgatgatgaactcggggaagtgatggccatttttgcacccatataagagatagtgaagtgtacccctttcatggtgaaacttggaatccttgtgttgatcatagacattgaatgtttttttaactgtcaattggttagctgtttttgtacttgcgttaaaagaagttagaatgtcagcttatctgacagatagctattgcactcaactattccagctcttatgttgttgcttagatcattgtatttagtttttgcatatatcctcaaacttttttttattatatgctagatattgccgcttgctgggca

SEQ ID NO: 6361 - DNA, 798 bp, Citrullus lanatus
aaggggtttagggtttcgtttcttatcgcctgaagatcctctcaccctcagtacaatttcgatagccatggcgagcaccaaagtgcagaggattatgacccagccgattaacttgatattcaggtttcttcaaagtaaagctcgtattcagatttggctatttgagcaaaaagaccttaggatcgaaggccgaattattggatttgatgagtatatgaatttagtgcttgatgatgctgaggaagttcatgttaagaaaaagagtaaaaaggcacttgggaggattcttctcaagggagacaatattacattaatgatgaacacgggaaaatgatgatcatccagcagaacacattattgagattaagttttcacaatcattgtatggcgctatagcttttacaattaccttctgtttggagttgtatctttcaacgttttaagccatcaatgattaaccagttcttggatgtataatgttatattgctgttggtaggtagtatcctggcgccatagcttttacaattaccttctgttgggaggttgtatcttttaatgttttaagccatcgctgattaactagttctttggttgtgtaatgttatattgctgttggtaggttatacttgtatgtgaactccttttagtttatcgtccttataattggttgtttacaccgaccaatccttgaaactatggaatttgggttccttgaatcataaactagaaatggtggagcatcctttgagaacgtctggttaattttgagagggataggcgtttccctgaattctgat

SEQ ID NO: 6362 - DNA, 906 bp, Cucurbita pepo
taattcgttagggcgcgcctaaaaagcgcggggtacttccactttcaagaagcgttctctagggttcgtttcgcatctcctggaagtctaacaggcaaggtcctctcacctcctaaccaattttgatagccatggcgagcaccaaagtgcagaggattatgacccagcccattaacttgatattcaggtttcttcaaagtaaagctcgcattcagatttggctgtttgagcaaaaggaccttaggatcgagggccgaattattggatttgatgagtacatgaatttagttctcgatgacgccgaggaagtaaatattaagaaaaagagtaaaaaacactcgggaggattctcctcaaaggagacaacattacgttaatgatgaacacgggaaaatgatcgtcctgcagaacacattattgagatctattttcacttccattgtatggcactatagcttttacaatttagcttctgttcggagttgtatctttctacatttcaagccatcagtgactaactagttatttgggtgtataacgttatattgctattggtaggtaatgtcgttttatgtgaactccttttaaattattggccttagaattggttgtttgcaccaaccgaatccttgaaactacggactttaggctcctcaaattgtaaactgttaatggagcatcgtttgagaatttcctgtttatttcaagaggatgttggttaccctggatttgtttcattgaacctcaactcatggtcttcatcctcggagagaaagcctcaccttcctaatcctgtataagattgattaccaagttatgttgtgatgatgcgttctaaattattaccttttacctaggactttggtctatttttaattaataaccttcactcagacatcgttgacc

SEQ ID NO: 6363 - DNA, 553 bp, Carpinus betulus
tatagcattatagttagggcttccttacgagcgttgtgagttacagattgggagtgagaaagcagtatcagcagccatggcgagcaccaaagttcagaggattatgactcaacccatcaatctgattttcaggtttcttcaaagcaaagctcgcattcagatttggcttttttgagcagaaggatttgcgcattgagggccgtattattggctttgacgagtacatgaacttggttttggatgaggctgaagaagtcaacgtaaaaaagaagagcagaaagacattagggcgtattctactaaaaggggacaacataactctgatgatgaatacgggaaaatgatgaagcaatcagcagtggcatggcatttgaattgacacctcattgcatctcttcaatagtcaaagatgtgtagaaaatctcgtggtgaagttccaagttttaatattccctgtgatagggaagttttgagaaaactaaaacatgcctaacatgttgtttgttgttacttgggaattgctggctacttgttcacgtgtcaaccttccttt

SEQ ID NO: 6364 - DNA, 829 bp, Phaseolus vulgaris
gtcttacttgatcttccactgggacaacccaaaccaagaccaccttttcaaagcttctatctctttctttccctctcttttttttgtctttctctcttctttttgttaatcttttgctctcacttcttcaaccatcttctttcaatctgttggtagattttagcagccatggcgagcaccaaagttcagagggttatgactcagcccattaacttgatttttaggtttcttcagagcaaagcacgcattcagatttggctttttgagcaaaaggatttgaagattgaaggccgaatcattggttttgatgaatacatgaatttggttcttgatgatgctgaagaagtgaacatcaaaaagaaaagcagaaagaccttagggaggatccttcttaaaggagacaacataaccttgatgatgagcacggggaaatgatgaacaacacgcaggacagttatgctcctatccatcaaaaaagcaaaattatatttcccttcagtttaattatgtttctctccttaacattttgaatatgtaatgagagcaatattatcatgtatgaatctatgaatatttagtacactagataaatttttagtttggcagcttaacatgttggtttgtatgtcatattaattttgcctttaatatcccaattcttacctggaagttgatgatcttatggttaatgatgtatagcactgatatatgttaggaatactgcaactttgagtctcaccatagtagaaatgagacactgaaaacctcttctgtgtatcctctttgaaagactcaataatggtatgagagttcatggttcttcatggta

SEQ ID NO: 6365 - DNA, 406 bp, Ricinus communis
gtgttgaaaacctaataaaccctagctgccgcttgttgaacctgctctccatctccggcgagctacctctccagatatctttgaagtcgttaacaccaaatatcgcagccatggcgagtactaaggtccagaggattatgactcaacccattaacttgattttcaggttccttcaaagtaaagctcgaattcaaatttggctttttgagcagaaagatctgaggattgaaggccgaatcattggctttgatgagtatatgaatttggttcttgatgatgctgaggaagtcaatgtcaagaagaaaacaagaaagactcttggaaggattcttcttaaaggagacaacattactctgatgatgaattcggggaaatgatgatcaacgtagcaagtgtttggacttct

SEQ ID NO: 6366 - DNA, 512 bp, Castanea mollissima
gaagaaccatcgaatttggcagccatggcgagcaccaaagttcagaggattatgacccaacccattaacctgattttcaggtttcttcagagtaaagctcgcattcagatttggctttttgagcagaaagacctgaggatcgagggccgaatcattggctttgatgagtacatgaatttggttttggatgatgctgaagaagtcaatgtcaaaaagaagagcaggaaatctttagggcggattcttctcaagggagacaacataactttgatgatgaattctggaaagtgatgatgattccagcaattgtgtaaattggcatcaagctgccttttcaatcaaacgggggtctctagcatctttgtactggctatgttagatacatcttggacattaagtatgatttatgtaacttataaatgattttccatccattgagtagatacattggcactgtaactctaatacatggtttgggttggagtaatattcaaatggcacaagaaagattt

SEQ ID NO: 6367 - DNA, 541 bp, Cleome gynandra
aggaagagagaggccagaagacttagggaattagggttttagttttcctccacagttcgagctccagataccctgaaacttcagcagccatggcgagcaccaaagttcaaaggattatgacccaacccatcaatttgatttttaggtttcttcaaagtaaagctaggatccaaatatggctttttgagcagaaagacttgaggattgagggacgaattattggttttgacgaatacatgaatttggtgctggatgatgctgaagaagtgaacatcaagaaaaagaccagaaaaactcttgggaggattttacttaagggagataacataaccctgatgatgaacacgggcaagtgagggatgtgtaaaaaatccgcttatgtaccgccatccatggatgatgaatgtgtaaactgacatcttgatttctcaaaactctcaagatgtttaatgctttcttcaccttaaattggtgcttgacgctgtcgtatatcactgatcagatgttattggatggtttaagaccatttcttgattggtgt

SEQ ID NO: 6368 - DNA, 1104 bp, Gossypium hirsutum
cgagattttcacagccatggcgagcaccaaagtacagaggattatgacccaacccatcaacctgatcttcaggtttctccaaagtaaagctcgcattcagatttggcttttcgaacagaaagatttgaggattgaaggccgaatcattggttttgacgagtacatgaatttggttctggatgatgctgaagaagttaacgtcaagaagaaaagccgaaagtcattaggaaggattcttcttaaaggagacaacattactcttatgatgaatagtggaaaatgattgtagatccagcagttatttggactcgtgaatgcaaaatcttcttgtcatcgtataggtcaatctactatgactatatcgtactatctttaaaaacatgccttcgtgttaggacattcaccttctaggaggtgcttctagtatttcagacagtttactgatgcttttgcttagattatctaatgatttgacatgtatgattctgctctttgatctgcattataagatttctgattaagcctgcattcttctcgttttcgttaaccatgcatgtgctgctgttcggttttggatttcatttatttctggtacgtattggcctcctcatttatttagaagatctagctaactacgagtacatgttaactatgttactcctactcgttgtttgtttttcttcaagtataaaatgtctgatacttgtatttgatccatggatttggggatatgacttctaggaatcctcaaaatacatagaaaaacttggaaaaatcagaccatacctagtatcctgtactcagtcttctctcaaatccaagtagcattatcctcctaagtttttgaagcttattgtcgaagtcgtcgatgattttgtttgtgtcaatttggctttagtcatgatctaagtattgctatgatggtagattgtcttgaacctaaaaagtctatttgattgtagttaatataactcagaagttgaaaatgaccctaactagaaactatttgaatattaagttgcctttgggcttcgggtttagcatagttgtagccgttaccagtataatgcatctttggtcgtcaagtgatcttacaaaaaagaa

SEQ ID NO: 6369 - DNA, 807 bp, Solanum melongena
acggcttggggtattgctagggtttagctactttccttgagactgaagaaggagcttcattggtaggagaaacaggaatttcagccatggctagcaccaaagttcaaaggattatgacccagcccattaacctgattttcaggtttcttcagagcaaagctcggattcaaatatggcttttcgagcagaaggatctgaggattgaaggacgtatcattggttttgatgagtacatgaatttagttctggatgatgctgaggaagtgaatgtgaagaagaaaaccagcaagcagttggggcggattcttctgaaaggcgataatattactctgatgatgaacacggggaaataattgcttgtctaacgttgatgggatcttttacgtgttcaccaaatgcaaatcgaaaccatgtgacttcatgattgacagagttgcatggggccgactttcatttagtgtgtatgttgctgtaggtaatatttgacatggtttcattgaattaaatgctttgattgttgtatggattgcctatttatgacataggatctgggctcctctccatttctgtgacggttgatggcttgaatattagcgccacaggaagtgtatatttttcgtagtttttgttgtttgagtataacttcgaccacatcaattcctatggtgggtgaaacataccagagaaaaatgcgaagatgaaacaaaggaatacgtgggggagagactgctgacaaaagggatcaacaaaaacccaggaattgttaattgtgtgcctcagccaatataaaaaactttcattatctgg

SEQ ID NO: 6370 - DNA, 692 bp, Linum usitatissimum
aagcgggagattcttgttcgttgaagaagaaagaaacccctctgcccctctaaaccctaggaaagtcaccggaaaattctgcagccatggcgagcactaaggttcaaaggattatgacccaacccattaacctgattttcaggttccttcagagcaaagctcgtatccagatttggctgtttgagcagaaggatatgagaattgaaggccgaattatcggttttgatgagtacatgaacttggtcttggatgatgccgaggaggtcaatgtcaagaagaagagcagaaagtccctagggaggattcttctgaaaggagacaacatcaccctgatgatgaacacgggaaagtgagcttccagtttgtactgagttaagtaagaagacatggtgccctaatcagaagttttgtgaatcgttgtagaagattaatgaaactgagttgaatgcttgaatgttgaaatgggtctggatgggaaagctgttgttcctgttataaaggatctgaagctgttaaagtcatatctgggaacctaattcagtttcattagacgtgttggcatgtaactctgtatcccttttgctcaaggaaaataagttatgcattttgtcagccttctgatattactactagtatgattcttgatactgagtgccttgaagtaaagaacagataatatccatgaggtacat

SEQ ID NO: 6371 - DNA, 523 bp, Fraxinus spp
ttttggcgccggagctccaattcagcagccatggcgagcacaaaagtccagaggattatgactcaacccattaacctcatcttcaggtttctccagagcaaagctcgtattcagatttggctttttgagcagaaggatacgaggatcgaaggccgaatcatcggctttgatgaatacatgaatttggtactggatgatgctgaggaagtcaatgtcaagaagaagagcagaaagcaacttggtaggattcttctgaaaggagataatataacgttgatgatgaataccgggaaatgatgcaaaaggattagaaatgcaacatttgaaaactagaggggactggctagtaatgggttcctcagatttctggcagcaagtttgtacgagaatgccttgttttgttaaactccattttaaacgactttatttggtattttaattgtatctcatcactgtttctcggctgagcctttttgtgtatacatttgtatcttgttcaaagaactgctagctagcacttgac

SEQ ID NO: 6372 - DNA, 596 bp, Gossypium raimondii
aagagctcattttttatctgtttaaaacctttcgaaaaagagggaaaagaaaaaagcggtcgagattttcacagccatggcgagcaccaaagtacagaggattatgacccaacccatcaacctgatcttcaggtttctccaaagtaaagctcgcattcagatttggcttttcgagcagaaagatttgaggattgaaggccgaatcattggttttgacgagtacatgaatttagttcttgatgatgctgaagaagttaacgtcaagaagaaaagccgaaagtcattaggaaggattcttcttaaaggagacaacattactcttatgatgaatagtggaaaatgattgtagatccagcagttatttggactcgtgaatgcaaaatcttcttgtcatcgtataggtcaatctactatgacaatatcgtgctatctttaaaaacatgccttcgtgttagaacattcaccttctaggaggtgcttctagtatttcggacagtttactgatgcttttgcttagattaactaatgatttgacatgtatgattctgccctttgatctgcactataagatttctgattaagtcggcataaaaaac

SEQ ID NO: 6373 - DNA, 540 bp, Vitis vinifera
aagagcttcattcggcggctagggtttcacttcgtcaacgtctccgaagaagagagctccgaacttagcagccatggcgaccaccaaagtccagaggattatgacccagcccattaatctgatattcaggtttcttcaaagcaaagctcgaattcagatttggctatttgagcagaaagatttgagaattgaaggcagaatcataggatttgacgagtacatgaatttggttctggatgatgctgaagaagtcaatgtcaagaaaaacacaaaaaagactttaggaaggattctcctcaaaggagacaacattacgctgatgatgaatacgggaaaatgatgtttttgcagtgcatgtgatcacatggaggttgatgtttttagattctgcagtagccttttaattcaactcgggtatcgtatatgtccatagacatcttaaagatgactaaatctgtgtaccttggattcatagcaaatgatattattctcttcttgtttattttgcttgttgcatagttgatcttgctgtatgttcac

SEQ ID NO: 6374 - DNA, 635 bp, Ipomoea batatas
tagggcttttaacaaacacttcgccagctagggttttgctgctctcttcggacttagagaagaaggaatagagacgagacttcagtagcaaagcacaagcagcagccatggcgagcacgaaagttcagaggattatgacccagcccattaatctgatattcaggtttcttcagagtaaagctcgaattcagatttggctttttgagcagaaggatctgaggattgaaggccgcattattgggtttgatgagtacatgaatttggttttggatgatgctgaggaagtcaatgtaaagaagaacagcagaaagcaattgggtcgcattcttctaaaaggggacaatatcaccctgatgatgaacacggggaagtaacatcatagatggcgatttggatctcagcagcatattatcgttcgcttggaaatcctttgaacttcaactattataaccaatgtattctagggattgagtagtacatgagatggcagagttctatctttgatgtgtagcattttcattgatcttgttccagctgttgtatacttagcacacaatgatgcatggtttgaactgaagttttccattaacctctgttatatcaaaccaagtttgagaccaagaattgtttacaaa

SEQ ID NO: 6375 - DNA, 692 bp, Ipomoea nil
ggggggttagcagctgtaagtgtagaatagcagtgcgtatcagtgaccgtagggcttttaacaaacacttcgccagttagggttttgctgctctcttgcgactcagggaagaaggaatagaagcgagattttcagtagcagagaacaagcagcagccatggcgagcacgaaagttcagaggattatgacccagcccattaatctgatattcaggtttcttcagagtaaagctcgaattcagatttggctttttgagcagaaggatctgaggattgaaggccgcattattgggtttgatgagtacatgaatttggttttggatgatgctgaggaagtcaatgtaaagaagaatagcagaaagcaattgggtcgcattcttctaaaaggggacaatatcaccctgatgatgaacacggggaagtaacatcgtggatggcgatttggatctcagcagcatatttcaaatgcatattatcggtcgcttggaaatcctttgaacttccaactattataaccaatgtattctagggattgagtagtatatgagatgccagagttctatctttgatgtgtagcattttcattgatcttgttccagttgttgtatacttagccacaaaatgatgcatggtttgaactgaagtttaccatttacctctattatatcaaccaagttggagccaaaaaaaaaa

SEQ ID NO: 6376 - DNA, 601 bp, Tropaeolum majus
cggccggggggaggtccgcggagcgtagtaagtttaagagtgaaagtggagcgaagtcctctttcgaattagggttttacatttcttccatcgagtttcttcctagaaccctaaaactctgcagccatggcgagcaccaaagttcaaaggattatgacccagccgattaacttgattttcagatttctccaaagcaaagctcgcatccagatttggctttttgagcagaaagatctaaggatcgaagggcgtattattggttttgatgagtacatgaatttggttttggatgatgctgaagaagtaaacatcaaaaagaagagcagaaagaccctaggaagaattctgcttaaaggagacaacataactcttatgatgagcacgggaaagtgagggtaatatcttcagctgcgtagactggcattgtagcaccaaagttttatgtaggtcaagatattctgctctattgcaataccattcagtatatctggatatcttgtatgataaatcatgtagatgctataacttgaattcttcagatattttgtctttttcttgctttgtccttcatggctatatatgatattgcattttatctgaa

SEQ ID NO: 6377 - DNA, 530 bp, Tropaeolum majus
gggttttacatttcttccatcgagtttcttcctagaaccctaaaactctgcagccatggcgagcaccaaagttcaaaggattatgacccagcctattaacttgattttcagatttctccaaagcaaagctcgcatccagatttggctttttgagcagaaagatctaaggatcgaagggcgtattattggttttgatgagtacatgaatttggttttggatgatgctgaagaagtaaacatcaaaaagaagagcagaaagaccctaggaagaattctgcttaaaggagacaacataactcttatgatgagcacgggaaagtgagggtaatatcttcagctgtgtagactggcatggtagcaccaaagttttatgtaggtcaagatattctgctctattgcaataccattcagtatatctggatatcttgtatgataaatcatgtagatgctataacttgaattcttcagatattttgtccttttcttggtttgtccttcatcgctatatatgatattgcattttatctgaa

SEQ ID NO: 6378 - DNA, 1034 bp, Nicotiana benthamiana
agtaatatctcctaactaggtttttgcttcattccgcgagatcagagaggaagagtgactcgtgagagaaacaggagtagcagccatggctagcaccaaagtacagaggattatgacccaacccattaacctgatcttcaggtttcttcagagtaaagctcgtattcagatatggctgtttgagcagaaggatctgaggattgaaggacgtattattggctttgatgagtacatgaatttggttctagatgatgctgaggaagtcagtgtgaagaagaaaagcagaaagcagttggggcggattcttctgaaaggagataatatcacattgatgatgaacacggggaaatgatttcttgtcagctggattgtggaagaagtttgatttttatggtaaaatcaactgttgaaattcaacagttgtgtctttgtggacaaggagcacgatgttggacgcgcgaccttgattttggactttgatttactttttgctatttgtaaattcagcatggtttccttgagtctaaatgtctaatactccatggatgtcatggctctgacctcttcatatatagcgaggtcaattttcgagtaattgtacaaaagaagttgcttgatgccctagctattggctccaaagtcagaagtaccttctgatacgctgttgtggtagcaaattcctgttgctccttaaagtgacactcaagcaacttataaaagcaaatactctttgaacttcttatctgttattgatagcagggtaattataagtgtattgtgcaagtagctttataaccgtttctctattttggttagtatggtagtcagaagtatattacaagaaaagaagtatgatagcttaagagtctaggtattagtatggatgttgggaatttgctttaggatgtaggtattgtcaccgagatgtatgaacttgctaagatgtggcactgatgggtacatgactaacttccttttatttgattcctttaaaaacattttccttataagttcctcagaaaatctcctaagag

SEQ ID NO: 6379 - DNA, 574 bp, Quercus alba
tctctctctctctctctctctctctctctctctgaagaaccatcgaatttggcagccatggcgagcaccaaagttcagaggattatgacccaacccattaacctgattttcaggtttcttcagagtaaagctcgcattcagatttggctttttgagcagaaagacctgaggatcgagggccgaatcattggctttgatgagtacatgaatttggttttggatgatgctgaagaagtcaatgtcaaaaagaagagcaggaaatctttagggcggattcttctcaagggagacaacataactttgatgatgaattctggaaagtgatgatgattccagcaattgtgtaaattggcatcatgttgccttttcaatcaaatggaggtctctagcatctttgtactgcggctatgttagatacatcttggacatttaagtatgatttatgtaacttataaatgattttctatccattgagtagatacattggcactgtaactcttatacatggtttgggttggtgtaatattcaaatggcacaagaaagatttgattgaatcaaatgctgccttgcttt

SEQ ID NO: 6380 - DNA, 700 bp, Carica papaya
cttctcagatcctctccttcccttcccttccctttcctctcgccctcagctccaggtgcagctgctgttttctgtttcttcaagcaatccgggagcttcggcttgtaacgtattgtgttcaacaaagagattgcagtgcgccgaaaccacaacaaacttcagccatggcgagcaccaaagtacagaggattatgacccaacccattaacctgattttcaggtttcttcaaagtaaagctcgcattcagatttggctatttgagcagaaagatttgaggattgaaggacgaataattggttttgatgaatacatgaatctagttctggatgatgccgaagaagtgaacatcaagaaaaagagcagaaaatcacttggaagaattcttcttaaaggagacaacataaccctcatgatgaacacgggaaagtgaatgtcataccaatactggcctttatttggattggcatgactttgttagttcaagggattgtgtagatttcagtttaagtggtttctcagttatggtaggagaacatgtgttttaaatgcttgaatggatttcatgtatgatcaatcttgtagccagagaatttatagaagaattattgtccaacttaattatctcgatcaagcatcaaattttctgtagaattgtatgttagataccatctatggttaaaagaaagtggctttttaatc

SEQ ID NO: 6381 - DNA, 383 bp, Capsicum annuum
ctcatagtcggagaaagaggagtaacagcagcagccatggcgagcaccaaagtacaaaggattatgacccagcccatcaatctgatcttcagatttcttcagagtaaagctcgaattcagatatggctattcgagcagaaggatctgaggattgaaggacgtattattggttttgatgagtacatgaatttggttctagatgatgccgatgaagtcaatgtgaagaagaagagcagaaagcagttagggcggattcttttgaaaggagataatatcactttgatgatgaacacggggaaatgatatcttgtgagctggaccttggaagaaattcgaatttttctggcaactaccaactgttggaaccacttgcctttgtccac

SEQ ID NO: 6382 - DNA, 868 bp, Petunia hybrida
atcttaattttttagtacaaaattggtgctagcactaaacaatccaccaaccaaatatgaaataactatagtcccaaatttaattccggaatttaatccggaattgttaatccaattccaccgtccaaccccaccaaacaaacaccccttaacgttttaaggcacatttttcaaattcacaaattaagcaaactagggttttgctacttctcgtgagctcacagaggaagaacagttactcgtgggagaaaaaacaattgtagcagccatggcaagcactaaagtacagcggattatgacccaacctattaatctgatattcaggtttcttcaaagtaaagcacgtattcagatttggttgttcgagcaaaaggattcgaggatcgaagggcgtattattggttttgatgagtacatgaacctggttctagatgatgctgaggaagtcaacgtgaagaagaaaagcagaaagcagttggggcggattcttctgaaaggagacaatatcacactgatgatgaacacgggtaaatgatttactgtcagctggattgcggaagaagtctgatatgttttggcgaacatcatctgttgaaactatgtgtcgatatgggcaaggaactggaaattagacgcaccgccttgagtttgaacatccattttctttctgtaatatgtatatccagcatggttttcatggagtctcactctgcatggaattcatggctcttacctctttgtttagtcgacttatgagtaatcagaagtgcattctgatgagtagctgtggtagtgatttccggattatcgatttaactgcatttgctcttcgaaccttatcaaaagtaagaagttgcattttactctg

SEQ ID NO: 6383 - DNA, 719 bp, Solanum tuberosum
gatttgctagggtttagctgctttccttgagactgaaaaaggagcttagttgatcggagaaacaggaatttcagccatggctagcaccaaagttcaaaggattatgacccagcccattaacctgattttcaggtttcttcagagcaaagctcggattcaaatatggctttttgaacagaaggatctgaggattgaaggacgtatcattggttttgatgagtacatgaatttagttctggacgatgctgaggaagttaatgtgaagaagaaaaccagcaagcagttggggcggattcttctgaaaggcgataacattactctgatgatgaacacggggaaataatttcttgtgtgttggagtaggaaagttggtggcatcttgtacgtgttcaccagatgcaaattgaaaccatgtgacctcatgaatgacagaattgcatggccctgactttcatttagtgtgtgtatgttgatgtaggtaaaatatttgacatggtttcattgaaccaaatgctttgattgttgtatgaatgtctattcatgacataagatccgggctcctctccattcctgtgttagttgatggcttgactattagtgccaaaggaagtgtatatttttctaagtttttgttggtcgagtacaactccacattattatcatttgaaccatgcttgtcagctacctaccatgactgtttcgccccccaaaaaaaaaca

SEQ ID NO: 6384 - DNA, 659 bp, Rhizophora mangle
tagttggtcctattacggccggggaagtctcgcgtgatatcggcagttctctgctctagggttcaaggcctccccaactacaacagctatctttcttatctaaaaccctctggagagcagccatggcgagcaccaaagtgcagagggttatgacccaacctattaacttgatcttcagattccttcaaagcaaagctcgcattcagatttggctgtttgagcagaaggatttgaggattgaaggccgcatcattggttttgatgaatacatgaatttggttctggatgatgctgaggaagtcagtgttaagaaaaagaccagaaaggctctaggaaggattctccttaaaggagacaacataactctgatgatgaacacggggaagtgatgaaccaacgctcttgttatgcagactgcttttagattgtagtttcaattgctggaaggtttagctgtttagtctttttatttgtttcctcctcttttattatgaccctgtcgccctcttggggaggctcgggggagatgttttacaaatattattggtctatcagcttgctaatcctccatgcaatgtgacaagttttgtggataacaatggattaatagacaattaggtaacaattaacaaataagaactttaagaacttaagaaagt

SEQ ID NO: 6385 - DNA, 804 bp, Sarracenia psittacina
gtgatgctataagacatcttgatgagcaagtgctaaattagtcagctcacctcctcgccagggttttatcacattccttcaattcctgttgcttccaaggctttctgaaggagacgactctgttggcgaggtcgatagcagtcatggcgactactaaagtccagaggattatgacccaaccgattaatctcattttcaggttccttcaaagtaaagctcgtatccagatatggcttttcgagcagaaggacctcaggattgaaggacgtattattgggttcgatgagtatatgaatttggttctggaggatgctgaggaagtcaatgtaaagaagaagagcagaaaaactttggggaggatccttcttaaaggggacaacattacgctgatgatgaacacgggaaaatgaggactagcttttactagtgcatggaatgacagcttatttttgtcatgttggttatgaagcagattatatgtatttaggtttcagtgaacaattttctgactatactctgaaactgggtttctcagcttttcattttgtatctgttgtctactctgtgtttcttgtcatgattttatgtgaattttattaggcattttgcttgttctttgtttcttgcccgtcactagcagcgggatagggagaagatagtctatctacctgcctagctttggtagatttcatagtgatgtgtattcaagttgtggaaacagtcctgaatcggggttaaggttgcacatgtcttgcccttttcaagtcatttttctctagcgagagccttatgcacagcgttatc

SEQ ID NO: 6386 - DNA, 576 bp, Sarracenia psittacina
tgtaagagttcgtgatgctataagacatcttgatgagcaagtgctaaattagacagctcacctcctcgctagggttttatcacattccttcaattcctgttgcttccaaggctttctgaaggagacgactctgttggcgaggtcgatagcagtcatggcgacaactaaagtccagaggattatgacccaacctattaatctcattttcaggttccttcaaagtaaagctcgtatccagatatggcttttcgagcagaaggacctcaggattgaaggacgtattattgggttcgatgagtatatgaatttggttctggaggatgctgaggaagtcaatgtaaagaagaagagcagaaaaactttggggaggatccttcttaaaggggacaacattacgctgatgatgaacacgggaaaatgaggactagcttttactagtgcatggaatgacagcttatttttgttgtgttggttatgaagcagattatatgtatttaggtttcagtgaacaattttctgactatactctgaaactgggtttctcagtcttttcattttgatctgttgtctactcta

SEQ ID NO: 6387 - DNA, 953 bp, Sesamum indicum
gacgagataaagttagtccagaaacccgattttccatctcaaaggtagaataaaaagactgagggagtctcaacctctcccctgctagggtttttgcagcaaaagaagtgggaaaaagagcgcaagaaattctctgcagcagagccccaaaagcaagcggccatggcgagcaccaaagtccagcgtattatgacccaacccattaacctgatctttaggtttctacagagcaaagctcgcattcagatatggctttttgagcagaaggatctgaggattgaaggccggatcattggctttgacgagtacatgaatttggttttggatgacgcggaagaggtcaacgtaaagaagaatagcaggaagcaacttgggaggattttgttgaaaggggataatatcactttgatgatgaatactgggaagtaattctggagacaaggcgaaaagtgtaatcactaaaccgtaaagtggctggctgttggtggttctatgggactgttgtcccaactttgtacggattcaactcgtttaggatctattttctcttagcccatgtcttctatctcacaactattgtgtatcaccttatcctgccttttgaatatcattacaagaatttgtagtacttgaaactggacatcaggtaaatgtttggcatggccgttgcagacagttgaatatgttgagggagatgcattcttactttggttacaagagagagctgtcattggttacctcagagatatgcatgattttgttaagcttagaggaaagtgtgagatttttcagggatgcggtcggttttagtttgaactttgaagttactttcgtttgtaatgtagttcttgatgatgtttgcaggctaaagtaactcggtagtagaaaattattaggtcatacagccataagctcttaaagtttatgatatgatattattaaagctgcctaac

SEQ ID NO: 6388 - DNA, 834 bp, Solanum lycopersicum
ggcccattacccatgaagtccagtgaaaacaaaataaaagcccagatgcaaaagcgagacgttttccgcgagcccaaacccgaattcatatttgcatatgctacggcattaggcgccatttcgattcacggcttagggtatttgctagggtttagctgctttccttggagactgaagaaggagcttagttgatcggagtaacaggaatttcagccatggctagcaccaaagttcaaaggattatgacccagcccattaacctgattttcaggtttcttcagagcaaagctcggattcaaatatggctttttgaacagaaggatctgaggattgaaggacgtatcattggttttgatgagtacatgaatttagttctggatgatgctgaggaagttaatgtgaagaagaaaaccagcaagcagttggggcggattcttctgaaaggcgataatattactctgatgatgaacacggggaaataatttcttgtctgttggagtacgaaagttggtggcatcttctacgtgttcaccagacgcaaattgaaaccatgtggcctcatgaatgacagaattgcatggccctgactttcatttactgtgtatgttgatgtaggtaaaatatttgacatggtttcattgaaccaaatgctttgattgttgtatgaacgtctattcatgacactaagatccgagctcctctccgttccttgtcagttgatggcttgattatttgcgccaaaagaagtgtatattttttttagtttttgttggtgaagtataactattagaaccatgcttgtcagctacctaccgtgactgttagcgcccccca

SEQ ID NO: 6389 - DNA, 589 bp, Juglans hindsii x Juglans regia
gggggtcgagagactcgatgctgtcagggtagaggggaggggaaaaaaaaaaagctctctgctttagggttttgcacgtcttcgactccatttctctgtgacccgagcaaccatcgaattcagcagtcatggcaagcaccaaagttcagaggatcatgacccaacccattaacctgattttcaggtttcttcagagtaaagctcgtattcaaatatggctttttgagcagcgggacctgaggattgagggcagaattattggttttgatgagtacatgaatttggttctggatgatgctgaagaagtcaatgtcaagaagaagagtagaaaatctctagggcggattcttcttaagggagacaacataactctgatgatgaacacgggaaaatgatgattccagcatccttttcaattacatggaggttagctgctttcagtttactgctattttagatccctgttggagatcatgtttgattatgattaatcagcttagtaatgaactttcctgtcggagatcatgtatgatcaatccacttactaatgattctagatctttaggctagactcatgacactatttgtt

SEQ ID NO: 6390 - DNA, 400 bp, Arachis hypogaea
gagcttttggggtttggggttttagctgcaaacaacaacgatcttcctgaatccttttcgccatggctagcaccaaagttcagagggttatgacccaacctattaacttgattttcaggtttcttcaaagtaaagctcgcattcagatttggctcttcgagcaaaaggatttgaggatcgaaggccgaatcatcggttttgatgaatacatgaatttggttcttgatgatgctgaagagtgaacgtaaagaagaatatcagaaagacattagggaggatccttcttaaaggagacaacataacgttaatgatgaacacgggcaaatgaataatgaacattagaacgtagaagggaggacagaactagtagaaccatacattctatccagacaaaggagag

SEQ ID NO: 6391 - DNA, 778 bp, Vaccinium corymbosum
ggtcgagtgaacgaaccgccctgcacaagagagaagatttcccaaatctcaccagtcgcggcgtctagggtttttgctttcaaggttttctgaaggagacgactctgtggccgacgatagcagcagccatggcgaccaccaaagtccagaggatcatgacacaacccatcaatctcatcttcaggttccttcaaagtaaagctcggatccagatatggctgtttgagcagaaggacttgaggattgaagggcgtattattgggtttgacgagtacatgaatttggttctggaggatgctgaggaagtcaatgtaaagaagaaaagcagaaaggctttggggaggatccttcttaaaaggggacaacatcacgctaatgatgaacacggggaaatgaagatggattttcgatggtgcatggagtagcagcttgacgaagcagattattaagacagtcaacttttcttctaatgattgtgtaccctaagactaaaatgtagagcttatatggatagcttttgaggcattgttgttcatcttcctgcattggtgtttttgagtagaggttgcgacaattcttttcctttatgctggattggaggttatttcgtgacggtactgcaacttagctattgggaaatatgctataattagtccttgtgtatccatgttgtctgcttttttgtgacaccttgtagctgaattttacggttattaatttcttagtaattttaaagttaacaagttaaaaagtaaaaccaacttcgtttggttcaacc

SEQ ID NO: 6392 - DNA, 296 bp, Nicotiana benthamiana
agtagcagccatggctagcaccaaagtacagaggattatgacccaacctattaacctgatcttcaggtttctttagagtaaagctcgtattcagatatggctatttgagcaaaaggatctgaggattgaaggacgtattattggctttgatgagtatatgaacttggttctagatgatgttgaggaagtgaatgtgaagaaaaaaagcagaaagcagttggggcggattcttttgaaaggagataatatcacattgatgatgaacacggggaaataatttcttgtcagctggatgg

SEQ ID NO: 6393 - DNA, 605 bp, Rosmarinus officinalis
attgtgactagggtttagctgcttctctttgtcgaaggctcgaagcattgttaaaagctagacagcaatcaagggagcagtagcagccatggctagcaccaaagttcagaggattatgacccaacccattaatctcatcttcaggttccttcaaagcaaagctcggatacagatttggctttttgagcagaaggacttgaggattgaaggacgcatcattggttttgatgagtacatgaatttggttctggatgatgctgaggaagtccacatgaagaagaagagcagaaagcaactaggcaggatacttctcaagggggacaacattaccttgatgatgaatactgggaaataatgtcccaatctttctgatcgcagatcgaaagtagattttagcatcaacaaatggagttatatttagaattttcaagaacatcctccttagtgatgatgtaacctgatcagtagatttcctatttaatgcacagctctgcgtgagaaagtcttttatgagtgttgaagcccatattgtaattttagaaagtggtatgaactgaatgcttcgccagcttttatccatggtaatatcccttccttttccggtc

SEQ ID NO: 6394 - DNA, 1002 bp, Spinacia oleracea
gtcattctctttaccctcttttatttttgagtttaccccaaagtgctctaaactgattcctcactccccctaggtttttccatcctctttccccacttcatttccccaccctccttctctctcctctagcccagaactttaacaacagcagcaagggaagatgccacactcacgttgccggcgactactgctgtgaaaatccgtccattaactccgatcacttgcttatctccggccgccgtcgagcctataaattcactatactacgaggtttctctaatacggagggattttagcatagcagaacaatttcaaagcagaagtacagcagacctttgaagcagcaacaatggcgagcaccaaagttcagaggattatgacccagcctatcaacctgatattcaggtttctccaaagtaaagcccgtatccagatttggttgtttgagcagaaggatgccaggattgaaggccgtattattgggtttgacgagtacatgaatttagttttagatgatgctgaagaggtgaacgtcaaaaagaagaccagaaaatcacttgggaggattcttctgaaaggagacaatattactctgatgatgaatacgggaaaatgaggcccagcttatatgcatttgttcagcagtgttgagattgttgggtctggatgccattgcgaactgttcacctgccgtaatctgtgtaaacttgctctgattagtgaatgtagtagtatctacttgaagcaattcccctcgtatagtataaatgtagtttgcggaatatgactactccgtagttgatttgatggatgtctttgttcgtatttttgtaatatttcttattgttgagatcgatcctggctgtgcttttcgtttttgggtattttactgtgttttatttacagtagagggtatttctagtgaactttttatatttatgatctctaattagttccttgaaatcttatgaaaattaaaaatgatattcaactaatttaatt

SEQ ID NO: 6395 - DNA, 673 bp, Acacia harpophylla
ggcaaactgcaaagttagccatctcgctggtttagggttttgcttggtttgagttgagttgagtggcgccggagggtttcaatttcgcccccaaaaaactctctttcaccttctcagcgcggaaaccagcagcaaccgcagccatggcgagcactaaggtccagaggattatgacccaacccatcaatctgatcttcaggtttcttcaaagtaaagcgcgcattcagatttggctttttgagcagaaagatttgcgaattgaaggccgtataattgggtttgatgagtacatgaacttggtgctggatgatgctgaagaagtaaacattaagaaaaagagcagaaaatccctgggtaggattttattgaaaggggacaacataactctgatgatgaacacttttaaatgatgggggagcagcaccctttagagaatcacattttgggggggtcttttgtgggaggtcgaccaaagagatgccttctaagacatatatagcccttttatatctttgatgatatttcagcatctcagtagaaagaattatgtgttgatcgaacttctgctttctgtaaaccattgtatgtttttctagttcatattgtcatctaatttcccgtggattcctcctacactgcttgttttccccttttgttttcttgttcttcacac

SEQ ID NO: 6396 - DNA, 454 bp, Antirrhinum majus
gggtttctacacagagcagaaatctttgcagttcagtgacaatcagcagcaatggcgagcactaaagttcagcggattatgacccaacccattaatctgatcttcagatttcttcagagtaaagctaggattcagatttggctttttgagcagaaggatctgaggatcgaaggccgtataattggttttgacgagtatatgaatttggtcctggatgacgctgaagaagtcagtgtgaagaagaacagcagaaagcaacttggaaggatactcttaaaaggggacaacatcacattgatgatgaatacgggcaaatgatgaccaactgttcatggcattcaaaacttagctgcgttttgtgtagtcatctgtataatgatttgaacctacaggctatgatctcatattttaatgtcgactgtctatgttgttagcagaccttgaagtgattgtc

SEQ ID NO: 6397 - DNA, 663 bp, Beta vulgaris
acggccgaagagcgtagtagaaactagaaagtaagaaactatactccgctaagggtttcttcgtcgtctctctctattctctactctttagtctctatttcggtggtgtagcactgtatctagggttttagcagcagacaaattttcaaagcagcaacaatggcgagcaccaaagtccagcgtattatgacacagcctattaacctgatcttcaggtttcttcaaagcaaagctcgtattcagatttggctgtttgagcagaaggatctgaggattgaaggccgtataattggctttgatgagtacatgaatttggttttagacgatgctgaagaggtgaacgttaaaaagaagaccaataaaccactagggaggattcttttgaaaggagacaatattactctgatgatgaactctggaaaatgagtcccagtgatgcgcacttgctctgcagtaatggaagtgttggtctgaaagccgctgcaaactgctcactccccgtagaagttttgtttgtgtaaacttattgattaatggtagtatctactcctggcatttgcctcctctccgtatagttgaaatgtactatgatcattgatgattgtgaattagtggatcgatggatgtcttttctcatatctagtagtatattcgggtttgatt

SEQ ID NO: 6398 - DNA, 507 bp, Bruguiera gymnorhiza
ggctgttattggttggcttttaagggagggaaagggaaagggaaaggggaagggcgaggtgaagaaggagggatagctgttggggggtaaactagggtttaaggtgccatttgtcgaacaaggttgttgtggggtgcattttttttctgaagaagcccttcagccatggcgagcaccaaagtccagcggattatgacccaacccattaacttgatcttcaggttccttcaaagcaaagctcgtatccagatttggctttttgagcagaaggatttgagaattgaaggtcgtataattggttttgatgagtacatgaatttggttctggatgatgctgaggaagtcaatgtcaagaaaaggagcagaaagtctttaggaaggattcttctaaaaggagacaacattactctgatgatgaacatgggaaagtaacggtcaatcctagtgacatccttgtgatactgatttggattgcattttccgtggcgtggggattgagctagctga

SEQ ID NO: 6399 - DNA, 612 bp, Bupleurum chinense
aggtttgaaattgagaaacatcatctcttccaagtcttctgcagtcatggcgagcactaaagtacagaggattatgacccaaccaatcaatttgatcttcaggtttctacaaagcaaagcgcgcattcagatatggcttttcgagcagaaagatttaaggattgaaggcagaattattggatttgatgaatacatgaatttagtcctggatgatgctgaagaagtcagtataaagaagaagagcagaaaatcacttggaagaattttgcttaaaggagacaacattacattgatgatgaacacgggcaaatgatgtctatttggaaaacttgattgtgcaatgaggttttttcagctctacatatattgctgtggtctcgctgtcatattatttgtttagctcactcagattttctcgtatgcgaggtagaaacttaatttcttactttgttatggtgttgtaattccaatggtgcgtatttttttctttcctccatttccattacattatgtagttgatttctaatgtaatgtattcaataaccgaatggtaatcattaatcaagtatgtatggtaatcattaatcaagtatgtgatgttatgtcttaaaa

SEQ ID NO: 6400 - DNA, 598 bp, Theobroma cacao
aggcgcagtcagcagagaagaagaccgaagaagaagaagaagaagaggaacagagaagaagcgagcagaacacaccatggccagcaccaaagtccagcggatcatgacccagcccatcaatctgattttcagatttctccaaagcaaagctcgcattcagatttggcttttcgaacagaaggatttgagaatcgaaggacgtatcattgggtttgatgagtatatgaatttggttttggatgatgctgaagaagtcaacattaagaagaaaagtagaaagtcactagggaggatcctgctgaaaggggacaacataactttgatgatgaatgcgggaaagtaaggaacaagttcgaggccacagtgcaatttggttctccttgcagctattactataatgaatatgctgctctattgtagtagtttaaatggtgtatcctctgttgcagtagattttatgacagtggaaatgcattttatgcataaccaaactgcaaaccttttgtattgtatcatagcaagaacagcttgatgccttacaattatttagatctgttgagatttcagcatctgcatctatgtccaacttgatacctac

SEQ ID NO: 6401 - DNA, 506 bp, Theobroma cacao
gaggaagggtttaacagctatctactcaaaacctctttcacgttctgcgaagagggaaacaagcgctcaagttttccacagccatggcgagcaccaaagtccaaagaatcatgacccaacccatcaacctgatcttcaggtttctccaaagtaaagctcgcattcagatttggctttttgagcagaaagatttgaggattgaaggccgaatcattggatttgatgagtacatgaatttggttctcgatgatgctgaagaagtcaacatcaagaaaaagagcagaaagtcattaggaaggatacttcttaaaggagacaatataactcttatgatgaatagtggaaagtgatgatcatctcagtagttatgtggactagcattacaagttttctgaaattcacgtagcatgtttcctgttgcaaataattgccgtgacatcaacattattagtgggagagccttgaagttaaggatttagatgactggtgcaatgaagtggttggtt
